United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 73

SEQ ID NO: 2632725 - RNA, 22 nt, Escherichia coli CFT073
cagcgaaauacaaguccccgcu

SEQ ID NO: 2632726 - RNA, 15 nt, Escherichia coli CFT073
cagcgaacaccagca

SEQ ID NO: 2632727 - RNA, 16 nt, Escherichia coli CFT073
cagcgaacaccagcag

SEQ ID NO: 2632728 - RNA, 23 nt, Escherichia coli CFT073
cagcgaaccgccaaucgccacgc

SEQ ID NO: 2632729 - RNA, 20 nt, Escherichia coli CFT073
cagcgaacggucgccgcgca

SEQ ID NO: 2632730 - RNA, 24 nt, Escherichia coli CFT073
cagcgaagcauucagacacgccgc

SEQ ID NO: 2632731 - RNA, 22 nt, Escherichia coli CFT073
cagcgaagccagcucccacagu

SEQ ID NO: 2632732 - RNA, 21 nt, Escherichia coli CFT073
cagcgaagcccacaccgccca

SEQ ID NO: 2632733 - RNA, 15 nt, Escherichia coli CFT073
cagcgaagcgcauca

SEQ ID NO: 2632734 - RNA, 17 nt, Escherichia coli CFT073
cagcgaaguacgcggca

SEQ ID NO: 2632735 - RNA, 21 nt, Escherichia coli CFT073
cagcgaauaauucagcccaaa

SEQ ID NO: 2632736 - RNA, 23 nt, Escherichia coli CFT073
cagcgaaucagcccagcccugaa

SEQ ID NO: 2632737 - RNA, 15 nt, Escherichia coli CFT073
cagcgaauuccaguu

SEQ ID NO: 2632738 - RNA, 19 nt, Escherichia coli CFT073
cagcgacaagcucucuuca

SEQ ID NO: 2632739 - RNA, 17 nt, Escherichia coli CFT073
cagcgacaccagccauc

SEQ ID NO: 2632740 - RNA, 18 nt, Escherichia coli CFT073
cagcgacaccuuccgcgu

SEQ ID NO: 2632741 - RNA, 17 nt, Escherichia coli CFT073
cagcgacagauucagcg

SEQ ID NO: 2632742 - RNA, 15 nt, Escherichia coli CFT073
cagcgaccacaaaua

SEQ ID NO: 2632743 - RNA, 14 nt, Escherichia coli CFT073
cagcgaccgcgcca

SEQ ID NO: 2632744 - RNA, 19 nt, Escherichia coli CFT073
cagcgacgacuggcgcggc

SEQ ID NO: 2632745 - RNA, 22 nt, Escherichia coli CFT073
cagcgacgacuggcgcggcagg

SEQ ID NO: 2632746 - RNA, 22 nt, Escherichia coli CFT073
cagcgacgaugucgucgguauc

SEQ ID NO: 2632747 - RNA, 13 nt, Escherichia coli CFT073
cagcgagaagucg

SEQ ID NO: 2632748 - RNA, 17 nt, Escherichia coli CFT073
cagcgagcuggcgcuga

SEQ ID NO: 2632749 - RNA, 19 nt, Escherichia coli CFT073
cagcgaguuuuucaguccg

SEQ ID NO: 2632750 - RNA, 21 nt, Escherichia coli CFT073
cagcgauaaugaaugaugcgg

SEQ ID NO: 2632751 - RNA, 14 nt, Escherichia coli CFT073
cagcgauaccggcu

SEQ ID NO: 2632752 - RNA, 13 nt, Escherichia coli CFT073
cagcgaucgcuuu

SEQ ID NO: 2632753 - RNA, 15 nt, Escherichia coli CFT073
cagcgaugcugacga

SEQ ID NO: 2632754 - RNA, 18 nt, Escherichia coli CFT073
cagcgauguuagcgucaa

SEQ ID NO: 2632755 - RNA, 16 nt, Escherichia coli CFT073
cagcgauuaacugcgc

SEQ ID NO: 2632756 - RNA, 12 nt, Escherichia coli CFT073
cagcgcaaagau

SEQ ID NO: 2632757 - RNA, 17 nt, Escherichia coli CFT073
cagcgcaaagauaauga

SEQ ID NO: 2632758 - RNA, 19 nt, Escherichia coli CFT073
cagcgcaaagcccgccgcc

SEQ ID NO: 2632759 - RNA, 21 nt, Escherichia coli CFT073
cagcgcaaagcccgccgccac

SEQ ID NO: 2632760 - RNA, 23 nt, Escherichia coli CFT073
cagcgcaaagcccgccgccacaa

SEQ ID NO: 2632761 - RNA, 22 nt, Escherichia coli CFT073
cagcgcaauaccgauaucgcca

SEQ ID NO: 2632762 - RNA, 15 nt, Escherichia coli CFT073
cagcgcaauagccug

SEQ ID NO: 2632763 - RNA, 20 nt, Escherichia coli CFT073
cagcgcaauguugcuggcga

SEQ ID NO: 2632764 - RNA, 20 nt, Escherichia coli CFT073
cagcgcaccaacggucagcg

SEQ ID NO: 2632765 - RNA, 17 nt, Escherichia coli CFT073
cagcgcaccagaaacaa

SEQ ID NO: 2632766 - RNA, 23 nt, Escherichia coli CFT073
cagcgcaccgagugguucaucaa

SEQ ID NO: 2632767 - RNA, 23 nt, Escherichia coli CFT073
cagcgcaccugugguagcggcuc

SEQ ID NO: 2632768 - RNA, 19 nt, Escherichia coli CFT073
cagcgcacggcgaaaauua

SEQ ID NO: 2632769 - RNA, 18 nt, Escherichia coli CFT073
cagcgcacuacgccgcaa

SEQ ID NO: 2632770 - RNA, 19 nt, Escherichia coli CFT073
cagcgcacuacgccgcaaa

SEQ ID NO: 2632771 - RNA, 13 nt, Escherichia coli CFT073
cagcgcacuuuca

SEQ ID NO: 2632772 - RNA, 12 nt, Escherichia coli CFT073
cagcgcagcacc

SEQ ID NO: 2632773 - RNA, 15 nt, Escherichia coli CFT073
cagcgcagcuuccgg

SEQ ID NO: 2632774 - RNA, 12 nt, Escherichia coli CFT073
cagcgcaggaaa

SEQ ID NO: 2632775 - RNA, 19 nt, Escherichia coli CFT073
cagcgcauaagccacaaua

SEQ ID NO: 2632776 - RNA, 13 nt, Escherichia coli CFT073
cagcgcaucauga

SEQ ID NO: 2632777 - RNA, 15 nt, Escherichia coli CFT073
cagcgcauccuggcu

SEQ ID NO: 2632778 - RNA, 22 nt, Escherichia coli CFT073
cagcgcaucguagauuucaucc

SEQ ID NO: 2632779 - RNA, 20 nt, Escherichia coli CFT073
cagcgcaugacccagugcau

SEQ ID NO: 2632780 - RNA, 15 nt, Escherichia coli CFT073
cagcgcauggcggca

SEQ ID NO: 2632781 - RNA, 17 nt, Escherichia coli CFT073
cagcgcauggcggcagc

SEQ ID NO: 2632782 - RNA, 19 nt, Escherichia coli CFT073
cagcgcauggcggcagcgu

SEQ ID NO: 2632783 - RNA, 22 nt, Escherichia coli CFT073
cagcgccaacggugaaaaacca

SEQ ID NO: 2632784 - RNA, 15 nt, Escherichia coli CFT073
cagcgccaccacaaa

SEQ ID NO: 2632785 - RNA, 16 nt, Escherichia coli CFT073
cagcgccaccacaaaa

SEQ ID NO: 2632786 - RNA, 18 nt, Escherichia coli CFT073
cagcgccaccaccaguac

SEQ ID NO: 2632787 - RNA, 18 nt, Escherichia coli CFT073
cagcgccaccacccagaa

SEQ ID NO: 2632788 - RNA, 11 nt, Escherichia coli CFT073
cagcgccagaa

SEQ ID NO: 2632789 - RNA, 14 nt, Escherichia coli CFT073
cagcgccagacacu

SEQ ID NO: 2632790 - RNA, 15 nt, Escherichia coli CFT073
cagcgccagacacug

SEQ ID NO: 2632791 - RNA, 14 nt, Escherichia coli CFT073
cagcgucaguucuc

SEQ ID NO: 2632792 - RNA, 21 nt, Escherichia coli CFT073
cagcgucaucaauccugcagc

SEQ ID NO: 2632793 - RNA, 22 nt, Escherichia coli CFT073
cagcgucaucggaucauuaguc

SEQ ID NO: 2632794 - RNA, 22 nt, Escherichia coli CFT073
cagcgucauuuccagacgccau

SEQ ID NO: 2632795 - RNA, 13 nt, Escherichia coli CFT073
cagcguccagcgc

SEQ ID NO: 2632796 - RNA, 16 nt, Escherichia coli CFT073
cagcgucgccagcagc

SEQ ID NO: 2632797 - RNA, 22 nt, Escherichia coli CFT073
cagcgucgcggucagacgcgau

SEQ ID NO: 2632798 - RNA, 17 nt, Escherichia coli CFT073
cagcgucgggccacgcu

SEQ ID NO: 2632799 - RNA, 12 nt, Escherichia coli CFT073
cagcgucgggua

SEQ ID NO: 2632800 - RNA, 23 nt, Escherichia coli CFT073
cagcgucggugucaucgacauca

SEQ ID NO: 2632801 - RNA, 17 nt, Escherichia coli CFT073
cagcgucgguuccugau

SEQ ID NO: 2632802 - RNA, 17 nt, Escherichia coli CFT073
cagcgucguauccagcg

SEQ ID NO: 2632803 - RNA, 20 nt, Escherichia coli CFT073
cagcgucucacuaucgccga

SEQ ID NO: 2632804 - RNA, 14 nt, Escherichia coli CFT073
cagcgugagcggca

SEQ ID NO: 2632805 - RNA, 23 nt, Escherichia coli CFT073
cagcgugcauagcagcacaccac

SEQ ID NO: 2632806 - RNA, 15 nt, Escherichia coli CFT073
cagcgugccaggcgc

SEQ ID NO: 2632807 - RNA, 18 nt, Escherichia coli CFT073
cagcgugccaggcgcgcu

SEQ ID NO: 2632808 - RNA, 21 nt, Escherichia coli CFT073
cagcgugccgcgaucccagac

SEQ ID NO: 2632809 - RNA, 15 nt, Escherichia coli CFT073
cagcgugcguugacc

SEQ ID NO: 2632810 - RNA, 18 nt, Escherichia coli CFT073
cagcgugcucucaaauau

SEQ ID NO: 2632811 - RNA, 23 nt, Escherichia coli CFT073
cagcguguuaggaucacgccccu

SEQ ID NO: 2632812 - RNA, 16 nt, Escherichia coli CFT073
cagcguguugaggaag

SEQ ID NO: 2632813 - RNA, 22 nt, Escherichia coli CFT073
cagcguguugaggaagcgcaac

SEQ ID NO: 2632814 - RNA, 16 nt, Escherichia coli CFT073
cagcguuaauuuccuc

SEQ ID NO: 2632815 - RNA, 14 nt, Escherichia coli CFT073
cagcguucccagcc

SEQ ID NO: 2632816 - RNA, 14 nt, Escherichia coli CFT073
cagcguuccccaga

SEQ ID NO: 2632817 - RNA, 15 nt, Escherichia coli CFT073
cagcguucccuuccc

SEQ ID NO: 2632818 - RNA, 22 nt, Escherichia coli CFT073
cagcguugaggaacucaaacca

SEQ ID NO: 2632819 - RNA, 20 nt, Escherichia coli CFT073
cagcguugagggauaggugg

SEQ ID NO: 2632820 - RNA, 15 nt, Escherichia coli CFT073
cagcguugaugcuca

SEQ ID NO: 2632821 - RNA, 22 nt, Escherichia coli CFT073
cagcguugcccccugaagcagu

SEQ ID NO: 2632822 - RNA, 23 nt, Escherichia coli CFT073
cagcguuuaucaauauccagucg

SEQ ID NO: 2632823 - RNA, 15 nt, Escherichia coli CFT073
cagcguuuccagcac

SEQ ID NO: 2632824 - RNA, 17 nt, Escherichia coli CFT073
cagcguuuccagcacca

SEQ ID NO: 2632825 - RNA, 20 nt, Escherichia coli CFT073
cagcguuuccagcaccaguu

SEQ ID NO: 2632826 - RNA, 21 nt, Escherichia coli CFT073
cagcguuuccagcaccaguuc

SEQ ID NO: 2632827 - RNA, 16 nt, Escherichia coli CFT073
cagcguuugcugaaaa

SEQ ID NO: 2632828 - RNA, 14 nt, Escherichia coli CFT073
cagcguuugcugcu

SEQ ID NO: 2632829 - RNA, 18 nt, Escherichia coli CFT073
cagcguuuucuucaauga

SEQ ID NO: 2632830 - RNA, 20 nt, Escherichia coli CFT073
cagcuaauugauuguacauu

SEQ ID NO: 2632831 - RNA, 17 nt, Escherichia coli CFT073
cagcuacaccgaucacc

SEQ ID NO: 2632832 - RNA, 22 nt, Escherichia coli CFT073
cagcuaucguuagccauauggc

SEQ ID NO: 2632833 - RNA, 17 nt, Escherichia coli CFT073
cagcucaaucgccucgc

SEQ ID NO: 2632834 - RNA, 12 nt, Escherichia coli CFT073
cagcucaccuca

SEQ ID NO: 2632835 - RNA, 13 nt, Escherichia coli CFT073
cagcucacgcagc

SEQ ID NO: 2632836 - RNA, 15 nt, Escherichia coli CFT073
cagcucacgcgccag

SEQ ID NO: 2632837 - RNA, 21 nt, Escherichia coli CFT073
cagcucacgcgccagcuucac

SEQ ID NO: 2632838 - RNA, 14 nt, Escherichia coli CFT073
cagcucacggccag

SEQ ID NO: 2632839 - RNA, 16 nt, Escherichia coli CFT073
cagcucacugauaaua

SEQ ID NO: 2632840 - RNA, 18 nt, Escherichia coli CFT073
cagcucacuucgauccag

SEQ ID NO: 2632841 - RNA, 19 nt, Escherichia coli CFT073
cagcucauaggccugcuga

SEQ ID NO: 2632842 - RNA, 23 nt, Escherichia coli CFT073
cagcucauauuccugcauugcuu

SEQ ID NO: 2632843 - RNA, 15 nt, Escherichia coli CFT073
cagcucaucaacacg

SEQ ID NO: 2632844 - RNA, 17 nt, Escherichia coli CFT073
cagcucaucagcauuug

SEQ ID NO: 2632845 - RNA, 12 nt, Escherichia coli CFT073
cagcucauccag

SEQ ID NO: 2632846 - RNA, 14 nt, Escherichia coli CFT073
cagcucauccagcg

SEQ ID NO: 2632847 - RNA, 15 nt, Escherichia coli CFT073
cagcucauccagcgu

SEQ ID NO: 2632848 - RNA, 12 nt, Escherichia coli CFT073
cagcuccagcgc

SEQ ID NO: 2632849 - RNA, 18 nt, Escherichia coli CFT073
cagcuccccacaccacca

SEQ ID NO: 2632850 - RNA, 17 nt, Escherichia coli CFT073
cagcuccggcacuuccc

SEQ ID NO: 2632851 - RNA, 20 nt, Escherichia coli CFT073
cagcucgcgauacgcuucaa

SEQ ID NO: 2632852 - RNA, 17 nt, Escherichia coli CFT073
cagcucgcgccaggugu

SEQ ID NO: 2632853 - RNA, 20 nt, Escherichia coli CFT073
cagcucggcgaucuguuccg

SEQ ID NO: 2632854 - RNA, 23 nt, Escherichia coli CFT073
cagcucgugcagaacauccagcu

SEQ ID NO: 2632855 - RNA, 22 nt, Escherichia coli CFT073
cagcucucagacaauuacucgc

SEQ ID NO: 2632856 - RNA, 18 nt, Escherichia coli CFT073
cagcucucgcguuacuac

SEQ ID NO: 2632857 - RNA, 19 nt, Escherichia coli CFT073
cagcucuuccgacuugcuu

SEQ ID NO: 2632858 - RNA, 16 nt, Escherichia coli CFT073
cagcucuuuauccagc

SEQ ID NO: 2632859 - RNA, 19 nt, Escherichia coli CFT073
cagcucuuuauccagcagc

SEQ ID NO: 2632860 - RNA, 13 nt, Escherichia coli CFT073
cagcucuuucucg

SEQ ID NO: 2632861 - RNA, 20 nt, Escherichia coli CFT073
cagcugaaaucaccgccacc

SEQ ID NO: 2632862 - RNA, 23 nt, Escherichia coli CFT073
cagcugaaaucaccgccaccagc

SEQ ID NO: 2632863 - RNA, 16 nt, Escherichia coli CFT073
cagcugacugacuuca

SEQ ID NO: 2632864 - RNA, 21 nt, Escherichia coli CFT073
cagcugacugacuucaacagg

SEQ ID NO: 2632865 - RNA, 17 nt, Escherichia coli CFT073
cagcugaugcgaacgcc

SEQ ID NO: 2632866 - RNA, 21 nt, Escherichia coli CFT073
cagcugauguagucauacugc

SEQ ID NO: 2632867 - RNA, 23 nt, Escherichia coli CFT073
cagcugccagaguuccugcauau

SEQ ID NO: 2632868 - RNA, 16 nt, Escherichia coli CFT073
cagcugccaggcaccg

SEQ ID NO: 2632869 - RNA, 18 nt, Escherichia coli CFT073
cagcugccgaaccacuga

SEQ ID NO: 2632870 - RNA, 20 nt, Escherichia coli CFT073
cagcugccgaaccacugaug

SEQ ID NO: 2632871 - RNA, 14 nt, Escherichia coli CFT073
cagcugccugccag

SEQ ID NO: 2632872 - RNA, 16 nt, Escherichia coli CFT073
cagcugccugccagua

SEQ ID NO: 2632873 - RNA, 16 nt, Escherichia coli CFT073
cagcugccugcggcga

SEQ ID NO: 2632874 - RNA, 20 nt, Escherichia coli CFT073
cagcugcucauagcggcugc

SEQ ID NO: 2632875 - RNA, 13 nt, Escherichia coli CFT073
cagcugcucccag

SEQ ID NO: 2632876 - RNA, 14 nt, Escherichia coli CFT073
cagcugcucccagc

SEQ ID NO: 2632877 - RNA, 15 nt, Escherichia coli CFT073
cagcugcucccagcg

SEQ ID NO: 2632878 - RNA, 17 nt, Escherichia coli CFT073
cagcugcucccagcgca

SEQ ID NO: 2632879 - RNA, 18 nt, Escherichia coli CFT073
cagcugcucccagcgcau

SEQ ID NO: 2632880 - RNA, 14 nt, Escherichia coli CFT073
cagcuggaguagau

SEQ ID NO: 2632881 - RNA, 16 nt, Escherichia coli CFT073
cagcuggauaucaaug

SEQ ID NO: 2632882 - RNA, 17 nt, Escherichia coli CFT073
cagcuggcgccaggcuu

SEQ ID NO: 2632883 - RNA, 18 nt, Escherichia coli CFT073
cagcuggcgccaggcuuc

SEQ ID NO: 2632884 - RNA, 19 nt, Escherichia coli CFT073
cagcugggcgauuuucuac

SEQ ID NO: 2632885 - RNA, 21 nt, Escherichia coli CFT073
cagcugggcgauuuucuacuu

SEQ ID NO: 2632886 - RNA, 23 nt, Escherichia coli CFT073
cagcugguaauggcgaucgggaa

SEQ ID NO: 2632887 - RNA, 19 nt, Escherichia coli CFT073
cagcuguccgauuuguucu

SEQ ID NO: 2632888 - RNA, 17 nt, Escherichia coli CFT073
cagcugucguacccagu

SEQ ID NO: 2632889 - RNA, 18 nt, Escherichia coli CFT073
cagcugucguacccaguc

SEQ ID NO: 2632890 - RNA, 17 nt, Escherichia coli CFT073
cagcuuaaucaccagcg

SEQ ID NO: 2632891 - RNA, 24 nt, Escherichia coli CFT073
cagcuuacgcgccagagcuggcac

SEQ ID NO: 2632892 - RNA, 15 nt, Escherichia coli CFT073
cagcuuagacaacgc

SEQ ID NO: 2632893 - RNA, 20 nt, Escherichia coli CFT073
cagcuuagacaacgccgcuu

SEQ ID NO: 2632894 - RNA, 15 nt, Escherichia coli CFT073
cagcuuagcggcgcg

SEQ ID NO: 2632895 - RNA, 18 nt, Escherichia coli CFT073
cagcuuauuaacagucag

SEQ ID NO: 2632896 - RNA, 19 nt, Escherichia coli CFT073
cagcuuauuaacagucagu

SEQ ID NO: 2632897 - RNA, 22 nt, Escherichia coli CFT073
cagcuucacaaaggcuugcugc

SEQ ID NO: 2632898 - RNA, 10 nt, Escherichia coli CFT073
cagcuucaga

SEQ ID NO: 2632899 - RNA, 17 nt, Escherichia coli CFT073
caggcagaaacaucauc

SEQ ID NO: 2632900 - RNA, 20 nt, Escherichia coli CFT073
caggcagaacaccggcagcg

SEQ ID NO: 2632901 - RNA, 15 nt, Escherichia coli CFT073
caggcagaacgccau

SEQ ID NO: 2632902 - RNA, 20 nt, Escherichia coli CFT073
caggcagaacgccaugccaa

SEQ ID NO: 2632903 - RNA, 22 nt, Escherichia coli CFT073
caggcagaagagaagaaagaag

SEQ ID NO: 2632904 - RNA, 14 nt, Escherichia coli CFT073
caggcagacgauga

SEQ ID NO: 2632905 - RNA, 21 nt, Escherichia coli CFT073
caggcagacgaugaugcagau

SEQ ID NO: 2632906 - RNA, 17 nt, Escherichia coli CFT073
caggcagauacaaccaa

SEQ ID NO: 2632907 - RNA, 21 nt, Escherichia coli CFT073
caggcagauacaaccaaucgc

SEQ ID NO: 2632908 - RNA, 22 nt, Escherichia coli CFT073
caggcagcaaucacugccagaa

SEQ ID NO: 2632909 - RNA, 19 nt, Escherichia coli CFT073
caggcaguggaauauccca

SEQ ID NO: 2632910 - RNA, 18 nt, Escherichia coli CFT073
caggcauauucaccguca

SEQ ID NO: 2632911 - RNA, 18 nt, Escherichia coli CFT073
caggcaucgugcaccaau

SEQ ID NO: 2632912 - RNA, 20 nt, Escherichia coli CFT073
caggcaucuuccagcgucgg

SEQ ID NO: 2632913 - RNA, 12 nt, Escherichia coli CFT073
caggcaugcaau

SEQ ID NO: 2632914 - RNA, 23 nt, Escherichia coli CFT073
caggcauuagugcgcaguugccg

SEQ ID NO: 2632915 - RNA, 23 nt, Escherichia coli CFT073
caggcauuauggcgcaguugccg

SEQ ID NO: 2632916 - RNA, 14 nt, Escherichia coli CFT073
caggccaauagugc

SEQ ID NO: 2632917 - RNA, 16 nt, Escherichia coli CFT073
caggccaauagugcgg

SEQ ID NO: 2632918 - RNA, 14 nt, Escherichia coli CFT073
caggccaccaggcc

SEQ ID NO: 2632919 - RNA, 22 nt, Escherichia coli CFT073
caggccaccucgcaacaauguc

SEQ ID NO: 2632920 - RNA, 18 nt, Escherichia coli CFT073
caggccacgaaucagcac

SEQ ID NO: 2632921 - RNA, 20 nt, Escherichia coli CFT073
caggccacgaaucagcaccg

SEQ ID NO: 2632922 - RNA, 23 nt, Escherichia coli CFT073
caggccacucaugccuuucauau

SEQ ID NO: 2632923 - RNA, 21 nt, Escherichia coli CFT073
caggccagauacugccgacca

SEQ ID NO: 2632924 - RNA, 20 nt, Escherichia coli CFT073
caggccauaugacaccaacg

SEQ ID NO: 2632925 - RNA, 21 nt, Escherichia coli CFT073
caggccauaugacaccaacgc

SEQ ID NO: 2632926 - RNA, 15 nt, Escherichia coli CFT073
caggccaucagcagc

SEQ ID NO: 2632927 - RNA, 16 nt, Escherichia coli CFT073
caggccaucagcagcg

SEQ ID NO: 2632928 - RNA, 13 nt, Escherichia coli CFT073
caggccaucgcca

SEQ ID NO: 2632929 - RNA, 17 nt, Escherichia coli CFT073
caggccgcaucauacug

SEQ ID NO: 2632930 - RNA, 17 nt, Escherichia coli CFT073
caggccgccacuucggu

SEQ ID NO: 2632931 - RNA, 22 nt, Escherichia coli CFT073
caggccgccagcaccgauugcc

SEQ ID NO: 2632932 - RNA, 22 nt, Escherichia coli CFT073
caggccgcccaaaauaucacgc

SEQ ID NO: 2632933 - RNA, 19 nt, Escherichia coli CFT073
caggccgccgucaucacgc

SEQ ID NO: 2632934 - RNA, 13 nt, Escherichia coli CFT073
caggccggagcca

SEQ ID NO: 2632935 - RNA, 18 nt, Escherichia coli CFT073
caggccggaugagacgcg

SEQ ID NO: 2632936 - RNA, 23 nt, Escherichia coli CFT073
caggccggaugagacgcggcacu

SEQ ID NO: 2632937 - RNA, 16 nt, Escherichia coli CFT073
caggccuacacuccgg

SEQ ID NO: 2632938 - RNA, 15 nt, Escherichia coli CFT073
caggccuaccagaga

SEQ ID NO: 2632939 - RNA, 16 nt, Escherichia coli CFT073
caggccuacgccagac

SEQ ID NO: 2632940 - RNA, 18 nt, Escherichia coli CFT073
caggccuacggggugugu

SEQ ID NO: 2632941 - RNA, 21 nt, Escherichia coli CFT073
caggccuacgugauuccugca

SEQ ID NO: 2632942 - RNA, 20 nt, Escherichia coli CFT073
caggccucaugugaugguaa

SEQ ID NO: 2632943 - RNA, 18 nt, Escherichia coli CFT073
caggccugauaagcguag

SEQ ID NO: 2632944 - RNA, 13 nt, Escherichia coli CFT073
caggccugcaaaa

SEQ ID NO: 2632945 - RNA, 17 nt, Escherichia coli CFT073
caggcgaaaccagcagc

SEQ ID NO: 2632946 - RNA, 20 nt, Escherichia coli CFT073
caggcgaaaccagcagccau

SEQ ID NO: 2632947 - RNA, 21 nt, Escherichia coli CFT073
caggcgacucgguugcacaga

SEQ ID NO: 2632948 - RNA, 18 nt, Escherichia coli CFT073
caggcgagucgagauccc

SEQ ID NO: 2632949 - RNA, 19 nt, Escherichia coli CFT073
caggcgagugguaugacuu

SEQ ID NO: 2632950 - RNA, 18 nt, Escherichia coli CFT073
caggcgaucuucccgcgc

SEQ ID NO: 2632951 - RNA, 19 nt, Escherichia coli CFT073
caggcgauugaguauuaaa

SEQ ID NO: 2632952 - RNA, 21 nt, Escherichia coli CFT073
caggcgauuuaaucccgugcc

SEQ ID NO: 2632953 - RNA, 15 nt, Escherichia coli CFT073
caggcgauuucaaau

SEQ ID NO: 2632954 - RNA, 23 nt, Escherichia coli CFT073
caggcgauuucaaauugcucgaa

SEQ ID NO: 2632955 - RNA, 13 nt, Escherichia coli CFT073
caggcgcaccagc

SEQ ID NO: 2632956 - RNA, 19 nt, Escherichia coli CFT073
caggcgcgaagccugcgga

SEQ ID NO: 2632957 - RNA, 21 nt, Escherichia coli CFT073
caggcgcgaagccugcggaua

SEQ ID NO: 2632958 - RNA, 14 nt, Escherichia coli CFT073
caggcgcgccuggu

SEQ ID NO: 2632959 - RNA, 22 nt, Escherichia coli CFT073
caggcgcugaacuuccgggauc

SEQ ID NO: 2632960 - RNA, 13 nt, Escherichia coli CFT073
caggcgcugaucg

SEQ ID NO: 2632961 - RNA, 16 nt, Escherichia coli CFT073
caggcgcugcuggagc

SEQ ID NO: 2632962 - RNA, 15 nt, Escherichia coli CFT073
caggcgcuuuuucuu

SEQ ID NO: 2632963 - RNA, 14 nt, Escherichia coli CFT073
caggcggcaauggc

SEQ ID NO: 2632964 - RNA, 23 nt, Escherichia coli CFT073
caggcggguaucguuaaagagau

SEQ ID NO: 2632965 - RNA, 14 nt, Escherichia coli CFT073
caggcggucgccgu

SEQ ID NO: 2632966 - RNA, 14 nt, Escherichia coli CFT073
caggcgguggaaca

SEQ ID NO: 2632967 - RNA, 23 nt, Escherichia coli CFT073
caggcgguggaacaagucagcgc

SEQ ID NO: 2632968 - RNA, 22 nt, Escherichia coli CFT073
caggcguaacgacaugaagauc

SEQ ID NO: 2632969 - RNA, 11 nt, Escherichia coli CFT073
caggcgucgca

SEQ ID NO: 2632970 - RNA, 20 nt, Escherichia coli CFT073
caggcgucgcaucaggcauu

SEQ ID NO: 2632971 - RNA, 14 nt, Escherichia coli CFT073
caggcgucgcgcag

SEQ ID NO: 2632972 - RNA, 13 nt, Escherichia coli CFT073
caggcguuucacu

SEQ ID NO: 2632973 - RNA, 15 nt, Escherichia coli CFT073
caggcguuucuucac

SEQ ID NO: 2632974 - RNA, 17 nt, Escherichia coli CFT073
caggcguuucuucaccc

SEQ ID NO: 2632975 - RNA, 21 nt, Escherichia coli CFT073
caggcguuuuuggcaucggca

SEQ ID NO: 2632976 - RNA, 14 nt, Escherichia coli CFT073
caggcuaauccagu

SEQ ID NO: 2632977 - RNA, 22 nt, Escherichia coli CFT073
caggcuaccgcagugaaauuuc

SEQ ID NO: 2632978 - RNA, 15 nt, Escherichia coli CFT073
caggcuacgccagau

SEQ ID NO: 2632979 - RNA, 23 nt, Escherichia coli CFT073
caggcuacggcuguaguucagaa

SEQ ID NO: 2632980 - RNA, 14 nt, Escherichia coli CFT073
caggcuacucccag

SEQ ID NO: 2632981 - RNA, 15 nt, Escherichia coli CFT073
caggcuacucccagu

SEQ ID NO: 2632982 - RNA, 16 nt, Escherichia coli CFT073
caggcuagccgccagc

SEQ ID NO: 2632983 - RNA, 17 nt, Escherichia coli CFT073
caggcuaucgaacaugc

SEQ ID NO: 2632984 - RNA, 21 nt, Escherichia coli CFT073
caggcuaucuucgauaaacuc

SEQ ID NO: 2632985 - RNA, 16 nt, Escherichia coli CFT073
caggcuccagauaaca

SEQ ID NO: 2632986 - RNA, 16 nt, Escherichia coli CFT073
caggcucuccgugggc

SEQ ID NO: 2632987 - RNA, 15 nt, Escherichia coli CFT073
caggcucugacugau

SEQ ID NO: 2632988 - RNA, 23 nt, Escherichia coli CFT073
caggcugaacaacaguuuuaucu

SEQ ID NO: 2632989 - RNA, 15 nt, Escherichia coli CFT073
caggcugagaaggga

SEQ ID NO: 2632990 - RNA, 12 nt, Escherichia coli CFT073
caggcugaugga

SEQ ID NO: 2632991 - RNA, 18 nt, Escherichia coli CFT073
caggcugauggagauuuu

SEQ ID NO: 2632992 - RNA, 22 nt, Escherichia coli CFT073
caggcugguguaaaaacugcca

SEQ ID NO: 2632993 - RNA, 20 nt, Escherichia coli CFT073
caggcuuacgaaguuccugc

SEQ ID NO: 2632994 - RNA, 17 nt, Escherichia coli CFT073
caggcuuacguuaccca

SEQ ID NO: 2632995 - RNA, 14 nt, Escherichia coli CFT073
caggcuucauacac

SEQ ID NO: 2632996 - RNA, 23 nt, Escherichia coli CFT073
caggcuuccuggcuugccagcca

SEQ ID NO: 2632997 - RNA, 19 nt, Escherichia coli CFT073
caggcuuuaaauuccgugc

SEQ ID NO: 2632998 - RNA, 15 nt, Escherichia coli CFT073
caggcuuuauucuga

SEQ ID NO: 2632999 - RNA, 21 nt, Escherichia coli CFT073
cagggaaaaaagccccgcagc

SEQ ID NO: 2633000 - RNA, 22 nt, Escherichia coli CFT073
cagggaaaaaagccccgcagcc

SEQ ID NO: 2633001 - RNA, 15 nt, Escherichia coli CFT073
cagggaaagaaacgc

SEQ ID NO: 2633002 - RNA, 15 nt, Escherichia coli CFT073
cagggaacacaugug

SEQ ID NO: 2633003 - RNA, 23 nt, Escherichia coli CFT073
cagggaagauguuggcagcggca

SEQ ID NO: 2633004 - RNA, 17 nt, Escherichia coli CFT073
cagggaaguagauaccc

SEQ ID NO: 2633005 - RNA, 16 nt, Escherichia coli CFT073
cagggacgcgcaaaau

SEQ ID NO: 2633006 - RNA, 16 nt, Escherichia coli CFT073
caguaaauaaaaaauc

SEQ ID NO: 2633007 - RNA, 18 nt, Escherichia coli CFT073
caguaaauaaaaaaucca

SEQ ID NO: 2633008 - RNA, 14 nt, Escherichia coli CFT073
caguaaauccauaa

SEQ ID NO: 2633009 - RNA, 15 nt, Escherichia coli CFT073
caguaaaugcuggcg

SEQ ID NO: 2633010 - RNA, 17 nt, Escherichia coli CFT073
caguaaccagaaaccgu

SEQ ID NO: 2633011 - RNA, 13 nt, Escherichia coli CFT073
caguaaccagccg

SEQ ID NO: 2633012 - RNA, 14 nt, Escherichia coli CFT073
caguaaccagccgu

SEQ ID NO: 2633013 - RNA, 16 nt, Escherichia coli CFT073
caguaacccagcacca

SEQ ID NO: 2633014 - RNA, 17 nt, Escherichia coli CFT073
caguaacggcgcuugaa

SEQ ID NO: 2633015 - RNA, 14 nt, Escherichia coli CFT073
caguaacugcugua

SEQ ID NO: 2633016 - RNA, 16 nt, Escherichia coli CFT073
caguaagcaguccagc

SEQ ID NO: 2633017 - RNA, 21 nt, Escherichia coli CFT073
caguaagcaguccagcgccug

SEQ ID NO: 2633018 - RNA, 21 nt, Escherichia coli CFT073
caguaagcccaccacaaacca

SEQ ID NO: 2633019 - RNA, 19 nt, Escherichia coli CFT073
caguaagggaucacgcggu

SEQ ID NO: 2633020 - RNA, 15 nt, Escherichia coli CFT073
caguaauaaagacgg

SEQ ID NO: 2633021 - RNA, 13 nt, Escherichia coli CFT073
caguaauauggcg

SEQ ID NO: 2633022 - RNA, 22 nt, Escherichia coli CFT073
caguaaugaucugaucaaacuc

SEQ ID NO: 2633023 - RNA, 18 nt, Escherichia coli CFT073
caguaauuuccugccagc

SEQ ID NO: 2633024 - RNA, 12 nt, Escherichia coli CFT073
caguacaaacau

SEQ ID NO: 2633025 - RNA, 13 nt, Escherichia coli CFT073
caguacaccaauu

SEQ ID NO: 2633026 - RNA, 15 nt, Escherichia coli CFT073
caguacacgcugaag

SEQ ID NO: 2633027 - RNA, 17 nt, Escherichia coli CFT073
caguacacgcugaagau

SEQ ID NO: 2633028 - RNA, 18 nt, Escherichia coli CFT073
caguacacgcugaagauc

SEQ ID NO: 2633029 - RNA, 16 nt, Escherichia coli CFT073
caguacaguaccgaac

SEQ ID NO: 2633030 - RNA, 13 nt, Escherichia coli CFT073
caguaccaccgcg

SEQ ID NO: 2633031 - RNA, 13 nt, Escherichia coli CFT073
caguaccagcaac

SEQ ID NO: 2633032 - RNA, 15 nt, Escherichia coli CFT073
caguaccagcagcgc

SEQ ID NO: 2633033 - RNA, 17 nt, Escherichia coli CFT073
caguaccagcagcgccg

SEQ ID NO: 2633034 - RNA, 13 nt, Escherichia coli CFT073
caguaccagcagu

SEQ ID NO: 2633035 - RNA, 20 nt, Escherichia coli CFT073
caguaccaggcaauaaacau

SEQ ID NO: 2633036 - RNA, 16 nt, Escherichia coli CFT073
caguaccgcagccgga

SEQ ID NO: 2633037 - RNA, 21 nt, Escherichia coli CFT073
caguaccgccagugcagcgaa

SEQ ID NO: 2633038 - RNA, 23 nt, Escherichia coli CFT073
caguaccgccgccauaaacagca

SEQ ID NO: 2633039 - RNA, 17 nt, Escherichia coli CFT073
caguaccugcaaaccgu

SEQ ID NO: 2633040 - RNA, 21 nt, Escherichia coli CFT073
caguaccuucguccaucccac

SEQ ID NO: 2633041 - RNA, 23 nt, Escherichia coli CFT073
caguacgagcaucaucuuccggu

SEQ ID NO: 2633042 - RNA, 20 nt, Escherichia coli CFT073
caguacgaugauugccacaa

SEQ ID NO: 2633043 - RNA, 22 nt, Escherichia coli CFT073
caguacgcacaaugccguaacc

SEQ ID NO: 2633044 - RNA, 19 nt, Escherichia coli CFT073
caguacgccauucgcugug

SEQ ID NO: 2633045 - RNA, 18 nt, Escherichia coli CFT073
caguacgcccacgccagc

SEQ ID NO: 2633046 - RNA, 22 nt, Escherichia coli CFT073
caguacgcggacacuuuccugc

SEQ ID NO: 2633047 - RNA, 23 nt, Escherichia coli CFT073
caguacgcggacacuuuccugcu

SEQ ID NO: 2633048 - RNA, 23 nt, Escherichia coli CFT073
caguacggauaauggagccagau

SEQ ID NO: 2633049 - RNA, 17 nt, Escherichia coli CFT073
caguacggcagcaaucg

SEQ ID NO: 2633050 - RNA, 21 nt, Escherichia coli CFT073
caguacggcagcaaucgacca

SEQ ID NO: 2633051 - RNA, 17 nt, Escherichia coli CFT073
caguacggcuauauaca

SEQ ID NO: 2633052 - RNA, 21 nt, Escherichia coli CFT073
caguacggucgugcgguuuca

SEQ ID NO: 2633053 - RNA, 19 nt, Escherichia coli CFT073
caguacugacuauccacug

SEQ ID NO: 2633054 - RNA, 20 nt, Escherichia coli CFT073
caguacugacuauccacugg

SEQ ID NO: 2633055 - RNA, 16 nt, Escherichia coli CFT073
caguacuguacaacac

SEQ ID NO: 2633056 - RNA, 18 nt, Escherichia coli CFT073
caguagaacaauuaauac

SEQ ID NO: 2633057 - RNA, 13 nt, Escherichia coli CFT073
caguagacaauuu

SEQ ID NO: 2633058 - RNA, 17 nt, Escherichia coli CFT073
caguagagaucuucaua

SEQ ID NO: 2633059 - RNA, 17 nt, Escherichia coli CFT073
caguagcaccucuccac

SEQ ID NO: 2633060 - RNA, 20 nt, Escherichia coli CFT073
caguagcaccucuccacgca

SEQ ID NO: 2633061 - RNA, 14 nt, Escherichia coli CFT073
caguagcaguaauu

SEQ ID NO: 2633062 - RNA, 19 nt, Escherichia coli CFT073
caguagcauccccggcaac

SEQ ID NO: 2633063 - RNA, 15 nt, Escherichia coli CFT073
caguagcaugaacau

SEQ ID NO: 2633064 - RNA, 19 nt, Escherichia coli CFT073
caguagcccuugugcugcg

SEQ ID NO: 2633065 - RNA, 15 nt, Escherichia coli CFT073
caguagccuuuaucu

SEQ ID NO: 2633066 - RNA, 17 nt, Escherichia coli CFT073
caguagcgcaauaacca

SEQ ID NO: 2633067 - RNA, 18 nt, Escherichia coli CFT073
caguagcgcaauaaccac

SEQ ID NO: 2633068 - RNA, 17 nt, Escherichia coli CFT073
caguagcgccucuucca

SEQ ID NO: 2633069 - RNA, 20 nt, Escherichia coli CFT073
caguagcguaaaggcugcca

SEQ ID NO: 2633070 - RNA, 21 nt, Escherichia coli CFT073
caguagcguaaaggcugccag

SEQ ID NO: 2633071 - RNA, 13 nt, Escherichia coli CFT073
caguagcgucgcc

SEQ ID NO: 2633072 - RNA, 20 nt, Escherichia coli CFT073
caguagcuauaaaccugcug

SEQ ID NO: 2633073 - RNA, 17 nt, Escherichia coli CFT073
caguagugaaaaaagca

SEQ ID NO: 2633074 - RNA, 21 nt, Escherichia coli CFT073
caguaguuuuugcagauggau

SEQ ID NO: 2633075 - RNA, 14 nt, Escherichia coli CFT073
caguauauugcuga

SEQ ID NO: 2633076 - RNA, 20 nt, Escherichia coli CFT073
caguaugaaacgccugauga

SEQ ID NO: 2633077 - RNA, 15 nt, Escherichia coli CFT073
caguaugcaacaacu

SEQ ID NO: 2633078 - RNA, 19 nt, Escherichia coli CFT073
caguaugcaacaacucuaa

SEQ ID NO: 2633079 - RNA, 17 nt, Escherichia coli CFT073
caguauguaauuaaaca

SEQ ID NO: 2633080 - RNA, 16 nt, Escherichia coli CFT073
caguauuaccagaccu

SEQ ID NO: 2633081 - RNA, 23 nt, Escherichia coli CFT073
caguauuucuuuguuuccccugg

SEQ ID NO: 2633082 - RNA, 22 nt, Escherichia coli CFT073
cagucaaaacuuuucaccagcg

SEQ ID NO: 2633083 - RNA, 15 nt, Escherichia coli CFT073
cagucaaccgccuga

SEQ ID NO: 2633084 - RNA, 18 nt, Escherichia coli CFT073
cagucaccagcaucagcg

SEQ ID NO: 2633085 - RNA, 18 nt, Escherichia coli CFT073
cagucacccugcccggca

SEQ ID NO: 2633086 - RNA, 19 nt, Escherichia coli CFT073
cagucaccugcccuccggu

SEQ ID NO: 2633087 - RNA, 20 nt, Escherichia coli CFT073
cagucaccugcggugcagcc

SEQ ID NO: 2633088 - RNA, 14 nt, Escherichia coli CFT073
cagucacgcaacau

SEQ ID NO: 2633089 - RNA, 14 nt, Escherichia coli CFT073
cagucacgccagua

SEQ ID NO: 2633090 - RNA, 16 nt, Escherichia coli CFT073
cagucacugccaccau

SEQ ID NO: 2633091 - RNA, 14 nt, Escherichia coli CFT073
cagucacuucaaau

SEQ ID NO: 2633092 - RNA, 16 nt, Escherichia coli CFT073
cagucacuuccugauc

SEQ ID NO: 2633093 - RNA, 13 nt, Escherichia coli CFT073
cagucagccagcg

SEQ ID NO: 2633094 - RNA, 20 nt, Escherichia coli CFT073
cagucagcgguuuugaucac

SEQ ID NO: 2633095 - RNA, 18 nt, Escherichia coli CFT073
cagucaggcgauuguuua

SEQ ID NO: 2633096 - RNA, 20 nt, Escherichia coli CFT073
cagucaucacuuucagaccg

SEQ ID NO: 2633097 - RNA, 13 nt, Escherichia coli CFT073
caguccaaucagg

SEQ ID NO: 2633098 - RNA, 22 nt, Escherichia coli CFT073
caguccacacugagcaccacac

SEQ ID NO: 2633099 - RNA, 12 nt, Escherichia coli CFT073
caguccacaucu

SEQ ID NO: 2633100 - RNA, 13 nt, Escherichia coli CFT073
caguccagcgccu

SEQ ID NO: 2633101 - RNA, 15 nt, Escherichia coli CFT073
caguccagcgccuga

SEQ ID NO: 2633102 - RNA, 13 nt, Escherichia coli CFT073
caguccaucggca

SEQ ID NO: 2633103 - RNA, 14 nt, Escherichia coli CFT073
cagucccaguucau

SEQ ID NO: 2633104 - RNA, 17 nt, Escherichia coli CFT073
cagucccauaacauauu

SEQ ID NO: 2633105 - RNA, 22 nt, Escherichia coli CFT073
cagucccauaacauauucaccc

SEQ ID NO: 2633106 - RNA, 17 nt, Escherichia coli CFT073
cagucccguacccagca

SEQ ID NO: 2633107 - RNA, 21 nt, Escherichia coli CFT073
cagucccugaaucgccacgcc

SEQ ID NO: 2633108 - RNA, 23 nt, Escherichia coli CFT073
cagucccugcucuuucagcaccg

SEQ ID NO: 2633109 - RNA, 21 nt, Escherichia coli CFT073
caguccgcucgccgcagagau

SEQ ID NO: 2633110 - RNA, 19 nt, Escherichia coli CFT073
caguccucaucauccucuu

SEQ ID NO: 2633111 - RNA, 12 nt, Escherichia coli CFT073
caguccugcagg

SEQ ID NO: 2633112 - RNA, 22 nt, Escherichia coli CFT073
caguccuggcgcuuugaaacgc

SEQ ID NO: 2633113 - RNA, 23 nt, Escherichia coli CFT073
caguccuguucaaacuucgccac

SEQ ID NO: 2633114 - RNA, 22 nt, Escherichia coli CFT073
cagugucagaaucguaaagauc

SEQ ID NO: 2633115 - RNA, 16 nt, Escherichia coli CFT073
cagugucagguacuga

SEQ ID NO: 2633116 - RNA, 16 nt, Escherichia coli CFT073
cagugucggaugcggc

SEQ ID NO: 2633117 - RNA, 23 nt, Escherichia coli CFT073
cagugucuuaucuggcauuugca

SEQ ID NO: 2633118 - RNA, 22 nt, Escherichia coli CFT073
cagugugaauaauugugcaauu

SEQ ID NO: 2633119 - RNA, 13 nt, Escherichia coli CFT073
caguguuguauuc

SEQ ID NO: 2633120 - RNA, 12 nt, Escherichia coli CFT073
caguguuuauca

SEQ ID NO: 2633121 - RNA, 20 nt, Escherichia coli CFT073
caguuaaagcaauuccagcg

SEQ ID NO: 2633122 - RNA, 22 nt, Escherichia coli CFT073
caguuaaccugcgccucaguuu

SEQ ID NO: 2633123 - RNA, 21 nt, Escherichia coli CFT073
caguuaagcaacugacuggcu

SEQ ID NO: 2633124 - RNA, 18 nt, Escherichia coli CFT073
caguuacugccaucuucc

SEQ ID NO: 2633125 - RNA, 14 nt, Escherichia coli CFT073
caguuagcuuuucu

SEQ ID NO: 2633126 - RNA, 17 nt, Escherichia coli CFT073
caguuauagcgcagacg

SEQ ID NO: 2633127 - RNA, 14 nt, Escherichia coli CFT073
caguuauucauugc

SEQ ID NO: 2633128 - RNA, 21 nt, Escherichia coli CFT073
caguucaaagcguggugagac

SEQ ID NO: 2633129 - RNA, 21 nt, Escherichia coli CFT073
caguucaaauucauugucggg

SEQ ID NO: 2633130 - RNA, 19 nt, Escherichia coli CFT073
caguucaacggugucgaua

SEQ ID NO: 2633131 - RNA, 20 nt, Escherichia coli CFT073
caguucaaucauuugcacca

SEQ ID NO: 2633132 - RNA, 18 nt, Escherichia coli CFT073
caguucacagcgcagauu

SEQ ID NO: 2633133 - RNA, 21 nt, Escherichia coli CFT073
caguucaccaccuggcggcgu

SEQ ID NO: 2633134 - RNA, 23 nt, Escherichia coli CFT073
caguucaccaccuggcggcgugu

SEQ ID NO: 2633135 - RNA, 20 nt, Escherichia coli CFT073
caguucacguccggcagcag

SEQ ID NO: 2633136 - RNA, 15 nt, Escherichia coli CFT073
caguucagcaacacu

SEQ ID NO: 2633137 - RNA, 21 nt, Escherichia coli CFT073
caguucagcaacacuacaccc

SEQ ID NO: 2633138 - RNA, 12 nt, Escherichia coli CFT073
caguucagucag

SEQ ID NO: 2633139 - RNA, 15 nt, Escherichia coli CFT073
caguucaucaacgcc

SEQ ID NO: 2633140 - RNA, 12 nt, Escherichia coli CFT073
caguucauccag

SEQ ID NO: 2633141 - RNA, 15 nt, Escherichia coli CFT073
caguucauccagacg

SEQ ID NO: 2633142 - RNA, 18 nt, Escherichia coli CFT073
caguucauccauuaacag

SEQ ID NO: 2633143 - RNA, 22 nt, Escherichia coli CFT073
caguucaucuacuacuggagac

SEQ ID NO: 2633144 - RNA, 16 nt, Escherichia coli CFT073
caguucaugacgugac

SEQ ID NO: 2633145 - RNA, 15 nt, Escherichia coli CFT073
caguuccacaccuac

SEQ ID NO: 2633146 - RNA, 16 nt, Escherichia coli CFT073
caguuccagcgccugg

SEQ ID NO: 2633147 - RNA, 14 nt, Escherichia coli CFT073
caguuccugaucga

SEQ ID NO: 2633148 - RNA, 19 nt, Escherichia coli CFT073
caguucgauauccagaccg

SEQ ID NO: 2633149 - RNA, 14 nt, Escherichia coli CFT073
caguucgccuucau

SEQ ID NO: 2633150 - RNA, 19 nt, Escherichia coli CFT073
caguucgccuuccagcagc

SEQ ID NO: 2633151 - RNA, 20 nt, Escherichia coli CFT073
caguucgccuuccagcagcu

SEQ ID NO: 2633152 - RNA, 16 nt, Escherichia coli CFT073
caguucggcaucaucg

SEQ ID NO: 2633153 - RNA, 14 nt, Escherichia coli CFT073
caguucgucacagu

SEQ ID NO: 2633154 - RNA, 14 nt, Escherichia coli CFT073
caguucguucaguu

SEQ ID NO: 2633155 - RNA, 17 nt, Escherichia coli CFT073
caguucguucaguugcg

SEQ ID NO: 2633156 - RNA, 18 nt, Escherichia coli CFT073
caguucguucaguugcgu

SEQ ID NO: 2633157 - RNA, 15 nt, Escherichia coli CFT073
caguucucuggcauu

SEQ ID NO: 2633158 - RNA, 20 nt, Escherichia coli CFT073
caguucucuggcauuuuugu

SEQ ID NO: 2633159 - RNA, 14 nt, Escherichia coli CFT073
caguucugcagcgu

SEQ ID NO: 2633160 - RNA, 16 nt, Escherichia coli CFT073
caguucuuucaggcgu

SEQ ID NO: 2633161 - RNA, 15 nt, Escherichia coli CFT073
caguugacagccaca

SEQ ID NO: 2633162 - RNA, 13 nt, Escherichia coli CFT073
caguugaccugcg

SEQ ID NO: 2633163 - RNA, 17 nt, Escherichia coli CFT073
caguugaccugcgaccg

SEQ ID NO: 2633164 - RNA, 22 nt, Escherichia coli CFT073
caguugauacaggaacagccac

SEQ ID NO: 2633165 - RNA, 19 nt, Escherichia coli CFT073
caguugaugaccagugcag

SEQ ID NO: 2633166 - RNA, 17 nt, Escherichia coli CFT073
caguugaugauguucaa

SEQ ID NO: 2633167 - RNA, 22 nt, Escherichia coli CFT073
caguugcagucucaugcgucau

SEQ ID NO: 2633168 - RNA, 23 nt, Escherichia coli CFT073
caguugcaguuauuauaaguuca

SEQ ID NO: 2633169 - RNA, 18 nt, Escherichia coli CFT073
caguugccauauccaccg

SEQ ID NO: 2633170 - RNA, 13 nt, Escherichia coli CFT073
caguugccggaug

SEQ ID NO: 2633171 - RNA, 17 nt, Escherichia coli CFT073
caguugccggaugcggc

SEQ ID NO: 2633172 - RNA, 14 nt, Escherichia coli CFT073
caguugcgcuucac

SEQ ID NO: 2633173 - RNA, 12 nt, Escherichia coli CFT073
caguugcgugcc

SEQ ID NO: 2633174 - RNA, 12 nt, Escherichia coli CFT073
caguugcucuuc

SEQ ID NO: 2633175 - RNA, 17 nt, Escherichia coli CFT073
caguugcugacgaucgg

SEQ ID NO: 2633176 - RNA, 14 nt, Escherichia coli CFT073
caguugcugcguga

SEQ ID NO: 2633177 - RNA, 21 nt, Escherichia coli CFT073
caguuggcagaauuugaggaa

SEQ ID NO: 2633178 - RNA, 20 nt, Escherichia coli CFT073
caguuggcagagauucuuca

SEQ ID NO: 2633179 - RNA, 23 nt, Escherichia coli CFT073
caguuggcugugguacugccgac

SEQ ID NO: 2633180 - RNA, 17 nt, Escherichia coli CFT073
caguugguagagcacga

SEQ ID NO: 2633181 - RNA, 20 nt, Escherichia coli CFT073
caguugguagguccagccgc

SEQ ID NO: 2633182 - RNA, 20 nt, Escherichia coli CFT073
caguugguuagagcacauca

SEQ ID NO: 2633183 - RNA, 14 nt, Escherichia coli CFT073
caguuguaauaaga

SEQ ID NO: 2633184 - RNA, 18 nt, Escherichia coli CFT073
caguuguaauaagagguu

SEQ ID NO: 2633185 - RNA, 18 nt, Escherichia coli CFT073
caguuguaaucacgcuca

SEQ ID NO: 2633186 - RNA, 19 nt, Escherichia coli CFT073
caguuguaaucacgcucaa

SEQ ID NO: 2633187 - RNA, 19 nt, Escherichia coli CFT073
caguuguaugucauaaaaa

SEQ ID NO: 2633188 - RNA, 20 nt, Escherichia coli CFT073
caguuguaugucauaaaaau

SEQ ID NO: 2633189 - RNA, 15 nt, Escherichia coli CFT073
caguugugaugccac

SEQ ID NO: 2633190 - RNA, 16 nt, Escherichia coli CFT073
caguugugcugccagc

SEQ ID NO: 2633191 - RNA, 17 nt, Escherichia coli CFT073
caguugugcugccagcc

SEQ ID NO: 2633192 - RNA, 15 nt, Escherichia coli CFT073
caguuguuccugaua

SEQ ID NO: 2633193 - RNA, 15 nt, Escherichia coli CFT073
caguuguugcgugaa

SEQ ID NO: 2633194 - RNA, 15 nt, Escherichia coli CFT073
caguuguuugcggaa

SEQ ID NO: 2633195 - RNA, 13 nt, Escherichia coli CFT073
caguuuaaacaga

SEQ ID NO: 2633196 - RNA, 22 nt, Escherichia coli CFT073
caguuuaccgaaaaucacgcug

SEQ ID NO: 2633197 - RNA, 18 nt, Escherichia coli CFT073
caguuuaccgagcgccgg

SEQ ID NO: 2633198 - RNA, 23 nt, Escherichia coli CFT073
caguuuaccgagcgccgggagau

SEQ ID NO: 2633199 - RNA, 23 nt, Escherichia coli CFT073
caguuuacgagugcgcucuucaa

SEQ ID NO: 2633200 - RNA, 15 nt, Escherichia coli CFT073
caguuuagcucagaa

SEQ ID NO: 2633201 - RNA, 16 nt, Escherichia coli CFT073
caguuuagcucagaau

SEQ ID NO: 2633202 - RNA, 20 nt, Escherichia coli CFT073
caguuuauaauuggcagugg

SEQ ID NO: 2633203 - RNA, 13 nt, Escherichia coli CFT073
caguuuaucaauc

SEQ ID NO: 2633204 - RNA, 19 nt, Escherichia coli CFT073
caguuuaucaaucucagca

SEQ ID NO: 2633205 - RNA, 15 nt, Escherichia coli CFT073
caguuuauccagcca

SEQ ID NO: 2633206 - RNA, 16 nt, Escherichia coli CFT073
caguuuauccagccac

SEQ ID NO: 2633207 - RNA, 22 nt, Escherichia coli CFT073
caguuuauccaucucuugcggc

SEQ ID NO: 2633208 - RNA, 16 nt, Escherichia coli CFT073
caguuuauccugacga

SEQ ID NO: 2633209 - RNA, 15 nt, Escherichia coli CFT073
caguuuauggaacaa

SEQ ID NO: 2633210 - RNA, 18 nt, Escherichia coli CFT073
caguuuauucuuuacugc

SEQ ID NO: 2633211 - RNA, 14 nt, Escherichia coli CFT073
caguuucaccagca

SEQ ID NO: 2633212 - RNA, 23 nt, Escherichia coli CFT073
caguuucagagcgaauuaagaau

SEQ ID NO: 2633213 - RNA, 17 nt, Escherichia coli CFT073
caguuucagccccauca

SEQ ID NO: 2633214 - RNA, 16 nt, Escherichia coli CFT073
caguuucgacaucaca

SEQ ID NO: 2633215 - RNA, 17 nt, Escherichia coli CFT073
caguuucgagaaauucu

SEQ ID NO: 2633216 - RNA, 17 nt, Escherichia coli CFT073
caguuucgaucagcaau

SEQ ID NO: 2633217 - RNA, 20 nt, Escherichia coli CFT073
caguuucgcauccagagauu

SEQ ID NO: 2633218 - RNA, 19 nt, Escherichia coli CFT073
caguuucgucaacuucuuu

SEQ ID NO: 2633219 - RNA, 15 nt, Escherichia coli CFT073
caguuucuuuuaaca

SEQ ID NO: 2633220 - RNA, 20 nt, Escherichia coli CFT073
caguuugcaggccaaacagc

SEQ ID NO: 2633221 - RNA, 15 nt, Escherichia coli CFT073
caguuugccaaacca

SEQ ID NO: 2633222 - RNA, 11 nt, Escherichia coli CFT073
cauaccagcag

SEQ ID NO: 2633223 - RNA, 13 nt, Escherichia coli CFT073
cauaccagcagca

SEQ ID NO: 2633224 - RNA, 17 nt, Escherichia coli CFT073
cauaccagcaggaaucc

SEQ ID NO: 2633225 - RNA, 17 nt, Escherichia coli CFT073
cauaccauauuguuuca

SEQ ID NO: 2633226 - RNA, 24 nt, Escherichia coli CFT073
cauaccauauuguuucaacacagg

SEQ ID NO: 2633227 - RNA, 20 nt, Escherichia coli CFT073
cauacccaccaauuaauccc

SEQ ID NO: 2633228 - RNA, 23 nt, Escherichia coli CFT073
cauacccgcacaaauagccagca

SEQ ID NO: 2633229 - RNA, 15 nt, Escherichia coli CFT073
cauaccggacuccag

SEQ ID NO: 2633230 - RNA, 16 nt, Escherichia coli CFT073
cauaccggacuccaga

SEQ ID NO: 2633231 - RNA, 14 nt, Escherichia coli CFT073
cauaccuaaaagca

SEQ ID NO: 2633232 - RNA, 21 nt, Escherichia coli CFT073
cauaccuaaaagcacgccaga

SEQ ID NO: 2633233 - RNA, 22 nt, Escherichia coli CFT073
cauaccuaaaagcacgccagac

SEQ ID NO: 2633234 - RNA, 17 nt, Escherichia coli CFT073
cauaccuaccugcaguu

SEQ ID NO: 2633235 - RNA, 16 nt, Escherichia coli CFT073
cauacgagucgccugu

SEQ ID NO: 2633236 - RNA, 19 nt, Escherichia coli CFT073
cauacgcaaugugcagcag

SEQ ID NO: 2633237 - RNA, 14 nt, Escherichia coli CFT073
cauacgccacaucc

SEQ ID NO: 2633238 - RNA, 13 nt, Escherichia coli CFT073
cauacgccggaug

SEQ ID NO: 2633239 - RNA, 19 nt, Escherichia coli CFT073
cauacgcgguauuaaaucc

SEQ ID NO: 2633240 - RNA, 20 nt, Escherichia coli CFT073
cauacgcgguauuaaauccg

SEQ ID NO: 2633241 - RNA, 23 nt, Escherichia coli CFT073
cauacgcgguauuaaauccgcua

SEQ ID NO: 2633242 - RNA, 21 nt, Escherichia coli CFT073
cauacgggauuuuacuuccca

SEQ ID NO: 2633243 - RNA, 15 nt, Escherichia coli CFT073
cauacguugcauaaa

SEQ ID NO: 2633244 - RNA, 16 nt, Escherichia coli CFT073
cauacucaucuuccau

SEQ ID NO: 2633245 - RNA, 17 nt, Escherichia coli CFT073
cauacuccagucgcugc

SEQ ID NO: 2633246 - RNA, 19 nt, Escherichia coli CFT073
cauacucgaggcauuggca

SEQ ID NO: 2633247 - RNA, 23 nt, Escherichia coli CFT073
cauacucguugacgaccaguccg

SEQ ID NO: 2633248 - RNA, 15 nt, Escherichia coli CFT073
cauacucuccuccag

SEQ ID NO: 2633249 - RNA, 18 nt, Escherichia coli CFT073
cauacugacaaacugcgc

SEQ ID NO: 2633250 - RNA, 15 nt, Escherichia coli CFT073
cauacugauuaccca

SEQ ID NO: 2633251 - RNA, 17 nt, Escherichia coli CFT073
cauacugauuacccagu

SEQ ID NO: 2633252 - RNA, 18 nt, Escherichia coli CFT073
cauacugauuacccaguu

SEQ ID NO: 2633253 - RNA, 16 nt, Escherichia coli CFT073
cauacugcuugccauu

SEQ ID NO: 2633254 - RNA, 18 nt, Escherichia coli CFT073
cauacuggacacugaaua

SEQ ID NO: 2633255 - RNA, 23 nt, Escherichia coli CFT073
cauacuggcuucgauaccgucca

SEQ ID NO: 2633256 - RNA, 16 nt, Escherichia coli CFT073
cauacuuaaugccagu

SEQ ID NO: 2633257 - RNA, 19 nt, Escherichia coli CFT073
cauacuuaaugccaguuca

SEQ ID NO: 2633258 - RNA, 23 nt, Escherichia coli CFT073
cauacuuauugaaagcaaaaaaa

SEQ ID NO: 2633259 - RNA, 15 nt, Escherichia coli CFT073
cauagaagaaauaaa

SEQ ID NO: 2633260 - RNA, 23 nt, Escherichia coli CFT073
cauagaauaaagacacugcuguu

SEQ ID NO: 2633261 - RNA, 13 nt, Escherichia coli CFT073
cauagacagccac

SEQ ID NO: 2633262 - RNA, 14 nt, Escherichia coli CFT073
cauagacagccaca

SEQ ID NO: 2633263 - RNA, 15 nt, Escherichia coli CFT073
cauagaccauugcau

SEQ ID NO: 2633264 - RNA, 17 nt, Escherichia coli CFT073
cauagacgccacccgau

SEQ ID NO: 2633265 - RNA, 20 nt, Escherichia coli CFT073
cauagacggugacacuuugu

SEQ ID NO: 2633266 - RNA, 13 nt, Escherichia coli CFT073
cauagacuuaugc

SEQ ID NO: 2633267 - RNA, 21 nt, Escherichia coli CFT073
cauagacuuuacuaauagcaa

SEQ ID NO: 2633268 - RNA, 12 nt, Escherichia coli CFT073
cauagagauaac

SEQ ID NO: 2633269 - RNA, 21 nt, Escherichia coli CFT073
cauagagauaacuggcaaaaa

SEQ ID NO: 2633270 - RNA, 17 nt, Escherichia coli CFT073
cauagauaccuucuuga

SEQ ID NO: 2633271 - RNA, 15 nt, Escherichia coli CFT073
cauagcaggcauccu

SEQ ID NO: 2633272 - RNA, 14 nt, Escherichia coli CFT073
cauagccaccuggc

SEQ ID NO: 2633273 - RNA, 17 nt, Escherichia coli CFT073
cauagccacucaccgcc

SEQ ID NO: 2633274 - RNA, 19 nt, Escherichia coli CFT073
cauagccagcgaccgcgcc

SEQ ID NO: 2633275 - RNA, 17 nt, Escherichia coli CFT073
cauagccaucugccuga

SEQ ID NO: 2633276 - RNA, 15 nt, Escherichia coli CFT073
cauagccgaaaaugc

SEQ ID NO: 2633277 - RNA, 22 nt, Escherichia coli CFT073
cauagccggagguuuuucaaau

SEQ ID NO: 2633278 - RNA, 18 nt, Escherichia coli CFT073
cauagcgggcaaucagcg

SEQ ID NO: 2633279 - RNA, 18 nt, Escherichia coli CFT073
cauagcgguaaaugacgg

SEQ ID NO: 2633280 - RNA, 14 nt, Escherichia coli CFT073
cauagcguaacuua

SEQ ID NO: 2633281 - RNA, 16 nt, Escherichia coli CFT073
cauagcgugacaccag

SEQ ID NO: 2633282 - RNA, 20 nt, Escherichia coli CFT073
cauagcuaauccccuccagc

SEQ ID NO: 2633283 - RNA, 22 nt, Escherichia coli CFT073
cauagcuaauccccuccagcga

SEQ ID NO: 2633284 - RNA, 21 nt, Escherichia coli CFT073
cauagcuuggcagagcgacau

SEQ ID NO: 2633285 - RNA, 22 nt, Escherichia coli CFT073
cauagcuuggcagagcgacaua

SEQ ID NO: 2633286 - RNA, 19 nt, Escherichia coli CFT073
cauaggccagccgccgcuc

SEQ ID NO: 2633287 - RNA, 18 nt, Escherichia coli CFT073
cauaggccaucggcagca

SEQ ID NO: 2633288 - RNA, 15 nt, Escherichia coli CFT073
cauaggucaggaaua

SEQ ID NO: 2633289 - RNA, 14 nt, Escherichia coli CFT073
cauaguauuuaucc

SEQ ID NO: 2633290 - RNA, 20 nt, Escherichia coli CFT073
cauagucacuaccuguuuaa

SEQ ID NO: 2633291 - RNA, 16 nt, Escherichia coli CFT073
cauaguccggcaccag

SEQ ID NO: 2633292 - RNA, 23 nt, Escherichia coli CFT073
cauagugaucagccucucucuga

SEQ ID NO: 2633293 - RNA, 15 nt, Escherichia coli CFT073
cauagugccugaugc

SEQ ID NO: 2633294 - RNA, 23 nt, Escherichia coli CFT073
cauaguugcgacugauagcggcg

SEQ ID NO: 2633295 - RNA, 18 nt, Escherichia coli CFT073
cauauaaacauaucacuu

SEQ ID NO: 2633296 - RNA, 13 nt, Escherichia coli CFT073
cauauaacgucca

SEQ ID NO: 2633297 - RNA, 15 nt, Escherichia coli CFT073
cauauaacguccagu

SEQ ID NO: 2633298 - RNA, 16 nt, Escherichia coli CFT073
cauauaccgcaucagc

SEQ ID NO: 2633299 - RNA, 20 nt, Escherichia coli CFT073
cauauaccgcaucagcaucg

SEQ ID NO: 2633300 - RNA, 23 nt, Escherichia coli CFT073
cauauagccgccuuuuuguugua

SEQ ID NO: 2633301 - RNA, 20 nt, Escherichia coli CFT073
cauauaucagcgccacauca

SEQ ID NO: 2633302 - RNA, 23 nt, Escherichia coli CFT073
cauauaucagcgccacaucagca

SEQ ID NO: 2633303 - RNA, 20 nt, Escherichia coli CFT073
cauauaugaauauugcugaa

SEQ ID NO: 2633304 - RNA, 17 nt, Escherichia coli CFT073
cauauauuuucgccauu

SEQ ID NO: 2633305 - RNA, 18 nt, Escherichia coli CFT073
cauaucaccguucacugc

SEQ ID NO: 2633306 - RNA, 14 nt, Escherichia coli CFT073
cauaucacuuuuau

SEQ ID NO: 2633307 - RNA, 14 nt, Escherichia coli CFT073
cauaucagcgcaaa

SEQ ID NO: 2633308 - RNA, 15 nt, Escherichia coli CFT073
cauaucaucaaggcu

SEQ ID NO: 2633309 - RNA, 23 nt, Escherichia coli CFT073
cauaucaucaucggucaguuugc

SEQ ID NO: 2633310 - RNA, 11 nt, Escherichia coli CFT073
cauauccagcg

SEQ ID NO: 2633311 - RNA, 15 nt, Escherichia coli CFT073
cauauccagcgccug

SEQ ID NO: 2633312 - RNA, 23 nt, Escherichia coli CFT073
cauauccagcgccugagcagcga

SEQ ID NO: 2633313 - RNA, 17 nt, Escherichia coli CFT073
cauauccagugcaccac

SEQ ID NO: 2633314 - RNA, 17 nt, Escherichia coli CFT073
cauaucccaccagcgcc

SEQ ID NO: 2633315 - RNA, 14 nt, Escherichia coli CFT073
cauauccgacacua

SEQ ID NO: 2633316 - RNA, 18 nt, Escherichia coli CFT073
cauaucgcgugcacuaca

SEQ ID NO: 2633317 - RNA, 13 nt, Escherichia coli CFT073
cauaucgcuggcu

SEQ ID NO: 2633318 - RNA, 14 nt, Escherichia coli CFT073
cauaucgcuggcug

SEQ ID NO: 2633319 - RNA, 15 nt, Escherichia coli CFT073
cauaucgcuggcugc

SEQ ID NO: 2633320 - RNA, 16 nt, Escherichia coli CFT073
cauaucgcuggcugca

SEQ ID NO: 2633321 - RNA, 19 nt, Escherichia coli CFT073
cauaucgcuggcugcagug

SEQ ID NO: 2633322 - RNA, 16 nt, Escherichia coli CFT073
cauaucgguaaaugcu

SEQ ID NO: 2633323 - RNA, 13 nt, Escherichia coli CFT073
cauaucucccagu

SEQ ID NO: 2633324 - RNA, 20 nt, Escherichia coli CFT073
cauaucuucaggccaauuca

SEQ ID NO: 2633325 - RNA, 17 nt, Escherichia coli CFT073
cauaugaccauucgccg

SEQ ID NO: 2633326 - RNA, 20 nt, Escherichia coli CFT073
cauaugauaggcuucaaccg

SEQ ID NO: 2633327 - RNA, 17 nt, Escherichia coli CFT073
cauaugcacacgcagcu

SEQ ID NO: 2633328 - RNA, 18 nt, Escherichia coli CFT073
cauaugcagccacugcug

SEQ ID NO: 2633329 - RNA, 13 nt, Escherichia coli CFT073
cauaugccccugu

SEQ ID NO: 2633330 - RNA, 18 nt, Escherichia coli CFT073
caucacgacagcaccacu

SEQ ID NO: 2633331 - RNA, 14 nt, Escherichia coli CFT073
caucacgacauaau

SEQ ID NO: 2633332 - RNA, 15 nt, Escherichia coli CFT073
caucacgcacugcaa

SEQ ID NO: 2633333 - RNA, 17 nt, Escherichia coli CFT073
caucacgcacugcaaua

SEQ ID NO: 2633334 - RNA, 20 nt, Escherichia coli CFT073
caucacgcacugcaauauua

SEQ ID NO: 2633335 - RNA, 13 nt, Escherichia coli CFT073
caucacgccgcug

SEQ ID NO: 2633336 - RNA, 16 nt, Escherichia coli CFT073
caucacgccgcuggca

SEQ ID NO: 2633337 - RNA, 20 nt, Escherichia coli CFT073
caucacgcgguuacgcaccg

SEQ ID NO: 2633338 - RNA, 19 nt, Escherichia coli CFT073
caucacgcucgcaggcggc

SEQ ID NO: 2633339 - RNA, 21 nt, Escherichia coli CFT073
caucacggaucaguuuaucca

SEQ ID NO: 2633340 - RNA, 16 nt, Escherichia coli CFT073
caucacggcagccuga

SEQ ID NO: 2633341 - RNA, 23 nt, Escherichia coli CFT073
caucacgguugagagcaaacacc

SEQ ID NO: 2633342 - RNA, 17 nt, Escherichia coli CFT073
caucacuaccagcgcca

SEQ ID NO: 2633343 - RNA, 14 nt, Escherichia coli CFT073
caucacuauucaga

SEQ ID NO: 2633344 - RNA, 14 nt, Escherichia coli CFT073
caucacucacgaca

SEQ ID NO: 2633345 - RNA, 21 nt, Escherichia coli CFT073
caucacuccaguccaccccca

SEQ ID NO: 2633346 - RNA, 17 nt, Escherichia coli CFT073
caucacuccccgcaaca

SEQ ID NO: 2633347 - RNA, 22 nt, Escherichia coli CFT073
caucacucuguuuuaacgcaga

SEQ ID NO: 2633348 - RNA, 16 nt, Escherichia coli CFT073
caucacugcaaauacc

SEQ ID NO: 2633349 - RNA, 15 nt, Escherichia coli CFT073
caucagaaaugccag

SEQ ID NO: 2633350 - RNA, 18 nt, Escherichia coli CFT073
caucagaacugacgccca

SEQ ID NO: 2633351 - RNA, 23 nt, Escherichia coli CFT073
caucagacaccggcgcacaaccg

SEQ ID NO: 2633352 - RNA, 15 nt, Escherichia coli CFT073
caucagacugcuuuu

SEQ ID NO: 2633353 - RNA, 17 nt, Escherichia coli CFT073
caucagacuuugcgcca

SEQ ID NO: 2633354 - RNA, 15 nt, Escherichia coli CFT073
caucagaguacagau

SEQ ID NO: 2633355 - RNA, 18 nt, Escherichia coli CFT073
caucagaucguugaaccc

SEQ ID NO: 2633356 - RNA, 22 nt, Escherichia coli CFT073
caucagaucguugaacccggca

SEQ ID NO: 2633357 - RNA, 17 nt, Escherichia coli CFT073
caucagauuguugaucg

SEQ ID NO: 2633358 - RNA, 14 nt, Escherichia coli CFT073
caucagcaaauaga

SEQ ID NO: 2633359 - RNA, 16 nt, Escherichia coli CFT073
caucagcagauaccaa

SEQ ID NO: 2633360 - RNA, 16 nt, Escherichia coli CFT073
caucagcagcaacaaa

SEQ ID NO: 2633361 - RNA, 23 nt, Escherichia coli CFT073
caucagcaguuuuuccccugcca

SEQ ID NO: 2633362 - RNA, 18 nt, Escherichia coli CFT073
caucagcauaaucaccag

SEQ ID NO: 2633363 - RNA, 19 nt, Escherichia coli CFT073
caucagcauaaucaccagu

SEQ ID NO: 2633364 - RNA, 16 nt, Escherichia coli CFT073
caucagcaucccaccu

SEQ ID NO: 2633365 - RNA, 15 nt, Escherichia coli CFT073
caucagcaugacaaa

SEQ ID NO: 2633366 - RNA, 18 nt, Escherichia coli CFT073
caucagcaugacaaaaaa

SEQ ID NO: 2633367 - RNA, 22 nt, Escherichia coli CFT073
caucagcaugacaaaaaagcca

SEQ ID NO: 2633368 - RNA, 19 nt, Escherichia coli CFT073
caucagccacuucaaccag

SEQ ID NO: 2633369 - RNA, 12 nt, Escherichia coli CFT073
caucagccaggg

SEQ ID NO: 2633370 - RNA, 20 nt, Escherichia coli CFT073
caucagcgaacgacauccgc

SEQ ID NO: 2633371 - RNA, 21 nt, Escherichia coli CFT073
caucagcgacgaccguuuuac

SEQ ID NO: 2633372 - RNA, 20 nt, Escherichia coli CFT073
caucagcgauucauugagua

SEQ ID NO: 2633373 - RNA, 21 nt, Escherichia coli CFT073
caucagcgauucauugaguaa

SEQ ID NO: 2633374 - RNA, 12 nt, Escherichia coli CFT073
caucagcgccaa

SEQ ID NO: 2633375 - RNA, 14 nt, Escherichia coli CFT073
caucagcgccaacc

SEQ ID NO: 2633376 - RNA, 11 nt, Escherichia coli CFT073
caucagcgccu

SEQ ID NO: 2633377 - RNA, 20 nt, Escherichia coli CFT073
caucagcgccugauggacau

SEQ ID NO: 2633378 - RNA, 14 nt, Escherichia coli CFT073
caucagcgccuuac

SEQ ID NO: 2633379 - RNA, 22 nt, Escherichia coli CFT073
caucagcgcuaccagagccgcg

SEQ ID NO: 2633380 - RNA, 17 nt, Escherichia coli CFT073
caucagcggcaaaacgg

SEQ ID NO: 2633381 - RNA, 19 nt, Escherichia coli CFT073
caucagcggcgaagccuaa

SEQ ID NO: 2633382 - RNA, 19 nt, Escherichia coli CFT073
caucagcggguuuuucccu

SEQ ID NO: 2633383 - RNA, 18 nt, Escherichia coli CFT073
caucagcgguacucgcgc

SEQ ID NO: 2633384 - RNA, 21 nt, Escherichia coli CFT073
caucagcucuguagcaacgau

SEQ ID NO: 2633385 - RNA, 18 nt, Escherichia coli CFT073
caucagcuggaucgagau

SEQ ID NO: 2633386 - RNA, 14 nt, Escherichia coli CFT073
caucagcuggcaaa

SEQ ID NO: 2633387 - RNA, 22 nt, Escherichia coli CFT073
caucagcuggcaaacaugcagc

SEQ ID NO: 2633388 - RNA, 11 nt, Escherichia coli CFT073
caucaggcaac

SEQ ID NO: 2633389 - RNA, 21 nt, Escherichia coli CFT073
caucaggcaacccagaagaaa

SEQ ID NO: 2633390 - RNA, 14 nt, Escherichia coli CFT073
caucaggcaacccg

SEQ ID NO: 2633391 - RNA, 22 nt, Escherichia coli CFT073
caucaggcaaucggcgcaaaau

SEQ ID NO: 2633392 - RNA, 21 nt, Escherichia coli CFT073
caucaggcaaugggcaaacgc

SEQ ID NO: 2633393 - RNA, 19 nt, Escherichia coli CFT073
caucaggcagaacaccggc

SEQ ID NO: 2633394 - RNA, 17 nt, Escherichia coli CFT073
caucaggcaucgugcac

SEQ ID NO: 2633395 - RNA, 22 nt, Escherichia coli CFT073
caucaggcaucgugcaccaauu

SEQ ID NO: 2633396 - RNA, 13 nt, Escherichia coli CFT073
caucaggcaugau

SEQ ID NO: 2633397 - RNA, 21 nt, Escherichia coli CFT073
caucaggccaaacagaccaau

SEQ ID NO: 2633398 - RNA, 13 nt, Escherichia coli CFT073
caucaggccaggc

SEQ ID NO: 2633399 - RNA, 21 nt, Escherichia coli CFT073
caucaggcguugauugccgga

SEQ ID NO: 2633400 - RNA, 22 nt, Escherichia coli CFT073
caucagguaauaggcaggcauc

SEQ ID NO: 2633401 - RNA, 14 nt, Escherichia coli CFT073
caucagguauuuau

SEQ ID NO: 2633402 - RNA, 14 nt, Escherichia coli CFT073
caucagguugagga

SEQ ID NO: 2633403 - RNA, 20 nt, Escherichia coli CFT073
caucagguuggaucaacagg

SEQ ID NO: 2633404 - RNA, 20 nt, Escherichia coli CFT073
caucaguagcaguaauuuau

SEQ ID NO: 2633405 - RNA, 15 nt, Escherichia coli CFT073
caucaguagcauccc

SEQ ID NO: 2633406 - RNA, 19 nt, Escherichia coli CFT073
caucagucucaaaccggcu

SEQ ID NO: 2633407 - RNA, 20 nt, Escherichia coli CFT073
caucagucuuaagcggcuaa

SEQ ID NO: 2633408 - RNA, 16 nt, Escherichia coli CFT073
caucaguugcaccuga

SEQ ID NO: 2633409 - RNA, 15 nt, Escherichia coli CFT073
caucaguuucauuuc

SEQ ID NO: 2633410 - RNA, 14 nt, Escherichia coli CFT073
caucauaaauaaga

SEQ ID NO: 2633411 - RNA, 12 nt, Escherichia coli CFT073
caucaucacgaa

SEQ ID NO: 2633412 - RNA, 12 nt, Escherichia coli CFT073
caucaucagaaa

SEQ ID NO: 2633413 - RNA, 14 nt, Escherichia coli CFT073
caucaucagaaaug

SEQ ID NO: 2633414 - RNA, 12 nt, Escherichia coli CFT073
caucauccagca

SEQ ID NO: 2633415 - RNA, 19 nt, Escherichia coli CFT073
caucauccccguaucuuca

SEQ ID NO: 2633416 - RNA, 17 nt, Escherichia coli CFT073
caucauccgcggauaaa

SEQ ID NO: 2633417 - RNA, 18 nt, Escherichia coli CFT073
caucauccgcggauaaaa

SEQ ID NO: 2633418 - RNA, 22 nt, Escherichia coli CFT073
caucauccggcacuuuuucauc

SEQ ID NO: 2633419 - RNA, 16 nt, Escherichia coli CFT073
caucauccucuucagc

SEQ ID NO: 2633420 - RNA, 21 nt, Escherichia coli CFT073
caucaugaaacgcccacgcgc

SEQ ID NO: 2633421 - RNA, 23 nt, Escherichia coli CFT073
caucaugaacugggcuauggcaa

SEQ ID NO: 2633422 - RNA, 19 nt, Escherichia coli CFT073
caucaugcggauuaauaag

SEQ ID NO: 2633423 - RNA, 18 nt, Escherichia coli CFT073
caucaugcgucaccagca

SEQ ID NO: 2633424 - RNA, 14 nt, Escherichia coli CFT073
caucaugcuuaaau

SEQ ID NO: 2633425 - RNA, 22 nt, Escherichia coli CFT073
caucauggcgaugagaaucagu

SEQ ID NO: 2633426 - RNA, 22 nt, Escherichia coli CFT073
caucaugggcaagguauugcac

SEQ ID NO: 2633427 - RNA, 20 nt, Escherichia coli CFT073
caucaugguuugcauccaca

SEQ ID NO: 2633428 - RNA, 12 nt, Escherichia coli CFT073
caucauguggcu

SEQ ID NO: 2633429 - RNA, 13 nt, Escherichia coli CFT073
caucauuaaaggc

SEQ ID NO: 2633430 - RNA, 12 nt, Escherichia coli CFT073
caucauuaacug

SEQ ID NO: 2633431 - RNA, 14 nt, Escherichia coli CFT073
caucauuaacugcu

SEQ ID NO: 2633432 - RNA, 22 nt, Escherichia coli CFT073
caucauucccuacgcgauaaaa

SEQ ID NO: 2633433 - RNA, 14 nt, Escherichia coli CFT073
caucauugccgccu

SEQ ID NO: 2633434 - RNA, 22 nt, Escherichia coli CFT073
caucauugguuaacuccagcga

SEQ ID NO: 2633435 - RNA, 13 nt, Escherichia coli CFT073
caucauuuugcua

SEQ ID NO: 2633436 - RNA, 20 nt, Escherichia coli CFT073
caucauuuugcuauucaccu

SEQ ID NO: 2633437 - RNA, 13 nt, Escherichia coli CFT073
cauccaauaacgu

SEQ ID NO: 2633438 - RNA, 22 nt, Escherichia coli CFT073
cauccuaaaggcaaaaugccag

SEQ ID NO: 2633439 - RNA, 19 nt, Escherichia coli CFT073
cauccugaauauccuguuc

SEQ ID NO: 2633440 - RNA, 17 nt, Escherichia coli CFT073
cauccugaauuaacuua

SEQ ID NO: 2633441 - RNA, 20 nt, Escherichia coli CFT073
cauccugaguuaaucgccgc

SEQ ID NO: 2633442 - RNA, 19 nt, Escherichia coli CFT073
cauccugccaggaccgcug

SEQ ID NO: 2633443 - RNA, 22 nt, Escherichia coli CFT073
cauccugccaggaccgcugaaa

SEQ ID NO: 2633444 - RNA, 23 nt, Escherichia coli CFT073
cauccugccaggaccgcugaaau

SEQ ID NO: 2633445 - RNA, 12 nt, Escherichia coli CFT073
cauccugccaug

SEQ ID NO: 2633446 - RNA, 18 nt, Escherichia coli CFT073
cauccugccaugcgcaau

SEQ ID NO: 2633447 - RNA, 14 nt, Escherichia coli CFT073
cauccugcucaagu

SEQ ID NO: 2633448 - RNA, 14 nt, Escherichia coli CFT073
cauccuucagugcc

SEQ ID NO: 2633449 - RNA, 14 nt, Escherichia coli CFT073
caucgaaaauacac

SEQ ID NO: 2633450 - RNA, 20 nt, Escherichia coli CFT073
caucgaaaauacacgcugca

SEQ ID NO: 2633451 - RNA, 20 nt, Escherichia coli CFT073
caucgaaaaugccacugcgc

SEQ ID NO: 2633452 - RNA, 15 nt, Escherichia coli CFT073
caucgaaccaucggc

SEQ ID NO: 2633453 - RNA, 17 nt, Escherichia coli CFT073
caucgaauaaauugagc

SEQ ID NO: 2633454 - RNA, 23 nt, Escherichia coli CFT073
caucgaauguugcguucaucagu

SEQ ID NO: 2633455 - RNA, 12 nt, Escherichia coli CFT073
caucgacaccag

SEQ ID NO: 2633456 - RNA, 18 nt, Escherichia coli CFT073
caucgacaccagccagac

SEQ ID NO: 2633457 - RNA, 19 nt, Escherichia coli CFT073
caucgacagcaaauugcgc

SEQ ID NO: 2633458 - RNA, 15 nt, Escherichia coli CFT073
caucgacaguaccag

SEQ ID NO: 2633459 - RNA, 18 nt, Escherichia coli CFT073
caucgacgaaauggugug

SEQ ID NO: 2633460 - RNA, 14 nt, Escherichia coli CFT073
caucgacuccagcg

SEQ ID NO: 2633461 - RNA, 21 nt, Escherichia coli CFT073
caucgacuccagcgcuucgcu

SEQ ID NO: 2633462 - RNA, 20 nt, Escherichia coli CFT073
caucgagcagcauaauugcc

SEQ ID NO: 2633463 - RNA, 18 nt, Escherichia coli CFT073
caucgauuuacugccaau

SEQ ID NO: 2633464 - RNA, 19 nt, Escherichia coli CFT073
caucgcaaaggacaucccg

SEQ ID NO: 2633465 - RNA, 21 nt, Escherichia coli CFT073
caucgcaacgcaucuuuuuca

SEQ ID NO: 2633466 - RNA, 21 nt, Escherichia coli CFT073
caucgcaccaaacgggcaagc

SEQ ID NO: 2633467 - RNA, 15 nt, Escherichia coli CFT073
caucgcaucaaaguu

SEQ ID NO: 2633468 - RNA, 17 nt, Escherichia coli CFT073
caucgcaucguacauca

SEQ ID NO: 2633469 - RNA, 15 nt, Escherichia coli CFT073
caucgcaucuucgcc

SEQ ID NO: 2633470 - RNA, 15 nt, Escherichia coli CFT073
caucgcaugacgcaa

SEQ ID NO: 2633471 - RNA, 15 nt, Escherichia coli CFT073
caucgcaugccagcg

SEQ ID NO: 2633472 - RNA, 20 nt, Escherichia coli CFT073
caucgcaugccagcgccccu

SEQ ID NO: 2633473 - RNA, 14 nt, Escherichia coli CFT073
caucgccaaacagg

SEQ ID NO: 2633474 - RNA, 13 nt, Escherichia coli CFT073
caucgccaccgcg

SEQ ID NO: 2633475 - RNA, 22 nt, Escherichia coli CFT073
caucgccacugcaaauuuuaac

SEQ ID NO: 2633476 - RNA, 23 nt, Escherichia coli CFT073
caucgccagaacuacccgguucg

SEQ ID NO: 2633477 - RNA, 17 nt, Escherichia coli CFT073
caucgccagagaagaaa

SEQ ID NO: 2633478 - RNA, 13 nt, Escherichia coli CFT073
caucgccagcagc

SEQ ID NO: 2633479 - RNA, 15 nt, Escherichia coli CFT073
caucgccagcagcca

SEQ ID NO: 2633480 - RNA, 16 nt, Escherichia coli CFT073
caucgccagcgcggcg

SEQ ID NO: 2633481 - RNA, 18 nt, Escherichia coli CFT073
caucgccauaaacaccag

SEQ ID NO: 2633482 - RNA, 22 nt, Escherichia coli CFT073
caucgccauaaacaccagcagc

SEQ ID NO: 2633483 - RNA, 21 nt, Escherichia coli CFT073
caucgccauauuggggaugac

SEQ ID NO: 2633484 - RNA, 17 nt, Escherichia coli CFT073
caucgccauuaccacca

SEQ ID NO: 2633485 - RNA, 15 nt, Escherichia coli CFT073
caucgccauuuucug

SEQ ID NO: 2633486 - RNA, 15 nt, Escherichia coli CFT073
caucgcccagccauc

SEQ ID NO: 2633487 - RNA, 18 nt, Escherichia coli CFT073
caucgcccgcaacaaacu

SEQ ID NO: 2633488 - RNA, 23 nt, Escherichia coli CFT073
caucgccgcacuauuuaccgcca

SEQ ID NO: 2633489 - RNA, 14 nt, Escherichia coli CFT073
caucgccgccaaac

SEQ ID NO: 2633490 - RNA, 17 nt, Escherichia coli CFT073
caucgccgguuuugcca

SEQ ID NO: 2633491 - RNA, 19 nt, Escherichia coli CFT073
caucgccugaucgcgcagu

SEQ ID NO: 2633492 - RNA, 21 nt, Escherichia coli CFT073
caucgccugaucgcgcaguaa

SEQ ID NO: 2633493 - RNA, 17 nt, Escherichia coli CFT073
caucgccuucaucugca

SEQ ID NO: 2633494 - RNA, 21 nt, Escherichia coli CFT073
caucgccuucgcaaaaaacca

SEQ ID NO: 2633495 - RNA, 22 nt, Escherichia coli CFT073
caucgccuucgcaaaaaaccau

SEQ ID NO: 2633496 - RNA, 14 nt, Escherichia coli CFT073
caucgccuucuuga

SEQ ID NO: 2633497 - RNA, 20 nt, Escherichia coli CFT073
caucgcgaggaaugacggau

SEQ ID NO: 2633498 - RNA, 14 nt, Escherichia coli CFT073
caucgcgauccacg

SEQ ID NO: 2633499 - RNA, 13 nt, Escherichia coli CFT073
caucgcgcacaug

SEQ ID NO: 2633500 - RNA, 15 nt, Escherichia coli CFT073
caucgcgcaccagcg

SEQ ID NO: 2633501 - RNA, 13 nt, Escherichia coli CFT073
caucgcgccaaac

SEQ ID NO: 2633502 - RNA, 16 nt, Escherichia coli CFT073
caucgcgcccgccgcc

SEQ ID NO: 2633503 - RNA, 18 nt, Escherichia coli CFT073
caucgcgcccgccgccau

SEQ ID NO: 2633504 - RNA, 18 nt, Escherichia coli CFT073
caucgcggcacacagcac

SEQ ID NO: 2633505 - RNA, 16 nt, Escherichia coli CFT073
caucgcggucagcugc

SEQ ID NO: 2633506 - RNA, 15 nt, Escherichia coli CFT073
caucgcgguuaugcc

SEQ ID NO: 2633507 - RNA, 20 nt, Escherichia coli CFT073
caucgcgguuaugccgccga

SEQ ID NO: 2633508 - RNA, 18 nt, Escherichia coli CFT073
caucgcgucaucgucaca

SEQ ID NO: 2633509 - RNA, 15 nt, Escherichia coli CFT073
caucgcuacaccaau

SEQ ID NO: 2633510 - RNA, 18 nt, Escherichia coli CFT073
caucgcuagauauauauu

SEQ ID NO: 2633511 - RNA, 17 nt, Escherichia coli CFT073
caucgcucccaaaccgc

SEQ ID NO: 2633512 - RNA, 15 nt, Escherichia coli CFT073
caucgcugugcugcu

SEQ ID NO: 2633513 - RNA, 18 nt, Escherichia coli CFT073
caucgcuuaguuaaacca

SEQ ID NO: 2633514 - RNA, 13 nt, Escherichia coli CFT073
caucgcuucaugc

SEQ ID NO: 2633515 - RNA, 21 nt, Escherichia coli CFT073
caucgcuucaugcccgccgac

SEQ ID NO: 2633516 - RNA, 20 nt, Escherichia coli CFT073
caucgcuuuccagguggugc

SEQ ID NO: 2633517 - RNA, 20 nt, Escherichia coli CFT073
caucgcuuugugcucuuccu

SEQ ID NO: 2633518 - RNA, 15 nt, Escherichia coli CFT073
caucggaaugcacag

SEQ ID NO: 2633519 - RNA, 18 nt, Escherichia coli CFT073
caucggcaaaggcgugaa

SEQ ID NO: 2633520 - RNA, 17 nt, Escherichia coli CFT073
caucggcaacgccagcg

SEQ ID NO: 2633521 - RNA, 15 nt, Escherichia coli CFT073
caucggcaccgccag

SEQ ID NO: 2633522 - RNA, 16 nt, Escherichia coli CFT073
caucggcaccgccagc

SEQ ID NO: 2633523 - RNA, 16 nt, Escherichia coli CFT073
caucggcagcgccaau

SEQ ID NO: 2633524 - RNA, 15 nt, Escherichia coli CFT073
caucggcauacagcg

SEQ ID NO: 2633525 - RNA, 15 nt, Escherichia coli CFT073
caucggcauuaaucu

SEQ ID NO: 2633526 - RNA, 24 nt, Escherichia coli CFT073
caucggcauuaaucugcucggcga

SEQ ID NO: 2633527 - RNA, 13 nt, Escherichia coli CFT073
caucggcgucggu

SEQ ID NO: 2633528 - RNA, 15 nt, Escherichia coli CFT073
caucggcgucgguuu

SEQ ID NO: 2633529 - RNA, 22 nt, Escherichia coli CFT073
caucggcugcgcuucuuccagc

SEQ ID NO: 2633530 - RNA, 19 nt, Escherichia coli CFT073
caucggcuggccuuccggc

SEQ ID NO: 2633531 - RNA, 23 nt, Escherichia coli CFT073
caucggcuuuggcaaauggcgcu

SEQ ID NO: 2633532 - RNA, 15 nt, Escherichia coli CFT073
caucgggauaucgcc

SEQ ID NO: 2633533 - RNA, 14 nt, Escherichia coli CFT073
caucgggcaauggc

SEQ ID NO: 2633534 - RNA, 15 nt, Escherichia coli CFT073
caucgggcaucgcaa

SEQ ID NO: 2633535 - RNA, 16 nt, Escherichia coli CFT073
caucggggaauugugc

SEQ ID NO: 2633536 - RNA, 17 nt, Escherichia coli CFT073
caucggggaauugugcu

SEQ ID NO: 2633537 - RNA, 20 nt, Escherichia coli CFT073
caucggggcugaugaaguug

SEQ ID NO: 2633538 - RNA, 16 nt, Escherichia coli CFT073
caucgguacacauucg

SEQ ID NO: 2633539 - RNA, 19 nt, Escherichia coli CFT073
caucgguacacauucgcgg

SEQ ID NO: 2633540 - RNA, 15 nt, Escherichia coli CFT073
caucgguagcaccag

SEQ ID NO: 2633541 - RNA, 22 nt, Escherichia coli CFT073
caucgguaucaucccagccaau

SEQ ID NO: 2633542 - RNA, 20 nt, Escherichia coli CFT073
caucgguaucgaauaaagau

SEQ ID NO: 2633543 - RNA, 21 nt, Escherichia coli CFT073
caucgguuguuuucaguagca

SEQ ID NO: 2633544 - RNA, 19 nt, Escherichia coli CFT073
caucguagacauaaccggu

SEQ ID NO: 2633545 - RNA, 21 nt, Escherichia coli CFT073
caucguaguuuuugcccauca

SEQ ID NO: 2633546 - RNA, 18 nt, Escherichia coli CFT073
caugacacacucugaccu

SEQ ID NO: 2633547 - RNA, 22 nt, Escherichia coli CFT073
caugacagcgcccgacaagauc

SEQ ID NO: 2633548 - RNA, 16 nt, Escherichia coli CFT073
caugacaggcaaccgg

SEQ ID NO: 2633549 - RNA, 14 nt, Escherichia coli CFT073
caugacauccccau

SEQ ID NO: 2633550 - RNA, 15 nt, Escherichia coli CFT073
caugacaucuccagc

SEQ ID NO: 2633551 - RNA, 14 nt, Escherichia coli CFT073
caugaccaccgcag

SEQ ID NO: 2633552 - RNA, 16 nt, Escherichia coli CFT073
caugaccgaucaaggc

SEQ ID NO: 2633553 - RNA, 18 nt, Escherichia coli CFT073
caugaccgcuccgccauc

SEQ ID NO: 2633554 - RNA, 22 nt, Escherichia coli CFT073
caugaccgcuccgccaucuucu

SEQ ID NO: 2633555 - RNA, 23 nt, Escherichia coli CFT073
caugaccgugaucguggccauga

SEQ ID NO: 2633556 - RNA, 17 nt, Escherichia coli CFT073
caugaccguuugccccg

SEQ ID NO: 2633557 - RNA, 23 nt, Escherichia coli CFT073
caugacgcaacaacacaccacca

SEQ ID NO: 2633558 - RNA, 17 nt, Escherichia coli CFT073
caugacgcacuuucgcu

SEQ ID NO: 2633559 - RNA, 19 nt, Escherichia coli CFT073
caugacgcacuuucgcuuu

SEQ ID NO: 2633560 - RNA, 19 nt, Escherichia coli CFT073
caugacgcgcaucacgaca

SEQ ID NO: 2633561 - RNA, 20 nt, Escherichia coli CFT073
caugaguaacagucaguuau

SEQ ID NO: 2633562 - RNA, 12 nt, Escherichia coli CFT073
caugaguaauuu

SEQ ID NO: 2633563 - RNA, 20 nt, Escherichia coli CFT073
caugaguuggauaauugcgu

SEQ ID NO: 2633564 - RNA, 14 nt, Escherichia coli CFT073
caugauaaauaaua

SEQ ID NO: 2633565 - RNA, 19 nt, Escherichia coli CFT073
caugauaagacgcguggcg

SEQ ID NO: 2633566 - RNA, 20 nt, Escherichia coli CFT073
caugauaagacgcguggcgu

SEQ ID NO: 2633567 - RNA, 15 nt, Escherichia coli CFT073
caugauaccgauuac

SEQ ID NO: 2633568 - RNA, 15 nt, Escherichia coli CFT073
caugauacucagcac

SEQ ID NO: 2633569 - RNA, 15 nt, Escherichia coli CFT073
caugaucgaagcaaa

SEQ ID NO: 2633570 - RNA, 15 nt, Escherichia coli CFT073
caugaucguuaaauc

SEQ ID NO: 2633571 - RNA, 13 nt, Escherichia coli CFT073
caugaucugcaaa

SEQ ID NO: 2633572 - RNA, 22 nt, Escherichia coli CFT073
caugaucugugugguuuuguag

SEQ ID NO: 2633573 - RNA, 18 nt, Escherichia coli CFT073
caugaugacaacauagcu

SEQ ID NO: 2633574 - RNA, 17 nt, Escherichia coli CFT073
caugaugacgcguaacg

SEQ ID NO: 2633575 - RNA, 22 nt, Escherichia coli CFT073
caugaugacuugccuccagcga

SEQ ID NO: 2633576 - RNA, 14 nt, Escherichia coli CFT073
caugaugaggccga

SEQ ID NO: 2633577 - RNA, 16 nt, Escherichia coli CFT073
caugaugaggccgaua

SEQ ID NO: 2633578 - RNA, 22 nt, Escherichia coli CFT073
caugaugcuccgccagcgccac

SEQ ID NO: 2633579 - RNA, 13 nt, Escherichia coli CFT073
caugauguccugc

SEQ ID NO: 2633580 - RNA, 17 nt, Escherichia coli CFT073
caugauuaucaugcccu

SEQ ID NO: 2633581 - RNA, 14 nt, Escherichia coli CFT073
caugauucauccgu

SEQ ID NO: 2633582 - RNA, 18 nt, Escherichia coli CFT073
caugauuguauggaaugc

SEQ ID NO: 2633583 - RNA, 12 nt, Escherichia coli CFT073
caugauuucugc

SEQ ID NO: 2633584 - RNA, 15 nt, Escherichia coli CFT073
caugcaacacaagcc

SEQ ID NO: 2633585 - RNA, 16 nt, Escherichia coli CFT073
caugcaacuugaagua

SEQ ID NO: 2633586 - RNA, 16 nt, Escherichia coli CFT073
caugcaaggaaaaacu

SEQ ID NO: 2633587 - RNA, 20 nt, Escherichia coli CFT073
caugcacggacgcuuguuau

SEQ ID NO: 2633588 - RNA, 14 nt, Escherichia coli CFT073
caugcagcaugggu

SEQ ID NO: 2633589 - RNA, 22 nt, Escherichia coli CFT073
caugcagcauggguaaagccca

SEQ ID NO: 2633590 - RNA, 17 nt, Escherichia coli CFT073
caugcaggcaugcaaua

SEQ ID NO: 2633591 - RNA, 19 nt, Escherichia coli CFT073
caugcaggcaugcaauauu

SEQ ID NO: 2633592 - RNA, 23 nt, Escherichia coli CFT073
caugcagggcaaacuccgagaga

SEQ ID NO: 2633593 - RNA, 22 nt, Escherichia coli CFT073
caugcaggucguuuuccugcau

SEQ ID NO: 2633594 - RNA, 16 nt, Escherichia coli CFT073
caugcaguaccagaua

SEQ ID NO: 2633595 - RNA, 13 nt, Escherichia coli CFT073
caugcauauaaga

SEQ ID NO: 2633596 - RNA, 16 nt, Escherichia coli CFT073
caugcaucgguuuugc

SEQ ID NO: 2633597 - RNA, 17 nt, Escherichia coli CFT073
caugccagaaaaggagu

SEQ ID NO: 2633598 - RNA, 18 nt, Escherichia coli CFT073
caugccagugaugggcag

SEQ ID NO: 2633599 - RNA, 17 nt, Escherichia coli CFT073
caugccaguuucuuuua

SEQ ID NO: 2633600 - RNA, 15 nt, Escherichia coli CFT073
caugccauccgcauc

SEQ ID NO: 2633601 - RNA, 14 nt, Escherichia coli CFT073
caugccaucgacga

SEQ ID NO: 2633602 - RNA, 16 nt, Escherichia coli CFT073
caugccaucugccagc

SEQ ID NO: 2633603 - RNA, 21 nt, Escherichia coli CFT073
caugccccauggacaugcgca

SEQ ID NO: 2633604 - RNA, 16 nt, Escherichia coli CFT073
caugcccggagagauc

SEQ ID NO: 2633605 - RNA, 16 nt, Escherichia coli CFT073
caugccgacaaacagc

SEQ ID NO: 2633606 - RNA, 15 nt, Escherichia coli CFT073
caugccgaugccgac

SEQ ID NO: 2633607 - RNA, 18 nt, Escherichia coli CFT073
caugccgaugccgacgau

SEQ ID NO: 2633608 - RNA, 16 nt, Escherichia coli CFT073
caugccgccaccacca

SEQ ID NO: 2633609 - RNA, 17 nt, Escherichia coli CFT073
caugccgccaccaccag

SEQ ID NO: 2633610 - RNA, 20 nt, Escherichia coli CFT073
caugccgccaccaccagcgc

SEQ ID NO: 2633611 - RNA, 17 nt, Escherichia coli CFT073
caugccggccagcgcca

SEQ ID NO: 2633612 - RNA, 17 nt, Escherichia coli CFT073
caugccuaaagugcugg

SEQ ID NO: 2633613 - RNA, 17 nt, Escherichia coli CFT073
caugccugcauaaagga

SEQ ID NO: 2633614 - RNA, 16 nt, Escherichia coli CFT073
caugcgaauacagccc

SEQ ID NO: 2633615 - RNA, 13 nt, Escherichia coli CFT073
caugcgaucccau

SEQ ID NO: 2633616 - RNA, 21 nt, Escherichia coli CFT073
caugcgcaccuuuaccacucc

SEQ ID NO: 2633617 - RNA, 14 nt, Escherichia coli CFT073
caugcgcauaagac

SEQ ID NO: 2633618 - RNA, 16 nt, Escherichia coli CFT073
caugcgcauaagaccg

SEQ ID NO: 2633619 - RNA, 14 nt, Escherichia coli CFT073
caugcgcgccggac

SEQ ID NO: 2633620 - RNA, 22 nt, Escherichia coli CFT073
caugcgcugcgcuuaucaggcc

SEQ ID NO: 2633621 - RNA, 17 nt, Escherichia coli CFT073
caugcggcgugccuuca

SEQ ID NO: 2633622 - RNA, 20 nt, Escherichia coli CFT073
caugcgggucgagaaaaucg

SEQ ID NO: 2633623 - RNA, 15 nt, Escherichia coli CFT073
caugcguuaucgcca

SEQ ID NO: 2633624 - RNA, 13 nt, Escherichia coli CFT073
caugcuaaaaauc

SEQ ID NO: 2633625 - RNA, 16 nt, Escherichia coli CFT073
caugcuaaugguugca

SEQ ID NO: 2633626 - RNA, 14 nt, Escherichia coli CFT073
caugcuaugcgcca

SEQ ID NO: 2633627 - RNA, 14 nt, Escherichia coli CFT073
caugcuauuacgcc

SEQ ID NO: 2633628 - RNA, 13 nt, Escherichia coli CFT073
caugcucaccaau

SEQ ID NO: 2633629 - RNA, 14 nt, Escherichia coli CFT073
caugcucaccaauc

SEQ ID NO: 2633630 - RNA, 12 nt, Escherichia coli CFT073
caugcuccgcac

SEQ ID NO: 2633631 - RNA, 17 nt, Escherichia coli CFT073
caugcugacugcgcucu

SEQ ID NO: 2633632 - RNA, 20 nt, Escherichia coli CFT073
caugcugagcuucuucaaaa

SEQ ID NO: 2633633 - RNA, 20 nt, Escherichia coli CFT073
caugcugaugcuacccauau

SEQ ID NO: 2633634 - RNA, 19 nt, Escherichia coli CFT073
caugcugcggcuguccggc

SEQ ID NO: 2633635 - RNA, 16 nt, Escherichia coli CFT073
caugcuggaaccacag

SEQ ID NO: 2633636 - RNA, 17 nt, Escherichia coli CFT073
caugcuggaaccacagc

SEQ ID NO: 2633637 - RNA, 19 nt, Escherichia coli CFT073
caugcuggaaccacagcgc

SEQ ID NO: 2633638 - RNA, 18 nt, Escherichia coli CFT073
caugcuguagugaauugc

SEQ ID NO: 2633639 - RNA, 16 nt, Escherichia coli CFT073
caugcuuaaauauuuu

SEQ ID NO: 2633640 - RNA, 12 nt, Escherichia coli CFT073
caugcuucugca

SEQ ID NO: 2633641 - RNA, 23 nt, Escherichia coli CFT073
caugcuucugcacgcuugccugu

SEQ ID NO: 2633642 - RNA, 19 nt, Escherichia coli CFT073
cauggaauagaaucaccgc

SEQ ID NO: 2633643 - RNA, 13 nt, Escherichia coli CFT073
cauggcagccagg

SEQ ID NO: 2633644 - RNA, 17 nt, Escherichia coli CFT073
cauggcauccuguuuuc

SEQ ID NO: 2633645 - RNA, 22 nt, Escherichia coli CFT073
cauggcauuaaauucagcaaau

SEQ ID NO: 2633646 - RNA, 13 nt, Escherichia coli CFT073
cauggcauuuucu

SEQ ID NO: 2633647 - RNA, 15 nt, Escherichia coli CFT073
cauggccgcaagagu

SEQ ID NO: 2633648 - RNA, 15 nt, Escherichia coli CFT073
cauggcggauccguu

SEQ ID NO: 2633649 - RNA, 18 nt, Escherichia coli CFT073
cauggcggcagcgugcca

SEQ ID NO: 2633650 - RNA, 12 nt, Escherichia coli CFT073
cauggcgugaca

SEQ ID NO: 2633651 - RNA, 17 nt, Escherichia coli CFT073
cauggcgugacauggcg

SEQ ID NO: 2633652 - RNA, 17 nt, Escherichia coli CFT073
cauggcguuuuucccaa

SEQ ID NO: 2633653 - RNA, 17 nt, Escherichia coli CFT073
caugggcauccacagua

SEQ ID NO: 2633654 - RNA, 15 nt, Escherichia coli CFT073
cauggggagacccca

SEQ ID NO: 2633655 - RNA, 15 nt, Escherichia coli CFT073
cauuauccuuuaucu

SEQ ID NO: 2633656 - RNA, 16 nt, Escherichia coli CFT073
cauuauccuuuaucug

SEQ ID NO: 2633657 - RNA, 19 nt, Escherichia coli CFT073
cauuauccuuuaucugccc

SEQ ID NO: 2633658 - RNA, 13 nt, Escherichia coli CFT073
cauuaucgauccu

SEQ ID NO: 2633659 - RNA, 16 nt, Escherichia coli CFT073
cauuaucuucuuucuc

SEQ ID NO: 2633660 - RNA, 23 nt, Escherichia coli CFT073
cauuaugcuggaaucaauaauua

SEQ ID NO: 2633661 - RNA, 22 nt, Escherichia coli CFT073
cauuauggcgcaguugccggau

SEQ ID NO: 2633662 - RNA, 23 nt, Escherichia coli CFT073
cauuauggcgcaguugccggaug

SEQ ID NO: 2633663 - RNA, 19 nt, Escherichia coli CFT073
cauuauucauuuuucgcua

SEQ ID NO: 2633664 - RNA, 16 nt, Escherichia coli CFT073
cauuauuuuugcuaua

SEQ ID NO: 2633665 - RNA, 19 nt, Escherichia coli CFT073
cauucaacuuaagucucca

SEQ ID NO: 2633666 - RNA, 15 nt, Escherichia coli CFT073
cauucaaugauuuaa

SEQ ID NO: 2633667 - RNA, 19 nt, Escherichia coli CFT073
cauucaccagcccacaugc

SEQ ID NO: 2633668 - RNA, 13 nt, Escherichia coli CFT073
cauucagaauaau

SEQ ID NO: 2633669 - RNA, 19 nt, Escherichia coli CFT073
cauucagacacgccgccag

SEQ ID NO: 2633670 - RNA, 23 nt, Escherichia coli CFT073
cauucagacacgccgccagacca

SEQ ID NO: 2633671 - RNA, 15 nt, Escherichia coli CFT073
cauucagacaggcga

SEQ ID NO: 2633672 - RNA, 15 nt, Escherichia coli CFT073
cauucagauucaaau

SEQ ID NO: 2633673 - RNA, 16 nt, Escherichia coli CFT073
cauucagauucaaauc

SEQ ID NO: 2633674 - RNA, 22 nt, Escherichia coli CFT073
cauucagcaauaacuccccuuc

SEQ ID NO: 2633675 - RNA, 10 nt, Escherichia coli CFT073
cauucaggcc

SEQ ID NO: 2633676 - RNA, 21 nt, Escherichia coli CFT073
cauucaggcguaacaguaguu

SEQ ID NO: 2633677 - RNA, 20 nt, Escherichia coli CFT073
cauucauauacucgcauaau

SEQ ID NO: 2633678 - RNA, 18 nt, Escherichia coli CFT073
cauucaucacgcacugca

SEQ ID NO: 2633679 - RNA, 15 nt, Escherichia coli CFT073
cauucaucgccaccg

SEQ ID NO: 2633680 - RNA, 22 nt, Escherichia coli CFT073
cauucaucgccaccgcgggcaa

SEQ ID NO: 2633681 - RNA, 20 nt, Escherichia coli CFT073
cauucaugcgaauacagccc

SEQ ID NO: 2633682 - RNA, 13 nt, Escherichia coli CFT073
cauucauucagau

SEQ ID NO: 2633683 - RNA, 15 nt, Escherichia coli CFT073
cauucauucagauuc

SEQ ID NO: 2633684 - RNA, 18 nt, Escherichia coli CFT073
cauuccaccauacagacc

SEQ ID NO: 2633685 - RNA, 19 nt, Escherichia coli CFT073
cauuccagccagaaaucac

SEQ ID NO: 2633686 - RNA, 21 nt, Escherichia coli CFT073
cauuccaguccacaucaacca

SEQ ID NO: 2633687 - RNA, 16 nt, Escherichia coli CFT073
cauuccagucugcuga

SEQ ID NO: 2633688 - RNA, 23 nt, Escherichia coli CFT073
cauucccagcccccuguguugau

SEQ ID NO: 2633689 - RNA, 22 nt, Escherichia coli CFT073
cauuccccggagcccuacaaac

SEQ ID NO: 2633690 - RNA, 20 nt, Escherichia coli CFT073
cauucccgguuucaggauga

SEQ ID NO: 2633691 - RNA, 16 nt, Escherichia coli CFT073
cauucccuacgcgaua

SEQ ID NO: 2633692 - RNA, 18 nt, Escherichia coli CFT073
cauucccuacgcgauaaa

SEQ ID NO: 2633693 - RNA, 13 nt, Escherichia coli CFT073
cauucccugcagu

SEQ ID NO: 2633694 - RNA, 21 nt, Escherichia coli CFT073
cauuccgcccagaccgugcgc

SEQ ID NO: 2633695 - RNA, 12 nt, Escherichia coli CFT073
cauuccgccgcc

SEQ ID NO: 2633696 - RNA, 14 nt, Escherichia coli CFT073
cauuccgccgccca

SEQ ID NO: 2633697 - RNA, 15 nt, Escherichia coli CFT073
cauuccuugaaaucg

SEQ ID NO: 2633698 - RNA, 14 nt, Escherichia coli CFT073
cauuccuuuacuua

SEQ ID NO: 2633699 - RNA, 14 nt, Escherichia coli CFT073
cauucgcaauacau

SEQ ID NO: 2633700 - RNA, 21 nt, Escherichia coli CFT073
cauucgcagcugcaguaccag

SEQ ID NO: 2633701 - RNA, 14 nt, Escherichia coli CFT073
cauucgcccgccga

SEQ ID NO: 2633702 - RNA, 16 nt, Escherichia coli CFT073
cauucgccguccagga

SEQ ID NO: 2633703 - RNA, 18 nt, Escherichia coli CFT073
cauucgccguuaccagca

SEQ ID NO: 2633704 - RNA, 19 nt, Escherichia coli CFT073
cauucgccguuaccagcac

SEQ ID NO: 2633705 - RNA, 21 nt, Escherichia coli CFT073
cauucgccguuaccagcaccg

SEQ ID NO: 2633706 - RNA, 23 nt, Escherichia coli CFT073
cauucgcgcacggugcaucuuca

SEQ ID NO: 2633707 - RNA, 18 nt, Escherichia coli CFT073
cauucggcauugaauaua

SEQ ID NO: 2633708 - RNA, 20 nt, Escherichia coli CFT073
cauucggcguuaacaauaac

SEQ ID NO: 2633709 - RNA, 23 nt, Escherichia coli CFT073
cauucguaaugaauguuuuccug

SEQ ID NO: 2633710 - RNA, 17 nt, Escherichia coli CFT073
cauucucaccuacagcc

SEQ ID NO: 2633711 - RNA, 12 nt, Escherichia coli CFT073
cauucuccggca

SEQ ID NO: 2633712 - RNA, 22 nt, Escherichia coli CFT073
cauucucgcuacccaugaagaa

SEQ ID NO: 2633713 - RNA, 18 nt, Escherichia coli CFT073
cauucucgucuugcguuu

SEQ ID NO: 2633714 - RNA, 22 nt, Escherichia coli CFT073
cauucugcgcugacucuacuga

SEQ ID NO: 2633715 - RNA, 20 nt, Escherichia coli CFT073
cauucuugcgcggauggccu

SEQ ID NO: 2633716 - RNA, 13 nt, Escherichia coli CFT073
cauucuuucccag

SEQ ID NO: 2633717 - RNA, 16 nt, Escherichia coli CFT073
cauucuuucccagcag

SEQ ID NO: 2633718 - RNA, 22 nt, Escherichia coli CFT073
cauucuuucuucccguuuucag

SEQ ID NO: 2633719 - RNA, 13 nt, Escherichia coli CFT073
cauugaaaucaaa

SEQ ID NO: 2633720 - RNA, 18 nt, Escherichia coli CFT073
cauugaaggcaauugcau

SEQ ID NO: 2633721 - RNA, 15 nt, Escherichia coli CFT073
cauugaauuaaaaug

SEQ ID NO: 2633722 - RNA, 19 nt, Escherichia coli CFT073
cauugaauuaaaaugugua

SEQ ID NO: 2633723 - RNA, 22 nt, Escherichia coli CFT073
cauugaauuuaauugguuuugc

SEQ ID NO: 2633724 - RNA, 23 nt, Escherichia coli CFT073
cauugacagaccguugcucagaa

SEQ ID NO: 2633725 - RNA, 13 nt, Escherichia coli CFT073
cauugacaguaaa

SEQ ID NO: 2633726 - RNA, 17 nt, Escherichia coli CFT073
cauugacaguaaagaua

SEQ ID NO: 2633727 - RNA, 19 nt, Escherichia coli CFT073
cauugacgguuuccacuuc

SEQ ID NO: 2633728 - RNA, 15 nt, Escherichia coli CFT073
cauugaguagccucu

SEQ ID NO: 2633729 - RNA, 18 nt, Escherichia coli CFT073
cauugaguagccucugcg

SEQ ID NO: 2633730 - RNA, 21 nt, Escherichia coli CFT073
cauugaguuguggggcaugau

SEQ ID NO: 2633731 - RNA, 21 nt, Escherichia coli CFT073
cauugaucgauaagccagcaa

SEQ ID NO: 2633732 - RNA, 12 nt, Escherichia coli CFT073
cauugaugaacg

SEQ ID NO: 2633733 - RNA, 18 nt, Escherichia coli CFT073
cauugaugagaacaucau

SEQ ID NO: 2633734 - RNA, 16 nt, Escherichia coli CFT073
cauugauggcgcuuuc

SEQ ID NO: 2633735 - RNA, 17 nt, Escherichia coli CFT073
cauugauucgccgccgc

SEQ ID NO: 2633736 - RNA, 22 nt, Escherichia coli CFT073
cauugauucgccgccgcauauc

SEQ ID NO: 2633737 - RNA, 14 nt, Escherichia coli CFT073
cauugauuucuuau

SEQ ID NO: 2633738 - RNA, 16 nt, Escherichia coli CFT073
cauugauuuucaaauc

SEQ ID NO: 2633739 - RNA, 13 nt, Escherichia coli CFT073
cauugccagaaac

SEQ ID NO: 2633740 - RNA, 12 nt, Escherichia coli CFT073
cauugccagcgc

SEQ ID NO: 2633741 - RNA, 21 nt, Escherichia coli CFT073
cauugccauuguuguagguac

SEQ ID NO: 2633742 - RNA, 15 nt, Escherichia coli CFT073
cauugccgccucugc

SEQ ID NO: 2633743 - RNA, 17 nt, Escherichia coli CFT073
cauugccggaagcgcca

SEQ ID NO: 2633744 - RNA, 21 nt, Escherichia coli CFT073
cauugccggaugcgacgcugg

SEQ ID NO: 2633745 - RNA, 21 nt, Escherichia coli CFT073
cauugccgggcgcaucagauc

SEQ ID NO: 2633746 - RNA, 23 nt, Escherichia coli CFT073
cauugccugaugcgacgcugcgc

SEQ ID NO: 2633747 - RNA, 13 nt, Escherichia coli CFT073
cauugccugaugu

SEQ ID NO: 2633748 - RNA, 14 nt, Escherichia coli CFT073
cauugccugcaacg

SEQ ID NO: 2633749 - RNA, 22 nt, Escherichia coli CFT073
cauugccugcaacgaaccaauc

SEQ ID NO: 2633750 - RNA, 11 nt, Escherichia coli CFT073
cauugccuggc

SEQ ID NO: 2633751 - RNA, 20 nt, Escherichia coli CFT073
cauugcgcaaccgcccggcc

SEQ ID NO: 2633752 - RNA, 17 nt, Escherichia coli CFT073
cauugcgccgaacaaca

SEQ ID NO: 2633753 - RNA, 18 nt, Escherichia coli CFT073
cauugcgccgaacaacag

SEQ ID NO: 2633754 - RNA, 20 nt, Escherichia coli CFT073
cauugcgccgaacaacagug

SEQ ID NO: 2633755 - RNA, 15 nt, Escherichia coli CFT073
cauugcuaucaacaa

SEQ ID NO: 2633756 - RNA, 22 nt, Escherichia coli CFT073
cauugcucauuccgccgcccag

SEQ ID NO: 2633757 - RNA, 18 nt, Escherichia coli CFT073
cauugcucuuucacuuua

SEQ ID NO: 2633758 - RNA, 18 nt, Escherichia coli CFT073
cauugcugacauggcaau

SEQ ID NO: 2633759 - RNA, 21 nt, Escherichia coli CFT073
cauugcugcugaagcaacagu

SEQ ID NO: 2633760 - RNA, 22 nt, Escherichia coli CFT073
cauugcuggaugcaugccaacc

SEQ ID NO: 2633761 - RNA, 20 nt, Escherichia coli CFT073
cauugcuggugauugcaaag

SEQ ID NO: 2633762 - RNA, 14 nt, Escherichia coli CFT073
cauuggcaaaacca

SEQ ID NO: 2633763 - RNA, 11 nt, Escherichia coli CFT073
ccaaacugcuc

SEQ ID NO: 2633764 - RNA, 14 nt, Escherichia coli CFT073
ccaaacuggaauag

SEQ ID NO: 2633765 - RNA, 20 nt, Escherichia coli CFT073
ccaaacugguaacuguaggu

SEQ ID NO: 2633766 - RNA, 23 nt, Escherichia coli CFT073
ccaaagaagcguugauccagcgc

SEQ ID NO: 2633767 - RNA, 21 nt, Escherichia coli CFT073
ccaaagaccaggaaacccaac

SEQ ID NO: 2633768 - RNA, 18 nt, Escherichia coli CFT073
ccaaagcaccacuccuca

SEQ ID NO: 2633769 - RNA, 19 nt, Escherichia coli CFT073
ccaaagccccccacguuua

SEQ ID NO: 2633770 - RNA, 16 nt, Escherichia coli CFT073
ccaaagccucaaugcu

SEQ ID NO: 2633771 - RNA, 20 nt, Escherichia coli CFT073
ccaaagcguucagugaucgc

SEQ ID NO: 2633772 - RNA, 15 nt, Escherichia coli CFT073
ccaaagucaucaauu

SEQ ID NO: 2633773 - RNA, 21 nt, Escherichia coli CFT073
ccaaagucaucaauugcaauc

SEQ ID NO: 2633774 - RNA, 19 nt, Escherichia coli CFT073
ccaaagucgauagcuguac

SEQ ID NO: 2633775 - RNA, 21 nt, Escherichia coli CFT073
ccaaaguguaaaaaaucccag

SEQ ID NO: 2633776 - RNA, 21 nt, Escherichia coli CFT073
ccaaaguuuuuaaauaacaua

SEQ ID NO: 2633777 - RNA, 21 nt, Escherichia coli CFT073
ccaaauaaaaaaacgccagaa

SEQ ID NO: 2633778 - RNA, 18 nt, Escherichia coli CFT073
ccaaauagcucaaugaaa

SEQ ID NO: 2633779 - RNA, 12 nt, Escherichia coli CFT073
ccaaauauccgc

SEQ ID NO: 2633780 - RNA, 17 nt, Escherichia coli CFT073
ccaaauauucagccacu

SEQ ID NO: 2633781 - RNA, 17 nt, Escherichia coli CFT073
ccaaaucaaaucauccu

SEQ ID NO: 2633782 - RNA, 16 nt, Escherichia coli CFT073
ccaaaucauaaaaauc

SEQ ID NO: 2633783 - RNA, 17 nt, Escherichia coli CFT073
ccaaauccggcaaauaa

SEQ ID NO: 2633784 - RNA, 17 nt, Escherichia coli CFT073
ccaaaucgucaacguaa

SEQ ID NO: 2633785 - RNA, 15 nt, Escherichia coli CFT073
ccaaaucugauuaau

SEQ ID NO: 2633786 - RNA, 20 nt, Escherichia coli CFT073
ccaaauuuggugcucaguuu

SEQ ID NO: 2633787 - RNA, 17 nt, Escherichia coli CFT073
ccaacaacccugcauca

SEQ ID NO: 2633788 - RNA, 21 nt, Escherichia coli CFT073
ccaacaacccugcaucagaac

SEQ ID NO: 2633789 - RNA, 18 nt, Escherichia coli CFT073
ccaacaagcaccggcacc

SEQ ID NO: 2633790 - RNA, 23 nt, Escherichia coli CFT073
ccaacaagcaccggcaccgaggu

SEQ ID NO: 2633791 - RNA, 19 nt, Escherichia coli CFT073
ccaacaaggcgcuaaaagc

SEQ ID NO: 2633792 - RNA, 17 nt, Escherichia coli CFT073
ccaacaauaaaaagcgg

SEQ ID NO: 2633793 - RNA, 11 nt, Escherichia coli CFT073
ccaacaaucau

SEQ ID NO: 2633794 - RNA, 10 nt, Escherichia coli CFT073
ccaacaccca

SEQ ID NO: 2633795 - RNA, 18 nt, Escherichia coli CFT073
ccaacacccacagccaug

SEQ ID NO: 2633796 - RNA, 16 nt, Escherichia coli CFT073
ccaacagcagccacac

SEQ ID NO: 2633797 - RNA, 20 nt, Escherichia coli CFT073
ccaacagcagccacaccaau

SEQ ID NO: 2633798 - RNA, 15 nt, Escherichia coli CFT073
ccaacagcgacauca

SEQ ID NO: 2633799 - RNA, 12 nt, Escherichia coli CFT073
ccaacaggcgag

SEQ ID NO: 2633800 - RNA, 13 nt, Escherichia coli CFT073
ccaacaggcgaga

SEQ ID NO: 2633801 - RNA, 18 nt, Escherichia coli CFT073
ccaacagugccgaugccg

SEQ ID NO: 2633802 - RNA, 21 nt, Escherichia coli CFT073
ccaacaguugcccaaucgagc

SEQ ID NO: 2633803 - RNA, 22 nt, Escherichia coli CFT073
ccaacauggucaucaucauuaa

SEQ ID NO: 2633804 - RNA, 15 nt, Escherichia coli CFT073
ccaaccacaacccag

SEQ ID NO: 2633805 - RNA, 20 nt, Escherichia coli CFT073
ccaaccacaugaucauucac

SEQ ID NO: 2633806 - RNA, 12 nt, Escherichia coli CFT073
ccaaccaccgga

SEQ ID NO: 2633807 - RNA, 23 nt, Escherichia coli CFT073
ccaaccacggaguugaccagcuc

SEQ ID NO: 2633808 - RNA, 14 nt, Escherichia coli CFT073
ccaaccacugcucu

SEQ ID NO: 2633809 - RNA, 22 nt, Escherichia coli CFT073
ccaaccacuuuacgcaaaauau

SEQ ID NO: 2633810 - RNA, 12 nt, Escherichia coli CFT073
ccaaccagcagg

SEQ ID NO: 2633811 - RNA, 13 nt, Escherichia coli CFT073
ccaaccagcaggu

SEQ ID NO: 2633812 - RNA, 13 nt, Escherichia coli CFT073
ccaaccaucaucc

SEQ ID NO: 2633813 - RNA, 22 nt, Escherichia coli CFT073
ccaaccaugccgcccagcagca

SEQ ID NO: 2633814 - RNA, 22 nt, Escherichia coli CFT073
ccaaccccaauguaaccacagg

SEQ ID NO: 2633815 - RNA, 22 nt, Escherichia coli CFT073
ccaacccuaacccaacauucga

SEQ ID NO: 2633816 - RNA, 23 nt, Escherichia coli CFT073
ccaacccuggugcaauuacgcua

SEQ ID NO: 2633817 - RNA, 21 nt, Escherichia coli CFT073
ccaaccgcaauaaccaucagc

SEQ ID NO: 2633818 - RNA, 22 nt, Escherichia coli CFT073
ccaaccgcaauaaccaucagcu

SEQ ID NO: 2633819 - RNA, 14 nt, Escherichia coli CFT073
ccaacgaaucuuua

SEQ ID NO: 2633820 - RNA, 17 nt, Escherichia coli CFT073
ccaacgacaacaccgau

SEQ ID NO: 2633821 - RNA, 19 nt, Escherichia coli CFT073
ccaacgcagacgcauacug

SEQ ID NO: 2633822 - RNA, 20 nt, Escherichia coli CFT073
ccaacgcauagacagccaca

SEQ ID NO: 2633823 - RNA, 14 nt, Escherichia coli CFT073
ccaacgcgccaccg

SEQ ID NO: 2633824 - RNA, 19 nt, Escherichia coli CFT073
ccaacgcgccaccgaccag

SEQ ID NO: 2633825 - RNA, 21 nt, Escherichia coli CFT073
ccaacgcggcccaacauaauc

SEQ ID NO: 2633826 - RNA, 16 nt, Escherichia coli CFT073
ccaacgcuaaauacug

SEQ ID NO: 2633827 - RNA, 17 nt, Escherichia coli CFT073
ccaacggacgggucgcu

SEQ ID NO: 2633828 - RNA, 13 nt, Escherichia coli CFT073
ccaacggcgagcc

SEQ ID NO: 2633829 - RNA, 16 nt, Escherichia coli CFT073
ccaacggucagcgcac

SEQ ID NO: 2633830 - RNA, 17 nt, Escherichia coli CFT073
ccaacggugaaaaacca

SEQ ID NO: 2633831 - RNA, 18 nt, Escherichia coli CFT073
ccaacggugaaaaaccaa

SEQ ID NO: 2633832 - RNA, 23 nt, Escherichia coli CFT073
ccaacggugaaaaaccaaucucc

SEQ ID NO: 2633833 - RNA, 22 nt, Escherichia coli CFT073
ccaacgucugccugguuucucu

SEQ ID NO: 2633834 - RNA, 23 nt, Escherichia coli CFT073
ccaacgugguuuaccaccagcgg

SEQ ID NO: 2633835 - RNA, 19 nt, Escherichia coli CFT073
ccaacguucguacugcccu

SEQ ID NO: 2633836 - RNA, 21 nt, Escherichia coli CFT073
ccaacguuucuggaaguaauc

SEQ ID NO: 2633837 - RNA, 14 nt, Escherichia coli CFT073
ccaacuccaccaau

SEQ ID NO: 2633838 - RNA, 19 nt, Escherichia coli CFT073
ccaacuccucuuugcugcc

SEQ ID NO: 2633839 - RNA, 12 nt, Escherichia coli CFT073
ccaacucuuuac

SEQ ID NO: 2633840 - RNA, 13 nt, Escherichia coli CFT073
ccaacugaaagaa

SEQ ID NO: 2633841 - RNA, 18 nt, Escherichia coli CFT073
ccaacugauuuucaucuu

SEQ ID NO: 2633842 - RNA, 19 nt, Escherichia coli CFT073
ccaacuggcgcagcaguuc

SEQ ID NO: 2633843 - RNA, 21 nt, Escherichia coli CFT073
ccaacuggcgcagcaguucgc

SEQ ID NO: 2633844 - RNA, 18 nt, Escherichia coli CFT073
ccaacuggguuaacguca

SEQ ID NO: 2633845 - RNA, 15 nt, Escherichia coli CFT073
ccaacuuauuguuuu

SEQ ID NO: 2633846 - RNA, 11 nt, Escherichia coli CFT073
ccaacuucaua

SEQ ID NO: 2633847 - RNA, 16 nt, Escherichia coli CFT073
ccaacuucauacauug

SEQ ID NO: 2633848 - RNA, 13 nt, Escherichia coli CFT073
ccaacuucaugac

SEQ ID NO: 2633849 - RNA, 22 nt, Escherichia coli CFT073
ccaacuucggggagcgauauca

SEQ ID NO: 2633850 - RNA, 15 nt, Escherichia coli CFT073
ccaagaaacaccaga

SEQ ID NO: 2633851 - RNA, 21 nt, Escherichia coli CFT073
ccaagaaagauaguaaccguu

SEQ ID NO: 2633852 - RNA, 18 nt, Escherichia coli CFT073
ccaagaagaacgccgguu

SEQ ID NO: 2633853 - RNA, 20 nt, Escherichia coli CFT073
ccaagacugaguuuuauucu

SEQ ID NO: 2633854 - RNA, 22 nt, Escherichia coli CFT073
ccaagagcaaauuuuccccaga

SEQ ID NO: 2633855 - RNA, 22 nt, Escherichia coli CFT073
ccaagaugcggggauuuucgca

SEQ ID NO: 2633856 - RNA, 13 nt, Escherichia coli CFT073
ccaagccaagcca

SEQ ID NO: 2633857 - RNA, 15 nt, Escherichia coli CFT073
ccaagcgggaauagc

SEQ ID NO: 2633858 - RNA, 17 nt, Escherichia coli CFT073
ccaaggccaagagcaaa

SEQ ID NO: 2633859 - RNA, 15 nt, Escherichia coli CFT073
ccaaggucuccgccc

SEQ ID NO: 2633860 - RNA, 18 nt, Escherichia coli CFT073
ccaaggucuccgcccagc

SEQ ID NO: 2633861 - RNA, 16 nt, Escherichia coli CFT073
ccaaguuuaugcaaua

SEQ ID NO: 2633862 - RNA, 23 nt, Escherichia coli CFT073
ccaaguuuaugcaauagcgccug

SEQ ID NO: 2633863 - RNA, 12 nt, Escherichia coli CFT073
ccaaguuucaau

SEQ ID NO: 2633864 - RNA, 16 nt, Escherichia coli CFT073
ccaaguuucaauaucc

SEQ ID NO: 2633865 - RNA, 21 nt, Escherichia coli CFT073
ccaauaaaacgcaccggcaag

SEQ ID NO: 2633866 - RNA, 20 nt, Escherichia coli CFT073
ccaauaaagaacccggcaau

SEQ ID NO: 2633867 - RNA, 23 nt, Escherichia coli CFT073
ccaauaacucaaguuguaauucc

SEQ ID NO: 2633868 - RNA, 17 nt, Escherichia coli CFT073
ccaauaacucgcacguu

SEQ ID NO: 2633869 - RNA, 22 nt, Escherichia coli CFT073
ccaauaauugagccgauaaagc

SEQ ID NO: 2633870 - RNA, 13 nt, Escherichia coli CFT073
ccaauaccagcau

SEQ ID NO: 2633871 - RNA, 13 nt, Escherichia coli CFT073
ccacaucacacca

SEQ ID NO: 2633872 - RNA, 23 nt, Escherichia coli CFT073
ccacaucacaccauccagcaaca

SEQ ID NO: 2633873 - RNA, 12 nt, Escherichia coli CFT073
ccacaucagcga

SEQ ID NO: 2633874 - RNA, 12 nt, Escherichia coli CFT073
ccacauccagcg

SEQ ID NO: 2633875 - RNA, 14 nt, Escherichia coli CFT073
ccacauccaugcuu

SEQ ID NO: 2633876 - RNA, 18 nt, Escherichia coli CFT073
ccacauccgcgguaucgc

SEQ ID NO: 2633877 - RNA, 21 nt, Escherichia coli CFT073
ccacauccggcauauuaacca

SEQ ID NO: 2633878 - RNA, 14 nt, Escherichia coli CFT073
ccacaucgccauau

SEQ ID NO: 2633879 - RNA, 21 nt, Escherichia coli CFT073
ccacaucgguuugcgcagcuu

SEQ ID NO: 2633880 - RNA, 20 nt, Escherichia coli CFT073
ccacaucucaauccgcuuac

SEQ ID NO: 2633881 - RNA, 20 nt, Escherichia coli CFT073
ccacauggagcuuuaaacac

SEQ ID NO: 2633882 - RNA, 14 nt, Escherichia coli CFT073
ccacauggcgugca

SEQ ID NO: 2633883 - RNA, 15 nt, Escherichia coli CFT073
ccacauguugcgcuu

SEQ ID NO: 2633884 - RNA, 23 nt, Escherichia coli CFT073
ccacauguugcgcuucaccaguu

SEQ ID NO: 2633885 - RNA, 19 nt, Escherichia coli CFT073
ccacauuaacgaaccgcua

SEQ ID NO: 2633886 - RNA, 23 nt, Escherichia coli CFT073
ccacauuagucauuacucaucca

SEQ ID NO: 2633887 - RNA, 16 nt, Escherichia coli CFT073
ccacauugcugcacau

SEQ ID NO: 2633888 - RNA, 15 nt, Escherichia coli CFT073
ccaccaaaacagcga

SEQ ID NO: 2633889 - RNA, 23 nt, Escherichia coli CFT073
ccaccaaaacagcgacaccagcc

SEQ ID NO: 2633890 - RNA, 16 nt, Escherichia coli CFT073
ccaccaaacugcgccc

SEQ ID NO: 2633891 - RNA, 20 nt, Escherichia coli CFT073
ccaccaaauaaaaaaacgcc

SEQ ID NO: 2633892 - RNA, 19 nt, Escherichia coli CFT073
ccaccaaaugcagcaacca

SEQ ID NO: 2633893 - RNA, 21 nt, Escherichia coli CFT073
ccaccaauacuugcgaaucau

SEQ ID NO: 2633894 - RNA, 18 nt, Escherichia coli CFT073
ccaccaauguggaaagcc

SEQ ID NO: 2633895 - RNA, 14 nt, Escherichia coli CFT073
ccaccacaccagac

SEQ ID NO: 2633896 - RNA, 16 nt, Escherichia coli CFT073
ccaccacaccagacca

SEQ ID NO: 2633897 - RNA, 20 nt, Escherichia coli CFT073
ccaccacaccagaccagaca

SEQ ID NO: 2633898 - RNA, 14 nt, Escherichia coli CFT073
ccaccaccaccugc

SEQ ID NO: 2633899 - RNA, 12 nt, Escherichia coli CFT073
ccaccaccagac

SEQ ID NO: 2633900 - RNA, 12 nt, Escherichia coli CFT073
ccaccaccagcg

SEQ ID NO: 2633901 - RNA, 16 nt, Escherichia coli CFT073
ccaccaccagcgcacu

SEQ ID NO: 2633902 - RNA, 18 nt, Escherichia coli CFT073
ccaccaccucuuccagcg

SEQ ID NO: 2633903 - RNA, 16 nt, Escherichia coli CFT073
ccaccacgccaagaaa

SEQ ID NO: 2633904 - RNA, 21 nt, Escherichia coli CFT073
ccaccacgcgggguaaaaccc

SEQ ID NO: 2633905 - RNA, 15 nt, Escherichia coli CFT073
ccaccacucaaaagc

SEQ ID NO: 2633906 - RNA, 18 nt, Escherichia coli CFT073
ccaccacucaaaagcgua

SEQ ID NO: 2633907 - RNA, 21 nt, Escherichia coli CFT073
ccaccacugacaaucgccagu

SEQ ID NO: 2633908 - RNA, 14 nt, Escherichia coli CFT073
ccaccacuuccugc

SEQ ID NO: 2633909 - RNA, 14 nt, Escherichia coli CFT073
ccaccacuucuuuc

SEQ ID NO: 2633910 - RNA, 17 nt, Escherichia coli CFT073
ccaccacuucuuucacg

SEQ ID NO: 2633911 - RNA, 15 nt, Escherichia coli CFT073
ccaccagaaccgccg

SEQ ID NO: 2633912 - RNA, 16 nt, Escherichia coli CFT073
ccaccagacgauggcu

SEQ ID NO: 2633913 - RNA, 17 nt, Escherichia coli CFT073
ccaccagcaaaaacggc

SEQ ID NO: 2633914 - RNA, 22 nt, Escherichia coli CFT073
ccaccagcacaccgucagccag

SEQ ID NO: 2633915 - RNA, 18 nt, Escherichia coli CFT073
ccaccagcaccgcgacaa

SEQ ID NO: 2633916 - RNA, 17 nt, Escherichia coli CFT073
ccaccagcacugauuuu

SEQ ID NO: 2633917 - RNA, 14 nt, Escherichia coli CFT073
ccaccagccaacaa

SEQ ID NO: 2633918 - RNA, 14 nt, Escherichia coli CFT073
ccaccagcgccauu

SEQ ID NO: 2633919 - RNA, 13 nt, Escherichia coli CFT073
ccaccagcgccgc

SEQ ID NO: 2633920 - RNA, 11 nt, Escherichia coli CFT073
ccaccagcggc

SEQ ID NO: 2633921 - RNA, 11 nt, Escherichia coli CFT073
ccaccagcgua

SEQ ID NO: 2633922 - RNA, 22 nt, Escherichia coli CFT073
ccaccaggaaaaagaucagcgg

SEQ ID NO: 2633923 - RNA, 19 nt, Escherichia coli CFT073
ccaccaggaacgcgccaag

SEQ ID NO: 2633924 - RNA, 22 nt, Escherichia coli CFT073
ccaccaggaacucagcgugcca

SEQ ID NO: 2633925 - RNA, 15 nt, Escherichia coli CFT073
ccaccaggccacggc

SEQ ID NO: 2633926 - RNA, 16 nt, Escherichia coli CFT073
ccaccaguacacuggu

SEQ ID NO: 2633927 - RNA, 17 nt, Escherichia coli CFT073
ccaccagugaauaagcg

SEQ ID NO: 2633928 - RNA, 23 nt, Escherichia coli CFT073
ccaccaucaccucucacgacgcu

SEQ ID NO: 2633929 - RNA, 17 nt, Escherichia coli CFT073
ccaccauucgccaagaa

SEQ ID NO: 2633930 - RNA, 13 nt, Escherichia coli CFT073
ccacccaccagcg

SEQ ID NO: 2633931 - RNA, 15 nt, Escherichia coli CFT073
ccacccaccagcgcc

SEQ ID NO: 2633932 - RNA, 18 nt, Escherichia coli CFT073
ccacccaccgcagcccag

SEQ ID NO: 2633933 - RNA, 14 nt, Escherichia coli CFT073
ccaccccacaccag

SEQ ID NO: 2633934 - RNA, 21 nt, Escherichia coli CFT073
ccacccccauaauccaugcca

SEQ ID NO: 2633935 - RNA, 17 nt, Escherichia coli CFT073
ccacccgcagcaagcgu

SEQ ID NO: 2633936 - RNA, 13 nt, Escherichia coli CFT073
ccacccgcagcca

SEQ ID NO: 2633937 - RNA, 14 nt, Escherichia coli CFT073
ccaccgaaacuugc

SEQ ID NO: 2633938 - RNA, 15 nt, Escherichia coli CFT073
ccaccgacaccgcau

SEQ ID NO: 2633939 - RNA, 23 nt, Escherichia coli CFT073
ccaccgaccaggcaaaccaguac

SEQ ID NO: 2633940 - RNA, 22 nt, Escherichia coli CFT073
ccaccgaguaauaacaguaaug

SEQ ID NO: 2633941 - RNA, 14 nt, Escherichia coli CFT073
ccaccgcagcccag

SEQ ID NO: 2633942 - RNA, 16 nt, Escherichia coli CFT073
ccaccgcccagagaau

SEQ ID NO: 2633943 - RNA, 14 nt, Escherichia coli CFT073
ccaccgcgcuaagg

SEQ ID NO: 2633944 - RNA, 17 nt, Escherichia coli CFT073
ccaccggaauacauagc

SEQ ID NO: 2633945 - RNA, 22 nt, Escherichia coli CFT073
ccaccggaauggucaccacaaa

SEQ ID NO: 2633946 - RNA, 19 nt, Escherichia coli CFT073
ccaccggcaagaaugauac

SEQ ID NO: 2633947 - RNA, 18 nt, Escherichia coli CFT073
ccaccggcaaucugcugg

SEQ ID NO: 2633948 - RNA, 16 nt, Escherichia coli CFT073
ccaccgguacaaacau

SEQ ID NO: 2633949 - RNA, 16 nt, Escherichia coli CFT073
ccaccgguuuauuauu

SEQ ID NO: 2633950 - RNA, 21 nt, Escherichia coli CFT073
ccaccguacgccagcgucacu

SEQ ID NO: 2633951 - RNA, 14 nt, Escherichia coli CFT073
ccaccgucaaaucc

SEQ ID NO: 2633952 - RNA, 13 nt, Escherichia coli CFT073
ccaccgucaucac

SEQ ID NO: 2633953 - RNA, 15 nt, Escherichia coli CFT073
ccaccguguauuucu

SEQ ID NO: 2633954 - RNA, 22 nt, Escherichia coli CFT073
ccaccguuuaccucgucaccac

SEQ ID NO: 2633955 - RNA, 14 nt, Escherichia coli CFT073
ccaccuccacgccc

SEQ ID NO: 2633956 - RNA, 15 nt, Escherichia coli CFT073
ccaccuccacgccca

SEQ ID NO: 2633957 - RNA, 22 nt, Escherichia coli CFT073
ccaccuccgcuaaauccgccgc

SEQ ID NO: 2633958 - RNA, 17 nt, Escherichia coli CFT073
ccaccucgcaacaaugu

SEQ ID NO: 2633959 - RNA, 20 nt, Escherichia coli CFT073
ccaccugcgaacuguaauga

SEQ ID NO: 2633960 - RNA, 21 nt, Escherichia coli CFT073
ccaccuugcggaaacugucaa

SEQ ID NO: 2633961 - RNA, 15 nt, Escherichia coli CFT073
ccacgaaucagcacc

SEQ ID NO: 2633962 - RNA, 23 nt, Escherichia coli CFT073
ccacgaccagcgcaaacggcagc

SEQ ID NO: 2633963 - RNA, 19 nt, Escherichia coli CFT073
ccacgagacuuauuaaaga

SEQ ID NO: 2633964 - RNA, 12 nt, Escherichia coli CFT073
ccacgagcggcg

SEQ ID NO: 2633965 - RNA, 13 nt, Escherichia coli CFT073
ccacgagcggcgu

SEQ ID NO: 2633966 - RNA, 20 nt, Escherichia coli CFT073
ccacgaggaucgauaucacc

SEQ ID NO: 2633967 - RNA, 19 nt, Escherichia coli CFT073
ccacgaucccuugcaguug

SEQ ID NO: 2633968 - RNA, 18 nt, Escherichia coli CFT073
ccacgauucagcgucggu

SEQ ID NO: 2633969 - RNA, 20 nt, Escherichia coli CFT073
ccacgcaaagcacgccaggu

SEQ ID NO: 2633970 - RNA, 13 nt, Escherichia coli CFT073
ccacgcaccacca

SEQ ID NO: 2633971 - RNA, 18 nt, Escherichia coli CFT073
ccacgcacgccugcaucu

SEQ ID NO: 2633972 - RNA, 14 nt, Escherichia coli CFT073
ccacgccaaaaagc

SEQ ID NO: 2633973 - RNA, 14 nt, Escherichia coli CFT073
ccacgccaccagcg

SEQ ID NO: 2633974 - RNA, 15 nt, Escherichia coli CFT073
ccacgccacgcugcc

SEQ ID NO: 2633975 - RNA, 20 nt, Escherichia coli CFT073
ccacgccagagauaacccaa

SEQ ID NO: 2633976 - RNA, 14 nt, Escherichia coli CFT073
ccacgcccagcgca

SEQ ID NO: 2633977 - RNA, 16 nt, Escherichia coli CFT073
ccacgccgagagaagc

SEQ ID NO: 2633978 - RNA, 20 nt, Escherichia coli CFT073
ccacgccguuuuuacccagc

SEQ ID NO: 2633979 - RNA, 24 nt, Escherichia coli CFT073
ccacgccguuuuuacccagcagca

SEQ ID NO: 2633980 - RNA, 21 nt, Escherichia coli CFT073
ccagaacgcugccuugcucuu

SEQ ID NO: 2633981 - RNA, 22 nt, Escherichia coli CFT073
ccagaacgcugccuugcucuuc

SEQ ID NO: 2633982 - RNA, 15 nt, Escherichia coli CFT073
ccagaagaaccgcca

SEQ ID NO: 2633983 - RNA, 17 nt, Escherichia coli CFT073
ccagaagaugcguucac

SEQ ID NO: 2633984 - RNA, 14 nt, Escherichia coli CFT073
ccagaagggguaau

SEQ ID NO: 2633985 - RNA, 12 nt, Escherichia coli CFT073
ccagaauacccg

SEQ ID NO: 2633986 - RNA, 23 nt, Escherichia coli CFT073
ccagaauauugccgaagaccaga

SEQ ID NO: 2633987 - RNA, 23 nt, Escherichia coli CFT073
ccagaaucaccggagcugccagc

SEQ ID NO: 2633988 - RNA, 15 nt, Escherichia coli CFT073
ccagaaucaucauau

SEQ ID NO: 2633989 - RNA, 17 nt, Escherichia coli CFT073
ccagaauccccacaaac

SEQ ID NO: 2633990 - RNA, 16 nt, Escherichia coli CFT073
ccagaaucgccaacgc

SEQ ID NO: 2633991 - RNA, 13 nt, Escherichia coli CFT073
ccagaaugcccca

SEQ ID NO: 2633992 - RNA, 19 nt, Escherichia coli CFT073
ccagaauuccgugccagca

SEQ ID NO: 2633993 - RNA, 21 nt, Escherichia coli CFT073
ccagaauuccgugccagcacc

SEQ ID NO: 2633994 - RNA, 23 nt, Escherichia coli CFT073
ccagaauuccgugccagcaccaa

SEQ ID NO: 2633995 - RNA, 15 nt, Escherichia coli CFT073
ccagaauugaccagu

SEQ ID NO: 2633996 - RNA, 17 nt, Escherichia coli CFT073
ccagacaaaccacgccu

SEQ ID NO: 2633997 - RNA, 21 nt, Escherichia coli CFT073
ccagacaacagucaaccgccu

SEQ ID NO: 2633998 - RNA, 16 nt, Escherichia coli CFT073
ccagacaauccagcga

SEQ ID NO: 2633999 - RNA, 21 nt, Escherichia coli CFT073
ccagacaauggcccgccgcau

SEQ ID NO: 2634000 - RNA, 15 nt, Escherichia coli CFT073
ccagacaauuaacac

SEQ ID NO: 2634001 - RNA, 17 nt, Escherichia coli CFT073
ccagacacaacaauacc

SEQ ID NO: 2634002 - RNA, 15 nt, Escherichia coli CFT073
ccagacacaguucuu

SEQ ID NO: 2634003 - RNA, 22 nt, Escherichia coli CFT073
ccagacacaguucuucaaaaau

SEQ ID NO: 2634004 - RNA, 15 nt, Escherichia coli CFT073
ccagacaccgcugcu

SEQ ID NO: 2634005 - RNA, 16 nt, Escherichia coli CFT073
ccagacaccggcuuuc

SEQ ID NO: 2634006 - RNA, 18 nt, Escherichia coli CFT073
ccagacagucgccgcuuc

SEQ ID NO: 2634007 - RNA, 23 nt, Escherichia coli CFT073
ccagacaucaccaguaccgccac

SEQ ID NO: 2634008 - RNA, 21 nt, Escherichia coli CFT073
ccagacauuacaaaauacaaa

SEQ ID NO: 2634009 - RNA, 17 nt, Escherichia coli CFT073
ccagaccaaacauacga

SEQ ID NO: 2634010 - RNA, 14 nt, Escherichia coli CFT073
ccagaccaauagaa

SEQ ID NO: 2634011 - RNA, 23 nt, Escherichia coli CFT073
ccagaccaauugccgcaccaacc

SEQ ID NO: 2634012 - RNA, 15 nt, Escherichia coli CFT073
ccagaccacagguaa

SEQ ID NO: 2634013 - RNA, 16 nt, Escherichia coli CFT073
ccagaccagcaauaaa

SEQ ID NO: 2634014 - RNA, 22 nt, Escherichia coli CFT073
ccagaccagcuaccacgccgau

SEQ ID NO: 2634015 - RNA, 15 nt, Escherichia coli CFT073
ccagacccagcuuca

SEQ ID NO: 2634016 - RNA, 15 nt, Escherichia coli CFT073
ccagacccggcaagc

SEQ ID NO: 2634017 - RNA, 20 nt, Escherichia coli CFT073
ccagacccgguuuauuuauu

SEQ ID NO: 2634018 - RNA, 15 nt, Escherichia coli CFT073
ccagaccgaacagca

SEQ ID NO: 2634019 - RNA, 13 nt, Escherichia coli CFT073
ccagaccgccuuu

SEQ ID NO: 2634020 - RNA, 19 nt, Escherichia coli CFT073
ccagaccgcgcuugccgcc

SEQ ID NO: 2634021 - RNA, 20 nt, Escherichia coli CFT073
ccagaccgugcgcagcaucg

SEQ ID NO: 2634022 - RNA, 20 nt, Escherichia coli CFT073
ccagaccugaauuugcucca

SEQ ID NO: 2634023 - RNA, 15 nt, Escherichia coli CFT073
ccagaccuuaucaca

SEQ ID NO: 2634024 - RNA, 23 nt, Escherichia coli CFT073
ccagacgaaugaagcagaagccg

SEQ ID NO: 2634025 - RNA, 17 nt, Escherichia coli CFT073
ccagacgauuuucccug

SEQ ID NO: 2634026 - RNA, 22 nt, Escherichia coli CFT073
ccagacgcaacagaaacgccau

SEQ ID NO: 2634027 - RNA, 18 nt, Escherichia coli CFT073
ccagacgcaaccugaugu

SEQ ID NO: 2634028 - RNA, 17 nt, Escherichia coli CFT073
ccagacgccccaguaaa

SEQ ID NO: 2634029 - RNA, 20 nt, Escherichia coli CFT073
ccagacgccccaguaaacac

SEQ ID NO: 2634030 - RNA, 15 nt, Escherichia coli CFT073
ccagacguuauugcc

SEQ ID NO: 2634031 - RNA, 17 nt, Escherichia coli CFT073
ccagacucaccagcauc

SEQ ID NO: 2634032 - RNA, 16 nt, Escherichia coli CFT073
ccagacucagcaacag

SEQ ID NO: 2634033 - RNA, 20 nt, Escherichia coli CFT073
ccagacucagcaacagguaa

SEQ ID NO: 2634034 - RNA, 19 nt, Escherichia coli CFT073
ccagacugacaaucaucgc

SEQ ID NO: 2634035 - RNA, 20 nt, Escherichia coli CFT073
ccagacugacaaucaucgcc

SEQ ID NO: 2634036 - RNA, 23 nt, Escherichia coli CFT073
ccagacugaugugcuccaucagg

SEQ ID NO: 2634037 - RNA, 17 nt, Escherichia coli CFT073
ccagacugcgcauuaaa

SEQ ID NO: 2634038 - RNA, 18 nt, Escherichia coli CFT073
ccagacugcgcauuaaau

SEQ ID NO: 2634039 - RNA, 17 nt, Escherichia coli CFT073
ccagacuggagcacugc

SEQ ID NO: 2634040 - RNA, 20 nt, Escherichia coli CFT073
ccagacuggagcacugcgcc

SEQ ID NO: 2634041 - RNA, 16 nt, Escherichia coli CFT073
ccagacuuuguugaau

SEQ ID NO: 2634042 - RNA, 22 nt, Escherichia coli CFT073
ccagagaacugaacaccgccuu

SEQ ID NO: 2634043 - RNA, 15 nt, Escherichia coli CFT073
ccagagaauauuaac

SEQ ID NO: 2634044 - RNA, 19 nt, Escherichia coli CFT073
ccagagagcggagcaauga

SEQ ID NO: 2634045 - RNA, 16 nt, Escherichia coli CFT073
ccagagcacugcauuc

SEQ ID NO: 2634046 - RNA, 20 nt, Escherichia coli CFT073
ccagagcagcgguaagguga

SEQ ID NO: 2634047 - RNA, 15 nt, Escherichia coli CFT073
ccagagcccguuacc

SEQ ID NO: 2634048 - RNA, 17 nt, Escherichia coli CFT073
ccagagccgcgccgcua

SEQ ID NO: 2634049 - RNA, 19 nt, Escherichia coli CFT073
ccagagcggagauaaucgc

SEQ ID NO: 2634050 - RNA, 13 nt, Escherichia coli CFT073
ccagagcuaaaau

SEQ ID NO: 2634051 - RNA, 17 nt, Escherichia coli CFT073
ccagagcuuugggccca

SEQ ID NO: 2634052 - RNA, 11 nt, Escherichia coli CFT073
ccagagcuuuu

SEQ ID NO: 2634053 - RNA, 16 nt, Escherichia coli CFT073
ccagauaaaacacauc

SEQ ID NO: 2634054 - RNA, 22 nt, Escherichia coli CFT073
ccagauaaaacaucucuuccca

SEQ ID NO: 2634055 - RNA, 15 nt, Escherichia coli CFT073
ccagauaaauauuau

SEQ ID NO: 2634056 - RNA, 17 nt, Escherichia coli CFT073
ccagauaacaaucauca

SEQ ID NO: 2634057 - RNA, 18 nt, Escherichia coli CFT073
ccagauaagacacugacg

SEQ ID NO: 2634058 - RNA, 15 nt, Escherichia coli CFT073
ccagauaaggcguuc

SEQ ID NO: 2634059 - RNA, 23 nt, Escherichia coli CFT073
ccagauaaggcguucacgccgca

SEQ ID NO: 2634060 - RNA, 23 nt, Escherichia coli CFT073
ccagauaaggcguuuacgccgca

SEQ ID NO: 2634061 - RNA, 20 nt, Escherichia coli CFT073
ccagauaaucacccgccuuc

SEQ ID NO: 2634062 - RNA, 16 nt, Escherichia coli CFT073
ccagauaauggcuguu

SEQ ID NO: 2634063 - RNA, 17 nt, Escherichia coli CFT073
ccagauacugccgacca

SEQ ID NO: 2634064 - RNA, 14 nt, Escherichia coli CFT073
ccagauagccgacc

SEQ ID NO: 2634065 - RNA, 14 nt, Escherichia coli CFT073
ccagauagccgcca

SEQ ID NO: 2634066 - RNA, 18 nt, Escherichia coli CFT073
ccagauaguucgcaaucg

SEQ ID NO: 2634067 - RNA, 18 nt, Escherichia coli CFT073
ccagauauuuaaguugau

SEQ ID NO: 2634068 - RNA, 14 nt, Escherichia coli CFT073
ccagaucacgcagc

SEQ ID NO: 2634069 - RNA, 15 nt, Escherichia coli CFT073
ccagaucacgcagca

SEQ ID NO: 2634070 - RNA, 18 nt, Escherichia coli CFT073
ccagaucacgcagcaagc

SEQ ID NO: 2634071 - RNA, 15 nt, Escherichia coli CFT073
ccagaucacuucugu

SEQ ID NO: 2634072 - RNA, 14 nt, Escherichia coli CFT073
ccagaucagaacgc

SEQ ID NO: 2634073 - RNA, 18 nt, Escherichia coli CFT073
ccagaucaucguuuccga

SEQ ID NO: 2634074 - RNA, 14 nt, Escherichia coli CFT073
ccagauccaauacc

SEQ ID NO: 2634075 - RNA, 15 nt, Escherichia coli CFT073
ccagauccagcaagg

SEQ ID NO: 2634076 - RNA, 17 nt, Escherichia coli CFT073
ccagauccagcaagggg

SEQ ID NO: 2634077 - RNA, 19 nt, Escherichia coli CFT073
ccagauccugccauuggca

SEQ ID NO: 2634078 - RNA, 16 nt, Escherichia coli CFT073
ccagaucgguaauuga

SEQ ID NO: 2634079 - RNA, 23 nt, Escherichia coli CFT073
ccagaucguguuuugcaaucauc

SEQ ID NO: 2634080 - RNA, 14 nt, Escherichia coli CFT073
ccagaucuuccagc

SEQ ID NO: 2634081 - RNA, 20 nt, Escherichia coli CFT073
ccagaucuuucgccagucca

SEQ ID NO: 2634082 - RNA, 22 nt, Escherichia coli CFT073
ccagaugcgacguuacaaccac

SEQ ID NO: 2634083 - RNA, 18 nt, Escherichia coli CFT073
ccagaugcggcgugaacg

SEQ ID NO: 2634084 - RNA, 13 nt, Escherichia coli CFT073
ccagaugcgggug

SEQ ID NO: 2634085 - RNA, 18 nt, Escherichia coli CFT073
ccagauggacaaaagccc

SEQ ID NO: 2634086 - RNA, 17 nt, Escherichia coli CFT073
ccagauggaucagcguu

SEQ ID NO: 2634087 - RNA, 20 nt, Escherichia coli CFT073
ccagaugucuuuacccggac

SEQ ID NO: 2634088 - RNA, 16 nt, Escherichia coli CFT073
ccagccagaagaaaac

SEQ ID NO: 2634089 - RNA, 16 nt, Escherichia coli CFT073
ccagccagacucagca

SEQ ID NO: 2634090 - RNA, 22 nt, Escherichia coli CFT073
ccagccagguguugauccacgg

SEQ ID NO: 2634091 - RNA, 23 nt, Escherichia coli CFT073
ccagccaguagaacaauuaauac

SEQ ID NO: 2634092 - RNA, 14 nt, Escherichia coli CFT073
ccagccaguagcac

SEQ ID NO: 2634093 - RNA, 23 nt, Escherichia coli CFT073
ccagccaguauugccaugcacgc

SEQ ID NO: 2634094 - RNA, 12 nt, Escherichia coli CFT073
ccagccaugcca

SEQ ID NO: 2634095 - RNA, 15 nt, Escherichia coli CFT073
ccagccaugucgcca

SEQ ID NO: 2634096 - RNA, 18 nt, Escherichia coli CFT073
ccagccauuaaccagcca

SEQ ID NO: 2634097 - RNA, 11 nt, Escherichia coli CFT073
ccagcccagcg

SEQ ID NO: 2634098 - RNA, 17 nt, Escherichia coli CFT073
ccagcccaucgcuagau

SEQ ID NO: 2634099 - RNA, 14 nt, Escherichia coli CFT073
ccagccccaccagc

SEQ ID NO: 2634100 - RNA, 16 nt, Escherichia coli CFT073
ccagccccaccagcaa

SEQ ID NO: 2634101 - RNA, 15 nt, Escherichia coli CFT073
ccagccccagaacuc

SEQ ID NO: 2634102 - RNA, 20 nt, Escherichia coli CFT073
ccagccccauaauauaagga

SEQ ID NO: 2634103 - RNA, 15 nt, Escherichia coli CFT073
ccagccccucagcgg

SEQ ID NO: 2634104 - RNA, 21 nt, Escherichia coli CFT073
ccagcccgacgauaccgccgc

SEQ ID NO: 2634105 - RNA, 17 nt, Escherichia coli CFT073
ccagcccgaucggcugg

SEQ ID NO: 2634106 - RNA, 13 nt, Escherichia coli CFT073
ccagcccgcuggu

SEQ ID NO: 2634107 - RNA, 19 nt, Escherichia coli CFT073
ccagcccggcaagugucgc

SEQ ID NO: 2634108 - RNA, 17 nt, Escherichia coli CFT073
ccagccgaacagugcca

SEQ ID NO: 2634109 - RNA, 14 nt, Escherichia coli CFT073
ccagccgaucagcg

SEQ ID NO: 2634110 - RNA, 17 nt, Escherichia coli CFT073
ccagccgaucagcggcg

SEQ ID NO: 2634111 - RNA, 19 nt, Escherichia coli CFT073
ccagccgccaacuccacca

SEQ ID NO: 2634112 - RNA, 14 nt, Escherichia coli CFT073
ccagccgccagcau

SEQ ID NO: 2634113 - RNA, 15 nt, Escherichia coli CFT073
ccagccgccgcuccu

SEQ ID NO: 2634114 - RNA, 16 nt, Escherichia coli CFT073
ccagccgcgucugaau

SEQ ID NO: 2634115 - RNA, 12 nt, Escherichia coli CFT073
ccagccggcaaa

SEQ ID NO: 2634116 - RNA, 20 nt, Escherichia coli CFT073
ccagccgggcgguuaacgac

SEQ ID NO: 2634117 - RNA, 23 nt, Escherichia coli CFT073
ccagccguuauguugauucauuu

SEQ ID NO: 2634118 - RNA, 19 nt, Escherichia coli CFT073
ccagccuacagaacgcugc

SEQ ID NO: 2634119 - RNA, 15 nt, Escherichia coli CFT073
ccagccuccaaccca

SEQ ID NO: 2634120 - RNA, 19 nt, Escherichia coli CFT073
ccagccugcgcuaccagaa

SEQ ID NO: 2634121 - RNA, 12 nt, Escherichia coli CFT073
ccagccuucuuc

SEQ ID NO: 2634122 - RNA, 20 nt, Escherichia coli CFT073
ccagccuucuucauccagcg

SEQ ID NO: 2634123 - RNA, 18 nt, Escherichia coli CFT073
ccagccuugaggccaucc

SEQ ID NO: 2634124 - RNA, 18 nt, Escherichia coli CFT073
ccagccuuuccagcaauc

SEQ ID NO: 2634125 - RNA, 18 nt, Escherichia coli CFT073
ccagcgacagccagccca

SEQ ID NO: 2634126 - RNA, 15 nt, Escherichia coli CFT073
ccagcgaccgcgcca

SEQ ID NO: 2634127 - RNA, 13 nt, Escherichia coli CFT073
ccagcgagaagcu

SEQ ID NO: 2634128 - RNA, 21 nt, Escherichia coli CFT073
ccagcgauacucucgcgucgu

SEQ ID NO: 2634129 - RNA, 11 nt, Escherichia coli CFT073
ccagcgauccg

SEQ ID NO: 2634130 - RNA, 22 nt, Escherichia coli CFT073
ccagcgauccggguaauaaacc

SEQ ID NO: 2634131 - RNA, 11 nt, Escherichia coli CFT073
ccagcgaugcu

SEQ ID NO: 2634132 - RNA, 16 nt, Escherichia coli CFT073
ccagcgcaaggcgcga

SEQ ID NO: 2634133 - RNA, 12 nt, Escherichia coli CFT073
ccagcgcaccug

SEQ ID NO: 2634134 - RNA, 14 nt, Escherichia coli CFT073
ccagcgcaccugaa

SEQ ID NO: 2634135 - RNA, 17 nt, Escherichia coli CFT073
ccagcgcacuacgccgc

SEQ ID NO: 2634136 - RNA, 13 nt, Escherichia coli CFT073
ccagcgcauggcg

SEQ ID NO: 2634137 - RNA, 19 nt, Escherichia coli CFT073
ccagcgcauggcggcagcg

SEQ ID NO: 2634138 - RNA, 15 nt, Escherichia coli CFT073
ccagcgccaaagcca

SEQ ID NO: 2634139 - RNA, 13 nt, Escherichia coli CFT073
ccagcgccaccac

SEQ ID NO: 2634140 - RNA, 14 nt, Escherichia coli CFT073
ccagcgccaccacc

SEQ ID NO: 2634141 - RNA, 19 nt, Escherichia coli CFT073
ccagcgccaccacgccgau

SEQ ID NO: 2634142 - RNA, 17 nt, Escherichia coli CFT073
ccagcgccaccgguuua

SEQ ID NO: 2634143 - RNA, 22 nt, Escherichia coli CFT073
ccagcgccaucucuucugcgcu

SEQ ID NO: 2634144 - RNA, 18 nt, Escherichia coli CFT073
ccagcgcccguaaaccaa

SEQ ID NO: 2634145 - RNA, 13 nt, Escherichia coli CFT073
ccagcgccgcgcg

SEQ ID NO: 2634146 - RNA, 15 nt, Escherichia coli CFT073
ccagcgccugaauaa

SEQ ID NO: 2634147 - RNA, 17 nt, Escherichia coli CFT073
ccagcgccugaauaauc

SEQ ID NO: 2634148 - RNA, 14 nt, Escherichia coli CFT073
ccagcgccugcgcg

SEQ ID NO: 2634149 - RNA, 15 nt, Escherichia coli CFT073
ccagcgccuggcagc

SEQ ID NO: 2634150 - RNA, 21 nt, Escherichia coli CFT073
ccagcgccuggcgaaucgccu

SEQ ID NO: 2634151 - RNA, 18 nt, Escherichia coli CFT073
ccagcgcgaacauuucau

SEQ ID NO: 2634152 - RNA, 16 nt, Escherichia coli CFT073
ccagcgcgaccgccau

SEQ ID NO: 2634153 - RNA, 12 nt, Escherichia coli CFT073
ccagcgcgcgca

SEQ ID NO: 2634154 - RNA, 13 nt, Escherichia coli CFT073
ccagcgcggcagc

SEQ ID NO: 2634155 - RNA, 20 nt, Escherichia coli CFT073
ccagcgcggcagcggcuuca

SEQ ID NO: 2634156 - RNA, 18 nt, Escherichia coli CFT073
ccagcgcguuugucagca

SEQ ID NO: 2634157 - RNA, 20 nt, Escherichia coli CFT073
ccagcgcugcggccugcugc

SEQ ID NO: 2634158 - RNA, 22 nt, Escherichia coli CFT073
ccagcgcugcggccugcugcac

SEQ ID NO: 2634159 - RNA, 17 nt, Escherichia coli CFT073
ccagcgcuucgcucccc

SEQ ID NO: 2634160 - RNA, 22 nt, Escherichia coli CFT073
ccagcgcuuuugcuacuuuuuu

SEQ ID NO: 2634161 - RNA, 20 nt, Escherichia coli CFT073
ccagcggaaaauaucaccaa

SEQ ID NO: 2634162 - RNA, 13 nt, Escherichia coli CFT073
ccagcggaauaga

SEQ ID NO: 2634163 - RNA, 22 nt, Escherichia coli CFT073
ccagcggaauuccggcuucuuc

SEQ ID NO: 2634164 - RNA, 15 nt, Escherichia coli CFT073
ccagcggaugaccca

SEQ ID NO: 2634165 - RNA, 17 nt, Escherichia coli CFT073
ccagcggaugacccagc

SEQ ID NO: 2634166 - RNA, 21 nt, Escherichia coli CFT073
ccagcggaugacccagcgcga

SEQ ID NO: 2634167 - RNA, 17 nt, Escherichia coli CFT073
ccagcggcaaccagcag

SEQ ID NO: 2634168 - RNA, 17 nt, Escherichia coli CFT073
ccagcggcaccgaggau

SEQ ID NO: 2634169 - RNA, 14 nt, Escherichia coli CFT073
ccagcggcaggccg

SEQ ID NO: 2634170 - RNA, 19 nt, Escherichia coli CFT073
ccagcgggaucgccguuaa

SEQ ID NO: 2634171 - RNA, 14 nt, Escherichia coli CFT073
ccagcgggcgucaa

SEQ ID NO: 2634172 - RNA, 21 nt, Escherichia coli CFT073
ccagcgggcgucaaaaucauc

SEQ ID NO: 2634173 - RNA, 16 nt, Escherichia coli CFT073
ccagcggguaaacagc

SEQ ID NO: 2634174 - RNA, 20 nt, Escherichia coli CFT073
ccagcggugaaaacggcaau

SEQ ID NO: 2634175 - RNA, 12 nt, Escherichia coli CFT073
ccagcguaauaa

SEQ ID NO: 2634176 - RNA, 17 nt, Escherichia coli CFT073
ccagcguaccaguggcg

SEQ ID NO: 2634177 - RNA, 21 nt, Escherichia coli CFT073
ccagcguaccaugauccugca

SEQ ID NO: 2634178 - RNA, 20 nt, Escherichia coli CFT073
ccagcguagugauaccccgc

SEQ ID NO: 2634179 - RNA, 15 nt, Escherichia coli CFT073
ccagcgucagcagca

SEQ ID NO: 2634180 - RNA, 16 nt, Escherichia coli CFT073
ccagcgucagcagcaa

SEQ ID NO: 2634181 - RNA, 19 nt, Escherichia coli CFT073
ccagcgucucuucaauccg

SEQ ID NO: 2634182 - RNA, 21 nt, Escherichia coli CFT073
ccagcguggcgaacggauagc

SEQ ID NO: 2634183 - RNA, 21 nt, Escherichia coli CFT073
ccagcgugucgagcauugcca

SEQ ID NO: 2634184 - RNA, 15 nt, Escherichia coli CFT073
ccagcguuacccaga

SEQ ID NO: 2634185 - RNA, 16 nt, Escherichia coli CFT073
ccagcguuacccagac

SEQ ID NO: 2634186 - RNA, 19 nt, Escherichia coli CFT073
ccagcguuacccagacaaa

SEQ ID NO: 2634187 - RNA, 19 nt, Escherichia coli CFT073
ccagcguuaucccauucca

SEQ ID NO: 2634188 - RNA, 17 nt, Escherichia coli CFT073
ccagcguucccacguuc

SEQ ID NO: 2634189 - RNA, 19 nt, Escherichia coli CFT073
ccagcguuuaucaauaucc

SEQ ID NO: 2634190 - RNA, 16 nt, Escherichia coli CFT073
ccagcguuuccagcac

SEQ ID NO: 2634191 - RNA, 17 nt, Escherichia coli CFT073
ccagcguuuccagcacc

SEQ ID NO: 2634192 - RNA, 18 nt, Escherichia coli CFT073
ccagcguuuccagcacca

SEQ ID NO: 2634193 - RNA, 21 nt, Escherichia coli CFT073
ccagcguuuccagcaccaguu

SEQ ID NO: 2634194 - RNA, 17 nt, Escherichia coli CFT073
ccagcguuugcggcgcu

SEQ ID NO: 2634195 - RNA, 22 nt, Escherichia coli CFT073
ccagcguuugcugcuuaucgcg

SEQ ID NO: 2634196 - RNA, 18 nt, Escherichia coli CFT073
ccagcuaccacgccgaua

SEQ ID NO: 2634197 - RNA, 15 nt, Escherichia coli CFT073
ccaguaccgccgcca

SEQ ID NO: 2634198 - RNA, 17 nt, Escherichia coli CFT073
ccaguaccuucguccau

SEQ ID NO: 2634199 - RNA, 15 nt, Escherichia coli CFT073
ccaguacgccuucac

SEQ ID NO: 2634200 - RNA, 16 nt, Escherichia coli CFT073
ccaguacgccuucacg

SEQ ID NO: 2634201 - RNA, 12 nt, Escherichia coli CFT073
ccaguacgcgca

SEQ ID NO: 2634202 - RNA, 19 nt, Escherichia coli CFT073
ccaguacgcgcaaccccgc

SEQ ID NO: 2634203 - RNA, 22 nt, Escherichia coli CFT073
ccaguacgcggacacuuuccug

SEQ ID NO: 2634204 - RNA, 21 nt, Escherichia coli CFT073
ccaguacgcgggcaacgccuu

SEQ ID NO: 2634205 - RNA, 17 nt, Escherichia coli CFT073
ccaguacgggcagcgca

SEQ ID NO: 2634206 - RNA, 13 nt, Escherichia coli CFT073
ccaguagaacaau

SEQ ID NO: 2634207 - RNA, 19 nt, Escherichia coli CFT073
ccaguagcaccucuccacg

SEQ ID NO: 2634208 - RNA, 23 nt, Escherichia coli CFT073
ccaguagcaccucuccacgcauc

SEQ ID NO: 2634209 - RNA, 19 nt, Escherichia coli CFT073
ccaguagcuugaaaucacc

SEQ ID NO: 2634210 - RNA, 16 nt, Escherichia coli CFT073
ccaguagugcgcagaa

SEQ ID NO: 2634211 - RNA, 21 nt, Escherichia coli CFT073
ccaguagugcuuucagcgaaa

SEQ ID NO: 2634212 - RNA, 15 nt, Escherichia coli CFT073
ccaguaguugcucaa

SEQ ID NO: 2634213 - RNA, 20 nt, Escherichia coli CFT073
ccaguaguugcucaagcuga

SEQ ID NO: 2634214 - RNA, 20 nt, Escherichia coli CFT073
ccaguauauugcugauuuuc

SEQ ID NO: 2634215 - RNA, 22 nt, Escherichia coli CFT073
ccaguauugccaugcacgcaaa

SEQ ID NO: 2634216 - RNA, 16 nt, Escherichia coli CFT073
ccagucacugccacca

SEQ ID NO: 2634217 - RNA, 18 nt, Escherichia coli CFT073
ccagucacugccaccauc

SEQ ID NO: 2634218 - RNA, 20 nt, Escherichia coli CFT073
ccagucagcgaacaccagca

SEQ ID NO: 2634219 - RNA, 23 nt, Escherichia coli CFT073
ccagucaggcaugaucagcgucc

SEQ ID NO: 2634220 - RNA, 21 nt, Escherichia coli CFT073
ccagucauaauucagaucgcu

SEQ ID NO: 2634221 - RNA, 14 nt, Escherichia coli CFT073
ccaguccaucggca

SEQ ID NO: 2634222 - RNA, 17 nt, Escherichia coli CFT073
ccaguccggcaauguga

SEQ ID NO: 2634223 - RNA, 18 nt, Escherichia coli CFT073
ccaguccgguggagagca

SEQ ID NO: 2634224 - RNA, 20 nt, Escherichia coli CFT073
ccaguccuacacacgccagu

SEQ ID NO: 2634225 - RNA, 16 nt, Escherichia coli CFT073
ccagucgaggcugacg

SEQ ID NO: 2634226 - RNA, 22 nt, Escherichia coli CFT073
ccagucgcgcaauugccagaca

SEQ ID NO: 2634227 - RNA, 14 nt, Escherichia coli CFT073
ccagucgcugcuga

SEQ ID NO: 2634228 - RNA, 15 nt, Escherichia coli CFT073
ccagucgcugcugac

SEQ ID NO: 2634229 - RNA, 16 nt, Escherichia coli CFT073
ccagucgguagugccg

SEQ ID NO: 2634230 - RNA, 22 nt, Escherichia coli CFT073
ccagucucccuuuacccgcgcu

SEQ ID NO: 2634231 - RNA, 12 nt, Escherichia coli CFT073
ccagucugcuga

SEQ ID NO: 2634232 - RNA, 16 nt, Escherichia coli CFT073
ccagucuuccugcggc

SEQ ID NO: 2634233 - RNA, 14 nt, Escherichia coli CFT073
ccagucuuuccaua

SEQ ID NO: 2634234 - RNA, 13 nt, Escherichia coli CFT073
ccagugaauacug

SEQ ID NO: 2634235 - RNA, 17 nt, Escherichia coli CFT073
ccagugaauacugcgcg

SEQ ID NO: 2634236 - RNA, 13 nt, Escherichia coli CFT073
ccagugacgccgc

SEQ ID NO: 2634237 - RNA, 14 nt, Escherichia coli CFT073
ccagugaucuggcu

SEQ ID NO: 2634238 - RNA, 23 nt, Escherichia coli CFT073
ccagugcagauaccaccagcgcc

SEQ ID NO: 2634239 - RNA, 21 nt, Escherichia coli CFT073
ccagugcccgaccacuucaug

SEQ ID NO: 2634240 - RNA, 22 nt, Escherichia coli CFT073
ccagugcccgaccacuucaugc

SEQ ID NO: 2634241 - RNA, 12 nt, Escherichia coli CFT073
ccagugccggaa

SEQ ID NO: 2634242 - RNA, 18 nt, Escherichia coli CFT073
ccagugccggaugauuca

SEQ ID NO: 2634243 - RNA, 21 nt, Escherichia coli CFT073
ccagugccggaugauucacau

SEQ ID NO: 2634244 - RNA, 18 nt, Escherichia coli CFT073
ccagugcuacccccagac

SEQ ID NO: 2634245 - RNA, 12 nt, Escherichia coli CFT073
ccagugcuccac

SEQ ID NO: 2634246 - RNA, 18 nt, Escherichia coli CFT073
ccagugcuuucagugccu

SEQ ID NO: 2634247 - RNA, 19 nt, Escherichia coli CFT073
ccaguggaugcgccauacc

SEQ ID NO: 2634248 - RNA, 15 nt, Escherichia coli CFT073
ccagugguaaaaaag

SEQ ID NO: 2634249 - RNA, 16 nt, Escherichia coli CFT073
ccagugguacaaaagc

SEQ ID NO: 2634250 - RNA, 14 nt, Escherichia coli CFT073
ccagugucgcauca

SEQ ID NO: 2634251 - RNA, 16 nt, Escherichia coli CFT073
ccagugucgcaucagg

SEQ ID NO: 2634252 - RNA, 20 nt, Escherichia coli CFT073
ccagugugaugcguccgcua

SEQ ID NO: 2634253 - RNA, 14 nt, Escherichia coli CFT073
ccaguguucuuccg

SEQ ID NO: 2634254 - RNA, 14 nt, Escherichia coli CFT073
ccaguguuguauuc

SEQ ID NO: 2634255 - RNA, 17 nt, Escherichia coli CFT073
ccaguguuguauucaga

SEQ ID NO: 2634256 - RNA, 16 nt, Escherichia coli CFT073
ccaguguuuccggaau

SEQ ID NO: 2634257 - RNA, 22 nt, Escherichia coli CFT073
ccaguguuuuaccggcaacucu

SEQ ID NO: 2634258 - RNA, 15 nt, Escherichia coli CFT073
ccaguuaacgccgcg

SEQ ID NO: 2634259 - RNA, 23 nt, Escherichia coli CFT073
ccaguuacccagcggauaaagca

SEQ ID NO: 2634260 - RNA, 14 nt, Escherichia coli CFT073
ccaguuaccgccgg

SEQ ID NO: 2634261 - RNA, 12 nt, Escherichia coli CFT073
ccaguucacacc

SEQ ID NO: 2634262 - RNA, 16 nt, Escherichia coli CFT073
ccaguucacgaauauu

SEQ ID NO: 2634263 - RNA, 22 nt, Escherichia coli CFT073
ccaguucacgcgauuuuucauc

SEQ ID NO: 2634264 - RNA, 15 nt, Escherichia coli CFT073
ccaguucagcggcug

SEQ ID NO: 2634265 - RNA, 20 nt, Escherichia coli CFT073
ccaguucaugacgcaggcgu

SEQ ID NO: 2634266 - RNA, 17 nt, Escherichia coli CFT073
ccaguucaugacgugac

SEQ ID NO: 2634267 - RNA, 15 nt, Escherichia coli CFT073
ccaguuccacuuugc

SEQ ID NO: 2634268 - RNA, 23 nt, Escherichia coli CFT073
ccaguuccacuuugcuuucagau

SEQ ID NO: 2634269 - RNA, 22 nt, Escherichia coli CFT073
ccaguucgauguugugaauauu

SEQ ID NO: 2634270 - RNA, 14 nt, Escherichia coli CFT073
ccaguucgcuuuga

SEQ ID NO: 2634271 - RNA, 23 nt, Escherichia coli CFT073
ccaguucggcguucaccagcgca

SEQ ID NO: 2634272 - RNA, 19 nt, Escherichia coli CFT073
ccaguucuuccgcagagua

SEQ ID NO: 2634273 - RNA, 19 nt, Escherichia coli CFT073
ccaguucuuccgccagaca

SEQ ID NO: 2634274 - RNA, 22 nt, Escherichia coli CFT073
ccaguugagcggauucgcguuu

SEQ ID NO: 2634275 - RNA, 19 nt, Escherichia coli CFT073
ccaguugagcuccagugcg

SEQ ID NO: 2634276 - RNA, 15 nt, Escherichia coli CFT073
ccaguugaugaccag

SEQ ID NO: 2634277 - RNA, 17 nt, Escherichia coli CFT073
ccaguugcauaauuucu

SEQ ID NO: 2634278 - RNA, 17 nt, Escherichia coli CFT073
ccaguugguguucggca

SEQ ID NO: 2634279 - RNA, 22 nt, Escherichia coli CFT073
ccaguugucgguaauugcgccg

SEQ ID NO: 2634280 - RNA, 14 nt, Escherichia coli CFT073
ccaguugugaugcc

SEQ ID NO: 2634281 - RNA, 17 nt, Escherichia coli CFT073
ccaguugugcaccacca

SEQ ID NO: 2634282 - RNA, 16 nt, Escherichia coli CFT073
ccaguuguugcgugaa

SEQ ID NO: 2634283 - RNA, 14 nt, Escherichia coli CFT073
ccaguuuaccgaaa

SEQ ID NO: 2634284 - RNA, 23 nt, Escherichia coli CFT073
ccaguuuaucaaugacaucugca

SEQ ID NO: 2634285 - RNA, 12 nt, Escherichia coli CFT073
ccaguuucacag

SEQ ID NO: 2634286 - RNA, 14 nt, Escherichia coli CFT073
ccaguuucacagga

SEQ ID NO: 2634287 - RNA, 14 nt, Escherichia coli CFT073
ccaguuucggacgc

SEQ ID NO: 2634288 - RNA, 15 nt, Escherichia coli CFT073
ccaguuucugcccaa

SEQ ID NO: 2634289 - RNA, 19 nt, Escherichia coli CFT073
ccaguuucuucaggccagc

SEQ ID NO: 2634290 - RNA, 21 nt, Escherichia coli CFT073
ccaguuucuucaggccagccu

SEQ ID NO: 2634291 - RNA, 20 nt, Escherichia coli CFT073
ccaguuucuuuuaacaaacu

SEQ ID NO: 2634292 - RNA, 21 nt, Escherichia coli CFT073
ccaguuugcaggccaaacagc

SEQ ID NO: 2634293 - RNA, 21 nt, Escherichia coli CFT073
ccaguuuggugacgccacaac

SEQ ID NO: 2634294 - RNA, 17 nt, Escherichia coli CFT073
ccaguuuguagccgaua

SEQ ID NO: 2634295 - RNA, 22 nt, Escherichia coli CFT073
ccaguuuucagaaugagguuca

SEQ ID NO: 2634296 - RNA, 18 nt, Escherichia coli CFT073
ccaguuuuucuuuuucaa

SEQ ID NO: 2634297 - RNA, 24 nt, Escherichia coli CFT073
ccaguuuuuucgcuugaucuuccu

SEQ ID NO: 2634298 - RNA, 11 nt, Escherichia coli CFT073
ccauaaaaacg

SEQ ID NO: 2634299 - RNA, 15 nt, Escherichia coli CFT073
ccauaaaaacgauaa

SEQ ID NO: 2634300 - RNA, 14 nt, Escherichia coli CFT073
ccauaaacaccagc

SEQ ID NO: 2634301 - RNA, 15 nt, Escherichia coli CFT073
ccauaaacaccagca

SEQ ID NO: 2634302 - RNA, 20 nt, Escherichia coli CFT073
ccauaaacaucgucaggaag

SEQ ID NO: 2634303 - RNA, 19 nt, Escherichia coli CFT073
ccauaaaccgcaucaugua

SEQ ID NO: 2634304 - RNA, 14 nt, Escherichia coli CFT073
ccauaaauuugugc

SEQ ID NO: 2634305 - RNA, 15 nt, Escherichia coli CFT073
ccauccccaccaaaa

SEQ ID NO: 2634306 - RNA, 23 nt, Escherichia coli CFT073
ccauccccacggcucgugcggua

SEQ ID NO: 2634307 - RNA, 18 nt, Escherichia coli CFT073
ccauccccuuuucacgca

SEQ ID NO: 2634308 - RNA, 17 nt, Escherichia coli CFT073
ccaucccgcucuguaag

SEQ ID NO: 2634309 - RNA, 13 nt, Escherichia coli CFT073
ccaucccggcaac

SEQ ID NO: 2634310 - RNA, 20 nt, Escherichia coli CFT073
ccaucccuaauauaaacaac

SEQ ID NO: 2634311 - RNA, 15 nt, Escherichia coli CFT073
ccaucccuaugcaua

SEQ ID NO: 2634312 - RNA, 13 nt, Escherichia coli CFT073
ccaucccuucacc

SEQ ID NO: 2634313 - RNA, 14 nt, Escherichia coli CFT073
ccauccgagcagca

SEQ ID NO: 2634314 - RNA, 23 nt, Escherichia coli CFT073
ccauccgagcagcaaugcuuacu

SEQ ID NO: 2634315 - RNA, 14 nt, Escherichia coli CFT073
ccauccgcccacac

SEQ ID NO: 2634316 - RNA, 16 nt, Escherichia coli CFT073
ccauccgcccacacca

SEQ ID NO: 2634317 - RNA, 13 nt, Escherichia coli CFT073
ccauccggcaaca

SEQ ID NO: 2634318 - RNA, 23 nt, Escherichia coli CFT073
ccauccggcugauuuaucaggcu

SEQ ID NO: 2634319 - RNA, 15 nt, Escherichia coli CFT073
ccauccuccgcagcc

SEQ ID NO: 2634320 - RNA, 17 nt, Escherichia coli CFT073
ccauccuuaugcagcgg

SEQ ID NO: 2634321 - RNA, 18 nt, Escherichia coli CFT073
ccaucgaaccaucggcuu

SEQ ID NO: 2634322 - RNA, 16 nt, Escherichia coli CFT073
ccaucgacaccagcca

SEQ ID NO: 2634323 - RNA, 19 nt, Escherichia coli CFT073
ccaucgacaccagccagac

SEQ ID NO: 2634324 - RNA, 16 nt, Escherichia coli CFT073
ccaucgacgaaauggu

SEQ ID NO: 2634325 - RNA, 21 nt, Escherichia coli CFT073
ccaucgacguccaaucagcac

SEQ ID NO: 2634326 - RNA, 15 nt, Escherichia coli CFT073
ccaucgauacccaga

SEQ ID NO: 2634327 - RNA, 21 nt, Escherichia coli CFT073
ccaucgauuuugcaauaaugg

SEQ ID NO: 2634328 - RNA, 16 nt, Escherichia coli CFT073
ccaucgcaaacagcac

SEQ ID NO: 2634329 - RNA, 18 nt, Escherichia coli CFT073
ccaucgcagaaacgacac

SEQ ID NO: 2634330 - RNA, 15 nt, Escherichia coli CFT073
ccaucgcaugccagc

SEQ ID NO: 2634331 - RNA, 16 nt, Escherichia coli CFT073
ccaucgccaccgcuuc

SEQ ID NO: 2634332 - RNA, 19 nt, Escherichia coli CFT073
ccaucgccaccgcuucgcu

SEQ ID NO: 2634333 - RNA, 14 nt, Escherichia coli CFT073
ccaucgccaccgga

SEQ ID NO: 2634334 - RNA, 14 nt, Escherichia coli CFT073
ccaucgccagcagc

SEQ ID NO: 2634335 - RNA, 15 nt, Escherichia coli CFT073
ccaucgccagcagcc

SEQ ID NO: 2634336 - RNA, 16 nt, Escherichia coli CFT073
ccaucgccaggaacaa

SEQ ID NO: 2634337 - RNA, 12 nt, Escherichia coli CFT073
ccaucgccgccu

SEQ ID NO: 2634338 - RNA, 16 nt, Escherichia coli CFT073
ccaucgccgccuggcu

SEQ ID NO: 2634339 - RNA, 16 nt, Escherichia coli CFT073
ccaucgcgacggcaga

SEQ ID NO: 2634340 - RNA, 21 nt, Escherichia coli CFT073
ccaucgcgaucaucaguacgc

SEQ ID NO: 2634341 - RNA, 17 nt, Escherichia coli CFT073
ccaucgcgauccacgcu

SEQ ID NO: 2634342 - RNA, 20 nt, Escherichia coli CFT073
ccaucgcuacauaacgcagc

SEQ ID NO: 2634343 - RNA, 20 nt, Escherichia coli CFT073
ccaucgcuagauaggucacc

SEQ ID NO: 2634344 - RNA, 17 nt, Escherichia coli CFT073
ccaucgcuucaugcccg

SEQ ID NO: 2634345 - RNA, 14 nt, Escherichia coli CFT073
ccaucgcuuuucgu

SEQ ID NO: 2634346 - RNA, 18 nt, Escherichia coli CFT073
ccaucggcagcgguaagg

SEQ ID NO: 2634347 - RNA, 24 nt, Escherichia coli CFT073
ccaucggcauuaaucugcucggcg

SEQ ID NO: 2634348 - RNA, 15 nt, Escherichia coli CFT073
ccaucggcgcuacgg

SEQ ID NO: 2634349 - RNA, 15 nt, Escherichia coli CFT073
ccaucggcgcuggcg

SEQ ID NO: 2634350 - RNA, 15 nt, Escherichia coli CFT073
ccaucggcuuuggca

SEQ ID NO: 2634351 - RNA, 14 nt, Escherichia coli CFT073
ccaucgucacgauu

SEQ ID NO: 2634352 - RNA, 18 nt, Escherichia coli CFT073
ccaucgucggguaguuaa

SEQ ID NO: 2634353 - RNA, 15 nt, Escherichia coli CFT073
ccaucguuaaaaaac

SEQ ID NO: 2634354 - RNA, 18 nt, Escherichia coli CFT073
ccaucguugaauacauuc

SEQ ID NO: 2634355 - RNA, 21 nt, Escherichia coli CFT073
ccaucguugagcaucugcaaa

SEQ ID NO: 2634356 - RNA, 18 nt, Escherichia coli CFT073
ccaucguugaugcauacg

SEQ ID NO: 2634357 - RNA, 22 nt, Escherichia coli CFT073
ccaucucaaaacguccggcaau

SEQ ID NO: 2634358 - RNA, 12 nt, Escherichia coli CFT073
ccaucuccagcu

SEQ ID NO: 2634359 - RNA, 14 nt, Escherichia coli CFT073
ccaucuccagugcg

SEQ ID NO: 2634360 - RNA, 15 nt, Escherichia coli CFT073
ccaucuccuuacugc

SEQ ID NO: 2634361 - RNA, 19 nt, Escherichia coli CFT073
ccaucuccuuacugccccc

SEQ ID NO: 2634362 - RNA, 22 nt, Escherichia coli CFT073
ccaucucggauaaggcuuccua

SEQ ID NO: 2634363 - RNA, 23 nt, Escherichia coli CFT073
ccaucucggauaaggcuuccuac

SEQ ID NO: 2634364 - RNA, 14 nt, Escherichia coli CFT073
ccaucucugcaacg

SEQ ID NO: 2634365 - RNA, 21 nt, Escherichia coli CFT073
ccaucucugcaacgucuuccc

SEQ ID NO: 2634366 - RNA, 18 nt, Escherichia coli CFT073
ccaucucuugcggcagaa

SEQ ID NO: 2634367 - RNA, 13 nt, Escherichia coli CFT073
ccaucugaacuca

SEQ ID NO: 2634368 - RNA, 19 nt, Escherichia coli CFT073
ccaucugaauaaacggcuc

SEQ ID NO: 2634369 - RNA, 18 nt, Escherichia coli CFT073
ccaucugaugauauuuuu

SEQ ID NO: 2634370 - RNA, 14 nt, Escherichia coli CFT073
ccaucugauucuuc

SEQ ID NO: 2634371 - RNA, 17 nt, Escherichia coli CFT073
ccaucugauucuuccca

SEQ ID NO: 2634372 - RNA, 16 nt, Escherichia coli CFT073
ccaucugccagcaagc

SEQ ID NO: 2634373 - RNA, 15 nt, Escherichia coli CFT073
ccaucuuccagcauc

SEQ ID NO: 2634374 - RNA, 23 nt, Escherichia coli CFT073
ccaucuucguaccaaaugaaccg

SEQ ID NO: 2634375 - RNA, 22 nt, Escherichia coli CFT073
ccaucuucugaaucagaucaag

SEQ ID NO: 2634376 - RNA, 21 nt, Escherichia coli CFT073
ccaucuucuugcagcuuaauc

SEQ ID NO: 2634377 - RNA, 22 nt, Escherichia coli CFT073
ccaugaacgcgaaggccagcac

SEQ ID NO: 2634378 - RNA, 14 nt, Escherichia coli CFT073
ccaugacaaacuca

SEQ ID NO: 2634379 - RNA, 21 nt, Escherichia coli CFT073
ccaugacaaacucaccuggcu

SEQ ID NO: 2634380 - RNA, 14 nt, Escherichia coli CFT073
ccaugacaucccca

SEQ ID NO: 2634381 - RNA, 16 nt, Escherichia coli CFT073
ccaugacaucuccagc

SEQ ID NO: 2634382 - RNA, 20 nt, Escherichia coli CFT073
ccaugaccaccgcagcaacc

SEQ ID NO: 2634383 - RNA, 18 nt, Escherichia coli CFT073
ccaugaccgcuccgccau

SEQ ID NO: 2634384 - RNA, 19 nt, Escherichia coli CFT073
ccaugacgaugcagaaaua

SEQ ID NO: 2634385 - RNA, 12 nt, Escherichia coli CFT073
ccaugagacaaa

SEQ ID NO: 2634386 - RNA, 17 nt, Escherichia coli CFT073
ccaugauaaacggcacu

SEQ ID NO: 2634387 - RNA, 16 nt, Escherichia coli CFT073
ccaugaugaccccaga

SEQ ID NO: 2634388 - RNA, 19 nt, Escherichia coli CFT073
ccaugauuccccagccacg

SEQ ID NO: 2634389 - RNA, 24 nt, Escherichia coli CFT073
ccaugcaaucacugccaccaggaa

SEQ ID NO: 2634390 - RNA, 17 nt, Escherichia coli CFT073
ccaugcaccaacccuaa

SEQ ID NO: 2634391 - RNA, 15 nt, Escherichia coli CFT073
ccaugcacugcaacg

SEQ ID NO: 2634392 - RNA, 18 nt, Escherichia coli CFT073
ccaugcacuuuuacugac

SEQ ID NO: 2634393 - RNA, 13 nt, Escherichia coli CFT073
ccaugcaggcugg

SEQ ID NO: 2634394 - RNA, 13 nt, Escherichia coli CFT073
ccaugccaaacag

SEQ ID NO: 2634395 - RNA, 16 nt, Escherichia coli CFT073
ccaugccacaguaaaa

SEQ ID NO: 2634396 - RNA, 17 nt, Escherichia coli CFT073
ccaugccaguuucuuuu

SEQ ID NO: 2634397 - RNA, 22 nt, Escherichia coli CFT073
ccaugccaucugccagcaagcg

SEQ ID NO: 2634398 - RNA, 19 nt, Escherichia coli CFT073
ccaugcccaguuuauucuu

SEQ ID NO: 2634399 - RNA, 17 nt, Escherichia coli CFT073
ccaugccgccaccacca

SEQ ID NO: 2634400 - RNA, 14 nt, Escherichia coli CFT073
ccaugccgcccagc

SEQ ID NO: 2634401 - RNA, 18 nt, Escherichia coli CFT073
ccaugccgcccagcagca

SEQ ID NO: 2634402 - RNA, 17 nt, Escherichia coli CFT073
ccaugcgauggcggcag

SEQ ID NO: 2634403 - RNA, 14 nt, Escherichia coli CFT073
ccaugcgcucgacg

SEQ ID NO: 2634404 - RNA, 19 nt, Escherichia coli CFT073
ccaugcuaauaaucagcac

SEQ ID NO: 2634405 - RNA, 18 nt, Escherichia coli CFT073
ccaugcuaauagcugcgc

SEQ ID NO: 2634406 - RNA, 18 nt, Escherichia coli CFT073
ccaugcuaugcgccacgg

SEQ ID NO: 2634407 - RNA, 16 nt, Escherichia coli CFT073
ccaugcugagcuucuu

SEQ ID NO: 2634408 - RNA, 15 nt, Escherichia coli CFT073
ccaugcuuguuuauu

SEQ ID NO: 2634409 - RNA, 14 nt, Escherichia coli CFT073
ccauggaacucuuu

SEQ ID NO: 2634410 - RNA, 17 nt, Escherichia coli CFT073
ccauggaaucaccgcca

SEQ ID NO: 2634411 - RNA, 17 nt, Escherichia coli CFT073
ccauggacaugcgcacc

SEQ ID NO: 2634412 - RNA, 14 nt, Escherichia coli CFT073
ccaugggaaauggc

SEQ ID NO: 2634413 - RNA, 22 nt, Escherichia coli CFT073
ccaugggaaauggcuggucagg

SEQ ID NO: 2634414 - RNA, 22 nt, Escherichia coli CFT073
cccacccaacauggucaucauc

SEQ ID NO: 2634415 - RNA, 15 nt, Escherichia coli CFT073
cccaccccaauguuu

SEQ ID NO: 2634416 - RNA, 17 nt, Escherichia coli CFT073
cccaccgccaggcacuu

SEQ ID NO: 2634417 - RNA, 12 nt, Escherichia coli CFT073
cccaccucgugc

SEQ ID NO: 2634418 - RNA, 14 nt, Escherichia coli CFT073
cccaccucgugcac

SEQ ID NO: 2634419 - RNA, 14 nt, Escherichia coli CFT073
cccaccugcgguuc

SEQ ID NO: 2634420 - RNA, 12 nt, Escherichia coli CFT073
cccacgaccagu

SEQ ID NO: 2634421 - RNA, 18 nt, Escherichia coli CFT073
cccacgcaaaccaccugg

SEQ ID NO: 2634422 - RNA, 18 nt, Escherichia coli CFT073
cccacgcacagaacaaaa

SEQ ID NO: 2634423 - RNA, 20 nt, Escherichia coli CFT073
cccacgccccuggugcuugc

SEQ ID NO: 2634424 - RNA, 13 nt, Escherichia coli CFT073
cccacggcgguaa

SEQ ID NO: 2634425 - RNA, 21 nt, Escherichia coli CFT073
cccacggcggugucgccagaa

SEQ ID NO: 2634426 - RNA, 16 nt, Escherichia coli CFT073
cccacggcguguagcc

SEQ ID NO: 2634427 - RNA, 16 nt, Escherichia coli CFT073
cccacgggacgcugca

SEQ ID NO: 2634428 - RNA, 19 nt, Escherichia coli CFT073
cccacggguggucuucaua

SEQ ID NO: 2634429 - RNA, 19 nt, Escherichia coli CFT073
cccacuacaccguacuccc

SEQ ID NO: 2634430 - RNA, 20 nt, Escherichia coli CFT073
cccacuacaccguacucccg

SEQ ID NO: 2634431 - RNA, 19 nt, Escherichia coli CFT073
cccacuauuggaugacaaa

SEQ ID NO: 2634432 - RNA, 15 nt, Escherichia coli CFT073
cccacucaucaagca

SEQ ID NO: 2634433 - RNA, 12 nt, Escherichia coli CFT073
cccacugcaugg

SEQ ID NO: 2634434 - RNA, 20 nt, Escherichia coli CFT073
cccacuguuugaucugcugc

SEQ ID NO: 2634435 - RNA, 16 nt, Escherichia coli CFT073
cccacuuucugcgcaa

SEQ ID NO: 2634436 - RNA, 12 nt, Escherichia coli CFT073
cccagaaaauac

SEQ ID NO: 2634437 - RNA, 21 nt, Escherichia coli CFT073
cccagaaaauacucagcaccc

SEQ ID NO: 2634438 - RNA, 18 nt, Escherichia coli CFT073
cccagaaacaggcggcgc

SEQ ID NO: 2634439 - RNA, 19 nt, Escherichia coli CFT073
cccagaaacaggcggcgcg

SEQ ID NO: 2634440 - RNA, 17 nt, Escherichia coli CFT073
cccagaacucacgcacu

SEQ ID NO: 2634441 - RNA, 16 nt, Escherichia coli CFT073
cccagaagacgagccg

SEQ ID NO: 2634442 - RNA, 18 nt, Escherichia coli CFT073
cccagaauccccacaaac

SEQ ID NO: 2634443 - RNA, 22 nt, Escherichia coli CFT073
cccagaaucucuuuuguuuccc

SEQ ID NO: 2634444 - RNA, 16 nt, Escherichia coli CFT073
cccagacacaguucuu

SEQ ID NO: 2634445 - RNA, 22 nt, Escherichia coli CFT073
cccagaccuaacuuggcaaagc

SEQ ID NO: 2634446 - RNA, 18 nt, Escherichia coli CFT073
cccagcaacgaaacaccg

SEQ ID NO: 2634447 - RNA, 17 nt, Escherichia coli CFT073
cccagcaauccugcaug

SEQ ID NO: 2634448 - RNA, 16 nt, Escherichia coli CFT073
cccagcaccaguacca

SEQ ID NO: 2634449 - RNA, 16 nt, Escherichia coli CFT073
cccagcaccgcagaga

SEQ ID NO: 2634450 - RNA, 12 nt, Escherichia coli CFT073
cccagcagagau

SEQ ID NO: 2634451 - RNA, 15 nt, Escherichia coli CFT073
cccagcaucacgccc

SEQ ID NO: 2634452 - RNA, 22 nt, Escherichia coli CFT073
cccagcaucacgcccgcuuuuu

SEQ ID NO: 2634453 - RNA, 14 nt, Escherichia coli CFT073
cccagccaguccug

SEQ ID NO: 2634454 - RNA, 13 nt, Escherichia coli CFT073
cccagcccagcgc

SEQ ID NO: 2634455 - RNA, 16 nt, Escherichia coli CFT073
cccagcccagcggaaa

SEQ ID NO: 2634456 - RNA, 23 nt, Escherichia coli CFT073
cccagccgcaaacgacacugcuc

SEQ ID NO: 2634457 - RNA, 18 nt, Escherichia coli CFT073
cccagccgguaaggccaa

SEQ ID NO: 2634458 - RNA, 17 nt, Escherichia coli CFT073
cccagccggucagcagg

SEQ ID NO: 2634459 - RNA, 15 nt, Escherichia coli CFT073
cccagccuuuccagc

SEQ ID NO: 2634460 - RNA, 14 nt, Escherichia coli CFT073
cccagcgaagcaaa

SEQ ID NO: 2634461 - RNA, 15 nt, Escherichia coli CFT073
cccagcgaccacaaa

SEQ ID NO: 2634462 - RNA, 17 nt, Escherichia coli CFT073
cccagcgaggcaaucag

SEQ ID NO: 2634463 - RNA, 18 nt, Escherichia coli CFT073
cccagcgcaagggccgcc

SEQ ID NO: 2634464 - RNA, 12 nt, Escherichia coli CFT073
cccagcgccugg

SEQ ID NO: 2634465 - RNA, 18 nt, Escherichia coli CFT073
cccagcgccuggcagcau

SEQ ID NO: 2634466 - RNA, 14 nt, Escherichia coli CFT073
cccagcgcgaaaga

SEQ ID NO: 2634467 - RNA, 14 nt, Escherichia coli CFT073
cccagcggaaaaua

SEQ ID NO: 2634468 - RNA, 21 nt, Escherichia coli CFT073
cccagcggaaaauaucaccaa

SEQ ID NO: 2634469 - RNA, 22 nt, Escherichia coli CFT073
cccagcggaaauuaccgcacca

SEQ ID NO: 2634470 - RNA, 20 nt, Escherichia coli CFT073
cccagcggaugacccagcgc

SEQ ID NO: 2634471 - RNA, 15 nt, Escherichia coli CFT073
cccagcgucagcagc

SEQ ID NO: 2634472 - RNA, 16 nt, Escherichia coli CFT073
cccagcgucagcagca

SEQ ID NO: 2634473 - RNA, 18 nt, Escherichia coli CFT073
cccagcgucagcagcaau

SEQ ID NO: 2634474 - RNA, 19 nt, Escherichia coli CFT073
cccagcgucggaaucccuu

SEQ ID NO: 2634475 - RNA, 17 nt, Escherichia coli CFT073
cccagcguugcagagag

SEQ ID NO: 2634476 - RNA, 16 nt, Escherichia coli CFT073
cccagcguuugcugcu

SEQ ID NO: 2634477 - RNA, 21 nt, Escherichia coli CFT073
cccagcuggcgccaggcuuca

SEQ ID NO: 2634478 - RNA, 16 nt, Escherichia coli CFT073
cccaggcauccaguug

SEQ ID NO: 2634479 - RNA, 16 nt, Escherichia coli CFT073
cccaggccaucgccac

SEQ ID NO: 2634480 - RNA, 16 nt, Escherichia coli CFT073
cccaggcugugcgcca

SEQ ID NO: 2634481 - RNA, 18 nt, Escherichia coli CFT073
cccagggaaacagccacc

SEQ ID NO: 2634482 - RNA, 17 nt, Escherichia coli CFT073
cccagggaucaccugcg

SEQ ID NO: 2634483 - RNA, 23 nt, Escherichia coli CFT073
cccagguaucguugaugcucuug

SEQ ID NO: 2634484 - RNA, 19 nt, Escherichia coli CFT073
cccaggucaauaauuucuc

SEQ ID NO: 2634485 - RNA, 20 nt, Escherichia coli CFT073
cccagguuugacgccugcag

SEQ ID NO: 2634486 - RNA, 21 nt, Escherichia coli CFT073
cccagguuugacgccugcagc

SEQ ID NO: 2634487 - RNA, 13 nt, Escherichia coli CFT073
cccaguaccgcca

SEQ ID NO: 2634488 - RNA, 22 nt, Escherichia coli CFT073
cccagucaagaaaacuuaucuu

SEQ ID NO: 2634489 - RNA, 15 nt, Escherichia coli CFT073
cccagucccaccauc

SEQ ID NO: 2634490 - RNA, 16 nt, Escherichia coli CFT073
cccaguccgcucgccg

SEQ ID NO: 2634491 - RNA, 17 nt, Escherichia coli CFT073
cccaguccgcucgccgc

SEQ ID NO: 2634492 - RNA, 17 nt, Escherichia coli CFT073
cccagucgccaguaauc

SEQ ID NO: 2634493 - RNA, 15 nt, Escherichia coli CFT073
cccagucgucauccc

SEQ ID NO: 2634494 - RNA, 20 nt, Escherichia coli CFT073
cccagucgucaucccagucc

SEQ ID NO: 2634495 - RNA, 21 nt, Escherichia coli CFT073
cccagucgucaucccaguccu

SEQ ID NO: 2634496 - RNA, 14 nt, Escherichia coli CFT073
cccagucuuuccau

SEQ ID NO: 2634497 - RNA, 22 nt, Escherichia coli CFT073
cccagugaauccagcaugcuca

SEQ ID NO: 2634498 - RNA, 16 nt, Escherichia coli CFT073
cccagugccagcacca

SEQ ID NO: 2634499 - RNA, 15 nt, Escherichia coli CFT073
cccaguggcagcaau

SEQ ID NO: 2634500 - RNA, 20 nt, Escherichia coli CFT073
cccaguuacugccaucuucc

SEQ ID NO: 2634501 - RNA, 15 nt, Escherichia coli CFT073
cccaguucaaacggc

SEQ ID NO: 2634502 - RNA, 18 nt, Escherichia coli CFT073
cccaguugugcugccagc

SEQ ID NO: 2634503 - RNA, 15 nt, Escherichia coli CFT073
cccaguuuaccgaaa

SEQ ID NO: 2634504 - RNA, 14 nt, Escherichia coli CFT073
cccaguuuuccauc

SEQ ID NO: 2634505 - RNA, 23 nt, Escherichia coli CFT073
cccaguuuugcgcguuggcaaga

SEQ ID NO: 2634506 - RNA, 14 nt, Escherichia coli CFT073
cccauaccacagca

SEQ ID NO: 2634507 - RNA, 13 nt, Escherichia coli CFT073
cccauacccacca

SEQ ID NO: 2634508 - RNA, 17 nt, Escherichia coli CFT073
cccauacucaucuucca

SEQ ID NO: 2634509 - RNA, 18 nt, Escherichia coli CFT073
cccauaugcagccacugc

SEQ ID NO: 2634510 - RNA, 20 nt, Escherichia coli CFT073
cccauauguucccgcgccuc

SEQ ID NO: 2634511 - RNA, 19 nt, Escherichia coli CFT073
cccauauuggcaacagcca

SEQ ID NO: 2634512 - RNA, 18 nt, Escherichia coli CFT073
cccaucaccggcacaaaa

SEQ ID NO: 2634513 - RNA, 24 nt, Escherichia coli CFT073
cccaucagcgguacucgcgcaguu

SEQ ID NO: 2634514 - RNA, 13 nt, Escherichia coli CFT073
cccaucaguagca

SEQ ID NO: 2634515 - RNA, 11 nt, Escherichia coli CFT073
cccauccacgc

SEQ ID NO: 2634516 - RNA, 16 nt, Escherichia coli CFT073
cccauccagcagagau

SEQ ID NO: 2634517 - RNA, 13 nt, Escherichia coli CFT073
cccaucgccacgc

SEQ ID NO: 2634518 - RNA, 12 nt, Escherichia coli CFT073
cccaucgccaga

SEQ ID NO: 2634519 - RNA, 13 nt, Escherichia coli CFT073
cccaucgccagca

SEQ ID NO: 2634520 - RNA, 14 nt, Escherichia coli CFT073
cccaucgccagcac

SEQ ID NO: 2634521 - RNA, 19 nt, Escherichia coli CFT073
cccaucgcgcccgccgcca

SEQ ID NO: 2634522 - RNA, 15 nt, Escherichia coli CFT073
cccaucgugauaaac

SEQ ID NO: 2634523 - RNA, 20 nt, Escherichia coli CFT073
cccgcaacgcccugcaacug

SEQ ID NO: 2634524 - RNA, 15 nt, Escherichia coli CFT073
cccgcaaugcaauca

SEQ ID NO: 2634525 - RNA, 19 nt, Escherichia coli CFT073
cccgcacaaauagccagca

SEQ ID NO: 2634526 - RNA, 15 nt, Escherichia coli CFT073
cccgcagcacggcga

SEQ ID NO: 2634527 - RNA, 12 nt, Escherichia coli CFT073
cccgcagccacg

SEQ ID NO: 2634528 - RNA, 13 nt, Escherichia coli CFT073
cccgcagccagca

SEQ ID NO: 2634529 - RNA, 17 nt, Escherichia coli CFT073
cccgcagccgauuuuau

SEQ ID NO: 2634530 - RNA, 13 nt, Escherichia coli CFT073
cccgcagcggcga

SEQ ID NO: 2634531 - RNA, 17 nt, Escherichia coli CFT073
cccgcauccgcugaugc

SEQ ID NO: 2634532 - RNA, 16 nt, Escherichia coli CFT073
cccgcauuuacucuca

SEQ ID NO: 2634533 - RNA, 14 nt, Escherichia coli CFT073
cccgccaccggcuu

SEQ ID NO: 2634534 - RNA, 12 nt, Escherichia coli CFT073
cccgccagacca

SEQ ID NO: 2634535 - RNA, 19 nt, Escherichia coli CFT073
cccgccagcacgaccgcca

SEQ ID NO: 2634536 - RNA, 14 nt, Escherichia coli CFT073
cccgccagcagaau

SEQ ID NO: 2634537 - RNA, 19 nt, Escherichia coli CFT073
cccgccagcaugccgccaa

SEQ ID NO: 2634538 - RNA, 16 nt, Escherichia coli CFT073
cccgccagcgcgcgcg

SEQ ID NO: 2634539 - RNA, 14 nt, Escherichia coli CFT073
cccgccagcgucuc

SEQ ID NO: 2634540 - RNA, 23 nt, Escherichia coli CFT073
cccgccagugcuuucagugccug

SEQ ID NO: 2634541 - RNA, 18 nt, Escherichia coli CFT073
cccgccaucaucccuaca

SEQ ID NO: 2634542 - RNA, 16 nt, Escherichia coli CFT073
cccgccaucgcccauc

SEQ ID NO: 2634543 - RNA, 16 nt, Escherichia coli CFT073
cccgcccccgccagcg

SEQ ID NO: 2634544 - RNA, 15 nt, Escherichia coli CFT073
cccgccccugacagg

SEQ ID NO: 2634545 - RNA, 20 nt, Escherichia coli CFT073
cccgccggugagcacaucag

SEQ ID NO: 2634546 - RNA, 13 nt, Escherichia coli CFT073
cccgccugcugcg

SEQ ID NO: 2634547 - RNA, 21 nt, Escherichia coli CFT073
cccgcgacaaucgcccccauc

SEQ ID NO: 2634548 - RNA, 18 nt, Escherichia coli CFT073
cccgcgauaaaaauccug

SEQ ID NO: 2634549 - RNA, 18 nt, Escherichia coli CFT073
cccgcgauggcuggaauc

SEQ ID NO: 2634550 - RNA, 12 nt, Escherichia coli CFT073
cccgcgccagcg

SEQ ID NO: 2634551 - RNA, 13 nt, Escherichia coli CFT073
cccgcgcccaggc

SEQ ID NO: 2634552 - RNA, 18 nt, Escherichia coli CFT073
cccgcgccucaacgccua

SEQ ID NO: 2634553 - RNA, 17 nt, Escherichia coli CFT073
cccgcggcgcagcucca

SEQ ID NO: 2634554 - RNA, 18 nt, Escherichia coli CFT073
cccgcgucguucaucgca

SEQ ID NO: 2634555 - RNA, 12 nt, Escherichia coli CFT073
cccgcguucugg

SEQ ID NO: 2634556 - RNA, 19 nt, Escherichia coli CFT073
cccgcguuucgcugcgucu

SEQ ID NO: 2634557 - RNA, 22 nt, Escherichia coli CFT073
cccgcguuucgcugcgucuucc

SEQ ID NO: 2634558 - RNA, 23 nt, Escherichia coli CFT073
cccgcuaaugcgacccacgcccc

SEQ ID NO: 2634559 - RNA, 22 nt, Escherichia coli CFT073
cccgcuaccugccgccaccaug

SEQ ID NO: 2634560 - RNA, 13 nt, Escherichia coli CFT073
cccgcucauaaua

SEQ ID NO: 2634561 - RNA, 17 nt, Escherichia coli CFT073
cccgcuucaaacgcuga

SEQ ID NO: 2634562 - RNA, 12 nt, Escherichia coli CFT073
cccgcuucgccc

SEQ ID NO: 2634563 - RNA, 15 nt, Escherichia coli CFT073
cccgcuucgcccgcc

SEQ ID NO: 2634564 - RNA, 13 nt, Escherichia coli CFT073
cccgcuucgccug

SEQ ID NO: 2634565 - RNA, 14 nt, Escherichia coli CFT073
cccgcuucuuccag

SEQ ID NO: 2634566 - RNA, 23 nt, Escherichia coli CFT073
cccgcuuuggcaucuucugccgg

SEQ ID NO: 2634567 - RNA, 17 nt, Escherichia coli CFT073
cccgcuuuucgccaguu

SEQ ID NO: 2634568 - RNA, 23 nt, Escherichia coli CFT073
cccggaacgggagaaacccggcc

SEQ ID NO: 2634569 - RNA, 17 nt, Escherichia coli CFT073
cccggaagcaucaaacg

SEQ ID NO: 2634570 - RNA, 13 nt, Escherichia coli CFT073
cccggaagccacc

SEQ ID NO: 2634571 - RNA, 20 nt, Escherichia coli CFT073
cccggaagccaccacgccaa

SEQ ID NO: 2634572 - RNA, 23 nt, Escherichia coli CFT073
cccggaagccaccacgccaagaa

SEQ ID NO: 2634573 - RNA, 13 nt, Escherichia coli CFT073
cccggaaucgcgu

SEQ ID NO: 2634574 - RNA, 13 nt, Escherichia coli CFT073
cccggagacgccg

SEQ ID NO: 2634575 - RNA, 16 nt, Escherichia coli CFT073
cccggauuacagcuca

SEQ ID NO: 2634576 - RNA, 23 nt, Escherichia coli CFT073
cccggauuacgcaucaguuucau

SEQ ID NO: 2634577 - RNA, 20 nt, Escherichia coli CFT073
cccggauuuuuuugcaguug

SEQ ID NO: 2634578 - RNA, 17 nt, Escherichia coli CFT073
cccggcaaaaaacacuc

SEQ ID NO: 2634579 - RNA, 23 nt, Escherichia coli CFT073
cccggcaaaauagaguguuccuc

SEQ ID NO: 2634580 - RNA, 16 nt, Escherichia coli CFT073
cccggcaaacucuacc

SEQ ID NO: 2634581 - RNA, 20 nt, Escherichia coli CFT073
cccggcaacaaauucacgcc

SEQ ID NO: 2634582 - RNA, 22 nt, Escherichia coli CFT073
cccggcaacguugccaguacca

SEQ ID NO: 2634583 - RNA, 21 nt, Escherichia coli CFT073
cccggcaagaaauaccgaaga

SEQ ID NO: 2634584 - RNA, 23 nt, Escherichia coli CFT073
cccggcaagaaauaccgaagagu

SEQ ID NO: 2634585 - RNA, 18 nt, Escherichia coli CFT073
cccggcaagugucgccug

SEQ ID NO: 2634586 - RNA, 17 nt, Escherichia coli CFT073
cccggcaaucgccagau

SEQ ID NO: 2634587 - RNA, 22 nt, Escherichia coli CFT073
cccggcaaucgccagauccgcu

SEQ ID NO: 2634588 - RNA, 16 nt, Escherichia coli CFT073
cccggcaaugcgccga

SEQ ID NO: 2634589 - RNA, 15 nt, Escherichia coli CFT073
cccggcaauggugug

SEQ ID NO: 2634590 - RNA, 20 nt, Escherichia coli CFT073
cccggcacauggccgggguu

SEQ ID NO: 2634591 - RNA, 16 nt, Escherichia coli CFT073
cccggcaccaaucacc

SEQ ID NO: 2634592 - RNA, 14 nt, Escherichia coli CFT073
cccggcaccagcac

SEQ ID NO: 2634593 - RNA, 14 nt, Escherichia coli CFT073
cccggcagagaaaa

SEQ ID NO: 2634594 - RNA, 15 nt, Escherichia coli CFT073
cccggcagagaaaau

SEQ ID NO: 2634595 - RNA, 14 nt, Escherichia coli CFT073
cccggcaggaauau

SEQ ID NO: 2634596 - RNA, 13 nt, Escherichia coli CFT073
cccggcaucauua

SEQ ID NO: 2634597 - RNA, 21 nt, Escherichia coli CFT073
cccggcaucauuauucccccg

SEQ ID NO: 2634598 - RNA, 17 nt, Escherichia coli CFT073
cccggcauucaccucug

SEQ ID NO: 2634599 - RNA, 24 nt, Escherichia coli CFT073
cccggccaguacgcgggcaacgcc

SEQ ID NO: 2634600 - RNA, 18 nt, Escherichia coli CFT073
cccggccauacccgccag

SEQ ID NO: 2634601 - RNA, 22 nt, Escherichia coli CFT073
cccggccccuggucgcgcggca

SEQ ID NO: 2634602 - RNA, 15 nt, Escherichia coli CFT073
cccggccucaacaau

SEQ ID NO: 2634603 - RNA, 12 nt, Escherichia coli CFT073
cccggccugaua

SEQ ID NO: 2634604 - RNA, 15 nt, Escherichia coli CFT073
cccggcgcagcgcgc

SEQ ID NO: 2634605 - RNA, 17 nt, Escherichia coli CFT073
cccggcgcagcgcgcga

SEQ ID NO: 2634606 - RNA, 22 nt, Escherichia coli CFT073
cccggcguggugcagccgccau

SEQ ID NO: 2634607 - RNA, 14 nt, Escherichia coli CFT073
cccggcguuaucgg

SEQ ID NO: 2634608 - RNA, 19 nt, Escherichia coli CFT073
cccggcguuuucagaucca

SEQ ID NO: 2634609 - RNA, 15 nt, Escherichia coli CFT073
cccggcuaacagucu

SEQ ID NO: 2634610 - RNA, 14 nt, Escherichia coli CFT073
cccggcuuccugca

SEQ ID NO: 2634611 - RNA, 13 nt, Escherichia coli CFT073
cccgggcuuuauc

SEQ ID NO: 2634612 - RNA, 18 nt, Escherichia coli CFT073
cccgguaaagcgcaugau

SEQ ID NO: 2634613 - RNA, 21 nt, Escherichia coli CFT073
cccgguaccuuugaacugcug

SEQ ID NO: 2634614 - RNA, 22 nt, Escherichia coli CFT073
cccgguauccaucagacuuugc

SEQ ID NO: 2634615 - RNA, 15 nt, Escherichia coli CFT073
cccggucaucaaauu

SEQ ID NO: 2634616 - RNA, 23 nt, Escherichia coli CFT073
cccgguccuucaucuucaacggc

SEQ ID NO: 2634617 - RNA, 19 nt, Escherichia coli CFT073
cccggugaccgucgagcag

SEQ ID NO: 2634618 - RNA, 13 nt, Escherichia coli CFT073
cccggugccgccg

SEQ ID NO: 2634619 - RNA, 23 nt, Escherichia coli CFT073
cccgguggcggcgucagcggcug

SEQ ID NO: 2634620 - RNA, 19 nt, Escherichia coli CFT073
cccgguguucccgcgccag

SEQ ID NO: 2634621 - RNA, 21 nt, Escherichia coli CFT073
cccgguuuaccaucacuuugc

SEQ ID NO: 2634622 - RNA, 13 nt, Escherichia coli CFT073
cccguaaaccaag

SEQ ID NO: 2634623 - RNA, 20 nt, Escherichia coli CFT073
cccguaccgguugucguggu

SEQ ID NO: 2634624 - RNA, 14 nt, Escherichia coli CFT073
cccguacugaaccc

SEQ ID NO: 2634625 - RNA, 15 nt, Escherichia coli CFT073
cccgucugcugcugc

SEQ ID NO: 2634626 - RNA, 16 nt, Escherichia coli CFT073
cccgugaagacuuugc

SEQ ID NO: 2634627 - RNA, 20 nt, Escherichia coli CFT073
cccgugacgggugacgccaa

SEQ ID NO: 2634628 - RNA, 17 nt, Escherichia coli CFT073
cccgugagucuccuuua

SEQ ID NO: 2634629 - RNA, 12 nt, Escherichia coli CFT073
cccgugcugcuu

SEQ ID NO: 2634630 - RNA, 20 nt, Escherichia coli CFT073
cccgugcugcuuuuaaugcu

SEQ ID NO: 2634631 - RNA, 13 nt, Escherichia coli CFT073
cccgugucccagg

SEQ ID NO: 2634632 - RNA, 19 nt, Escherichia coli CFT073
ccgaagaguaaccaaacgu

SEQ ID NO: 2634633 - RNA, 18 nt, Escherichia coli CFT073
ccgaagcagcugcuggug

SEQ ID NO: 2634634 - RNA, 16 nt, Escherichia coli CFT073
ccgaagcgccaauacc

SEQ ID NO: 2634635 - RNA, 14 nt, Escherichia coli CFT073
ccgaagcgccuuua

SEQ ID NO: 2634636 - RNA, 22 nt, Escherichia coli CFT073
ccgaagcggugagguucagucc

SEQ ID NO: 2634637 - RNA, 17 nt, Escherichia coli CFT073
ccgaaguucauccauac

SEQ ID NO: 2634638 - RNA, 21 nt, Escherichia coli CFT073
ccgaaguucauccauaccaca

SEQ ID NO: 2634639 - RNA, 19 nt, Escherichia coli CFT073
ccgaaguucguacacccgc

SEQ ID NO: 2634640 - RNA, 20 nt, Escherichia coli CFT073
ccgaaguucguacacccgcc

SEQ ID NO: 2634641 - RNA, 16 nt, Escherichia coli CFT073
ccgaauagaacauaau

SEQ ID NO: 2634642 - RNA, 17 nt, Escherichia coli CFT073
ccgaauagaacauaaug

SEQ ID NO: 2634643 - RNA, 12 nt, Escherichia coli CFT073
ccgaaugcgccu

SEQ ID NO: 2634644 - RNA, 21 nt, Escherichia coli CFT073
ccgaaugggccuuucaacuau

SEQ ID NO: 2634645 - RNA, 16 nt, Escherichia coli CFT073
ccgacaaacagcgaga

SEQ ID NO: 2634646 - RNA, 22 nt, Escherichia coli CFT073
ccgacaaauguguucagcgaca

SEQ ID NO: 2634647 - RNA, 15 nt, Escherichia coli CFT073
ccgacaaccggugcu

SEQ ID NO: 2634648 - RNA, 17 nt, Escherichia coli CFT073
ccgacaaccggugcugc

SEQ ID NO: 2634649 - RNA, 17 nt, Escherichia coli CFT073
ccgacaaucucuucgag

SEQ ID NO: 2634650 - RNA, 19 nt, Escherichia coli CFT073
ccgacaaucucuucgagaa

SEQ ID NO: 2634651 - RNA, 13 nt, Escherichia coli CFT073
ccgacaauggcgc

SEQ ID NO: 2634652 - RNA, 11 nt, Escherichia coli CFT073
ccgacaccagc

SEQ ID NO: 2634653 - RNA, 13 nt, Escherichia coli CFT073
ccgacaccgccug

SEQ ID NO: 2634654 - RNA, 15 nt, Escherichia coli CFT073
ccgacaccgccugua

SEQ ID NO: 2634655 - RNA, 17 nt, Escherichia coli CFT073
ccgacaccggcagagau

SEQ ID NO: 2634656 - RNA, 21 nt, Escherichia coli CFT073
ccgacacuauaucucaaucaa

SEQ ID NO: 2634657 - RNA, 13 nt, Escherichia coli CFT073
ccgacacuggcag

SEQ ID NO: 2634658 - RNA, 15 nt, Escherichia coli CFT073
ccgacacuggcagug

SEQ ID NO: 2634659 - RNA, 16 nt, Escherichia coli CFT073
ccgacagauaaaucau

SEQ ID NO: 2634660 - RNA, 15 nt, Escherichia coli CFT073
ccgacaucaacgccu

SEQ ID NO: 2634661 - RNA, 18 nt, Escherichia coli CFT073
ccgacaucaacgccugau

SEQ ID NO: 2634662 - RNA, 12 nt, Escherichia coli CFT073
ccgacaucacgg

SEQ ID NO: 2634663 - RNA, 16 nt, Escherichia coli CFT073
ccgacaucugccaguu

SEQ ID NO: 2634664 - RNA, 21 nt, Escherichia coli CFT073
ccgacauuaucaccgacaaac

SEQ ID NO: 2634665 - RNA, 23 nt, Escherichia coli CFT073
ccgacauuaucaccgacaaacag

SEQ ID NO: 2634666 - RNA, 17 nt, Escherichia coli CFT073
ccgacauuucugcugcc

SEQ ID NO: 2634667 - RNA, 10 nt, Escherichia coli CFT073
ccgaccacuu

SEQ ID NO: 2634668 - RNA, 19 nt, Escherichia coli CFT073
ccgaccaucgccagcucaa

SEQ ID NO: 2634669 - RNA, 20 nt, Escherichia coli CFT073
ccgaccaucggcacgaccag

SEQ ID NO: 2634670 - RNA, 15 nt, Escherichia coli CFT073
ccgaccgcaaggaag

SEQ ID NO: 2634671 - RNA, 12 nt, Escherichia coli CFT073
ccgaccucaaca

SEQ ID NO: 2634672 - RNA, 20 nt, Escherichia coli CFT073
ccgacgacgaccagcggcaa

SEQ ID NO: 2634673 - RNA, 23 nt, Escherichia coli CFT073
ccgacgagaaaugucggcccgca

SEQ ID NO: 2634674 - RNA, 18 nt, Escherichia coli CFT073
ccgacgauaccgccgcac

SEQ ID NO: 2634675 - RNA, 21 nt, Escherichia coli CFT073
ccgacgauauuccgacggcga

SEQ ID NO: 2634676 - RNA, 14 nt, Escherichia coli CFT073
ccgacgcgccaggu

SEQ ID NO: 2634677 - RNA, 14 nt, Escherichia coli CFT073
ccgacgcuccugau

SEQ ID NO: 2634678 - RNA, 16 nt, Escherichia coli CFT073
ccgacgguauuaacuc

SEQ ID NO: 2634679 - RNA, 14 nt, Escherichia coli CFT073
ccgacguuacgcgc

SEQ ID NO: 2634680 - RNA, 22 nt, Escherichia coli CFT073
ccgacguugcguugccgccaau

SEQ ID NO: 2634681 - RNA, 17 nt, Escherichia coli CFT073
ccgacucaagcauccag

SEQ ID NO: 2634682 - RNA, 15 nt, Escherichia coli CFT073
ccgacugaaguucug

SEQ ID NO: 2634683 - RNA, 13 nt, Escherichia coli CFT073
ccgacuuauucuu

SEQ ID NO: 2634684 - RNA, 21 nt, Escherichia coli CFT073
ccgacuuugaaggauaagacg

SEQ ID NO: 2634685 - RNA, 22 nt, Escherichia coli CFT073
ccgagagaagcgcguucauccc

SEQ ID NO: 2634686 - RNA, 15 nt, Escherichia coli CFT073
ccgagauaaaugcca

SEQ ID NO: 2634687 - RNA, 16 nt, Escherichia coli CFT073
ccgagauaaaugccaa

SEQ ID NO: 2634688 - RNA, 21 nt, Escherichia coli CFT073
ccgagauauugauacaggaaa

SEQ ID NO: 2634689 - RNA, 15 nt, Escherichia coli CFT073
ccgagcaaugagcua

SEQ ID NO: 2634690 - RNA, 20 nt, Escherichia coli CFT073
ccgagcacaaagccgugcca

SEQ ID NO: 2634691 - RNA, 15 nt, Escherichia coli CFT073
ccgagccgguugccu

SEQ ID NO: 2634692 - RNA, 16 nt, Escherichia coli CFT073
ccgagcgcaagccacg

SEQ ID NO: 2634693 - RNA, 12 nt, Escherichia coli CFT073
ccgagcgcccgc

SEQ ID NO: 2634694 - RNA, 14 nt, Escherichia coli CFT073
ccgagcgcccgcca

SEQ ID NO: 2634695 - RNA, 22 nt, Escherichia coli CFT073
ccgagcggcaccacgagcggcg

SEQ ID NO: 2634696 - RNA, 13 nt, Escherichia coli CFT073
ccgaggcaaugcc

SEQ ID NO: 2634697 - RNA, 16 nt, Escherichia coli CFT073
ccgaggcauucagcca

SEQ ID NO: 2634698 - RNA, 17 nt, Escherichia coli CFT073
ccgaggcauucagccag

SEQ ID NO: 2634699 - RNA, 15 nt, Escherichia coli CFT073
ccgaggccaaaacca

SEQ ID NO: 2634700 - RNA, 17 nt, Escherichia coli CFT073
ccgaguagccagcugcc

SEQ ID NO: 2634701 - RNA, 18 nt, Escherichia coli CFT073
ccgaguagcucaccagca

SEQ ID NO: 2634702 - RNA, 14 nt, Escherichia coli CFT073
ccgauaaaacauua

SEQ ID NO: 2634703 - RNA, 15 nt, Escherichia coli CFT073
ccgauaaaacauuac

SEQ ID NO: 2634704 - RNA, 15 nt, Escherichia coli CFT073
ccgauaaaauaauca

SEQ ID NO: 2634705 - RNA, 13 nt, Escherichia coli CFT073
ccgauaaauaaua

SEQ ID NO: 2634706 - RNA, 16 nt, Escherichia coli CFT073
ccgauaaaugccacca

SEQ ID NO: 2634707 - RNA, 16 nt, Escherichia coli CFT073
ccgauaaccacgcuca

SEQ ID NO: 2634708 - RNA, 22 nt, Escherichia coli CFT073
ccgauaaccgcaaaaccaacgc

SEQ ID NO: 2634709 - RNA, 21 nt, Escherichia coli CFT073
ccgauaaucaacgcgccgcca

SEQ ID NO: 2634710 - RNA, 13 nt, Escherichia coli CFT073
ccgauacgcauaa

SEQ ID NO: 2634711 - RNA, 22 nt, Escherichia coli CFT073
ccgauacgcauaaacaucuucc

SEQ ID NO: 2634712 - RNA, 14 nt, Escherichia coli CFT073
ccgauauaaaaaau

SEQ ID NO: 2634713 - RNA, 17 nt, Escherichia coli CFT073
ccgauaucgcuggcaga

SEQ ID NO: 2634714 - RNA, 13 nt, Escherichia coli CFT073
ccgaucaaggcau

SEQ ID NO: 2634715 - RNA, 14 nt, Escherichia coli CFT073
ccgaucagauugag

SEQ ID NO: 2634716 - RNA, 19 nt, Escherichia coli CFT073
ccgaucaguaccagcccgc

SEQ ID NO: 2634717 - RNA, 15 nt, Escherichia coli CFT073
ccgaucaucaaaaaa

SEQ ID NO: 2634718 - RNA, 13 nt, Escherichia coli CFT073
ccgauccagcggu

SEQ ID NO: 2634719 - RNA, 14 nt, Escherichia coli CFT073
ccgauccggcacca

SEQ ID NO: 2634720 - RNA, 16 nt, Escherichia coli CFT073
ccgauccggcaccaau

SEQ ID NO: 2634721 - RNA, 15 nt, Escherichia coli CFT073
ccgaugaagucauug

SEQ ID NO: 2634722 - RNA, 21 nt, Escherichia coli CFT073
ccgaugacagaaucagcagcg

SEQ ID NO: 2634723 - RNA, 16 nt, Escherichia coli CFT073
ccgaugagcugcaacu

SEQ ID NO: 2634724 - RNA, 20 nt, Escherichia coli CFT073
ccgaugcauaugaaugccag

SEQ ID NO: 2634725 - RNA, 12 nt, Escherichia coli CFT073
ccgaugccagca

SEQ ID NO: 2634726 - RNA, 18 nt, Escherichia coli CFT073
ccgaugcccucaauaucu

SEQ ID NO: 2634727 - RNA, 23 nt, Escherichia coli CFT073
  misc_feature (14)..(14): n is a, c, g or u
ccgaugcgcaagcnuuaucgugc

SEQ ID NO: 2634728 - RNA, 19 nt, Escherichia coli CFT073
ccgaugcgcuuuaucgucg

SEQ ID NO: 2634729 - RNA, 18 nt, Escherichia coli CFT073
ccgauggcaaaagugaua

SEQ ID NO: 2634730 - RNA, 20 nt, Escherichia coli CFT073
ccgauggcgggauuuuuagc

SEQ ID NO: 2634731 - RNA, 16 nt, Escherichia coli CFT073
ccgauggugcagcaga

SEQ ID NO: 2634732 - RNA, 12 nt, Escherichia coli CFT073
ccgaugucugca

SEQ ID NO: 2634733 - RNA, 13 nt, Escherichia coli CFT073
ccgauuaaucagu

SEQ ID NO: 2634734 - RNA, 17 nt, Escherichia coli CFT073
ccgauuacucagcaacu

SEQ ID NO: 2634735 - RNA, 12 nt, Escherichia coli CFT073
ccgauugccaug

SEQ ID NO: 2634736 - RNA, 19 nt, Escherichia coli CFT073
ccgauugccauguuuuccu

SEQ ID NO: 2634737 - RNA, 22 nt, Escherichia coli CFT073
ccgauugccauguuuuccuuuu

SEQ ID NO: 2634738 - RNA, 20 nt, Escherichia coli CFT073
ccgauuucaugaagcugaca

SEQ ID NO: 2634739 - RNA, 13 nt, Escherichia coli CFT073
ccgauuuguucuc

SEQ ID NO: 2634740 - RNA, 22 nt, Escherichia coli CFT073
ccgauuuuauguaaagacuuca

SEQ ID NO: 2634741 - RNA, 13 nt, Escherichia coli CFT073
ccgccauaaacag

SEQ ID NO: 2634742 - RNA, 15 nt, Escherichia coli CFT073
ccgccauagaaagga

SEQ ID NO: 2634743 - RNA, 14 nt, Escherichia coli CFT073
ccgccauccaggua

SEQ ID NO: 2634744 - RNA, 15 nt, Escherichia coli CFT073
ccgccaucgcccgca

SEQ ID NO: 2634745 - RNA, 20 nt, Escherichia coli CFT073
ccgccaucggcgggauuuuu

SEQ ID NO: 2634746 - RNA, 18 nt, Escherichia coli CFT073
ccgccauuaaacgcagua

SEQ ID NO: 2634747 - RNA, 20 nt, Escherichia coli CFT073
ccgccauugacagaauauac

SEQ ID NO: 2634748 - RNA, 15 nt, Escherichia coli CFT073
ccgccauuuccagcg

SEQ ID NO: 2634749 - RNA, 16 nt, Escherichia coli CFT073
ccgccauuuccagcgu

SEQ ID NO: 2634750 - RNA, 16 nt, Escherichia coli CFT073
ccgcccagcagcgccg

SEQ ID NO: 2634751 - RNA, 17 nt, Escherichia coli CFT073
ccgcccagugccagcac

SEQ ID NO: 2634752 - RNA, 14 nt, Escherichia coli CFT073
ccgcccauccaggg

SEQ ID NO: 2634753 - RNA, 14 nt, Escherichia coli CFT073
ccgcccccgccagc

SEQ ID NO: 2634754 - RNA, 13 nt, Escherichia coli CFT073
ccgccccggcgau

SEQ ID NO: 2634755 - RNA, 17 nt, Escherichia coli CFT073
ccgcccgaugaauagca

SEQ ID NO: 2634756 - RNA, 22 nt, Escherichia coli CFT073
ccgcccgucaaacguaccgcca

SEQ ID NO: 2634757 - RNA, 23 nt, Escherichia coli CFT073
ccgcccguuuucuccagcgccgc

SEQ ID NO: 2634758 - RNA, 16 nt, Escherichia coli CFT073
ccgcccuuuuucuuau

SEQ ID NO: 2634759 - RNA, 18 nt, Escherichia coli CFT073
ccgccgaccaacgcagaa

SEQ ID NO: 2634760 - RNA, 13 nt, Escherichia coli CFT073
ccgccgagaaaua

SEQ ID NO: 2634761 - RNA, 13 nt, Escherichia coli CFT073
ccgccgaggccga

SEQ ID NO: 2634762 - RNA, 21 nt, Escherichia coli CFT073
ccgccgcauuauggugaagaa

SEQ ID NO: 2634763 - RNA, 15 nt, Escherichia coli CFT073
ccgccgccaaacugu

SEQ ID NO: 2634764 - RNA, 14 nt, Escherichia coli CFT073
ccgccgccaaucgc

SEQ ID NO: 2634765 - RNA, 15 nt, Escherichia coli CFT073
ccgccgccacaauca

SEQ ID NO: 2634766 - RNA, 23 nt, Escherichia coli CFT073
ccgccgccacuucuggcggcggc

SEQ ID NO: 2634767 - RNA, 11 nt, Escherichia coli CFT073
ccgccgcccgg

SEQ ID NO: 2634768 - RNA, 18 nt, Escherichia coli CFT073
ccgccgcccggcaaaacg

SEQ ID NO: 2634769 - RNA, 12 nt, Escherichia coli CFT073
ccgccgccgcca

SEQ ID NO: 2634770 - RNA, 13 nt, Escherichia coli CFT073
ccgccgccgccac

SEQ ID NO: 2634771 - RNA, 12 nt, Escherichia coli CFT073
ccgccgcuccuc

SEQ ID NO: 2634772 - RNA, 14 nt, Escherichia coli CFT073
ccgccgcuccucau

SEQ ID NO: 2634773 - RNA, 16 nt, Escherichia coli CFT073
ccgccgcuggcgcagc

SEQ ID NO: 2634774 - RNA, 23 nt, Escherichia coli CFT073
ccgccggaaagcaguaccgcagc

SEQ ID NO: 2634775 - RNA, 15 nt, Escherichia coli CFT073
ccgccggaugcggcg

SEQ ID NO: 2634776 - RNA, 16 nt, Escherichia coli CFT073
ccgccggggcuggugg

SEQ ID NO: 2634777 - RNA, 23 nt, Escherichia coli CFT073
ccgccgguggcguuuccagcagu

SEQ ID NO: 2634778 - RNA, 16 nt, Escherichia coli CFT073
ccgccgguugccccgc

SEQ ID NO: 2634779 - RNA, 17 nt, Escherichia coli CFT073
ccgccguacgucagcgc

SEQ ID NO: 2634780 - RNA, 15 nt, Escherichia coli CFT073
ccgccgucagacgcg

SEQ ID NO: 2634781 - RNA, 20 nt, Escherichia coli CFT073
ccgccgugcggugggcuacg

SEQ ID NO: 2634782 - RNA, 19 nt, Escherichia coli CFT073
ccgccguuaccuucggccc

SEQ ID NO: 2634783 - RNA, 21 nt, Escherichia coli CFT073
ccgccguuaccuucggcccca

SEQ ID NO: 2634784 - RNA, 14 nt, Escherichia coli CFT073
ccgccguugcucuu

SEQ ID NO: 2634785 - RNA, 16 nt, Escherichia coli CFT073
ccgccuaauaccagaa

SEQ ID NO: 2634786 - RNA, 13 nt, Escherichia coli CFT073
ccgccucagccag

SEQ ID NO: 2634787 - RNA, 20 nt, Escherichia coli CFT073
ccgccucaucaucgcgcguu

SEQ ID NO: 2634788 - RNA, 13 nt, Escherichia coli CFT073
ccgccucgcucag

SEQ ID NO: 2634789 - RNA, 23 nt, Escherichia coli CFT073
ccgccugauuuacuuacuucugc

SEQ ID NO: 2634790 - RNA, 22 nt, Escherichia coli CFT073
ccgccugcaauucgcagaccgg

SEQ ID NO: 2634791 - RNA, 20 nt, Escherichia coli CFT073
ccgccugccuucccuucucu

SEQ ID NO: 2634792 - RNA, 17 nt, Escherichia coli CFT073
ccgccugcgugcaguuc

SEQ ID NO: 2634793 - RNA, 12 nt, Escherichia coli CFT073
ccgccugcugcg

SEQ ID NO: 2634794 - RNA, 21 nt, Escherichia coli CFT073
ccgccuggagguuuagccaaa

SEQ ID NO: 2634795 - RNA, 16 nt, Escherichia coli CFT073
ccgccuggugcaggcg

SEQ ID NO: 2634796 - RNA, 23 nt, Escherichia coli CFT073
ccgccuguaaacggaugacuucg

SEQ ID NO: 2634797 - RNA, 18 nt, Escherichia coli CFT073
ccgccuuuuuaauuugcc

SEQ ID NO: 2634798 - RNA, 19 nt, Escherichia coli CFT073
ccgcgaaccagaccagcaa

SEQ ID NO: 2634799 - RNA, 20 nt, Escherichia coli CFT073
ccgcgaagcagcuccagaau

SEQ ID NO: 2634800 - RNA, 17 nt, Escherichia coli CFT073
ccgcgaaguuuuuccag

SEQ ID NO: 2634801 - RNA, 18 nt, Escherichia coli CFT073
ccgcgaauuaugcagccu

SEQ ID NO: 2634802 - RNA, 14 nt, Escherichia coli CFT073
ccgcgacaauauca

SEQ ID NO: 2634803 - RNA, 21 nt, Escherichia coli CFT073
ccgcgacaaucgcccccauca

SEQ ID NO: 2634804 - RNA, 20 nt, Escherichia coli CFT073
ccgcgacaucgucuccagcg

SEQ ID NO: 2634805 - RNA, 16 nt, Escherichia coli CFT073
ccgcgacgacgacagg

SEQ ID NO: 2634806 - RNA, 14 nt, Escherichia coli CFT073
ccgcgagcaaaauc

SEQ ID NO: 2634807 - RNA, 17 nt, Escherichia coli CFT073
ccgcgauaccacccgca

SEQ ID NO: 2634808 - RNA, 22 nt, Escherichia coli CFT073
ccgcgauaccacccgcagugau

SEQ ID NO: 2634809 - RNA, 15 nt, Escherichia coli CFT073
ccgcgaucccagacc

SEQ ID NO: 2634810 - RNA, 15 nt, Escherichia coli CFT073
ccgcgauuuuguccu

SEQ ID NO: 2634811 - RNA, 21 nt, Escherichia coli CFT073
ccgcgcacgaggugccaccag

SEQ ID NO: 2634812 - RNA, 18 nt, Escherichia coli CFT073
ccgcgcauagcaccaccg

SEQ ID NO: 2634813 - RNA, 13 nt, Escherichia coli CFT073
ccgcgccaagccu

SEQ ID NO: 2634814 - RNA, 11 nt, Escherichia coli CFT073
ccgcgccagau

SEQ ID NO: 2634815 - RNA, 22 nt, Escherichia coli CFT073
ccgcgcccuuuugcuaagguca

SEQ ID NO: 2634816 - RNA, 20 nt, Escherichia coli CFT073
ccgcgccuucgugcggcugc

SEQ ID NO: 2634817 - RNA, 17 nt, Escherichia coli CFT073
ccgcgcggcgcaggcgc

SEQ ID NO: 2634818 - RNA, 24 nt, Escherichia coli CFT073
ccgcgcgugccggaacgccgcugg

SEQ ID NO: 2634819 - RNA, 18 nt, Escherichia coli CFT073
ccgcgcuaccacuuccca

SEQ ID NO: 2634820 - RNA, 22 nt, Escherichia coli CFT073
ccgcgcugcuguagcaguucca

SEQ ID NO: 2634821 - RNA, 20 nt, Escherichia coli CFT073
ccgcgcuucgcggacuucug

SEQ ID NO: 2634822 - RNA, 15 nt, Escherichia coli CFT073
ccgcgcuugccgccg

SEQ ID NO: 2634823 - RNA, 19 nt, Escherichia coli CFT073
ccgcgcuuucuucuucgcg

SEQ ID NO: 2634824 - RNA, 21 nt, Escherichia coli CFT073
ccgcggaacgcacuauacaac

SEQ ID NO: 2634825 - RNA, 12 nt, Escherichia coli CFT073
ccgcggcgcagc

SEQ ID NO: 2634826 - RNA, 15 nt, Escherichia coli CFT073
ccgcggcugcagcgg

SEQ ID NO: 2634827 - RNA, 13 nt, Escherichia coli CFT073
ccgcgggacaaau

SEQ ID NO: 2634828 - RNA, 15 nt, Escherichia coli CFT073
ccgcggggaucugga

SEQ ID NO: 2634829 - RNA, 14 nt, Escherichia coli CFT073
ccgcguaacuuuug

SEQ ID NO: 2634830 - RNA, 18 nt, Escherichia coli CFT073
ccgcgucauugacgcugg

SEQ ID NO: 2634831 - RNA, 20 nt, Escherichia coli CFT073
ccgcgucauugacgcuggcu

SEQ ID NO: 2634832 - RNA, 15 nt, Escherichia coli CFT073
ccgcgucgggcgacg

SEQ ID NO: 2634833 - RNA, 20 nt, Escherichia coli CFT073
ccgcgucguugaaaugcggc

SEQ ID NO: 2634834 - RNA, 21 nt, Escherichia coli CFT073
ccgcgucguugaaaugcggcg

SEQ ID NO: 2634835 - RNA, 21 nt, Escherichia coli CFT073
ccgcgucuuaucaggccuacg

SEQ ID NO: 2634836 - RNA, 16 nt, Escherichia coli CFT073
ccgcgugaugcggcau

SEQ ID NO: 2634837 - RNA, 18 nt, Escherichia coli CFT073
ccgcgugaugcggcaucu

SEQ ID NO: 2634838 - RNA, 15 nt, Escherichia coli CFT073
ccgcgugccaccauu

SEQ ID NO: 2634839 - RNA, 19 nt, Escherichia coli CFT073
ccgcguuccugacgaucaa

SEQ ID NO: 2634840 - RNA, 23 nt, Escherichia coli CFT073
ccgcguuccugacgaucaagcga

SEQ ID NO: 2634841 - RNA, 15 nt, Escherichia coli CFT073
ccgcguuggcgcagc

SEQ ID NO: 2634842 - RNA, 17 nt, Escherichia coli CFT073
ccgcguuuccacgcuga

SEQ ID NO: 2634843 - RNA, 18 nt, Escherichia coli CFT073
ccgcuaaauccgccgcca

SEQ ID NO: 2634844 - RNA, 13 nt, Escherichia coli CFT073
ccgcuaacagcag

SEQ ID NO: 2634845 - RNA, 20 nt, Escherichia coli CFT073
ccgcuaacugauacccggcu

SEQ ID NO: 2634846 - RNA, 19 nt, Escherichia coli CFT073
ccgcuaagcccgaugauga

SEQ ID NO: 2634847 - RNA, 19 nt, Escherichia coli CFT073
ccgcuacccgaacaccaau

SEQ ID NO: 2634848 - RNA, 20 nt, Escherichia coli CFT073
ccgcuaccgcccugagcauc

SEQ ID NO: 2634849 - RNA, 10 nt, Escherichia coli CFT073
ccggaugauu

SEQ ID NO: 2634850 - RNA, 19 nt, Escherichia coli CFT073
ccggaugauucacaucauc

SEQ ID NO: 2634851 - RNA, 15 nt, Escherichia coli CFT073
ccggaugcaaacgau

SEQ ID NO: 2634852 - RNA, 16 nt, Escherichia coli CFT073
ccggaugcccggucaa

SEQ ID NO: 2634853 - RNA, 19 nt, Escherichia coli CFT073
ccggaugcgacauagaucu

SEQ ID NO: 2634854 - RNA, 17 nt, Escherichia coli CFT073
ccggaugcgacgcacga

SEQ ID NO: 2634855 - RNA, 20 nt, Escherichia coli CFT073
ccggaugcgacgcuggccgc

SEQ ID NO: 2634856 - RNA, 22 nt, Escherichia coli CFT073
ccggaugcggcauaaacgccuu

SEQ ID NO: 2634857 - RNA, 23 nt, Escherichia coli CFT073
ccggaugcggcgagaacgccuua

SEQ ID NO: 2634858 - RNA, 22 nt, Escherichia coli CFT073
ccggaugcggcgugaacgccuu

SEQ ID NO: 2634859 - RNA, 22 nt, Escherichia coli CFT073
ccggauggauccccgcagcaaa

SEQ ID NO: 2634860 - RNA, 20 nt, Escherichia coli CFT073
ccggauggcaacagcagcca

SEQ ID NO: 2634861 - RNA, 21 nt, Escherichia coli CFT073
ccggauggcacgcauccggca

SEQ ID NO: 2634862 - RNA, 13 nt, Escherichia coli CFT073
ccggauggcagag

SEQ ID NO: 2634863 - RNA, 16 nt, Escherichia coli CFT073
ccggaugguaugccau

SEQ ID NO: 2634864 - RNA, 16 nt, Escherichia coli CFT073
ccggauguguugcauc

SEQ ID NO: 2634865 - RNA, 21 nt, Escherichia coli CFT073
ccggauuacgcaucaguuuca

SEQ ID NO: 2634866 - RNA, 14 nt, Escherichia coli CFT073
ccggauucaagcau

SEQ ID NO: 2634867 - RNA, 17 nt, Escherichia coli CFT073
ccggauuuucaccaucg

SEQ ID NO: 2634868 - RNA, 15 nt, Escherichia coli CFT073
ccggauuuuuaugac

SEQ ID NO: 2634869 - RNA, 17 nt, Escherichia coli CFT073
ccggcaaaaucaaugcc

SEQ ID NO: 2634870 - RNA, 20 nt, Escherichia coli CFT073
ccggcaaauuggcguggcgg

SEQ ID NO: 2634871 - RNA, 16 nt, Escherichia coli CFT073
ccggcaaccacaccca

SEQ ID NO: 2634872 - RNA, 13 nt, Escherichia coli CFT073
ccggcaaccagca

SEQ ID NO: 2634873 - RNA, 14 nt, Escherichia coli CFT073
ccggcaaccagcac

SEQ ID NO: 2634874 - RNA, 15 nt, Escherichia coli CFT073
ccggcaaccggaucg

SEQ ID NO: 2634875 - RNA, 18 nt, Escherichia coli CFT073
ccggcaacgaccgcgagc

SEQ ID NO: 2634876 - RNA, 18 nt, Escherichia coli CFT073
ccggcaacgucaguccca

SEQ ID NO: 2634877 - RNA, 12 nt, Escherichia coli CFT073
ccggcaauaucc

SEQ ID NO: 2634878 - RNA, 21 nt, Escherichia coli CFT073
ccggcaaucaccgccagcggc

SEQ ID NO: 2634879 - RNA, 16 nt, Escherichia coli CFT073
ccggcaaucgccagau

SEQ ID NO: 2634880 - RNA, 18 nt, Escherichia coli CFT073
ccggcaaucgcgccagaa

SEQ ID NO: 2634881 - RNA, 20 nt, Escherichia coli CFT073
ccggcaauuagcuggaauaa

SEQ ID NO: 2634882 - RNA, 21 nt, Escherichia coli CFT073
ccggcaauucucacugauuac

SEQ ID NO: 2634883 - RNA, 17 nt, Escherichia coli CFT073
ccggcaauugcaccgcg

SEQ ID NO: 2634884 - RNA, 19 nt, Escherichia coli CFT073
ccggcaauuuugcgccgau

SEQ ID NO: 2634885 - RNA, 14 nt, Escherichia coli CFT073
ccggcacaaaacug

SEQ ID NO: 2634886 - RNA, 17 nt, Escherichia coli CFT073
ccggcacaucgccgaag

SEQ ID NO: 2634887 - RNA, 20 nt, Escherichia coli CFT073
ccggcaccaauguaggccug

SEQ ID NO: 2634888 - RNA, 14 nt, Escherichia coli CFT073
ccggcaccagcacc

SEQ ID NO: 2634889 - RNA, 12 nt, Escherichia coli CFT073
ccggcaccagcg

SEQ ID NO: 2634890 - RNA, 15 nt, Escherichia coli CFT073
ccggcaccagcgcug

SEQ ID NO: 2634891 - RNA, 14 nt, Escherichia coli CFT073
ccggcaccauucca

SEQ ID NO: 2634892 - RNA, 16 nt, Escherichia coli CFT073
ccggcaccugucagac

SEQ ID NO: 2634893 - RNA, 20 nt, Escherichia coli CFT073
ccggcacguuuuggcaggca

SEQ ID NO: 2634894 - RNA, 16 nt, Escherichia coli CFT073
ccggcacuaacgcaaa

SEQ ID NO: 2634895 - RNA, 22 nt, Escherichia coli CFT073
ccggcacugaaagagucgccag

SEQ ID NO: 2634896 - RNA, 16 nt, Escherichia coli CFT073
ccggcacuuacuuucc

SEQ ID NO: 2634897 - RNA, 14 nt, Escherichia coli CFT073
ccggcacuucaacu

SEQ ID NO: 2634898 - RNA, 13 nt, Escherichia coli CFT073
ccggcagaaacca

SEQ ID NO: 2634899 - RNA, 16 nt, Escherichia coli CFT073
ccggcagaccaucguc

SEQ ID NO: 2634900 - RNA, 17 nt, Escherichia coli CFT073
ccggcagaccaucguca

SEQ ID NO: 2634901 - RNA, 13 nt, Escherichia coli CFT073
ccggcagagaaaa

SEQ ID NO: 2634902 - RNA, 22 nt, Escherichia coli CFT073
ccggcagagaaaaugccgcaca

SEQ ID NO: 2634903 - RNA, 13 nt, Escherichia coli CFT073
ccggcagcuucac

SEQ ID NO: 2634904 - RNA, 23 nt, Escherichia coli CFT073
ccggcaggaaauuaagaucagaa

SEQ ID NO: 2634905 - RNA, 12 nt, Escherichia coli CFT073
ccggcagugauc

SEQ ID NO: 2634906 - RNA, 20 nt, Escherichia coli CFT073
ccggcagugcuuucauuuca

SEQ ID NO: 2634907 - RNA, 18 nt, Escherichia coli CFT073
ccggcauaaacaaagcgc

SEQ ID NO: 2634908 - RNA, 13 nt, Escherichia coli CFT073
ccggcauaacaug

SEQ ID NO: 2634909 - RNA, 15 nt, Escherichia coli CFT073
ccggcauaauaagcc

SEQ ID NO: 2634910 - RNA, 16 nt, Escherichia coli CFT073
ccggcaucaaccagca

SEQ ID NO: 2634911 - RNA, 13 nt, Escherichia coli CFT073
ccggcaucaguaa

SEQ ID NO: 2634912 - RNA, 12 nt, Escherichia coli CFT073
ccggcauccaga

SEQ ID NO: 2634913 - RNA, 17 nt, Escherichia coli CFT073
ccggcaucgcaaaccag

SEQ ID NO: 2634914 - RNA, 13 nt, Escherichia coli CFT073
ccggcaucgccag

SEQ ID NO: 2634915 - RNA, 16 nt, Escherichia coli CFT073
ccggcaucuuuaacgu

SEQ ID NO: 2634916 - RNA, 17 nt, Escherichia coli CFT073
ccggcaugacgccgggc

SEQ ID NO: 2634917 - RNA, 19 nt, Escherichia coli CFT073
ccggcauggugagcgcaca

SEQ ID NO: 2634918 - RNA, 22 nt, Escherichia coli CFT073
ccggcauguuuaauucugcggc

SEQ ID NO: 2634919 - RNA, 20 nt, Escherichia coli CFT073
ccggcauuaucacaucagcg

SEQ ID NO: 2634920 - RNA, 21 nt, Escherichia coli CFT073
ccggcauuaucacaucagcgc

SEQ ID NO: 2634921 - RNA, 21 nt, Escherichia coli CFT073
ccggcauugacgaugccgucg

SEQ ID NO: 2634922 - RNA, 23 nt, Escherichia coli CFT073
ccggcauuucggcccaugacaaa

SEQ ID NO: 2634923 - RNA, 23 nt, Escherichia coli CFT073
ccggcauuugagcauagugccug

SEQ ID NO: 2634924 - RNA, 23 nt, Escherichia coli CFT073
ccggcauuuuuuagcgccagcca

SEQ ID NO: 2634925 - RNA, 18 nt, Escherichia coli CFT073
ccggccagcaugccugug

SEQ ID NO: 2634926 - RNA, 20 nt, Escherichia coli CFT073
ccggccagcgccaccaccag

SEQ ID NO: 2634927 - RNA, 15 nt, Escherichia coli CFT073
ccggccaguccccuc

SEQ ID NO: 2634928 - RNA, 18 nt, Escherichia coli CFT073
ccggccaguccccucgcc

SEQ ID NO: 2634929 - RNA, 15 nt, Escherichia coli CFT073
ccggccccgucgccc

SEQ ID NO: 2634930 - RNA, 17 nt, Escherichia coli CFT073
ccggccccuggucgcgc

SEQ ID NO: 2634931 - RNA, 15 nt, Escherichia coli CFT073
ccggccuaccggacg

SEQ ID NO: 2634932 - RNA, 18 nt, Escherichia coli CFT073
ccggccuacgggaacagu

SEQ ID NO: 2634933 - RNA, 21 nt, Escherichia coli CFT073
ccggccuacgggaacagugcu

SEQ ID NO: 2634934 - RNA, 22 nt, Escherichia coli CFT073
ccggccuacguagaucacugaa

SEQ ID NO: 2634935 - RNA, 21 nt, Escherichia coli CFT073
ccggccuaucaacgucgucgu

SEQ ID NO: 2634936 - RNA, 22 nt, Escherichia coli CFT073
ccggccugcacugcaggccgga

SEQ ID NO: 2634937 - RNA, 15 nt, Escherichia coli CFT073
ccggccuugauuauu

SEQ ID NO: 2634938 - RNA, 19 nt, Escherichia coli CFT073
ccggcgacacaucuaaugc

SEQ ID NO: 2634939 - RNA, 14 nt, Escherichia coli CFT073
ccggcgacuuccug

SEQ ID NO: 2634940 - RNA, 19 nt, Escherichia coli CFT073
ccggcgauugauagcgacg

SEQ ID NO: 2634941 - RNA, 15 nt, Escherichia coli CFT073
ccggcgcacuggcgc

SEQ ID NO: 2634942 - RNA, 16 nt, Escherichia coli CFT073
ccggcguaugcccagg

SEQ ID NO: 2634943 - RNA, 23 nt, Escherichia coli CFT073
ccggcgucagauucggauccagc

SEQ ID NO: 2634944 - RNA, 15 nt, Escherichia coli CFT073
ccggcguccaccugc

SEQ ID NO: 2634945 - RNA, 16 nt, Escherichia coli CFT073
ccggcguccaccugcg

SEQ ID NO: 2634946 - RNA, 16 nt, Escherichia coli CFT073
ccggcguuucuggcaa

SEQ ID NO: 2634947 - RNA, 20 nt, Escherichia coli CFT073
ccggcguuuuuauuauuaaa

SEQ ID NO: 2634948 - RNA, 22 nt, Escherichia coli CFT073
ccggcuaacagucuggcguuuu

SEQ ID NO: 2634949 - RNA, 14 nt, Escherichia coli CFT073
ccggcuacgugccg

SEQ ID NO: 2634950 - RNA, 22 nt, Escherichia coli CFT073
ccggcuccaguuaacgccgcgc

SEQ ID NO: 2634951 - RNA, 16 nt, Escherichia coli CFT073
ccggcucccgcagcca

SEQ ID NO: 2634952 - RNA, 17 nt, Escherichia coli CFT073
ccggcucccgcagccac

SEQ ID NO: 2634953 - RNA, 19 nt, Escherichia coli CFT073
ccggcucccgcagccacuc

SEQ ID NO: 2634954 - RNA, 15 nt, Escherichia coli CFT073
ccggcugaccuggaa

SEQ ID NO: 2634955 - RNA, 19 nt, Escherichia coli CFT073
ccggcugcugcaaugccau

SEQ ID NO: 2634956 - RNA, 22 nt, Escherichia coli CFT073
ccggcugcugcaaugccauuca

SEQ ID NO: 2634957 - RNA, 12 nt, Escherichia coli CFT073
ccguagcguuuu

SEQ ID NO: 2634958 - RNA, 17 nt, Escherichia coli CFT073
ccguagcguuuuuucau

SEQ ID NO: 2634959 - RNA, 20 nt, Escherichia coli CFT073
ccguagcuggcaaugauauu

SEQ ID NO: 2634960 - RNA, 13 nt, Escherichia coli CFT073
ccguaguggccac

SEQ ID NO: 2634961 - RNA, 22 nt, Escherichia coli CFT073
ccguagugggucagcggcggcu

SEQ ID NO: 2634962 - RNA, 19 nt, Escherichia coli CFT073
ccguauguugcacaccagg

SEQ ID NO: 2634963 - RNA, 20 nt, Escherichia coli CFT073
ccgucaaacguaccgccaga

SEQ ID NO: 2634964 - RNA, 15 nt, Escherichia coli CFT073
ccgucaauaaaaacg

SEQ ID NO: 2634965 - RNA, 15 nt, Escherichia coli CFT073
ccgucaauaggcaua

SEQ ID NO: 2634966 - RNA, 24 nt, Escherichia coli CFT073
ccgucaauaggcauauagccgcca

SEQ ID NO: 2634967 - RNA, 21 nt, Escherichia coli CFT073
ccgucaauccagccgcccagc

SEQ ID NO: 2634968 - RNA, 21 nt, Escherichia coli CFT073
ccgucacaggcacaccgccgc

SEQ ID NO: 2634969 - RNA, 12 nt, Escherichia coli CFT073
ccgucaccagca

SEQ ID NO: 2634970 - RNA, 13 nt, Escherichia coli CFT073
ccgucaccagcau

SEQ ID NO: 2634971 - RNA, 15 nt, Escherichia coli CFT073
ccgucacgcagucag

SEQ ID NO: 2634972 - RNA, 14 nt, Escherichia coli CFT073
ccgucacuucuucg

SEQ ID NO: 2634973 - RNA, 23 nt, Escherichia coli CFT073
ccgucagcaaaguaccaucgucc

SEQ ID NO: 2634974 - RNA, 19 nt, Escherichia coli CFT073
ccgucagccagcacugaca

SEQ ID NO: 2634975 - RNA, 11 nt, Escherichia coli CFT073
ccgucagccgc

SEQ ID NO: 2634976 - RNA, 16 nt, Escherichia coli CFT073
ccgucagcgcaugauu

SEQ ID NO: 2634977 - RNA, 16 nt, Escherichia coli CFT073
ccgucagggccugcgu

SEQ ID NO: 2634978 - RNA, 19 nt, Escherichia coli CFT073
ccgucagggccugcgugug

SEQ ID NO: 2634979 - RNA, 22 nt, Escherichia coli CFT073
ccgucaguucauccauuaacag

SEQ ID NO: 2634980 - RNA, 20 nt, Escherichia coli CFT073
ccgucaguuuuucacccgca

SEQ ID NO: 2634981 - RNA, 21 nt, Escherichia coli CFT073
ccgucaguuuuucacccgcaa

SEQ ID NO: 2634982 - RNA, 17 nt, Escherichia coli CFT073
ccgucaucacgcaggcu

SEQ ID NO: 2634983 - RNA, 21 nt, Escherichia coli CFT073
ccgucaucgacgucagcagau

SEQ ID NO: 2634984 - RNA, 17 nt, Escherichia coli CFT073
ccgucaugucucucaga

SEQ ID NO: 2634985 - RNA, 23 nt, Escherichia coli CFT073
ccguccagaucaucccggcaaac

SEQ ID NO: 2634986 - RNA, 12 nt, Escherichia coli CFT073
ccguccagcguu

SEQ ID NO: 2634987 - RNA, 23 nt, Escherichia coli CFT073
ccguccggcacucaaucgccaaa

SEQ ID NO: 2634988 - RNA, 15 nt, Escherichia coli CFT073
ccguccggcaucgca

SEQ ID NO: 2634989 - RNA, 18 nt, Escherichia coli CFT073
ccgucgagaaucaacaca

SEQ ID NO: 2634990 - RNA, 16 nt, Escherichia coli CFT073
ccgucgauaugcaaau

SEQ ID NO: 2634991 - RNA, 21 nt, Escherichia coli CFT073
ccgucgcaauacccugaccca

SEQ ID NO: 2634992 - RNA, 10 nt, Escherichia coli CFT073
ccgucgcaug

SEQ ID NO: 2634993 - RNA, 21 nt, Escherichia coli CFT073
ccgucgcauggggaucgugau

SEQ ID NO: 2634994 - RNA, 19 nt, Escherichia coli CFT073
ccgucgccauugcagccgc

SEQ ID NO: 2634995 - RNA, 17 nt, Escherichia coli CFT073
ccgucgcccacagucug

SEQ ID NO: 2634996 - RNA, 17 nt, Escherichia coli CFT073
ccgucgccuucaacgua

SEQ ID NO: 2634997 - RNA, 13 nt, Escherichia coli CFT073
ccgucgcgccagg

SEQ ID NO: 2634998 - RNA, 18 nt, Escherichia coli CFT073
ccgucggcuucacgccca

SEQ ID NO: 2634999 - RNA, 19 nt, Escherichia coli CFT073
ccgucggcuucacgcccag

SEQ ID NO: 2635000 - RNA, 14 nt, Escherichia coli CFT073
ccgucgucccuucc

SEQ ID NO: 2635001 - RNA, 16 nt, Escherichia coli CFT073
ccgucguggucgugau

SEQ ID NO: 2635002 - RNA, 19 nt, Escherichia coli CFT073
ccgucguuaaugcgcccag

SEQ ID NO: 2635003 - RNA, 12 nt, Escherichia coli CFT073
ccgucugaaaac

SEQ ID NO: 2635004 - RNA, 17 nt, Escherichia coli CFT073
ccgucugccacuucuuc

SEQ ID NO: 2635005 - RNA, 19 nt, Escherichia coli CFT073
ccgucugccacuucuucca

SEQ ID NO: 2635006 - RNA, 22 nt, Escherichia coli CFT073
ccgucugggcaaaaucaucacu

SEQ ID NO: 2635007 - RNA, 17 nt, Escherichia coli CFT073
ccgucuucccgcagcca

SEQ ID NO: 2635008 - RNA, 18 nt, Escherichia coli CFT073
ccgucuucccgcagccac

SEQ ID NO: 2635009 - RNA, 21 nt, Escherichia coli CFT073
ccgucuuuauccagcaccacu

SEQ ID NO: 2635010 - RNA, 19 nt, Escherichia coli CFT073
ccgucuuuggcccauugca

SEQ ID NO: 2635011 - RNA, 19 nt, Escherichia coli CFT073
ccgugaacgugaccaugag

SEQ ID NO: 2635012 - RNA, 20 nt, Escherichia coli CFT073
ccgugacgguaacguugcuc

SEQ ID NO: 2635013 - RNA, 11 nt, Escherichia coli CFT073
ccgugacuuca

SEQ ID NO: 2635014 - RNA, 13 nt, Escherichia coli CFT073
ccgugagcaaugc

SEQ ID NO: 2635015 - RNA, 19 nt, Escherichia coli CFT073
ccgugaugauuucgauccg

SEQ ID NO: 2635016 - RNA, 13 nt, Escherichia coli CFT073
ccgugcacaccga

SEQ ID NO: 2635017 - RNA, 23 nt, Escherichia coli CFT073
ccgugcagcgcaaucgccuccag

SEQ ID NO: 2635018 - RNA, 20 nt, Escherichia coli CFT073
ccgugcagguucuuuuaaac

SEQ ID NO: 2635019 - RNA, 19 nt, Escherichia coli CFT073
ccgugcaucuccugaaaca

SEQ ID NO: 2635020 - RNA, 17 nt, Escherichia coli CFT073
ccgugcauuuuucgcuu

SEQ ID NO: 2635021 - RNA, 15 nt, Escherichia coli CFT073
ccgugccaauguuga

SEQ ID NO: 2635022 - RNA, 20 nt, Escherichia coli CFT073
ccgugccagcaccaaacugg

SEQ ID NO: 2635023 - RNA, 16 nt, Escherichia coli CFT073
ccgugccgcuguucug

SEQ ID NO: 2635024 - RNA, 13 nt, Escherichia coli CFT073
ccgugcgcuuuuu

SEQ ID NO: 2635025 - RNA, 15 nt, Escherichia coli CFT073
ccgugcggugggcua

SEQ ID NO: 2635026 - RNA, 17 nt, Escherichia coli CFT073
ccguggagugguucggu

SEQ ID NO: 2635027 - RNA, 19 nt, Escherichia coli CFT073
ccguggcaaauugcccaag

SEQ ID NO: 2635028 - RNA, 15 nt, Escherichia coli CFT073
ccgugguccagcugu

SEQ ID NO: 2635029 - RNA, 19 nt, Escherichia coli CFT073
ccguguaauucgccgucgu

SEQ ID NO: 2635030 - RNA, 21 nt, Escherichia coli CFT073
ccgugucgggagggagaaccc

SEQ ID NO: 2635031 - RNA, 21 nt, Escherichia coli CFT073
ccgugugacuguacaauaucg

SEQ ID NO: 2635032 - RNA, 23 nt, Escherichia coli CFT073
ccguguuguagauauccacaaca

SEQ ID NO: 2635033 - RNA, 14 nt, Escherichia coli CFT073
ccguuaaccaauau

SEQ ID NO: 2635034 - RNA, 16 nt, Escherichia coli CFT073
ccguuaacuaacggua

SEQ ID NO: 2635035 - RNA, 21 nt, Escherichia coli CFT073
ccguuacccgacgcgccaggu

SEQ ID NO: 2635036 - RNA, 14 nt, Escherichia coli CFT073
ccguuaccggaaga

SEQ ID NO: 2635037 - RNA, 13 nt, Escherichia coli CFT073
ccguuaccggacg

SEQ ID NO: 2635038 - RNA, 15 nt, Escherichia coli CFT073
ccguuaccggacggc

SEQ ID NO: 2635039 - RNA, 20 nt, Escherichia coli CFT073
ccguuacggaccacgcacag

SEQ ID NO: 2635040 - RNA, 21 nt, Escherichia coli CFT073
ccguuacggaccacgcacagc

SEQ ID NO: 2635041 - RNA, 21 nt, Escherichia coli CFT073
ccguuauacaucgcuuuccag

SEQ ID NO: 2635042 - RNA, 11 nt, Escherichia coli CFT073
ccguucaauuc

SEQ ID NO: 2635043 - RNA, 16 nt, Escherichia coli CFT073
ccguucagaucggcaa

SEQ ID NO: 2635044 - RNA, 17 nt, Escherichia coli CFT073
ccguucauccgcuucag

SEQ ID NO: 2635045 - RNA, 19 nt, Escherichia coli CFT073
ccguuccucaccguuuaau

SEQ ID NO: 2635046 - RNA, 20 nt, Escherichia coli CFT073
ccguucggugguaucaaaau

SEQ ID NO: 2635047 - RNA, 22 nt, Escherichia coli CFT073
ccguucggugguaucaaaauga

SEQ ID NO: 2635048 - RNA, 15 nt, Escherichia coli CFT073
ccguucguccgagcg

SEQ ID NO: 2635049 - RNA, 19 nt, Escherichia coli CFT073
ccguucuccucaacgaugc

SEQ ID NO: 2635050 - RNA, 20 nt, Escherichia coli CFT073
ccguucuggacuuccccugc

SEQ ID NO: 2635051 - RNA, 19 nt, Escherichia coli CFT073
ccguucuuaagauauaaag

SEQ ID NO: 2635052 - RNA, 12 nt, Escherichia coli CFT073
ccguucuucccg

SEQ ID NO: 2635053 - RNA, 13 nt, Escherichia coli CFT073
ccguucuuccuca

SEQ ID NO: 2635054 - RNA, 19 nt, Escherichia coli CFT073
ccguucuuccucaugcggc

SEQ ID NO: 2635055 - RNA, 17 nt, Escherichia coli CFT073
ccguucuucgccauaac

SEQ ID NO: 2635056 - RNA, 20 nt, Escherichia coli CFT073
ccguugacgaugucgacagg

SEQ ID NO: 2635057 - RNA, 21 nt, Escherichia coli CFT073
ccguugacgaugucgacagga

SEQ ID NO: 2635058 - RNA, 21 nt, Escherichia coli CFT073
ccguugcgcccaucaucaucg

SEQ ID NO: 2635059 - RNA, 21 nt, Escherichia coli CFT073
ccguugcuucgccgcaucguc

SEQ ID NO: 2635060 - RNA, 18 nt, Escherichia coli CFT073
ccguugggaaucgucagg

SEQ ID NO: 2635061 - RNA, 18 nt, Escherichia coli CFT073
ccguugugcugaugucag

SEQ ID NO: 2635062 - RNA, 18 nt, Escherichia coli CFT073
ccguuuaaagcguucacu

SEQ ID NO: 2635063 - RNA, 15 nt, Escherichia coli CFT073
ccguuuacggcuaaa

SEQ ID NO: 2635064 - RNA, 21 nt, Escherichia coli CFT073
ccguuugccagaacugcugcg

SEQ ID NO: 2635065 - RNA, 16 nt, Escherichia coli CFT073
ccucucaacgugcggg

SEQ ID NO: 2635066 - RNA, 21 nt, Escherichia coli CFT073
ccucuccccagaggggcgagg

SEQ ID NO: 2635067 - RNA, 18 nt, Escherichia coli CFT073
ccucugauuccugacguu

SEQ ID NO: 2635068 - RNA, 14 nt, Escherichia coli CFT073
ccucugcaacgucu

SEQ ID NO: 2635069 - RNA, 19 nt, Escherichia coli CFT073
ccucugcaacgucuucccg

SEQ ID NO: 2635070 - RNA, 20 nt, Escherichia coli CFT073
ccucugcaccagaacucccu

SEQ ID NO: 2635071 - RNA, 13 nt, Escherichia coli CFT073
ccucugcguuauu

SEQ ID NO: 2635072 - RNA, 13 nt, Escherichia coli CFT073
ccucuguuacuac

SEQ ID NO: 2635073 - RNA, 15 nt, Escherichia coli CFT073
ccucuucaauuaaca

SEQ ID NO: 2635074 - RNA, 16 nt, Escherichia coli CFT073
ccucuucaauuaacaa

SEQ ID NO: 2635075 - RNA, 13 nt, Escherichia coli CFT073
ccucuucauuaaa

SEQ ID NO: 2635076 - RNA, 23 nt, Escherichia coli CFT073
ccucuuccagagagguuuucaac

SEQ ID NO: 2635077 - RNA, 16 nt, Escherichia coli CFT073
ccucuuccauuucauc

SEQ ID NO: 2635078 - RNA, 19 nt, Escherichia coli CFT073
ccucuuccauuucaucgcc

SEQ ID NO: 2635079 - RNA, 20 nt, Escherichia coli CFT073
ccucuuccauuucaucgcca

SEQ ID NO: 2635080 - RNA, 23 nt, Escherichia coli CFT073
ccucuuccgacagcguuacgcuu

SEQ ID NO: 2635081 - RNA, 15 nt, Escherichia coli CFT073
ccucuucuuuaaaac

SEQ ID NO: 2635082 - RNA, 17 nt, Escherichia coli CFT073
ccucuugcauuguguaa

SEQ ID NO: 2635083 - RNA, 12 nt, Escherichia coli CFT073
ccucuuuaccgg

SEQ ID NO: 2635084 - RNA, 22 nt, Escherichia coli CFT073
ccucuuuauuuccugcgcaaua

SEQ ID NO: 2635085 - RNA, 19 nt, Escherichia coli CFT073
ccucuuucaccagaucgcc

SEQ ID NO: 2635086 - RNA, 19 nt, Escherichia coli CFT073
ccucuuuuaccaucagcgu

SEQ ID NO: 2635087 - RNA, 13 nt, Escherichia coli CFT073
ccugaaaaaugag

SEQ ID NO: 2635088 - RNA, 13 nt, Escherichia coli CFT073
ccugaaaacgaaa

SEQ ID NO: 2635089 - RNA, 23 nt, Escherichia coli CFT073
ccugaaacgcggcguaaccaccc

SEQ ID NO: 2635090 - RNA, 13 nt, Escherichia coli CFT073
ccugaacaagcaa

SEQ ID NO: 2635091 - RNA, 17 nt, Escherichia coli CFT073
ccugaacaccagaacca

SEQ ID NO: 2635092 - RNA, 23 nt, Escherichia coli CFT073
ccugaacaccagaaccagcaacc

SEQ ID NO: 2635093 - RNA, 17 nt, Escherichia coli CFT073
ccugaaccagaccgccu

SEQ ID NO: 2635094 - RNA, 22 nt, Escherichia coli CFT073
ccugaagaaccaagccugcugg

SEQ ID NO: 2635095 - RNA, 16 nt, Escherichia coli CFT073
ccugaagcggcagagg

SEQ ID NO: 2635096 - RNA, 20 nt, Escherichia coli CFT073
ccugaagcuaaaaccugcac

SEQ ID NO: 2635097 - RNA, 20 nt, Escherichia coli CFT073
ccugaauaacuggcgcgaca

SEQ ID NO: 2635098 - RNA, 20 nt, Escherichia coli CFT073
ccugaauaaucguaaucagc

SEQ ID NO: 2635099 - RNA, 18 nt, Escherichia coli CFT073
ccugaaucaccugauuga

SEQ ID NO: 2635100 - RNA, 16 nt, Escherichia coli CFT073
ccugaaucagccagua

SEQ ID NO: 2635101 - RNA, 22 nt, Escherichia coli CFT073
ccugaaucagccaguaaaccaa

SEQ ID NO: 2635102 - RNA, 17 nt, Escherichia coli CFT073
ccugaaucugagcauuu

SEQ ID NO: 2635103 - RNA, 18 nt, Escherichia coli CFT073
ccugaaucugagcauuua

SEQ ID NO: 2635104 - RNA, 13 nt, Escherichia coli CFT073
ccugaaucuggcu

SEQ ID NO: 2635105 - RNA, 17 nt, Escherichia coli CFT073
ccugaauggugaccugc

SEQ ID NO: 2635106 - RNA, 19 nt, Escherichia coli CFT073
ccugaauugacuacaaaaa

SEQ ID NO: 2635107 - RNA, 20 nt, Escherichia coli CFT073
ccugaauuugcuccagaaac

SEQ ID NO: 2635108 - RNA, 18 nt, Escherichia coli CFT073
ccugacagaccacucucu

SEQ ID NO: 2635109 - RNA, 22 nt, Escherichia coli CFT073
ccugacauuaaguguccgccaa

SEQ ID NO: 2635110 - RNA, 12 nt, Escherichia coli CFT073
ccugacauuucc

SEQ ID NO: 2635111 - RNA, 20 nt, Escherichia coli CFT073
ccugaccaaauacacgcacg

SEQ ID NO: 2635112 - RNA, 14 nt, Escherichia coli CFT073
ccugaccauuauca

SEQ ID NO: 2635113 - RNA, 13 nt, Escherichia coli CFT073
ccugacccagcac

SEQ ID NO: 2635114 - RNA, 14 nt, Escherichia coli CFT073
ccugacccagcacc

SEQ ID NO: 2635115 - RNA, 16 nt, Escherichia coli CFT073
ccugacccagcaccag

SEQ ID NO: 2635116 - RNA, 23 nt, Escherichia coli CFT073
ccugacccagcaccaguaccauu

SEQ ID NO: 2635117 - RNA, 16 nt, Escherichia coli CFT073
ccugaccggaaagaau

SEQ ID NO: 2635118 - RNA, 22 nt, Escherichia coli CFT073
ccugaccuuuacggcgcgucaa

SEQ ID NO: 2635119 - RNA, 16 nt, Escherichia coli CFT073
ccugaccuuuuuucag

SEQ ID NO: 2635120 - RNA, 22 nt, Escherichia coli CFT073
ccugacgagcuuucuuauucgc

SEQ ID NO: 2635121 - RNA, 18 nt, Escherichia coli CFT073
ccugacgcccguuuucac

SEQ ID NO: 2635122 - RNA, 12 nt, Escherichia coli CFT073
ccugacgcugcu

SEQ ID NO: 2635123 - RNA, 15 nt, Escherichia coli CFT073
ccugacgcugcucag

SEQ ID NO: 2635124 - RNA, 22 nt, Escherichia coli CFT073
ccugacgcuguuuuuaacacag

SEQ ID NO: 2635125 - RNA, 18 nt, Escherichia coli CFT073
ccugacggaaaucaucca

SEQ ID NO: 2635126 - RNA, 22 nt, Escherichia coli CFT073
ccugacggaaaucauccagcac

SEQ ID NO: 2635127 - RNA, 23 nt, Escherichia coli CFT073
ccugacugaguaauagccugaug

SEQ ID NO: 2635128 - RNA, 17 nt, Escherichia coli CFT073
ccugacuguuccaguac

SEQ ID NO: 2635129 - RNA, 15 nt, Escherichia coli CFT073
ccugacuguuuuucc

SEQ ID NO: 2635130 - RNA, 20 nt, Escherichia coli CFT073
ccugacuguuuuuccagcuu

SEQ ID NO: 2635131 - RNA, 21 nt, Escherichia coli CFT073
ccugacuuacuuccugucuuc

SEQ ID NO: 2635132 - RNA, 17 nt, Escherichia coli CFT073
ccugacuugcgaacuca

SEQ ID NO: 2635133 - RNA, 20 nt, Escherichia coli CFT073
ccugacuuuguaccagcggg

SEQ ID NO: 2635134 - RNA, 17 nt, Escherichia coli CFT073
ccugagacagacagccu

SEQ ID NO: 2635135 - RNA, 19 nt, Escherichia coli CFT073
ccugagacagacagccuca

SEQ ID NO: 2635136 - RNA, 13 nt, Escherichia coli CFT073
ccugagaggauga

SEQ ID NO: 2635137 - RNA, 17 nt, Escherichia coli CFT073
ccugagcagcaaccacu

SEQ ID NO: 2635138 - RNA, 19 nt, Escherichia coli CFT073
ccugaguaucgaaaacauc

SEQ ID NO: 2635139 - RNA, 22 nt, Escherichia coli CFT073
ccugaguaucgaaaacaucaaa

SEQ ID NO: 2635140 - RNA, 17 nt, Escherichia coli CFT073
ccugauaaaucaccugc

SEQ ID NO: 2635141 - RNA, 19 nt, Escherichia coli CFT073
ccugauaaccuuccagcuu

SEQ ID NO: 2635142 - RNA, 21 nt, Escherichia coli CFT073
ccugauaaccuuccagcuucg

SEQ ID NO: 2635143 - RNA, 12 nt, Escherichia coli CFT073
ccugauaagaca

SEQ ID NO: 2635144 - RNA, 12 nt, Escherichia coli CFT073
ccugauaagacg

SEQ ID NO: 2635145 - RNA, 17 nt, Escherichia coli CFT073
ccugauaagacgcgaac

SEQ ID NO: 2635146 - RNA, 22 nt, Escherichia coli CFT073
ccugauaagacgcgccagcauc

SEQ ID NO: 2635147 - RNA, 21 nt, Escherichia coli CFT073
ccugauacgcgccaaucggca

SEQ ID NO: 2635148 - RNA, 15 nt, Escherichia coli CFT073
ccugaucaauaagcg

SEQ ID NO: 2635149 - RNA, 14 nt, Escherichia coli CFT073
ccugaucaaucauc

SEQ ID NO: 2635150 - RNA, 19 nt, Escherichia coli CFT073
ccugaucaaucaucaggcu

SEQ ID NO: 2635151 - RNA, 13 nt, Escherichia coli CFT073
ccugauccauacu

SEQ ID NO: 2635152 - RNA, 22 nt, Escherichia coli CFT073
ccugauccauugucuccagggc

SEQ ID NO: 2635153 - RNA, 15 nt, Escherichia coli CFT073
ccugaucgacgcgcu

SEQ ID NO: 2635154 - RNA, 22 nt, Escherichia coli CFT073
ccugaucgcgcaguuuaugcag

SEQ ID NO: 2635155 - RNA, 12 nt, Escherichia coli CFT073
ccugaugaaaaa

SEQ ID NO: 2635156 - RNA, 22 nt, Escherichia coli CFT073
ccugaugaaaaaucuccagcgu

SEQ ID NO: 2635157 - RNA, 23 nt, Escherichia coli CFT073
ccugaugaaaaaucuccagcguu

SEQ ID NO: 2635158 - RNA, 19 nt, Escherichia coli CFT073
ccugaugaucuaaaagcaa

SEQ ID NO: 2635159 - RNA, 14 nt, Escherichia coli CFT073
ccugaugcgacgcu

SEQ ID NO: 2635160 - RNA, 19 nt, Escherichia coli CFT073
ccugaugcgacgcuggcgc

SEQ ID NO: 2635161 - RNA, 20 nt, Escherichia coli CFT073
ccugaugcgacgcugguugc

SEQ ID NO: 2635162 - RNA, 16 nt, Escherichia coli CFT073
ccugaugcgacgcuug

SEQ ID NO: 2635163 - RNA, 18 nt, Escherichia coli CFT073
ccugaugcgaugcuggcg

SEQ ID NO: 2635164 - RNA, 16 nt, Escherichia coli CFT073
ccugaugcgugcgcca

SEQ ID NO: 2635165 - RNA, 14 nt, Escherichia coli CFT073
ccugauggcgcgcc

SEQ ID NO: 2635166 - RNA, 23 nt, Escherichia coli CFT073
ccugauguagcgugauuuuguag

SEQ ID NO: 2635167 - RNA, 16 nt, Escherichia coli CFT073
ccugaugugacgcuug

SEQ ID NO: 2635168 - RNA, 20 nt, Escherichia coli CFT073
ccugauguuucugcgcgaaa

SEQ ID NO: 2635169 - RNA, 17 nt, Escherichia coli CFT073
ccugauuuucuucauug

SEQ ID NO: 2635170 - RNA, 17 nt, Escherichia coli CFT073
ccugcaaaaucuguuga

SEQ ID NO: 2635171 - RNA, 14 nt, Escherichia coli CFT073
ccugcaaacgcuuu

SEQ ID NO: 2635172 - RNA, 14 nt, Escherichia coli CFT073
ccugcaaauaaaua

SEQ ID NO: 2635173 - RNA, 14 nt, Escherichia coli CFT073
ccuggacuuuaaac

SEQ ID NO: 2635174 - RNA, 14 nt, Escherichia coli CFT073
ccuggagaguguuu

SEQ ID NO: 2635175 - RNA, 21 nt, Escherichia coli CFT073
ccuggagaguguuuuaucugu

SEQ ID NO: 2635176 - RNA, 23 nt, Escherichia coli CFT073
ccuggaggagaguaugcgcguca

SEQ ID NO: 2635177 - RNA, 20 nt, Escherichia coli CFT073
ccuggagguggcaguuacug

SEQ ID NO: 2635178 - RNA, 22 nt, Escherichia coli CFT073
ccuggauaaggccaccagcggc

SEQ ID NO: 2635179 - RNA, 17 nt, Escherichia coli CFT073
ccuggcaccaguggucu

SEQ ID NO: 2635180 - RNA, 22 nt, Escherichia coli CFT073
ccuggcaugauugagcugcccg

SEQ ID NO: 2635181 - RNA, 19 nt, Escherichia coli CFT073
ccuggccauaccaugacga

SEQ ID NO: 2635182 - RNA, 14 nt, Escherichia coli CFT073
ccuggcgagcagca

SEQ ID NO: 2635183 - RNA, 16 nt, Escherichia coli CFT073
ccuggcgcaaaagaga

SEQ ID NO: 2635184 - RNA, 18 nt, Escherichia coli CFT073
ccuggcgcgacaauauuc

SEQ ID NO: 2635185 - RNA, 17 nt, Escherichia coli CFT073
ccuggcgcugugguggg

SEQ ID NO: 2635186 - RNA, 20 nt, Escherichia coli CFT073
ccuggcggcagauagcgaua

SEQ ID NO: 2635187 - RNA, 20 nt, Escherichia coli CFT073
ccuggcgggaauaaaagcca

SEQ ID NO: 2635188 - RNA, 13 nt, Escherichia coli CFT073
ccuggcugcccau

SEQ ID NO: 2635189 - RNA, 14 nt, Escherichia coli CFT073
ccuggcuggucagc

SEQ ID NO: 2635190 - RNA, 16 nt, Escherichia coli CFT073
ccuggcuugccagcca

SEQ ID NO: 2635191 - RNA, 16 nt, Escherichia coli CFT073
ccugggcaagcaccua

SEQ ID NO: 2635192 - RNA, 16 nt, Escherichia coli CFT073
ccugggcaauggugaa

SEQ ID NO: 2635193 - RNA, 14 nt, Escherichia coli CFT073
ccugggccaccucu

SEQ ID NO: 2635194 - RNA, 16 nt, Escherichia coli CFT073
ccugggccagcaccau

SEQ ID NO: 2635195 - RNA, 15 nt, Escherichia coli CFT073
ccugggcgagguggg

SEQ ID NO: 2635196 - RNA, 19 nt, Escherichia coli CFT073
ccugggcguuugcgcgacg

SEQ ID NO: 2635197 - RNA, 17 nt, Escherichia coli CFT073
ccugggcuucauccagc

SEQ ID NO: 2635198 - RNA, 18 nt, Escherichia coli CFT073
ccugggcuucauccagca

SEQ ID NO: 2635199 - RNA, 17 nt, Escherichia coli CFT073
ccuggggauucaucacc

SEQ ID NO: 2635200 - RNA, 16 nt, Escherichia coli CFT073
ccuggggucaucagca

SEQ ID NO: 2635201 - RNA, 14 nt, Escherichia coli CFT073
ccuggguauaaauc

SEQ ID NO: 2635202 - RNA, 22 nt, Escherichia coli CFT073
ccugguacauugcgaacaggua

SEQ ID NO: 2635203 - RNA, 13 nt, Escherichia coli CFT073
ccuggugcaggcg

SEQ ID NO: 2635204 - RNA, 18 nt, Escherichia coli CFT073
ccugguuauuucacuuca

SEQ ID NO: 2635205 - RNA, 15 nt, Escherichia coli CFT073
ccuguaaaaaagaaa

SEQ ID NO: 2635206 - RNA, 22 nt, Escherichia coli CFT073
ccuguaaaaaagaaaugccugc

SEQ ID NO: 2635207 - RNA, 14 nt, Escherichia coli CFT073
ccuguaaccaccgu

SEQ ID NO: 2635208 - RNA, 21 nt, Escherichia coli CFT073
ccuguaaguuacuaaaaguaa

SEQ ID NO: 2635209 - RNA, 22 nt, Escherichia coli CFT073
ccuguaaugccuuuuccagcgc

SEQ ID NO: 2635210 - RNA, 20 nt, Escherichia coli CFT073
ccuguaauggcuggaucaga

SEQ ID NO: 2635211 - RNA, 15 nt, Escherichia coli CFT073
ccuguacaagcaacu

SEQ ID NO: 2635212 - RNA, 19 nt, Escherichia coli CFT073
ccuguagauauucuuccag

SEQ ID NO: 2635213 - RNA, 20 nt, Escherichia coli CFT073
ccuguaggucggauaagacg

SEQ ID NO: 2635214 - RNA, 23 nt, Escherichia coli CFT073
ccuguaucaugcaguaccagaua

SEQ ID NO: 2635215 - RNA, 16 nt, Escherichia coli CFT073
ccugucaccgggcaaa

SEQ ID NO: 2635216 - RNA, 17 nt, Escherichia coli CFT073
ccugucagacuuaagcc

SEQ ID NO: 2635217 - RNA, 22 nt, Escherichia coli CFT073
ccugucaguucguuuuacgcac

SEQ ID NO: 2635218 - RNA, 20 nt, Escherichia coli CFT073
ccuguccagacggagcugcc

SEQ ID NO: 2635219 - RNA, 22 nt, Escherichia coli CFT073
ccuguccagacggagcugccag

SEQ ID NO: 2635220 - RNA, 14 nt, Escherichia coli CFT073
ccugucgaggccaa

SEQ ID NO: 2635221 - RNA, 18 nt, Escherichia coli CFT073
ccugucgcuuugacagcu

SEQ ID NO: 2635222 - RNA, 16 nt, Escherichia coli CFT073
ccugucgugacaucca

SEQ ID NO: 2635223 - RNA, 16 nt, Escherichia coli CFT073
ccugucuaaccgccug

SEQ ID NO: 2635224 - RNA, 16 nt, Escherichia coli CFT073
ccugucuucccugcug

SEQ ID NO: 2635225 - RNA, 14 nt, Escherichia coli CFT073
ccuguggaucgcgg

SEQ ID NO: 2635226 - RNA, 14 nt, Escherichia coli CFT073
ccuguuaaucagcu

SEQ ID NO: 2635227 - RNA, 13 nt, Escherichia coli CFT073
ccuguuaauucuc

SEQ ID NO: 2635228 - RNA, 18 nt, Escherichia coli CFT073
ccuguuaauucucccugc

SEQ ID NO: 2635229 - RNA, 22 nt, Escherichia coli CFT073
ccuguuaauucucccugcgacg

SEQ ID NO: 2635230 - RNA, 22 nt, Escherichia coli CFT073
ccuguucaaacuucgccacagc

SEQ ID NO: 2635231 - RNA, 18 nt, Escherichia coli CFT073
ccuguuccggcagaaacc

SEQ ID NO: 2635232 - RNA, 15 nt, Escherichia coli CFT073
ccuguugauugcguu

SEQ ID NO: 2635233 - RNA, 21 nt, Escherichia coli CFT073
ccuguugcacaauacgcccgg

SEQ ID NO: 2635234 - RNA, 21 nt, Escherichia coli CFT073
ccuguugcgcuccgcgaccca

SEQ ID NO: 2635235 - RNA, 16 nt, Escherichia coli CFT073
ccuguugcguuaagcc

SEQ ID NO: 2635236 - RNA, 16 nt, Escherichia coli CFT073
ccuguuuaauaugcaa

SEQ ID NO: 2635237 - RNA, 16 nt, Escherichia coli CFT073
ccuguuucucauugac

SEQ ID NO: 2635238 - RNA, 20 nt, Escherichia coli CFT073
ccuguuugguugccagccau

SEQ ID NO: 2635239 - RNA, 23 nt, Escherichia coli CFT073
ccuguuuucaccggcacgcguug

SEQ ID NO: 2635240 - RNA, 13 nt, Escherichia coli CFT073
ccuguuuucgauu

SEQ ID NO: 2635241 - RNA, 16 nt, Escherichia coli CFT073
ccuuaacgauuacagc

SEQ ID NO: 2635242 - RNA, 13 nt, Escherichia coli CFT073
ccuuaacgcaaaa

SEQ ID NO: 2635243 - RNA, 18 nt, Escherichia coli CFT073
ccuuaauaccggcaucca

SEQ ID NO: 2635244 - RNA, 20 nt, Escherichia coli CFT073
ccuuaauaccggcauccaga

SEQ ID NO: 2635245 - RNA, 14 nt, Escherichia coli CFT073
ccuuaaucuucacu

SEQ ID NO: 2635246 - RNA, 19 nt, Escherichia coli CFT073
ccuuacuuacacaucauga

SEQ ID NO: 2635247 - RNA, 11 nt, Escherichia coli CFT073
ccuuaguaucg

SEQ ID NO: 2635248 - RNA, 13 nt, Escherichia coli CFT073
ccuuauauaaaac

SEQ ID NO: 2635249 - RNA, 12 nt, Escherichia coli CFT073
ccuuauccagca

SEQ ID NO: 2635250 - RNA, 14 nt, Escherichia coli CFT073
ccuuauccagcaga

SEQ ID NO: 2635251 - RNA, 19 nt, Escherichia coli CFT073
ccuuauccgacauuucugc

SEQ ID NO: 2635252 - RNA, 17 nt, Escherichia coli CFT073
ccuuauccgaccuacac

SEQ ID NO: 2635253 - RNA, 13 nt, Escherichia coli CFT073
ccuuauccgccug

SEQ ID NO: 2635254 - RNA, 13 nt, Escherichia coli CFT073
ccuuauccggccu

SEQ ID NO: 2635255 - RNA, 20 nt, Escherichia coli CFT073
ccuuauccggccuaccgcau

SEQ ID NO: 2635256 - RNA, 16 nt, Escherichia coli CFT073
ccuuaugcccggcacg

SEQ ID NO: 2635257 - RNA, 18 nt, Escherichia coli CFT073
ccuuaugcugcuuacaua

SEQ ID NO: 2635258 - RNA, 22 nt, Escherichia coli CFT073
ccuuauggugucuaugcauaga

SEQ ID NO: 2635259 - RNA, 20 nt, Escherichia coli CFT073
ccuuauugaccccguaauua

SEQ ID NO: 2635260 - RNA, 18 nt, Escherichia coli CFT073
ccuuauuuuuauaacuau

SEQ ID NO: 2635261 - RNA, 15 nt, Escherichia coli CFT073
ccuucaagcguccau

SEQ ID NO: 2635262 - RNA, 22 nt, Escherichia coli CFT073
ccuucacauuucccggaauaau

SEQ ID NO: 2635263 - RNA, 20 nt, Escherichia coli CFT073
ccuucacgggcaaccacagu

SEQ ID NO: 2635264 - RNA, 18 nt, Escherichia coli CFT073
ccuucacggguugcgccu

SEQ ID NO: 2635265 - RNA, 15 nt, Escherichia coli CFT073
ccuucagcaauuugu

SEQ ID NO: 2635266 - RNA, 22 nt, Escherichia coli CFT073
ccuucagucauauuucuguuug

SEQ ID NO: 2635267 - RNA, 14 nt, Escherichia coli CFT073
ccuucauaaugaau

SEQ ID NO: 2635268 - RNA, 17 nt, Escherichia coli CFT073
ccuucauacgacgacgg

SEQ ID NO: 2635269 - RNA, 15 nt, Escherichia coli CFT073
ccuucauauuccuga

SEQ ID NO: 2635270 - RNA, 12 nt, Escherichia coli CFT073
ccuucauccagg

SEQ ID NO: 2635271 - RNA, 19 nt, Escherichia coli CFT073
ccuucaucuucauccggcu

SEQ ID NO: 2635272 - RNA, 17 nt, Escherichia coli CFT073
ccuucaucuuuauagaa

SEQ ID NO: 2635273 - RNA, 15 nt, Escherichia coli CFT073
ccuucauucaccagu

SEQ ID NO: 2635274 - RNA, 19 nt, Escherichia coli CFT073
ccuuccagaaacaucccca

SEQ ID NO: 2635275 - RNA, 18 nt, Escherichia coli CFT073
ccuuccagcgcguucugu

SEQ ID NO: 2635276 - RNA, 13 nt, Escherichia coli CFT073
ccuuccagcuucg

SEQ ID NO: 2635277 - RNA, 16 nt, Escherichia coli CFT073
ccuucccagccgggaa

SEQ ID NO: 2635278 - RNA, 13 nt, Escherichia coli CFT073
ccuucccccacca

SEQ ID NO: 2635279 - RNA, 21 nt, Escherichia coli CFT073
ccuucccgacguaacaucuga

SEQ ID NO: 2635280 - RNA, 20 nt, Escherichia coli CFT073
ccuuccgcaauacagccagc

SEQ ID NO: 2635281 - RNA, 16 nt, Escherichia coli CFT073
cgaaaccauauuaaau

SEQ ID NO: 2635282 - RNA, 21 nt, Escherichia coli CFT073
cgaaaccauauuaaauggccc

SEQ ID NO: 2635283 - RNA, 17 nt, Escherichia coli CFT073
cgaaacccgaaccacgc

SEQ ID NO: 2635284 - RNA, 14 nt, Escherichia coli CFT073
cgaaaccgcucuca

SEQ ID NO: 2635285 - RNA, 19 nt, Escherichia coli CFT073
cgaaacgaaagucccgaua

SEQ ID NO: 2635286 - RNA, 20 nt, Escherichia coli CFT073
cgaaacugacauacaaaucg

SEQ ID NO: 2635287 - RNA, 17 nt, Escherichia coli CFT073
cgaaacugcguggcgaa

SEQ ID NO: 2635288 - RNA, 22 nt, Escherichia coli CFT073
cgaaacuugcgugauauuacau

SEQ ID NO: 2635289 - RNA, 18 nt, Escherichia coli CFT073
cgaaagcguauccaucac

SEQ ID NO: 2635290 - RNA, 17 nt, Escherichia coli CFT073
cgaaagcgucagcuuuc

SEQ ID NO: 2635291 - RNA, 19 nt, Escherichia coli CFT073
cgaaagggcgucgauaucc

SEQ ID NO: 2635292 - RNA, 20 nt, Escherichia coli CFT073
cgaaaguucaaccucaagca

SEQ ID NO: 2635293 - RNA, 14 nt, Escherichia coli CFT073
cgaaauaaaagugu

SEQ ID NO: 2635294 - RNA, 20 nt, Escherichia coli CFT073
cgaaauagcccgguuuacca

SEQ ID NO: 2635295 - RNA, 14 nt, Escherichia coli CFT073
cgaaauagccgaaa

SEQ ID NO: 2635296 - RNA, 15 nt, Escherichia coli CFT073
cgaaaucgccauucc

SEQ ID NO: 2635297 - RNA, 12 nt, Escherichia coli CFT073
cgaaaucgcccu

SEQ ID NO: 2635298 - RNA, 16 nt, Escherichia coli CFT073
cgaaaucggcaccgcc

SEQ ID NO: 2635299 - RNA, 22 nt, Escherichia coli CFT073
cgaaaucggcaccgccgccaaa

SEQ ID NO: 2635300 - RNA, 18 nt, Escherichia coli CFT073
cgaaaucuuccaguggca

SEQ ID NO: 2635301 - RNA, 20 nt, Escherichia coli CFT073
cgaaaucuuuuuacugccgc

SEQ ID NO: 2635302 - RNA, 17 nt, Escherichia coli CFT073
cgaaaugagauauuuca

SEQ ID NO: 2635303 - RNA, 20 nt, Escherichia coli CFT073
cgaaauggcugccaaugaua

SEQ ID NO: 2635304 - RNA, 18 nt, Escherichia coli CFT073
cgaaauugcugacgcaaa

SEQ ID NO: 2635305 - RNA, 21 nt, Escherichia coli CFT073
cgaacaacucgguuaacggca

SEQ ID NO: 2635306 - RNA, 20 nt, Escherichia coli CFT073
cgaacaauaucgccagcuug

SEQ ID NO: 2635307 - RNA, 18 nt, Escherichia coli CFT073
cgaacagacaaaaagaau

SEQ ID NO: 2635308 - RNA, 14 nt, Escherichia coli CFT073
cgaacagaccaaac

SEQ ID NO: 2635309 - RNA, 19 nt, Escherichia coli CFT073
cgaacagauugaagauaga

SEQ ID NO: 2635310 - RNA, 17 nt, Escherichia coli CFT073
cgaacagcgucgcauca

SEQ ID NO: 2635311 - RNA, 19 nt, Escherichia coli CFT073
cgaacagcgucgcaucagg

SEQ ID NO: 2635312 - RNA, 20 nt, Escherichia coli CFT073
cgaacagcgucgcaucaggc

SEQ ID NO: 2635313 - RNA, 12 nt, Escherichia coli CFT073
cgaacaggucac

SEQ ID NO: 2635314 - RNA, 13 nt, Escherichia coli CFT073
cgaacagucgcug

SEQ ID NO: 2635315 - RNA, 14 nt, Escherichia coli CFT073
cgaacaugcggguc

SEQ ID NO: 2635316 - RNA, 18 nt, Escherichia coli CFT073
cgaacauuaagaggcauu

SEQ ID NO: 2635317 - RNA, 23 nt, Escherichia coli CFT073
cgaaccaaaguagauaaucgcuu

SEQ ID NO: 2635318 - RNA, 21 nt, Escherichia coli CFT073
cgaaccacugauggaauuuca

SEQ ID NO: 2635319 - RNA, 24 nt, Escherichia coli CFT073
cgaaccagccguugucagucauca

SEQ ID NO: 2635320 - RNA, 17 nt, Escherichia coli CFT073
cgaaccagugcuccacc

SEQ ID NO: 2635321 - RNA, 16 nt, Escherichia coli CFT073
cgaaccaucggcuuug

SEQ ID NO: 2635322 - RNA, 20 nt, Escherichia coli CFT073
cgaaccggggccgaaacccc

SEQ ID NO: 2635323 - RNA, 23 nt, Escherichia coli CFT073
cgaaccguucauuucacgcagcg

SEQ ID NO: 2635324 - RNA, 21 nt, Escherichia coli CFT073
cgaaccuuccaucgcaucuuc

SEQ ID NO: 2635325 - RNA, 21 nt, Escherichia coli CFT073
cgaacgacauccgccagcgcc

SEQ ID NO: 2635326 - RNA, 21 nt, Escherichia coli CFT073
cgaacgcagugauaacucaaa

SEQ ID NO: 2635327 - RNA, 15 nt, Escherichia coli CFT073
cgaacgccgccagua

SEQ ID NO: 2635328 - RNA, 14 nt, Escherichia coli CFT073
cgaacgcugacaaa

SEQ ID NO: 2635329 - RNA, 20 nt, Escherichia coli CFT073
cgaacgcugacaaacugcgu

SEQ ID NO: 2635330 - RNA, 16 nt, Escherichia coli CFT073
cgaacggcuguugaug

SEQ ID NO: 2635331 - RNA, 12 nt, Escherichia coli CFT073
cgaacgggugau

SEQ ID NO: 2635332 - RNA, 15 nt, Escherichia coli CFT073
cgaacguaggccuca

SEQ ID NO: 2635333 - RNA, 16 nt, Escherichia coli CFT073
cgaacgugaucgcccc

SEQ ID NO: 2635334 - RNA, 16 nt, Escherichia coli CFT073
cgaacguuuucaccac

SEQ ID NO: 2635335 - RNA, 24 nt, Escherichia coli CFT073
cgaacuaaccgcacucagccagcc

SEQ ID NO: 2635336 - RNA, 16 nt, Escherichia coli CFT073
cgaacucaccaugacc

SEQ ID NO: 2635337 - RNA, 15 nt, Escherichia coli CFT073
cgaacuccaguagcg

SEQ ID NO: 2635338 - RNA, 17 nt, Escherichia coli CFT073
cgaacuccgaucccugc

SEQ ID NO: 2635339 - RNA, 17 nt, Escherichia coli CFT073
cgaacuccgccccggca

SEQ ID NO: 2635340 - RNA, 19 nt, Escherichia coli CFT073
cgaacuccgccccggcaau

SEQ ID NO: 2635341 - RNA, 17 nt, Escherichia coli CFT073
cgaacugucgauuugua

SEQ ID NO: 2635342 - RNA, 16 nt, Escherichia coli CFT073
cgaacuuuaucugcac

SEQ ID NO: 2635343 - RNA, 13 nt, Escherichia coli CFT073
cgaagaaaaacug

SEQ ID NO: 2635344 - RNA, 22 nt, Escherichia coli CFT073
cgaagaaacgaccuccaucgca

SEQ ID NO: 2635345 - RNA, 16 nt, Escherichia coli CFT073
cgaagaacauaaacag

SEQ ID NO: 2635346 - RNA, 14 nt, Escherichia coli CFT073
cgaagacaucaucg

SEQ ID NO: 2635347 - RNA, 17 nt, Escherichia coli CFT073
cgaagagagcgccagua

SEQ ID NO: 2635348 - RNA, 17 nt, Escherichia coli CFT073
cgaagagaucgauguuu

SEQ ID NO: 2635349 - RNA, 13 nt, Escherichia coli CFT073
cgaagaucaccac

SEQ ID NO: 2635350 - RNA, 22 nt, Escherichia coli CFT073
cgaagauggcauacaacgccau

SEQ ID NO: 2635351 - RNA, 14 nt, Escherichia coli CFT073
cgaagcaaagaguu

SEQ ID NO: 2635352 - RNA, 14 nt, Escherichia coli CFT073
cgaagcacacauac

SEQ ID NO: 2635353 - RNA, 17 nt, Escherichia coli CFT073
cgaagccagcucccaca

SEQ ID NO: 2635354 - RNA, 22 nt, Escherichia coli CFT073
cgaagccugcggauaaucgcgg

SEQ ID NO: 2635355 - RNA, 17 nt, Escherichia coli CFT073
cgaagcgcaugccuucg

SEQ ID NO: 2635356 - RNA, 15 nt, Escherichia coli CFT073
cgaagcgccaauacc

SEQ ID NO: 2635357 - RNA, 13 nt, Escherichia coli CFT073
cgaagcggcugcg

SEQ ID NO: 2635358 - RNA, 20 nt, Escherichia coli CFT073
cgaagcggcugcgccugugg

SEQ ID NO: 2635359 - RNA, 15 nt, Escherichia coli CFT073
cgaagcugaccagac

SEQ ID NO: 2635360 - RNA, 15 nt, Escherichia coli CFT073
cgaaggacugccgca

SEQ ID NO: 2635361 - RNA, 16 nt, Escherichia coli CFT073
cgaaggccagcaccac

SEQ ID NO: 2635362 - RNA, 17 nt, Escherichia coli CFT073
cgaaggugaacgccacc

SEQ ID NO: 2635363 - RNA, 23 nt, Escherichia coli CFT073
cgaaggugcauugaaggcaauug

SEQ ID NO: 2635364 - RNA, 15 nt, Escherichia coli CFT073
cgaaguaaccgcauc

SEQ ID NO: 2635365 - RNA, 19 nt, Escherichia coli CFT073
cgaaguacuccuguucacc

SEQ ID NO: 2635366 - RNA, 19 nt, Escherichia coli CFT073
cgaagugaugaaaaacguu

SEQ ID NO: 2635367 - RNA, 16 nt, Escherichia coli CFT073
cgaagugguuccacgc

SEQ ID NO: 2635368 - RNA, 13 nt, Escherichia coli CFT073
cgaaguuccugca

SEQ ID NO: 2635369 - RNA, 19 nt, Escherichia coli CFT073
cgaaguucuuccggcagcc

SEQ ID NO: 2635370 - RNA, 11 nt, Escherichia coli CFT073
cgaaguugaag

SEQ ID NO: 2635371 - RNA, 12 nt, Escherichia coli CFT073
cgaaguuuuccu

SEQ ID NO: 2635372 - RNA, 16 nt, Escherichia coli CFT073
cgaaguuuuccucagu

SEQ ID NO: 2635373 - RNA, 19 nt, Escherichia coli CFT073
cgaauaagaauaugaacaa

SEQ ID NO: 2635374 - RNA, 21 nt, Escherichia coli CFT073
cgaauacccggugcguauucg

SEQ ID NO: 2635375 - RNA, 22 nt, Escherichia coli CFT073
cgaauacgacagucaauauuca

SEQ ID NO: 2635376 - RNA, 22 nt, Escherichia coli CFT073
cgaauacgccgauaucgcuggc

SEQ ID NO: 2635377 - RNA, 18 nt, Escherichia coli CFT073
cgaauaguggaguaugag

SEQ ID NO: 2635378 - RNA, 14 nt, Escherichia coli CFT073
cgaaucaacuccag

SEQ ID NO: 2635379 - RNA, 23 nt, Escherichia coli CFT073
cgaaucacagcuauaccgccagg

SEQ ID NO: 2635380 - RNA, 14 nt, Escherichia coli CFT073
cgaauccagcaagc

SEQ ID NO: 2635381 - RNA, 19 nt, Escherichia coli CFT073
cgaaucccgcaacuugcga

SEQ ID NO: 2635382 - RNA, 14 nt, Escherichia coli CFT073
cgaaucccuaagcg

SEQ ID NO: 2635383 - RNA, 19 nt, Escherichia coli CFT073
cgaauccgcggaugauucc

SEQ ID NO: 2635384 - RNA, 17 nt, Escherichia coli CFT073
cgaauccggcagcgaac

SEQ ID NO: 2635385 - RNA, 20 nt, Escherichia coli CFT073
cgaauccuucccccaccacc

SEQ ID NO: 2635386 - RNA, 22 nt, Escherichia coli CFT073
cgaaucgauaaccccagaugga

SEQ ID NO: 2635387 - RNA, 15 nt, Escherichia coli CFT073
cgaaucgccccagca

SEQ ID NO: 2635388 - RNA, 21 nt, Escherichia coli CFT073
cgaaucgcguugccaguuuuu

SEQ ID NO: 2635389 - RNA, 12 nt, Escherichia coli CFT073
cgacccacgccc

SEQ ID NO: 2635390 - RNA, 13 nt, Escherichia coli CFT073
cgacccacgcccc

SEQ ID NO: 2635391 - RNA, 23 nt, Escherichia coli CFT073
cgacccauaauguguuaauaaug

SEQ ID NO: 2635392 - RNA, 18 nt, Escherichia coli CFT073
cgacccgauucggucaug

SEQ ID NO: 2635393 - RNA, 22 nt, Escherichia coli CFT073
cgacccggcguuuucagaucca

SEQ ID NO: 2635394 - RNA, 17 nt, Escherichia coli CFT073
cgacccgguucaauuuc

SEQ ID NO: 2635395 - RNA, 17 nt, Escherichia coli CFT073
cgacccguuuacggcua

SEQ ID NO: 2635396 - RNA, 20 nt, Escherichia coli CFT073
cgacccugaugaauauucuc

SEQ ID NO: 2635397 - RNA, 15 nt, Escherichia coli CFT073
cgacccuucaucggu

SEQ ID NO: 2635398 - RNA, 18 nt, Escherichia coli CFT073
cgaccgaucaccacaaua

SEQ ID NO: 2635399 - RNA, 22 nt, Escherichia coli CFT073
cgaccgauuaauuccccugcca

SEQ ID NO: 2635400 - RNA, 21 nt, Escherichia coli CFT073
cgaccgcgggacaaauaauga

SEQ ID NO: 2635401 - RNA, 17 nt, Escherichia coli CFT073
cgaccggauuagucugg

SEQ ID NO: 2635402 - RNA, 23 nt, Escherichia coli CFT073
cgaccguaaauucucccgccccc

SEQ ID NO: 2635403 - RNA, 22 nt, Escherichia coli CFT073
cgaccguagcguaaaucaucgg

SEQ ID NO: 2635404 - RNA, 16 nt, Escherichia coli CFT073
cgaccgucgguuucgc

SEQ ID NO: 2635405 - RNA, 22 nt, Escherichia coli CFT073
cgaccgucuuuauccagcacca

SEQ ID NO: 2635406 - RNA, 18 nt, Escherichia coli CFT073
cgaccgugcgccagcaaa

SEQ ID NO: 2635407 - RNA, 21 nt, Escherichia coli CFT073
cgaccuacacgcccgcgaagc

SEQ ID NO: 2635408 - RNA, 14 nt, Escherichia coli CFT073
cgacgaauagguaa

SEQ ID NO: 2635409 - RNA, 22 nt, Escherichia coli CFT073
cgacgaauuucaucgcuacacc

SEQ ID NO: 2635410 - RNA, 13 nt, Escherichia coli CFT073
cgacgaccagcgg

SEQ ID NO: 2635411 - RNA, 18 nt, Escherichia coli CFT073
cgacgacuggcgcggcag

SEQ ID NO: 2635412 - RNA, 14 nt, Escherichia coli CFT073
cgacgauaccgccg

SEQ ID NO: 2635413 - RNA, 22 nt, Escherichia coli CFT073
cgacgauauuccgacggcgagc

SEQ ID NO: 2635414 - RNA, 21 nt, Escherichia coli CFT073
cgacgaucgggaacagccaca

SEQ ID NO: 2635415 - RNA, 16 nt, Escherichia coli CFT073
cgacgcauacgauccu

SEQ ID NO: 2635416 - RNA, 15 nt, Escherichia coli CFT073
cgacgcgcgcggguc

SEQ ID NO: 2635417 - RNA, 15 nt, Escherichia coli CFT073
cgacgcgcuggcaaa

SEQ ID NO: 2635418 - RNA, 23 nt, Escherichia coli CFT073
cgacgcgggccgcgucuuaucag

SEQ ID NO: 2635419 - RNA, 15 nt, Escherichia coli CFT073
cgacgcuugccgcgu

SEQ ID NO: 2635420 - RNA, 13 nt, Escherichia coli CFT073
cgacggcaccaaa

SEQ ID NO: 2635421 - RNA, 15 nt, Escherichia coli CFT073
cgacggcaucgccau

SEQ ID NO: 2635422 - RNA, 22 nt, Escherichia coli CFT073
cgacggcgaaucaaccgcgccu

SEQ ID NO: 2635423 - RNA, 14 nt, Escherichia coli CFT073
cgacggcuggcaaa

SEQ ID NO: 2635424 - RNA, 18 nt, Escherichia coli CFT073
cgacgggccugcaggugu

SEQ ID NO: 2635425 - RNA, 13 nt, Escherichia coli CFT073
cgacgguugaauc

SEQ ID NO: 2635426 - RNA, 15 nt, Escherichia coli CFT073
cgacgguuuccaggc

SEQ ID NO: 2635427 - RNA, 17 nt, Escherichia coli CFT073
cgacgguuuccaggcag

SEQ ID NO: 2635428 - RNA, 13 nt, Escherichia coli CFT073
cgacguaauuuag

SEQ ID NO: 2635429 - RNA, 22 nt, Escherichia coli CFT073
cgacgucugaucggcaaucacg

SEQ ID NO: 2635430 - RNA, 16 nt, Escherichia coli CFT073
cgacgugcccuuucag

SEQ ID NO: 2635431 - RNA, 18 nt, Escherichia coli CFT073
cgacguucugccaaacgc

SEQ ID NO: 2635432 - RNA, 20 nt, Escherichia coli CFT073
cgacguugcguugccgccaa

SEQ ID NO: 2635433 - RNA, 16 nt, Escherichia coli CFT073
cgacguuuaccgcauc

SEQ ID NO: 2635434 - RNA, 17 nt, Escherichia coli CFT073
cgacguuugaugcgucu

SEQ ID NO: 2635435 - RNA, 16 nt, Escherichia coli CFT073
cgacguuuuucaggcu

SEQ ID NO: 2635436 - RNA, 17 nt, Escherichia coli CFT073
cgacuaccacguaacga

SEQ ID NO: 2635437 - RNA, 15 nt, Escherichia coli CFT073
cgacucaaaucacgc

SEQ ID NO: 2635438 - RNA, 16 nt, Escherichia coli CFT073
cgacucaaaucacgca

SEQ ID NO: 2635439 - RNA, 18 nt, Escherichia coli CFT073
cgacucgcgaaucgccgu

SEQ ID NO: 2635440 - RNA, 17 nt, Escherichia coli CFT073
cgacucggugcgcccgc

SEQ ID NO: 2635441 - RNA, 17 nt, Escherichia coli CFT073
cgacucugaaugccagu

SEQ ID NO: 2635442 - RNA, 14 nt, Escherichia coli CFT073
cgacucuguuaugg

SEQ ID NO: 2635443 - RNA, 20 nt, Escherichia coli CFT073
cgacugaaaggucaucauca

SEQ ID NO: 2635444 - RNA, 14 nt, Escherichia coli CFT073
cgacugaugaaguc

SEQ ID NO: 2635445 - RNA, 20 nt, Escherichia coli CFT073
cgacugcaagccaugacgca

SEQ ID NO: 2635446 - RNA, 20 nt, Escherichia coli CFT073
cgacugccagccacacugcg

SEQ ID NO: 2635447 - RNA, 16 nt, Escherichia coli CFT073
cgacugcgccaauacc

SEQ ID NO: 2635448 - RNA, 14 nt, Escherichia coli CFT073
cgacuggauaauga

SEQ ID NO: 2635449 - RNA, 13 nt, Escherichia coli CFT073
cgacuggccaugg

SEQ ID NO: 2635450 - RNA, 21 nt, Escherichia coli CFT073
cgacuggcugaacaguuuacc

SEQ ID NO: 2635451 - RNA, 14 nt, Escherichia coli CFT073
cgacugucuuccug

SEQ ID NO: 2635452 - RNA, 17 nt, Escherichia coli CFT073
cgacugugaaguauuaa

SEQ ID NO: 2635453 - RNA, 19 nt, Escherichia coli CFT073
cgacuguuuauuguugauu

SEQ ID NO: 2635454 - RNA, 19 nt, Escherichia coli CFT073
cgacuuaaaaggaaaauca

SEQ ID NO: 2635455 - RNA, 17 nt, Escherichia coli CFT073
cgacuuccaccagcggc

SEQ ID NO: 2635456 - RNA, 23 nt, Escherichia coli CFT073
cgacuuccaccagcggcugaaua

SEQ ID NO: 2635457 - RNA, 23 nt, Escherichia coli CFT073
cgacuuccugcaaucuuuccugc

SEQ ID NO: 2635458 - RNA, 19 nt, Escherichia coli CFT073
cgacuugcuuuucgcuucc

SEQ ID NO: 2635459 - RNA, 21 nt, Escherichia coli CFT073
cgagaaaaagccuaagaaguc

SEQ ID NO: 2635460 - RNA, 20 nt, Escherichia coli CFT073
cgagaaaaucaucugcgccc

SEQ ID NO: 2635461 - RNA, 22 nt, Escherichia coli CFT073
cgagaacaccgaaccaaaguag

SEQ ID NO: 2635462 - RNA, 16 nt, Escherichia coli CFT073
cgagaacgucgcaggg

SEQ ID NO: 2635463 - RNA, 22 nt, Escherichia coli CFT073
cgagaacucggaagcagcguaa

SEQ ID NO: 2635464 - RNA, 22 nt, Escherichia coli CFT073
cgagaagacaauccccgccagc

SEQ ID NO: 2635465 - RNA, 18 nt, Escherichia coli CFT073
cgagaagccgaccagcac

SEQ ID NO: 2635466 - RNA, 22 nt, Escherichia coli CFT073
cgagaagccgaccagcaccgcc

SEQ ID NO: 2635467 - RNA, 22 nt, Escherichia coli CFT073
cgagaaguuuuucgucaccugg

SEQ ID NO: 2635468 - RNA, 17 nt, Escherichia coli CFT073
cgagaauaaaacaagca

SEQ ID NO: 2635469 - RNA, 15 nt, Escherichia coli CFT073
cgagaaucugccgca

SEQ ID NO: 2635470 - RNA, 18 nt, Escherichia coli CFT073
cgagaaugaagucaccaa

SEQ ID NO: 2635471 - RNA, 18 nt, Escherichia coli CFT073
cgagaaugcugaagucga

SEQ ID NO: 2635472 - RNA, 15 nt, Escherichia coli CFT073
cgagacgagcaagaa

SEQ ID NO: 2635473 - RNA, 15 nt, Escherichia coli CFT073
cgagacggcggaaag

SEQ ID NO: 2635474 - RNA, 22 nt, Escherichia coli CFT073
cgagacgguauuacccggcccc

SEQ ID NO: 2635475 - RNA, 15 nt, Escherichia coli CFT073
cgagacuuauuaaag

SEQ ID NO: 2635476 - RNA, 15 nt, Escherichia coli CFT073
cgagagaacugcugc

SEQ ID NO: 2635477 - RNA, 14 nt, Escherichia coli CFT073
cgagagaagcgcgu

SEQ ID NO: 2635478 - RNA, 15 nt, Escherichia coli CFT073
cgagagagaaaauaa

SEQ ID NO: 2635479 - RNA, 18 nt, Escherichia coli CFT073
cgagagagcguugccgca

SEQ ID NO: 2635480 - RNA, 17 nt, Escherichia coli CFT073
cgagagccuucggcaaa

SEQ ID NO: 2635481 - RNA, 16 nt, Escherichia coli CFT073
cgagauaaaugccaaa

SEQ ID NO: 2635482 - RNA, 16 nt, Escherichia coli CFT073
cgagauaauggcaaug

SEQ ID NO: 2635483 - RNA, 23 nt, Escherichia coli CFT073
cgagauaaugguuuccagcaucg

SEQ ID NO: 2635484 - RNA, 13 nt, Escherichia coli CFT073
cgagauaauguuc

SEQ ID NO: 2635485 - RNA, 19 nt, Escherichia coli CFT073
cgagauauccacauuaacg

SEQ ID NO: 2635486 - RNA, 20 nt, Escherichia coli CFT073
cgagauauccacauuaacga

SEQ ID NO: 2635487 - RNA, 20 nt, Escherichia coli CFT073
cgagauauugauacaggaaa

SEQ ID NO: 2635488 - RNA, 19 nt, Escherichia coli CFT073
cgagauauuucaccagcgc

SEQ ID NO: 2635489 - RNA, 17 nt, Escherichia coli CFT073
cgagauauuuccuuguu

SEQ ID NO: 2635490 - RNA, 16 nt, Escherichia coli CFT073
cgagaucaacagcaua

SEQ ID NO: 2635491 - RNA, 18 nt, Escherichia coli CFT073
cgagaucuuuaauacacg

SEQ ID NO: 2635492 - RNA, 23 nt, Escherichia coli CFT073
cgagaucuuuaucaaucaccgcu

SEQ ID NO: 2635493 - RNA, 15 nt, Escherichia coli CFT073
cgagaugguaaagca

SEQ ID NO: 2635494 - RNA, 17 nt, Escherichia coli CFT073
cgagauucauccaguuc

SEQ ID NO: 2635495 - RNA, 19 nt, Escherichia coli CFT073
cgagauugugaacacaagc

SEQ ID NO: 2635496 - RNA, 20 nt, Escherichia coli CFT073
cgagcaaaagccuuauccgc

SEQ ID NO: 2635497 - RNA, 18 nt, Escherichia coli CFT073
cgauacagaccccggcau

SEQ ID NO: 2635498 - RNA, 19 nt, Escherichia coli CFT073
cgauacagaccccggcauu

SEQ ID NO: 2635499 - RNA, 18 nt, Escherichia coli CFT073
cgauaccaacgcauuuau

SEQ ID NO: 2635500 - RNA, 21 nt, Escherichia coli CFT073
cgauaccuaacgccagcgcga

SEQ ID NO: 2635501 - RNA, 22 nt, Escherichia coli CFT073
cgauacgcauaaacaucuucca

SEQ ID NO: 2635502 - RNA, 22 nt, Escherichia coli CFT073
cgauacgguuaaaucaggaaaa

SEQ ID NO: 2635503 - RNA, 15 nt, Escherichia coli CFT073
cgauacucugccauc

SEQ ID NO: 2635504 - RNA, 14 nt, Escherichia coli CFT073
cgauagaaaucaga

SEQ ID NO: 2635505 - RNA, 16 nt, Escherichia coli CFT073
cgauagaaaucagacu

SEQ ID NO: 2635506 - RNA, 21 nt, Escherichia coli CFT073
cgauagcaagcgcugugaaac

SEQ ID NO: 2635507 - RNA, 20 nt, Escherichia coli CFT073
cgauagcgaaagucaucggg

SEQ ID NO: 2635508 - RNA, 20 nt, Escherichia coli CFT073
cgauagcgcaccaaccacug

SEQ ID NO: 2635509 - RNA, 22 nt, Escherichia coli CFT073
cgauagcgcaccaaccacugcu

SEQ ID NO: 2635510 - RNA, 17 nt, Escherichia coli CFT073
cgauagcgcgccagccg

SEQ ID NO: 2635511 - RNA, 23 nt, Escherichia coli CFT073
cgauagcuaacugccuccugcaa

SEQ ID NO: 2635512 - RNA, 15 nt, Escherichia coli CFT073
cgauaggccuuaacc

SEQ ID NO: 2635513 - RNA, 19 nt, Escherichia coli CFT073
cgauaggccuuaaccgccg

SEQ ID NO: 2635514 - RNA, 21 nt, Escherichia coli CFT073
cgauaggggggauugccgcga

SEQ ID NO: 2635515 - RNA, 15 nt, Escherichia coli CFT073
cgauaguacauuucu

SEQ ID NO: 2635516 - RNA, 22 nt, Escherichia coli CFT073
cgauaguacauuucuucuuuca

SEQ ID NO: 2635517 - RNA, 20 nt, Escherichia coli CFT073
cgauaguagagauccuggcg

SEQ ID NO: 2635518 - RNA, 19 nt, Escherichia coli CFT073
cgauaguggaacaaagaaa

SEQ ID NO: 2635519 - RNA, 18 nt, Escherichia coli CFT073
cgauaguggucgauguac

SEQ ID NO: 2635520 - RNA, 17 nt, Escherichia coli CFT073
cgauauaaauuccacgc

SEQ ID NO: 2635521 - RNA, 15 nt, Escherichia coli CFT073
cgauauaaccauggc

SEQ ID NO: 2635522 - RNA, 18 nt, Escherichia coli CFT073
cgauauagaccaucggcg

SEQ ID NO: 2635523 - RNA, 21 nt, Escherichia coli CFT073
cgauauccgugcauuccagca

SEQ ID NO: 2635524 - RNA, 19 nt, Escherichia coli CFT073
cgauauccugaaacgcggc

SEQ ID NO: 2635525 - RNA, 22 nt, Escherichia coli CFT073
cgauaucgccauuaaacaaccc

SEQ ID NO: 2635526 - RNA, 16 nt, Escherichia coli CFT073
cgauaucuuucacaaa

SEQ ID NO: 2635527 - RNA, 17 nt, Escherichia coli CFT073
cgauaugaccauuggua

SEQ ID NO: 2635528 - RNA, 15 nt, Escherichia coli CFT073
cgauaugccccagcc

SEQ ID NO: 2635529 - RNA, 14 nt, Escherichia coli CFT073
cgauaugccggcau

SEQ ID NO: 2635530 - RNA, 21 nt, Escherichia coli CFT073
cgauauggccuucuucaucgc

SEQ ID NO: 2635531 - RNA, 17 nt, Escherichia coli CFT073
cgauaugggcagcucua

SEQ ID NO: 2635532 - RNA, 22 nt, Escherichia coli CFT073
cgauaugggcagcucuaucugc

SEQ ID NO: 2635533 - RNA, 23 nt, Escherichia coli CFT073
cgauauguucaggauauuuauau

SEQ ID NO: 2635534 - RNA, 19 nt, Escherichia coli CFT073
cgauauuacgggucacaaa

SEQ ID NO: 2635535 - RNA, 21 nt, Escherichia coli CFT073
cgauauuacgggucacaaaca

SEQ ID NO: 2635536 - RNA, 21 nt, Escherichia coli CFT073
cgauauuaguggcaaccgcaa

SEQ ID NO: 2635537 - RNA, 18 nt, Escherichia coli CFT073
cgauauucauuuugcugg

SEQ ID NO: 2635538 - RNA, 16 nt, Escherichia coli CFT073
cgauauuuaugccggu

SEQ ID NO: 2635539 - RNA, 16 nt, Escherichia coli CFT073
cgauauuugccgcgac

SEQ ID NO: 2635540 - RNA, 13 nt, Escherichia coli CFT073
cgaucaacagaau

SEQ ID NO: 2635541 - RNA, 14 nt, Escherichia coli CFT073
cgaucaacccaguu

SEQ ID NO: 2635542 - RNA, 14 nt, Escherichia coli CFT073
cgaucaauuucuuc

SEQ ID NO: 2635543 - RNA, 11 nt, Escherichia coli CFT073
cgaucaccgca

SEQ ID NO: 2635544 - RNA, 21 nt, Escherichia coli CFT073
cgaucaccgcacggcgaguau

SEQ ID NO: 2635545 - RNA, 23 nt, Escherichia coli CFT073
cgaucaccgcagaaaguugcgga

SEQ ID NO: 2635546 - RNA, 14 nt, Escherichia coli CFT073
cgaucacguaauaa

SEQ ID NO: 2635547 - RNA, 17 nt, Escherichia coli CFT073
cgaucacguaauaaaau

SEQ ID NO: 2635548 - RNA, 18 nt, Escherichia coli CFT073
cgaucagaaugaugcggu

SEQ ID NO: 2635549 - RNA, 18 nt, Escherichia coli CFT073
cgaucagacgaucgcgca

SEQ ID NO: 2635550 - RNA, 19 nt, Escherichia coli CFT073
cgaucagcaauuucuccgc

SEQ ID NO: 2635551 - RNA, 18 nt, Escherichia coli CFT073
cgaucaguuacucugcaa

SEQ ID NO: 2635552 - RNA, 15 nt, Escherichia coli CFT073
cgaucauauccagca

SEQ ID NO: 2635553 - RNA, 16 nt, Escherichia coli CFT073
cgaucauauccagcau

SEQ ID NO: 2635554 - RNA, 18 nt, Escherichia coli CFT073
cgaucauauccagcaucg

SEQ ID NO: 2635555 - RNA, 18 nt, Escherichia coli CFT073
cgaucaucaccugcgcug

SEQ ID NO: 2635556 - RNA, 14 nt, Escherichia coli CFT073
cgaucaucacgaca

SEQ ID NO: 2635557 - RNA, 19 nt, Escherichia coli CFT073
cgaucaucacgacauaauu

SEQ ID NO: 2635558 - RNA, 15 nt, Escherichia coli CFT073
cgaucaucauccagc

SEQ ID NO: 2635559 - RNA, 13 nt, Escherichia coli CFT073
cgaucaucgacag

SEQ ID NO: 2635560 - RNA, 13 nt, Escherichia coli CFT073
cgaucaucuggcg

SEQ ID NO: 2635561 - RNA, 14 nt, Escherichia coli CFT073
cgaucaugauaaau

SEQ ID NO: 2635562 - RNA, 15 nt, Escherichia coli CFT073
cgaucaugauaaaua

SEQ ID NO: 2635563 - RNA, 22 nt, Escherichia coli CFT073
cgaucauggucugcgccgcauu

SEQ ID NO: 2635564 - RNA, 15 nt, Escherichia coli CFT073
cgaucauuaacacca

SEQ ID NO: 2635565 - RNA, 20 nt, Escherichia coli CFT073
cgaucauuaacaccacgcca

SEQ ID NO: 2635566 - RNA, 19 nt, Escherichia coli CFT073
cgaucauuccgcccagacc

SEQ ID NO: 2635567 - RNA, 19 nt, Escherichia coli CFT073
cgauccagugauuccaguc

SEQ ID NO: 2635568 - RNA, 22 nt, Escherichia coli CFT073
cgaucccggagaagagauaaac

SEQ ID NO: 2635569 - RNA, 21 nt, Escherichia coli CFT073
cgauccgcgucauugacgcug

SEQ ID NO: 2635570 - RNA, 16 nt, Escherichia coli CFT073
cgauccggcaccaaug

SEQ ID NO: 2635571 - RNA, 20 nt, Escherichia coli CFT073
cgauccugauacagaccgcg

SEQ ID NO: 2635572 - RNA, 16 nt, Escherichia coli CFT073
cgauccuguucgaaca

SEQ ID NO: 2635573 - RNA, 17 nt, Escherichia coli CFT073
cgaucgauauucaccgu

SEQ ID NO: 2635574 - RNA, 22 nt, Escherichia coli CFT073
cgaucgccacuuucacgccgcc

SEQ ID NO: 2635575 - RNA, 11 nt, Escherichia coli CFT073
cgaucgcccgc

SEQ ID NO: 2635576 - RNA, 17 nt, Escherichia coli CFT073
cgaucgcccggcaccag

SEQ ID NO: 2635577 - RNA, 18 nt, Escherichia coli CFT073
cgaucgcccggcaccagc

SEQ ID NO: 2635578 - RNA, 21 nt, Escherichia coli CFT073
cgaucgcgaauaugcugggcg

SEQ ID NO: 2635579 - RNA, 22 nt, Escherichia coli CFT073
cgaucgcgccaaucagcgcagc

SEQ ID NO: 2635580 - RNA, 17 nt, Escherichia coli CFT073
cgaucgcgguaacagau

SEQ ID NO: 2635581 - RNA, 20 nt, Escherichia coli CFT073
cgaucgcuaaagcauucucc

SEQ ID NO: 2635582 - RNA, 22 nt, Escherichia coli CFT073
cgaucgcuuucgcuuucucuuc

SEQ ID NO: 2635583 - RNA, 15 nt, Escherichia coli CFT073
cgaucggcaggaaaa

SEQ ID NO: 2635584 - RNA, 23 nt, Escherichia coli CFT073
cgaucggugaugccaaucggcgg

SEQ ID NO: 2635585 - RNA, 17 nt, Escherichia coli CFT073
cgaucgucgcucacuuc

SEQ ID NO: 2635586 - RNA, 21 nt, Escherichia coli CFT073
cgaucucccgcuuuggcaucu

SEQ ID NO: 2635587 - RNA, 14 nt, Escherichia coli CFT073
cgaucucgccagag

SEQ ID NO: 2635588 - RNA, 16 nt, Escherichia coli CFT073
cgaucucgccagagag

SEQ ID NO: 2635589 - RNA, 20 nt, Escherichia coli CFT073
cgaucucuuuauuugauucg

SEQ ID NO: 2635590 - RNA, 16 nt, Escherichia coli CFT073
cgaucugacauuugca

SEQ ID NO: 2635591 - RNA, 19 nt, Escherichia coli CFT073
cgaucuguuuaucgcgcaa

SEQ ID NO: 2635592 - RNA, 15 nt, Escherichia coli CFT073
cgaucuucaaacugg

SEQ ID NO: 2635593 - RNA, 13 nt, Escherichia coli CFT073
cgaucuucccgcg

SEQ ID NO: 2635594 - RNA, 14 nt, Escherichia coli CFT073
cgaucuuccgaccg

SEQ ID NO: 2635595 - RNA, 18 nt, Escherichia coli CFT073
cgaucuuccgaccgcccu

SEQ ID NO: 2635596 - RNA, 20 nt, Escherichia coli CFT073
cgaucuuccggcgggcaaac

SEQ ID NO: 2635597 - RNA, 15 nt, Escherichia coli CFT073
cgaucuuccucuacg

SEQ ID NO: 2635598 - RNA, 19 nt, Escherichia coli CFT073
cgaucuucggcgucagaaa

SEQ ID NO: 2635599 - RNA, 15 nt, Escherichia coli CFT073
cgaucuucugccaau

SEQ ID NO: 2635600 - RNA, 19 nt, Escherichia coli CFT073
cgaucuucugccaauuuuu

SEQ ID NO: 2635601 - RNA, 17 nt, Escherichia coli CFT073
cgaugaaaaaccuuaaa

SEQ ID NO: 2635602 - RNA, 19 nt, Escherichia coli CFT073
cgaugaaauucacugucgu

SEQ ID NO: 2635603 - RNA, 19 nt, Escherichia coli CFT073
cgaugaacaugcagcaacu

SEQ ID NO: 2635604 - RNA, 13 nt, Escherichia coli CFT073
cgcaacuguccca

SEQ ID NO: 2635605 - RNA, 17 nt, Escherichia coli CFT073
cgcaacuuucgccgguu

SEQ ID NO: 2635606 - RNA, 14 nt, Escherichia coli CFT073
cgcaagccacgggc

SEQ ID NO: 2635607 - RNA, 17 nt, Escherichia coli CFT073
cgcaagcggcccggaga

SEQ ID NO: 2635608 - RNA, 16 nt, Escherichia coli CFT073
cgcaaggaucggugcu

SEQ ID NO: 2635609 - RNA, 14 nt, Escherichia coli CFT073
cgcaaggcauugag

SEQ ID NO: 2635610 - RNA, 15 nt, Escherichia coli CFT073
cgcaauaaucaucuc

SEQ ID NO: 2635611 - RNA, 15 nt, Escherichia coli CFT073
cgcaauacagccagc

SEQ ID NO: 2635612 - RNA, 20 nt, Escherichia coli CFT073
cgcaauaucauucgguugcc

SEQ ID NO: 2635613 - RNA, 22 nt, Escherichia coli CFT073
cgcaauauuuuauauuacgccu

SEQ ID NO: 2635614 - RNA, 19 nt, Escherichia coli CFT073
cgcaaucaaauuugccagc

SEQ ID NO: 2635615 - RNA, 18 nt, Escherichia coli CFT073
cgcaaucagcaccgcgcg

SEQ ID NO: 2635616 - RNA, 15 nt, Escherichia coli CFT073
cgcaaucauuuuuuc

SEQ ID NO: 2635617 - RNA, 14 nt, Escherichia coli CFT073
cgcaaucgccucca

SEQ ID NO: 2635618 - RNA, 19 nt, Escherichia coli CFT073
cgcaaugccgcauacauaa

SEQ ID NO: 2635619 - RNA, 18 nt, Escherichia coli CFT073
cgcaauggccguuccggc

SEQ ID NO: 2635620 - RNA, 21 nt, Escherichia coli CFT073
cgcaauggccguuccggcaac

SEQ ID NO: 2635621 - RNA, 16 nt, Escherichia coli CFT073
cgcaaugguguacuca

SEQ ID NO: 2635622 - RNA, 15 nt, Escherichia coli CFT073
cgcaauguccauaaa

SEQ ID NO: 2635623 - RNA, 12 nt, Escherichia coli CFT073
cgcaaugugcuc

SEQ ID NO: 2635624 - RNA, 23 nt, Escherichia coli CFT073
cgcaauuuauugaauuugcagau

SEQ ID NO: 2635625 - RNA, 14 nt, Escherichia coli CFT073
cgcacaaacgccac

SEQ ID NO: 2635626 - RNA, 16 nt, Escherichia coli CFT073
cgcacaaacgccaccu

SEQ ID NO: 2635627 - RNA, 17 nt, Escherichia coli CFT073
cgcacaccgagauaaug

SEQ ID NO: 2635628 - RNA, 18 nt, Escherichia coli CFT073
cgcacagcccgccgccau

SEQ ID NO: 2635629 - RNA, 18 nt, Escherichia coli CFT073
cgcacaggcggcccaguu

SEQ ID NO: 2635630 - RNA, 17 nt, Escherichia coli CFT073
cgcacagguugcacgga

SEQ ID NO: 2635631 - RNA, 20 nt, Escherichia coli CFT073
cgcacaguacgcgcccgccg

SEQ ID NO: 2635632 - RNA, 14 nt, Escherichia coli CFT073
cgcacaucaccgcc

SEQ ID NO: 2635633 - RNA, 21 nt, Escherichia coli CFT073
cgcacaugcagcuucgccauu

SEQ ID NO: 2635634 - RNA, 23 nt, Escherichia coli CFT073
cgcacaugucaguugcauaccau

SEQ ID NO: 2635635 - RNA, 14 nt, Escherichia coli CFT073
cgcacauugccgua

SEQ ID NO: 2635636 - RNA, 22 nt, Escherichia coli CFT073
cgcaccaaaguuaaucagcgcc

SEQ ID NO: 2635637 - RNA, 17 nt, Escherichia coli CFT073
cgcaccaaauccaaccu

SEQ ID NO: 2635638 - RNA, 13 nt, Escherichia coli CFT073
cgcaccaacgcaa

SEQ ID NO: 2635639 - RNA, 20 nt, Escherichia coli CFT073
cgcaccaacggucagcgcac

SEQ ID NO: 2635640 - RNA, 13 nt, Escherichia coli CFT073
cgcaccaacucca

SEQ ID NO: 2635641 - RNA, 11 nt, Escherichia coli CFT073
cgcaccaccag

SEQ ID NO: 2635642 - RNA, 14 nt, Escherichia coli CFT073
cgcaccaccagcag

SEQ ID NO: 2635643 - RNA, 15 nt, Escherichia coli CFT073
cgcaccaccagcagc

SEQ ID NO: 2635644 - RNA, 16 nt, Escherichia coli CFT073
cgcaccaccagcagcu

SEQ ID NO: 2635645 - RNA, 17 nt, Escherichia coli CFT073
cgcaccagaaacaauaa

SEQ ID NO: 2635646 - RNA, 18 nt, Escherichia coli CFT073
cgcaccagcacaucaccu

SEQ ID NO: 2635647 - RNA, 22 nt, Escherichia coli CFT073
cgcaccagcggaaugcagucac

SEQ ID NO: 2635648 - RNA, 17 nt, Escherichia coli CFT073
cgcaccaggcaguuuau

SEQ ID NO: 2635649 - RNA, 12 nt, Escherichia coli CFT073
cgcaccaggcga

SEQ ID NO: 2635650 - RNA, 13 nt, Escherichia coli CFT073
cgcacccgccauc

SEQ ID NO: 2635651 - RNA, 16 nt, Escherichia coli CFT073
cgcaccgcgugaugcg

SEQ ID NO: 2635652 - RNA, 18 nt, Escherichia coli CFT073
cgcaccgcgugaugcggc

SEQ ID NO: 2635653 - RNA, 22 nt, Escherichia coli CFT073
cgcaccggaaauugcugccgcu

SEQ ID NO: 2635654 - RNA, 12 nt, Escherichia coli CFT073
cgcaccggcaag

SEQ ID NO: 2635655 - RNA, 16 nt, Escherichia coli CFT073
cgcaccgguuccgggc

SEQ ID NO: 2635656 - RNA, 18 nt, Escherichia coli CFT073
cgcaccuacagccaugcg

SEQ ID NO: 2635657 - RNA, 12 nt, Escherichia coli CFT073
cgcaccugccag

SEQ ID NO: 2635658 - RNA, 13 nt, Escherichia coli CFT073
cgcaccugccagc

SEQ ID NO: 2635659 - RNA, 15 nt, Escherichia coli CFT073
cgcaccugccagcgc

SEQ ID NO: 2635660 - RNA, 13 nt, Escherichia coli CFT073
cgcaccugccagu

SEQ ID NO: 2635661 - RNA, 17 nt, Escherichia coli CFT073
cgcaccuucauucaggc

SEQ ID NO: 2635662 - RNA, 23 nt, Escherichia coli CFT073
cgcaccuucauucaggccaaagc

SEQ ID NO: 2635663 - RNA, 18 nt, Escherichia coli CFT073
cgcaccuuucaacggucg

SEQ ID NO: 2635664 - RNA, 19 nt, Escherichia coli CFT073
cgcacgaggaacagcgcgc

SEQ ID NO: 2635665 - RNA, 18 nt, Escherichia coli CFT073
cgcacgcugucgccagug

SEQ ID NO: 2635666 - RNA, 16 nt, Escherichia coli CFT073
cgcacggcguucaggc

SEQ ID NO: 2635667 - RNA, 18 nt, Escherichia coli CFT073
cgcacgguucgccaucac

SEQ ID NO: 2635668 - RNA, 20 nt, Escherichia coli CFT073
cgcacguaacgaguuaccgu

SEQ ID NO: 2635669 - RNA, 16 nt, Escherichia coli CFT073
cgcacguucugucgcu

SEQ ID NO: 2635670 - RNA, 15 nt, Escherichia coli CFT073
cgcacguugccagca

SEQ ID NO: 2635671 - RNA, 17 nt, Escherichia coli CFT073
cgcacguugccagcaac

SEQ ID NO: 2635672 - RNA, 19 nt, Escherichia coli CFT073
cgcacguugccagcaacug

SEQ ID NO: 2635673 - RNA, 15 nt, Escherichia coli CFT073
cgcacguuguuaaca

SEQ ID NO: 2635674 - RNA, 23 nt, Escherichia coli CFT073
cgcacguuuuuccagugauuguc

SEQ ID NO: 2635675 - RNA, 14 nt, Escherichia coli CFT073
cgcacuccaacucu

SEQ ID NO: 2635676 - RNA, 21 nt, Escherichia coli CFT073
cgcacucuacucccugcugau

SEQ ID NO: 2635677 - RNA, 16 nt, Escherichia coli CFT073
cgcacugcaggcugau

SEQ ID NO: 2635678 - RNA, 20 nt, Escherichia coli CFT073
cgcacuggcgagcgccagca

SEQ ID NO: 2635679 - RNA, 16 nt, Escherichia coli CFT073
cgcacuggcgcgccug

SEQ ID NO: 2635680 - RNA, 17 nt, Escherichia coli CFT073
cgcacuggcgcgccugu

SEQ ID NO: 2635681 - RNA, 12 nt, Escherichia coli CFT073
cgcacuuacagc

SEQ ID NO: 2635682 - RNA, 13 nt, Escherichia coli CFT073
cgcacuuugcugg

SEQ ID NO: 2635683 - RNA, 16 nt, Escherichia coli CFT073
cgcagaaaaaagcuug

SEQ ID NO: 2635684 - RNA, 18 nt, Escherichia coli CFT073
cgcagaaauaccccgcca

SEQ ID NO: 2635685 - RNA, 20 nt, Escherichia coli CFT073
cgcagaaauaccccgccagc

SEQ ID NO: 2635686 - RNA, 23 nt, Escherichia coli CFT073
cgcagaaauaccccgccagcaga

SEQ ID NO: 2635687 - RNA, 19 nt, Escherichia coli CFT073
cgcagaaaugcgaaaauua

SEQ ID NO: 2635688 - RNA, 14 nt, Escherichia coli CFT073
cgcagaacuucacu

SEQ ID NO: 2635689 - RNA, 22 nt, Escherichia coli CFT073
cgcagaaucuucuucucagcca

SEQ ID NO: 2635690 - RNA, 12 nt, Escherichia coli CFT073
cgcagaccaaac

SEQ ID NO: 2635691 - RNA, 14 nt, Escherichia coli CFT073
cgcagaccaaccgu

SEQ ID NO: 2635692 - RNA, 16 nt, Escherichia coli CFT073
cgcagaccuucugcca

SEQ ID NO: 2635693 - RNA, 19 nt, Escherichia coli CFT073
cgcagagugcgcagcaucg

SEQ ID NO: 2635694 - RNA, 15 nt, Escherichia coli CFT073
cgcagaguuuccagg

SEQ ID NO: 2635695 - RNA, 19 nt, Escherichia coli CFT073
cgcagaguuuccaggcugg

SEQ ID NO: 2635696 - RNA, 16 nt, Escherichia coli CFT073
cgcagauaagaccaau

SEQ ID NO: 2635697 - RNA, 19 nt, Escherichia coli CFT073
cgcagauuuuugcgccauc

SEQ ID NO: 2635698 - RNA, 21 nt, Escherichia coli CFT073
cgcagcaaaagcaggcaccgc

SEQ ID NO: 2635699 - RNA, 17 nt, Escherichia coli CFT073
cgcagcaaagcccgggc

SEQ ID NO: 2635700 - RNA, 18 nt, Escherichia coli CFT073
cgcagcaacuacagcauu

SEQ ID NO: 2635701 - RNA, 20 nt, Escherichia coli CFT073
cgcagcacccugaguuuuca

SEQ ID NO: 2635702 - RNA, 18 nt, Escherichia coli CFT073
cgcagcacgacucucccc

SEQ ID NO: 2635703 - RNA, 20 nt, Escherichia coli CFT073
cgcagcacgacucuccccug

SEQ ID NO: 2635704 - RNA, 12 nt, Escherichia coli CFT073
cgcagcacggcg

SEQ ID NO: 2635705 - RNA, 16 nt, Escherichia coli CFT073
cgcagcaucggccugc

SEQ ID NO: 2635706 - RNA, 16 nt, Escherichia coli CFT073
cgcagccacgucaccu

SEQ ID NO: 2635707 - RNA, 12 nt, Escherichia coli CFT073
cgcagccagcac

SEQ ID NO: 2635708 - RNA, 15 nt, Escherichia coli CFT073
cgcagccagcacugc

SEQ ID NO: 2635709 - RNA, 13 nt, Escherichia coli CFT073
cgcagccaguuaa

SEQ ID NO: 2635710 - RNA, 22 nt, Escherichia coli CFT073
cgcagcgcaucaggcaacccag

SEQ ID NO: 2635711 - RNA, 22 nt, Escherichia coli CFT073
cgcagcgcguuacgcccaagca

SEQ ID NO: 2635712 - RNA, 21 nt, Escherichia coli CFT073
cgcagcggaggcgauaaugac

SEQ ID NO: 2635713 - RNA, 19 nt, Escherichia coli CFT073
cgcaugaugccggguuugc

SEQ ID NO: 2635714 - RNA, 15 nt, Escherichia coli CFT073
cgcaugaugucugca

SEQ ID NO: 2635715 - RNA, 15 nt, Escherichia coli CFT073
cgcaugccagcgccc

SEQ ID NO: 2635716 - RNA, 16 nt, Escherichia coli CFT073
cgcaugguagaaaucu

SEQ ID NO: 2635717 - RNA, 16 nt, Escherichia coli CFT073
cgcauguaacugccuu

SEQ ID NO: 2635718 - RNA, 15 nt, Escherichia coli CFT073
cgcauuaaauaccaa

SEQ ID NO: 2635719 - RNA, 18 nt, Escherichia coli CFT073
cgcauuaaauaccaagcc

SEQ ID NO: 2635720 - RNA, 16 nt, Escherichia coli CFT073
cgcauuaacucacugg

SEQ ID NO: 2635721 - RNA, 18 nt, Escherichia coli CFT073
cgcauuaacucacuggcg

SEQ ID NO: 2635722 - RNA, 16 nt, Escherichia coli CFT073
cgcauuauuuugcgga

SEQ ID NO: 2635723 - RNA, 15 nt, Escherichia coli CFT073
cgcauucaccagcgg

SEQ ID NO: 2635724 - RNA, 16 nt, Escherichia coli CFT073
cgcauucgaucaccgc

SEQ ID NO: 2635725 - RNA, 20 nt, Escherichia coli CFT073
cgcauucgaucaccgcagaa

SEQ ID NO: 2635726 - RNA, 13 nt, Escherichia coli CFT073
cgcauucguucau

SEQ ID NO: 2635727 - RNA, 18 nt, Escherichia coli CFT073
cgcauucugugccggaau

SEQ ID NO: 2635728 - RNA, 21 nt, Escherichia coli CFT073
cgcauugccgccauuuauaaa

SEQ ID NO: 2635729 - RNA, 14 nt, Escherichia coli CFT073
cgcauugcggcauc

SEQ ID NO: 2635730 - RNA, 13 nt, Escherichia coli CFT073
cgcauugcuggcu

SEQ ID NO: 2635731 - RNA, 18 nt, Escherichia coli CFT073
cgccaaaaggcaauucaa

SEQ ID NO: 2635732 - RNA, 23 nt, Escherichia coli CFT073
cgccaaaccgaccaaucacaucg

SEQ ID NO: 2635733 - RNA, 21 nt, Escherichia coli CFT073
cgccaaacucggucacgcggu

SEQ ID NO: 2635734 - RNA, 19 nt, Escherichia coli CFT073
cgccaaacugugcaccgcc

SEQ ID NO: 2635735 - RNA, 14 nt, Escherichia coli CFT073
cgccaaagcggcag

SEQ ID NO: 2635736 - RNA, 15 nt, Escherichia coli CFT073
cgccaaagcggcagu

SEQ ID NO: 2635737 - RNA, 14 nt, Escherichia coli CFT073
cgccaaaucugccg

SEQ ID NO: 2635738 - RNA, 18 nt, Escherichia coli CFT073
cgccaaauggcaggcaca

SEQ ID NO: 2635739 - RNA, 19 nt, Escherichia coli CFT073
cgccaaauggcaggcacag

SEQ ID NO: 2635740 - RNA, 21 nt, Escherichia coli CFT073
cgccaaauucuuuaucgauaa

SEQ ID NO: 2635741 - RNA, 23 nt, Escherichia coli CFT073
cgccaacaaaaaugcaggcguuu

SEQ ID NO: 2635742 - RNA, 13 nt, Escherichia coli CFT073
cgccaacagcagc

SEQ ID NO: 2635743 - RNA, 14 nt, Escherichia coli CFT073
cgccaacagcagcc

SEQ ID NO: 2635744 - RNA, 13 nt, Escherichia coli CFT073
cgccaaccagcug

SEQ ID NO: 2635745 - RNA, 13 nt, Escherichia coli CFT073
cgccaaccaggau

SEQ ID NO: 2635746 - RNA, 15 nt, Escherichia coli CFT073
cgccaacgucugccu

SEQ ID NO: 2635747 - RNA, 23 nt, Escherichia coli CFT073
cgccaacgugguuuaccaccagc

SEQ ID NO: 2635748 - RNA, 15 nt, Escherichia coli CFT073
cgccaacguguugcu

SEQ ID NO: 2635749 - RNA, 19 nt, Escherichia coli CFT073
cgccaacucaacgccugcu

SEQ ID NO: 2635750 - RNA, 19 nt, Escherichia coli CFT073
cgccaagauagaaccacgc

SEQ ID NO: 2635751 - RNA, 14 nt, Escherichia coli CFT073
cgccaagcgcaaua

SEQ ID NO: 2635752 - RNA, 20 nt, Escherichia coli CFT073
cgccaaguucgaacgccgcc

SEQ ID NO: 2635753 - RNA, 14 nt, Escherichia coli CFT073
cgccaauaacagaa

SEQ ID NO: 2635754 - RNA, 12 nt, Escherichia coli CFT073
cgccaauaaucu

SEQ ID NO: 2635755 - RNA, 14 nt, Escherichia coli CFT073
cgccaauaaucugc

SEQ ID NO: 2635756 - RNA, 13 nt, Escherichia coli CFT073
cgccaauaaugaa

SEQ ID NO: 2635757 - RNA, 17 nt, Escherichia coli CFT073
cgccaaucagcgcagca

SEQ ID NO: 2635758 - RNA, 19 nt, Escherichia coli CFT073
cgccaaucagcgcagcacc

SEQ ID NO: 2635759 - RNA, 12 nt, Escherichia coli CFT073
cgccaaucgcca

SEQ ID NO: 2635760 - RNA, 20 nt, Escherichia coli CFT073
cgccaaucgccacgccaaga

SEQ ID NO: 2635761 - RNA, 16 nt, Escherichia coli CFT073
cgccaaucgucgccgu

SEQ ID NO: 2635762 - RNA, 17 nt, Escherichia coli CFT073
cgccaaugaucccgcca

SEQ ID NO: 2635763 - RNA, 18 nt, Escherichia coli CFT073
cgccaauuacgccugccc

SEQ ID NO: 2635764 - RNA, 21 nt, Escherichia coli CFT073
cgccaauuugucgccaucguu

SEQ ID NO: 2635765 - RNA, 22 nt, Escherichia coli CFT073
cgccaauuugucgccaucguua

SEQ ID NO: 2635766 - RNA, 17 nt, Escherichia coli CFT073
cgccacaacuucaacgu

SEQ ID NO: 2635767 - RNA, 22 nt, Escherichia coli CFT073
cgccacaaucagcgcggcgaua

SEQ ID NO: 2635768 - RNA, 24 nt, Escherichia coli CFT073
cgccacauugugggauuccagcgc

SEQ ID NO: 2635769 - RNA, 14 nt, Escherichia coli CFT073
cgccaccacaacau

SEQ ID NO: 2635770 - RNA, 19 nt, Escherichia coli CFT073
cgccaccacaacauuccca

SEQ ID NO: 2635771 - RNA, 13 nt, Escherichia coli CFT073
cgccaccaccagc

SEQ ID NO: 2635772 - RNA, 14 nt, Escherichia coli CFT073
cgccaccaccagcg

SEQ ID NO: 2635773 - RNA, 13 nt, Escherichia coli CFT073
cgccaccaccagu

SEQ ID NO: 2635774 - RNA, 17 nt, Escherichia coli CFT073
cgccaccacgcccagcg

SEQ ID NO: 2635775 - RNA, 18 nt, Escherichia coli CFT073
cgccaccagaaccgccgc

SEQ ID NO: 2635776 - RNA, 22 nt, Escherichia coli CFT073
cgccaccagauacggcgaucgu

SEQ ID NO: 2635777 - RNA, 18 nt, Escherichia coli CFT073
cgccaccagcgccaccac

SEQ ID NO: 2635778 - RNA, 22 nt, Escherichia coli CFT073
cgccaccagcgucagaaacagu

SEQ ID NO: 2635779 - RNA, 18 nt, Escherichia coli CFT073
cgccaccauguugcgcag

SEQ ID NO: 2635780 - RNA, 16 nt, Escherichia coli CFT073
cgccaccgaccaggca

SEQ ID NO: 2635781 - RNA, 14 nt, Escherichia coli CFT073
cgccaccgcuucgc

SEQ ID NO: 2635782 - RNA, 21 nt, Escherichia coli CFT073
cgccaccggcuuucgcuucaa

SEQ ID NO: 2635783 - RNA, 14 nt, Escherichia coli CFT073
cgccaccucuuuca

SEQ ID NO: 2635784 - RNA, 18 nt, Escherichia coli CFT073
cgccaccucuuucaccaa

SEQ ID NO: 2635785 - RNA, 15 nt, Escherichia coli CFT073
cgccacgacucaaau

SEQ ID NO: 2635786 - RNA, 16 nt, Escherichia coli CFT073
cgccacgccaaccacc

SEQ ID NO: 2635787 - RNA, 13 nt, Escherichia coli CFT073
cgccacgccaaga

SEQ ID NO: 2635788 - RNA, 16 nt, Escherichia coli CFT073
cgccacgccaccagcg

SEQ ID NO: 2635789 - RNA, 11 nt, Escherichia coli CFT073
cgccacgcggg

SEQ ID NO: 2635790 - RNA, 19 nt, Escherichia coli CFT073
cgccacgcgggaagucacu

SEQ ID NO: 2635791 - RNA, 23 nt, Escherichia coli CFT073
cgccacggaaacauucaauaagc

SEQ ID NO: 2635792 - RNA, 20 nt, Escherichia coli CFT073
cgccacgucguuccccauca

SEQ ID NO: 2635793 - RNA, 14 nt, Escherichia coli CFT073
cgccacuaagcagg

SEQ ID NO: 2635794 - RNA, 22 nt, Escherichia coli CFT073
cgccacuaucgccaucaggcag

SEQ ID NO: 2635795 - RNA, 18 nt, Escherichia coli CFT073
cgccacuccacugcgcau

SEQ ID NO: 2635796 - RNA, 19 nt, Escherichia coli CFT073
cgccacugcgacaccagca

SEQ ID NO: 2635797 - RNA, 18 nt, Escherichia coli CFT073
cgccacuggcggaugcgg

SEQ ID NO: 2635798 - RNA, 21 nt, Escherichia coli CFT073
cgccacuggcggaugcggcga

SEQ ID NO: 2635799 - RNA, 17 nt, Escherichia coli CFT073
cgccacuugagccgcca

SEQ ID NO: 2635800 - RNA, 19 nt, Escherichia coli CFT073
cgccacuugagccgccacc

SEQ ID NO: 2635801 - RNA, 16 nt, Escherichia coli CFT073
cgccacuuucacgccg

SEQ ID NO: 2635802 - RNA, 19 nt, Escherichia coli CFT073
cgccacuuucacgccgcca

SEQ ID NO: 2635803 - RNA, 23 nt, Escherichia coli CFT073
cgccacuuuuuucacccacacuu

SEQ ID NO: 2635804 - RNA, 20 nt, Escherichia coli CFT073
cgccagaaaaccuggcgcag

SEQ ID NO: 2635805 - RNA, 23 nt, Escherichia coli CFT073
cgccagaaagacgguuaacgcca

SEQ ID NO: 2635806 - RNA, 22 nt, Escherichia coli CFT073
cgccagaaaguuuuucaacacc

SEQ ID NO: 2635807 - RNA, 13 nt, Escherichia coli CFT073
cgccagaaaucag

SEQ ID NO: 2635808 - RNA, 15 nt, Escherichia coli CFT073
cgccagaaauuugca

SEQ ID NO: 2635809 - RNA, 17 nt, Escherichia coli CFT073
cgccagaacacgcuccc

SEQ ID NO: 2635810 - RNA, 21 nt, Escherichia coli CFT073
cgccagaacacgcucccagca

SEQ ID NO: 2635811 - RNA, 15 nt, Escherichia coli CFT073
cgccagaagaaccgc

SEQ ID NO: 2635812 - RNA, 23 nt, Escherichia coli CFT073
cgccagaagaauaaaacauagcc

SEQ ID NO: 2635813 - RNA, 17 nt, Escherichia coli CFT073
cgccagaauagcgccgc

SEQ ID NO: 2635814 - RNA, 21 nt, Escherichia coli CFT073
cgccagaauauugccauuacg

SEQ ID NO: 2635815 - RNA, 18 nt, Escherichia coli CFT073
cgccagacaauugccgcu

SEQ ID NO: 2635816 - RNA, 14 nt, Escherichia coli CFT073
cgccagacacugga

SEQ ID NO: 2635817 - RNA, 17 nt, Escherichia coli CFT073
cgccagaccacugcgcc

SEQ ID NO: 2635818 - RNA, 14 nt, Escherichia coli CFT073
cgccagaccagcua

SEQ ID NO: 2635819 - RNA, 21 nt, Escherichia coli CFT073
cgccagaccagcuaccacgcc

SEQ ID NO: 2635820 - RNA, 14 nt, Escherichia coli CFT073
cgccagaccugcgc

SEQ ID NO: 2635821 - RNA, 18 nt, Escherichia coli CFT073
cgccaucagccacuucaa

SEQ ID NO: 2635822 - RNA, 21 nt, Escherichia coli CFT073
cgccaucagccacuucaacca

SEQ ID NO: 2635823 - RNA, 12 nt, Escherichia coli CFT073
cgccaucagcgc

SEQ ID NO: 2635824 - RNA, 13 nt, Escherichia coli CFT073
cgccaucaggcag

SEQ ID NO: 2635825 - RNA, 15 nt, Escherichia coli CFT073
cgccaucagggccaa

SEQ ID NO: 2635826 - RNA, 15 nt, Escherichia coli CFT073
cgccaucaguuucag

SEQ ID NO: 2635827 - RNA, 16 nt, Escherichia coli CFT073
cgccaucaugaucaga

SEQ ID NO: 2635828 - RNA, 17 nt, Escherichia coli CFT073
cgccaucaugaucagaa

SEQ ID NO: 2635829 - RNA, 15 nt, Escherichia coli CFT073
cgccauccagccggg

SEQ ID NO: 2635830 - RNA, 14 nt, Escherichia coli CFT073
cgccauccagguag

SEQ ID NO: 2635831 - RNA, 18 nt, Escherichia coli CFT073
cgccauccagguagcaaa

SEQ ID NO: 2635832 - RNA, 14 nt, Escherichia coli CFT073
cgccauccccacgc

SEQ ID NO: 2635833 - RNA, 14 nt, Escherichia coli CFT073
cgccauccggcagc

SEQ ID NO: 2635834 - RNA, 19 nt, Escherichia coli CFT073
cgccauccgguuaucagaa

SEQ ID NO: 2635835 - RNA, 13 nt, Escherichia coli CFT073
cgccaucgcgcau

SEQ ID NO: 2635836 - RNA, 20 nt, Escherichia coli CFT073
cgccaucguuaaaaaacagu

SEQ ID NO: 2635837 - RNA, 22 nt, Escherichia coli CFT073
cgccaucguuaaaaaacagugc

SEQ ID NO: 2635838 - RNA, 16 nt, Escherichia coli CFT073
cgccaucguugaugca

SEQ ID NO: 2635839 - RNA, 19 nt, Escherichia coli CFT073
cgccaucucuucugcgcua

SEQ ID NO: 2635840 - RNA, 14 nt, Escherichia coli CFT073
cgccaugaagaugg

SEQ ID NO: 2635841 - RNA, 17 nt, Escherichia coli CFT073
cgccaugccaacgcggc

SEQ ID NO: 2635842 - RNA, 23 nt, Escherichia coli CFT073
cgccauggcauuaaauucagcaa

SEQ ID NO: 2635843 - RNA, 23 nt, Escherichia coli CFT073
cgccauggcggauccguugaucg

SEQ ID NO: 2635844 - RNA, 16 nt, Escherichia coli CFT073
cgccauguugccuggg

SEQ ID NO: 2635845 - RNA, 14 nt, Escherichia coli CFT073
cgccauuaacaacg

SEQ ID NO: 2635846 - RNA, 17 nt, Escherichia coli CFT073
cgccauuaacaacgucg

SEQ ID NO: 2635847 - RNA, 22 nt, Escherichia coli CFT073
cgccauuagcgaugaaaucaug

SEQ ID NO: 2635848 - RNA, 15 nt, Escherichia coli CFT073
cgccauuaucgauaa

SEQ ID NO: 2635849 - RNA, 17 nt, Escherichia coli CFT073
cgccauuccagccagaa

SEQ ID NO: 2635850 - RNA, 19 nt, Escherichia coli CFT073
cgccauucucaccuacagc

SEQ ID NO: 2635851 - RNA, 14 nt, Escherichia coli CFT073
cgccauugacagaa

SEQ ID NO: 2635852 - RNA, 15 nt, Escherichia coli CFT073
cgccauugaugagaa

SEQ ID NO: 2635853 - RNA, 18 nt, Escherichia coli CFT073
cgccauugcagccgcgau

SEQ ID NO: 2635854 - RNA, 20 nt, Escherichia coli CFT073
cgccauugcuaucaacaaua

SEQ ID NO: 2635855 - RNA, 13 nt, Escherichia coli CFT073
cgccauuuccagc

SEQ ID NO: 2635856 - RNA, 19 nt, Escherichia coli CFT073
cgccauuuugcaacgcuuu

SEQ ID NO: 2635857 - RNA, 16 nt, Escherichia coli CFT073
cgccauuuugcgcggc

SEQ ID NO: 2635858 - RNA, 18 nt, Escherichia coli CFT073
cgccauuuugcgcggcau

SEQ ID NO: 2635859 - RNA, 14 nt, Escherichia coli CFT073
cgcccaacacuucc

SEQ ID NO: 2635860 - RNA, 13 nt, Escherichia coli CFT073
cgcccaauauccu

SEQ ID NO: 2635861 - RNA, 22 nt, Escherichia coli CFT073
cgcccacaacagcaucgguauc

SEQ ID NO: 2635862 - RNA, 15 nt, Escherichia coli CFT073
cgcccacauaaccaa

SEQ ID NO: 2635863 - RNA, 20 nt, Escherichia coli CFT073
cgcccacauaaccaaucauc

SEQ ID NO: 2635864 - RNA, 14 nt, Escherichia coli CFT073
cgcccaccgccagg

SEQ ID NO: 2635865 - RNA, 22 nt, Escherichia coli CFT073
cgcccaccucuucuuuaaaacg

SEQ ID NO: 2635866 - RNA, 13 nt, Escherichia coli CFT073
cgcccacgcacca

SEQ ID NO: 2635867 - RNA, 17 nt, Escherichia coli CFT073
cgcccacgccagcccgc

SEQ ID NO: 2635868 - RNA, 14 nt, Escherichia coli CFT073
cgcccacuucuuuc

SEQ ID NO: 2635869 - RNA, 16 nt, Escherichia coli CFT073
cgcccagaccgugcgc

SEQ ID NO: 2635870 - RNA, 17 nt, Escherichia coli CFT073
cgcccagaccugcguuc

SEQ ID NO: 2635871 - RNA, 20 nt, Escherichia coli CFT073
cgcccagcagcgccgcgccu

SEQ ID NO: 2635872 - RNA, 13 nt, Escherichia coli CFT073
cgcccagccaucg

SEQ ID NO: 2635873 - RNA, 23 nt, Escherichia coli CFT073
cgcccagccugaaugccgcgccc

SEQ ID NO: 2635874 - RNA, 18 nt, Escherichia coli CFT073
cgcccagcgaccacaaau

SEQ ID NO: 2635875 - RNA, 20 nt, Escherichia coli CFT073
cgcccagcgaccacaaauac

SEQ ID NO: 2635876 - RNA, 13 nt, Escherichia coli CFT073
cgcccagcgcagg

SEQ ID NO: 2635877 - RNA, 18 nt, Escherichia coli CFT073
cgcccagcgcaggaaaga

SEQ ID NO: 2635878 - RNA, 18 nt, Escherichia coli CFT073
cgcccaggaaggcugacc

SEQ ID NO: 2635879 - RNA, 20 nt, Escherichia coli CFT073
cgcccaggcaaguagcgcca

SEQ ID NO: 2635880 - RNA, 15 nt, Escherichia coli CFT073
cgcccaguagugcgc

SEQ ID NO: 2635881 - RNA, 17 nt, Escherichia coli CFT073
cgcccaguagugcgcag

SEQ ID NO: 2635882 - RNA, 23 nt, Escherichia coli CFT073
cgcccagucacggcuggagccug

SEQ ID NO: 2635883 - RNA, 17 nt, Escherichia coli CFT073
cgcccauaacgcgcgcg

SEQ ID NO: 2635884 - RNA, 17 nt, Escherichia coli CFT073
cgcccauacucaucuuc

SEQ ID NO: 2635885 - RNA, 18 nt, Escherichia coli CFT073
cgcccauacucaucuucc

SEQ ID NO: 2635886 - RNA, 19 nt, Escherichia coli CFT073
cgcccauacucaucuucca

SEQ ID NO: 2635887 - RNA, 20 nt, Escherichia coli CFT073
cgcccaucauugcgccgaac

SEQ ID NO: 2635888 - RNA, 14 nt, Escherichia coli CFT073
cgcccaucgcgccc

SEQ ID NO: 2635889 - RNA, 19 nt, Escherichia coli CFT073
cgcccaucgcgcccgccgc

SEQ ID NO: 2635890 - RNA, 17 nt, Escherichia coli CFT073
cgcccaucuucguacca

SEQ ID NO: 2635891 - RNA, 16 nt, Escherichia coli CFT073
cgcccaugcgauuacg

SEQ ID NO: 2635892 - RNA, 20 nt, Escherichia coli CFT073
cgccccacaagcccgccaga

SEQ ID NO: 2635893 - RNA, 21 nt, Escherichia coli CFT073
cgccccagaauccccacaaac

SEQ ID NO: 2635894 - RNA, 21 nt, Escherichia coli CFT073
cgccccagaccugaauuugcu

SEQ ID NO: 2635895 - RNA, 20 nt, Escherichia coli CFT073
cgccccaguaaauggugaua

SEQ ID NO: 2635896 - RNA, 13 nt, Escherichia coli CFT073
cgcccccgccagc

SEQ ID NO: 2635897 - RNA, 15 nt, Escherichia coli CFT073
cgccccgcucacgca

SEQ ID NO: 2635898 - RNA, 13 nt, Escherichia coli CFT073
cgccccggaagcc

SEQ ID NO: 2635899 - RNA, 18 nt, Escherichia coli CFT073
cgccccggaagccagacg

SEQ ID NO: 2635900 - RNA, 15 nt, Escherichia coli CFT073
cgccccggcgauccc

SEQ ID NO: 2635901 - RNA, 20 nt, Escherichia coli CFT073
cgccccugcccuuucaacca

SEQ ID NO: 2635902 - RNA, 20 nt, Escherichia coli CFT073
cgcccgaccaucgccagcuc

SEQ ID NO: 2635903 - RNA, 21 nt, Escherichia coli CFT073
cgcccgagccgguugccugau

SEQ ID NO: 2635904 - RNA, 19 nt, Escherichia coli CFT073
cgcccgauagcgaaaguca

SEQ ID NO: 2635905 - RNA, 21 nt, Escherichia coli CFT073
cgcccgaugcauaauccgccg

SEQ ID NO: 2635906 - RNA, 18 nt, Escherichia coli CFT073
cgcccgaugccagcacag

SEQ ID NO: 2635907 - RNA, 23 nt, Escherichia coli CFT073
cgcccgcaacuuuaccgcaaucg

SEQ ID NO: 2635908 - RNA, 17 nt, Escherichia coli CFT073
cgcccgcacugucgcca

SEQ ID NO: 2635909 - RNA, 11 nt, Escherichia coli CFT073
cgcccgccaga

SEQ ID NO: 2635910 - RNA, 23 nt, Escherichia coli CFT073
cgcccgccgagaaauaucagcag

SEQ ID NO: 2635911 - RNA, 14 nt, Escherichia coli CFT073
cgcccgccgccauu

SEQ ID NO: 2635912 - RNA, 13 nt, Escherichia coli CFT073
cgcccgccugcgu

SEQ ID NO: 2635913 - RNA, 18 nt, Escherichia coli CFT073
cgcccggaaacgggcgcu

SEQ ID NO: 2635914 - RNA, 22 nt, Escherichia coli CFT073
cgcccggauauccacccgcagc

SEQ ID NO: 2635915 - RNA, 19 nt, Escherichia coli CFT073
cgcccggcguggugcagcc

SEQ ID NO: 2635916 - RNA, 22 nt, Escherichia coli CFT073
cgcccggcguggugcagccgcc

SEQ ID NO: 2635917 - RNA, 18 nt, Escherichia coli CFT073
cgcccgucaguucaucca

SEQ ID NO: 2635918 - RNA, 13 nt, Escherichia coli CFT073
cgcccgugcaucu

SEQ ID NO: 2635919 - RNA, 16 nt, Escherichia coli CFT073
cgcccguucuuccuca

SEQ ID NO: 2635920 - RNA, 18 nt, Escherichia coli CFT073
cgcccguuuucuccagcg

SEQ ID NO: 2635921 - RNA, 20 nt, Escherichia coli CFT073
cgcccucgauaugccagacu

SEQ ID NO: 2635922 - RNA, 20 nt, Escherichia coli CFT073
cgcccugaauuucaauaauu

SEQ ID NO: 2635923 - RNA, 19 nt, Escherichia coli CFT073
cgcccugauaaaucaccug

SEQ ID NO: 2635924 - RNA, 19 nt, Escherichia coli CFT073
cgcccugcaacaucaccgg

SEQ ID NO: 2635925 - RNA, 14 nt, Escherichia coli CFT073
cgcccugccgaucu

SEQ ID NO: 2635926 - RNA, 12 nt, Escherichia coli CFT073
cgcccugccuuu

SEQ ID NO: 2635927 - RNA, 15 nt, Escherichia coli CFT073
cgcccugcuccagca

SEQ ID NO: 2635928 - RNA, 18 nt, Escherichia coli CFT073
cgcccugggcuucaucca

SEQ ID NO: 2635929 - RNA, 23 nt, Escherichia coli CFT073
cgccguaguugcucccauaaugc

SEQ ID NO: 2635930 - RNA, 20 nt, Escherichia coli CFT073
cgccguauccgacguuacgc

SEQ ID NO: 2635931 - RNA, 18 nt, Escherichia coli CFT073
cgccgucaucacgcaggc

SEQ ID NO: 2635932 - RNA, 12 nt, Escherichia coli CFT073
cgccguccagga

SEQ ID NO: 2635933 - RNA, 15 nt, Escherichia coli CFT073
cgccguccaggaacc

SEQ ID NO: 2635934 - RNA, 13 nt, Escherichia coli CFT073
cgccgucgcgaag

SEQ ID NO: 2635935 - RNA, 24 nt, Escherichia coli CFT073
cgccguuaacacggugccaguacg

SEQ ID NO: 2635936 - RNA, 14 nt, Escherichia coli CFT073
cgccguucccagcg

SEQ ID NO: 2635937 - RNA, 16 nt, Escherichia coli CFT073
cgccguucccagcgga

SEQ ID NO: 2635938 - RNA, 21 nt, Escherichia coli CFT073
cgccguuuuuacccagcagca

SEQ ID NO: 2635939 - RNA, 16 nt, Escherichia coli CFT073
cgccuaaacugaucga

SEQ ID NO: 2635940 - RNA, 20 nt, Escherichia coli CFT073
cgccuaaauuuuuccacugg

SEQ ID NO: 2635941 - RNA, 14 nt, Escherichia coli CFT073
cgccuaccgccagu

SEQ ID NO: 2635942 - RNA, 17 nt, Escherichia coli CFT073
cgccuauaaacguuccc

SEQ ID NO: 2635943 - RNA, 18 nt, Escherichia coli CFT073
cgccuauacgcacgcggg

SEQ ID NO: 2635944 - RNA, 22 nt, Escherichia coli CFT073
cgccuauuauccggcaaccacc

SEQ ID NO: 2635945 - RNA, 20 nt, Escherichia coli CFT073
cgccucaacgccuaaugcca

SEQ ID NO: 2635946 - RNA, 19 nt, Escherichia coli CFT073
cgccucaccgccauuugca

SEQ ID NO: 2635947 - RNA, 13 nt, Escherichia coli CFT073
cgccucagccaga

SEQ ID NO: 2635948 - RNA, 19 nt, Escherichia coli CFT073
cgccucagccgaaacacac

SEQ ID NO: 2635949 - RNA, 18 nt, Escherichia coli CFT073
cgccucaucaucgcgcgu

SEQ ID NO: 2635950 - RNA, 20 nt, Escherichia coli CFT073
cgccucgcuuuuaugccugg

SEQ ID NO: 2635951 - RNA, 12 nt, Escherichia coli CFT073
cgccucuucaua

SEQ ID NO: 2635952 - RNA, 21 nt, Escherichia coli CFT073
cgccucuucauacaucugcaa

SEQ ID NO: 2635953 - RNA, 14 nt, Escherichia coli CFT073
cgccucuuccaggc

SEQ ID NO: 2635954 - RNA, 17 nt, Escherichia coli CFT073
cgccugaccauuaucaa

SEQ ID NO: 2635955 - RNA, 14 nt, Escherichia coli CFT073
cgccugacgcaaua

SEQ ID NO: 2635956 - RNA, 16 nt, Escherichia coli CFT073
cgccugagcagcgaua

SEQ ID NO: 2635957 - RNA, 17 nt, Escherichia coli CFT073
cgccugauagcccgcac

SEQ ID NO: 2635958 - RNA, 15 nt, Escherichia coli CFT073
cgccugaucgcgcag

SEQ ID NO: 2635959 - RNA, 20 nt, Escherichia coli CFT073
cgccugauucggccuacaaa

SEQ ID NO: 2635960 - RNA, 16 nt, Escherichia coli CFT073
cgccugcaaauaaaua

SEQ ID NO: 2635961 - RNA, 18 nt, Escherichia coli CFT073
cgccugcacaaagcgcca

SEQ ID NO: 2635962 - RNA, 21 nt, Escherichia coli CFT073
cgccugcacaaagcgccagaa

SEQ ID NO: 2635963 - RNA, 20 nt, Escherichia coli CFT073
cgccugcagaggccgccgca

SEQ ID NO: 2635964 - RNA, 16 nt, Escherichia coli CFT073
cgccugcagcugcaga

SEQ ID NO: 2635965 - RNA, 21 nt, Escherichia coli CFT073
cgccugcagucagccagcgca

SEQ ID NO: 2635966 - RNA, 19 nt, Escherichia coli CFT073
cgccugccagaugcagcgg

SEQ ID NO: 2635967 - RNA, 16 nt, Escherichia coli CFT073
cgccugccuucccuuc

SEQ ID NO: 2635968 - RNA, 17 nt, Escherichia coli CFT073
cgccugccuucccuucu

SEQ ID NO: 2635969 - RNA, 18 nt, Escherichia coli CFT073
cgccugcgccaccacaac

SEQ ID NO: 2635970 - RNA, 12 nt, Escherichia coli CFT073
cgccugcgccau

SEQ ID NO: 2635971 - RNA, 15 nt, Escherichia coli CFT073
cgccugcgcgauacu

SEQ ID NO: 2635972 - RNA, 16 nt, Escherichia coli CFT073
cgccugcgucuaucag

SEQ ID NO: 2635973 - RNA, 21 nt, Escherichia coli CFT073
cgccugcgugcaguuccugcu

SEQ ID NO: 2635974 - RNA, 23 nt, Escherichia coli CFT073
cgccugcuccucggugaucucaa

SEQ ID NO: 2635975 - RNA, 19 nt, Escherichia coli CFT073
cgccugcuggcuagccucc

SEQ ID NO: 2635976 - RNA, 15 nt, Escherichia coli CFT073
cgccugcuucuacgc

SEQ ID NO: 2635977 - RNA, 13 nt, Escherichia coli CFT073
cgccuggcagcau

SEQ ID NO: 2635978 - RNA, 17 nt, Escherichia coli CFT073
cgccugggggggaaacc

SEQ ID NO: 2635979 - RNA, 17 nt, Escherichia coli CFT073
cgccugucaccgccucc

SEQ ID NO: 2635980 - RNA, 19 nt, Escherichia coli CFT073
cgccugucaccgccuccac

SEQ ID NO: 2635981 - RNA, 12 nt, Escherichia coli CFT073
cgccugucugca

SEQ ID NO: 2635982 - RNA, 23 nt, Escherichia coli CFT073
cgccuguugauugcguucaaucu

SEQ ID NO: 2635983 - RNA, 22 nt, Escherichia coli CFT073
cgccuguugcgguuucucccgu

SEQ ID NO: 2635984 - RNA, 22 nt, Escherichia coli CFT073
cgccuguugugucggcugcgua

SEQ ID NO: 2635985 - RNA, 19 nt, Escherichia coli CFT073
cgccuuauccgaccuacaa

SEQ ID NO: 2635986 - RNA, 12 nt, Escherichia coli CFT073
cgccuuauccgg

SEQ ID NO: 2635987 - RNA, 15 nt, Escherichia coli CFT073
cgccuuauccggccu

SEQ ID NO: 2635988 - RNA, 19 nt, Escherichia coli CFT073
cgccuuauccggccuacaa

SEQ ID NO: 2635989 - RNA, 20 nt, Escherichia coli CFT073
cgccuuauccggccuaccgg

SEQ ID NO: 2635990 - RNA, 19 nt, Escherichia coli CFT073
cgccuuauccggccuacgg

SEQ ID NO: 2635991 - RNA, 18 nt, Escherichia coli CFT073
cgccuuauccggccugca

SEQ ID NO: 2635992 - RNA, 20 nt, Escherichia coli CFT073
cgccuuauccggccugcaaa

SEQ ID NO: 2635993 - RNA, 23 nt, Escherichia coli CFT073
cgccuucagguuuuucagcugcc

SEQ ID NO: 2635994 - RNA, 14 nt, Escherichia coli CFT073
cgccuuccagcagc

SEQ ID NO: 2635995 - RNA, 15 nt, Escherichia coli CFT073
cgccuuccagcagcu

SEQ ID NO: 2635996 - RNA, 19 nt, Escherichia coli CFT073
cgccuucccuuucagcaaa

SEQ ID NO: 2635997 - RNA, 17 nt, Escherichia coli CFT073
cgccuuccgucagcaaa

SEQ ID NO: 2635998 - RNA, 16 nt, Escherichia coli CFT073
cgccuucguucagcca

SEQ ID NO: 2635999 - RNA, 15 nt, Escherichia coli CFT073
cgccuucuccggccu

SEQ ID NO: 2636000 - RNA, 13 nt, Escherichia coli CFT073
cgccuucuugaac

SEQ ID NO: 2636001 - RNA, 23 nt, Escherichia coli CFT073
cgccuuguaucacuggccucuuc

SEQ ID NO: 2636002 - RNA, 19 nt, Escherichia coli CFT073
cgccuuguucgcccugcag

SEQ ID NO: 2636003 - RNA, 15 nt, Escherichia coli CFT073
cgccuuucacgccgg

SEQ ID NO: 2636004 - RNA, 17 nt, Escherichia coli CFT073
cgccuuucagccccagc

SEQ ID NO: 2636005 - RNA, 13 nt, Escherichia coli CFT073
cgccuuugaugcc

SEQ ID NO: 2636006 - RNA, 14 nt, Escherichia coli CFT073
cgccuuugaugcca

SEQ ID NO: 2636007 - RNA, 15 nt, Escherichia coli CFT073
cgccuuuuaaugcgc

SEQ ID NO: 2636008 - RNA, 19 nt, Escherichia coli CFT073
cgccuuuuuaagcgcguug

SEQ ID NO: 2636009 - RNA, 21 nt, Escherichia coli CFT073
cgccuuuuugcgcgaagaaac

SEQ ID NO: 2636010 - RNA, 17 nt, Escherichia coli CFT073
cgcgaaaacaucguuga

SEQ ID NO: 2636011 - RNA, 20 nt, Escherichia coli CFT073
cgcgaaaacccucgaccauc

SEQ ID NO: 2636012 - RNA, 17 nt, Escherichia coli CFT073
cgcgaaaaugccccagc

SEQ ID NO: 2636013 - RNA, 13 nt, Escherichia coli CFT073
cgcgaaacugcgu

SEQ ID NO: 2636014 - RNA, 19 nt, Escherichia coli CFT073
cgcgaaagauaagguguca

SEQ ID NO: 2636015 - RNA, 19 nt, Escherichia coli CFT073
cgcgaaaguuaccgcgcca

SEQ ID NO: 2636016 - RNA, 19 nt, Escherichia coli CFT073
cgcgaaauaaucaaaugaa

SEQ ID NO: 2636017 - RNA, 16 nt, Escherichia coli CFT073
cgcgaacagccgcggu

SEQ ID NO: 2636018 - RNA, 15 nt, Escherichia coli CFT073
cgcgaaccagaccag

SEQ ID NO: 2636019 - RNA, 16 nt, Escherichia coli CFT073
cgcgaaccagagacag

SEQ ID NO: 2636020 - RNA, 14 nt, Escherichia coli CFT073
cgcgaaccaucacc

SEQ ID NO: 2636021 - RNA, 21 nt, Escherichia coli CFT073
cgcgaaccgccuggcgcugcu

SEQ ID NO: 2636022 - RNA, 19 nt, Escherichia coli CFT073
cgcgaacggggcugccagc

SEQ ID NO: 2636023 - RNA, 17 nt, Escherichia coli CFT073
cgcgaacuaaacaacgc

SEQ ID NO: 2636024 - RNA, 19 nt, Escherichia coli CFT073
cgcgaacuaaacaacgccg

SEQ ID NO: 2636025 - RNA, 21 nt, Escherichia coli CFT073
cgcgaacuaaacaacgccgcc

SEQ ID NO: 2636026 - RNA, 22 nt, Escherichia coli CFT073
cgcgaacuaaacaacgccgcca

SEQ ID NO: 2636027 - RNA, 13 nt, Escherichia coli CFT073
cgcgaagaaacga

SEQ ID NO: 2636028 - RNA, 23 nt, Escherichia coli CFT073
cgcgaagagccucgucggcgguu

SEQ ID NO: 2636029 - RNA, 13 nt, Escherichia coli CFT073
cgcgaagcacaca

SEQ ID NO: 2636030 - RNA, 14 nt, Escherichia coli CFT073
cgcgaagcacacau

SEQ ID NO: 2636031 - RNA, 14 nt, Escherichia coli CFT073
cgcgaagccugcgg

SEQ ID NO: 2636032 - RNA, 12 nt, Escherichia coli CFT073
cgcgaagcuggu

SEQ ID NO: 2636033 - RNA, 21 nt, Escherichia coli CFT073
cgcgaaucgccguuccggcgg

SEQ ID NO: 2636034 - RNA, 15 nt, Escherichia coli CFT073
cgcgaaucuucauag

SEQ ID NO: 2636035 - RNA, 23 nt, Escherichia coli CFT073
cgcgaaugggugaacccggcgau

SEQ ID NO: 2636036 - RNA, 21 nt, Escherichia coli CFT073
cgcgaaugguaaucagcgacu

SEQ ID NO: 2636037 - RNA, 13 nt, Escherichia coli CFT073
cgcgcuggcgcag

SEQ ID NO: 2636038 - RNA, 15 nt, Escherichia coli CFT073
cgcgcuguuccaggu

SEQ ID NO: 2636039 - RNA, 17 nt, Escherichia coli CFT073
cgcgcuuaucgccagcg

SEQ ID NO: 2636040 - RNA, 22 nt, Escherichia coli CFT073
cgcgcuucgguguuaaaacgca

SEQ ID NO: 2636041 - RNA, 22 nt, Escherichia coli CFT073
cgcgcuucguuuuccgccacau

SEQ ID NO: 2636042 - RNA, 20 nt, Escherichia coli CFT073
cgcgcuugcggaagcaaccg

SEQ ID NO: 2636043 - RNA, 18 nt, Escherichia coli CFT073
cgcgcuuucuggcgcaga

SEQ ID NO: 2636044 - RNA, 18 nt, Escherichia coli CFT073
cgcgcuuucuucgcagca

SEQ ID NO: 2636045 - RNA, 12 nt, Escherichia coli CFT073
cgcgcuuuuucg

SEQ ID NO: 2636046 - RNA, 17 nt, Escherichia coli CFT073
cgcgcuuuuuuuaugcc

SEQ ID NO: 2636047 - RNA, 21 nt, Escherichia coli CFT073
cgcgcuuuuuuuaugcccugg

SEQ ID NO: 2636048 - RNA, 22 nt, Escherichia coli CFT073
cgcggaaauucacuuccgucau

SEQ ID NO: 2636049 - RNA, 18 nt, Escherichia coli CFT073
cgcggaauuggccgcgca

SEQ ID NO: 2636050 - RNA, 17 nt, Escherichia coli CFT073
cgcggacaauaauaucu

SEQ ID NO: 2636051 - RNA, 20 nt, Escherichia coli CFT073
cgcggacaauaauaucuuuc

SEQ ID NO: 2636052 - RNA, 18 nt, Escherichia coli CFT073
cgcggauaaaacugccag

SEQ ID NO: 2636053 - RNA, 20 nt, Escherichia coli CFT073
cgcggauagccauccccgcc

SEQ ID NO: 2636054 - RNA, 22 nt, Escherichia coli CFT073
cgcggaucgccaaucugguugc

SEQ ID NO: 2636055 - RNA, 15 nt, Escherichia coli CFT073
cgcggauggccucug

SEQ ID NO: 2636056 - RNA, 17 nt, Escherichia coli CFT073
cgcggauuucggcggcu

SEQ ID NO: 2636057 - RNA, 20 nt, Escherichia coli CFT073
cgcggcaaaacccugcgcca

SEQ ID NO: 2636058 - RNA, 22 nt, Escherichia coli CFT073
cgcggcaaaacccugcgccagc

SEQ ID NO: 2636059 - RNA, 17 nt, Escherichia coli CFT073
cgcggcaaacugcauga

SEQ ID NO: 2636060 - RNA, 22 nt, Escherichia coli CFT073
cgcggcaauggucccuugcugg

SEQ ID NO: 2636061 - RNA, 14 nt, Escherichia coli CFT073
cgcggcacaccagc

SEQ ID NO: 2636062 - RNA, 16 nt, Escherichia coli CFT073
cgcggcauaacagaau

SEQ ID NO: 2636063 - RNA, 20 nt, Escherichia coli CFT073
cgcggcauaacagaaugcgc

SEQ ID NO: 2636064 - RNA, 16 nt, Escherichia coli CFT073
cgcggcgagagccuuc

SEQ ID NO: 2636065 - RNA, 22 nt, Escherichia coli CFT073
cgcggcgauaauacccagcaac

SEQ ID NO: 2636066 - RNA, 18 nt, Escherichia coli CFT073
cgcggcgauauccagcgc

SEQ ID NO: 2636067 - RNA, 20 nt, Escherichia coli CFT073
cgcggcguuaccggcaaugu

SEQ ID NO: 2636068 - RNA, 20 nt, Escherichia coli CFT073
cgcggcuaacacuuucgccu

SEQ ID NO: 2636069 - RNA, 17 nt, Escherichia coli CFT073
cgcggcuaacuccugau

SEQ ID NO: 2636070 - RNA, 20 nt, Escherichia coli CFT073
cgcggcucaggcgcacgcca

SEQ ID NO: 2636071 - RNA, 13 nt, Escherichia coli CFT073
cgcggcuccagaa

SEQ ID NO: 2636072 - RNA, 22 nt, Escherichia coli CFT073
cgcggcuccagaauauugccga

SEQ ID NO: 2636073 - RNA, 23 nt, Escherichia coli CFT073
cgcggcuucaacuuuccgcacuu

SEQ ID NO: 2636074 - RNA, 16 nt, Escherichia coli CFT073
cgcgggaaaaaguacu

SEQ ID NO: 2636075 - RNA, 21 nt, Escherichia coli CFT073
cgcgggagaucccuaauucuu

SEQ ID NO: 2636076 - RNA, 18 nt, Escherichia coli CFT073
cgcgggauaaucgcgccg

SEQ ID NO: 2636077 - RNA, 16 nt, Escherichia coli CFT073
cgcgggcaaucgccag

SEQ ID NO: 2636078 - RNA, 20 nt, Escherichia coli CFT073
cgcgggcaaucgccagacuc

SEQ ID NO: 2636079 - RNA, 23 nt, Escherichia coli CFT073
cgcggguaaaaccauuuugcugg

SEQ ID NO: 2636080 - RNA, 16 nt, Escherichia coli CFT073
cgcggguugccacguu

SEQ ID NO: 2636081 - RNA, 16 nt, Escherichia coli CFT073
cgcgguaaaagcccau

SEQ ID NO: 2636082 - RNA, 18 nt, Escherichia coli CFT073
cgcgguaaaagcccauca

SEQ ID NO: 2636083 - RNA, 17 nt, Escherichia coli CFT073
cgcgguaaagcgcggca

SEQ ID NO: 2636084 - RNA, 23 nt, Escherichia coli CFT073
cgcgguaagaguaaagcccgcca

SEQ ID NO: 2636085 - RNA, 20 nt, Escherichia coli CFT073
cgcgguacguuuuccagguu

SEQ ID NO: 2636086 - RNA, 21 nt, Escherichia coli CFT073
cgcgguaucgccgucaccacc

SEQ ID NO: 2636087 - RNA, 14 nt, Escherichia coli CFT073
cgcggugcgccgua

SEQ ID NO: 2636088 - RNA, 21 nt, Escherichia coli CFT073
cgcggugguguagaacaccuc

SEQ ID NO: 2636089 - RNA, 15 nt, Escherichia coli CFT073
cgcgguuacgcaccg

SEQ ID NO: 2636090 - RNA, 22 nt, Escherichia coli CFT073
cgcgguuauuuuggcacacacc

SEQ ID NO: 2636091 - RNA, 15 nt, Escherichia coli CFT073
cgcgguuuucuucca

SEQ ID NO: 2636092 - RNA, 20 nt, Escherichia coli CFT073
cgcgguuuucuuccagccac

SEQ ID NO: 2636093 - RNA, 21 nt, Escherichia coli CFT073
cgcguaaaauauugcugcuaa

SEQ ID NO: 2636094 - RNA, 19 nt, Escherichia coli CFT073
cgcguaaacgugcggcugu

SEQ ID NO: 2636095 - RNA, 22 nt, Escherichia coli CFT073
cgcguaaacgugcggcugugcg

SEQ ID NO: 2636096 - RNA, 21 nt, Escherichia coli CFT073
cgcguaaauccagcaccgcuu

SEQ ID NO: 2636097 - RNA, 12 nt, Escherichia coli CFT073
cgcguaacgcca

SEQ ID NO: 2636098 - RNA, 14 nt, Escherichia coli CFT073
cgcguaacgccaga

SEQ ID NO: 2636099 - RNA, 15 nt, Escherichia coli CFT073
cgcguaacgccagaa

SEQ ID NO: 2636100 - RNA, 15 nt, Escherichia coli CFT073
cgcguaacuuuugcc

SEQ ID NO: 2636101 - RNA, 16 nt, Escherichia coli CFT073
cgcguaauauccagcg

SEQ ID NO: 2636102 - RNA, 20 nt, Escherichia coli CFT073
cgcguaauguuuccagcauc

SEQ ID NO: 2636103 - RNA, 20 nt, Escherichia coli CFT073
cgcguacauugcugacaugg

SEQ ID NO: 2636104 - RNA, 16 nt, Escherichia coli CFT073
cgcguacgccgcucga

SEQ ID NO: 2636105 - RNA, 15 nt, Escherichia coli CFT073
cgcguagccaggcgg

SEQ ID NO: 2636106 - RNA, 17 nt, Escherichia coli CFT073
cgcguagccaggcggca

SEQ ID NO: 2636107 - RNA, 23 nt, Escherichia coli CFT073
cgcguaguucaggauaauuaucu

SEQ ID NO: 2636108 - RNA, 18 nt, Escherichia coli CFT073
cgcgucaucggcgcggua

SEQ ID NO: 2636109 - RNA, 20 nt, Escherichia coli CFT073
cgcgucaucggcgcgguagc

SEQ ID NO: 2636110 - RNA, 19 nt, Escherichia coli CFT073
cgcgucggcgucagcgcca

SEQ ID NO: 2636111 - RNA, 22 nt, Escherichia coli CFT073
cgcgucuuaucuggccuacagg

SEQ ID NO: 2636112 - RNA, 23 nt, Escherichia coli CFT073
cgcgugaaaugccaaauauuucu

SEQ ID NO: 2636113 - RNA, 13 nt, Escherichia coli CFT073
cgcgugacaccau

SEQ ID NO: 2636114 - RNA, 17 nt, Escherichia coli CFT073
cgcgugaguggcgcgcg

SEQ ID NO: 2636115 - RNA, 15 nt, Escherichia coli CFT073
cgcgugaucccuaac

SEQ ID NO: 2636116 - RNA, 14 nt, Escherichia coli CFT073
cgcgugccucuucu

SEQ ID NO: 2636117 - RNA, 19 nt, Escherichia coli CFT073
cgcgugcgccaccgcuucc

SEQ ID NO: 2636118 - RNA, 14 nt, Escherichia coli CFT073
cgcgugcugcgauu

SEQ ID NO: 2636119 - RNA, 11 nt, Escherichia coli CFT073
cgcguggaaca

SEQ ID NO: 2636120 - RNA, 20 nt, Escherichia coli CFT073
cgcguguugcgccaaucgcc

SEQ ID NO: 2636121 - RNA, 16 nt, Escherichia coli CFT073
cgcguuaaauccugcc

SEQ ID NO: 2636122 - RNA, 21 nt, Escherichia coli CFT073
cgcguuaaauccugccaacgc

SEQ ID NO: 2636123 - RNA, 11 nt, Escherichia coli CFT073
cgcguuaagcc

SEQ ID NO: 2636124 - RNA, 16 nt, Escherichia coli CFT073
cgcguuaagcccaguu

SEQ ID NO: 2636125 - RNA, 15 nt, Escherichia coli CFT073
cgcguuacggaucag

SEQ ID NO: 2636126 - RNA, 19 nt, Escherichia coli CFT073
cgcguuauuuguugccgga

SEQ ID NO: 2636127 - RNA, 14 nt, Escherichia coli CFT073
cgcguuauuuuuga

SEQ ID NO: 2636128 - RNA, 15 nt, Escherichia coli CFT073
cgcguuccaggccgu

SEQ ID NO: 2636129 - RNA, 12 nt, Escherichia coli CFT073
cgcguuccugac

SEQ ID NO: 2636130 - RNA, 19 nt, Escherichia coli CFT073
cgcguuccugacgaucaag

SEQ ID NO: 2636131 - RNA, 19 nt, Escherichia coli CFT073
cgcguucgauagcgcgcca

SEQ ID NO: 2636132 - RNA, 21 nt, Escherichia coli CFT073
cgcguucgauagcgcgccagc

SEQ ID NO: 2636133 - RNA, 18 nt, Escherichia coli CFT073
cgcguucggaccaaugcc

SEQ ID NO: 2636134 - RNA, 14 nt, Escherichia coli CFT073
cgcguucggcggau

SEQ ID NO: 2636135 - RNA, 21 nt, Escherichia coli CFT073
cgcguugcauaaagcucagau

SEQ ID NO: 2636136 - RNA, 14 nt, Escherichia coli CFT073
cgcguugcggguac

SEQ ID NO: 2636137 - RNA, 22 nt, Escherichia coli CFT073
cgcguuuaaccaccuccacgcc

SEQ ID NO: 2636138 - RNA, 18 nt, Escherichia coli CFT073
cgcguuuagcaguucauc

SEQ ID NO: 2636139 - RNA, 15 nt, Escherichia coli CFT073
cgcguuucugcgcuu

SEQ ID NO: 2636140 - RNA, 20 nt, Escherichia coli CFT073
cgcguuuuaucaggccuccg

SEQ ID NO: 2636141 - RNA, 18 nt, Escherichia coli CFT073
cgcuaaaaagcgccguuu

SEQ ID NO: 2636142 - RNA, 14 nt, Escherichia coli CFT073
cgcuaaaauuucuu

SEQ ID NO: 2636143 - RNA, 11 nt, Escherichia coli CFT073
cgcuaaauaaa

SEQ ID NO: 2636144 - RNA, 13 nt, Escherichia coli CFT073
cgcuaacagcagc

SEQ ID NO: 2636145 - RNA, 21 nt, Escherichia coli CFT073
cgcuggaugcgaugcuggcgc

SEQ ID NO: 2636146 - RNA, 14 nt, Escherichia coli CFT073
cgcuggcagcagaa

SEQ ID NO: 2636147 - RNA, 14 nt, Escherichia coli CFT073
cgcuggcagccaua

SEQ ID NO: 2636148 - RNA, 22 nt, Escherichia coli CFT073
cgcuggccaugauuaccagcau

SEQ ID NO: 2636149 - RNA, 21 nt, Escherichia coli CFT073
cgcuggccuccagcacuuccu

SEQ ID NO: 2636150 - RNA, 13 nt, Escherichia coli CFT073
cgcuggcgcagca

SEQ ID NO: 2636151 - RNA, 13 nt, Escherichia coli CFT073
cgcuggcgcgaau

SEQ ID NO: 2636152 - RNA, 12 nt, Escherichia coli CFT073
cgcuggcggcug

SEQ ID NO: 2636153 - RNA, 22 nt, Escherichia coli CFT073
cgcuggcgguuugccauuuucu

SEQ ID NO: 2636154 - RNA, 18 nt, Escherichia coli CFT073
cgcuggcguuguccgcca

SEQ ID NO: 2636155 - RNA, 20 nt, Escherichia coli CFT073
cgcuggcguuguccgccaga

SEQ ID NO: 2636156 - RNA, 17 nt, Escherichia coli CFT073
cgcuggcucaccacagc

SEQ ID NO: 2636157 - RNA, 14 nt, Escherichia coli CFT073
cgcugguacgcgca

SEQ ID NO: 2636158 - RNA, 16 nt, Escherichia coli CFT073
cgcugguggcaggcaa

SEQ ID NO: 2636159 - RNA, 18 nt, Escherichia coli CFT073
cgcugguucuccguucag

SEQ ID NO: 2636160 - RNA, 15 nt, Escherichia coli CFT073
cgcugguugcgucuu

SEQ ID NO: 2636161 - RNA, 24 nt, Escherichia coli CFT073
cgcuguaagccaagcgccgccuca

SEQ ID NO: 2636162 - RNA, 18 nt, Escherichia coli CFT073
cgcuguaagccgccgcca

SEQ ID NO: 2636163 - RNA, 17 nt, Escherichia coli CFT073
cgcuguaaugcuauaaa

SEQ ID NO: 2636164 - RNA, 17 nt, Escherichia coli CFT073
cgcuguaauuaccagcg

SEQ ID NO: 2636165 - RNA, 21 nt, Escherichia coli CFT073
cgcuguaauuucacaccauca

SEQ ID NO: 2636166 - RNA, 19 nt, Escherichia coli CFT073
cgcuguacucaccaacgca

SEQ ID NO: 2636167 - RNA, 17 nt, Escherichia coli CFT073
cgcugucauucauucag

SEQ ID NO: 2636168 - RNA, 20 nt, Escherichia coli CFT073
cgcugucgcgucuuaucaug

SEQ ID NO: 2636169 - RNA, 16 nt, Escherichia coli CFT073
cgcugucuuucaacag

SEQ ID NO: 2636170 - RNA, 19 nt, Escherichia coli CFT073
cgcugucuuuugaucaaau

SEQ ID NO: 2636171 - RNA, 15 nt, Escherichia coli CFT073
cgcugugacauccag

SEQ ID NO: 2636172 - RNA, 23 nt, Escherichia coli CFT073
cgcugugcugcugacguagcagc

SEQ ID NO: 2636173 - RNA, 19 nt, Escherichia coli CFT073
cgcuguggcagucacuucc

SEQ ID NO: 2636174 - RNA, 15 nt, Escherichia coli CFT073
cgcuguguaaaccca

SEQ ID NO: 2636175 - RNA, 23 nt, Escherichia coli CFT073
cgcuguuauugucggcagauacc

SEQ ID NO: 2636176 - RNA, 16 nt, Escherichia coli CFT073
cgcuguuccagguuuu

SEQ ID NO: 2636177 - RNA, 16 nt, Escherichia coli CFT073
cgcuguucugauuuug

SEQ ID NO: 2636178 - RNA, 16 nt, Escherichia coli CFT073
cgcuguugccagcagc

SEQ ID NO: 2636179 - RNA, 17 nt, Escherichia coli CFT073
cgcuguugcguaacuga

SEQ ID NO: 2636180 - RNA, 17 nt, Escherichia coli CFT073
cgcuguuuguucaucau

SEQ ID NO: 2636181 - RNA, 23 nt, Escherichia coli CFT073
cgcuguuuuucauugcguaacca

SEQ ID NO: 2636182 - RNA, 13 nt, Escherichia coli CFT073
cgcuuaacagaac

SEQ ID NO: 2636183 - RNA, 15 nt, Escherichia coli CFT073
cgcuuaacaguucca

SEQ ID NO: 2636184 - RNA, 15 nt, Escherichia coli CFT073
cgcuuaacgcgggcu

SEQ ID NO: 2636185 - RNA, 20 nt, Escherichia coli CFT073
cgcuuaacgcgggcuucuuc

SEQ ID NO: 2636186 - RNA, 13 nt, Escherichia coli CFT073
cgcuuaauaagaa

SEQ ID NO: 2636187 - RNA, 23 nt, Escherichia coli CFT073
cgcuuaaucaauugcaggaaggu

SEQ ID NO: 2636188 - RNA, 17 nt, Escherichia coli CFT073
cgcuuaccaugccaacg

SEQ ID NO: 2636189 - RNA, 19 nt, Escherichia coli CFT073
cgcuuacucuucguucuuc

SEQ ID NO: 2636190 - RNA, 19 nt, Escherichia coli CFT073
cgcuuagagcccaugcguu

SEQ ID NO: 2636191 - RNA, 23 nt, Escherichia coli CFT073
cgcuuagcaaagaacguaaucaa

SEQ ID NO: 2636192 - RNA, 14 nt, Escherichia coli CFT073
cgcuuaucgcccug

SEQ ID NO: 2636193 - RNA, 14 nt, Escherichia coli CFT073
cgcuucaaccaccu

SEQ ID NO: 2636194 - RNA, 21 nt, Escherichia coli CFT073
cgcuucaauacgcaucaccuc

SEQ ID NO: 2636195 - RNA, 14 nt, Escherichia coli CFT073
cgcuucacugccgg

SEQ ID NO: 2636196 - RNA, 17 nt, Escherichia coli CFT073
cgcuucagcccgcgaua

SEQ ID NO: 2636197 - RNA, 14 nt, Escherichia coli CFT073
cgcuucagcguauc

SEQ ID NO: 2636198 - RNA, 16 nt, Escherichia coli CFT073
cgcuucauagccguug

SEQ ID NO: 2636199 - RNA, 15 nt, Escherichia coli CFT073
cgcuucauuuacauc

SEQ ID NO: 2636200 - RNA, 18 nt, Escherichia coli CFT073
cgcuucauuuacaucacg

SEQ ID NO: 2636201 - RNA, 23 nt, Escherichia coli CFT073
cgcuucauuugcggguucuggcg

SEQ ID NO: 2636202 - RNA, 11 nt, Escherichia coli CFT073
cgcuuccaguu

SEQ ID NO: 2636203 - RNA, 16 nt, Escherichia coli CFT073
cgcuuccauauuggcg

SEQ ID NO: 2636204 - RNA, 18 nt, Escherichia coli CFT073
cgcuucccaaagacgacg

SEQ ID NO: 2636205 - RNA, 19 nt, Escherichia coli CFT073
cgcuucccaacgcagcaac

SEQ ID NO: 2636206 - RNA, 15 nt, Escherichia coli CFT073
cgcuuccggcagcuu

SEQ ID NO: 2636207 - RNA, 16 nt, Escherichia coli CFT073
cgcuuccuccaccacu

SEQ ID NO: 2636208 - RNA, 17 nt, Escherichia coli CFT073
cgcuuccuccaccacuu

SEQ ID NO: 2636209 - RNA, 21 nt, Escherichia coli CFT073
cgcuucgauucccagcuuuua

SEQ ID NO: 2636210 - RNA, 17 nt, Escherichia coli CFT073
cgcuucgccaaucagaa

SEQ ID NO: 2636211 - RNA, 18 nt, Escherichia coli CFT073
cgcuucgugcuuaaucau

SEQ ID NO: 2636212 - RNA, 17 nt, Escherichia coli CFT073
cgcuucguugaucagcg

SEQ ID NO: 2636213 - RNA, 12 nt, Escherichia coli CFT073
cgcuucugccgg

SEQ ID NO: 2636214 - RNA, 14 nt, Escherichia coli CFT073
cgcuucuucagccu

SEQ ID NO: 2636215 - RNA, 22 nt, Escherichia coli CFT073
cgcuucuuccagcaucgccccc

SEQ ID NO: 2636216 - RNA, 16 nt, Escherichia coli CFT073
cgcuucuucuuccagg

SEQ ID NO: 2636217 - RNA, 16 nt, Escherichia coli CFT073
cgcuugaucuuccuga

SEQ ID NO: 2636218 - RNA, 22 nt, Escherichia coli CFT073
cgcuugcaggaucagcuccggc

SEQ ID NO: 2636219 - RNA, 17 nt, Escherichia coli CFT073
cgcuugcauccggcaug

SEQ ID NO: 2636220 - RNA, 22 nt, Escherichia coli CFT073
cgcuugcgauauggcugcgcuu

SEQ ID NO: 2636221 - RNA, 19 nt, Escherichia coli CFT073
cgcuugcgcggcagcuuca

SEQ ID NO: 2636222 - RNA, 16 nt, Escherichia coli CFT073
cgcuugcggccagcac

SEQ ID NO: 2636223 - RNA, 22 nt, Escherichia coli CFT073
cgcuugcggccagcacaucuca

SEQ ID NO: 2636224 - RNA, 17 nt, Escherichia coli CFT073
cgcuugcgggcuggcgg

SEQ ID NO: 2636225 - RNA, 22 nt, Escherichia coli CFT073
cgcuugcgggcuggcggggccg

SEQ ID NO: 2636226 - RNA, 16 nt, Escherichia coli CFT073
cgcuuuaacgcccuga

SEQ ID NO: 2636227 - RNA, 22 nt, Escherichia coli CFT073
cgcuuuaaucaccaucgcgcca

SEQ ID NO: 2636228 - RNA, 20 nt, Escherichia coli CFT073
cgcuuuacccugguuagcaa

SEQ ID NO: 2636229 - RNA, 14 nt, Escherichia coli CFT073
cgcuuuaccgcugc

SEQ ID NO: 2636230 - RNA, 19 nt, Escherichia coli CFT073
cgcuuuacucaacuccccg

SEQ ID NO: 2636231 - RNA, 22 nt, Escherichia coli CFT073
cgcuuuagaaucggugauaaau

SEQ ID NO: 2636232 - RNA, 20 nt, Escherichia coli CFT073
cgcuuuauagcauagcguug

SEQ ID NO: 2636233 - RNA, 14 nt, Escherichia coli CFT073
cgcuuuauccagca

SEQ ID NO: 2636234 - RNA, 16 nt, Escherichia coli CFT073
cgcuuuauccagcaua

SEQ ID NO: 2636235 - RNA, 22 nt, Escherichia coli CFT073
cgcuuuaucgcccaccagcgac

SEQ ID NO: 2636236 - RNA, 16 nt, Escherichia coli CFT073
cgcuuucagcacgaca

SEQ ID NO: 2636237 - RNA, 16 nt, Escherichia coli CFT073
cgcuuucucuucggcu

SEQ ID NO: 2636238 - RNA, 19 nt, Escherichia coli CFT073
cgcuuucuggcgcgcggcu

SEQ ID NO: 2636239 - RNA, 17 nt, Escherichia coli CFT073
cgcuuugaugcguucuu

SEQ ID NO: 2636240 - RNA, 13 nt, Escherichia coli CFT073
cgcuuugauggca

SEQ ID NO: 2636241 - RNA, 12 nt, Escherichia coli CFT073
cgcuuugcugcc

SEQ ID NO: 2636242 - RNA, 17 nt, Escherichia coli CFT073
cgcuuugcugccuuccu

SEQ ID NO: 2636243 - RNA, 15 nt, Escherichia coli CFT073
cgcuuugugcucuuc

SEQ ID NO: 2636244 - RNA, 19 nt, Escherichia coli CFT073
cgcuuuguucaugucagau

SEQ ID NO: 2636245 - RNA, 19 nt, Escherichia coli CFT073
cgcuuuuaauucacuucug

SEQ ID NO: 2636246 - RNA, 22 nt, Escherichia coli CFT073
cgcuuuugggaucgccaucaca

SEQ ID NO: 2636247 - RNA, 14 nt, Escherichia coli CFT073
cgcuuuuucugaaa

SEQ ID NO: 2636248 - RNA, 13 nt, Escherichia coli CFT073
cgcuuuuucuugc

SEQ ID NO: 2636249 - RNA, 20 nt, Escherichia coli CFT073
cgcuuuuuuacgccugcaau

SEQ ID NO: 2636250 - RNA, 17 nt, Escherichia coli CFT073
cgcuuuuuucagcgcca

SEQ ID NO: 2636251 - RNA, 18 nt, Escherichia coli CFT073
cgcuuuuuucagcgccag

SEQ ID NO: 2636252 - RNA, 21 nt, Escherichia coli CFT073
cgcuuuuuucagcgccagcuu

SEQ ID NO: 2636253 - RNA, 16 nt, Escherichia coli CFT073
cggagguuuuuuccuc

SEQ ID NO: 2636254 - RNA, 12 nt, Escherichia coli CFT073
cggaguaaagca

SEQ ID NO: 2636255 - RNA, 14 nt, Escherichia coli CFT073
cggagucagucccu

SEQ ID NO: 2636256 - RNA, 18 nt, Escherichia coli CFT073
cggaguugaccagcucca

SEQ ID NO: 2636257 - RNA, 22 nt, Escherichia coli CFT073
cggaguugaccagcuccagcag

SEQ ID NO: 2636258 - RNA, 19 nt, Escherichia coli CFT073
cggauaaacgucuucgcca

SEQ ID NO: 2636259 - RNA, 17 nt, Escherichia coli CFT073
cggauaaagcagggcag

SEQ ID NO: 2636260 - RNA, 18 nt, Escherichia coli CFT073
cggauaaaugacucacgu

SEQ ID NO: 2636261 - RNA, 16 nt, Escherichia coli CFT073
cggauaagacgcgcca

SEQ ID NO: 2636262 - RNA, 21 nt, Escherichia coli CFT073
cggauaagacgcgccagcguc

SEQ ID NO: 2636263 - RNA, 20 nt, Escherichia coli CFT073
cggauaagacgcgucagcgc

SEQ ID NO: 2636264 - RNA, 18 nt, Escherichia coli CFT073
cggauaagaugcgccagc

SEQ ID NO: 2636265 - RNA, 21 nt, Escherichia coli CFT073
cggauaagaugcgccagcauc

SEQ ID NO: 2636266 - RNA, 13 nt, Escherichia coli CFT073
cggauaaggcguu

SEQ ID NO: 2636267 - RNA, 14 nt, Escherichia coli CFT073
cggauaaggcguuc

SEQ ID NO: 2636268 - RNA, 14 nt, Escherichia coli CFT073
cggauaaggcguuu

SEQ ID NO: 2636269 - RNA, 16 nt, Escherichia coli CFT073
cggauaaggcguuuac

SEQ ID NO: 2636270 - RNA, 21 nt, Escherichia coli CFT073
cggauaaggcguuuaugccgc

SEQ ID NO: 2636271 - RNA, 17 nt, Escherichia coli CFT073
cggauaaggcuuccuac

SEQ ID NO: 2636272 - RNA, 20 nt, Escherichia coli CFT073
cggauaaggcuuuugcucgu

SEQ ID NO: 2636273 - RNA, 16 nt, Escherichia coli CFT073
cggauaauuccccggc

SEQ ID NO: 2636274 - RNA, 13 nt, Escherichia coli CFT073
cggauaccccagc

SEQ ID NO: 2636275 - RNA, 19 nt, Escherichia coli CFT073
cggauaccccagcuggcgc

SEQ ID NO: 2636276 - RNA, 13 nt, Escherichia coli CFT073
cggauacggucag

SEQ ID NO: 2636277 - RNA, 23 nt, Escherichia coli CFT073
cggauacggucaguuuucgcccc

SEQ ID NO: 2636278 - RNA, 22 nt, Escherichia coli CFT073
cggauacgguuuuuugaacaga

SEQ ID NO: 2636279 - RNA, 14 nt, Escherichia coli CFT073
cggauaugcagcag

SEQ ID NO: 2636280 - RNA, 22 nt, Escherichia coli CFT073
cggauauuuuccagcaacgcug

SEQ ID NO: 2636281 - RNA, 15 nt, Escherichia coli CFT073
cggaucaguuuaucc

SEQ ID NO: 2636282 - RNA, 23 nt, Escherichia coli CFT073
cggaucaugguagcgugauggcc

SEQ ID NO: 2636283 - RNA, 13 nt, Escherichia coli CFT073
cggauccacaccu

SEQ ID NO: 2636284 - RNA, 13 nt, Escherichia coli CFT073
cggauccagaacu

SEQ ID NO: 2636285 - RNA, 16 nt, Escherichia coli CFT073
cggaucgaagacauca

SEQ ID NO: 2636286 - RNA, 15 nt, Escherichia coli CFT073
cggaucgacagcaac

SEQ ID NO: 2636287 - RNA, 19 nt, Escherichia coli CFT073
cggaucgaccgguucgccu

SEQ ID NO: 2636288 - RNA, 17 nt, Escherichia coli CFT073
cggaucggaacgcgauu

SEQ ID NO: 2636289 - RNA, 15 nt, Escherichia coli CFT073
cggaucggcucaaca

SEQ ID NO: 2636290 - RNA, 22 nt, Escherichia coli CFT073
cggaucggcucaacaucgcgcu

SEQ ID NO: 2636291 - RNA, 19 nt, Escherichia coli CFT073
cggaugaaaagucauccgg

SEQ ID NO: 2636292 - RNA, 16 nt, Escherichia coli CFT073
cggaugacccagcgcc

SEQ ID NO: 2636293 - RNA, 19 nt, Escherichia coli CFT073
cggaugacguuucgcgcca

SEQ ID NO: 2636294 - RNA, 12 nt, Escherichia coli CFT073
cggaugacuucg

SEQ ID NO: 2636295 - RNA, 22 nt, Escherichia coli CFT073
cggaugagacgcggcacuccgc

SEQ ID NO: 2636296 - RNA, 17 nt, Escherichia coli CFT073
cggaugaguacagcgca

SEQ ID NO: 2636297 - RNA, 18 nt, Escherichia coli CFT073
cggaugaugccacaaacu

SEQ ID NO: 2636298 - RNA, 15 nt, Escherichia coli CFT073
cggaugauuaccgga

SEQ ID NO: 2636299 - RNA, 14 nt, Escherichia coli CFT073
cggaugauuccgca

SEQ ID NO: 2636300 - RNA, 18 nt, Escherichia coli CFT073
cggaugcccggucaauac

SEQ ID NO: 2636301 - RNA, 14 nt, Escherichia coli CFT073
cggaugccgcugcu

SEQ ID NO: 2636302 - RNA, 14 nt, Escherichia coli CFT073
cggaugcgaaguaa

SEQ ID NO: 2636303 - RNA, 19 nt, Escherichia coli CFT073
cggaugcgacgcaaacgcc

SEQ ID NO: 2636304 - RNA, 15 nt, Escherichia coli CFT073
cggaugcgaugcuga

SEQ ID NO: 2636305 - RNA, 18 nt, Escherichia coli CFT073
cggaugcgaugcugacac

SEQ ID NO: 2636306 - RNA, 15 nt, Escherichia coli CFT073
cggaugcgaugcugg

SEQ ID NO: 2636307 - RNA, 17 nt, Escherichia coli CFT073
cggaugcgaugcuggcg

SEQ ID NO: 2636308 - RNA, 21 nt, Escherichia coli CFT073
cggaugcggagaaagucguag

SEQ ID NO: 2636309 - RNA, 16 nt, Escherichia coli CFT073
cggaugcggggcgagc

SEQ ID NO: 2636310 - RNA, 20 nt, Escherichia coli CFT073
cggaugcggggcgagcgcca

SEQ ID NO: 2636311 - RNA, 20 nt, Escherichia coli CFT073
cggauggauccccgcagcaa

SEQ ID NO: 2636312 - RNA, 15 nt, Escherichia coli CFT073
cggauggcaacagca

SEQ ID NO: 2636313 - RNA, 18 nt, Escherichia coli CFT073
cggauggcaacagcagcc

SEQ ID NO: 2636314 - RNA, 19 nt, Escherichia coli CFT073
cggauggcaacagcagcca

SEQ ID NO: 2636315 - RNA, 21 nt, Escherichia coli CFT073
cggauggguaauaccauccgg

SEQ ID NO: 2636316 - RNA, 21 nt, Escherichia coli CFT073
cggauguuagucucuucuuug

SEQ ID NO: 2636317 - RNA, 21 nt, Escherichia coli CFT073
cggauuaauaaggaugcaaca

SEQ ID NO: 2636318 - RNA, 14 nt, Escherichia coli CFT073
cggauuauccagcc

SEQ ID NO: 2636319 - RNA, 21 nt, Escherichia coli CFT073
cggauuauccagccaggcguu

SEQ ID NO: 2636320 - RNA, 18 nt, Escherichia coli CFT073
cggauuauucacuacugg

SEQ ID NO: 2636321 - RNA, 19 nt, Escherichia coli CFT073
cggauucacgccaaccagc

SEQ ID NO: 2636322 - RNA, 13 nt, Escherichia coli CFT073
cggauucgaugcc

SEQ ID NO: 2636323 - RNA, 19 nt, Escherichia coli CFT073
cggauugaccaacaguugc

SEQ ID NO: 2636324 - RNA, 19 nt, Escherichia coli CFT073
cggauuucccgauaaccuu

SEQ ID NO: 2636325 - RNA, 13 nt, Escherichia coli CFT073
cggauuuuccugc

SEQ ID NO: 2636326 - RNA, 19 nt, Escherichia coli CFT073
cggauuuuucgcgcgggca

SEQ ID NO: 2636327 - RNA, 15 nt, Escherichia coli CFT073
cggcaaaaccaucaa

SEQ ID NO: 2636328 - RNA, 21 nt, Escherichia coli CFT073
cggcaaaaccaucaauccacu

SEQ ID NO: 2636329 - RNA, 18 nt, Escherichia coli CFT073
cggcaaaacccugcgcca

SEQ ID NO: 2636330 - RNA, 19 nt, Escherichia coli CFT073
cggcaaaacggugcaggcu

SEQ ID NO: 2636331 - RNA, 21 nt, Escherichia coli CFT073
cggcaaaacguuauuuugcua

SEQ ID NO: 2636332 - RNA, 22 nt, Escherichia coli CFT073
cggcaaaaucuuccagaaugcc

SEQ ID NO: 2636333 - RNA, 19 nt, Escherichia coli CFT073
cggcaaacaguugcugaua

SEQ ID NO: 2636334 - RNA, 14 nt, Escherichia coli CFT073
cggcaaacgcaacc

SEQ ID NO: 2636335 - RNA, 21 nt, Escherichia coli CFT073
cggcaaacgggucgagaacga

SEQ ID NO: 2636336 - RNA, 14 nt, Escherichia coli CFT073
cggcaaacugcuga

SEQ ID NO: 2636337 - RNA, 15 nt, Escherichia coli CFT073
cggcaaacugcugau

SEQ ID NO: 2636338 - RNA, 16 nt, Escherichia coli CFT073
cggcaaacuucgucaa

SEQ ID NO: 2636339 - RNA, 16 nt, Escherichia coli CFT073
cggcaaagcgcaucag

SEQ ID NO: 2636340 - RNA, 15 nt, Escherichia coli CFT073
cggcaaaggucugau

SEQ ID NO: 2636341 - RNA, 19 nt, Escherichia coli CFT073
cggcaacaaggcuacgcca

SEQ ID NO: 2636342 - RNA, 19 nt, Escherichia coli CFT073
cggcaacaauuuccgcagc

SEQ ID NO: 2636343 - RNA, 13 nt, Escherichia coli CFT073
cggcaaccacacc

SEQ ID NO: 2636344 - RNA, 19 nt, Escherichia coli CFT073
cggcaaccacacccacauc

SEQ ID NO: 2636345 - RNA, 14 nt, Escherichia coli CFT073
cggcaaccagcacc

SEQ ID NO: 2636346 - RNA, 16 nt, Escherichia coli CFT073
cggcaaccagcagcau

SEQ ID NO: 2636347 - RNA, 23 nt, Escherichia coli CFT073
cggcaaccgcaacgacuacgcca

SEQ ID NO: 2636348 - RNA, 19 nt, Escherichia coli CFT073
cggcaaccgcgccaagccu

SEQ ID NO: 2636349 - RNA, 20 nt, Escherichia coli CFT073
cggcaaccgcgccaagccug

SEQ ID NO: 2636350 - RNA, 22 nt, Escherichia coli CFT073
cggcaacgaccgcgagcaaaau

SEQ ID NO: 2636351 - RNA, 13 nt, Escherichia coli CFT073
cggcaacgccagc

SEQ ID NO: 2636352 - RNA, 20 nt, Escherichia coli CFT073
cggcaacguugccaguacca

SEQ ID NO: 2636353 - RNA, 16 nt, Escherichia coli CFT073
cggcaacuggaaauga

SEQ ID NO: 2636354 - RNA, 16 nt, Escherichia coli CFT073
cggcaagaucagcauc

SEQ ID NO: 2636355 - RNA, 13 nt, Escherichia coli CFT073
cggcaagcaaauu

SEQ ID NO: 2636356 - RNA, 17 nt, Escherichia coli CFT073
cggcaagccgacaauaa

SEQ ID NO: 2636357 - RNA, 19 nt, Escherichia coli CFT073
cggcaagcgucgcaucagg

SEQ ID NO: 2636358 - RNA, 14 nt, Escherichia coli CFT073
cggcaauaaacagc

SEQ ID NO: 2636359 - RNA, 18 nt, Escherichia coli CFT073
cggcaauacuuugcagau

SEQ ID NO: 2636360 - RNA, 21 nt, Escherichia coli CFT073
cggcaauacuuugcagaucgc

SEQ ID NO: 2636361 - RNA, 18 nt, Escherichia coli CFT073
cggcauuuugcugaugca

SEQ ID NO: 2636362 - RNA, 22 nt, Escherichia coli CFT073
cggcauuuuucggcgucagaac

SEQ ID NO: 2636363 - RNA, 23 nt, Escherichia coli CFT073
cggccaaaaccuuucaccucagu

SEQ ID NO: 2636364 - RNA, 14 nt, Escherichia coli CFT073
cggccaaagggagc

SEQ ID NO: 2636365 - RNA, 15 nt, Escherichia coli CFT073
cggccacagcgccag

SEQ ID NO: 2636366 - RNA, 18 nt, Escherichia coli CFT073
cggccagacaccggcuuu

SEQ ID NO: 2636367 - RNA, 12 nt, Escherichia coli CFT073
cggccagcagcu

SEQ ID NO: 2636368 - RNA, 22 nt, Escherichia coli CFT073
cggccagcauugcgccagcgag

SEQ ID NO: 2636369 - RNA, 19 nt, Escherichia coli CFT073
cggccaguauuugucugcc

SEQ ID NO: 2636370 - RNA, 14 nt, Escherichia coli CFT073
cggccaguccccuc

SEQ ID NO: 2636371 - RNA, 20 nt, Escherichia coli CFT073
cggccaguguuuaucaucuc

SEQ ID NO: 2636372 - RNA, 15 nt, Escherichia coli CFT073
cggccauauccagcc

SEQ ID NO: 2636373 - RNA, 21 nt, Escherichia coli CFT073
cggccauauccagccaacgcc

SEQ ID NO: 2636374 - RNA, 15 nt, Escherichia coli CFT073
cggccaucacggauc

SEQ ID NO: 2636375 - RNA, 16 nt, Escherichia coli CFT073
cggccaugggcgugau

SEQ ID NO: 2636376 - RNA, 15 nt, Escherichia coli CFT073
cggcccacaggucgu

SEQ ID NO: 2636377 - RNA, 18 nt, Escherichia coli CFT073
cggcccaugacaaacuca

SEQ ID NO: 2636378 - RNA, 22 nt, Escherichia coli CFT073
cggcccaugacaaacucaccug

SEQ ID NO: 2636379 - RNA, 18 nt, Escherichia coli CFT073
cggccccaucgaaccauc

SEQ ID NO: 2636380 - RNA, 15 nt, Escherichia coli CFT073
cggccccgcgccagc

SEQ ID NO: 2636381 - RNA, 19 nt, Escherichia coli CFT073
cggccccuggucgcgcggc

SEQ ID NO: 2636382 - RNA, 20 nt, Escherichia coli CFT073
cggcccguacugaacccggg

SEQ ID NO: 2636383 - RNA, 18 nt, Escherichia coli CFT073
cggcccuucgauauauuu

SEQ ID NO: 2636384 - RNA, 20 nt, Escherichia coli CFT073
cggccuaccaugaucugcaa

SEQ ID NO: 2636385 - RNA, 22 nt, Escherichia coli CFT073
cggccuaccgaacuucgccagc

SEQ ID NO: 2636386 - RNA, 20 nt, Escherichia coli CFT073
cggccuaccguuccgacacc

SEQ ID NO: 2636387 - RNA, 16 nt, Escherichia coli CFT073
cggccuggcucguuau

SEQ ID NO: 2636388 - RNA, 19 nt, Escherichia coli CFT073
cggcgaaaaucauuuaucu

SEQ ID NO: 2636389 - RNA, 15 nt, Escherichia coli CFT073
cggcgaaccagccgu

SEQ ID NO: 2636390 - RNA, 16 nt, Escherichia coli CFT073
cggcgaagagagcgcc

SEQ ID NO: 2636391 - RNA, 13 nt, Escherichia coli CFT073
cggcgacagcaaa

SEQ ID NO: 2636392 - RNA, 15 nt, Escherichia coli CFT073
cggcgacaggaacca

SEQ ID NO: 2636393 - RNA, 13 nt, Escherichia coli CFT073
cggcgaccagcgc

SEQ ID NO: 2636394 - RNA, 15 nt, Escherichia coli CFT073
cggcgaccaguucgc

SEQ ID NO: 2636395 - RNA, 20 nt, Escherichia coli CFT073
cggcgaccaguucgcuuuga

SEQ ID NO: 2636396 - RNA, 19 nt, Escherichia coli CFT073
cggcgaccguucgccaggu

SEQ ID NO: 2636397 - RNA, 22 nt, Escherichia coli CFT073
cggcgaccguucgccaggucag

SEQ ID NO: 2636398 - RNA, 13 nt, Escherichia coli CFT073
cggcgacgcgcgc

SEQ ID NO: 2636399 - RNA, 14 nt, Escherichia coli CFT073
cggcgacgcgcgcg

SEQ ID NO: 2636400 - RNA, 12 nt, Escherichia coli CFT073
cggcgacuuccu

SEQ ID NO: 2636401 - RNA, 19 nt, Escherichia coli CFT073
cggcgagagccuucggcaa

SEQ ID NO: 2636402 - RNA, 22 nt, Escherichia coli CFT073
cggcgagaucuucgccaucccg

SEQ ID NO: 2636403 - RNA, 20 nt, Escherichia coli CFT073
cggcgaguauucuugcugau

SEQ ID NO: 2636404 - RNA, 15 nt, Escherichia coli CFT073
cggcgauaauaccca

SEQ ID NO: 2636405 - RNA, 15 nt, Escherichia coli CFT073
cggcgaucugcaccu

SEQ ID NO: 2636406 - RNA, 18 nt, Escherichia coli CFT073
cggcgaucuuuuaauaau

SEQ ID NO: 2636407 - RNA, 20 nt, Escherichia coli CFT073
cggcgaugguuuucaucccg

SEQ ID NO: 2636408 - RNA, 17 nt, Escherichia coli CFT073
cggcgauguagcgcugu

SEQ ID NO: 2636409 - RNA, 19 nt, Escherichia coli CFT073
cggcgauuuucaucgcuua

SEQ ID NO: 2636410 - RNA, 15 nt, Escherichia coli CFT073
cggcgcaacauccgc

SEQ ID NO: 2636411 - RNA, 16 nt, Escherichia coli CFT073
cggcgcaaccaucagu

SEQ ID NO: 2636412 - RNA, 22 nt, Escherichia coli CFT073
cggcgcaaugauaucgcuggca

SEQ ID NO: 2636413 - RNA, 22 nt, Escherichia coli CFT073
cggcgcaccaaagcguuuugcc

SEQ ID NO: 2636414 - RNA, 14 nt, Escherichia coli CFT073
cggcgcaccagaau

SEQ ID NO: 2636415 - RNA, 13 nt, Escherichia coli CFT073
cggcgcagagccc

SEQ ID NO: 2636416 - RNA, 14 nt, Escherichia coli CFT073
cggcgcagcaauua

SEQ ID NO: 2636417 - RNA, 23 nt, Escherichia coli CFT073
cggcgcaggucgcgcauuaccuc

SEQ ID NO: 2636418 - RNA, 14 nt, Escherichia coli CFT073
cggcgcauccgcca

SEQ ID NO: 2636419 - RNA, 17 nt, Escherichia coli CFT073
cggcgcauccgccagca

SEQ ID NO: 2636420 - RNA, 13 nt, Escherichia coli CFT073
cggcgcauugccu

SEQ ID NO: 2636421 - RNA, 23 nt, Escherichia coli CFT073
cggcgccuuuuucaguuugcuga

SEQ ID NO: 2636422 - RNA, 15 nt, Escherichia coli CFT073
cggcgcgagcgccuu

SEQ ID NO: 2636423 - RNA, 16 nt, Escherichia coli CFT073
cggcgcgagcgccuua

SEQ ID NO: 2636424 - RNA, 21 nt, Escherichia coli CFT073
cggcgcggaaggugccauacg

SEQ ID NO: 2636425 - RNA, 21 nt, Escherichia coli CFT073
cggcgcggcggguuaaccagc

SEQ ID NO: 2636426 - RNA, 15 nt, Escherichia coli CFT073
cggcgcguaucgcga

SEQ ID NO: 2636427 - RNA, 17 nt, Escherichia coli CFT073
cggcgcucaucaggcca

SEQ ID NO: 2636428 - RNA, 13 nt, Escherichia coli CFT073
cggcgcugaccac

SEQ ID NO: 2636429 - RNA, 23 nt, Escherichia coli CFT073
cggcgcugcaauugaucgcgcaa

SEQ ID NO: 2636430 - RNA, 20 nt, Escherichia coli CFT073
cggcgcuuucagcacgacau

SEQ ID NO: 2636431 - RNA, 12 nt, Escherichia coli CFT073
cggcggaacgcc

SEQ ID NO: 2636432 - RNA, 19 nt, Escherichia coli CFT073
cggcggaauuaaccgccca

SEQ ID NO: 2636433 - RNA, 21 nt, Escherichia coli CFT073
cggcggaauuaaccgcccacc

SEQ ID NO: 2636434 - RNA, 18 nt, Escherichia coli CFT073
cggcggcgcaaccaucag

SEQ ID NO: 2636435 - RNA, 21 nt, Escherichia coli CFT073
cggcggcucuuuugcugacuu

SEQ ID NO: 2636436 - RNA, 18 nt, Escherichia coli CFT073
cggcggguuaaccagcac

SEQ ID NO: 2636437 - RNA, 16 nt, Escherichia coli CFT073
cggcgguaaaaucauc

SEQ ID NO: 2636438 - RNA, 15 nt, Escherichia coli CFT073
cggcggugucgccag

SEQ ID NO: 2636439 - RNA, 17 nt, Escherichia coli CFT073
cggcgguugacgccccu

SEQ ID NO: 2636440 - RNA, 18 nt, Escherichia coli CFT073
cggcguaugaccggcguu

SEQ ID NO: 2636441 - RNA, 15 nt, Escherichia coli CFT073
cggcgucagcgccau

SEQ ID NO: 2636442 - RNA, 17 nt, Escherichia coli CFT073
cggcgucgauugcucaa

SEQ ID NO: 2636443 - RNA, 19 nt, Escherichia coli CFT073
cggcgucuaaucgcuuuau

SEQ ID NO: 2636444 - RNA, 19 nt, Escherichia coli CFT073
cggcgucuuguugaacaga

SEQ ID NO: 2636445 - RNA, 22 nt, Escherichia coli CFT073
cggcgugaacgccuuauccggc

SEQ ID NO: 2636446 - RNA, 13 nt, Escherichia coli CFT073
cggcgugauaaaa

SEQ ID NO: 2636447 - RNA, 18 nt, Escherichia coli CFT073
cggcgugauauccauaaa

SEQ ID NO: 2636448 - RNA, 19 nt, Escherichia coli CFT073
cggcgugccaaauauucag

SEQ ID NO: 2636449 - RNA, 22 nt, Escherichia coli CFT073
cggcgugcuucgcgcguucaau

SEQ ID NO: 2636450 - RNA, 17 nt, Escherichia coli CFT073
cggcguguagcccauca

SEQ ID NO: 2636451 - RNA, 11 nt, Escherichia coli CFT073
cggcguucacc

SEQ ID NO: 2636452 - RNA, 16 nt, Escherichia coli CFT073
cggcguucaccagcgc

SEQ ID NO: 2636453 - RNA, 21 nt, Escherichia coli CFT073
cggcguugcccaucgccacgc

SEQ ID NO: 2636454 - RNA, 12 nt, Escherichia coli CFT073
cggcguugccga

SEQ ID NO: 2636455 - RNA, 23 nt, Escherichia coli CFT073
cggcguuucacauucuccgccga

SEQ ID NO: 2636456 - RNA, 17 nt, Escherichia coli CFT073
cggcguuucgccaucgu

SEQ ID NO: 2636457 - RNA, 16 nt, Escherichia coli CFT073
cggcguuugcuccugc

SEQ ID NO: 2636458 - RNA, 14 nt, Escherichia coli CFT073
cggcguuuucugac

SEQ ID NO: 2636459 - RNA, 18 nt, Escherichia coli CFT073
cggcguuuuguagagcag

SEQ ID NO: 2636460 - RNA, 22 nt, Escherichia coli CFT073
cggcguuuuguagagcagcacg

SEQ ID NO: 2636461 - RNA, 23 nt, Escherichia coli CFT073
cggcguuuuuucaucacugcgcu

SEQ ID NO: 2636462 - RNA, 15 nt, Escherichia coli CFT073
cggcuaacuccugau

SEQ ID NO: 2636463 - RNA, 22 nt, Escherichia coli CFT073
cggcuacugauguucgccagau

SEQ ID NO: 2636464 - RNA, 14 nt, Escherichia coli CFT073
cggcuauauugcag

SEQ ID NO: 2636465 - RNA, 16 nt, Escherichia coli CFT073
cggcucaacaucgcgc

SEQ ID NO: 2636466 - RNA, 17 nt, Escherichia coli CFT073
cggcucaaccccagcca

SEQ ID NO: 2636467 - RNA, 14 nt, Escherichia coli CFT073
cggcucaccugcac

SEQ ID NO: 2636468 - RNA, 22 nt, Escherichia coli CFT073
cggcuccagacgcccgcgccca

SEQ ID NO: 2636469 - RNA, 14 nt, Escherichia coli CFT073
cgggcgucagcgca

SEQ ID NO: 2636470 - RNA, 16 nt, Escherichia coli CFT073
cgggcgucgaaaauau

SEQ ID NO: 2636471 - RNA, 14 nt, Escherichia coli CFT073
cgggcuaaucguca

SEQ ID NO: 2636472 - RNA, 15 nt, Escherichia coli CFT073
cgggcuaaucgucau

SEQ ID NO: 2636473 - RNA, 15 nt, Escherichia coli CFT073
cgggcuacaacgcac

SEQ ID NO: 2636474 - RNA, 15 nt, Escherichia coli CFT073
cgggcugcccggaua

SEQ ID NO: 2636475 - RNA, 24 nt, Escherichia coli CFT073
cgggcuggcggggccgcgucgccc

SEQ ID NO: 2636476 - RNA, 20 nt, Escherichia coli CFT073
cgggcugggaucugauuuuc

SEQ ID NO: 2636477 - RNA, 21 nt, Escherichia coli CFT073
cgggcugggaucugauuuucu

SEQ ID NO: 2636478 - RNA, 20 nt, Escherichia coli CFT073
cgggcugguuuucagcgaaa

SEQ ID NO: 2636479 - RNA, 13 nt, Escherichia coli CFT073
cgggcuucucgcu

SEQ ID NO: 2636480 - RNA, 23 nt, Escherichia coli CFT073
cgggcuuuuuugaucaaaauucc

SEQ ID NO: 2636481 - RNA, 14 nt, Escherichia coli CFT073
cggggacugguuga

SEQ ID NO: 2636482 - RNA, 20 nt, Escherichia coli CFT073
cggggagaaugccagcagca

SEQ ID NO: 2636483 - RNA, 22 nt, Escherichia coli CFT073
cggggagaaugccagcagcacc

SEQ ID NO: 2636484 - RNA, 22 nt, Escherichia coli CFT073
cggggagauguaauaacgcuua

SEQ ID NO: 2636485 - RNA, 13 nt, Escherichia coli CFT073
cggggaucacucc

SEQ ID NO: 2636486 - RNA, 19 nt, Escherichia coli CFT073
cggggcauagcguaacuua

SEQ ID NO: 2636487 - RNA, 19 nt, Escherichia coli CFT073
cggggccagcacauagccg

SEQ ID NO: 2636488 - RNA, 15 nt, Escherichia coli CFT073
cggggccgaaacccc

SEQ ID NO: 2636489 - RNA, 13 nt, Escherichia coli CFT073
cggggcuuuucuc

SEQ ID NO: 2636490 - RNA, 14 nt, Escherichia coli CFT073
cgggggcgaccugu

SEQ ID NO: 2636491 - RNA, 23 nt, Escherichia coli CFT073
cgggggcgaccugugccgccgcc

SEQ ID NO: 2636492 - RNA, 22 nt, Escherichia coli CFT073
cgggggcggcaaucgcugcuaa

SEQ ID NO: 2636493 - RNA, 14 nt, Escherichia coli CFT073
cgggggguugccgc

SEQ ID NO: 2636494 - RNA, 15 nt, Escherichia coli CFT073
cggggguaaaaccgg

SEQ ID NO: 2636495 - RNA, 14 nt, Escherichia coli CFT073
cggggucgugcaga

SEQ ID NO: 2636496 - RNA, 12 nt, Escherichia coli CFT073
cgggguuuugcu

SEQ ID NO: 2636497 - RNA, 21 nt, Escherichia coli CFT073
cggguaaaaccauuuugcugg

SEQ ID NO: 2636498 - RNA, 15 nt, Escherichia coli CFT073
cggguaaagacuauc

SEQ ID NO: 2636499 - RNA, 15 nt, Escherichia coli CFT073
cggguaagcgccaca

SEQ ID NO: 2636500 - RNA, 15 nt, Escherichia coli CFT073
cggguaagggacgga

SEQ ID NO: 2636501 - RNA, 23 nt, Escherichia coli CFT073
cggguaaguacgccaucgcgcau

SEQ ID NO: 2636502 - RNA, 15 nt, Escherichia coli CFT073
cggguaaucaucgcc

SEQ ID NO: 2636503 - RNA, 17 nt, Escherichia coli CFT073
cggguagcgcggcagcg

SEQ ID NO: 2636504 - RNA, 21 nt, Escherichia coli CFT073
cggguauuuaaacuucacgcu

SEQ ID NO: 2636505 - RNA, 22 nt, Escherichia coli CFT073
cggguauuuaaacuucacgcuc

SEQ ID NO: 2636506 - RNA, 14 nt, Escherichia coli CFT073
cgggucacugcggu

SEQ ID NO: 2636507 - RNA, 14 nt, Escherichia coli CFT073
cgggucagcgccac

SEQ ID NO: 2636508 - RNA, 22 nt, Escherichia coli CFT073
cgggucauaaucagacugugau

SEQ ID NO: 2636509 - RNA, 18 nt, Escherichia coli CFT073
cgggucgcaaacaacgcc

SEQ ID NO: 2636510 - RNA, 21 nt, Escherichia coli CFT073
cgggucgcaaacaacgccaca

SEQ ID NO: 2636511 - RNA, 12 nt, Escherichia coli CFT073
cgggucggcaca

SEQ ID NO: 2636512 - RNA, 13 nt, Escherichia coli CFT073
cgggucggcggca

SEQ ID NO: 2636513 - RNA, 21 nt, Escherichia coli CFT073
cgggucuguaaaagccccuuc

SEQ ID NO: 2636514 - RNA, 14 nt, Escherichia coli CFT073
cgggugaacgcguu

SEQ ID NO: 2636515 - RNA, 20 nt, Escherichia coli CFT073
cgggugaagagauccaccag

SEQ ID NO: 2636516 - RNA, 20 nt, Escherichia coli CFT073
cgggugcgaugcauccggca

SEQ ID NO: 2636517 - RNA, 23 nt, Escherichia coli CFT073
cggguggaucauuuucaugcugu

SEQ ID NO: 2636518 - RNA, 12 nt, Escherichia coli CFT073
cggguggccagc

SEQ ID NO: 2636519 - RNA, 23 nt, Escherichia coli CFT073
cggguguacauaaccgaagaagc

SEQ ID NO: 2636520 - RNA, 20 nt, Escherichia coli CFT073
cgggugucccguaacggaaa

SEQ ID NO: 2636521 - RNA, 16 nt, Escherichia coli CFT073
cggguuaaccagcacc

SEQ ID NO: 2636522 - RNA, 20 nt, Escherichia coli CFT073
cggguuaaccagcaccagcu

SEQ ID NO: 2636523 - RNA, 16 nt, Escherichia coli CFT073
cggguucuggcgcagc

SEQ ID NO: 2636524 - RNA, 15 nt, Escherichia coli CFT073
cggguuggagcgcgu

SEQ ID NO: 2636525 - RNA, 15 nt, Escherichia coli CFT073
cggguuuacgcgcgc

SEQ ID NO: 2636526 - RNA, 18 nt, Escherichia coli CFT073
cggguuuacuuccccggc

SEQ ID NO: 2636527 - RNA, 14 nt, Escherichia coli CFT073
cggguuuucaauga

SEQ ID NO: 2636528 - RNA, 17 nt, Escherichia coli CFT073
cggguuuucuacuuuuu

SEQ ID NO: 2636529 - RNA, 14 nt, Escherichia coli CFT073
cggguuuucucgcu

SEQ ID NO: 2636530 - RNA, 22 nt, Escherichia coli CFT073
cggguuuugaauucuugcugac

SEQ ID NO: 2636531 - RNA, 16 nt, Escherichia coli CFT073
cgguaaaaucauccug

SEQ ID NO: 2636532 - RNA, 20 nt, Escherichia coli CFT073
cgguaaaaucauccugcugc

SEQ ID NO: 2636533 - RNA, 16 nt, Escherichia coli CFT073
cgguaaagcccucacc

SEQ ID NO: 2636534 - RNA, 17 nt, Escherichia coli CFT073
cgguaaaucgacccuga

SEQ ID NO: 2636535 - RNA, 22 nt, Escherichia coli CFT073
cgguaaaucgacccugaugaau

SEQ ID NO: 2636536 - RNA, 14 nt, Escherichia coli CFT073
cgguaaauugcccc

SEQ ID NO: 2636537 - RNA, 20 nt, Escherichia coli CFT073
cgguaacagaauacugccgu

SEQ ID NO: 2636538 - RNA, 14 nt, Escherichia coli CFT073
cgguaacaggaaac

SEQ ID NO: 2636539 - RNA, 16 nt, Escherichia coli CFT073
cgguaaccauccauau

SEQ ID NO: 2636540 - RNA, 14 nt, Escherichia coli CFT073
cgguaacuccggca

SEQ ID NO: 2636541 - RNA, 13 nt, Escherichia coli CFT073
cgguaacucugau

SEQ ID NO: 2636542 - RNA, 16 nt, Escherichia coli CFT073
cgguaacucugaugac

SEQ ID NO: 2636543 - RNA, 23 nt, Escherichia coli CFT073
cgguaagaguaaagcccgccauc

SEQ ID NO: 2636544 - RNA, 18 nt, Escherichia coli CFT073
cgguaaguuaccggcaau

SEQ ID NO: 2636545 - RNA, 14 nt, Escherichia coli CFT073
cgguaaucaccagc

SEQ ID NO: 2636546 - RNA, 22 nt, Escherichia coli CFT073
cgguaaucaggcaaacgcccuu

SEQ ID NO: 2636547 - RNA, 14 nt, Escherichia coli CFT073
cgguaaucgcccgg

SEQ ID NO: 2636548 - RNA, 18 nt, Escherichia coli CFT073
cgguaauuccagcgguug

SEQ ID NO: 2636549 - RNA, 16 nt, Escherichia coli CFT073
cgguaauuccggcguu

SEQ ID NO: 2636550 - RNA, 21 nt, Escherichia coli CFT073
cgguaauuugacgugauuggu

SEQ ID NO: 2636551 - RNA, 16 nt, Escherichia coli CFT073
cgguacaauaaaaguu

SEQ ID NO: 2636552 - RNA, 13 nt, Escherichia coli CFT073
cgguacacaaaaa

SEQ ID NO: 2636553 - RNA, 14 nt, Escherichia coli CFT073
cgguacacaaccgc

SEQ ID NO: 2636554 - RNA, 13 nt, Escherichia coli CFT073
cgguacacgcaga

SEQ ID NO: 2636555 - RNA, 13 nt, Escherichia coli CFT073
cgguacaggcauc

SEQ ID NO: 2636556 - RNA, 22 nt, Escherichia coli CFT073
cgguaccuaccgguggcgugaa

SEQ ID NO: 2636557 - RNA, 23 nt, Escherichia coli CFT073
cgguacggauagccgccccagac

SEQ ID NO: 2636558 - RNA, 20 nt, Escherichia coli CFT073
cgguacugaccaucagcagc

SEQ ID NO: 2636559 - RNA, 19 nt, Escherichia coli CFT073
cgguacuucucaccgguaa

SEQ ID NO: 2636560 - RNA, 23 nt, Escherichia coli CFT073
cgguagcaccaguuggucggcga

SEQ ID NO: 2636561 - RNA, 20 nt, Escherichia coli CFT073
cgguagccugcaauuuccgc

SEQ ID NO: 2636562 - RNA, 15 nt, Escherichia coli CFT073
cgguaggcugacggc

SEQ ID NO: 2636563 - RNA, 21 nt, Escherichia coli CFT073
cgguagucaggaagccccagc

SEQ ID NO: 2636564 - RNA, 16 nt, Escherichia coli CFT073
cgguaguuccaccagu

SEQ ID NO: 2636565 - RNA, 14 nt, Escherichia coli CFT073
cgguauaacuugcc

SEQ ID NO: 2636566 - RNA, 14 nt, Escherichia coli CFT073
cgguaucaccaccc

SEQ ID NO: 2636567 - RNA, 20 nt, Escherichia coli CFT073
cgguauccggcucauaucuu

SEQ ID NO: 2636568 - RNA, 15 nt, Escherichia coli CFT073
cgguaucucgcgcca

SEQ ID NO: 2636569 - RNA, 21 nt, Escherichia coli CFT073
cgguaucugccagcacugcca

SEQ ID NO: 2636570 - RNA, 16 nt, Escherichia coli CFT073
cgguaugacccagcgc

SEQ ID NO: 2636571 - RNA, 13 nt, Escherichia coli CFT073
cgguaugcgugcu

SEQ ID NO: 2636572 - RNA, 18 nt, Escherichia coli CFT073
cgguauggccuuucuggc

SEQ ID NO: 2636573 - RNA, 14 nt, Escherichia coli CFT073
cgguaugguaaagc

SEQ ID NO: 2636574 - RNA, 21 nt, Escherichia coli CFT073
cgguauguucagaaagcgcca

SEQ ID NO: 2636575 - RNA, 16 nt, Escherichia coli CFT073
cgguauuaacucggaa

SEQ ID NO: 2636576 - RNA, 21 nt, Escherichia coli CFT073
cgguauuaauuugccagcgua

SEQ ID NO: 2636577 - RNA, 15 nt, Escherichia coli CFT073
cgguugagauaacgu

SEQ ID NO: 2636578 - RNA, 13 nt, Escherichia coli CFT073
cgguugauaauga

SEQ ID NO: 2636579 - RNA, 18 nt, Escherichia coli CFT073
cgguugaucucaucuucc

SEQ ID NO: 2636580 - RNA, 15 nt, Escherichia coli CFT073
cgguugccagcgcca

SEQ ID NO: 2636581 - RNA, 17 nt, Escherichia coli CFT073
cgguugccagcgccagc

SEQ ID NO: 2636582 - RNA, 22 nt, Escherichia coli CFT073
cgguugccagcgccagcgcacc

SEQ ID NO: 2636583 - RNA, 12 nt, Escherichia coli CFT073
cgguugccauaa

SEQ ID NO: 2636584 - RNA, 14 nt, Escherichia coli CFT073
cgguugcggaaccc

SEQ ID NO: 2636585 - RNA, 21 nt, Escherichia coli CFT073
cgguugcggaacccagcgcga

SEQ ID NO: 2636586 - RNA, 15 nt, Escherichia coli CFT073
cgguugcugaacagc

SEQ ID NO: 2636587 - RNA, 16 nt, Escherichia coli CFT073
cgguuggccugauaag

SEQ ID NO: 2636588 - RNA, 18 nt, Escherichia coli CFT073
cgguuguaggccugauca

SEQ ID NO: 2636589 - RNA, 16 nt, Escherichia coli CFT073
cgguugugugcuggcc

SEQ ID NO: 2636590 - RNA, 20 nt, Escherichia coli CFT073
cgguugugugcuggccauca

SEQ ID NO: 2636591 - RNA, 13 nt, Escherichia coli CFT073
cgguuguuuuaau

SEQ ID NO: 2636592 - RNA, 13 nt, Escherichia coli CFT073
cgguuuaccauca

SEQ ID NO: 2636593 - RNA, 14 nt, Escherichia coli CFT073
cgguuuaccaucac

SEQ ID NO: 2636594 - RNA, 15 nt, Escherichia coli CFT073
cgguuuaccaucacu

SEQ ID NO: 2636595 - RNA, 14 nt, Escherichia coli CFT073
cgguuuacccugcu

SEQ ID NO: 2636596 - RNA, 17 nt, Escherichia coli CFT073
cgguuucaaaacuggug

SEQ ID NO: 2636597 - RNA, 20 nt, Escherichia coli CFT073
cgguuucaacauuuccagcg

SEQ ID NO: 2636598 - RNA, 12 nt, Escherichia coli CFT073
cgguuucaacca

SEQ ID NO: 2636599 - RNA, 17 nt, Escherichia coli CFT073
cgguuucaaccagcagg

SEQ ID NO: 2636600 - RNA, 14 nt, Escherichia coli CFT073
cgguuucagccagg

SEQ ID NO: 2636601 - RNA, 15 nt, Escherichia coli CFT073
cgguuucaucagcca

SEQ ID NO: 2636602 - RNA, 21 nt, Escherichia coli CFT073
cgguuuccacuuccaccacuu

SEQ ID NO: 2636603 - RNA, 22 nt, Escherichia coli CFT073
cgguuucccggcaaucgccaga

SEQ ID NO: 2636604 - RNA, 16 nt, Escherichia coli CFT073
cgguuucucuucugcu

SEQ ID NO: 2636605 - RNA, 13 nt, Escherichia coli CFT073
cgguuucuuuauc

SEQ ID NO: 2636606 - RNA, 18 nt, Escherichia coli CFT073
cgguuugagagucaucca

SEQ ID NO: 2636607 - RNA, 20 nt, Escherichia coli CFT073
cgguuugaguucaccgccau

SEQ ID NO: 2636608 - RNA, 17 nt, Escherichia coli CFT073
cgguuugcgccgugcga

SEQ ID NO: 2636609 - RNA, 17 nt, Escherichia coli CFT073
cgguuuucaccuccggc

SEQ ID NO: 2636610 - RNA, 14 nt, Escherichia coli CFT073
cgguuuucaucauc

SEQ ID NO: 2636611 - RNA, 16 nt, Escherichia coli CFT073
cgguuuucugccuggu

SEQ ID NO: 2636612 - RNA, 16 nt, Escherichia coli CFT073
cgguuuucuuccagcc

SEQ ID NO: 2636613 - RNA, 13 nt, Escherichia coli CFT073
cgguuuugccagc

SEQ ID NO: 2636614 - RNA, 19 nt, Escherichia coli CFT073
cgguuuugucggcaugaua

SEQ ID NO: 2636615 - RNA, 19 nt, Escherichia coli CFT073
cgguuuuguugccgcccgu

SEQ ID NO: 2636616 - RNA, 22 nt, Escherichia coli CFT073
cgguuuuucugucaguuggcug

SEQ ID NO: 2636617 - RNA, 13 nt, Escherichia coli CFT073
cgguuuuuuucga

SEQ ID NO: 2636618 - RNA, 18 nt, Escherichia coli CFT073
cguaaaaacccgcuucgg

SEQ ID NO: 2636619 - RNA, 12 nt, Escherichia coli CFT073
cguaaaaccugc

SEQ ID NO: 2636620 - RNA, 16 nt, Escherichia coli CFT073
cguaaaacucacaacc

SEQ ID NO: 2636621 - RNA, 18 nt, Escherichia coli CFT073
cguaaaccacugacacag

SEQ ID NO: 2636622 - RNA, 15 nt, Escherichia coli CFT073
cguaaacgaucaucg

SEQ ID NO: 2636623 - RNA, 18 nt, Escherichia coli CFT073
cguaaacuuuagcacaau

SEQ ID NO: 2636624 - RNA, 18 nt, Escherichia coli CFT073
cguaaagcaucagacugc

SEQ ID NO: 2636625 - RNA, 19 nt, Escherichia coli CFT073
cguaaagucaaaauucaac

SEQ ID NO: 2636626 - RNA, 23 nt, Escherichia coli CFT073
cguaaaguggcggggucgugcag

SEQ ID NO: 2636627 - RNA, 14 nt, Escherichia coli CFT073
cguaaauaaugacc

SEQ ID NO: 2636628 - RNA, 14 nt, Escherichia coli CFT073
cguaaauguggcgg

SEQ ID NO: 2636629 - RNA, 17 nt, Escherichia coli CFT073
cguaaauuccccacccc

SEQ ID NO: 2636630 - RNA, 15 nt, Escherichia coli CFT073
cguaaauucucccgc

SEQ ID NO: 2636631 - RNA, 12 nt, Escherichia coli CFT073
cguaacaggaaa

SEQ ID NO: 2636632 - RNA, 11 nt, Escherichia coli CFT073
cguaacauauu

SEQ ID NO: 2636633 - RNA, 19 nt, Escherichia coli CFT073
cguaaccaccagcacugau

SEQ ID NO: 2636634 - RNA, 16 nt, Escherichia coli CFT073
cguaaccagcgcagac

SEQ ID NO: 2636635 - RNA, 22 nt, Escherichia coli CFT073
cguaaccugagaucugaucuuu

SEQ ID NO: 2636636 - RNA, 20 nt, Escherichia coli CFT073
cguaaccuugauccugcagu

SEQ ID NO: 2636637 - RNA, 12 nt, Escherichia coli CFT073
cguaacgacggc

SEQ ID NO: 2636638 - RNA, 17 nt, Escherichia coli CFT073
cguaacgccagaaagac

SEQ ID NO: 2636639 - RNA, 23 nt, Escherichia coli CFT073
cguaacgccgcgauagagagcag

SEQ ID NO: 2636640 - RNA, 21 nt, Escherichia coli CFT073
cguaacgcucaagaacggcaa

SEQ ID NO: 2636641 - RNA, 16 nt, Escherichia coli CFT073
cguaacggaaagagua

SEQ ID NO: 2636642 - RNA, 20 nt, Escherichia coli CFT073
cguaacggcucacccccauc

SEQ ID NO: 2636643 - RNA, 19 nt, Escherichia coli CFT073
cguaacguuucuuucauca

SEQ ID NO: 2636644 - RNA, 20 nt, Escherichia coli CFT073
cguaacguuucuuucaucag

SEQ ID NO: 2636645 - RNA, 14 nt, Escherichia coli CFT073
cguaacucaggugg

SEQ ID NO: 2636646 - RNA, 17 nt, Escherichia coli CFT073
cguaacuuaucaauuga

SEQ ID NO: 2636647 - RNA, 17 nt, Escherichia coli CFT073
cguaagcaacgccaaau

SEQ ID NO: 2636648 - RNA, 18 nt, Escherichia coli CFT073
cguaagguggauuacucu

SEQ ID NO: 2636649 - RNA, 17 nt, Escherichia coli CFT073
cguaagucaccgcuuuu

SEQ ID NO: 2636650 - RNA, 17 nt, Escherichia coli CFT073
cguaaguggaacuaaca

SEQ ID NO: 2636651 - RNA, 22 nt, Escherichia coli CFT073
cguaaguuaacugcacaccgcg

SEQ ID NO: 2636652 - RNA, 14 nt, Escherichia coli CFT073
cguaauaucuuccu

SEQ ID NO: 2636653 - RNA, 17 nt, Escherichia coli CFT073
cguaauaucuuccugaa

SEQ ID NO: 2636654 - RNA, 16 nt, Escherichia coli CFT073
cguaaucauaaaacac

SEQ ID NO: 2636655 - RNA, 16 nt, Escherichia coli CFT073
cguaauccguaaagcc

SEQ ID NO: 2636656 - RNA, 18 nt, Escherichia coli CFT073
cguaauccguaugacaaa

SEQ ID NO: 2636657 - RNA, 18 nt, Escherichia coli CFT073
cguaauccugaaagcgug

SEQ ID NO: 2636658 - RNA, 21 nt, Escherichia coli CFT073
cguaauccugaaagcguguca

SEQ ID NO: 2636659 - RNA, 15 nt, Escherichia coli CFT073
cguaaucucuuucca

SEQ ID NO: 2636660 - RNA, 16 nt, Escherichia coli CFT073
cguaaucucuuuccau

SEQ ID NO: 2636661 - RNA, 17 nt, Escherichia coli CFT073
cguaaucucuuuccauu

SEQ ID NO: 2636662 - RNA, 22 nt, Escherichia coli CFT073
cguaaugaauguuuuccuguuu

SEQ ID NO: 2636663 - RNA, 20 nt, Escherichia coli CFT073
cguaaugcuucuaccgucug

SEQ ID NO: 2636664 - RNA, 15 nt, Escherichia coli CFT073
cguaauggucugcga

SEQ ID NO: 2636665 - RNA, 15 nt, Escherichia coli CFT073
cguaauguuuccagc

SEQ ID NO: 2636666 - RNA, 19 nt, Escherichia coli CFT073
cguaauguuuccagcaucg

SEQ ID NO: 2636667 - RNA, 23 nt, Escherichia coli CFT073
cguaauuaguggcuaaccgucug

SEQ ID NO: 2636668 - RNA, 12 nt, Escherichia coli CFT073
cguaauuauucc

SEQ ID NO: 2636669 - RNA, 18 nt, Escherichia coli CFT073
cguaauucaccguucaau

SEQ ID NO: 2636670 - RNA, 13 nt, Escherichia coli CFT073
cguacaaccgcga

SEQ ID NO: 2636671 - RNA, 20 nt, Escherichia coli CFT073
cguacaaccgcgaacuggac

SEQ ID NO: 2636672 - RNA, 17 nt, Escherichia coli CFT073
cguacaaguccugaauu

SEQ ID NO: 2636673 - RNA, 18 nt, Escherichia coli CFT073
cguacacccgccagaauc

SEQ ID NO: 2636674 - RNA, 19 nt, Escherichia coli CFT073
cguacagacaccaaucagc

SEQ ID NO: 2636675 - RNA, 15 nt, Escherichia coli CFT073
cguacagauacauuu

SEQ ID NO: 2636676 - RNA, 16 nt, Escherichia coli CFT073
cguacagauacauuuc

SEQ ID NO: 2636677 - RNA, 12 nt, Escherichia coli CFT073
cguacagcagaa

SEQ ID NO: 2636678 - RNA, 14 nt, Escherichia coli CFT073
cguacagcccagga

SEQ ID NO: 2636679 - RNA, 21 nt, Escherichia coli CFT073
cguacaggacgggguugugau

SEQ ID NO: 2636680 - RNA, 15 nt, Escherichia coli CFT073
cguacauccggcaau

SEQ ID NO: 2636681 - RNA, 16 nt, Escherichia coli CFT073
cguacaugcagggcaa

SEQ ID NO: 2636682 - RNA, 15 nt, Escherichia coli CFT073
cguacauugcugaca

SEQ ID NO: 2636683 - RNA, 17 nt, Escherichia coli CFT073
cguacauugcugacaug

SEQ ID NO: 2636684 - RNA, 13 nt, Escherichia coli CFT073
cguaccagcgaaa

SEQ ID NO: 2636685 - RNA, 13 nt, Escherichia coli CFT073
cguacccagcgug

SEQ ID NO: 2636686 - RNA, 18 nt, Escherichia coli CFT073
cguacccaucaacaacug

SEQ ID NO: 2636687 - RNA, 19 nt, Escherichia coli CFT073
cguacccaucaacaacugg

SEQ ID NO: 2636688 - RNA, 13 nt, Escherichia coli CFT073
cguaccggaaccu

SEQ ID NO: 2636689 - RNA, 22 nt, Escherichia coli CFT073
cguaccggaaccugacggcgca

SEQ ID NO: 2636690 - RNA, 20 nt, Escherichia coli CFT073
cguaccggcgcguaucgcga

SEQ ID NO: 2636691 - RNA, 22 nt, Escherichia coli CFT073
cguaccugacgguaaauacgcg

SEQ ID NO: 2636692 - RNA, 23 nt, Escherichia coli CFT073
cguaccugcauuagcaaugcccu

SEQ ID NO: 2636693 - RNA, 16 nt, Escherichia coli CFT073
cguaccugccgcgccu

SEQ ID NO: 2636694 - RNA, 18 nt, Escherichia coli CFT073
cguacgccgcucgaauca

SEQ ID NO: 2636695 - RNA, 16 nt, Escherichia coli CFT073
cguacguuaacagccu

SEQ ID NO: 2636696 - RNA, 15 nt, Escherichia coli CFT073
cguacguucauggcg

SEQ ID NO: 2636697 - RNA, 14 nt, Escherichia coli CFT073
cguacuacgcgccg

SEQ ID NO: 2636698 - RNA, 17 nt, Escherichia coli CFT073
cguacuaucuacugccu

SEQ ID NO: 2636699 - RNA, 16 nt, Escherichia coli CFT073
cguacucaccgcucac

SEQ ID NO: 2636700 - RNA, 13 nt, Escherichia coli CFT073
cguacugaccgua

SEQ ID NO: 2636701 - RNA, 13 nt, Escherichia coli CFT073
cguacugaucuuu

SEQ ID NO: 2636702 - RNA, 22 nt, Escherichia coli CFT073
cguacugaucuuuuuucagccg

SEQ ID NO: 2636703 - RNA, 15 nt, Escherichia coli CFT073
cguacugcggaaccg

SEQ ID NO: 2636704 - RNA, 16 nt, Escherichia coli CFT073
cguacuggcaaucgcc

SEQ ID NO: 2636705 - RNA, 17 nt, Escherichia coli CFT073
cguacuggcaaucgcca

SEQ ID NO: 2636706 - RNA, 19 nt, Escherichia coli CFT073
cguacuggcgauugucggg

SEQ ID NO: 2636707 - RNA, 14 nt, Escherichia coli CFT073
cguacuguguugua

SEQ ID NO: 2636708 - RNA, 13 nt, Escherichia coli CFT073
cguacuucacaua

SEQ ID NO: 2636709 - RNA, 20 nt, Escherichia coli CFT073
cguagaagccagagaacaga

SEQ ID NO: 2636710 - RNA, 18 nt, Escherichia coli CFT073
cguagaauaaaagcauua

SEQ ID NO: 2636711 - RNA, 16 nt, Escherichia coli CFT073
cguagacauaaccggu

SEQ ID NO: 2636712 - RNA, 21 nt, Escherichia coli CFT073
cguagacuuccccacaaaaua

SEQ ID NO: 2636713 - RNA, 16 nt, Escherichia coli CFT073
cguagagaaaaccagu

SEQ ID NO: 2636714 - RNA, 15 nt, Escherichia coli CFT073
cguagcaagcauccc

SEQ ID NO: 2636715 - RNA, 14 nt, Escherichia coli CFT073
cguagccaggcuuu

SEQ ID NO: 2636716 - RNA, 14 nt, Escherichia coli CFT073
cguagccauuacca

SEQ ID NO: 2636717 - RNA, 17 nt, Escherichia coli CFT073
cguagccauuaccaggu

SEQ ID NO: 2636718 - RNA, 20 nt, Escherichia coli CFT073
cguagccccagucuuccugc

SEQ ID NO: 2636719 - RNA, 19 nt, Escherichia coli CFT073
cguagcguuuuuucauuuc

SEQ ID NO: 2636720 - RNA, 14 nt, Escherichia coli CFT073
cguagcucaucuuc

SEQ ID NO: 2636721 - RNA, 16 nt, Escherichia coli CFT073
cguagcuggcggcaau

SEQ ID NO: 2636722 - RNA, 17 nt, Escherichia coli CFT073
cguagcugggcaacaaa

SEQ ID NO: 2636723 - RNA, 22 nt, Escherichia coli CFT073
cguagcuuauuguacagcgccc

SEQ ID NO: 2636724 - RNA, 14 nt, Escherichia coli CFT073
cguaggagugcccc

SEQ ID NO: 2636725 - RNA, 20 nt, Escherichia coli CFT073
cguaggccggauaagaugcg

SEQ ID NO: 2636726 - RNA, 20 nt, Escherichia coli CFT073
cguaggccggauaaggcguu

SEQ ID NO: 2636727 - RNA, 13 nt, Escherichia coli CFT073
cguaggccugaua

SEQ ID NO: 2636728 - RNA, 14 nt, Escherichia coli CFT073
cguaggccugauaa

SEQ ID NO: 2636729 - RNA, 20 nt, Escherichia coli CFT073
cguaggccugauaagacgcg

SEQ ID NO: 2636730 - RNA, 13 nt, Escherichia coli CFT073
cguaggucaugcc

SEQ ID NO: 2636731 - RNA, 21 nt, Escherichia coli CFT073
cguaguacccucugcaccaga

SEQ ID NO: 2636732 - RNA, 22 nt, Escherichia coli CFT073
cguaguacuuuaacucacggcg

SEQ ID NO: 2636733 - RNA, 18 nt, Escherichia coli CFT073
cguagucugaccucuucu

SEQ ID NO: 2636734 - RNA, 16 nt, Escherichia coli CFT073
cguagugaugcaucau

SEQ ID NO: 2636735 - RNA, 19 nt, Escherichia coli CFT073
cguaguguggggaaugaua

SEQ ID NO: 2636736 - RNA, 19 nt, Escherichia coli CFT073
cguaguugcgcugguggca

SEQ ID NO: 2636737 - RNA, 12 nt, Escherichia coli CFT073
cguaguugcugc

SEQ ID NO: 2636738 - RNA, 17 nt, Escherichia coli CFT073
cguaguuugucuucaau

SEQ ID NO: 2636739 - RNA, 20 nt, Escherichia coli CFT073
cguaguuuuugcccaucaug

SEQ ID NO: 2636740 - RNA, 21 nt, Escherichia coli CFT073
cguauaccgucaggauaaacu

SEQ ID NO: 2636741 - RNA, 20 nt, Escherichia coli CFT073
cguauaccugauuaccaaaa

SEQ ID NO: 2636742 - RNA, 13 nt, Escherichia coli CFT073
cguauacugcagc

SEQ ID NO: 2636743 - RNA, 22 nt, Escherichia coli CFT073
cguauccaccgacacuacaaau

SEQ ID NO: 2636744 - RNA, 12 nt, Escherichia coli CFT073
cguauccaucac

SEQ ID NO: 2636745 - RNA, 18 nt, Escherichia coli CFT073
cguaucccagugcagcau

SEQ ID NO: 2636746 - RNA, 21 nt, Escherichia coli CFT073
cguaucuuuaaagcccgcagc

SEQ ID NO: 2636747 - RNA, 22 nt, Escherichia coli CFT073
cguaucuuuaaagcccgcagcg

SEQ ID NO: 2636748 - RNA, 14 nt, Escherichia coli CFT073
cguaugaccaccug

SEQ ID NO: 2636749 - RNA, 18 nt, Escherichia coli CFT073
cguaugcagccaggccau

SEQ ID NO: 2636750 - RNA, 22 nt, Escherichia coli CFT073
cguaugcaucgguggcgauacu

SEQ ID NO: 2636751 - RNA, 16 nt, Escherichia coli CFT073
cguaugcccagcgcag

SEQ ID NO: 2636752 - RNA, 13 nt, Escherichia coli CFT073
cguauuacugaga

SEQ ID NO: 2636753 - RNA, 19 nt, Escherichia coli CFT073
cguauuccaccguacgcca

SEQ ID NO: 2636754 - RNA, 18 nt, Escherichia coli CFT073
cguauuuugcccuguuga

SEQ ID NO: 2636755 - RNA, 15 nt, Escherichia coli CFT073
cgucaaaaccgggcu

SEQ ID NO: 2636756 - RNA, 10 nt, Escherichia coli CFT073
cgucaaaagg

SEQ ID NO: 2636757 - RNA, 16 nt, Escherichia coli CFT073
cgucaaaauucauaaa

SEQ ID NO: 2636758 - RNA, 22 nt, Escherichia coli CFT073
cgucaaacucauaaaccagcgg

SEQ ID NO: 2636759 - RNA, 17 nt, Escherichia coli CFT073
cgucaaccugaccaaau

SEQ ID NO: 2636760 - RNA, 14 nt, Escherichia coli CFT073
cgucaacgccgcgu

SEQ ID NO: 2636761 - RNA, 23 nt, Escherichia coli CFT073
cgucaacggugcuuuaauuucau

SEQ ID NO: 2636762 - RNA, 14 nt, Escherichia coli CFT073
cgucaacguaauga

SEQ ID NO: 2636763 - RNA, 13 nt, Escherichia coli CFT073
cgucaacuucuuu

SEQ ID NO: 2636764 - RNA, 21 nt, Escherichia coli CFT073
cgucaagaaaacuauuacuga

SEQ ID NO: 2636765 - RNA, 14 nt, Escherichia coli CFT073
cgucaagcgucgca

SEQ ID NO: 2636766 - RNA, 19 nt, Escherichia coli CFT073
cgucaagcgucgcauccgg

SEQ ID NO: 2636767 - RNA, 16 nt, Escherichia coli CFT073
cgucaauaaucaugca

SEQ ID NO: 2636768 - RNA, 15 nt, Escherichia coli CFT073
cgucaaucacacuga

SEQ ID NO: 2636769 - RNA, 16 nt, Escherichia coli CFT073
cgucaaucacacugac

SEQ ID NO: 2636770 - RNA, 17 nt, Escherichia coli CFT073
cgucaaucacuuucugc

SEQ ID NO: 2636771 - RNA, 16 nt, Escherichia coli CFT073
cgucaaucugcuccau

SEQ ID NO: 2636772 - RNA, 16 nt, Escherichia coli CFT073
cgucaaugccgcuucg

SEQ ID NO: 2636773 - RNA, 20 nt, Escherichia coli CFT073
cgucaaugccgucaccagca

SEQ ID NO: 2636774 - RNA, 19 nt, Escherichia coli CFT073
cgucacaggcacaccgccg

SEQ ID NO: 2636775 - RNA, 15 nt, Escherichia coli CFT073
cgucacaguuaacca

SEQ ID NO: 2636776 - RNA, 17 nt, Escherichia coli CFT073
cgucacaguuaaccagu

SEQ ID NO: 2636777 - RNA, 18 nt, Escherichia coli CFT073
cgucacaucaccaacacc

SEQ ID NO: 2636778 - RNA, 16 nt, Escherichia coli CFT073
cgucaccaccucaccc

SEQ ID NO: 2636779 - RNA, 18 nt, Escherichia coli CFT073
cgucaccaccucacccgc

SEQ ID NO: 2636780 - RNA, 16 nt, Escherichia coli CFT073
cgucaccaccugggug

SEQ ID NO: 2636781 - RNA, 13 nt, Escherichia coli CFT073
cgucaccagcauc

SEQ ID NO: 2636782 - RNA, 14 nt, Escherichia coli CFT073
cgucaccgccaggu

SEQ ID NO: 2636783 - RNA, 16 nt, Escherichia coli CFT073
cgucaccgguucggac

SEQ ID NO: 2636784 - RNA, 16 nt, Escherichia coli CFT073
cgucacgauaucgaua

SEQ ID NO: 2636785 - RNA, 18 nt, Escherichia coli CFT073
cgucacgccgaccagacc

SEQ ID NO: 2636786 - RNA, 20 nt, Escherichia coli CFT073
cgucacuggugugucaucug

SEQ ID NO: 2636787 - RNA, 21 nt, Escherichia coli CFT073
cgucacuggugugucaucugc

SEQ ID NO: 2636788 - RNA, 15 nt, Escherichia coli CFT073
cgucacuguugcugu

SEQ ID NO: 2636789 - RNA, 21 nt, Escherichia coli CFT073
cgucacuuugcugucgauuuu

SEQ ID NO: 2636790 - RNA, 19 nt, Escherichia coli CFT073
cgucacuuuucuuaauugc

SEQ ID NO: 2636791 - RNA, 13 nt, Escherichia coli CFT073
cgucagaaacagu

SEQ ID NO: 2636792 - RNA, 20 nt, Escherichia coli CFT073
cgucagaaauuaaacugucg

SEQ ID NO: 2636793 - RNA, 23 nt, Escherichia coli CFT073
cgucagacagcgcaauagccuga

SEQ ID NO: 2636794 - RNA, 21 nt, Escherichia coli CFT073
cgucagaccggcaaccagcac

SEQ ID NO: 2636795 - RNA, 22 nt, Escherichia coli CFT073
cgucucaaucaccaccagcgga

SEQ ID NO: 2636796 - RNA, 15 nt, Escherichia coli CFT073
cgucucacuaucgcc

SEQ ID NO: 2636797 - RNA, 19 nt, Escherichia coli CFT073
cgucucagcaccgucuggc

SEQ ID NO: 2636798 - RNA, 21 nt, Escherichia coli CFT073
cgucucauaacggauugcauc

SEQ ID NO: 2636799 - RNA, 16 nt, Escherichia coli CFT073
cgucuccucccgagcg

SEQ ID NO: 2636800 - RNA, 18 nt, Escherichia coli CFT073
cgucucgugaacgcccgg

SEQ ID NO: 2636801 - RNA, 15 nt, Escherichia coli CFT073
cgucugaauaucauc

SEQ ID NO: 2636802 - RNA, 16 nt, Escherichia coli CFT073
cgucugaauaucauca

SEQ ID NO: 2636803 - RNA, 13 nt, Escherichia coli CFT073
cgucugaucggca

SEQ ID NO: 2636804 - RNA, 22 nt, Escherichia coli CFT073
cgucugaucggcaaucacgccc

SEQ ID NO: 2636805 - RNA, 13 nt, Escherichia coli CFT073
cgucugccacggc

SEQ ID NO: 2636806 - RNA, 19 nt, Escherichia coli CFT073
cgucugccacggcagaaug

SEQ ID NO: 2636807 - RNA, 23 nt, Escherichia coli CFT073
cgucugccacuucuuccagcggc

SEQ ID NO: 2636808 - RNA, 20 nt, Escherichia coli CFT073
cgucugcccggugccgcguu

SEQ ID NO: 2636809 - RNA, 22 nt, Escherichia coli CFT073
cgucugcggugcgccaaacugc

SEQ ID NO: 2636810 - RNA, 13 nt, Escherichia coli CFT073
cgucugcgucgca

SEQ ID NO: 2636811 - RNA, 18 nt, Escherichia coli CFT073
cgucuggcagauccugaa

SEQ ID NO: 2636812 - RNA, 17 nt, Escherichia coli CFT073
cgucuggcauuuugcug

SEQ ID NO: 2636813 - RNA, 16 nt, Escherichia coli CFT073
cgucugggcaaaauca

SEQ ID NO: 2636814 - RNA, 18 nt, Escherichia coli CFT073
cgucugggcaaaaucauc

SEQ ID NO: 2636815 - RNA, 19 nt, Escherichia coli CFT073
cgucugggcaaaaucauca

SEQ ID NO: 2636816 - RNA, 23 nt, Escherichia coli CFT073
cgucugguaucgcgccagccagu

SEQ ID NO: 2636817 - RNA, 16 nt, Escherichia coli CFT073
cgucugguucgccaaa

SEQ ID NO: 2636818 - RNA, 14 nt, Escherichia coli CFT073
cgucugguuuuccu

SEQ ID NO: 2636819 - RNA, 23 nt, Escherichia coli CFT073
cgucuguaaccagaugucgcgca

SEQ ID NO: 2636820 - RNA, 15 nt, Escherichia coli CFT073
cgucuuaucaggccu

SEQ ID NO: 2636821 - RNA, 20 nt, Escherichia coli CFT073
cgucuuaucaggccuacaaa

SEQ ID NO: 2636822 - RNA, 20 nt, Escherichia coli CFT073
cgucuuaucaggccuacaau

SEQ ID NO: 2636823 - RNA, 20 nt, Escherichia coli CFT073
cgucuuaucaggccuacagg

SEQ ID NO: 2636824 - RNA, 18 nt, Escherichia coli CFT073
cgucuuaucaggccuacg

SEQ ID NO: 2636825 - RNA, 15 nt, Escherichia coli CFT073
cgucuuauccgaccu

SEQ ID NO: 2636826 - RNA, 20 nt, Escherichia coli CFT073
cgucuuaucuggccuacagg

SEQ ID NO: 2636827 - RNA, 14 nt, Escherichia coli CFT073
cgucuuccacuuca

SEQ ID NO: 2636828 - RNA, 16 nt, Escherichia coli CFT073
cgucuuccacuucauc

SEQ ID NO: 2636829 - RNA, 21 nt, Escherichia coli CFT073
cgucuucccgagacaucccuu

SEQ ID NO: 2636830 - RNA, 14 nt, Escherichia coli CFT073
cgucuucccgcagc

SEQ ID NO: 2636831 - RNA, 13 nt, Escherichia coli CFT073
cgucuucguccca

SEQ ID NO: 2636832 - RNA, 22 nt, Escherichia coli CFT073
cgucuucuucccagacccaguu

SEQ ID NO: 2636833 - RNA, 19 nt, Escherichia coli CFT073
cgucuuuaggaacgcgcug

SEQ ID NO: 2636834 - RNA, 20 nt, Escherichia coli CFT073
cgucuuuaggaacgcgcugc

SEQ ID NO: 2636835 - RNA, 23 nt, Escherichia coli CFT073
cgugaaacgcgucugaccgucuu

SEQ ID NO: 2636836 - RNA, 20 nt, Escherichia coli CFT073
cgugaaaguuugugccgccg

SEQ ID NO: 2636837 - RNA, 13 nt, Escherichia coli CFT073
cgugaaauccccu

SEQ ID NO: 2636838 - RNA, 12 nt, Escherichia coli CFT073
cgugaaauucac

SEQ ID NO: 2636839 - RNA, 18 nt, Escherichia coli CFT073
cgugaacgccuuauccga

SEQ ID NO: 2636840 - RNA, 20 nt, Escherichia coli CFT073
cgugaacgccuuauccgacc

SEQ ID NO: 2636841 - RNA, 18 nt, Escherichia coli CFT073
cgugaacgccuuauccgg

SEQ ID NO: 2636842 - RNA, 21 nt, Escherichia coli CFT073
cgugaacugggccugcauauc

SEQ ID NO: 2636843 - RNA, 14 nt, Escherichia coli CFT073
cgugaauaugucgc

SEQ ID NO: 2636844 - RNA, 22 nt, Escherichia coli CFT073
cgugaaucccaguacuguacaa

SEQ ID NO: 2636845 - RNA, 21 nt, Escherichia coli CFT073
cgugaaugccguaggcccagc

SEQ ID NO: 2636846 - RNA, 17 nt, Escherichia coli CFT073
cgugacacuaacagcag

SEQ ID NO: 2636847 - RNA, 20 nt, Escherichia coli CFT073
cgugaccacccauggaauga

SEQ ID NO: 2636848 - RNA, 17 nt, Escherichia coli CFT073
cgugaccgccagaacac

SEQ ID NO: 2636849 - RNA, 14 nt, Escherichia coli CFT073
cgugaccucuucgg

SEQ ID NO: 2636850 - RNA, 14 nt, Escherichia coli CFT073
cgugacugccgcca

SEQ ID NO: 2636851 - RNA, 16 nt, Escherichia coli CFT073
cgugacugccgccagc

SEQ ID NO: 2636852 - RNA, 19 nt, Escherichia coli CFT073
cgugacugggauauaaacu

SEQ ID NO: 2636853 - RNA, 20 nt, Escherichia coli CFT073
cgugacuucauucagaaaaa

SEQ ID NO: 2636854 - RNA, 13 nt, Escherichia coli CFT073
cgugacuuccagc

SEQ ID NO: 2636855 - RNA, 15 nt, Escherichia coli CFT073
cgugagucuccuuua

SEQ ID NO: 2636856 - RNA, 14 nt, Escherichia coli CFT073
cgugauaugcccac

SEQ ID NO: 2636857 - RNA, 20 nt, Escherichia coli CFT073
cgugauauuacauaccagca

SEQ ID NO: 2636858 - RNA, 21 nt, Escherichia coli CFT073
cgugauauuacauaccagcag

SEQ ID NO: 2636859 - RNA, 18 nt, Escherichia coli CFT073
cgugaucccuaacuggcg

SEQ ID NO: 2636860 - RNA, 21 nt, Escherichia coli CFT073
cgugaucgucuucaaccgcag

SEQ ID NO: 2636861 - RNA, 21 nt, Escherichia coli CFT073
cgugaugauaagugagcgauu

SEQ ID NO: 2636862 - RNA, 14 nt, Escherichia coli CFT073
cgugauguggaaau

SEQ ID NO: 2636863 - RNA, 15 nt, Escherichia coli CFT073
cgugauuccugcaau

SEQ ID NO: 2636864 - RNA, 17 nt, Escherichia coli CFT073
cgugauuccugcaauuu

SEQ ID NO: 2636865 - RNA, 19 nt, Escherichia coli CFT073
cgugauugguuucaaccug

SEQ ID NO: 2636866 - RNA, 21 nt, Escherichia coli CFT073
cgugauugguuucaaccugca

SEQ ID NO: 2636867 - RNA, 14 nt, Escherichia coli CFT073
cgugauuuuguagg

SEQ ID NO: 2636868 - RNA, 15 nt, Escherichia coli CFT073
cgugauuuuuguagg

SEQ ID NO: 2636869 - RNA, 18 nt, Escherichia coli CFT073
cgugauuuuuguaggucg

SEQ ID NO: 2636870 - RNA, 17 nt, Escherichia coli CFT073
cgugcaaaaucaaacag

SEQ ID NO: 2636871 - RNA, 14 nt, Escherichia coli CFT073
cgugcacaccgaag

SEQ ID NO: 2636872 - RNA, 22 nt, Escherichia coli CFT073
cgugcagggugagggcaauaau

SEQ ID NO: 2636873 - RNA, 16 nt, Escherichia coli CFT073
cgugcaguagcagcag

SEQ ID NO: 2636874 - RNA, 19 nt, Escherichia coli CFT073
cgugcauagcagcacacca

SEQ ID NO: 2636875 - RNA, 20 nt, Escherichia coli CFT073
cgugcauaucgcuguuggcg

SEQ ID NO: 2636876 - RNA, 23 nt, Escherichia coli CFT073
cgugcaucucuucaaauagcgga

SEQ ID NO: 2636877 - RNA, 20 nt, Escherichia coli CFT073
cgugcauuuuucgcuuuuca

SEQ ID NO: 2636878 - RNA, 13 nt, Escherichia coli CFT073
cgugccagagcau

SEQ ID NO: 2636879 - RNA, 17 nt, Escherichia coli CFT073
cgugccagagcaucuac

SEQ ID NO: 2636880 - RNA, 13 nt, Escherichia coli CFT073
cgugccagcacca

SEQ ID NO: 2636881 - RNA, 18 nt, Escherichia coli CFT073
cgugccaggaccauucac

SEQ ID NO: 2636882 - RNA, 20 nt, Escherichia coli CFT073
cgugccgaagaacauaaaca

SEQ ID NO: 2636883 - RNA, 20 nt, Escherichia coli CFT073
cgugccgcuacugcuugcca

SEQ ID NO: 2636884 - RNA, 18 nt, Escherichia coli CFT073
cgugccggaacgccgcug

SEQ ID NO: 2636885 - RNA, 23 nt, Escherichia coli CFT073
cgugccggaagucucuugccggu

SEQ ID NO: 2636886 - RNA, 21 nt, Escherichia coli CFT073
cgugccgguaaugcugaaauu

SEQ ID NO: 2636887 - RNA, 18 nt, Escherichia coli CFT073
cgugccugacggacgcgc

SEQ ID NO: 2636888 - RNA, 19 nt, Escherichia coli CFT073
cgugccugacggacgcgcg

SEQ ID NO: 2636889 - RNA, 19 nt, Escherichia coli CFT073
cgugccuuuaauggucagg

SEQ ID NO: 2636890 - RNA, 17 nt, Escherichia coli CFT073
cgugcgacgccauugcu

SEQ ID NO: 2636891 - RNA, 21 nt, Escherichia coli CFT073
cgugcgauuuguucaugcccg

SEQ ID NO: 2636892 - RNA, 19 nt, Escherichia coli CFT073
cgugcgcagcaucggcgca

SEQ ID NO: 2636893 - RNA, 12 nt, Escherichia coli CFT073
cgugcgccaccg

SEQ ID NO: 2636894 - RNA, 19 nt, Escherichia coli CFT073
cgugcgccagagcccguua

SEQ ID NO: 2636895 - RNA, 20 nt, Escherichia coli CFT073
cgugcgcuggacgccgaggu

SEQ ID NO: 2636896 - RNA, 14 nt, Escherichia coli CFT073
cgugcgcuuuuuag

SEQ ID NO: 2636897 - RNA, 22 nt, Escherichia coli CFT073
cgugcggcaggcacaaaaccug

SEQ ID NO: 2636898 - RNA, 16 nt, Escherichia coli CFT073
cgugcgggaccagcac

SEQ ID NO: 2636899 - RNA, 12 nt, Escherichia coli CFT073
cgugcgggcaaa

SEQ ID NO: 2636900 - RNA, 22 nt, Escherichia coli CFT073
cgugcgggugguaaacacaacg

SEQ ID NO: 2636901 - RNA, 14 nt, Escherichia coli CFT073
cgugcgguaacuuc

SEQ ID NO: 2636902 - RNA, 16 nt, Escherichia coli CFT073
cgugcgguaucaccac

SEQ ID NO: 2636903 - RNA, 14 nt, Escherichia coli CFT073
cguuccacgucaca

SEQ ID NO: 2636904 - RNA, 15 nt, Escherichia coli CFT073
cguuccacguccugc

SEQ ID NO: 2636905 - RNA, 13 nt, Escherichia coli CFT073
cguuccagauucc

SEQ ID NO: 2636906 - RNA, 14 nt, Escherichia coli CFT073
cguucccagagaau

SEQ ID NO: 2636907 - RNA, 15 nt, Escherichia coli CFT073
cguucccagagaaug

SEQ ID NO: 2636908 - RNA, 15 nt, Escherichia coli CFT073
cguucccagcgcguu

SEQ ID NO: 2636909 - RNA, 18 nt, Escherichia coli CFT073
cguucccagcggauacca

SEQ ID NO: 2636910 - RNA, 15 nt, Escherichia coli CFT073
cguuccccaucaccu

SEQ ID NO: 2636911 - RNA, 16 nt, Escherichia coli CFT073
cguuccccgucaucau

SEQ ID NO: 2636912 - RNA, 13 nt, Escherichia coli CFT073
cguucccggaaca

SEQ ID NO: 2636913 - RNA, 21 nt, Escherichia coli CFT073
cguucccuucuugcgcaaacc

SEQ ID NO: 2636914 - RNA, 19 nt, Escherichia coli CFT073
cguuccggauaucggcagc

SEQ ID NO: 2636915 - RNA, 17 nt, Escherichia coli CFT073
cguuccggcaacgacgu

SEQ ID NO: 2636916 - RNA, 22 nt, Escherichia coli CFT073
cguuccggcaacgacgucgauu

SEQ ID NO: 2636917 - RNA, 15 nt, Escherichia coli CFT073
cguuccggcggugau

SEQ ID NO: 2636918 - RNA, 20 nt, Escherichia coli CFT073
cguuccugacgaucaagcga

SEQ ID NO: 2636919 - RNA, 13 nt, Escherichia coli CFT073
cguuccugcaacg

SEQ ID NO: 2636920 - RNA, 22 nt, Escherichia coli CFT073
cguuccuugcugcgcggugaca

SEQ ID NO: 2636921 - RNA, 17 nt, Escherichia coli CFT073
cguucgaucaccgcacg

SEQ ID NO: 2636922 - RNA, 18 nt, Escherichia coli CFT073
cguucgccagcuccagcg

SEQ ID NO: 2636923 - RNA, 19 nt, Escherichia coli CFT073
cguucgccagucuccaggc

SEQ ID NO: 2636924 - RNA, 23 nt, Escherichia coli CFT073
cguucgcgaggugucuucgcgca

SEQ ID NO: 2636925 - RNA, 24 nt, Escherichia coli CFT073
cguucgcggggcuaccgccagacc

SEQ ID NO: 2636926 - RNA, 19 nt, Escherichia coli CFT073
cguucggaccaaugcccaa

SEQ ID NO: 2636927 - RNA, 14 nt, Escherichia coli CFT073
cguucggcgagcag

SEQ ID NO: 2636928 - RNA, 18 nt, Escherichia coli CFT073
cguucggcggaugcagga

SEQ ID NO: 2636929 - RNA, 22 nt, Escherichia coli CFT073
cguucgguaaguuaccggcaau

SEQ ID NO: 2636930 - RNA, 21 nt, Escherichia coli CFT073
cguucgguauuaauuugccag

SEQ ID NO: 2636931 - RNA, 19 nt, Escherichia coli CFT073
cguucggugauauacgcca

SEQ ID NO: 2636932 - RNA, 14 nt, Escherichia coli CFT073
cguucggugcgcgc

SEQ ID NO: 2636933 - RNA, 15 nt, Escherichia coli CFT073
cguucuacuaugagg

SEQ ID NO: 2636934 - RNA, 20 nt, Escherichia coli CFT073
cguucucaccaacuggcgca

SEQ ID NO: 2636935 - RNA, 16 nt, Escherichia coli CFT073
cguucucuucacgcca

SEQ ID NO: 2636936 - RNA, 20 nt, Escherichia coli CFT073
cguucugaauacccgccaga

SEQ ID NO: 2636937 - RNA, 11 nt, Escherichia coli CFT073
cguucugcggg

SEQ ID NO: 2636938 - RNA, 20 nt, Escherichia coli CFT073
cguucugcuguucuucugcc

SEQ ID NO: 2636939 - RNA, 14 nt, Escherichia coli CFT073
cguucuucccgccu

SEQ ID NO: 2636940 - RNA, 15 nt, Escherichia coli CFT073
cguugaaaaugcugg

SEQ ID NO: 2636941 - RNA, 21 nt, Escherichia coli CFT073
cguugaccuggaugccugcau

SEQ ID NO: 2636942 - RNA, 14 nt, Escherichia coli CFT073
cguugagagauaau

SEQ ID NO: 2636943 - RNA, 21 nt, Escherichia coli CFT073
cguugaggaacucaaaccauu

SEQ ID NO: 2636944 - RNA, 16 nt, Escherichia coli CFT073
cguugagggauaggug

SEQ ID NO: 2636945 - RNA, 17 nt, Escherichia coli CFT073
cguugaguuuacgcagc

SEQ ID NO: 2636946 - RNA, 13 nt, Escherichia coli CFT073
cguugauccagcg

SEQ ID NO: 2636947 - RNA, 13 nt, Escherichia coli CFT073
cguugaucgcuuu

SEQ ID NO: 2636948 - RNA, 14 nt, Escherichia coli CFT073
cguugaucuucucu

SEQ ID NO: 2636949 - RNA, 16 nt, Escherichia coli CFT073
cguugauugccggaug

SEQ ID NO: 2636950 - RNA, 20 nt, Escherichia coli CFT073
cguugauugccggaugcggc

SEQ ID NO: 2636951 - RNA, 14 nt, Escherichia coli CFT073
cguugauuggcgca

SEQ ID NO: 2636952 - RNA, 15 nt, Escherichia coli CFT073
cguugauuucaccau

SEQ ID NO: 2636953 - RNA, 19 nt, Escherichia coli CFT073
cguugcaaauauuccauca

SEQ ID NO: 2636954 - RNA, 15 nt, Escherichia coli CFT073
cguugcaaucagcgg

SEQ ID NO: 2636955 - RNA, 23 nt, Escherichia coli CFT073
cguugcaaucagcggugccgcga

SEQ ID NO: 2636956 - RNA, 20 nt, Escherichia coli CFT073
cguugcaccaaguucuucac

SEQ ID NO: 2636957 - RNA, 19 nt, Escherichia coli CFT073
cguugcagaaguugugaaa

SEQ ID NO: 2636958 - RNA, 23 nt, Escherichia coli CFT073
cguugcagagagucacgcagcau

SEQ ID NO: 2636959 - RNA, 17 nt, Escherichia coli CFT073
cguugcagguuaggcug

SEQ ID NO: 2636960 - RNA, 16 nt, Escherichia coli CFT073
cguugcauaaagcuca

SEQ ID NO: 2636961 - RNA, 13 nt, Escherichia coli CFT073
cguugcaucaccc

SEQ ID NO: 2636962 - RNA, 14 nt, Escherichia coli CFT073
cguugcauuccaga

SEQ ID NO: 2636963 - RNA, 19 nt, Escherichia coli CFT073
cguugccacacgacgccag

SEQ ID NO: 2636964 - RNA, 19 nt, Escherichia coli CFT073
cguugccacucaggcaaag

SEQ ID NO: 2636965 - RNA, 14 nt, Escherichia coli CFT073
cguugccagcaacu

SEQ ID NO: 2636966 - RNA, 16 nt, Escherichia coli CFT073
cguugccaguaccauc

SEQ ID NO: 2636967 - RNA, 21 nt, Escherichia coli CFT073
cguugccaguuuuuuagcgug

SEQ ID NO: 2636968 - RNA, 18 nt, Escherichia coli CFT073
cguugccgcaucagugau

SEQ ID NO: 2636969 - RNA, 18 nt, Escherichia coli CFT073
cguugccgcucccggcau

SEQ ID NO: 2636970 - RNA, 15 nt, Escherichia coli CFT073
cguugccggaucuuu

SEQ ID NO: 2636971 - RNA, 19 nt, Escherichia coli CFT073
cguugccgguuaucccgcu

SEQ ID NO: 2636972 - RNA, 17 nt, Escherichia coli CFT073
cguugcgccaaacguca

SEQ ID NO: 2636973 - RNA, 18 nt, Escherichia coli CFT073
cguugcggcuccagacgc

SEQ ID NO: 2636974 - RNA, 15 nt, Escherichia coli CFT073
cguugcggucugcca

SEQ ID NO: 2636975 - RNA, 16 nt, Escherichia coli CFT073
cguugcguugccgcca

SEQ ID NO: 2636976 - RNA, 12 nt, Escherichia coli CFT073
cguugcucagaa

SEQ ID NO: 2636977 - RNA, 18 nt, Escherichia coli CFT073
cguugcucaugcaacaca

SEQ ID NO: 2636978 - RNA, 20 nt, Escherichia coli CFT073
cguugcuggcaaucaccucu

SEQ ID NO: 2636979 - RNA, 15 nt, Escherichia coli CFT073
cguugcugucgcgca

SEQ ID NO: 2636980 - RNA, 16 nt, Escherichia coli CFT073
cguugcugucgcgcag

SEQ ID NO: 2636981 - RNA, 16 nt, Escherichia coli CFT073
cguugcuucacgcggg

SEQ ID NO: 2636982 - RNA, 13 nt, Escherichia coli CFT073
cguuggcaucaag

SEQ ID NO: 2636983 - RNA, 14 nt, Escherichia coli CFT073
cguuggcauuucga

SEQ ID NO: 2636984 - RNA, 15 nt, Escherichia coli CFT073
cguuggcggcgugac

SEQ ID NO: 2636985 - RNA, 20 nt, Escherichia coli CFT073
cguugguuugauagcaaugc

SEQ ID NO: 2636986 - RNA, 21 nt, Escherichia coli CFT073
cguugguuugauagcaaugcc

SEQ ID NO: 2636987 - RNA, 23 nt, Escherichia coli CFT073
cguuguaacuucuuuacuggcuu

SEQ ID NO: 2636988 - RNA, 16 nt, Escherichia coli CFT073
cguuguagcuuuuucc

SEQ ID NO: 2636989 - RNA, 16 nt, Escherichia coli CFT073
cguugucuggcuggug

SEQ ID NO: 2636990 - RNA, 19 nt, Escherichia coli CFT073
cguugucuguaauguccau

SEQ ID NO: 2636991 - RNA, 13 nt, Escherichia coli CFT073
cguugugcgaucc

SEQ ID NO: 2636992 - RNA, 20 nt, Escherichia coli CFT073
cguugugcgccaguucaucc

SEQ ID NO: 2636993 - RNA, 19 nt, Escherichia coli CFT073
cguugugguaaagcggcga

SEQ ID NO: 2636994 - RNA, 16 nt, Escherichia coli CFT073
cguuguuaaggguaaa

SEQ ID NO: 2636995 - RNA, 18 nt, Escherichia coli CFT073
cguuguuuacgccggaug

SEQ ID NO: 2636996 - RNA, 12 nt, Escherichia coli CFT073
cguuuaaucgcc

SEQ ID NO: 2636997 - RNA, 20 nt, Escherichia coli CFT073
cguuuaccucgucaccaccu

SEQ ID NO: 2636998 - RNA, 16 nt, Escherichia coli CFT073
cguuuacgcagguucu

SEQ ID NO: 2636999 - RNA, 18 nt, Escherichia coli CFT073
cguuuaggcgcaggauaa

SEQ ID NO: 2637000 - RNA, 20 nt, Escherichia coli CFT073
cguuuaugucgcauccugca

SEQ ID NO: 2637001 - RNA, 15 nt, Escherichia coli CFT073
cguuucaaaaacaaa

SEQ ID NO: 2637002 - RNA, 17 nt, Escherichia coli CFT073
cguuucaaacaggcugc

SEQ ID NO: 2637003 - RNA, 19 nt, Escherichia coli CFT073
cguuucacauucuccgccg

SEQ ID NO: 2637004 - RNA, 20 nt, Escherichia coli CFT073
cguuucacauucuccgccga

SEQ ID NO: 2637005 - RNA, 18 nt, Escherichia coli CFT073
cguuucaccaccacuucu

SEQ ID NO: 2637006 - RNA, 20 nt, Escherichia coli CFT073
cguuucaccucuuucaccaa

SEQ ID NO: 2637007 - RNA, 20 nt, Escherichia coli CFT073
cguuucaugccauccgcauc

SEQ ID NO: 2637008 - RNA, 17 nt, Escherichia coli CFT073
cguuuccagcaguucca

SEQ ID NO: 2637009 - RNA, 16 nt, Escherichia coli CFT073
cguuuccauaaccgcu

SEQ ID NO: 2637010 - RNA, 18 nt, Escherichia coli CFT073
cguuuccauaucgcuggc

SEQ ID NO: 2637011 - RNA, 15 nt, Escherichia coli CFT073
cguuucgcugcgucu

SEQ ID NO: 2637012 - RNA, 19 nt, Escherichia coli CFT073
cuaacucuugccagauuuu

SEQ ID NO: 2637013 - RNA, 19 nt, Escherichia coli CFT073
cuaacugacuuucuuuucc

SEQ ID NO: 2637014 - RNA, 21 nt, Escherichia coli CFT073
cuaacugcugcggaauagcaa

SEQ ID NO: 2637015 - RNA, 19 nt, Escherichia coli CFT073
cuaacuguuucgcggcaaa

SEQ ID NO: 2637016 - RNA, 23 nt, Escherichia coli CFT073
cuaacuguuucgcggcaaacugc

SEQ ID NO: 2637017 - RNA, 18 nt, Escherichia coli CFT073
cuaacuucgccaucagcg

SEQ ID NO: 2637018 - RNA, 15 nt, Escherichia coli CFT073
cuaacuucuuuuucg

SEQ ID NO: 2637019 - RNA, 15 nt, Escherichia coli CFT073
cuaagaagucauugg

SEQ ID NO: 2637020 - RNA, 15 nt, Escherichia coli CFT073
cuaagcacgauauca

SEQ ID NO: 2637021 - RNA, 20 nt, Escherichia coli CFT073
cuaagcaggguugcagcgga

SEQ ID NO: 2637022 - RNA, 15 nt, Escherichia coli CFT073
cuaagccauuuaacu

SEQ ID NO: 2637023 - RNA, 18 nt, Escherichia coli CFT073
cuaagccccugagcgaau

SEQ ID NO: 2637024 - RNA, 22 nt, Escherichia coli CFT073
cuaagccccugagcgaauaccc

SEQ ID NO: 2637025 - RNA, 23 nt, Escherichia coli CFT073
cuaagcggcuccgguccaagaug

SEQ ID NO: 2637026 - RNA, 17 nt, Escherichia coli CFT073
cuaagcuacguagcuca

SEQ ID NO: 2637027 - RNA, 15 nt, Escherichia coli CFT073
cuaagcugcgggaaa

SEQ ID NO: 2637028 - RNA, 21 nt, Escherichia coli CFT073
cuaaggguaaaacgacuggcc

SEQ ID NO: 2637029 - RNA, 17 nt, Escherichia coli CFT073
cuaaggucaccaguuca

SEQ ID NO: 2637030 - RNA, 12 nt, Escherichia coli CFT073
cuaauaaacauu

SEQ ID NO: 2637031 - RNA, 14 nt, Escherichia coli CFT073
cuaauaaacauugg

SEQ ID NO: 2637032 - RNA, 17 nt, Escherichia coli CFT073
cuaauaauguaauaugc

SEQ ID NO: 2637033 - RNA, 15 nt, Escherichia coli CFT073
cuaauaccagaacug

SEQ ID NO: 2637034 - RNA, 22 nt, Escherichia coli CFT073
cuaauaccagaacugaagauuc

SEQ ID NO: 2637035 - RNA, 21 nt, Escherichia coli CFT073
cuaauagcaaaauauaaaccg

SEQ ID NO: 2637036 - RNA, 14 nt, Escherichia coli CFT073
cuaauagcgcagcg

SEQ ID NO: 2637037 - RNA, 13 nt, Escherichia coli CFT073
cuaauaucaacgc

SEQ ID NO: 2637038 - RNA, 21 nt, Escherichia coli CFT073
cuaauaucaacgcuauuugcu

SEQ ID NO: 2637039 - RNA, 22 nt, Escherichia coli CFT073
cuaauauucuuuuuuuucacau

SEQ ID NO: 2637040 - RNA, 13 nt, Escherichia coli CFT073
cuaauauuuugug

SEQ ID NO: 2637041 - RNA, 18 nt, Escherichia coli CFT073
cuaauauuuugugauuua

SEQ ID NO: 2637042 - RNA, 21 nt, Escherichia coli CFT073
cuaaucaucaucagcgcuuua

SEQ ID NO: 2637043 - RNA, 18 nt, Escherichia coli CFT073
cuaaucaucuguugugcc

SEQ ID NO: 2637044 - RNA, 19 nt, Escherichia coli CFT073
cuaaucgagccgauuaaaa

SEQ ID NO: 2637045 - RNA, 17 nt, Escherichia coli CFT073
cuaaucgcuuuauagca

SEQ ID NO: 2637046 - RNA, 11 nt, Escherichia coli CFT073
cuaaucugaac

SEQ ID NO: 2637047 - RNA, 23 nt, Escherichia coli CFT073
cuaaucuggcggaucugaucagc

SEQ ID NO: 2637048 - RNA, 14 nt, Escherichia coli CFT073
cuaaugauucauaa

SEQ ID NO: 2637049 - RNA, 18 nt, Escherichia coli CFT073
cuaaugauucauaaacaa

SEQ ID NO: 2637050 - RNA, 12 nt, Escherichia coli CFT073
cuaaugccaacg

SEQ ID NO: 2637051 - RNA, 15 nt, Escherichia coli CFT073
cuaauguagcgacca

SEQ ID NO: 2637052 - RNA, 22 nt, Escherichia coli CFT073
cuaauguagcgaccauaacagc

SEQ ID NO: 2637053 - RNA, 21 nt, Escherichia coli CFT073
cuaaugucgugguacugccgg

SEQ ID NO: 2637054 - RNA, 21 nt, Escherichia coli CFT073
cuaauuauuaccgucagaaau

SEQ ID NO: 2637055 - RNA, 16 nt, Escherichia coli CFT073
cuaauuauuacucaac

SEQ ID NO: 2637056 - RNA, 20 nt, Escherichia coli CFT073
cuaauuauuacucaacaggu

SEQ ID NO: 2637057 - RNA, 15 nt, Escherichia coli CFT073
cuaauuuaucggcgu

SEQ ID NO: 2637058 - RNA, 15 nt, Escherichia coli CFT073
cuaauuuuuugcgcc

SEQ ID NO: 2637059 - RNA, 20 nt, Escherichia coli CFT073
cuacaaaaaaagccacggaa

SEQ ID NO: 2637060 - RNA, 23 nt, Escherichia coli CFT073
cuacaaaaucaugcaaauucaau

SEQ ID NO: 2637061 - RNA, 12 nt, Escherichia coli CFT073
cuacaaaccauc

SEQ ID NO: 2637062 - RNA, 23 nt, Escherichia coli CFT073
cuacaacaaccuuuguauuuuuc

SEQ ID NO: 2637063 - RNA, 12 nt, Escherichia coli CFT073
cuacaagagguc

SEQ ID NO: 2637064 - RNA, 13 nt, Escherichia coli CFT073
cuacaagcagaga

SEQ ID NO: 2637065 - RNA, 14 nt, Escherichia coli CFT073
cuacaagcagagag

SEQ ID NO: 2637066 - RNA, 22 nt, Escherichia coli CFT073
cuacaaucccguugaaaaugcu

SEQ ID NO: 2637067 - RNA, 13 nt, Escherichia coli CFT073
cuacacaccuucu

SEQ ID NO: 2637068 - RNA, 16 nt, Escherichia coli CFT073
cuacacgcccgcgaag

SEQ ID NO: 2637069 - RNA, 14 nt, Escherichia coli CFT073
cuacagaacgcugc

SEQ ID NO: 2637070 - RNA, 22 nt, Escherichia coli CFT073
cuacagaacgcugcaauuuauu

SEQ ID NO: 2637071 - RNA, 18 nt, Escherichia coli CFT073
cuacaggcggugucggaa

SEQ ID NO: 2637072 - RNA, 15 nt, Escherichia coli CFT073
cuacagugccccaaa

SEQ ID NO: 2637073 - RNA, 16 nt, Escherichia coli CFT073
cuacagugccccaaau

SEQ ID NO: 2637074 - RNA, 22 nt, Escherichia coli CFT073
cuacagugccccaaaugucgga

SEQ ID NO: 2637075 - RNA, 23 nt, Escherichia coli CFT073
cuacagugccccaaaugucggau

SEQ ID NO: 2637076 - RNA, 22 nt, Escherichia coli CFT073
cuacaucaggcagaacgccaug

SEQ ID NO: 2637077 - RNA, 18 nt, Escherichia coli CFT073
cuacaugccaucacaccu

SEQ ID NO: 2637078 - RNA, 14 nt, Escherichia coli CFT073
cuaccaacgcaccc

SEQ ID NO: 2637079 - RNA, 20 nt, Escherichia coli CFT073
cuaccaacgcacccgcgccg

SEQ ID NO: 2637080 - RNA, 19 nt, Escherichia coli CFT073
cuaccaaucagauugauca

SEQ ID NO: 2637081 - RNA, 13 nt, Escherichia coli CFT073
cuaccacuuccca

SEQ ID NO: 2637082 - RNA, 15 nt, Escherichia coli CFT073
cuaccagaccgcaca

SEQ ID NO: 2637083 - RNA, 18 nt, Escherichia coli CFT073
cuaccagcugaaaucacc

SEQ ID NO: 2637084 - RNA, 17 nt, Escherichia coli CFT073
cuaccaguagugaaaaa

SEQ ID NO: 2637085 - RNA, 23 nt, Escherichia coli CFT073
cuaccaguagugaaaaaagcaag

SEQ ID NO: 2637086 - RNA, 22 nt, Escherichia coli CFT073
cuaccagugccagaacagaaau

SEQ ID NO: 2637087 - RNA, 16 nt, Escherichia coli CFT073
cuaccaguuccagcgc

SEQ ID NO: 2637088 - RNA, 15 nt, Escherichia coli CFT073
cuaccaucgacacca

SEQ ID NO: 2637089 - RNA, 17 nt, Escherichia coli CFT073
cuaccaugaucugcaaa

SEQ ID NO: 2637090 - RNA, 23 nt, Escherichia coli CFT073
cuaccaugaucugcaaauucaau

SEQ ID NO: 2637091 - RNA, 21 nt, Escherichia coli CFT073
cuacccaaccgauaaccacgc

SEQ ID NO: 2637092 - RNA, 16 nt, Escherichia coli CFT073
cuacccaugaagaaaa

SEQ ID NO: 2637093 - RNA, 16 nt, Escherichia coli CFT073
cuacccgauaggcuuc

SEQ ID NO: 2637094 - RNA, 12 nt, Escherichia coli CFT073
cuacccgccagu

SEQ ID NO: 2637095 - RNA, 13 nt, Escherichia coli CFT073
cuacccgcgcagu

SEQ ID NO: 2637096 - RNA, 12 nt, Escherichia coli CFT073
cuacccgguucg

SEQ ID NO: 2637097 - RNA, 13 nt, Escherichia coli CFT073
cuaccgaccagac

SEQ ID NO: 2637098 - RNA, 21 nt, Escherichia coli CFT073
cuaccgcaccuuccggaauag

SEQ ID NO: 2637099 - RNA, 22 nt, Escherichia coli CFT073
cuaccgccaguaagguaacgcu

SEQ ID NO: 2637100 - RNA, 20 nt, Escherichia coli CFT073
cuaccgcccugagcaucaau

SEQ ID NO: 2637101 - RNA, 15 nt, Escherichia coli CFT073
cuaccggaaucgcgc

SEQ ID NO: 2637102 - RNA, 22 nt, Escherichia coli CFT073
cuaccguugaggcgaucgucgc

SEQ ID NO: 2637103 - RNA, 14 nt, Escherichia coli CFT073
cuaccugccgccac

SEQ ID NO: 2637104 - RNA, 16 nt, Escherichia coli CFT073
cuaccugcucgucauc

SEQ ID NO: 2637105 - RNA, 19 nt, Escherichia coli CFT073
cuaccugcucgucauccgc

SEQ ID NO: 2637106 - RNA, 19 nt, Escherichia coli CFT073
cuaccuggcuuuacuuaac

SEQ ID NO: 2637107 - RNA, 19 nt, Escherichia coli CFT073
cuaccuggucaccgacaac

SEQ ID NO: 2637108 - RNA, 14 nt, Escherichia coli CFT073
cuaccuuauccagc

SEQ ID NO: 2637109 - RNA, 18 nt, Escherichia coli CFT073
cuaccuuauccagcagau

SEQ ID NO: 2637110 - RNA, 20 nt, Escherichia coli CFT073
cuacgaacugagacugucug

SEQ ID NO: 2637111 - RNA, 13 nt, Escherichia coli CFT073
cuacgacuuucuc

SEQ ID NO: 2637112 - RNA, 12 nt, Escherichia coli CFT073
cuacgcaaagag

SEQ ID NO: 2637113 - RNA, 14 nt, Escherichia coli CFT073
cuacgcaucaugcc

SEQ ID NO: 2637114 - RNA, 12 nt, Escherichia coli CFT073
cuacgccacagc

SEQ ID NO: 2637115 - RNA, 15 nt, Escherichia coli CFT073
cuacgccagacagcg

SEQ ID NO: 2637116 - RNA, 22 nt, Escherichia coli CFT073
cuacgccaucaguuucagagcg

SEQ ID NO: 2637117 - RNA, 15 nt, Escherichia coli CFT073
cuacgccuaccacca

SEQ ID NO: 2637118 - RNA, 21 nt, Escherichia coli CFT073
cuacgcucucuucaaacgcuu

SEQ ID NO: 2637119 - RNA, 17 nt, Escherichia coli CFT073
cuacgcuuaucaggccu

SEQ ID NO: 2637120 - RNA, 15 nt, Escherichia coli CFT073
cucaacgccgcacag

SEQ ID NO: 2637121 - RNA, 13 nt, Escherichia coli CFT073
cucaacgccugcu

SEQ ID NO: 2637122 - RNA, 19 nt, Escherichia coli CFT073
cucaacgguccaaugguca

SEQ ID NO: 2637123 - RNA, 23 nt, Escherichia coli CFT073
cucaacggugaccucagguucaa

SEQ ID NO: 2637124 - RNA, 14 nt, Escherichia coli CFT073
cucaacuuccugaa

SEQ ID NO: 2637125 - RNA, 15 nt, Escherichia coli CFT073
cucaacuuccugaau

SEQ ID NO: 2637126 - RNA, 20 nt, Escherichia coli CFT073
cucaacuugcucaagccaga

SEQ ID NO: 2637127 - RNA, 22 nt, Escherichia coli CFT073
cucaacuuucuuggcacccagc

SEQ ID NO: 2637128 - RNA, 15 nt, Escherichia coli CFT073
cucaagaaugaccgc

SEQ ID NO: 2637129 - RNA, 15 nt, Escherichia coli CFT073
cucaagcaaucaagc

SEQ ID NO: 2637130 - RNA, 17 nt, Escherichia coli CFT073
cucaagcacccaaugcc

SEQ ID NO: 2637131 - RNA, 18 nt, Escherichia coli CFT073
cucaagcacccaaugcca

SEQ ID NO: 2637132 - RNA, 18 nt, Escherichia coli CFT073
cucaagccacuuccuuua

SEQ ID NO: 2637133 - RNA, 23 nt, Escherichia coli CFT073
cucaagccagauauuaagcggca

SEQ ID NO: 2637134 - RNA, 22 nt, Escherichia coli CFT073
cucaagcguugcuucacgcggg

SEQ ID NO: 2637135 - RNA, 21 nt, Escherichia coli CFT073
cucaagcucguugguuccacg

SEQ ID NO: 2637136 - RNA, 23 nt, Escherichia coli CFT073
cucaagcugaccgauaaccugcc

SEQ ID NO: 2637137 - RNA, 14 nt, Escherichia coli CFT073
cucaaguugcgaaa

SEQ ID NO: 2637138 - RNA, 21 nt, Escherichia coli CFT073
cucaaguugcgaaagcgagca

SEQ ID NO: 2637139 - RNA, 21 nt, Escherichia coli CFT073
cucaauaaucauucgcccgcc

SEQ ID NO: 2637140 - RNA, 23 nt, Escherichia coli CFT073
cucaauaaucauucgcccgccga

SEQ ID NO: 2637141 - RNA, 19 nt, Escherichia coli CFT073
cucaauaauuucuucauug

SEQ ID NO: 2637142 - RNA, 15 nt, Escherichia coli CFT073
cucaauauccugacc

SEQ ID NO: 2637143 - RNA, 13 nt, Escherichia coli CFT073
cucaaucaaaaga

SEQ ID NO: 2637144 - RNA, 14 nt, Escherichia coli CFT073
cucaaucaccacca

SEQ ID NO: 2637145 - RNA, 16 nt, Escherichia coli CFT073
cucaaucggaaaacaa

SEQ ID NO: 2637146 - RNA, 20 nt, Escherichia coli CFT073
cucaaucggaaaacaaccgc

SEQ ID NO: 2637147 - RNA, 16 nt, Escherichia coli CFT073
cucaaucugcgcuucu

SEQ ID NO: 2637148 - RNA, 20 nt, Escherichia coli CFT073
cucaaugaugccgccacagc

SEQ ID NO: 2637149 - RNA, 18 nt, Escherichia coli CFT073
cucaaugguguuuuccac

SEQ ID NO: 2637150 - RNA, 15 nt, Escherichia coli CFT073
cucaauguugcugcu

SEQ ID NO: 2637151 - RNA, 18 nt, Escherichia coli CFT073
cucaauuuauauucacuu

SEQ ID NO: 2637152 - RNA, 13 nt, Escherichia coli CFT073
cucacaaucaucg

SEQ ID NO: 2637153 - RNA, 14 nt, Escherichia coli CFT073
cucacacagcuuuc

SEQ ID NO: 2637154 - RNA, 15 nt, Escherichia coli CFT073
cucacacagcuuucu

SEQ ID NO: 2637155 - RNA, 17 nt, Escherichia coli CFT073
cucacaccacaacagcc

SEQ ID NO: 2637156 - RNA, 14 nt, Escherichia coli CFT073
cucacaccaugcca

SEQ ID NO: 2637157 - RNA, 18 nt, Escherichia coli CFT073
cucacaccaugccagaaa

SEQ ID NO: 2637158 - RNA, 22 nt, Escherichia coli CFT073
cucacagaggucuuuucucguu

SEQ ID NO: 2637159 - RNA, 19 nt, Escherichia coli CFT073
cucacagaguauuuccagc

SEQ ID NO: 2637160 - RNA, 23 nt, Escherichia coli CFT073
cucacagaguauuuccagcucaa

SEQ ID NO: 2637161 - RNA, 23 nt, Escherichia coli CFT073
cucacagggcugcugaugcgccg

SEQ ID NO: 2637162 - RNA, 12 nt, Escherichia coli CFT073
cucacauccagc

SEQ ID NO: 2637163 - RNA, 17 nt, Escherichia coli CFT073
cucaccaaucggcagaa

SEQ ID NO: 2637164 - RNA, 13 nt, Escherichia coli CFT073
cucaccaucaagu

SEQ ID NO: 2637165 - RNA, 17 nt, Escherichia coli CFT073
cucaccauuggcauaca

SEQ ID NO: 2637166 - RNA, 16 nt, Escherichia coli CFT073
cucacccagggaaagg

SEQ ID NO: 2637167 - RNA, 16 nt, Escherichia coli CFT073
cucacccccaucagca

SEQ ID NO: 2637168 - RNA, 15 nt, Escherichia coli CFT073
cucaccgcuggcgua

SEQ ID NO: 2637169 - RNA, 16 nt, Escherichia coli CFT073
cucaccggcuccaggc

SEQ ID NO: 2637170 - RNA, 16 nt, Escherichia coli CFT073
cucaccguugaaaucg

SEQ ID NO: 2637171 - RNA, 13 nt, Escherichia coli CFT073
cucaccugaguac

SEQ ID NO: 2637172 - RNA, 20 nt, Escherichia coli CFT073
cucaccugaguaccuugcug

SEQ ID NO: 2637173 - RNA, 15 nt, Escherichia coli CFT073
cucaccuuccacgcg

SEQ ID NO: 2637174 - RNA, 19 nt, Escherichia coli CFT073
cucaccuuuaaacaggccg

SEQ ID NO: 2637175 - RNA, 20 nt, Escherichia coli CFT073
cucacgauuguuaaucacau

SEQ ID NO: 2637176 - RNA, 13 nt, Escherichia coli CFT073
cucacgcacuucc

SEQ ID NO: 2637177 - RNA, 14 nt, Escherichia coli CFT073
cucacgcacuuccg

SEQ ID NO: 2637178 - RNA, 14 nt, Escherichia coli CFT073
cucacgcagcggcg

SEQ ID NO: 2637179 - RNA, 14 nt, Escherichia coli CFT073
cucacgcagcuucu

SEQ ID NO: 2637180 - RNA, 15 nt, Escherichia coli CFT073
cucacgcaucaacgc

SEQ ID NO: 2637181 - RNA, 14 nt, Escherichia coli CFT073
cucacgcauucucu

SEQ ID NO: 2637182 - RNA, 20 nt, Escherichia coli CFT073
cucacgguuaauggccggaa

SEQ ID NO: 2637183 - RNA, 19 nt, Escherichia coli CFT073
cucacuaccagugccagaa

SEQ ID NO: 2637184 - RNA, 12 nt, Escherichia coli CFT073
cucacucugcac

SEQ ID NO: 2637185 - RNA, 20 nt, Escherichia coli CFT073
cucacuuaaagcaacaccau

SEQ ID NO: 2637186 - RNA, 23 nt, Escherichia coli CFT073
cucacuuaaagccgcuuccgggc

SEQ ID NO: 2637187 - RNA, 16 nt, Escherichia coli CFT073
cucacuucacgcugcc

SEQ ID NO: 2637188 - RNA, 14 nt, Escherichia coli CFT073
cucacuugagguaa

SEQ ID NO: 2637189 - RNA, 13 nt, Escherichia coli CFT073
cucacuuuguagg

SEQ ID NO: 2637190 - RNA, 14 nt, Escherichia coli CFT073
cucacuuuguaggc

SEQ ID NO: 2637191 - RNA, 17 nt, Escherichia coli CFT073
cucacuuuguaggccug

SEQ ID NO: 2637192 - RNA, 18 nt, Escherichia coli CFT073
cucacuuuguaggccuga

SEQ ID NO: 2637193 - RNA, 19 nt, Escherichia coli CFT073
cucacuuuguaggccugau

SEQ ID NO: 2637194 - RNA, 21 nt, Escherichia coli CFT073
cucacuuuguaggccugauaa

SEQ ID NO: 2637195 - RNA, 13 nt, Escherichia coli CFT073
cucacuuuuccgc

SEQ ID NO: 2637196 - RNA, 16 nt, Escherichia coli CFT073
cucagaaucacgccaa

SEQ ID NO: 2637197 - RNA, 16 nt, Escherichia coli CFT073
cucagacucauuaaaa

SEQ ID NO: 2637198 - RNA, 13 nt, Escherichia coli CFT073
cucagagaaucau

SEQ ID NO: 2637199 - RNA, 20 nt, Escherichia coli CFT073
cucagagaggcuuuggcacc

SEQ ID NO: 2637200 - RNA, 14 nt, Escherichia coli CFT073
cucagaguaccgau

SEQ ID NO: 2637201 - RNA, 15 nt, Escherichia coli CFT073
cucagcaacuuccug

SEQ ID NO: 2637202 - RNA, 20 nt, Escherichia coli CFT073
cucagcaauauaggccgccg

SEQ ID NO: 2637203 - RNA, 19 nt, Escherichia coli CFT073
cucagcacaaccaccugau

SEQ ID NO: 2637204 - RNA, 15 nt, Escherichia coli CFT073
cucagcaccccgagg

SEQ ID NO: 2637205 - RNA, 12 nt, Escherichia coli CFT073
cucagcaguuuc

SEQ ID NO: 2637206 - RNA, 15 nt, Escherichia coli CFT073
cucagcaguuucggc

SEQ ID NO: 2637207 - RNA, 13 nt, Escherichia coli CFT073
cucagcauaugcu

SEQ ID NO: 2637208 - RNA, 15 nt, Escherichia coli CFT073
cucagcgccugcugc

SEQ ID NO: 2637209 - RNA, 23 nt, Escherichia coli CFT073
cucaggccgauuucaugaagcug

SEQ ID NO: 2637210 - RNA, 18 nt, Escherichia coli CFT073
cucaggcgaggcagacug

SEQ ID NO: 2637211 - RNA, 16 nt, Escherichia coli CFT073
cucaggcuggcugacc

SEQ ID NO: 2637212 - RNA, 19 nt, Escherichia coli CFT073
cucagguugauagaaauau

SEQ ID NO: 2637213 - RNA, 19 nt, Escherichia coli CFT073
cucagucggcgcuuuugca

SEQ ID NO: 2637214 - RNA, 18 nt, Escherichia coli CFT073
cucagugaccgucaugcc

SEQ ID NO: 2637215 - RNA, 16 nt, Escherichia coli CFT073
cucagugucagguacu

SEQ ID NO: 2637216 - RNA, 20 nt, Escherichia coli CFT073
cucaguuccgggaucaccag

SEQ ID NO: 2637217 - RNA, 16 nt, Escherichia coli CFT073
cucaguugggccagaa

SEQ ID NO: 2637218 - RNA, 18 nt, Escherichia coli CFT073
cucaguugguagagcacg

SEQ ID NO: 2637219 - RNA, 23 nt, Escherichia coli CFT073
cucaguugguagagcacgaccuu

SEQ ID NO: 2637220 - RNA, 18 nt, Escherichia coli CFT073
cucauaaguuucccagcu

SEQ ID NO: 2637221 - RNA, 21 nt, Escherichia coli CFT073
cucauaauacaggcuacuccc

SEQ ID NO: 2637222 - RNA, 22 nt, Escherichia coli CFT073
cucauaauacaggcuacuccca

SEQ ID NO: 2637223 - RNA, 19 nt, Escherichia coli CFT073
cucauagggugugacgaca

SEQ ID NO: 2637224 - RNA, 20 nt, Escherichia coli CFT073
cucauaucuucuccugucau

SEQ ID NO: 2637225 - RNA, 14 nt, Escherichia coli CFT073
cucauaugcagcau

SEQ ID NO: 2637226 - RNA, 14 nt, Escherichia coli CFT073
cucauauuuaagcc

SEQ ID NO: 2637227 - RNA, 16 nt, Escherichia coli CFT073
cucaucaagcauuuuc

SEQ ID NO: 2637228 - RNA, 14 nt, Escherichia coli CFT073
cucaucaauacccg

SEQ ID NO: 2637229 - RNA, 20 nt, Escherichia coli CFT073
cuccgcuaaauccgccgcca

SEQ ID NO: 2637230 - RNA, 21 nt, Escherichia coli CFT073
cuccgcuaaauccgccgccac

SEQ ID NO: 2637231 - RNA, 19 nt, Escherichia coli CFT073
cuccgcucuucaucuucca

SEQ ID NO: 2637232 - RNA, 23 nt, Escherichia coli CFT073
cuccggaaaauuggggccguccc

SEQ ID NO: 2637233 - RNA, 18 nt, Escherichia coli CFT073
cuccggcacuuaauacca

SEQ ID NO: 2637234 - RNA, 12 nt, Escherichia coli CFT073
cuccggcagcag

SEQ ID NO: 2637235 - RNA, 22 nt, Escherichia coli CFT073
cuccggcagcuuuaccggcuuc

SEQ ID NO: 2637236 - RNA, 18 nt, Escherichia coli CFT073
cuccggccuacaaaacau

SEQ ID NO: 2637237 - RNA, 17 nt, Escherichia coli CFT073
cuccggccugcacugca

SEQ ID NO: 2637238 - RNA, 18 nt, Escherichia coli CFT073
cuccggcgcauccaugau

SEQ ID NO: 2637239 - RNA, 22 nt, Escherichia coli CFT073
cuccggcgcguugauaccgugc

SEQ ID NO: 2637240 - RNA, 20 nt, Escherichia coli CFT073
cuccggcguuuuggcuguga

SEQ ID NO: 2637241 - RNA, 16 nt, Escherichia coli CFT073
cuccgggcgcaccagu

SEQ ID NO: 2637242 - RNA, 18 nt, Escherichia coli CFT073
cuccggugguuaacgcug

SEQ ID NO: 2637243 - RNA, 17 nt, Escherichia coli CFT073
cuccgugucuuuauuuc

SEQ ID NO: 2637244 - RNA, 16 nt, Escherichia coli CFT073
cuccucaacaaucguc

SEQ ID NO: 2637245 - RNA, 19 nt, Escherichia coli CFT073
cuccucaucaauauugucu

SEQ ID NO: 2637246 - RNA, 14 nt, Escherichia coli CFT073
cuccucuuuuucca

SEQ ID NO: 2637247 - RNA, 23 nt, Escherichia coli CFT073
cuccugagaacuucggcagagaa

SEQ ID NO: 2637248 - RNA, 14 nt, Escherichia coli CFT073
cuccugaucaagcu

SEQ ID NO: 2637249 - RNA, 21 nt, Escherichia coli CFT073
cuccugccaguuauagcgcag

SEQ ID NO: 2637250 - RNA, 20 nt, Escherichia coli CFT073
cuccugcgccucuccacacg

SEQ ID NO: 2637251 - RNA, 19 nt, Escherichia coli CFT073
cuccugcggcgacaaaugu

SEQ ID NO: 2637252 - RNA, 18 nt, Escherichia coli CFT073
cuccugcggcuucaacug

SEQ ID NO: 2637253 - RNA, 21 nt, Escherichia coli CFT073
cuccuggcgaauuuguucccc

SEQ ID NO: 2637254 - RNA, 19 nt, Escherichia coli CFT073
cuccuuucugagcaucaca

SEQ ID NO: 2637255 - RNA, 22 nt, Escherichia coli CFT073
cucgaacgugaucgccccggaa

SEQ ID NO: 2637256 - RNA, 15 nt, Escherichia coli CFT073
cucgaaguuuuccuc

SEQ ID NO: 2637257 - RNA, 15 nt, Escherichia coli CFT073
cucgacaccaaacag

SEQ ID NO: 2637258 - RNA, 17 nt, Escherichia coli CFT073
cucgacagccucuucca

SEQ ID NO: 2637259 - RNA, 21 nt, Escherichia coli CFT073
cucgacagccucuuccagaga

SEQ ID NO: 2637260 - RNA, 21 nt, Escherichia coli CFT073
cucgaccuuacgcagucgcug

SEQ ID NO: 2637261 - RNA, 23 nt, Escherichia coli CFT073
cucgacuuuagucgcuugcagga

SEQ ID NO: 2637262 - RNA, 18 nt, Escherichia coli CFT073
cucgaggaaaugcaauua

SEQ ID NO: 2637263 - RNA, 19 nt, Escherichia coli CFT073
cucgaggcucugauugccu

SEQ ID NO: 2637264 - RNA, 13 nt, Escherichia coli CFT073
cucgauaugcgcu

SEQ ID NO: 2637265 - RNA, 14 nt, Escherichia coli CFT073
cucgcaaaauaaaa

SEQ ID NO: 2637266 - RNA, 24 nt, Escherichia coli CFT073
cucgcaagccgaauaacggcucaa

SEQ ID NO: 2637267 - RNA, 16 nt, Escherichia coli CFT073
cucgcacgccacgccg

SEQ ID NO: 2637268 - RNA, 13 nt, Escherichia coli CFT073
cucgcacuucuga

SEQ ID NO: 2637269 - RNA, 20 nt, Escherichia coli CFT073
cucgcagaaauaccccgcca

SEQ ID NO: 2637270 - RNA, 21 nt, Escherichia coli CFT073
cucgcagaaauaccccgccag

SEQ ID NO: 2637271 - RNA, 23 nt, Escherichia coli CFT073
cucgcagcccguggcgcgaaagu

SEQ ID NO: 2637272 - RNA, 22 nt, Escherichia coli CFT073
cucgcaggcggcaucgugucgg

SEQ ID NO: 2637273 - RNA, 18 nt, Escherichia coli CFT073
cucgcagguuauaccuuu

SEQ ID NO: 2637274 - RNA, 13 nt, Escherichia coli CFT073
cucgccaccggca

SEQ ID NO: 2637275 - RNA, 18 nt, Escherichia coli CFT073
cucgccagagagcggagc

SEQ ID NO: 2637276 - RNA, 16 nt, Escherichia coli CFT073
cucgccaguguucuuc

SEQ ID NO: 2637277 - RNA, 17 nt, Escherichia coli CFT073
cucgccauccuuaugca

SEQ ID NO: 2637278 - RNA, 14 nt, Escherichia coli CFT073
cucgccccuccggg

SEQ ID NO: 2637279 - RNA, 17 nt, Escherichia coli CFT073
cucgcccgucuuccaga

SEQ ID NO: 2637280 - RNA, 21 nt, Escherichia coli CFT073
cucgccgagcagcuguuucau

SEQ ID NO: 2637281 - RNA, 16 nt, Escherichia coli CFT073
cucgccgcaaaaccca

SEQ ID NO: 2637282 - RNA, 14 nt, Escherichia coli CFT073
cucgccgcgcucca

SEQ ID NO: 2637283 - RNA, 18 nt, Escherichia coli CFT073
cucgccgcgcuccaucau

SEQ ID NO: 2637284 - RNA, 20 nt, Escherichia coli CFT073
cucgccgcgcuccaucaugu

SEQ ID NO: 2637285 - RNA, 19 nt, Escherichia coli CFT073
cucgccggaugaaaaguca

SEQ ID NO: 2637286 - RNA, 18 nt, Escherichia coli CFT073
cucgccguucuccucaac

SEQ ID NO: 2637287 - RNA, 15 nt, Escherichia coli CFT073
cucgccuauacgcac

SEQ ID NO: 2637288 - RNA, 14 nt, Escherichia coli CFT073
cucgccuugcugcc

SEQ ID NO: 2637289 - RNA, 17 nt, Escherichia coli CFT073
cucgcgaaaagaaacug

SEQ ID NO: 2637290 - RNA, 18 nt, Escherichia coli CFT073
cucgcgauacgcuucaac

SEQ ID NO: 2637291 - RNA, 11 nt, Escherichia coli CFT073
cucgcggcgga

SEQ ID NO: 2637292 - RNA, 18 nt, Escherichia coli CFT073
cucgcgucgugguaucgc

SEQ ID NO: 2637293 - RNA, 22 nt, Escherichia coli CFT073
cucgcguucgauagcgcgccag

SEQ ID NO: 2637294 - RNA, 17 nt, Escherichia coli CFT073
cucgcguucuguugccg

SEQ ID NO: 2637295 - RNA, 15 nt, Escherichia coli CFT073
cucgcuaaccacugu

SEQ ID NO: 2637296 - RNA, 13 nt, Escherichia coli CFT073
cucgcuauuuaca

SEQ ID NO: 2637297 - RNA, 18 nt, Escherichia coli CFT073
cucgcucaguuucgcgua

SEQ ID NO: 2637298 - RNA, 14 nt, Escherichia coli CFT073
cucgcucaugccag

SEQ ID NO: 2637299 - RNA, 19 nt, Escherichia coli CFT073
cucgcucgagagagaaaau

SEQ ID NO: 2637300 - RNA, 17 nt, Escherichia coli CFT073
cucgcucucgccgcgcu

SEQ ID NO: 2637301 - RNA, 18 nt, Escherichia coli CFT073
cucgcugacaucaacaau

SEQ ID NO: 2637302 - RNA, 21 nt, Escherichia coli CFT073
cucgcugacugauauugcccg

SEQ ID NO: 2637303 - RNA, 19 nt, Escherichia coli CFT073
cucgcugauugccccuccg

SEQ ID NO: 2637304 - RNA, 13 nt, Escherichia coli CFT073
cucgcuggcaggc

SEQ ID NO: 2637305 - RNA, 20 nt, Escherichia coli CFT073
cucgcuggcguuguccgcca

SEQ ID NO: 2637306 - RNA, 19 nt, Escherichia coli CFT073
cucgcuuaagccaucauca

SEQ ID NO: 2637307 - RNA, 21 nt, Escherichia coli CFT073
cucgcuuaaugguaacgccag

SEQ ID NO: 2637308 - RNA, 20 nt, Escherichia coli CFT073
cucggaaauauucaacaccg

SEQ ID NO: 2637309 - RNA, 20 nt, Escherichia coli CFT073
cucggcaaggccaauacccg

SEQ ID NO: 2637310 - RNA, 20 nt, Escherichia coli CFT073
cucggcacccguaggccgga

SEQ ID NO: 2637311 - RNA, 17 nt, Escherichia coli CFT073
cucggccaccguccaga

SEQ ID NO: 2637312 - RNA, 16 nt, Escherichia coli CFT073
cucggcgagcaacgca

SEQ ID NO: 2637313 - RNA, 22 nt, Escherichia coli CFT073
cucggggcuuuucucuaucugc

SEQ ID NO: 2637314 - RNA, 20 nt, Escherichia coli CFT073
cucgguaaaacuaacgccag

SEQ ID NO: 2637315 - RNA, 21 nt, Escherichia coli CFT073
cucgguaacgucauugcaauc

SEQ ID NO: 2637316 - RNA, 21 nt, Escherichia coli CFT073
cucggucaccaugaacaccaa

SEQ ID NO: 2637317 - RNA, 20 nt, Escherichia coli CFT073
cucggucacugacaccagca

SEQ ID NO: 2637318 - RNA, 21 nt, Escherichia coli CFT073
cucggugaccgagcgcccgcc

SEQ ID NO: 2637319 - RNA, 21 nt, Escherichia coli CFT073
cucguagguuucugccagcgu

SEQ ID NO: 2637320 - RNA, 22 nt, Escherichia coli CFT073
cucgucaaacucauaaaccagc

SEQ ID NO: 2637321 - RNA, 20 nt, Escherichia coli CFT073
cucgucaaucugcuccauua

SEQ ID NO: 2637322 - RNA, 14 nt, Escherichia coli CFT073
cucgucaccaccuc

SEQ ID NO: 2637323 - RNA, 16 nt, Escherichia coli CFT073
cucgucacuuuucuua

SEQ ID NO: 2637324 - RNA, 23 nt, Escherichia coli CFT073
cucgucccaaaagcucggucauu

SEQ ID NO: 2637325 - RNA, 15 nt, Escherichia coli CFT073
cucgucccuuugccu

SEQ ID NO: 2637326 - RNA, 12 nt, Escherichia coli CFT073
cucgucgcgcac

SEQ ID NO: 2637327 - RNA, 23 nt, Escherichia coli CFT073
cucgucggcgguuuucaucaucc

SEQ ID NO: 2637328 - RNA, 17 nt, Escherichia coli CFT073
cucgugauaguccagcc

SEQ ID NO: 2637329 - RNA, 13 nt, Escherichia coli CFT073
cucgugcaccgcc

SEQ ID NO: 2637330 - RNA, 18 nt, Escherichia coli CFT073
cucgugcagaacauccag

SEQ ID NO: 2637331 - RNA, 20 nt, Escherichia coli CFT073
cucgugcagaacauccagcu

SEQ ID NO: 2637332 - RNA, 13 nt, Escherichia coli CFT073
cucgugccagagc

SEQ ID NO: 2637333 - RNA, 15 nt, Escherichia coli CFT073
cucgugcgcgggaug

SEQ ID NO: 2637334 - RNA, 18 nt, Escherichia coli CFT073
cucgugcgguaucaccac

SEQ ID NO: 2637335 - RNA, 21 nt, Escherichia coli CFT073
cucgugcgguaucaccaccca

SEQ ID NO: 2637336 - RNA, 19 nt, Escherichia coli CFT073
cucuucguuaauuucugcu

SEQ ID NO: 2637337 - RNA, 21 nt, Escherichia coli CFT073
cucuucuaaaucguaccagcg

SEQ ID NO: 2637338 - RNA, 17 nt, Escherichia coli CFT073
cucuucugauaaaugaa

SEQ ID NO: 2637339 - RNA, 14 nt, Escherichia coli CFT073
cucuucuggcacca

SEQ ID NO: 2637340 - RNA, 14 nt, Escherichia coli CFT073
cucuucuucaagcc

SEQ ID NO: 2637341 - RNA, 22 nt, Escherichia coli CFT073
cucuucuucacgauaaaucaga

SEQ ID NO: 2637342 - RNA, 13 nt, Escherichia coli CFT073
cucuucuuccgcu

SEQ ID NO: 2637343 - RNA, 14 nt, Escherichia coli CFT073
cucuucuucgcuca

SEQ ID NO: 2637344 - RNA, 21 nt, Escherichia coli CFT073
cucuucuuuugccuguugcac

SEQ ID NO: 2637345 - RNA, 16 nt, Escherichia coli CFT073
cucuugccagauuuuc

SEQ ID NO: 2637346 - RNA, 18 nt, Escherichia coli CFT073
cucuugccguguuauccg

SEQ ID NO: 2637347 - RNA, 22 nt, Escherichia coli CFT073
cucuugcuggcauuacaagaau

SEQ ID NO: 2637348 - RNA, 14 nt, Escherichia coli CFT073
cucuugucacuggc

SEQ ID NO: 2637349 - RNA, 14 nt, Escherichia coli CFT073
cucuuuauaaagua

SEQ ID NO: 2637350 - RNA, 16 nt, Escherichia coli CFT073
cucuuuauaaaguaaa

SEQ ID NO: 2637351 - RNA, 14 nt, Escherichia coli CFT073
cucuuucacuccau

SEQ ID NO: 2637352 - RNA, 21 nt, Escherichia coli CFT073
cucuuucacuccauugucuuu

SEQ ID NO: 2637353 - RNA, 14 nt, Escherichia coli CFT073
cucuuuccauucuu

SEQ ID NO: 2637354 - RNA, 15 nt, Escherichia coli CFT073
cucuuucccggcaau

SEQ ID NO: 2637355 - RNA, 13 nt, Escherichia coli CFT073
cucuuucuccagc

SEQ ID NO: 2637356 - RNA, 16 nt, Escherichia coli CFT073
cucuuucuucagcacg

SEQ ID NO: 2637357 - RNA, 14 nt, Escherichia coli CFT073
cucuuucuucgcgu

SEQ ID NO: 2637358 - RNA, 22 nt, Escherichia coli CFT073
cucuuucuucgcguuacggauc

SEQ ID NO: 2637359 - RNA, 21 nt, Escherichia coli CFT073
cucuuugaacagccagaagcc

SEQ ID NO: 2637360 - RNA, 17 nt, Escherichia coli CFT073
cucuuugggcagaaaau

SEQ ID NO: 2637361 - RNA, 21 nt, Escherichia coli CFT073
cucuuuguaggccugauaaga

SEQ ID NO: 2637362 - RNA, 21 nt, Escherichia coli CFT073
cucuuuugacgcccccagacu

SEQ ID NO: 2637363 - RNA, 19 nt, Escherichia coli CFT073
cucuuuuucggggcugugg

SEQ ID NO: 2637364 - RNA, 16 nt, Escherichia coli CFT073
cucuuuuuucagaaua

SEQ ID NO: 2637365 - RNA, 16 nt, Escherichia coli CFT073
cugaaaaaaagugcau

SEQ ID NO: 2637366 - RNA, 17 nt, Escherichia coli CFT073
cugaaaaaaagugcaua

SEQ ID NO: 2637367 - RNA, 15 nt, Escherichia coli CFT073
cugaaaaacgaacau

SEQ ID NO: 2637368 - RNA, 13 nt, Escherichia coli CFT073
cugaaaaaugagc

SEQ ID NO: 2637369 - RNA, 20 nt, Escherichia coli CFT073
cugaaaaaugagcgaacaau

SEQ ID NO: 2637370 - RNA, 23 nt, Escherichia coli CFT073
cugaaaaaugagcgaacaauaaa

SEQ ID NO: 2637371 - RNA, 12 nt, Escherichia coli CFT073
cugaaaaccagg

SEQ ID NO: 2637372 - RNA, 18 nt, Escherichia coli CFT073
cugaaaaucuucucucau

SEQ ID NO: 2637373 - RNA, 16 nt, Escherichia coli CFT073
cugaaaaugaaauaaa

SEQ ID NO: 2637374 - RNA, 19 nt, Escherichia coli CFT073
cugaaaaugaaauaaaaca

SEQ ID NO: 2637375 - RNA, 23 nt, Escherichia coli CFT073
cugaaaauuaacgggcaggucac

SEQ ID NO: 2637376 - RNA, 13 nt, Escherichia coli CFT073
cugaaaauugucu

SEQ ID NO: 2637377 - RNA, 20 nt, Escherichia coli CFT073
cugaaacaauuuaccgaccu

SEQ ID NO: 2637378 - RNA, 21 nt, Escherichia coli CFT073
cugaaagaacaccagcaccga

SEQ ID NO: 2637379 - RNA, 20 nt, Escherichia coli CFT073
cugaaagagucgccagcugc

SEQ ID NO: 2637380 - RNA, 18 nt, Escherichia coli CFT073
cugaaagcgaaccauagu

SEQ ID NO: 2637381 - RNA, 19 nt, Escherichia coli CFT073
cugaaagcgccgggaaugc

SEQ ID NO: 2637382 - RNA, 23 nt, Escherichia coli CFT073
cugaaagggaagggagcgccguc

SEQ ID NO: 2637383 - RNA, 16 nt, Escherichia coli CFT073
cugaaaggucaucauc

SEQ ID NO: 2637384 - RNA, 17 nt, Escherichia coli CFT073
cugaaaggucaucauca

SEQ ID NO: 2637385 - RNA, 20 nt, Escherichia coli CFT073
cugaaaucaccgccaccagc

SEQ ID NO: 2637386 - RNA, 22 nt, Escherichia coli CFT073
cugaaauguaaaaguugcaguc

SEQ ID NO: 2637387 - RNA, 21 nt, Escherichia coli CFT073
cugaaauuccugagaggauga

SEQ ID NO: 2637388 - RNA, 13 nt, Escherichia coli CFT073
cugaaauuuaucg

SEQ ID NO: 2637389 - RNA, 16 nt, Escherichia coli CFT073
cugaacaagcaagagu

SEQ ID NO: 2637390 - RNA, 20 nt, Escherichia coli CFT073
cugaacacauuugucggaug

SEQ ID NO: 2637391 - RNA, 12 nt, Escherichia coli CFT073
cugaacaccaga

SEQ ID NO: 2637392 - RNA, 15 nt, Escherichia coli CFT073
cugaacagaaaucug

SEQ ID NO: 2637393 - RNA, 11 nt, Escherichia coli CFT073
cugaacagcuu

SEQ ID NO: 2637394 - RNA, 14 nt, Escherichia coli CFT073
cugaacagcuuuuu

SEQ ID NO: 2637395 - RNA, 17 nt, Escherichia coli CFT073
cugaacagcuuuuuccu

SEQ ID NO: 2637396 - RNA, 14 nt, Escherichia coli CFT073
cugaacagucgcug

SEQ ID NO: 2637397 - RNA, 22 nt, Escherichia coli CFT073
cugaacauuuucuucugccagg

SEQ ID NO: 2637398 - RNA, 14 nt, Escherichia coli CFT073
cugaaccagcgccg

SEQ ID NO: 2637399 - RNA, 15 nt, Escherichia coli CFT073
cugaaccagcgccgg

SEQ ID NO: 2637400 - RNA, 19 nt, Escherichia coli CFT073
cugaaccaucgacguccaa

SEQ ID NO: 2637401 - RNA, 15 nt, Escherichia coli CFT073
cugaaccgccccggg

SEQ ID NO: 2637402 - RNA, 23 nt, Escherichia coli CFT073
cugaaccggucgugacugccgcc

SEQ ID NO: 2637403 - RNA, 11 nt, Escherichia coli CFT073
cugaacgccgg

SEQ ID NO: 2637404 - RNA, 14 nt, Escherichia coli CFT073
cugaacgccugcac

SEQ ID NO: 2637405 - RNA, 23 nt, Escherichia coli CFT073
cugaacgucuuugcgcuccauca

SEQ ID NO: 2637406 - RNA, 22 nt, Escherichia coli CFT073
cugaacgugcucugcgccgccu

SEQ ID NO: 2637407 - RNA, 16 nt, Escherichia coli CFT073
cugaacguucugcugu

SEQ ID NO: 2637408 - RNA, 14 nt, Escherichia coli CFT073
cugaacuuucucuc

SEQ ID NO: 2637409 - RNA, 22 nt, Escherichia coli CFT073
cugaagaaccaagccugcuggc

SEQ ID NO: 2637410 - RNA, 15 nt, Escherichia coli CFT073
cugaagaaguaaaac

SEQ ID NO: 2637411 - RNA, 21 nt, Escherichia coli CFT073
cugaagauugaacagcagaac

SEQ ID NO: 2637412 - RNA, 20 nt, Escherichia coli CFT073
cugaagcaacaguaauaaug

SEQ ID NO: 2637413 - RNA, 19 nt, Escherichia coli CFT073
cugaagcaguuucaccagc

SEQ ID NO: 2637414 - RNA, 20 nt, Escherichia coli CFT073
cugaagcaguuucaccagca

SEQ ID NO: 2637415 - RNA, 21 nt, Escherichia coli CFT073
cugaagcaguuucaccagcag

SEQ ID NO: 2637416 - RNA, 16 nt, Escherichia coli CFT073
cugaagccaugaccua

SEQ ID NO: 2637417 - RNA, 18 nt, Escherichia coli CFT073
cugaagcuaaaaccugca

SEQ ID NO: 2637418 - RNA, 19 nt, Escherichia coli CFT073
cugaagguaagcaacagau

SEQ ID NO: 2637419 - RNA, 20 nt, Escherichia coli CFT073
cugaagguaagcaacagaug

SEQ ID NO: 2637420 - RNA, 19 nt, Escherichia coli CFT073
cugaaggugccuuuauugc

SEQ ID NO: 2637421 - RNA, 18 nt, Escherichia coli CFT073
cugaaguggguaauguca

SEQ ID NO: 2637422 - RNA, 21 nt, Escherichia coli CFT073
cugaaguggguaaugucacac

SEQ ID NO: 2637423 - RNA, 11 nt, Escherichia coli CFT073
cugaauaaucg

SEQ ID NO: 2637424 - RNA, 19 nt, Escherichia coli CFT073
cugaauaaucguaaucagc

SEQ ID NO: 2637425 - RNA, 22 nt, Escherichia coli CFT073
cugaauaaucguaaucagcauc

SEQ ID NO: 2637426 - RNA, 23 nt, Escherichia coli CFT073
cugaauacacaucagaaacgcga

SEQ ID NO: 2637427 - RNA, 20 nt, Escherichia coli CFT073
cugaauacccgccagaaaag

SEQ ID NO: 2637428 - RNA, 15 nt, Escherichia coli CFT073
cugaauaucaucacc

SEQ ID NO: 2637429 - RNA, 20 nt, Escherichia coli CFT073
cugaauaucaucacccugcg

SEQ ID NO: 2637430 - RNA, 23 nt, Escherichia coli CFT073
cugaauaucaucacccugcgauu

SEQ ID NO: 2637431 - RNA, 18 nt, Escherichia coli CFT073
cugaauauccuguucaga

SEQ ID NO: 2637432 - RNA, 15 nt, Escherichia coli CFT073
cugaauaucuuucuc

SEQ ID NO: 2637433 - RNA, 20 nt, Escherichia coli CFT073
cugaauauucggcuccagau

SEQ ID NO: 2637434 - RNA, 24 nt, Escherichia coli CFT073
cugaauauucggcuccagauuacu

SEQ ID NO: 2637435 - RNA, 18 nt, Escherichia coli CFT073
cugaauauugccaauggu

SEQ ID NO: 2637436 - RNA, 19 nt, Escherichia coli CFT073
cugaaucacaauccgcucu

SEQ ID NO: 2637437 - RNA, 14 nt, Escherichia coli CFT073
cugaaugcugccuu

SEQ ID NO: 2637438 - RNA, 16 nt, Escherichia coli CFT073
cugaauggugaccugc

SEQ ID NO: 2637439 - RNA, 16 nt, Escherichia coli CFT073
cugaauuaacuuauca

SEQ ID NO: 2637440 - RNA, 21 nt, Escherichia coli CFT073
cugaauuaacuuaucaagaaa

SEQ ID NO: 2637441 - RNA, 22 nt, Escherichia coli CFT073
cugaauuaaguuuuccgcuucu

SEQ ID NO: 2637442 - RNA, 12 nt, Escherichia coli CFT073
cugaauuccccu

SEQ ID NO: 2637443 - RNA, 18 nt, Escherichia coli CFT073
cugaauugccagcaucag

SEQ ID NO: 2637444 - RNA, 12 nt, Escherichia coli CFT073
cugagaacaaga

SEQ ID NO: 2637445 - RNA, 21 nt, Escherichia coli CFT073
cugagaacaagauugccugau

SEQ ID NO: 2637446 - RNA, 22 nt, Escherichia coli CFT073
cugagaacaagauugccugaug

SEQ ID NO: 2637447 - RNA, 18 nt, Escherichia coli CFT073
cugagaacauaaacaccc

SEQ ID NO: 2637448 - RNA, 21 nt, Escherichia coli CFT073
cugagaacuucggcagagaaa

SEQ ID NO: 2637449 - RNA, 17 nt, Escherichia coli CFT073
cugagaauuccggcaga

SEQ ID NO: 2637450 - RNA, 20 nt, Escherichia coli CFT073
cugagaauuccggcagagaa

SEQ ID NO: 2637451 - RNA, 19 nt, Escherichia coli CFT073
cugagacugucuguccggg

SEQ ID NO: 2637452 - RNA, 15 nt, Escherichia coli CFT073
cugagauuacauugg

SEQ ID NO: 2637453 - RNA, 13 nt, Escherichia coli CFT073
cugagcaaacagu

SEQ ID NO: 2637454 - RNA, 21 nt, Escherichia coli CFT073
cugagcaacaauuuucccuuc

SEQ ID NO: 2637455 - RNA, 15 nt, Escherichia coli CFT073
cugagcaagccuuac

SEQ ID NO: 2637456 - RNA, 18 nt, Escherichia coli CFT073
cugagcaagccuuacuuc

SEQ ID NO: 2637457 - RNA, 21 nt, Escherichia coli CFT073
cugagcagcgauaucugccga

SEQ ID NO: 2637458 - RNA, 12 nt, Escherichia coli CFT073
cugagcaucaau

SEQ ID NO: 2637459 - RNA, 14 nt, Escherichia coli CFT073
cugagcaucacaua

SEQ ID NO: 2637460 - RNA, 22 nt, Escherichia coli CFT073
cugagcaucacauaaucgaaaa

SEQ ID NO: 2637461 - RNA, 18 nt, Escherichia coli CFT073
cugagccaguuuuucuuu

SEQ ID NO: 2637462 - RNA, 21 nt, Escherichia coli CFT073
cugagccaguuuuucuuuuuc

SEQ ID NO: 2637463 - RNA, 14 nt, Escherichia coli CFT073
cugagcccacuguu

SEQ ID NO: 2637464 - RNA, 21 nt, Escherichia coli CFT073
cugagcggcguacccuccggg

SEQ ID NO: 2637465 - RNA, 20 nt, Escherichia coli CFT073
cugagcgugccccugaauaa

SEQ ID NO: 2637466 - RNA, 21 nt, Escherichia coli CFT073
cugagcgugccccugaauaau

SEQ ID NO: 2637467 - RNA, 19 nt, Escherichia coli CFT073
cugaggaucgggcagugcu

SEQ ID NO: 2637468 - RNA, 23 nt, Escherichia coli CFT073
cugaggccggaugccgcugcuau

SEQ ID NO: 2637469 - RNA, 17 nt, Escherichia coli CFT073
cugaggccuacguucga

SEQ ID NO: 2637470 - RNA, 20 nt, Escherichia coli CFT073
cugagguaacucucaugcuu

SEQ ID NO: 2637471 - RNA, 15 nt, Escherichia coli CFT073
cugaguaaaucaccu

SEQ ID NO: 2637472 - RNA, 15 nt, Escherichia coli CFT073
cugaguaauagccug

SEQ ID NO: 2637473 - RNA, 16 nt, Escherichia coli CFT073
cugaguaauagccuga

SEQ ID NO: 2637474 - RNA, 18 nt, Escherichia coli CFT073
cugaguaauagccugaug

SEQ ID NO: 2637475 - RNA, 22 nt, Escherichia coli CFT073
cugagucggaacuuugcugcaa

SEQ ID NO: 2637476 - RNA, 19 nt, Escherichia coli CFT073
cugagugggcgucagcagu

SEQ ID NO: 2637477 - RNA, 17 nt, Escherichia coli CFT073
cugaguuaauuaaaucc

SEQ ID NO: 2637478 - RNA, 13 nt, Escherichia coli CFT073
cugaguuauuuca

SEQ ID NO: 2637479 - RNA, 16 nt, Escherichia coli CFT073
cugaguuauuucauua

SEQ ID NO: 2637480 - RNA, 16 nt, Escherichia coli CFT073
cugaguuucagaccaa

SEQ ID NO: 2637481 - RNA, 17 nt, Escherichia coli CFT073
cugaguuuucaguaccg

SEQ ID NO: 2637482 - RNA, 23 nt, Escherichia coli CFT073
cugauaaaaaacccgcuuuuuga

SEQ ID NO: 2637483 - RNA, 15 nt, Escherichia coli CFT073
cugauaaaccagacc

SEQ ID NO: 2637484 - RNA, 14 nt, Escherichia coli CFT073
cugauaaaucaccu

SEQ ID NO: 2637485 - RNA, 13 nt, Escherichia coli CFT073
cugauaacacagc

SEQ ID NO: 2637486 - RNA, 15 nt, Escherichia coli CFT073
cugauaaccuuccag

SEQ ID NO: 2637487 - RNA, 22 nt, Escherichia coli CFT073
cugauaacgccacgccaccagc

SEQ ID NO: 2637488 - RNA, 18 nt, Escherichia coli CFT073
cugauaacuuuuuauccg

SEQ ID NO: 2637489 - RNA, 11 nt, Escherichia coli CFT073
cugauaagaca

SEQ ID NO: 2637490 - RNA, 13 nt, Escherichia coli CFT073
cugauaagacacg

SEQ ID NO: 2637491 - RNA, 10 nt, Escherichia coli CFT073
cugauaagau

SEQ ID NO: 2637492 - RNA, 20 nt, Escherichia coli CFT073
cugauaagcguagcgcauca

SEQ ID NO: 2637493 - RNA, 22 nt, Escherichia coli CFT073
cugauaaggcggcucuggcggc

SEQ ID NO: 2637494 - RNA, 18 nt, Escherichia coli CFT073
cugauaaggcguuuacgc

SEQ ID NO: 2637495 - RNA, 22 nt, Escherichia coli CFT073
cugauaauaaauaacagugccg

SEQ ID NO: 2637496 - RNA, 15 nt, Escherichia coli CFT073
cugauaaucaucuuc

SEQ ID NO: 2637497 - RNA, 19 nt, Escherichia coli CFT073
cugauaauccagacuauuu

SEQ ID NO: 2637498 - RNA, 20 nt, Escherichia coli CFT073
cugauaaugcagauaacuua

SEQ ID NO: 2637499 - RNA, 17 nt, Escherichia coli CFT073
cugauacaccuucaucg

SEQ ID NO: 2637500 - RNA, 18 nt, Escherichia coli CFT073
cugauacccggcuaacag

SEQ ID NO: 2637501 - RNA, 16 nt, Escherichia coli CFT073
cugauacuauucauug

SEQ ID NO: 2637502 - RNA, 23 nt, Escherichia coli CFT073
cugauacuccaugaguaacaguc

SEQ ID NO: 2637503 - RNA, 16 nt, Escherichia coli CFT073
cugauacuuaucauca

SEQ ID NO: 2637504 - RNA, 15 nt, Escherichia coli CFT073
cugauagaacauguc

SEQ ID NO: 2637505 - RNA, 19 nt, Escherichia coli CFT073
cugauagaacugcggcagg

SEQ ID NO: 2637506 - RNA, 17 nt, Escherichia coli CFT073
cugauaguaguuugaug

SEQ ID NO: 2637507 - RNA, 13 nt, Escherichia coli CFT073
cugauaguuccag

SEQ ID NO: 2637508 - RNA, 12 nt, Escherichia coli CFT073
cugauaucaccu

SEQ ID NO: 2637509 - RNA, 16 nt, Escherichia coli CFT073
cugauaucaccugcuu

SEQ ID NO: 2637510 - RNA, 22 nt, Escherichia coli CFT073
cugauaucggcucauaaaaacu

SEQ ID NO: 2637511 - RNA, 19 nt, Escherichia coli CFT073
cugauauggugguaacuac

SEQ ID NO: 2637512 - RNA, 15 nt, Escherichia coli CFT073
cugauauucaggaug

SEQ ID NO: 2637513 - RNA, 15 nt, Escherichia coli CFT073
cugauauugcuccag

SEQ ID NO: 2637514 - RNA, 17 nt, Escherichia coli CFT073
cugauauuuaaacggug

SEQ ID NO: 2637515 - RNA, 19 nt, Escherichia coli CFT073
cugaucaauaaauuuuuuc

SEQ ID NO: 2637516 - RNA, 12 nt, Escherichia coli CFT073
cugaucaauaag

SEQ ID NO: 2637517 - RNA, 16 nt, Escherichia coli CFT073
cugaucaauuucugcg

SEQ ID NO: 2637518 - RNA, 11 nt, Escherichia coli CFT073
cugaucaccca

SEQ ID NO: 2637519 - RNA, 13 nt, Escherichia coli CFT073
cugaucaccguag

SEQ ID NO: 2637520 - RNA, 17 nt, Escherichia coli CFT073
cugaucaccguagaagg

SEQ ID NO: 2637521 - RNA, 20 nt, Escherichia coli CFT073
cugaucaccugcgauaaacc

SEQ ID NO: 2637522 - RNA, 21 nt, Escherichia coli CFT073
cugaucaccugcgauaaaccg

SEQ ID NO: 2637523 - RNA, 14 nt, Escherichia coli CFT073
cugaucaucgccca

SEQ ID NO: 2637524 - RNA, 19 nt, Escherichia coli CFT073
cugaucaucgcccaguuga

SEQ ID NO: 2637525 - RNA, 13 nt, Escherichia coli CFT073
cugauccgcuucg

SEQ ID NO: 2637526 - RNA, 17 nt, Escherichia coli CFT073
cugauccguaaaauacu

SEQ ID NO: 2637527 - RNA, 18 nt, Escherichia coli CFT073
cugauccugcaacaacac

SEQ ID NO: 2637528 - RNA, 22 nt, Escherichia coli CFT073
cugaucgagcaguaauccagca

SEQ ID NO: 2637529 - RNA, 16 nt, Escherichia coli CFT073
cugaucggcaaucacg

SEQ ID NO: 2637530 - RNA, 22 nt, Escherichia coli CFT073
cugaucugccagcagacgccgg

SEQ ID NO: 2637531 - RNA, 22 nt, Escherichia coli CFT073
cugaucuuuaaucgcuccggaa

SEQ ID NO: 2637532 - RNA, 14 nt, Escherichia coli CFT073
cugaucuuuaucaa

SEQ ID NO: 2637533 - RNA, 22 nt, Escherichia coli CFT073
cugaugaaagcaugucaggcag

SEQ ID NO: 2637534 - RNA, 22 nt, Escherichia coli CFT073
cugaugaagacagaccuggcgc

SEQ ID NO: 2637535 - RNA, 19 nt, Escherichia coli CFT073
cugaugaaguugaaaucac

SEQ ID NO: 2637536 - RNA, 20 nt, Escherichia coli CFT073
cugaugaauuuaucuuucag

SEQ ID NO: 2637537 - RNA, 20 nt, Escherichia coli CFT073
cugaugacaaagucuaaaaa

SEQ ID NO: 2637538 - RNA, 16 nt, Escherichia coli CFT073
cugaugacugaugcuu

SEQ ID NO: 2637539 - RNA, 18 nt, Escherichia coli CFT073
cugaugagcaaaucgcgg

SEQ ID NO: 2637540 - RNA, 21 nt, Escherichia coli CFT073
cugaugagcaaaucgcggcuu

SEQ ID NO: 2637541 - RNA, 16 nt, Escherichia coli CFT073
cugaugagcggagcac

SEQ ID NO: 2637542 - RNA, 14 nt, Escherichia coli CFT073
cugaugaucuaaaa

SEQ ID NO: 2637543 - RNA, 17 nt, Escherichia coli CFT073
cugaugaucuaaaagca

SEQ ID NO: 2637544 - RNA, 21 nt, Escherichia coli CFT073
cugaugauuugccgauaagca

SEQ ID NO: 2637545 - RNA, 14 nt, Escherichia coli CFT073
cugaugcaccuuca

SEQ ID NO: 2637546 - RNA, 14 nt, Escherichia coli CFT073
cugaugcagcguca

SEQ ID NO: 2637547 - RNA, 18 nt, Escherichia coli CFT073
cugaugcagcgucaguga

SEQ ID NO: 2637548 - RNA, 24 nt, Escherichia coli CFT073
cugaugcagcgucagugacggcuu

SEQ ID NO: 2637549 - RNA, 12 nt, Escherichia coli CFT073
cugaugccacug

SEQ ID NO: 2637550 - RNA, 15 nt, Escherichia coli CFT073
cugaugcgacgcuga

SEQ ID NO: 2637551 - RNA, 16 nt, Escherichia coli CFT073
cugaugcgacgcuggc

SEQ ID NO: 2637552 - RNA, 23 nt, Escherichia coli CFT073
cugcacugucccaaaaugucgga

SEQ ID NO: 2637553 - RNA, 23 nt, Escherichia coli CFT073
cugcacuuugugucagugucaga

SEQ ID NO: 2637554 - RNA, 14 nt, Escherichia coli CFT073
cugcagaaaaucca

SEQ ID NO: 2637555 - RNA, 18 nt, Escherichia coli CFT073
cugcagaggccgccgcaa

SEQ ID NO: 2637556 - RNA, 20 nt, Escherichia coli CFT073
cugcagauaacuggccagcg

SEQ ID NO: 2637557 - RNA, 18 nt, Escherichia coli CFT073
cugcagcggccaguagcu

SEQ ID NO: 2637558 - RNA, 21 nt, Escherichia coli CFT073
cugcagcggucacauguucca

SEQ ID NO: 2637559 - RNA, 13 nt, Escherichia coli CFT073
cugcagcugcaga

SEQ ID NO: 2637560 - RNA, 21 nt, Escherichia coli CFT073
cugcagguguaucguaaaaug

SEQ ID NO: 2637561 - RNA, 16 nt, Escherichia coli CFT073
cugcagguugcaguug

SEQ ID NO: 2637562 - RNA, 21 nt, Escherichia coli CFT073
cugcagugcgcgaaccagaga

SEQ ID NO: 2637563 - RNA, 16 nt, Escherichia coli CFT073
cugcaguucaucaacg

SEQ ID NO: 2637564 - RNA, 17 nt, Escherichia coli CFT073
cugcaguuguuccugau

SEQ ID NO: 2637565 - RNA, 18 nt, Escherichia coli CFT073
cugcauaaaggcaaaaca

SEQ ID NO: 2637566 - RNA, 23 nt, Escherichia coli CFT073
cugcauaaucgcuacgccuuccg

SEQ ID NO: 2637567 - RNA, 14 nt, Escherichia coli CFT073
cugcauaccaagcc

SEQ ID NO: 2637568 - RNA, 13 nt, Escherichia coli CFT073
cugcauacucugc

SEQ ID NO: 2637569 - RNA, 14 nt, Escherichia coli CFT073
cugcaucaaccagc

SEQ ID NO: 2637570 - RNA, 18 nt, Escherichia coli CFT073
cugcaucaaccagcaccu

SEQ ID NO: 2637571 - RNA, 17 nt, Escherichia coli CFT073
cugcaucacgagcgcga

SEQ ID NO: 2637572 - RNA, 12 nt, Escherichia coli CFT073
cugcauccgcgc

SEQ ID NO: 2637573 - RNA, 19 nt, Escherichia coli CFT073
cugcauccgcgcuuucugg

SEQ ID NO: 2637574 - RNA, 13 nt, Escherichia coli CFT073
cugcauccguucu

SEQ ID NO: 2637575 - RNA, 21 nt, Escherichia coli CFT073
cugcauccguucuucggcgcu

SEQ ID NO: 2637576 - RNA, 13 nt, Escherichia coli CFT073
cugcaucuggcga

SEQ ID NO: 2637577 - RNA, 14 nt, Escherichia coli CFT073
cugcaucuggcgau

SEQ ID NO: 2637578 - RNA, 14 nt, Escherichia coli CFT073
cugcaugauuagca

SEQ ID NO: 2637579 - RNA, 21 nt, Escherichia coli CFT073
cugcauggccagacauuacaa

SEQ ID NO: 2637580 - RNA, 22 nt, Escherichia coli CFT073
cugcauggccagacauuacaaa

SEQ ID NO: 2637581 - RNA, 18 nt, Escherichia coli CFT073
cugcauguaaccuaauuu

SEQ ID NO: 2637582 - RNA, 14 nt, Escherichia coli CFT073
cugcauguuggcga

SEQ ID NO: 2637583 - RNA, 21 nt, Escherichia coli CFT073
cugcauguuuuuuaaguucag

SEQ ID NO: 2637584 - RNA, 19 nt, Escherichia coli CFT073
cugcauuagcaaugcccug

SEQ ID NO: 2637585 - RNA, 23 nt, Escherichia coli CFT073
cugcauuccuuguuuaaggaaaa

SEQ ID NO: 2637586 - RNA, 16 nt, Escherichia coli CFT073
cugcauucggcgacca

SEQ ID NO: 2637587 - RNA, 18 nt, Escherichia coli CFT073
cugcauugcgcugaacau

SEQ ID NO: 2637588 - RNA, 18 nt, Escherichia coli CFT073
cugcauugcuuuuguggu

SEQ ID NO: 2637589 - RNA, 23 nt, Escherichia coli CFT073
cugcauuuacggccauggaacau

SEQ ID NO: 2637590 - RNA, 18 nt, Escherichia coli CFT073
cugcauuuggacaccauu

SEQ ID NO: 2637591 - RNA, 13 nt, Escherichia coli CFT073
cugcauuuucucg

SEQ ID NO: 2637592 - RNA, 19 nt, Escherichia coli CFT073
cugccaaacgcucccagcc

SEQ ID NO: 2637593 - RNA, 20 nt, Escherichia coli CFT073
cugccaaccaacgcgccgca

SEQ ID NO: 2637594 - RNA, 18 nt, Escherichia coli CFT073
cugccaacgaacacaugc

SEQ ID NO: 2637595 - RNA, 23 nt, Escherichia coli CFT073
cugccaacgcaccguaacccuga

SEQ ID NO: 2637596 - RNA, 18 nt, Escherichia coli CFT073
cugccaauaaugcccgca

SEQ ID NO: 2637597 - RNA, 20 nt, Escherichia coli CFT073
cugccaauaaugcccgcacc

SEQ ID NO: 2637598 - RNA, 21 nt, Escherichia coli CFT073
cugccaauaaugcccgcacca

SEQ ID NO: 2637599 - RNA, 15 nt, Escherichia coli CFT073
cugccacacugccuu

SEQ ID NO: 2637600 - RNA, 15 nt, Escherichia coli CFT073
cugccacauuucucu

SEQ ID NO: 2637601 - RNA, 13 nt, Escherichia coli CFT073
cugccaccagcac

SEQ ID NO: 2637602 - RNA, 16 nt, Escherichia coli CFT073
cugccaccagcacacc

SEQ ID NO: 2637603 - RNA, 22 nt, Escherichia coli CFT073
cugccaccaggaacgcgccaag

SEQ ID NO: 2637604 - RNA, 18 nt, Escherichia coli CFT073
cugccaccguguauuucu

SEQ ID NO: 2637605 - RNA, 13 nt, Escherichia coli CFT073
cugccacgccacg

SEQ ID NO: 2637606 - RNA, 16 nt, Escherichia coli CFT073
cugccacgccacgcug

SEQ ID NO: 2637607 - RNA, 16 nt, Escherichia coli CFT073
cugccacucuccuggu

SEQ ID NO: 2637608 - RNA, 15 nt, Escherichia coli CFT073
cugccacuucuucca

SEQ ID NO: 2637609 - RNA, 19 nt, Escherichia coli CFT073
cugccagaaaucggccuuc

SEQ ID NO: 2637610 - RNA, 13 nt, Escherichia coli CFT073
cugccagaaccgc

SEQ ID NO: 2637611 - RNA, 15 nt, Escherichia coli CFT073
cugccagaaccgcuu

SEQ ID NO: 2637612 - RNA, 12 nt, Escherichia coli CFT073
cugccagaagca

SEQ ID NO: 2637613 - RNA, 20 nt, Escherichia coli CFT073
cugccagaaucgcaaccagc

SEQ ID NO: 2637614 - RNA, 14 nt, Escherichia coli CFT073
cugccagacaaaac

SEQ ID NO: 2637615 - RNA, 20 nt, Escherichia coli CFT073
cugccagacaaaacugacgc

SEQ ID NO: 2637616 - RNA, 16 nt, Escherichia coli CFT073
cugccagaucaucguu

SEQ ID NO: 2637617 - RNA, 24 nt, Escherichia coli CFT073
cugccagaucaucguuuccgaugg

SEQ ID NO: 2637618 - RNA, 13 nt, Escherichia coli CFT073
cugccagaucggc

SEQ ID NO: 2637619 - RNA, 13 nt, Escherichia coli CFT073
cugccagaugcag

SEQ ID NO: 2637620 - RNA, 15 nt, Escherichia coli CFT073
cugccagauucucca

SEQ ID NO: 2637621 - RNA, 19 nt, Escherichia coli CFT073
cugccagauucuccagcau

SEQ ID NO: 2637622 - RNA, 18 nt, Escherichia coli CFT073
cugccagcagacgccggu

SEQ ID NO: 2637623 - RNA, 13 nt, Escherichia coli CFT073
cugccagccacac

SEQ ID NO: 2637624 - RNA, 18 nt, Escherichia coli CFT073
cugccagccacacugcgg

SEQ ID NO: 2637625 - RNA, 17 nt, Escherichia coli CFT073
cugccagccacaggccg

SEQ ID NO: 2637626 - RNA, 19 nt, Escherichia coli CFT073
cugccagcccgcugguugu

SEQ ID NO: 2637627 - RNA, 19 nt, Escherichia coli CFT073
cugccagccgucgucgcgc

SEQ ID NO: 2637628 - RNA, 12 nt, Escherichia coli CFT073
cugccagcgccg

SEQ ID NO: 2637629 - RNA, 17 nt, Escherichia coli CFT073
cugccagcgugagggaa

SEQ ID NO: 2637630 - RNA, 23 nt, Escherichia coli CFT073
cugccagcugcucauagcggcug

SEQ ID NO: 2637631 - RNA, 21 nt, Escherichia coli CFT073
cugccagcuugcgauccugca

SEQ ID NO: 2637632 - RNA, 23 nt, Escherichia coli CFT073
cugccaggaccgcugaaauauca

SEQ ID NO: 2637633 - RNA, 22 nt, Escherichia coli CFT073
cugccaggcagcgauuaacugc

SEQ ID NO: 2637634 - RNA, 23 nt, Escherichia coli CFT073
cugccaggcagcgauuaacugcg

SEQ ID NO: 2637635 - RNA, 23 nt, Escherichia coli CFT073
cugccaggugaucccccugggcc

SEQ ID NO: 2637636 - RNA, 22 nt, Escherichia coli CFT073
cugccaggugcagcccauaagc

SEQ ID NO: 2637637 - RNA, 23 nt, Escherichia coli CFT073
cugccaguaagcaguccagcgcc

SEQ ID NO: 2637638 - RNA, 19 nt, Escherichia coli CFT073
cugccagugcaaaaaauca

SEQ ID NO: 2637639 - RNA, 22 nt, Escherichia coli CFT073
cugccaguggagccaucaccau

SEQ ID NO: 2637640 - RNA, 22 nt, Escherichia coli CFT073
cugccaguuaccaccgccagau

SEQ ID NO: 2637641 - RNA, 12 nt, Escherichia coli CFT073
cugccaguugcg

SEQ ID NO: 2637642 - RNA, 14 nt, Escherichia coli CFT073
cugccaguugcgcu

SEQ ID NO: 2637643 - RNA, 17 nt, Escherichia coli CFT073
cugccauaaacgguuuc

SEQ ID NO: 2637644 - RNA, 15 nt, Escherichia coli CFT073
cugccauauccagcc

SEQ ID NO: 2637645 - RNA, 19 nt, Escherichia coli CFT073
cugccaucacuauucagau

SEQ ID NO: 2637646 - RNA, 14 nt, Escherichia coli CFT073
cugccaucaucuuc

SEQ ID NO: 2637647 - RNA, 22 nt, Escherichia coli CFT073
cugccaucuuuuggcugauaau

SEQ ID NO: 2637648 - RNA, 23 nt, Escherichia coli CFT073
cugccaugaucaaauccaauaac

SEQ ID NO: 2637649 - RNA, 15 nt, Escherichia coli CFT073
cugccauuguugcug

SEQ ID NO: 2637650 - RNA, 20 nt, Escherichia coli CFT073
cugccauuguugcuggaucc

SEQ ID NO: 2637651 - RNA, 14 nt, Escherichia coli CFT073
cugcccaagugcag

SEQ ID NO: 2637652 - RNA, 16 nt, Escherichia coli CFT073
cugcccaauauacaaa

SEQ ID NO: 2637653 - RNA, 15 nt, Escherichia coli CFT073
cugcccaaucaaacu

SEQ ID NO: 2637654 - RNA, 20 nt, Escherichia coli CFT073
cugcccagccgguaaggcca

SEQ ID NO: 2637655 - RNA, 13 nt, Escherichia coli CFT073
cugccccauagag

SEQ ID NO: 2637656 - RNA, 19 nt, Escherichia coli CFT073
cugcccccggcguuaucgg

SEQ ID NO: 2637657 - RNA, 16 nt, Escherichia coli CFT073
cugcccgccgcgagcu

SEQ ID NO: 2637658 - RNA, 13 nt, Escherichia coli CFT073
cugcccgcuccag

SEQ ID NO: 2637659 - RNA, 13 nt, Escherichia coli CFT073
cugcccggcagcu

SEQ ID NO: 2637660 - RNA, 18 nt, Escherichia coli CFT073
cugcggggagaaugccag

SEQ ID NO: 2637661 - RNA, 21 nt, Escherichia coli CFT073
cugcggggagaaugccagcag

SEQ ID NO: 2637662 - RNA, 14 nt, Escherichia coli CFT073
cugcgguaauccgg

SEQ ID NO: 2637663 - RNA, 19 nt, Escherichia coli CFT073
cugcggugcgccaaacugc

SEQ ID NO: 2637664 - RNA, 22 nt, Escherichia coli CFT073
cugcggugguaucgaucacuuu

SEQ ID NO: 2637665 - RNA, 17 nt, Escherichia coli CFT073
cugcgguguaaaccagc

SEQ ID NO: 2637666 - RNA, 15 nt, Escherichia coli CFT073
cugcgguucagcuuu

SEQ ID NO: 2637667 - RNA, 16 nt, Escherichia coli CFT073
cugcgguucagcuuuu

SEQ ID NO: 2637668 - RNA, 16 nt, Escherichia coli CFT073
cugcgguuucggcgua

SEQ ID NO: 2637669 - RNA, 19 nt, Escherichia coli CFT073
cugcguagaguccagcgcc

SEQ ID NO: 2637670 - RNA, 17 nt, Escherichia coli CFT073
cugcgucaucggcagca

SEQ ID NO: 2637671 - RNA, 10 nt, Escherichia coli CFT073
cugcgucgca

SEQ ID NO: 2637672 - RNA, 18 nt, Escherichia coli CFT073
cugcgucgcgcguaacau

SEQ ID NO: 2637673 - RNA, 16 nt, Escherichia coli CFT073
cugcgucgcuuuccag

SEQ ID NO: 2637674 - RNA, 19 nt, Escherichia coli CFT073
cugcgucgcuuuccagucg

SEQ ID NO: 2637675 - RNA, 17 nt, Escherichia coli CFT073
cugcgucuuccacuuca

SEQ ID NO: 2637676 - RNA, 17 nt, Escherichia coli CFT073
cugcgugaccgccagaa

SEQ ID NO: 2637677 - RNA, 16 nt, Escherichia coli CFT073
cugcgugaucgaaaau

SEQ ID NO: 2637678 - RNA, 18 nt, Escherichia coli CFT073
cugcgugaucgaaaaucg

SEQ ID NO: 2637679 - RNA, 14 nt, Escherichia coli CFT073
cugcgugcaguucc

SEQ ID NO: 2637680 - RNA, 16 nt, Escherichia coli CFT073
cugcgugcaguuccug

SEQ ID NO: 2637681 - RNA, 20 nt, Escherichia coli CFT073
cugcguggaguaaagcccga

SEQ ID NO: 2637682 - RNA, 22 nt, Escherichia coli CFT073
cugcgugucguaagccaccgcc

SEQ ID NO: 2637683 - RNA, 12 nt, Escherichia coli CFT073
cugcguuauaca

SEQ ID NO: 2637684 - RNA, 13 nt, Escherichia coli CFT073
cugcguuauacau

SEQ ID NO: 2637685 - RNA, 15 nt, Escherichia coli CFT073
cugcguuauuuucag

SEQ ID NO: 2637686 - RNA, 13 nt, Escherichia coli CFT073
cugcguucaguug

SEQ ID NO: 2637687 - RNA, 17 nt, Escherichia coli CFT073
cugcguugcucaugcaa

SEQ ID NO: 2637688 - RNA, 23 nt, Escherichia coli CFT073
cugcguuuucacaguaauuuccu

SEQ ID NO: 2637689 - RNA, 22 nt, Escherichia coli CFT073
cugcguuuucgaaaaagcgcug

SEQ ID NO: 2637690 - RNA, 21 nt, Escherichia coli CFT073
cugcuaaaucggggaucauua

SEQ ID NO: 2637691 - RNA, 22 nt, Escherichia coli CFT073
cugcuaaaucggggaucauuaa

SEQ ID NO: 2637692 - RNA, 20 nt, Escherichia coli CFT073
cugcuaacaguuugccaaac

SEQ ID NO: 2637693 - RNA, 15 nt, Escherichia coli CFT073
cugcuagauaagcaa

SEQ ID NO: 2637694 - RNA, 14 nt, Escherichia coli CFT073
cugcucaagcguuu

SEQ ID NO: 2637695 - RNA, 12 nt, Escherichia coli CFT073
cugcucaaugga

SEQ ID NO: 2637696 - RNA, 16 nt, Escherichia coli CFT073
cugcucagcacgccac

SEQ ID NO: 2637697 - RNA, 16 nt, Escherichia coli CFT073
cugcucaggcagaaga

SEQ ID NO: 2637698 - RNA, 11 nt, Escherichia coli CFT073
cugcucaggcg

SEQ ID NO: 2637699 - RNA, 18 nt, Escherichia coli CFT073
cugcucaggcgacgcgga

SEQ ID NO: 2637700 - RNA, 19 nt, Escherichia coli CFT073
cugcucaggcgaggcagac

SEQ ID NO: 2637701 - RNA, 17 nt, Escherichia coli CFT073
cugcuccaucauccgcg

SEQ ID NO: 2637702 - RNA, 23 nt, Escherichia coli CFT073
cugcuccugcagaaaauccagcg

SEQ ID NO: 2637703 - RNA, 19 nt, Escherichia coli CFT073
cugcucgcaaaauaaaaac

SEQ ID NO: 2637704 - RNA, 15 nt, Escherichia coli CFT073
cugcucgcagaaaua

SEQ ID NO: 2637705 - RNA, 23 nt, Escherichia coli CFT073
cugcucgcgauggcgaucgugau

SEQ ID NO: 2637706 - RNA, 16 nt, Escherichia coli CFT073
cugcucggaaauauuc

SEQ ID NO: 2637707 - RNA, 18 nt, Escherichia coli CFT073
cugcucggucugcugggc

SEQ ID NO: 2637708 - RNA, 18 nt, Escherichia coli CFT073
cugcucguaaagcaucag

SEQ ID NO: 2637709 - RNA, 22 nt, Escherichia coli CFT073
cugcucguaaagcaucagacug

SEQ ID NO: 2637710 - RNA, 21 nt, Escherichia coli CFT073
cugcucuauacgcucauuuuc

SEQ ID NO: 2637711 - RNA, 15 nt, Escherichia coli CFT073
cugcucuauugccgu

SEQ ID NO: 2637712 - RNA, 22 nt, Escherichia coli CFT073
cugcucuauugccguaaucgcc

SEQ ID NO: 2637713 - RNA, 22 nt, Escherichia coli CFT073
cugcucugacauagacgccacc

SEQ ID NO: 2637714 - RNA, 16 nt, Escherichia coli CFT073
cugcucuggcagcacc

SEQ ID NO: 2637715 - RNA, 17 nt, Escherichia coli CFT073
cugcucuucacgcccgc

SEQ ID NO: 2637716 - RNA, 12 nt, Escherichia coli CFT073
cugcucuugauc

SEQ ID NO: 2637717 - RNA, 19 nt, Escherichia coli CFT073
cugcucuuucagcaccgcg

SEQ ID NO: 2637718 - RNA, 18 nt, Escherichia coli CFT073
cugcucuuucgccggauu

SEQ ID NO: 2637719 - RNA, 18 nt, Escherichia coli CFT073
cugcugaauauugccaau

SEQ ID NO: 2637720 - RNA, 20 nt, Escherichia coli CFT073
cugcugauaaccgccgccaa

SEQ ID NO: 2637721 - RNA, 23 nt, Escherichia coli CFT073
cugcugaugcgccgcuaacgucu

SEQ ID NO: 2637722 - RNA, 23 nt, Escherichia coli CFT073
cugcugcacgcccugauaaauca

SEQ ID NO: 2637723 - RNA, 15 nt, Escherichia coli CFT073
cugcugcauuucugg

SEQ ID NO: 2637724 - RNA, 17 nt, Escherichia coli CFT073
cugcugccguugccgcu

SEQ ID NO: 2637725 - RNA, 23 nt, Escherichia coli CFT073
cugcugcgucgcggccuguucca

SEQ ID NO: 2637726 - RNA, 18 nt, Escherichia coli CFT073
cugcugcguuccggcaug

SEQ ID NO: 2637727 - RNA, 18 nt, Escherichia coli CFT073
cugcugcuuuuccccauc

SEQ ID NO: 2637728 - RNA, 18 nt, Escherichia coli CFT073
cugcuggacgauuucacc

SEQ ID NO: 2637729 - RNA, 18 nt, Escherichia coli CFT073
cugcuggguaaagacauc

SEQ ID NO: 2637730 - RNA, 21 nt, Escherichia coli CFT073
cugcuggguauagcgcaucac

SEQ ID NO: 2637731 - RNA, 22 nt, Escherichia coli CFT073
cugcuguagcaguuccagcauc

SEQ ID NO: 2637732 - RNA, 14 nt, Escherichia coli CFT073
cugcugugugaucc

SEQ ID NO: 2637733 - RNA, 15 nt, Escherichia coli CFT073
cugcugugugaucca

SEQ ID NO: 2637734 - RNA, 16 nt, Escherichia coli CFT073
cugcuguuaccagaca

SEQ ID NO: 2637735 - RNA, 20 nt, Escherichia coli CFT073
cugcuuaagacguuguugaa

SEQ ID NO: 2637736 - RNA, 18 nt, Escherichia coli CFT073
cugcuuacauaguucuuc

SEQ ID NO: 2637737 - RNA, 20 nt, Escherichia coli CFT073
cugcuuaucgcccugcucca

SEQ ID NO: 2637738 - RNA, 15 nt, Escherichia coli CFT073
cugcuucaaaguuuu

SEQ ID NO: 2637739 - RNA, 21 nt, Escherichia coli CFT073
cugcuucaguaauaccgaacg

SEQ ID NO: 2637740 - RNA, 15 nt, Escherichia coli CFT073
cugcuucauguugca

SEQ ID NO: 2637741 - RNA, 12 nt, Escherichia coli CFT073
cugcuucugccg

SEQ ID NO: 2637742 - RNA, 13 nt, Escherichia coli CFT073
cugcuucuuacca

SEQ ID NO: 2637743 - RNA, 11 nt, Escherichia coli CFT073
cugcuugccau

SEQ ID NO: 2637744 - RNA, 16 nt, Escherichia coli CFT073
cugcuugccauucacu

SEQ ID NO: 2637745 - RNA, 20 nt, Escherichia coli CFT073
cugcuuuacccacgcuuuuc

SEQ ID NO: 2637746 - RNA, 14 nt, Escherichia coli CFT073
cugcuuuagggugg

SEQ ID NO: 2637747 - RNA, 19 nt, Escherichia coli CFT073
cugcuuucguaauaaauca

SEQ ID NO: 2637748 - RNA, 17 nt, Escherichia coli CFT073
cugcuuuuaaaugcccg

SEQ ID NO: 2637749 - RNA, 18 nt, Escherichia coli CFT073
cugcuuuuaaaugcccga

SEQ ID NO: 2637750 - RNA, 23 nt, Escherichia coli CFT073
cugcuuuucauacaaucgguaac

SEQ ID NO: 2637751 - RNA, 12 nt, Escherichia coli CFT073
cugcuuuuucaa

SEQ ID NO: 2637752 - RNA, 18 nt, Escherichia coli CFT073
cugcuuuuucaauuucca

SEQ ID NO: 2637753 - RNA, 14 nt, Escherichia coli CFT073
cugcuuuuugcucu

SEQ ID NO: 2637754 - RNA, 18 nt, Escherichia coli CFT073
cuggaaacagccaaucau

SEQ ID NO: 2637755 - RNA, 21 nt, Escherichia coli CFT073
cuggaaacagccaaucauaaa

SEQ ID NO: 2637756 - RNA, 12 nt, Escherichia coli CFT073
cuggaaaggccg

SEQ ID NO: 2637757 - RNA, 21 nt, Escherichia coli CFT073
cuggaaaugaucccagaacca

SEQ ID NO: 2637758 - RNA, 15 nt, Escherichia coli CFT073
cuggaacaguugcag

SEQ ID NO: 2637759 - RNA, 15 nt, Escherichia coli CFT073
cuggaaccacagcgc

SEQ ID NO: 2637760 - RNA, 17 nt, Escherichia coli CFT073
cuggaaccacagcgccg

SEQ ID NO: 2637761 - RNA, 19 nt, Escherichia coli CFT073
cuggaaccucgcgaaugcu

SEQ ID NO: 2637762 - RNA, 16 nt, Escherichia coli CFT073
cuggaacgggaagaaa

SEQ ID NO: 2637763 - RNA, 22 nt, Escherichia coli CFT073
cuggaagaccagcgaaaccuga

SEQ ID NO: 2637764 - RNA, 17 nt, Escherichia coli CFT073
cuggaagccauuuugca

SEQ ID NO: 2637765 - RNA, 14 nt, Escherichia coli CFT073
cuggaauaauaacu

SEQ ID NO: 2637766 - RNA, 15 nt, Escherichia coli CFT073
cuggaaucaucaagc

SEQ ID NO: 2637767 - RNA, 18 nt, Escherichia coli CFT073
cuggacaucgucugcggu

SEQ ID NO: 2637768 - RNA, 19 nt, Escherichia coli CFT073
cuguaacguuuggcacgcc

SEQ ID NO: 2637769 - RNA, 23 nt, Escherichia coli CFT073
cuguaauaccagccuucuucauc

SEQ ID NO: 2637770 - RNA, 13 nt, Escherichia coli CFT073
cuguaauccauug

SEQ ID NO: 2637771 - RNA, 21 nt, Escherichia coli CFT073
cuguaauccauugcaacuggc

SEQ ID NO: 2637772 - RNA, 16 nt, Escherichia coli CFT073
cuguaaugccuuuucc

SEQ ID NO: 2637773 - RNA, 19 nt, Escherichia coli CFT073
cuguaaugccuuuuccagc

SEQ ID NO: 2637774 - RNA, 22 nt, Escherichia coli CFT073
cuguaaugucaucucuggcacg

SEQ ID NO: 2637775 - RNA, 20 nt, Escherichia coli CFT073
cuguaauucguaacggccag

SEQ ID NO: 2637776 - RNA, 15 nt, Escherichia coli CFT073
cuguaauugccgcuc

SEQ ID NO: 2637777 - RNA, 22 nt, Escherichia coli CFT073
cuguaauugcuuagccgccggg

SEQ ID NO: 2637778 - RNA, 13 nt, Escherichia coli CFT073
cuguacaguaauc

SEQ ID NO: 2637779 - RNA, 16 nt, Escherichia coli CFT073
cuguaccaaaaucauc

SEQ ID NO: 2637780 - RNA, 22 nt, Escherichia coli CFT073
cuguaccaccagaaucgccagc

SEQ ID NO: 2637781 - RNA, 20 nt, Escherichia coli CFT073
cuguaccagcggcuuccagc

SEQ ID NO: 2637782 - RNA, 18 nt, Escherichia coli CFT073
cuguacucaccaacgcag

SEQ ID NO: 2637783 - RNA, 14 nt, Escherichia coli CFT073
cuguagaacaccug

SEQ ID NO: 2637784 - RNA, 18 nt, Escherichia coli CFT073
cuguagagcuaccggcag

SEQ ID NO: 2637785 - RNA, 21 nt, Escherichia coli CFT073
cuguagagcuaccggcaggaa

SEQ ID NO: 2637786 - RNA, 17 nt, Escherichia coli CFT073
cuguagauauauccuga

SEQ ID NO: 2637787 - RNA, 13 nt, Escherichia coli CFT073
cuguagauauucu

SEQ ID NO: 2637788 - RNA, 21 nt, Escherichia coli CFT073
cuguagcaacgauaacaauca

SEQ ID NO: 2637789 - RNA, 14 nt, Escherichia coli CFT073
cuguagccagcucg

SEQ ID NO: 2637790 - RNA, 20 nt, Escherichia coli CFT073
cuguaggguggggaaaaaac

SEQ ID NO: 2637791 - RNA, 18 nt, Escherichia coli CFT073
cuguaggucggauaagac

SEQ ID NO: 2637792 - RNA, 19 nt, Escherichia coli CFT073
cuguaggucggauaagacg

SEQ ID NO: 2637793 - RNA, 19 nt, Escherichia coli CFT073
cuguaguccaggccugauu

SEQ ID NO: 2637794 - RNA, 20 nt, Escherichia coli CFT073
cuguaguccaggccugauua

SEQ ID NO: 2637795 - RNA, 18 nt, Escherichia coli CFT073
cuguaucaccggcauuuu

SEQ ID NO: 2637796 - RNA, 13 nt, Escherichia coli CFT073
cuguaucccagcc

SEQ ID NO: 2637797 - RNA, 14 nt, Escherichia coli CFT073
cuguaucccagccc

SEQ ID NO: 2637798 - RNA, 17 nt, Escherichia coli CFT073
cuguaucgcaucaggca

SEQ ID NO: 2637799 - RNA, 16 nt, Escherichia coli CFT073
cuguauucaucgacug

SEQ ID NO: 2637800 - RNA, 15 nt, Escherichia coli CFT073
cuguauuuuuccagc

SEQ ID NO: 2637801 - RNA, 13 nt, Escherichia coli CFT073
cugucaacaccag

SEQ ID NO: 2637802 - RNA, 21 nt, Escherichia coli CFT073
cugucaacagcguuucuucga

SEQ ID NO: 2637803 - RNA, 13 nt, Escherichia coli CFT073
cugucaauaaacg

SEQ ID NO: 2637804 - RNA, 15 nt, Escherichia coli CFT073
cugucaccgccucca

SEQ ID NO: 2637805 - RNA, 17 nt, Escherichia coli CFT073
cugucaccucugcaacg

SEQ ID NO: 2637806 - RNA, 20 nt, Escherichia coli CFT073
cugucacgcuggcaucaauc

SEQ ID NO: 2637807 - RNA, 20 nt, Escherichia coli CFT073
cugucagaccuccguuuuuc

SEQ ID NO: 2637808 - RNA, 14 nt, Escherichia coli CFT073
cugucagcacgcug

SEQ ID NO: 2637809 - RNA, 12 nt, Escherichia coli CFT073
cugucagucugc

SEQ ID NO: 2637810 - RNA, 18 nt, Escherichia coli CFT073
cugucagugaccagcggc

SEQ ID NO: 2637811 - RNA, 15 nt, Escherichia coli CFT073
cugucaguuggcugu

SEQ ID NO: 2637812 - RNA, 15 nt, Escherichia coli CFT073
cugucaucgacaaaa

SEQ ID NO: 2637813 - RNA, 22 nt, Escherichia coli CFT073
cugucaugugugacugcacugu

SEQ ID NO: 2637814 - RNA, 13 nt, Escherichia coli CFT073
cugucauucauuc

SEQ ID NO: 2637815 - RNA, 17 nt, Escherichia coli CFT073
cugucauucauucagau

SEQ ID NO: 2637816 - RNA, 19 nt, Escherichia coli CFT073
cuguccaaauccuucagca

SEQ ID NO: 2637817 - RNA, 20 nt, Escherichia coli CFT073
cuguccauaccggacuccag

SEQ ID NO: 2637818 - RNA, 17 nt, Escherichia coli CFT073
cuguccgauuuguucuc

SEQ ID NO: 2637819 - RNA, 19 nt, Escherichia coli CFT073
cuguccgcauccccuacuc

SEQ ID NO: 2637820 - RNA, 16 nt, Escherichia coli CFT073
cuguccgccagaccaa

SEQ ID NO: 2637821 - RNA, 12 nt, Escherichia coli CFT073
cuguccggcacc

SEQ ID NO: 2637822 - RNA, 16 nt, Escherichia coli CFT073
cuguccggcgcacugg

SEQ ID NO: 2637823 - RNA, 14 nt, Escherichia coli CFT073
cuguccuccaugau

SEQ ID NO: 2637824 - RNA, 22 nt, Escherichia coli CFT073
cuguccucuucagcaucaauga

SEQ ID NO: 2637825 - RNA, 13 nt, Escherichia coli CFT073
cuguccugaaaau

SEQ ID NO: 2637826 - RNA, 23 nt, Escherichia coli CFT073
cugucgacaaagccgcaggcgug

SEQ ID NO: 2637827 - RNA, 16 nt, Escherichia coli CFT073
cugucgauaaacucau

SEQ ID NO: 2637828 - RNA, 22 nt, Escherichia coli CFT073
cugucgauuuucacauaagcug

SEQ ID NO: 2637829 - RNA, 15 nt, Escherichia coli CFT073
cugucgcgucaauca

SEQ ID NO: 2637830 - RNA, 16 nt, Escherichia coli CFT073
cugucgcgucaaucac

SEQ ID NO: 2637831 - RNA, 17 nt, Escherichia coli CFT073
cugucgcgucaaucacu

SEQ ID NO: 2637832 - RNA, 21 nt, Escherichia coli CFT073
cugucgcgucaaucacuuucu

SEQ ID NO: 2637833 - RNA, 19 nt, Escherichia coli CFT073
cugucgcuuuugcaucuuc

SEQ ID NO: 2637834 - RNA, 22 nt, Escherichia coli CFT073
cugucggcacugaccaccacca

SEQ ID NO: 2637835 - RNA, 19 nt, Escherichia coli CFT073
cugucggguaagcgccaca

SEQ ID NO: 2637836 - RNA, 20 nt, Escherichia coli CFT073
cugucggguaagcgccacaa

SEQ ID NO: 2637837 - RNA, 16 nt, Escherichia coli CFT073
cugucggugccaucau

SEQ ID NO: 2637838 - RNA, 19 nt, Escherichia coli CFT073
cugucguacccagucgcgc

SEQ ID NO: 2637839 - RNA, 14 nt, Escherichia coli CFT073
cugucuaccagcac

SEQ ID NO: 2637840 - RNA, 22 nt, Escherichia coli CFT073
cugucucauggguauaaccgcc

SEQ ID NO: 2637841 - RNA, 16 nt, Escherichia coli CFT073
cugucugaaugauaac

SEQ ID NO: 2637842 - RNA, 14 nt, Escherichia coli CFT073
cugucuuacagggc

SEQ ID NO: 2637843 - RNA, 17 nt, Escherichia coli CFT073
cugugaaacaccugcau

SEQ ID NO: 2637844 - RNA, 18 nt, Escherichia coli CFT073
cugugaaacaccugcauu

SEQ ID NO: 2637845 - RNA, 17 nt, Escherichia coli CFT073
cugugaagcaccugcgu

SEQ ID NO: 2637846 - RNA, 18 nt, Escherichia coli CFT073
cugugaagcaccugcguu

SEQ ID NO: 2637847 - RNA, 14 nt, Escherichia coli CFT073
cugugaauuacugc

SEQ ID NO: 2637848 - RNA, 21 nt, Escherichia coli CFT073
cugugaauuacugcugcggaa

SEQ ID NO: 2637849 - RNA, 24 nt, Escherichia coli CFT073
cugugaucauaucccggcugaaua

SEQ ID NO: 2637850 - RNA, 12 nt, Escherichia coli CFT073
cugugauugcgc

SEQ ID NO: 2637851 - RNA, 22 nt, Escherichia coli CFT073
cugugauuucuuuauugauaaa

SEQ ID NO: 2637852 - RNA, 16 nt, Escherichia coli CFT073
cugugcaaccuuuucc

SEQ ID NO: 2637853 - RNA, 17 nt, Escherichia coli CFT073
cugugcaauauuacuuc

SEQ ID NO: 2637854 - RNA, 15 nt, Escherichia coli CFT073
cugugcaaugaaaaa

SEQ ID NO: 2637855 - RNA, 18 nt, Escherichia coli CFT073
cugugcaccgcgcuggcu

SEQ ID NO: 2637856 - RNA, 17 nt, Escherichia coli CFT073
cugugcauguuuaacca

SEQ ID NO: 2637857 - RNA, 18 nt, Escherichia coli CFT073
cugugccacggcuuugca

SEQ ID NO: 2637858 - RNA, 16 nt, Escherichia coli CFT073
cugugccagcggcagu

SEQ ID NO: 2637859 - RNA, 11 nt, Escherichia coli CFT073
cugugccagcu

SEQ ID NO: 2637860 - RNA, 14 nt, Escherichia coli CFT073
cugugccagcucca

SEQ ID NO: 2637861 - RNA, 16 nt, Escherichia coli CFT073
cugugccgcgaccacc

SEQ ID NO: 2637862 - RNA, 18 nt, Escherichia coli CFT073
cugugccuccugcggcuu

SEQ ID NO: 2637863 - RNA, 17 nt, Escherichia coli CFT073
cugugcgacuucauuca

SEQ ID NO: 2637864 - RNA, 20 nt, Escherichia coli CFT073
cugugcgauuuccuucagca

SEQ ID NO: 2637865 - RNA, 22 nt, Escherichia coli CFT073
cugugcggucugauacaugcug

SEQ ID NO: 2637866 - RNA, 17 nt, Escherichia coli CFT073
cugugcguaaucgccga

SEQ ID NO: 2637867 - RNA, 17 nt, Escherichia coli CFT073
cuguggaucuuccccuu

SEQ ID NO: 2637868 - RNA, 22 nt, Escherichia coli CFT073
cuguggaucuuccccuuuugcc

SEQ ID NO: 2637869 - RNA, 16 nt, Escherichia coli CFT073
cuguggcguauucggc

SEQ ID NO: 2637870 - RNA, 17 nt, Escherichia coli CFT073
cuguggcguuauggcaa

SEQ ID NO: 2637871 - RNA, 14 nt, Escherichia coli CFT073
cuguggcuuuuuug

SEQ ID NO: 2637872 - RNA, 15 nt, Escherichia coli CFT073
cugugguacugccga

SEQ ID NO: 2637873 - RNA, 16 nt, Escherichia coli CFT073
cuguguaggccggaua

SEQ ID NO: 2637874 - RNA, 14 nt, Escherichia coli CFT073
cugugucgccgagc

SEQ ID NO: 2637875 - RNA, 21 nt, Escherichia coli CFT073
cugugucgccgagccuuccau

SEQ ID NO: 2637876 - RNA, 23 nt, Escherichia coli CFT073
cuuaccccuacggcgacagcaaa

SEQ ID NO: 2637877 - RNA, 17 nt, Escherichia coli CFT073
cuuaccuaccugcucaa

SEQ ID NO: 2637878 - RNA, 14 nt, Escherichia coli CFT073
cuuaccuucacgaa

SEQ ID NO: 2637879 - RNA, 21 nt, Escherichia coli CFT073
cuuacgaaaaagauauguugc

SEQ ID NO: 2637880 - RNA, 17 nt, Escherichia coli CFT073
cuuacgcaccggaaauu

SEQ ID NO: 2637881 - RNA, 22 nt, Escherichia coli CFT073
cuuacgcgccagagcuggcacc

SEQ ID NO: 2637882 - RNA, 20 nt, Escherichia coli CFT073
cuuacgggcguauucaauaa

SEQ ID NO: 2637883 - RNA, 22 nt, Escherichia coli CFT073
cuuacguauuucgauuuguucu

SEQ ID NO: 2637884 - RNA, 16 nt, Escherichia coli CFT073
cuuacguuacccagca

SEQ ID NO: 2637885 - RNA, 14 nt, Escherichia coli CFT073
cuuacuauauaaac

SEQ ID NO: 2637886 - RNA, 22 nt, Escherichia coli CFT073
cuuacucauuaaugcacuucca

SEQ ID NO: 2637887 - RNA, 13 nt, Escherichia coli CFT073
cuuacuucaacac

SEQ ID NO: 2637888 - RNA, 22 nt, Escherichia coli CFT073
cuuacuuccugucuucccugcu

SEQ ID NO: 2637889 - RNA, 14 nt, Escherichia coli CFT073
cuuacuugcugcuc

SEQ ID NO: 2637890 - RNA, 22 nt, Escherichia coli CFT073
cuuagacaucaaaauuaccuuu

SEQ ID NO: 2637891 - RNA, 14 nt, Escherichia coli CFT073
cuuagcgcaaguuu

SEQ ID NO: 2637892 - RNA, 16 nt, Escherichia coli CFT073
cuuaggggacauuuag

SEQ ID NO: 2637893 - RNA, 17 nt, Escherichia coli CFT073
cuuaggucggauaagac

SEQ ID NO: 2637894 - RNA, 19 nt, Escherichia coli CFT073
cuuaguuaaaccagcuguc

SEQ ID NO: 2637895 - RNA, 21 nt, Escherichia coli CFT073
cuuauaaaggcgcuucggcgc

SEQ ID NO: 2637896 - RNA, 21 nt, Escherichia coli CFT073
cuuauaaccagacgauuuucc

SEQ ID NO: 2637897 - RNA, 15 nt, Escherichia coli CFT073
cuuauaacugcccgc

SEQ ID NO: 2637898 - RNA, 20 nt, Escherichia coli CFT073
cuuauaacugcccgcaucaa

SEQ ID NO: 2637899 - RNA, 12 nt, Escherichia coli CFT073
cuuauauaaaac

SEQ ID NO: 2637900 - RNA, 20 nt, Escherichia coli CFT073
cuuauauaggugauaaagua

SEQ ID NO: 2637901 - RNA, 14 nt, Escherichia coli CFT073
cuuaucaggcauug

SEQ ID NO: 2637902 - RNA, 12 nt, Escherichia coli CFT073
cuuaucaggccu

SEQ ID NO: 2637903 - RNA, 13 nt, Escherichia coli CFT073
cuuaucaggccua

SEQ ID NO: 2637904 - RNA, 16 nt, Escherichia coli CFT073
cuuaucaggccuacaa

SEQ ID NO: 2637905 - RNA, 17 nt, Escherichia coli CFT073
cuuaucaggccuacaaa

SEQ ID NO: 2637906 - RNA, 18 nt, Escherichia coli CFT073
cuuaucaggccuacaagu

SEQ ID NO: 2637907 - RNA, 21 nt, Escherichia coli CFT073
cuuaucaggccuacaggugca

SEQ ID NO: 2637908 - RNA, 21 nt, Escherichia coli CFT073
cuuaucaggccuacauauccg

SEQ ID NO: 2637909 - RNA, 16 nt, Escherichia coli CFT073
cuuaucaggccuacga

SEQ ID NO: 2637910 - RNA, 13 nt, Escherichia coli CFT073
cuuaucaggccug

SEQ ID NO: 2637911 - RNA, 22 nt, Escherichia coli CFT073
cuuaucaggucaauugaacucu

SEQ ID NO: 2637912 - RNA, 13 nt, Escherichia coli CFT073
cuuaucaugccua

SEQ ID NO: 2637913 - RNA, 23 nt, Escherichia coli CFT073
cuuauccagcaacguuucgcugg

SEQ ID NO: 2637914 - RNA, 15 nt, Escherichia coli CFT073
cuuauccagcgccug

SEQ ID NO: 2637915 - RNA, 20 nt, Escherichia coli CFT073
cuuaucccuucgagcggggg

SEQ ID NO: 2637916 - RNA, 16 nt, Escherichia coli CFT073
cuuauccgaccuacaa

SEQ ID NO: 2637917 - RNA, 20 nt, Escherichia coli CFT073
cuuauccggccuacguagau

SEQ ID NO: 2637918 - RNA, 22 nt, Escherichia coli CFT073
cuuauccggccuccauaagagu

SEQ ID NO: 2637919 - RNA, 22 nt, Escherichia coli CFT073
cuuaucgcccugaauuucaaua

SEQ ID NO: 2637920 - RNA, 15 nt, Escherichia coli CFT073
cuuaucgucccaggc

SEQ ID NO: 2637921 - RNA, 20 nt, Escherichia coli CFT073
cuuaucguuagcauggguau

SEQ ID NO: 2637922 - RNA, 13 nt, Escherichia coli CFT073
cuuaucuuccugu

SEQ ID NO: 2637923 - RNA, 20 nt, Escherichia coli CFT073
cuuaugcugcuuacauaguu

SEQ ID NO: 2637924 - RNA, 16 nt, Escherichia coli CFT073
cuuauuaaagaucuua

SEQ ID NO: 2637925 - RNA, 19 nt, Escherichia coli CFT073
cuuauuaaugcuuucagua

SEQ ID NO: 2637926 - RNA, 19 nt, Escherichia coli CFT073
cuuauuauauugucuuaaa

SEQ ID NO: 2637927 - RNA, 18 nt, Escherichia coli CFT073
cuuauucaaucucuucac

SEQ ID NO: 2637928 - RNA, 19 nt, Escherichia coli CFT073
cuuauucaaucucuucaca

SEQ ID NO: 2637929 - RNA, 22 nt, Escherichia coli CFT073
cuuauucggccuaccaugaucu

SEQ ID NO: 2637930 - RNA, 21 nt, Escherichia coli CFT073
cuuauucugugaacuucaggu

SEQ ID NO: 2637931 - RNA, 18 nt, Escherichia coli CFT073
cuuauugccggaugcggc

SEQ ID NO: 2637932 - RNA, 17 nt, Escherichia coli CFT073
cuuauuguacagcgccc

SEQ ID NO: 2637933 - RNA, 19 nt, Escherichia coli CFT073
cuuauuuaaacugaagacu

SEQ ID NO: 2637934 - RNA, 14 nt, Escherichia coli CFT073
cuuauuuuucucua

SEQ ID NO: 2637935 - RNA, 13 nt, Escherichia coli CFT073
cuucaaaaaaguc

SEQ ID NO: 2637936 - RNA, 12 nt, Escherichia coli CFT073
cuucaaaaauaa

SEQ ID NO: 2637937 - RNA, 19 nt, Escherichia coli CFT073
cuucaaaauuuaacauuac

SEQ ID NO: 2637938 - RNA, 15 nt, Escherichia coli CFT073
cuucaaagacgcuuu

SEQ ID NO: 2637939 - RNA, 15 nt, Escherichia coli CFT073
cuucaaaguucugcg

SEQ ID NO: 2637940 - RNA, 18 nt, Escherichia coli CFT073
cuucaaaguucugcgucu

SEQ ID NO: 2637941 - RNA, 22 nt, Escherichia coli CFT073
cuucaaaguuuugugcuuuguu

SEQ ID NO: 2637942 - RNA, 12 nt, Escherichia coli CFT073
cuucaaauaaac

SEQ ID NO: 2637943 - RNA, 12 nt, Escherichia coli CFT073
cuucaaauauug

SEQ ID NO: 2637944 - RNA, 13 nt, Escherichia coli CFT073
cuucaaauauuga

SEQ ID NO: 2637945 - RNA, 21 nt, Escherichia coli CFT073
cuucaaauuuaauuugcugcg

SEQ ID NO: 2637946 - RNA, 18 nt, Escherichia coli CFT073
cuucaacaccaacugccu

SEQ ID NO: 2637947 - RNA, 21 nt, Escherichia coli CFT073
cuucaacacgacgcauugcca

SEQ ID NO: 2637948 - RNA, 13 nt, Escherichia coli CFT073
cuucaacacuuca

SEQ ID NO: 2637949 - RNA, 13 nt, Escherichia coli CFT073
cuucaacagcggc

SEQ ID NO: 2637950 - RNA, 16 nt, Escherichia coli CFT073
cuucaacauuaaagca

SEQ ID NO: 2637951 - RNA, 13 nt, Escherichia coli CFT073
cuucaaccaccuc

SEQ ID NO: 2637952 - RNA, 20 nt, Escherichia coli CFT073
cuucaaccaccucaguaccc

SEQ ID NO: 2637953 - RNA, 18 nt, Escherichia coli CFT073
cuucaaccagcggcgcau

SEQ ID NO: 2637954 - RNA, 14 nt, Escherichia coli CFT073
cuucaaccagugca

SEQ ID NO: 2637955 - RNA, 21 nt, Escherichia coli CFT073
cuucaaccguuucuuuuucga

SEQ ID NO: 2637956 - RNA, 21 nt, Escherichia coli CFT073
cuucaacgaaagcgccucaag

SEQ ID NO: 2637957 - RNA, 19 nt, Escherichia coli CFT073
cuucaacuacggcuuuuuu

SEQ ID NO: 2637958 - RNA, 20 nt, Escherichia coli CFT073
cuucaacuacggcuuuuuuc

SEQ ID NO: 2637959 - RNA, 22 nt, Escherichia coli CFT073
cuucaacuacggcuuuuuucau

SEQ ID NO: 2637960 - RNA, 23 nt, Escherichia coli CFT073
cuucaacuacggcuuuuuucauu

SEQ ID NO: 2637961 - RNA, 15 nt, Escherichia coli CFT073
cuucaagaauuaaaa

SEQ ID NO: 2637962 - RNA, 18 nt, Escherichia coli CFT073
cuucaagaauuaaaauau

SEQ ID NO: 2637963 - RNA, 22 nt, Escherichia coli CFT073
cuucaagcaucggcgcagcuaa

SEQ ID NO: 2637964 - RNA, 15 nt, Escherichia coli CFT073
cuucaagcuggugcu

SEQ ID NO: 2637965 - RNA, 22 nt, Escherichia coli CFT073
cuucaaggcagagucaucucug

SEQ ID NO: 2637966 - RNA, 20 nt, Escherichia coli CFT073
cuucaaguguggccgccagu

SEQ ID NO: 2637967 - RNA, 13 nt, Escherichia coli CFT073
cuucaauaaaccc

SEQ ID NO: 2637968 - RNA, 13 nt, Escherichia coli CFT073
cuucaauaccacc

SEQ ID NO: 2637969 - RNA, 14 nt, Escherichia coli CFT073
cuucaauaccaccc

SEQ ID NO: 2637970 - RNA, 17 nt, Escherichia coli CFT073
cuucaaucaacauauuu

SEQ ID NO: 2637971 - RNA, 20 nt, Escherichia coli CFT073
cuucaaucaacauauuucuc

SEQ ID NO: 2637972 - RNA, 12 nt, Escherichia coli CFT073
cuucaaucaaua

SEQ ID NO: 2637973 - RNA, 16 nt, Escherichia coli CFT073
cuucaaucgccaccac

SEQ ID NO: 2637974 - RNA, 15 nt, Escherichia coli CFT073
cuucacaaaggcuug

SEQ ID NO: 2637975 - RNA, 16 nt, Escherichia coli CFT073
cuucacaaaggcuugc

SEQ ID NO: 2637976 - RNA, 18 nt, Escherichia coli CFT073
cuucacaaccgccaucca

SEQ ID NO: 2637977 - RNA, 21 nt, Escherichia coli CFT073
cuucacacugaugacaggcua

SEQ ID NO: 2637978 - RNA, 12 nt, Escherichia coli CFT073
cuucacagacau

SEQ ID NO: 2637979 - RNA, 17 nt, Escherichia coli CFT073
cuucacagacauccuga

SEQ ID NO: 2637980 - RNA, 23 nt, Escherichia coli CFT073
cuucacaggccgccaggcagagc

SEQ ID NO: 2637981 - RNA, 18 nt, Escherichia coli CFT073
cuucacaugauaauaaaa

SEQ ID NO: 2637982 - RNA, 22 nt, Escherichia coli CFT073
cuucacauuguuaaagcccugc

SEQ ID NO: 2637983 - RNA, 14 nt, Escherichia coli CFT073
cuucaccaauguuc

SEQ ID NO: 2637984 - RNA, 11 nt, Escherichia coli CFT073
aaaaaaaagau

SEQ ID NO: 2637985 - RNA, 14 nt, Escherichia coli CFT073
aaaaaaagaacaac

SEQ ID NO: 2637986 - RNA, 17 nt, Escherichia coli CFT073
aaaaaaccagaaaggga

SEQ ID NO: 2637987 - RNA, 15 nt, Escherichia coli CFT073
aaaaaagaaaugccu

SEQ ID NO: 2637988 - RNA, 13 nt, Escherichia coli CFT073
aaaaaagaaggaa

SEQ ID NO: 2637989 - RNA, 16 nt, Escherichia coli CFT073
aaaaaagcaagauuaa

SEQ ID NO: 2637990 - RNA, 18 nt, Escherichia coli CFT073
aaaaaagcaagauuaaaa

SEQ ID NO: 2637991 - RNA, 21 nt, Escherichia coli CFT073
aaaaaagcaagauuaaaauau

SEQ ID NO: 2637992 - RNA, 20 nt, Escherichia coli CFT073
aaaaaagccaccaaccacaa

SEQ ID NO: 2637993 - RNA, 21 nt, Escherichia coli CFT073
aaaaaagugauuuacuuucuu

SEQ ID NO: 2637994 - RNA, 18 nt, Escherichia coli CFT073
aaaaaauacgcaucauau

SEQ ID NO: 2637995 - RNA, 18 nt, Escherichia coli CFT073
aaaaaaucccgaucuucu

SEQ ID NO: 2637996 - RNA, 19 nt, Escherichia coli CFT073
aaaaaaucuucacugaaua

SEQ ID NO: 2637997 - RNA, 12 nt, Escherichia coli CFT073
aaaaaauuaauu

SEQ ID NO: 2637998 - RNA, 17 nt, Escherichia coli CFT073
aaaaacaaagaaugcca

SEQ ID NO: 2637999 - RNA, 17 nt, Escherichia coli CFT073
aaaaacacaaaguaaac

SEQ ID NO: 2638000 - RNA, 19 nt, Escherichia coli CFT073
aaaaacaccucaucgcgca

SEQ ID NO: 2638001 - RNA, 22 nt, Escherichia coli CFT073
aaaaacagcgccugcacaaagc

SEQ ID NO: 2638002 - RNA, 21 nt, Escherichia coli CFT073
aaaaacaguaugcaacaacuc

SEQ ID NO: 2638003 - RNA, 22 nt, Escherichia coli CFT073
aaaaaccagaaagggaagaaca

SEQ ID NO: 2638004 - RNA, 14 nt, Escherichia coli CFT073
aaaaaccaucaccu

SEQ ID NO: 2638005 - RNA, 19 nt, Escherichia coli CFT073
aaaaaccccgcuccggcgg

SEQ ID NO: 2638006 - RNA, 12 nt, Escherichia coli CFT073
aaaaacccgccc

SEQ ID NO: 2638007 - RNA, 13 nt, Escherichia coli CFT073
aaaaaccugaccu

SEQ ID NO: 2638008 - RNA, 21 nt, Escherichia coli CFT073
aaaaaccugucuggauuuacu

SEQ ID NO: 2638009 - RNA, 16 nt, Escherichia coli CFT073
aaaaacgaacauuauu

SEQ ID NO: 2638010 - RNA, 20 nt, Escherichia coli CFT073
aaaaacgaagacagcgaaaa

SEQ ID NO: 2638011 - RNA, 18 nt, Escherichia coli CFT073
aaaaggugccacagcagu

SEQ ID NO: 2638012 - RNA, 22 nt, Escherichia coli CFT073
aaaaguaaaccagcgagaagcu

SEQ ID NO: 2638013 - RNA, 20 nt, Escherichia coli CFT073
aaaaguagcgcagcagauaa

SEQ ID NO: 2638014 - RNA, 19 nt, Escherichia coli CFT073
aaaaguagggcgcugccag

SEQ ID NO: 2638015 - RNA, 20 nt, Escherichia coli CFT073
aaaaguaguuccagcaugau

SEQ ID NO: 2638016 - RNA, 16 nt, Escherichia coli CFT073
aaaagucauccggcgu

SEQ ID NO: 2638017 - RNA, 16 nt, Escherichia coli CFT073
aaaagucccuucccag

SEQ ID NO: 2638018 - RNA, 19 nt, Escherichia coli CFT073
aaaagugcuguaaagcaca

SEQ ID NO: 2638019 - RNA, 13 nt, Escherichia coli CFT073
aaaaguugcaguc

SEQ ID NO: 2638020 - RNA, 20 nt, Escherichia coli CFT073
aaaaguuuauuacucagcgc

SEQ ID NO: 2638021 - RNA, 20 nt, Escherichia coli CFT073
aaaaguuugaucggagaaca

SEQ ID NO: 2638022 - RNA, 12 nt, Escherichia coli CFT073
aaaauaaaaacg

SEQ ID NO: 2638023 - RNA, 17 nt, Escherichia coli CFT073
aaaauaaaggguaauau

SEQ ID NO: 2638024 - RNA, 17 nt, Escherichia coli CFT073
aaaauaaaucaaaguca

SEQ ID NO: 2638025 - RNA, 17 nt, Escherichia coli CFT073
aaaauaaccggcaagca

SEQ ID NO: 2638026 - RNA, 14 nt, Escherichia coli CFT073
aaaauaaccgucuu

SEQ ID NO: 2638027 - RNA, 17 nt, Escherichia coli CFT073
aaaauaacgaucaucac

SEQ ID NO: 2638028 - RNA, 13 nt, Escherichia coli CFT073
aaaauaaggcugc

SEQ ID NO: 2638029 - RNA, 21 nt, Escherichia coli CFT073
aaaauaagucagaccaaaacc

SEQ ID NO: 2638030 - RNA, 14 nt, Escherichia coli CFT073
aaaauaaucucacc

SEQ ID NO: 2638031 - RNA, 18 nt, Escherichia coli CFT073
aaaauaaucucaccauuu

SEQ ID NO: 2638032 - RNA, 10 nt, Escherichia coli CFT073
aaaauaaugc

SEQ ID NO: 2638033 - RNA, 22 nt, Escherichia coli CFT073
aaaauacaaacgccauaaacuu

SEQ ID NO: 2638034 - RNA, 15 nt, Escherichia coli CFT073
aaaauacacaauccg

SEQ ID NO: 2638035 - RNA, 13 nt, Escherichia coli CFT073
aaaauacaggaaa

SEQ ID NO: 2638036 - RNA, 15 nt, Escherichia coli CFT073
aaaauaccaccaaug

SEQ ID NO: 2638037 - RNA, 21 nt, Escherichia coli CFT073
aaaauaccauuagucacauua

SEQ ID NO: 2638038 - RNA, 17 nt, Escherichia coli CFT073
aaaauaccgaacaugcc

SEQ ID NO: 2638039 - RNA, 16 nt, Escherichia coli CFT073
aaaauacuggcgauuu

SEQ ID NO: 2638040 - RNA, 20 nt, Escherichia coli CFT073
aaaauagccaccagccagua

SEQ ID NO: 2638041 - RNA, 23 nt, Escherichia coli CFT073
aaaauaggaauccgggucuguaa

SEQ ID NO: 2638042 - RNA, 13 nt, Escherichia coli CFT073
aaaauaucacucg

SEQ ID NO: 2638043 - RNA, 20 nt, Escherichia coli CFT073
aaaauaucguaggccugcuc

SEQ ID NO: 2638044 - RNA, 18 nt, Escherichia coli CFT073
aaaauaugcccuuguggc

SEQ ID NO: 2638045 - RNA, 13 nt, Escherichia coli CFT073
aaaaucaaaaacu

SEQ ID NO: 2638046 - RNA, 23 nt, Escherichia coli CFT073
aaaaucaaaguuaguaaaacuau

SEQ ID NO: 2638047 - RNA, 11 nt, Escherichia coli CFT073
aaaaucaccau

SEQ ID NO: 2638048 - RNA, 13 nt, Escherichia coli CFT073
aaaaucaccauca

SEQ ID NO: 2638049 - RNA, 14 nt, Escherichia coli CFT073
aaaaucaccaucac

SEQ ID NO: 2638050 - RNA, 22 nt, Escherichia coli CFT073
aaaaucaccucaucaccacaga

SEQ ID NO: 2638051 - RNA, 11 nt, Escherichia coli CFT073
aaaaucacggc

SEQ ID NO: 2638052 - RNA, 20 nt, Escherichia coli CFT073
aaaaucacggcaaacugcgc

SEQ ID NO: 2638053 - RNA, 11 nt, Escherichia coli CFT073
aaaaucagcgu

SEQ ID NO: 2638054 - RNA, 17 nt, Escherichia coli CFT073
aaaaucauauucuuuuu

SEQ ID NO: 2638055 - RNA, 21 nt, Escherichia coli CFT073
aaaaucaucacgcgguuacgc

SEQ ID NO: 2638056 - RNA, 23 nt, Escherichia coli CFT073
aaaaucauuuaucucgucacuuu

SEQ ID NO: 2638057 - RNA, 14 nt, Escherichia coli CFT073
aaaauccaucccaa

SEQ ID NO: 2638058 - RNA, 11 nt, Escherichia coli CFT073
aaaaucccagc

SEQ ID NO: 2638059 - RNA, 21 nt, Escherichia coli CFT073
aaaaucccggcaacaaauuca

SEQ ID NO: 2638060 - RNA, 21 nt, Escherichia coli CFT073
aaaauccgcuggugcuuuaaa

SEQ ID NO: 2638061 - RNA, 18 nt, Escherichia coli CFT073
aaaauccucaacgccgca

SEQ ID NO: 2638062 - RNA, 15 nt, Escherichia coli CFT073
aaaauccugccagcg

SEQ ID NO: 2638063 - RNA, 22 nt, Escherichia coli CFT073
aaaaucgagcguugcuucgcca

SEQ ID NO: 2638064 - RNA, 15 nt, Escherichia coli CFT073
aaaaucgauggguuu

SEQ ID NO: 2638065 - RNA, 13 nt, Escherichia coli CFT073
aaaaucgccugaa

SEQ ID NO: 2638066 - RNA, 14 nt, Escherichia coli CFT073
aaaaucgccugaac

SEQ ID NO: 2638067 - RNA, 15 nt, Escherichia coli CFT073
aaaaucggcaacauc

SEQ ID NO: 2638068 - RNA, 23 nt, Escherichia coli CFT073
aaaaucggcaacaucaaauacag

SEQ ID NO: 2638069 - RNA, 19 nt, Escherichia coli CFT073
aaaaucguaagcaggagau

SEQ ID NO: 2638070 - RNA, 15 nt, Escherichia coli CFT073
aaaaucuaccagcgg

SEQ ID NO: 2638071 - RNA, 18 nt, Escherichia coli CFT073
aaaaucuacggaagaguu

SEQ ID NO: 2638072 - RNA, 20 nt, Escherichia coli CFT073
aaaaucucgacuucuucauu

SEQ ID NO: 2638073 - RNA, 19 nt, Escherichia coli CFT073
aaaaucuuccagaaugccu

SEQ ID NO: 2638074 - RNA, 14 nt, Escherichia coli CFT073
aaaaucuucguuau

SEQ ID NO: 2638075 - RNA, 22 nt, Escherichia coli CFT073
aaaaucuuucagaguuguacca

SEQ ID NO: 2638076 - RNA, 19 nt, Escherichia coli CFT073
aaaaucuuugaaauaauau

SEQ ID NO: 2638077 - RNA, 23 nt, Escherichia coli CFT073
aaaaugacauuaaguaacaauau

SEQ ID NO: 2638078 - RNA, 17 nt, Escherichia coli CFT073
aaaaugauaaauugccu

SEQ ID NO: 2638079 - RNA, 17 nt, Escherichia coli CFT073
aaaaugaugauugacca

SEQ ID NO: 2638080 - RNA, 21 nt, Escherichia coli CFT073
aaaaugauguagcccugauac

SEQ ID NO: 2638081 - RNA, 18 nt, Escherichia coli CFT073
aaaaugaugucaaccauc

SEQ ID NO: 2638082 - RNA, 14 nt, Escherichia coli CFT073
aaaaugcaccggau

SEQ ID NO: 2638083 - RNA, 19 nt, Escherichia coli CFT073
aaaaugccguacagcagaa

SEQ ID NO: 2638084 - RNA, 15 nt, Escherichia coli CFT073
aaaaugcgaaaaaaa

SEQ ID NO: 2638085 - RNA, 23 nt, Escherichia coli CFT073
aaaaugcgcggucagaaaauuau

SEQ ID NO: 2638086 - RNA, 13 nt, Escherichia coli CFT073
aaaauggagagaa

SEQ ID NO: 2638087 - RNA, 24 nt, Escherichia coli CFT073
aaaauggcguugcuggcgugaaau

SEQ ID NO: 2638088 - RNA, 19 nt, Escherichia coli CFT073
aaaauggucagccagcggc

SEQ ID NO: 2638089 - RNA, 17 nt, Escherichia coli CFT073
aaaaugguuugccagca

SEQ ID NO: 2638090 - RNA, 20 nt, Escherichia coli CFT073
aaaaugguuugccagcagag

SEQ ID NO: 2638091 - RNA, 19 nt, Escherichia coli CFT073
aaaauguugcgccucaaga

SEQ ID NO: 2638092 - RNA, 23 nt, Escherichia coli CFT073
aaaauuaauuuuuuaauaaaaag

SEQ ID NO: 2638093 - RNA, 15 nt, Escherichia coli CFT073
aaaauuauuuuaaau

SEQ ID NO: 2638094 - RNA, 15 nt, Escherichia coli CFT073
aaaauucaucaaaug

SEQ ID NO: 2638095 - RNA, 15 nt, Escherichia coli CFT073
aaaauugauaaccaa

SEQ ID NO: 2638096 - RNA, 19 nt, Escherichia coli CFT073
aaaauugccggaugcggcg

SEQ ID NO: 2638097 - RNA, 17 nt, Escherichia coli CFT073
aaaauugccuguugcgc

SEQ ID NO: 2638098 - RNA, 22 nt, Escherichia coli CFT073
aaaauugccuguugcgcuacgu

SEQ ID NO: 2638099 - RNA, 20 nt, Escherichia coli CFT073
aaaauugucuuuuucaaagu

SEQ ID NO: 2638100 - RNA, 17 nt, Escherichia coli CFT073
aaaauuuauccagcgca

SEQ ID NO: 2638101 - RNA, 13 nt, Escherichia coli CFT073
aaaauuucacaua

SEQ ID NO: 2638102 - RNA, 23 nt, Escherichia coli CFT073
aaaauuucucuuucacuccauug

SEQ ID NO: 2638103 - RNA, 18 nt, Escherichia coli CFT073
aaaauuucuuuuuuucau

SEQ ID NO: 2638104 - RNA, 23 nt, Escherichia coli CFT073
aaaauuuuauccgcaaagauuug

SEQ ID NO: 2638105 - RNA, 22 nt, Escherichia coli CFT073
aaaauuuuuucagauaaaagcu

SEQ ID NO: 2638106 - RNA, 15 nt, Escherichia coli CFT073
aaacaaacaugaauc

SEQ ID NO: 2638107 - RNA, 22 nt, Escherichia coli CFT073
aaacaaacugcgauuuaacgcc

SEQ ID NO: 2638108 - RNA, 14 nt, Escherichia coli CFT073
aaacaaaucacuau

SEQ ID NO: 2638109 - RNA, 14 nt, Escherichia coli CFT073
aaacaacaugcuau

SEQ ID NO: 2638110 - RNA, 13 nt, Escherichia coli CFT073
aaacaaccccauc

SEQ ID NO: 2638111 - RNA, 15 nt, Escherichia coli CFT073
aaacaacgcuucaaa

SEQ ID NO: 2638112 - RNA, 24 nt, Escherichia coli CFT073
aaacaagacaucacucacgacaca

SEQ ID NO: 2638113 - RNA, 20 nt, Escherichia coli CFT073
aaacaagaucgcccugaggg

SEQ ID NO: 2638114 - RNA, 17 nt, Escherichia coli CFT073
aaacaaggaucgcgaca

SEQ ID NO: 2638115 - RNA, 11 nt, Escherichia coli CFT073
aaacaauaaua

SEQ ID NO: 2638116 - RNA, 16 nt, Escherichia coli CFT073
aaacaauaauauugcu

SEQ ID NO: 2638117 - RNA, 14 nt, Escherichia coli CFT073
aaacaaucguugcc

SEQ ID NO: 2638118 - RNA, 14 nt, Escherichia coli CFT073
aaacacaucaguga

SEQ ID NO: 2638119 - RNA, 16 nt, Escherichia coli CFT073
aaacgaccaaucgcgg

SEQ ID NO: 2638120 - RNA, 13 nt, Escherichia coli CFT073
aaacgaccacucu

SEQ ID NO: 2638121 - RNA, 17 nt, Escherichia coli CFT073
aaacgaccacucuuucg

SEQ ID NO: 2638122 - RNA, 15 nt, Escherichia coli CFT073
aaacgagccauaaaa

SEQ ID NO: 2638123 - RNA, 19 nt, Escherichia coli CFT073
aaacgagccauaaaaucac

SEQ ID NO: 2638124 - RNA, 21 nt, Escherichia coli CFT073
aaacgagcgauccaacuaaau

SEQ ID NO: 2638125 - RNA, 22 nt, Escherichia coli CFT073
aaacgauaauacgucggcauca

SEQ ID NO: 2638126 - RNA, 16 nt, Escherichia coli CFT073
aaacgauauccugcug

SEQ ID NO: 2638127 - RNA, 15 nt, Escherichia coli CFT073
aaacgauuaucaaca

SEQ ID NO: 2638128 - RNA, 19 nt, Escherichia coli CFT073
aaacgauucggcaaucaca

SEQ ID NO: 2638129 - RNA, 19 nt, Escherichia coli CFT073
aaacgcaagguuguugaaa

SEQ ID NO: 2638130 - RNA, 14 nt, Escherichia coli CFT073
aaacgcaguuuaau

SEQ ID NO: 2638131 - RNA, 20 nt, Escherichia coli CFT073
aaacgcauaaaacggcgcau

SEQ ID NO: 2638132 - RNA, 16 nt, Escherichia coli CFT073
aaacgcauaucgcccu

SEQ ID NO: 2638133 - RNA, 14 nt, Escherichia coli CFT073
aaacgccaccagau

SEQ ID NO: 2638134 - RNA, 19 nt, Escherichia coli CFT073
aaacgccaccuuuucggug

SEQ ID NO: 2638135 - RNA, 14 nt, Escherichia coli CFT073
aaacgccagaauca

SEQ ID NO: 2638136 - RNA, 13 nt, Escherichia coli CFT073
aaacgccagcaug

SEQ ID NO: 2638137 - RNA, 19 nt, Escherichia coli CFT073
aaacgccauaaacuucauu

SEQ ID NO: 2638138 - RNA, 13 nt, Escherichia coli CFT073
aaacgccgcuggu

SEQ ID NO: 2638139 - RNA, 23 nt, Escherichia coli CFT073
aaacgccgucgccuucauaccau

SEQ ID NO: 2638140 - RNA, 19 nt, Escherichia coli CFT073
aaacgccucauccggccua

SEQ ID NO: 2638141 - RNA, 20 nt, Escherichia coli CFT073
aaacgccugaccguugauuu

SEQ ID NO: 2638142 - RNA, 14 nt, Escherichia coli CFT073
aaacgccugcuccu

SEQ ID NO: 2638143 - RNA, 16 nt, Escherichia coli CFT073
aaacgccuuauccggc

SEQ ID NO: 2638144 - RNA, 21 nt, Escherichia coli CFT073
aaacgcgccagcgucgcaucc

SEQ ID NO: 2638145 - RNA, 13 nt, Escherichia coli CFT073
aaacgcgcggcaa

SEQ ID NO: 2638146 - RNA, 19 nt, Escherichia coli CFT073
aaacgcgucugaccgucuu

SEQ ID NO: 2638147 - RNA, 16 nt, Escherichia coli CFT073
aaacgcucaaacagcg

SEQ ID NO: 2638148 - RNA, 19 nt, Escherichia coli CFT073
aaacgcucauaaauugcag

SEQ ID NO: 2638149 - RNA, 20 nt, Escherichia coli CFT073
aaacgcuccugcuacaccau

SEQ ID NO: 2638150 - RNA, 12 nt, Escherichia coli CFT073
aaacgcucggca

SEQ ID NO: 2638151 - RNA, 13 nt, Escherichia coli CFT073
aaacgcuggaugu

SEQ ID NO: 2638152 - RNA, 21 nt, Escherichia coli CFT073
aaacgcuggugaaaucagccg

SEQ ID NO: 2638153 - RNA, 20 nt, Escherichia coli CFT073
aaacgcuguaauuaccagcg

SEQ ID NO: 2638154 - RNA, 21 nt, Escherichia coli CFT073
aaacgcugugcguaaucgccg

SEQ ID NO: 2638155 - RNA, 21 nt, Escherichia coli CFT073
aaacgcuuauaguaacguuug

SEQ ID NO: 2638156 - RNA, 15 nt, Escherichia coli CFT073
aaacgcuucucaaga

SEQ ID NO: 2638157 - RNA, 14 nt, Escherichia coli CFT073
aaacgcuuuuaacg

SEQ ID NO: 2638158 - RNA, 22 nt, Escherichia coli CFT073
aaacggaaagcagauaacccag

SEQ ID NO: 2638159 - RNA, 21 nt, Escherichia coli CFT073
aaacggcaggagagauacccc

SEQ ID NO: 2638160 - RNA, 20 nt, Escherichia coli CFT073
aaacggcauaaauuucaggc

SEQ ID NO: 2638161 - RNA, 11 nt, Escherichia coli CFT073
aaacggcgcau

SEQ ID NO: 2638162 - RNA, 22 nt, Escherichia coli CFT073
aaacggcgucgauugcucaaca

SEQ ID NO: 2638163 - RNA, 19 nt, Escherichia coli CFT073
aaacggcuaaggcagugau

SEQ ID NO: 2638164 - RNA, 13 nt, Escherichia coli CFT073
aaacggcugggaa

SEQ ID NO: 2638165 - RNA, 20 nt, Escherichia coli CFT073
aaacggcugggaaaucacca

SEQ ID NO: 2638166 - RNA, 17 nt, Escherichia coli CFT073
aaacgggcaagccagca

SEQ ID NO: 2638167 - RNA, 19 nt, Escherichia coli CFT073
aaacgggcugcccggauag

SEQ ID NO: 2638168 - RNA, 18 nt, Escherichia coli CFT073
aaacggucuacauugcuc

SEQ ID NO: 2638169 - RNA, 19 nt, Escherichia coli CFT073
aaacggugagacgccagaa

SEQ ID NO: 2638170 - RNA, 21 nt, Escherichia coli CFT073
aaacgguggccacagcaagca

SEQ ID NO: 2638171 - RNA, 13 nt, Escherichia coli CFT073
aaacgguuaugaa

SEQ ID NO: 2638172 - RNA, 16 nt, Escherichia coli CFT073
aaacgguucgcggugc

SEQ ID NO: 2638173 - RNA, 20 nt, Escherichia coli CFT073
aaacguagcggaaaucacag

SEQ ID NO: 2638174 - RNA, 15 nt, Escherichia coli CFT073
aaacgucuugucaac

SEQ ID NO: 2638175 - RNA, 15 nt, Escherichia coli CFT073
aaacgugaauuuuua

SEQ ID NO: 2638176 - RNA, 18 nt, Escherichia coli CFT073
aaacguggccuccaaaaa

SEQ ID NO: 2638177 - RNA, 22 nt, Escherichia coli CFT073
aaacguggccuccaaaaaacaa

SEQ ID NO: 2638178 - RNA, 22 nt, Escherichia coli CFT073
aaacguuaacgccccacuccuc

SEQ ID NO: 2638179 - RNA, 23 nt, Escherichia coli CFT073
aaacguucaucgggcaucgcaac

SEQ ID NO: 2638180 - RNA, 13 nt, Escherichia coli CFT073
aaacuaaccagac

SEQ ID NO: 2638181 - RNA, 15 nt, Escherichia coli CFT073
aaacuacacuccgua

SEQ ID NO: 2638182 - RNA, 16 nt, Escherichia coli CFT073
aaacuacagaugaaau

SEQ ID NO: 2638183 - RNA, 17 nt, Escherichia coli CFT073
aaacuacgcugcggcga

SEQ ID NO: 2638184 - RNA, 17 nt, Escherichia coli CFT073
aaacuaucccaucagcg

SEQ ID NO: 2638185 - RNA, 14 nt, Escherichia coli CFT073
aaacuaucugaaaa

SEQ ID NO: 2638186 - RNA, 18 nt, Escherichia coli CFT073
aaacucaagcuaaaccaa

SEQ ID NO: 2638187 - RNA, 19 nt, Escherichia coli CFT073
aaacucaagcuaaaccaau

SEQ ID NO: 2638188 - RNA, 20 nt, Escherichia coli CFT073
aaacucaagcuaaaccaaua

SEQ ID NO: 2638189 - RNA, 15 nt, Escherichia coli CFT073
aaacucaauucacgc

SEQ ID NO: 2638190 - RNA, 16 nt, Escherichia coli CFT073
aaacucacaaccaggg

SEQ ID NO: 2638191 - RNA, 13 nt, Escherichia coli CFT073
aaacucaccgcgc

SEQ ID NO: 2638192 - RNA, 15 nt, Escherichia coli CFT073
aaacucaccgcgcac

SEQ ID NO: 2638193 - RNA, 20 nt, Escherichia coli CFT073
aaacucacugccagcaucag

SEQ ID NO: 2638194 - RNA, 14 nt, Escherichia coli CFT073
aaacucaugggucu

SEQ ID NO: 2638195 - RNA, 14 nt, Escherichia coli CFT073
aaacuccagcccuu

SEQ ID NO: 2638196 - RNA, 11 nt, Escherichia coli CFT073
aaacucgcggc

SEQ ID NO: 2638197 - RNA, 14 nt, Escherichia coli CFT073
aaacucgcugcgga

SEQ ID NO: 2638198 - RNA, 19 nt, Escherichia coli CFT073
aaacucgcuggcggcuggc

SEQ ID NO: 2638199 - RNA, 21 nt, Escherichia coli CFT073
aaacucggucacgcggucauc

SEQ ID NO: 2638200 - RNA, 14 nt, Escherichia coli CFT073
aaacucucccaugc

SEQ ID NO: 2638201 - RNA, 16 nt, Escherichia coli CFT073
aaacucugcggcauca

SEQ ID NO: 2638202 - RNA, 14 nt, Escherichia coli CFT073
aaacugaagcgcgc

SEQ ID NO: 2638203 - RNA, 22 nt, Escherichia coli CFT073
aaacugaccgucuccaagauau

SEQ ID NO: 2638204 - RNA, 19 nt, Escherichia coli CFT073
aaacugaucuuuaucaagc

SEQ ID NO: 2638205 - RNA, 13 nt, Escherichia coli CFT073
aaacugcagcagg

SEQ ID NO: 2638206 - RNA, 14 nt, Escherichia coli CFT073
aaacugccccgcca

SEQ ID NO: 2638207 - RNA, 18 nt, Escherichia coli CFT073
aaacugccccgccagugc

SEQ ID NO: 2638208 - RNA, 22 nt, Escherichia coli CFT073
aaacugccgucaauuuuaagca

SEQ ID NO: 2638209 - RNA, 18 nt, Escherichia coli CFT073
aaacugcguagaguccag

SEQ ID NO: 2638210 - RNA, 17 nt, Escherichia coli CFT073
aaacugcgugugacaaa

SEQ ID NO: 2638211 - RNA, 15 nt, Escherichia coli CFT073
aaacuggaauagcgc

SEQ ID NO: 2638212 - RNA, 15 nt, Escherichia coli CFT073
aaacuggcugaugcu

SEQ ID NO: 2638213 - RNA, 22 nt, Escherichia coli CFT073
aaacuggcugaugcuggcaccg

SEQ ID NO: 2638214 - RNA, 13 nt, Escherichia coli CFT073
aaacuggcugugc

SEQ ID NO: 2638215 - RNA, 15 nt, Escherichia coli CFT073
aaacuggcugugcgu

SEQ ID NO: 2638216 - RNA, 21 nt, Escherichia coli CFT073
aaacuggguuuugaucuccag

SEQ ID NO: 2638217 - RNA, 18 nt, Escherichia coli CFT073
aaacuggugguaagaaua

SEQ ID NO: 2638218 - RNA, 19 nt, Escherichia coli CFT073
aaacugguuauaugaauac

SEQ ID NO: 2638219 - RNA, 22 nt, Escherichia coli CFT073
aaacugguugcaacaucaaacu

SEQ ID NO: 2638220 - RNA, 24 nt, Escherichia coli CFT073
aaacuguaucccagcccagcggaa

SEQ ID NO: 2638221 - RNA, 16 nt, Escherichia coli CFT073
aaacugucaacaccag

SEQ ID NO: 2638222 - RNA, 18 nt, Escherichia coli CFT073
aaacugugaguacccuuu

SEQ ID NO: 2638223 - RNA, 16 nt, Escherichia coli CFT073
aaacugugauugugau

SEQ ID NO: 2638224 - RNA, 19 nt, Escherichia coli CFT073
aaacuguucgguacaauca

SEQ ID NO: 2638225 - RNA, 13 nt, Escherichia coli CFT073
aaacuguuuccag

SEQ ID NO: 2638226 - RNA, 18 nt, Escherichia coli CFT073
aaacuuauuuaaacccuu

SEQ ID NO: 2638227 - RNA, 24 nt, Escherichia coli CFT073
aaagcguucagugaucgccugcau

SEQ ID NO: 2638228 - RNA, 21 nt, Escherichia coli CFT073
aaagcguuccacgucacaggc

SEQ ID NO: 2638229 - RNA, 15 nt, Escherichia coli CFT073
aaagcuaacagcgcc

SEQ ID NO: 2638230 - RNA, 17 nt, Escherichia coli CFT073
aaagcucacuuugucug

SEQ ID NO: 2638231 - RNA, 13 nt, Escherichia coli CFT073
aaagcucuucaug

SEQ ID NO: 2638232 - RNA, 12 nt, Escherichia coli CFT073
aaagcugagaaa

SEQ ID NO: 2638233 - RNA, 18 nt, Escherichia coli CFT073
aaagcugagaaaauguau

SEQ ID NO: 2638234 - RNA, 15 nt, Escherichia coli CFT073
aaagcugauaaucau

SEQ ID NO: 2638235 - RNA, 12 nt, Escherichia coli CFT073
aaagcugcggau

SEQ ID NO: 2638236 - RNA, 19 nt, Escherichia coli CFT073
aaagcugcugaccaccagc

SEQ ID NO: 2638237 - RNA, 18 nt, Escherichia coli CFT073
aaagcugcugcuuuuccc

SEQ ID NO: 2638238 - RNA, 17 nt, Escherichia coli CFT073
aaagcugucaccaauca

SEQ ID NO: 2638239 - RNA, 21 nt, Escherichia coli CFT073
aaagcuguuaucgauauacaa

SEQ ID NO: 2638240 - RNA, 19 nt, Escherichia coli CFT073
aaagcuuaugcuguacuuu

SEQ ID NO: 2638241 - RNA, 14 nt, Escherichia coli CFT073
aaagcuuuuuauua

SEQ ID NO: 2638242 - RNA, 15 nt, Escherichia coli CFT073
aaaggacagaguguu

SEQ ID NO: 2638243 - RNA, 16 nt, Escherichia coli CFT073
aaaggauaaauaaaau

SEQ ID NO: 2638244 - RNA, 17 nt, Escherichia coli CFT073
aaaggauauucgucgca

SEQ ID NO: 2638245 - RNA, 16 nt, Escherichia coli CFT073
aaaggcaaaaugccag

SEQ ID NO: 2638246 - RNA, 18 nt, Escherichia coli CFT073
aaaggcaaaaugccagcc

SEQ ID NO: 2638247 - RNA, 23 nt, Escherichia coli CFT073
aaaggccgcaggcuguuaccccu

SEQ ID NO: 2638248 - RNA, 23 nt, Escherichia coli CFT073
aaaggcguuaugcugcggcaucg

SEQ ID NO: 2638249 - RNA, 13 nt, Escherichia coli CFT073
aaaggcugugaaa

SEQ ID NO: 2638250 - RNA, 20 nt, Escherichia coli CFT073
aaagggcuaacgugcagguu

SEQ ID NO: 2638251 - RNA, 14 nt, Escherichia coli CFT073
aaagguaaggauaa

SEQ ID NO: 2638252 - RNA, 18 nt, Escherichia coli CFT073
aaagguaaggauaaaaaa

SEQ ID NO: 2638253 - RNA, 15 nt, Escherichia coli CFT073
aaagguauuauugau

SEQ ID NO: 2638254 - RNA, 13 nt, Escherichia coli CFT073
aaaggucaauucc

SEQ ID NO: 2638255 - RNA, 22 nt, Escherichia coli CFT073
aaaggucaucacaucccagcag

SEQ ID NO: 2638256 - RNA, 13 nt, Escherichia coli CFT073
aaaggucaucauc

SEQ ID NO: 2638257 - RNA, 16 nt, Escherichia coli CFT073
aaaggucaucaucacu

SEQ ID NO: 2638258 - RNA, 14 nt, Escherichia coli CFT073
aaaggugacuggca

SEQ ID NO: 2638259 - RNA, 22 nt, Escherichia coli CFT073
aaaggugacuggcagaaugaag

SEQ ID NO: 2638260 - RNA, 15 nt, Escherichia coli CFT073
aaaggugagucgcaa

SEQ ID NO: 2638261 - RNA, 14 nt, Escherichia coli CFT073
aaaggugccacagc

SEQ ID NO: 2638262 - RNA, 21 nt, Escherichia coli CFT073
aaagguugcagcuccccacac

SEQ ID NO: 2638263 - RNA, 23 nt, Escherichia coli CFT073
aaaguacacauugccauuguugu

SEQ ID NO: 2638264 - RNA, 17 nt, Escherichia coli CFT073
aaaguacgcuuucccuu

SEQ ID NO: 2638265 - RNA, 21 nt, Escherichia coli CFT073
aaaguacucuuugaacagcca

SEQ ID NO: 2638266 - RNA, 22 nt, Escherichia coli CFT073
aaaguauggacgugcucugguu

SEQ ID NO: 2638267 - RNA, 17 nt, Escherichia coli CFT073
aaagucaaaauucaacu

SEQ ID NO: 2638268 - RNA, 13 nt, Escherichia coli CFT073
aaagucacauucc

SEQ ID NO: 2638269 - RNA, 22 nt, Escherichia coli CFT073
aaagucacgccaauaaucgauu

SEQ ID NO: 2638270 - RNA, 19 nt, Escherichia coli CFT073
aaagucaggcaauucuuuc

SEQ ID NO: 2638271 - RNA, 12 nt, Escherichia coli CFT073
aaagucaucaau

SEQ ID NO: 2638272 - RNA, 11 nt, Escherichia coli CFT073
aaagucaugcg

SEQ ID NO: 2638273 - RNA, 19 nt, Escherichia coli CFT073
aaagucauuccuucaaccc

SEQ ID NO: 2638274 - RNA, 20 nt, Escherichia coli CFT073
aaagucccuucccagccggg

SEQ ID NO: 2638275 - RNA, 15 nt, Escherichia coli CFT073
aaagucggcaccagu

SEQ ID NO: 2638276 - RNA, 17 nt, Escherichia coli CFT073
aaagucggggagaaagu

SEQ ID NO: 2638277 - RNA, 18 nt, Escherichia coli CFT073
aaagugaaugucggcggc

SEQ ID NO: 2638278 - RNA, 16 nt, Escherichia coli CFT073
aaagugauuuacuuuc

SEQ ID NO: 2638279 - RNA, 23 nt, Escherichia coli CFT073
aaagugccgccagcuucgcuucc

SEQ ID NO: 2638280 - RNA, 19 nt, Escherichia coli CFT073
aaagugccggauguucgca

SEQ ID NO: 2638281 - RNA, 23 nt, Escherichia coli CFT073
aaagugcgccgaggaaacauuug

SEQ ID NO: 2638282 - RNA, 17 nt, Escherichia coli CFT073
aaagugugcaucgccgg

SEQ ID NO: 2638283 - RNA, 13 nt, Escherichia coli CFT073
aaaguucaaccuc

SEQ ID NO: 2638284 - RNA, 21 nt, Escherichia coli CFT073
aaaguugaagccgaacagucg

SEQ ID NO: 2638285 - RNA, 21 nt, Escherichia coli CFT073
aaaguugaagcugaacagucg

SEQ ID NO: 2638286 - RNA, 20 nt, Escherichia coli CFT073
aaaguuggcguucacugccg

SEQ ID NO: 2638287 - RNA, 12 nt, Escherichia coli CFT073
aaaguuuaacua

SEQ ID NO: 2638288 - RNA, 21 nt, Escherichia coli CFT073
aaaguuuauuacucagcgcaa

SEQ ID NO: 2638289 - RNA, 19 nt, Escherichia coli CFT073
aaaguuuccuguuucucau

SEQ ID NO: 2638290 - RNA, 20 nt, Escherichia coli CFT073
aaaguuuccuguuucucauu

SEQ ID NO: 2638291 - RNA, 16 nt, Escherichia coli CFT073
aaaguuuugugcuuug

SEQ ID NO: 2638292 - RNA, 17 nt, Escherichia coli CFT073
aaaguuuugugcuuugu

SEQ ID NO: 2638293 - RNA, 21 nt, Escherichia coli CFT073
aaaguuuuuauauuuuuugcu

SEQ ID NO: 2638294 - RNA, 21 nt, Escherichia coli CFT073
aaauaaaaaaacgccagaauc

SEQ ID NO: 2638295 - RNA, 15 nt, Escherichia coli CFT073
aaauaaacaacaaaa

SEQ ID NO: 2638296 - RNA, 16 nt, Escherichia coli CFT073
aaauaaacaacaaaau

SEQ ID NO: 2638297 - RNA, 18 nt, Escherichia coli CFT073
aaauaaaggguaauauau

SEQ ID NO: 2638298 - RNA, 22 nt, Escherichia coli CFT073
aaauaaaucaaagucagaucaa

SEQ ID NO: 2638299 - RNA, 23 nt, Escherichia coli CFT073
aaauaaaugcuugacucuguagc

SEQ ID NO: 2638300 - RNA, 15 nt, Escherichia coli CFT073
aaauaacaaauaauu

SEQ ID NO: 2638301 - RNA, 19 nt, Escherichia coli CFT073
aaauaacagugauugcuuu

SEQ ID NO: 2638302 - RNA, 13 nt, Escherichia coli CFT073
aaauaacauaucc

SEQ ID NO: 2638303 - RNA, 19 nt, Escherichia coli CFT073
aaauaaccgccaccaggaa

SEQ ID NO: 2638304 - RNA, 22 nt, Escherichia coli CFT073
aaauaaccgguauugcuccaga

SEQ ID NO: 2638305 - RNA, 18 nt, Escherichia coli CFT073
aaauaacgaucaucacga

SEQ ID NO: 2638306 - RNA, 20 nt, Escherichia coli CFT073
aaauaacgccccggcaaaac

SEQ ID NO: 2638307 - RNA, 18 nt, Escherichia coli CFT073
aaauaacgguauugcuuu

SEQ ID NO: 2638308 - RNA, 14 nt, Escherichia coli CFT073
aaauaacgucgcca

SEQ ID NO: 2638309 - RNA, 15 nt, Escherichia coli CFT073
aaauaacugguuagc

SEQ ID NO: 2638310 - RNA, 13 nt, Escherichia coli CFT073
aaauaagaaaagc

SEQ ID NO: 2638311 - RNA, 20 nt, Escherichia coli CFT073
aaauaagaugcgaguaaaca

SEQ ID NO: 2638312 - RNA, 19 nt, Escherichia coli CFT073
aaauaagcacaaagcaaua

SEQ ID NO: 2638313 - RNA, 20 nt, Escherichia coli CFT073
aaauaagcacaaagcaauau

SEQ ID NO: 2638314 - RNA, 16 nt, Escherichia coli CFT073
aaauaauaaguaaaca

SEQ ID NO: 2638315 - RNA, 19 nt, Escherichia coli CFT073
aaauaauacguagcaccaa

SEQ ID NO: 2638316 - RNA, 21 nt, Escherichia coli CFT073
aaauaauaucagccuuuucau

SEQ ID NO: 2638317 - RNA, 13 nt, Escherichia coli CFT073
aaauaaucaaaug

SEQ ID NO: 2638318 - RNA, 12 nt, Escherichia coli CFT073
aaauaaucacca

SEQ ID NO: 2638319 - RNA, 22 nt, Escherichia coli CFT073
aaauaaucgacgaggaaaauga

SEQ ID NO: 2638320 - RNA, 13 nt, Escherichia coli CFT073
aaauaaucucacc

SEQ ID NO: 2638321 - RNA, 15 nt, Escherichia coli CFT073
aaauaaucucaccau

SEQ ID NO: 2638322 - RNA, 17 nt, Escherichia coli CFT073
aaauaaucucaccauuu

SEQ ID NO: 2638323 - RNA, 19 nt, Escherichia coli CFT073
aaauaaucuguugauuuaa

SEQ ID NO: 2638324 - RNA, 13 nt, Escherichia coli CFT073
aaauaauuugaac

SEQ ID NO: 2638325 - RNA, 20 nt, Escherichia coli CFT073
aaauacaaacgccauaaacu

SEQ ID NO: 2638326 - RNA, 18 nt, Escherichia coli CFT073
aaauacagcaauggaaaa

SEQ ID NO: 2638327 - RNA, 16 nt, Escherichia coli CFT073
aaauaccacucagcuu

SEQ ID NO: 2638328 - RNA, 18 nt, Escherichia coli CFT073
aaauaccauuagucacau

SEQ ID NO: 2638329 - RNA, 19 nt, Escherichia coli CFT073
aaauaccauuagucacauu

SEQ ID NO: 2638330 - RNA, 14 nt, Escherichia coli CFT073
aaauacgacugaua

SEQ ID NO: 2638331 - RNA, 16 nt, Escherichia coli CFT073
aaauacuaaauaugaa

SEQ ID NO: 2638332 - RNA, 17 nt, Escherichia coli CFT073
aaauacuaaauaugaaa

SEQ ID NO: 2638333 - RNA, 14 nt, Escherichia coli CFT073
aaauacucauuaau

SEQ ID NO: 2638334 - RNA, 13 nt, Escherichia coli CFT073
aaauacugcugca

SEQ ID NO: 2638335 - RNA, 17 nt, Escherichia coli CFT073
aaaucuucaagcaucgg

SEQ ID NO: 2638336 - RNA, 17 nt, Escherichia coli CFT073
aaaucuuccagaaugcc

SEQ ID NO: 2638337 - RNA, 14 nt, Escherichia coli CFT073
aaaucuuugaaaua

SEQ ID NO: 2638338 - RNA, 13 nt, Escherichia coli CFT073
aaaugaaagcagc

SEQ ID NO: 2638339 - RNA, 22 nt, Escherichia coli CFT073
aaaugaagaaaaaccguauuca

SEQ ID NO: 2638340 - RNA, 22 nt, Escherichia coli CFT073
aaaugaauaacuuccuguaacc

SEQ ID NO: 2638341 - RNA, 23 nt, Escherichia coli CFT073
aaaugacauucacgcugucggca

SEQ ID NO: 2638342 - RNA, 21 nt, Escherichia coli CFT073
aaaugacccauuuucucggcu

SEQ ID NO: 2638343 - RNA, 18 nt, Escherichia coli CFT073
aaaugacgcuuuauucau

SEQ ID NO: 2638344 - RNA, 19 nt, Escherichia coli CFT073
aaaugacgcuuuauucaug

SEQ ID NO: 2638345 - RNA, 17 nt, Escherichia coli CFT073
aaaugacgggccaagca

SEQ ID NO: 2638346 - RNA, 13 nt, Escherichia coli CFT073
aaaugagaaaacu

SEQ ID NO: 2638347 - RNA, 23 nt, Escherichia coli CFT073
aaaugagaaaacuaucugaaaau

SEQ ID NO: 2638348 - RNA, 15 nt, Escherichia coli CFT073
aaaugaucaauaauu

SEQ ID NO: 2638349 - RNA, 15 nt, Escherichia coli CFT073
aaaugaugauugacc

SEQ ID NO: 2638350 - RNA, 13 nt, Escherichia coli CFT073
aaaugaugcacca

SEQ ID NO: 2638351 - RNA, 21 nt, Escherichia coli CFT073
aaaugaugucaaccauccgaa

SEQ ID NO: 2638352 - RNA, 19 nt, Escherichia coli CFT073
aaaugcaacauuaucugau

SEQ ID NO: 2638353 - RNA, 18 nt, Escherichia coli CFT073
aaaugcacgcugccuggu

SEQ ID NO: 2638354 - RNA, 16 nt, Escherichia coli CFT073
aaaugcagcaaccaga

SEQ ID NO: 2638355 - RNA, 12 nt, Escherichia coli CFT073
aaaugcaggcag

SEQ ID NO: 2638356 - RNA, 16 nt, Escherichia coli CFT073
aaaugcauacaugcuu

SEQ ID NO: 2638357 - RNA, 23 nt, Escherichia coli CFT073
aaaugccaaauguauccaucacc

SEQ ID NO: 2638358 - RNA, 22 nt, Escherichia coli CFT073
aaaugccccacuuuacggcccg

SEQ ID NO: 2638359 - RNA, 16 nt, Escherichia coli CFT073
aaaugcccgacaaaaa

SEQ ID NO: 2638360 - RNA, 15 nt, Escherichia coli CFT073
aaaugccgcacauca

SEQ ID NO: 2638361 - RNA, 16 nt, Escherichia coli CFT073
aaaugccgcacaucac

SEQ ID NO: 2638362 - RNA, 23 nt, Escherichia coli CFT073
aaaugccggaauuaauaauccgg

SEQ ID NO: 2638363 - RNA, 20 nt, Escherichia coli CFT073
aaaugccgguuaauacgccg

SEQ ID NO: 2638364 - RNA, 13 nt, Escherichia coli CFT073
aaaugcgaaaaaa

SEQ ID NO: 2638365 - RNA, 11 nt, Escherichia coli CFT073
aaaugcgcaug

SEQ ID NO: 2638366 - RNA, 17 nt, Escherichia coli CFT073
aaaugcgcuuaaucaau

SEQ ID NO: 2638367 - RNA, 19 nt, Escherichia coli CFT073
aaaugcgggcuuggcuggu

SEQ ID NO: 2638368 - RNA, 15 nt, Escherichia coli CFT073
aaaugcugguuuugu

SEQ ID NO: 2638369 - RNA, 18 nt, Escherichia coli CFT073
aaauggagagaaccagcg

SEQ ID NO: 2638370 - RNA, 17 nt, Escherichia coli CFT073
aaauggauaagaaagau

SEQ ID NO: 2638371 - RNA, 12 nt, Escherichia coli CFT073
aaauggcaggca

SEQ ID NO: 2638372 - RNA, 17 nt, Escherichia coli CFT073
aaauggcugaccggaau

SEQ ID NO: 2638373 - RNA, 17 nt, Escherichia coli CFT073
aaauggcuggcagcaga

SEQ ID NO: 2638374 - RNA, 19 nt, Escherichia coli CFT073
aaaugggggagagccagca

SEQ ID NO: 2638375 - RNA, 12 nt, Escherichia coli CFT073
aaauggucacac

SEQ ID NO: 2638376 - RNA, 16 nt, Escherichia coli CFT073
aaauggucacacacaa

SEQ ID NO: 2638377 - RNA, 13 nt, Escherichia coli CFT073
aaauggucagcca

SEQ ID NO: 2638378 - RNA, 16 nt, Escherichia coli CFT073
aaauggugugcauggu

SEQ ID NO: 2638379 - RNA, 16 nt, Escherichia coli CFT073
aaauguauuucaucau

SEQ ID NO: 2638380 - RNA, 23 nt, Escherichia coli CFT073
aaaugucagggacguaccaauga

SEQ ID NO: 2638381 - RNA, 19 nt, Escherichia coli CFT073
aaaugucgauuaucgacuc

SEQ ID NO: 2638382 - RNA, 19 nt, Escherichia coli CFT073
aaaugugccggaugcauca

SEQ ID NO: 2638383 - RNA, 19 nt, Escherichia coli CFT073
aaauguguacuucucugug

SEQ ID NO: 2638384 - RNA, 18 nt, Escherichia coli CFT073
aaauguugaauugcaggg

SEQ ID NO: 2638385 - RNA, 14 nt, Escherichia coli CFT073
aaauuaagcggcaa

SEQ ID NO: 2638386 - RNA, 16 nt, Escherichia coli CFT073
aaauuaccaccagcga

SEQ ID NO: 2638387 - RNA, 23 nt, Escherichia coli CFT073
aaauuaccaccagcgacagccag

SEQ ID NO: 2638388 - RNA, 20 nt, Escherichia coli CFT073
aaauuacccuucguuuuccg

SEQ ID NO: 2638389 - RNA, 19 nt, Escherichia coli CFT073
aaauuaccgcaccaccagc

SEQ ID NO: 2638390 - RNA, 22 nt, Escherichia coli CFT073
aaauuaccgcaccaccagcagc

SEQ ID NO: 2638391 - RNA, 23 nt, Escherichia coli CFT073
aaauuaccgcaccaccagcagcu

SEQ ID NO: 2638392 - RNA, 18 nt, Escherichia coli CFT073
aaauuacuggauaaccug

SEQ ID NO: 2638393 - RNA, 14 nt, Escherichia coli CFT073
aaauuauagaugca

SEQ ID NO: 2638394 - RNA, 13 nt, Escherichia coli CFT073
aaauuauggauca

SEQ ID NO: 2638395 - RNA, 15 nt, Escherichia coli CFT073
aaauuauuuuaaauu

SEQ ID NO: 2638396 - RNA, 23 nt, Escherichia coli CFT073
aaauucaaugacaguaucaccaa

SEQ ID NO: 2638397 - RNA, 19 nt, Escherichia coli CFT073
aaauucaauguguugauaa

SEQ ID NO: 2638398 - RNA, 13 nt, Escherichia coli CFT073
aaauucacgcagg

SEQ ID NO: 2638399 - RNA, 16 nt, Escherichia coli CFT073
aaauucagacuacuga

SEQ ID NO: 2638400 - RNA, 21 nt, Escherichia coli CFT073
aaauucagcauuacccgucug

SEQ ID NO: 2638401 - RNA, 20 nt, Escherichia coli CFT073
aaauucaggggaagccagac

SEQ ID NO: 2638402 - RNA, 19 nt, Escherichia coli CFT073
aaauucauccaguagaaua

SEQ ID NO: 2638403 - RNA, 22 nt, Escherichia coli CFT073
aaauucauccaguagaauaaug

SEQ ID NO: 2638404 - RNA, 18 nt, Escherichia coli CFT073
aaauucccggccucaaca

SEQ ID NO: 2638405 - RNA, 23 nt, Escherichia coli CFT073
aaauuccuguagcggaaaaucgg

SEQ ID NO: 2638406 - RNA, 16 nt, Escherichia coli CFT073
aaauucgagagaauua

SEQ ID NO: 2638407 - RNA, 13 nt, Escherichia coli CFT073
aaauucgcgcaga

SEQ ID NO: 2638408 - RNA, 13 nt, Escherichia coli CFT073
aaauugaagaguu

SEQ ID NO: 2638409 - RNA, 21 nt, Escherichia coli CFT073
aaauugagauaagcaacaaac

SEQ ID NO: 2638410 - RNA, 14 nt, Escherichia coli CFT073
aaauugcaggaacu

SEQ ID NO: 2638411 - RNA, 13 nt, Escherichia coli CFT073
aaauugccccaga

SEQ ID NO: 2638412 - RNA, 14 nt, Escherichia coli CFT073
aaauugccccagac

SEQ ID NO: 2638413 - RNA, 19 nt, Escherichia coli CFT073
aaauugcccggcuacgugc

SEQ ID NO: 2638414 - RNA, 20 nt, Escherichia coli CFT073
aaauugcgacugaaccagcg

SEQ ID NO: 2638415 - RNA, 16 nt, Escherichia coli CFT073
aaauugcgcaacuuuu

SEQ ID NO: 2638416 - RNA, 20 nt, Escherichia coli CFT073
aaauugcgcaacuuuuucuu

SEQ ID NO: 2638417 - RNA, 23 nt, Escherichia coli CFT073
aaauugcguaaagccugcuggca

SEQ ID NO: 2638418 - RNA, 15 nt, Escherichia coli CFT073
aaauugugauaaaaa

SEQ ID NO: 2638419 - RNA, 17 nt, Escherichia coli CFT073
aaauugugauaaaaauc

SEQ ID NO: 2638420 - RNA, 22 nt, Escherichia coli CFT073
aaauugugucgacauagccauc

SEQ ID NO: 2638421 - RNA, 21 nt, Escherichia coli CFT073
aaauuguugccggagaaacuc

SEQ ID NO: 2638422 - RNA, 14 nt, Escherichia coli CFT073
aaauuuaacauuac

SEQ ID NO: 2638423 - RNA, 16 nt, Escherichia coli CFT073
aaauuuaauaucuucu

SEQ ID NO: 2638424 - RNA, 19 nt, Escherichia coli CFT073
aaauuuaucgcauauccuc

SEQ ID NO: 2638425 - RNA, 17 nt, Escherichia coli CFT073
aaauuucaggcaacaaa

SEQ ID NO: 2638426 - RNA, 18 nt, Escherichia coli CFT073
aaauuucgucguaaucau

SEQ ID NO: 2638427 - RNA, 15 nt, Escherichia coli CFT073
aaauuucuaucauca

SEQ ID NO: 2638428 - RNA, 20 nt, Escherichia coli CFT073
aaauuucucccgcuaacuga

SEQ ID NO: 2638429 - RNA, 21 nt, Escherichia coli CFT073
aaauuucucuuucacuccauu

SEQ ID NO: 2638430 - RNA, 15 nt, Escherichia coli CFT073
aaauuucuucccuuu

SEQ ID NO: 2638431 - RNA, 16 nt, Escherichia coli CFT073
aaauuucuucccuuuc

SEQ ID NO: 2638432 - RNA, 17 nt, Escherichia coli CFT073
aaauuugcauaaaaauu

SEQ ID NO: 2638433 - RNA, 23 nt, Escherichia coli CFT073
aaauuuuaacgcauaauaaaggc

SEQ ID NO: 2638434 - RNA, 15 nt, Escherichia coli CFT073
aaauuuugaacagaa

SEQ ID NO: 2638435 - RNA, 12 nt, Escherichia coli CFT073
aaauuuugagug

SEQ ID NO: 2638436 - RNA, 22 nt, Escherichia coli CFT073
aaauuuuuucgcugaaggucag

SEQ ID NO: 2638437 - RNA, 18 nt, Escherichia coli CFT073
aacaaaaaacccaucaac

SEQ ID NO: 2638438 - RNA, 22 nt, Escherichia coli CFT073
aacaaaaacuuuuguauuuuac

SEQ ID NO: 2638439 - RNA, 15 nt, Escherichia coli CFT073
aacaaaaaugcaggc

SEQ ID NO: 2638440 - RNA, 18 nt, Escherichia coli CFT073
aacaaaaguggacauguu

SEQ ID NO: 2638441 - RNA, 12 nt, Escherichia coli CFT073
aacaaaaugccg

SEQ ID NO: 2638442 - RNA, 19 nt, Escherichia coli CFT073
aacaaacgauuuaucgauu

SEQ ID NO: 2638443 - RNA, 23 nt, Escherichia coli CFT073
aacacuuccgggucgcugucuuu

SEQ ID NO: 2638444 - RNA, 20 nt, Escherichia coli CFT073
aacacuuggcgucaaacgac

SEQ ID NO: 2638445 - RNA, 20 nt, Escherichia coli CFT073
aacacuuugccgucugccac

SEQ ID NO: 2638446 - RNA, 14 nt, Escherichia coli CFT073
aacagaaacgccau

SEQ ID NO: 2638447 - RNA, 17 nt, Escherichia coli CFT073
aacagaaacgccaucca

SEQ ID NO: 2638448 - RNA, 23 nt, Escherichia coli CFT073
aacagaacgcgccuuaaaaacca

SEQ ID NO: 2638449 - RNA, 18 nt, Escherichia coli CFT073
aacagaagaucaugccga

SEQ ID NO: 2638450 - RNA, 18 nt, Escherichia coli CFT073
aacagaagguauacugca

SEQ ID NO: 2638451 - RNA, 14 nt, Escherichia coli CFT073
aacagaauacccag

SEQ ID NO: 2638452 - RNA, 22 nt, Escherichia coli CFT073
aacagaauggugccgacaggug

SEQ ID NO: 2638453 - RNA, 13 nt, Escherichia coli CFT073
aacagacaaaaag

SEQ ID NO: 2638454 - RNA, 15 nt, Escherichia coli CFT073
aacagacaaaaagaa

SEQ ID NO: 2638455 - RNA, 16 nt, Escherichia coli CFT073
aacagaccagaaacgc

SEQ ID NO: 2638456 - RNA, 22 nt, Escherichia coli CFT073
aacagaccagcaaagugcgcuu

SEQ ID NO: 2638457 - RNA, 16 nt, Escherichia coli CFT073
aacagauaaaaguuac

SEQ ID NO: 2638458 - RNA, 15 nt, Escherichia coli CFT073
aacagauaaauggca

SEQ ID NO: 2638459 - RNA, 18 nt, Escherichia coli CFT073
aacagauaaccacuggca

SEQ ID NO: 2638460 - RNA, 23 nt, Escherichia coli CFT073
aacagauaauaaaaaagaaaaga

SEQ ID NO: 2638461 - RNA, 24 nt, Escherichia coli CFT073
aacagauacuggaagugaucuuuc

SEQ ID NO: 2638462 - RNA, 14 nt, Escherichia coli CFT073
aacagaucauccau

SEQ ID NO: 2638463 - RNA, 15 nt, Escherichia coli CFT073
aacagaugaaugaaa

SEQ ID NO: 2638464 - RNA, 21 nt, Escherichia coli CFT073
aacagaugaguugaaauugau

SEQ ID NO: 2638465 - RNA, 22 nt, Escherichia coli CFT073
aacagauuuugcaggccugaua

SEQ ID NO: 2638466 - RNA, 23 nt, Escherichia coli CFT073
aacagauuuugcaggccugauaa

SEQ ID NO: 2638467 - RNA, 23 nt, Escherichia coli CFT073
aacagcaaaucuccccggcgcag

SEQ ID NO: 2638468 - RNA, 16 nt, Escherichia coli CFT073
aacagcaaccuccguc

SEQ ID NO: 2638469 - RNA, 14 nt, Escherichia coli CFT073
aacagcaacucagc

SEQ ID NO: 2638470 - RNA, 14 nt, Escherichia coli CFT073
aacagcacagccag

SEQ ID NO: 2638471 - RNA, 11 nt, Escherichia coli CFT073
aacagcaccau

SEQ ID NO: 2638472 - RNA, 20 nt, Escherichia coli CFT073
aacagcagaacgaccagcgc

SEQ ID NO: 2638473 - RNA, 20 nt, Escherichia coli CFT073
aacagcagauccgguucgcc

SEQ ID NO: 2638474 - RNA, 13 nt, Escherichia coli CFT073
aacagcagaucga

SEQ ID NO: 2638475 - RNA, 17 nt, Escherichia coli CFT073
aacagcagccacggcag

SEQ ID NO: 2638476 - RNA, 22 nt, Escherichia coli CFT073
aacagccaaucauaaacgccug

SEQ ID NO: 2638477 - RNA, 13 nt, Escherichia coli CFT073
aacagccagaagc

SEQ ID NO: 2638478 - RNA, 16 nt, Escherichia coli CFT073
aacagccagaagguga

SEQ ID NO: 2638479 - RNA, 14 nt, Escherichia coli CFT073
aacagccagcagcg

SEQ ID NO: 2638480 - RNA, 22 nt, Escherichia coli CFT073
aacagccaggcuuuaccuucag

SEQ ID NO: 2638481 - RNA, 14 nt, Escherichia coli CFT073
aacagccaucgcca

SEQ ID NO: 2638482 - RNA, 17 nt, Escherichia coli CFT073
aacagccccugacuggu

SEQ ID NO: 2638483 - RNA, 15 nt, Escherichia coli CFT073
aacagccuuguauua

SEQ ID NO: 2638484 - RNA, 17 nt, Escherichia coli CFT073
aacagcgacaccagcca

SEQ ID NO: 2638485 - RNA, 16 nt, Escherichia coli CFT073
aacagcgacagauuca

SEQ ID NO: 2638486 - RNA, 13 nt, Escherichia coli CFT073
aacagcgcaccag

SEQ ID NO: 2638487 - RNA, 20 nt, Escherichia coli CFT073
aacagcgcaccagaaacaau

SEQ ID NO: 2638488 - RNA, 22 nt, Escherichia coli CFT073
aacagcgcaccagaaacaauaa

SEQ ID NO: 2638489 - RNA, 11 nt, Escherichia coli CFT073
aacagcgcauu

SEQ ID NO: 2638490 - RNA, 17 nt, Escherichia coli CFT073
aacagcgcccaacacuu

SEQ ID NO: 2638491 - RNA, 15 nt, Escherichia coli CFT073
aacagcggagcaaga

SEQ ID NO: 2638492 - RNA, 16 nt, Escherichia coli CFT073
aacagcgggacaacaa

SEQ ID NO: 2638493 - RNA, 16 nt, Escherichia coli CFT073
aacagcgucgagccau

SEQ ID NO: 2638494 - RNA, 16 nt, Escherichia coli CFT073
aacagcgugccgcgau

SEQ ID NO: 2638495 - RNA, 16 nt, Escherichia coli CFT073
aacagcucgacaccaa

SEQ ID NO: 2638496 - RNA, 23 nt, Escherichia coli CFT073
aacagcuugcuguuucgcugacg

SEQ ID NO: 2638497 - RNA, 20 nt, Escherichia coli CFT073
aacaggaauguuguccaggg

SEQ ID NO: 2638498 - RNA, 18 nt, Escherichia coli CFT073
aacaggaauucggcaucg

SEQ ID NO: 2638499 - RNA, 14 nt, Escherichia coli CFT073
aacaggcaucacuu

SEQ ID NO: 2638500 - RNA, 22 nt, Escherichia coli CFT073
aacagggauccccagccgccuc

SEQ ID NO: 2638501 - RNA, 22 nt, Escherichia coli CFT073
aacagggggaggcaucuucccg

SEQ ID NO: 2638502 - RNA, 19 nt, Escherichia coli CFT073
aacagggugcagcgagugc

SEQ ID NO: 2638503 - RNA, 18 nt, Escherichia coli CFT073
aacaggucaauuucaaua

SEQ ID NO: 2638504 - RNA, 17 nt, Escherichia coli CFT073
aacaggucacgggcaau

SEQ ID NO: 2638505 - RNA, 18 nt, Escherichia coli CFT073
aacaggugauaauccaga

SEQ ID NO: 2638506 - RNA, 19 nt, Escherichia coli CFT073
aacaggugauaauccagau

SEQ ID NO: 2638507 - RNA, 22 nt, Escherichia coli CFT073
aacagguuacgcuggauuucaa

SEQ ID NO: 2638508 - RNA, 20 nt, Escherichia coli CFT073
aacagguugccguccagcgc

SEQ ID NO: 2638509 - RNA, 14 nt, Escherichia coli CFT073
aacaguaacccagc

SEQ ID NO: 2638510 - RNA, 20 nt, Escherichia coli CFT073
aacaguaacccagcaccaac

SEQ ID NO: 2638511 - RNA, 22 nt, Escherichia coli CFT073
aacaguacaauauuaauuacuu

SEQ ID NO: 2638512 - RNA, 21 nt, Escherichia coli CFT073
aacaguagacaauuuuucaua

SEQ ID NO: 2638513 - RNA, 16 nt, Escherichia coli CFT073
aacaguagagccgcca

SEQ ID NO: 2638514 - RNA, 14 nt, Escherichia coli CFT073
aacaguaugcaaca

SEQ ID NO: 2638515 - RNA, 16 nt, Escherichia coli CFT073
aacaguaugcaacaac

SEQ ID NO: 2638516 - RNA, 21 nt, Escherichia coli CFT073
aacagucagucacaggggagg

SEQ ID NO: 2638517 - RNA, 24 nt, Escherichia coli CFT073
aacagucgcccgaccaucgccagc

SEQ ID NO: 2638518 - RNA, 22 nt, Escherichia coli CFT073
aacagucgcugaucaccguaga

SEQ ID NO: 2638519 - RNA, 12 nt, Escherichia coli CFT073
aacagugaaauc

SEQ ID NO: 2638520 - RNA, 22 nt, Escherichia coli CFT073
aacagugaccaucuuccagcau

SEQ ID NO: 2638521 - RNA, 21 nt, Escherichia coli CFT073
aacagugccgcgcauagcacc

SEQ ID NO: 2638522 - RNA, 23 nt, Escherichia coli CFT073
aacagugccgcgcauagcaccac

SEQ ID NO: 2638523 - RNA, 22 nt, Escherichia coli CFT073
aacaguguuucuccgccaauuc

SEQ ID NO: 2638524 - RNA, 23 nt, Escherichia coli CFT073
aacaguucacguccggcagcaga

SEQ ID NO: 2638525 - RNA, 15 nt, Escherichia coli CFT073
aacaguucagcaaca

SEQ ID NO: 2638526 - RNA, 18 nt, Escherichia coli CFT073
aacaguucaugguuagcc

SEQ ID NO: 2638527 - RNA, 16 nt, Escherichia coli CFT073
aacaguucugcagcgu

SEQ ID NO: 2638528 - RNA, 18 nt, Escherichia coli CFT073
aacaguugcagucucaug

SEQ ID NO: 2638529 - RNA, 13 nt, Escherichia coli CFT073
aacauaagcaaau

SEQ ID NO: 2638530 - RNA, 13 nt, Escherichia coli CFT073
aacauaauccagc

SEQ ID NO: 2638531 - RNA, 13 nt, Escherichia coli CFT073
aacauacaaauag

SEQ ID NO: 2638532 - RNA, 19 nt, Escherichia coli CFT073
aacauacaaauagccaauu

SEQ ID NO: 2638533 - RNA, 17 nt, Escherichia coli CFT073
aacauacccaguuucau

SEQ ID NO: 2638534 - RNA, 15 nt, Escherichia coli CFT073
aacauaccuaaaagc

SEQ ID NO: 2638535 - RNA, 22 nt, Escherichia coli CFT073
aacauacgacuuugcgcaggca

SEQ ID NO: 2638536 - RNA, 13 nt, Escherichia coli CFT073
aacauacggcaua

SEQ ID NO: 2638537 - RNA, 22 nt, Escherichia coli CFT073
aacauagcuuggcagagcgaca

SEQ ID NO: 2638538 - RNA, 17 nt, Escherichia coli CFT073
aacauauccccagggaa

SEQ ID NO: 2638539 - RNA, 18 nt, Escherichia coli CFT073
aacauauuacgaaugaca

SEQ ID NO: 2638540 - RNA, 23 nt, Escherichia coli CFT073
aacauauugcuccauaauugcca

SEQ ID NO: 2638541 - RNA, 13 nt, Escherichia coli CFT073
aacaucaaauaca

SEQ ID NO: 2638542 - RNA, 12 nt, Escherichia coli CFT073
aacaucaaauca

SEQ ID NO: 2638543 - RNA, 15 nt, Escherichia coli CFT073
aacaucaacagaccu

SEQ ID NO: 2638544 - RNA, 13 nt, Escherichia coli CFT073
aacaucaauaaca

SEQ ID NO: 2638545 - RNA, 23 nt, Escherichia coli CFT073
aacaucaauggaugcaucuucau

SEQ ID NO: 2638546 - RNA, 18 nt, Escherichia coli CFT073
aacaucacaccugcucag

SEQ ID NO: 2638547 - RNA, 14 nt, Escherichia coli CFT073
aacaucacgccuuc

SEQ ID NO: 2638548 - RNA, 16 nt, Escherichia coli CFT073
aacaucacgccuucaa

SEQ ID NO: 2638549 - RNA, 15 nt, Escherichia coli CFT073
aacaucacgcugacg

SEQ ID NO: 2638550 - RNA, 23 nt, Escherichia coli CFT073
aacaucacgcugacgcaucugua

SEQ ID NO: 2638551 - RNA, 13 nt, Escherichia coli CFT073
aaccauccacauu

SEQ ID NO: 2638552 - RNA, 20 nt, Escherichia coli CFT073
aaccauccgagcagcaaugc

SEQ ID NO: 2638553 - RNA, 13 nt, Escherichia coli CFT073
aaccaugcacuuu

SEQ ID NO: 2638554 - RNA, 19 nt, Escherichia coli CFT073
aaccaugccgcccagcagc

SEQ ID NO: 2638555 - RNA, 17 nt, Escherichia coli CFT073
aaccauguagacauagg

SEQ ID NO: 2638556 - RNA, 15 nt, Escherichia coli CFT073
aaccaugucaucaau

SEQ ID NO: 2638557 - RNA, 16 nt, Escherichia coli CFT073
aaccaugucaucaauu

SEQ ID NO: 2638558 - RNA, 17 nt, Escherichia coli CFT073
aaccauuaaacguacug

SEQ ID NO: 2638559 - RNA, 12 nt, Escherichia coli CFT073
aaccauuaaaua

SEQ ID NO: 2638560 - RNA, 16 nt, Escherichia coli CFT073
aaccauucccggcuuu

SEQ ID NO: 2638561 - RNA, 17 nt, Escherichia coli CFT073
aaccauugcagccaauc

SEQ ID NO: 2638562 - RNA, 15 nt, Escherichia coli CFT073
aacccaaauccgcca

SEQ ID NO: 2638563 - RNA, 14 nt, Escherichia coli CFT073
aacccaaccugcca

SEQ ID NO: 2638564 - RNA, 15 nt, Escherichia coli CFT073
aacccaaccugccag

SEQ ID NO: 2638565 - RNA, 17 nt, Escherichia coli CFT073
aacccaaccugccagag

SEQ ID NO: 2638566 - RNA, 17 nt, Escherichia coli CFT073
aacccaacggcaaacau

SEQ ID NO: 2638567 - RNA, 19 nt, Escherichia coli CFT073
aacccaacggcaaacaucg

SEQ ID NO: 2638568 - RNA, 15 nt, Escherichia coli CFT073
aacccaacuggugau

SEQ ID NO: 2638569 - RNA, 15 nt, Escherichia coli CFT073
aacccaagcgcgcug

SEQ ID NO: 2638570 - RNA, 14 nt, Escherichia coli CFT073
aacccacgaccagu

SEQ ID NO: 2638571 - RNA, 16 nt, Escherichia coli CFT073
aacccacgaccagugc

SEQ ID NO: 2638572 - RNA, 23 nt, Escherichia coli CFT073
aacccagcagcccgagcaacagu

SEQ ID NO: 2638573 - RNA, 12 nt, Escherichia coli CFT073
aacccauccagc

SEQ ID NO: 2638574 - RNA, 17 nt, Escherichia coli CFT073
aacccccugaaagcgac

SEQ ID NO: 2638575 - RNA, 18 nt, Escherichia coli CFT073
aacccgagcgccagcgaa

SEQ ID NO: 2638576 - RNA, 22 nt, Escherichia coli CFT073
aacccgaugguucccuuuuuca

SEQ ID NO: 2638577 - RNA, 19 nt, Escherichia coli CFT073
aacccgcaguccugcaggu

SEQ ID NO: 2638578 - RNA, 22 nt, Escherichia coli CFT073
aacccgcgacgacgacaggcaa

SEQ ID NO: 2638579 - RNA, 18 nt, Escherichia coli CFT073
aacccgcgaugaccaaaa

SEQ ID NO: 2638580 - RNA, 14 nt, Escherichia coli CFT073
aacccggccugaua

SEQ ID NO: 2638581 - RNA, 18 nt, Escherichia coli CFT073
aacccguaaaaaucggca

SEQ ID NO: 2638582 - RNA, 16 nt, Escherichia coli CFT073
aacccuaaagcaccca

SEQ ID NO: 2638583 - RNA, 22 nt, Escherichia coli CFT073
aacccuaaagcacccagcaauc

SEQ ID NO: 2638584 - RNA, 17 nt, Escherichia coli CFT073
aacccuaacccaacauu

SEQ ID NO: 2638585 - RNA, 21 nt, Escherichia coli CFT073
aacccucccgguuaauaagag

SEQ ID NO: 2638586 - RNA, 21 nt, Escherichia coli CFT073
aacccucuauacugcgcgccg

SEQ ID NO: 2638587 - RNA, 16 nt, Escherichia coli CFT073
aacccugcaucagaac

SEQ ID NO: 2638588 - RNA, 13 nt, Escherichia coli CFT073
aacccugcgccag

SEQ ID NO: 2638589 - RNA, 18 nt, Escherichia coli CFT073
aacccuguggaucuuccc

SEQ ID NO: 2638590 - RNA, 19 nt, Escherichia coli CFT073
aacccuguggaucuucccc

SEQ ID NO: 2638591 - RNA, 21 nt, Escherichia coli CFT073
aacccuucaagaauuaaaaua

SEQ ID NO: 2638592 - RNA, 14 nt, Escherichia coli CFT073
aacccuucgccagc

SEQ ID NO: 2638593 - RNA, 15 nt, Escherichia coli CFT073
aacccuuucaccaac

SEQ ID NO: 2638594 - RNA, 22 nt, Escherichia coli CFT073
aacccuuugcggugcagcagcu

SEQ ID NO: 2638595 - RNA, 22 nt, Escherichia coli CFT073
aaccgacaauauugaugcucgc

SEQ ID NO: 2638596 - RNA, 19 nt, Escherichia coli CFT073
aaccgacggggacucuccc

SEQ ID NO: 2638597 - RNA, 19 nt, Escherichia coli CFT073
aaccgagauaaaugccaaa

SEQ ID NO: 2638598 - RNA, 19 nt, Escherichia coli CFT073
aaccgagaugguaaagcac

SEQ ID NO: 2638599 - RNA, 19 nt, Escherichia coli CFT073
aaccgcaauaaccaucagc

SEQ ID NO: 2638600 - RNA, 15 nt, Escherichia coli CFT073
aaccgcaccaaaucc

SEQ ID NO: 2638601 - RNA, 19 nt, Escherichia coli CFT073
aaccgcaccaaauccauuu

SEQ ID NO: 2638602 - RNA, 17 nt, Escherichia coli CFT073
aaccgcacgcugcggca

SEQ ID NO: 2638603 - RNA, 18 nt, Escherichia coli CFT073
aaccgcacucagccagcc

SEQ ID NO: 2638604 - RNA, 15 nt, Escherichia coli CFT073
aaccgcagugauuuc

SEQ ID NO: 2638605 - RNA, 13 nt, Escherichia coli CFT073
aaccgcaucaugu

SEQ ID NO: 2638606 - RNA, 22 nt, Escherichia coli CFT073
aaccgcaucauguaaaucaauu

SEQ ID NO: 2638607 - RNA, 17 nt, Escherichia coli CFT073
aaccgcauccagauucu

SEQ ID NO: 2638608 - RNA, 20 nt, Escherichia coli CFT073
aaccgccaaauucggcgguu

SEQ ID NO: 2638609 - RNA, 16 nt, Escherichia coli CFT073
aaccgccaaucgccac

SEQ ID NO: 2638610 - RNA, 13 nt, Escherichia coli CFT073
aaccgccagcaca

SEQ ID NO: 2638611 - RNA, 17 nt, Escherichia coli CFT073
aaccgccaguucccccu

SEQ ID NO: 2638612 - RNA, 18 nt, Escherichia coli CFT073
aaccgccaguucccccug

SEQ ID NO: 2638613 - RNA, 24 nt, Escherichia coli CFT073
aaccgcccagcagcgccgcgccua

SEQ ID NO: 2638614 - RNA, 22 nt, Escherichia coli CFT073
aaccgcccagugccagcaccac

SEQ ID NO: 2638615 - RNA, 18 nt, Escherichia coli CFT073
aaccgccgacgcgaagca

SEQ ID NO: 2638616 - RNA, 20 nt, Escherichia coli CFT073
aaccgccgacgcgaagcaca

SEQ ID NO: 2638617 - RNA, 17 nt, Escherichia coli CFT073
aaccgccgauggcccgc

SEQ ID NO: 2638618 - RNA, 10 nt, Escherichia coli CFT073
aaccgccgcu

SEQ ID NO: 2638619 - RNA, 22 nt, Escherichia coli CFT073
aaccgccgcugucugaaugaua

SEQ ID NO: 2638620 - RNA, 20 nt, Escherichia coli CFT073
aaccgccggauagcuaauca

SEQ ID NO: 2638621 - RNA, 19 nt, Escherichia coli CFT073
aaccgcgacauacuuaaau

SEQ ID NO: 2638622 - RNA, 17 nt, Escherichia coli CFT073
aaccgcgccaugucugc

SEQ ID NO: 2638623 - RNA, 20 nt, Escherichia coli CFT073
aaccgcgccaugucugcaua

SEQ ID NO: 2638624 - RNA, 18 nt, Escherichia coli CFT073
aaccgcguaacuuuugcc

SEQ ID NO: 2638625 - RNA, 15 nt, Escherichia coli CFT073
aaccgcugccaggca

SEQ ID NO: 2638626 - RNA, 21 nt, Escherichia coli CFT073
aaccgcuggccaguuuucaga

SEQ ID NO: 2638627 - RNA, 13 nt, Escherichia coli CFT073
aaccgcuuucugc

SEQ ID NO: 2638628 - RNA, 16 nt, Escherichia coli CFT073
aaccggagcacagacu

SEQ ID NO: 2638629 - RNA, 17 nt, Escherichia coli CFT073
aaccggaucgauaaaca

SEQ ID NO: 2638630 - RNA, 18 nt, Escherichia coli CFT073
aaccggauuuucaccauc

SEQ ID NO: 2638631 - RNA, 13 nt, Escherichia coli CFT073
aaccggugcugcg

SEQ ID NO: 2638632 - RNA, 21 nt, Escherichia coli CFT073
aaccggugcugcgccuaacaa

SEQ ID NO: 2638633 - RNA, 19 nt, Escherichia coli CFT073
aaccggugugguaaauuuu

SEQ ID NO: 2638634 - RNA, 14 nt, Escherichia coli CFT073
aaccgguuuagaaa

SEQ ID NO: 2638635 - RNA, 23 nt, Escherichia coli CFT073
aaccgucacguugcgacaaacca

SEQ ID NO: 2638636 - RNA, 23 nt, Escherichia coli CFT073
aaccgucguugcugucgcgcagc

SEQ ID NO: 2638637 - RNA, 16 nt, Escherichia coli CFT073
aaccgucuuugcugau

SEQ ID NO: 2638638 - RNA, 23 nt, Escherichia coli CFT073
aaccgugauauugggucuaucca

SEQ ID NO: 2638639 - RNA, 13 nt, Escherichia coli CFT073
aaccgugcuucag

SEQ ID NO: 2638640 - RNA, 18 nt, Escherichia coli CFT073
aaccuaagaaccagaauu

SEQ ID NO: 2638641 - RNA, 15 nt, Escherichia coli CFT073
aaccuaagccgcgug

SEQ ID NO: 2638642 - RNA, 16 nt, Escherichia coli CFT073
aaccucaaaaagaaac

SEQ ID NO: 2638643 - RNA, 18 nt, Escherichia coli CFT073
aaccucaagcacagccgc

SEQ ID NO: 2638644 - RNA, 19 nt, Escherichia coli CFT073
aaccucaagcacagccgca

SEQ ID NO: 2638645 - RNA, 21 nt, Escherichia coli CFT073
aaccucacagaggucuuuucu

SEQ ID NO: 2638646 - RNA, 11 nt, Escherichia coli CFT073
aaccucucaga

SEQ ID NO: 2638647 - RNA, 13 nt, Escherichia coli CFT073
aaccucucagaau

SEQ ID NO: 2638648 - RNA, 20 nt, Escherichia coli CFT073
aaccugacggcgcaacgcau

SEQ ID NO: 2638649 - RNA, 17 nt, Escherichia coli CFT073
aaccugaggcaauaaau

SEQ ID NO: 2638650 - RNA, 12 nt, Escherichia coli CFT073
aaccugccagag

SEQ ID NO: 2638651 - RNA, 21 nt, Escherichia coli CFT073
aaccugccgcgccugcgccau

SEQ ID NO: 2638652 - RNA, 18 nt, Escherichia coli CFT073
aaccugcgccucaguuuc

SEQ ID NO: 2638653 - RNA, 18 nt, Escherichia coli CFT073
aaccuguaaaguacaaua

SEQ ID NO: 2638654 - RNA, 17 nt, Escherichia coli CFT073
aaccugugacagcagcg

SEQ ID NO: 2638655 - RNA, 18 nt, Escherichia coli CFT073
aaccuguucaacaauucg

SEQ ID NO: 2638656 - RNA, 20 nt, Escherichia coli CFT073
aaccuucacccucacgcauu

SEQ ID NO: 2638657 - RNA, 20 nt, Escherichia coli CFT073
aaccuucacggguugcgccu

SEQ ID NO: 2638658 - RNA, 21 nt, Escherichia coli CFT073
aaccuucacggguugcgccug

SEQ ID NO: 2638659 - RNA, 20 nt, Escherichia coli CFT073
aacgccuuauccggccugca

SEQ ID NO: 2638660 - RNA, 13 nt, Escherichia coli CFT073
aacgccuuccaga

SEQ ID NO: 2638661 - RNA, 20 nt, Escherichia coli CFT073
aacgccuucuccggccuacc

SEQ ID NO: 2638662 - RNA, 15 nt, Escherichia coli CFT073
aacgccuuuaccacc

SEQ ID NO: 2638663 - RNA, 20 nt, Escherichia coli CFT073
aacgccuuuaccaccagugg

SEQ ID NO: 2638664 - RNA, 21 nt, Escherichia coli CFT073
aacgccuuucagccccagcgc

SEQ ID NO: 2638665 - RNA, 19 nt, Escherichia coli CFT073
aacgcgacauaucgccagu

SEQ ID NO: 2638666 - RNA, 19 nt, Escherichia coli CFT073
aacgcgacuuaaaccgcug

SEQ ID NO: 2638667 - RNA, 15 nt, Escherichia coli CFT073
aacgcgauucccagu

SEQ ID NO: 2638668 - RNA, 23 nt, Escherichia coli CFT073
aacgcgauucccagucgcgcaau

SEQ ID NO: 2638669 - RNA, 13 nt, Escherichia coli CFT073
aacgcgccaagau

SEQ ID NO: 2638670 - RNA, 18 nt, Escherichia coli CFT073
aacgcgccaauagccgca

SEQ ID NO: 2638671 - RNA, 19 nt, Escherichia coli CFT073
aacgcgccaauagccgcac

SEQ ID NO: 2638672 - RNA, 12 nt, Escherichia coli CFT073
aacgcgccaccg

SEQ ID NO: 2638673 - RNA, 23 nt, Escherichia coli CFT073
aacgcgcccaguggaugcgccau

SEQ ID NO: 2638674 - RNA, 19 nt, Escherichia coli CFT073
aacgcgcuaaccuguuuuc

SEQ ID NO: 2638675 - RNA, 21 nt, Escherichia coli CFT073
aacgcgcugccagaucaaaca

SEQ ID NO: 2638676 - RNA, 17 nt, Escherichia coli CFT073
aacgcgcuuugaugcgu

SEQ ID NO: 2638677 - RNA, 20 nt, Escherichia coli CFT073
aacgcggcaggagagaucga

SEQ ID NO: 2638678 - RNA, 16 nt, Escherichia coli CFT073
aacgcggcguaaccac

SEQ ID NO: 2638679 - RNA, 22 nt, Escherichia coli CFT073
aacgcgugcgccuuucagcgug

SEQ ID NO: 2638680 - RNA, 14 nt, Escherichia coli CFT073
aacgcguucucgcc

SEQ ID NO: 2638681 - RNA, 22 nt, Escherichia coli CFT073
aacgcguuguaaaaacggaugc

SEQ ID NO: 2638682 - RNA, 23 nt, Escherichia coli CFT073
aacgcuaaauacugaccguccgg

SEQ ID NO: 2638683 - RNA, 13 nt, Escherichia coli CFT073
aacgcuaaccauu

SEQ ID NO: 2638684 - RNA, 22 nt, Escherichia coli CFT073
aacgcuacgcuaacuucgccau

SEQ ID NO: 2638685 - RNA, 20 nt, Escherichia coli CFT073
aacgcuaucggcauaaccaa

SEQ ID NO: 2638686 - RNA, 20 nt, Escherichia coli CFT073
aacgcucggcaacaccucag

SEQ ID NO: 2638687 - RNA, 21 nt, Escherichia coli CFT073
aacgcugacggugccagguaa

SEQ ID NO: 2638688 - RNA, 19 nt, Escherichia coli CFT073
aacgcugcauacucugcaa

SEQ ID NO: 2638689 - RNA, 16 nt, Escherichia coli CFT073
aacgcugcccgccgcg

SEQ ID NO: 2638690 - RNA, 22 nt, Escherichia coli CFT073
aacgcuggggccaucgccgccu

SEQ ID NO: 2638691 - RNA, 16 nt, Escherichia coli CFT073
aacgcuggugaaauca

SEQ ID NO: 2638692 - RNA, 19 nt, Escherichia coli CFT073
aacgcugugcguaaucgcc

SEQ ID NO: 2638693 - RNA, 21 nt, Escherichia coli CFT073
aacgcugugcguaaucgccga

SEQ ID NO: 2638694 - RNA, 17 nt, Escherichia coli CFT073
aacgcuucaaccagugc

SEQ ID NO: 2638695 - RNA, 14 nt, Escherichia coli CFT073
aacgcuucugucgc

SEQ ID NO: 2638696 - RNA, 20 nt, Escherichia coli CFT073
aacgcuuguacggcuccgcc

SEQ ID NO: 2638697 - RNA, 20 nt, Escherichia coli CFT073
aacgcuuuacucaacucccc

SEQ ID NO: 2638698 - RNA, 21 nt, Escherichia coli CFT073
aacgcuuuuaacggugccagc

SEQ ID NO: 2638699 - RNA, 16 nt, Escherichia coli CFT073
aacggaaagcagauaa

SEQ ID NO: 2638700 - RNA, 20 nt, Escherichia coli CFT073
aacggaauuuaaaugacaau

SEQ ID NO: 2638701 - RNA, 13 nt, Escherichia coli CFT073
aacggaccaauaa

SEQ ID NO: 2638702 - RNA, 20 nt, Escherichia coli CFT073
aacggaccaauaaacgccag

SEQ ID NO: 2638703 - RNA, 12 nt, Escherichia coli CFT073
aacggagccuuu

SEQ ID NO: 2638704 - RNA, 20 nt, Escherichia coli CFT073
aacggauuaucccccgguuu

SEQ ID NO: 2638705 - RNA, 21 nt, Escherichia coli CFT073
aacggcaagaucagcauccau

SEQ ID NO: 2638706 - RNA, 14 nt, Escherichia coli CFT073
aacggcacaaaucc

SEQ ID NO: 2638707 - RNA, 19 nt, Escherichia coli CFT073
aacggcacggaaagcagca

SEQ ID NO: 2638708 - RNA, 19 nt, Escherichia coli CFT073
aacggcagagaaaccacau

SEQ ID NO: 2638709 - RNA, 22 nt, Escherichia coli CFT073
aacggcagaguuguucugcgac

SEQ ID NO: 2638710 - RNA, 19 nt, Escherichia coli CFT073
aacggcagcgccugcagcu

SEQ ID NO: 2638711 - RNA, 12 nt, Escherichia coli CFT073
aacggcagguuu

SEQ ID NO: 2638712 - RNA, 21 nt, Escherichia coli CFT073
aacggcaucgccaaccaucgc

SEQ ID NO: 2638713 - RNA, 16 nt, Escherichia coli CFT073
aacggcauuuuccagc

SEQ ID NO: 2638714 - RNA, 15 nt, Escherichia coli CFT073
aacggcccauaccac

SEQ ID NO: 2638715 - RNA, 14 nt, Escherichia coli CFT073
aacggccccagagc

SEQ ID NO: 2638716 - RNA, 16 nt, Escherichia coli CFT073
aacggcccggcgacga

SEQ ID NO: 2638717 - RNA, 13 nt, Escherichia coli CFT073
aacggccugacca

SEQ ID NO: 2638718 - RNA, 20 nt, Escherichia coli CFT073
aacggcgagaucuucgccau

SEQ ID NO: 2638719 - RNA, 21 nt, Escherichia coli CFT073
aacggcgaugcuuugaccucc

SEQ ID NO: 2638720 - RNA, 18 nt, Escherichia coli CFT073
aacggcgcaccagaauac

SEQ ID NO: 2638721 - RNA, 14 nt, Escherichia coli CFT073
aacggcggucaggu

SEQ ID NO: 2638722 - RNA, 14 nt, Escherichia coli CFT073
aacggcgucagcca

SEQ ID NO: 2638723 - RNA, 17 nt, Escherichia coli CFT073
aacggcgucagccacaa

SEQ ID NO: 2638724 - RNA, 18 nt, Escherichia coli CFT073
aacggcucaaacugcucc

SEQ ID NO: 2638725 - RNA, 16 nt, Escherichia coli CFT073
aacggcucacccccau

SEQ ID NO: 2638726 - RNA, 20 nt, Escherichia coli CFT073
aacggcucacccccaucagc

SEQ ID NO: 2638727 - RNA, 20 nt, Escherichia coli CFT073
aacggcugauaacaauauca

SEQ ID NO: 2638728 - RNA, 14 nt, Escherichia coli CFT073
aacgggauaaacga

SEQ ID NO: 2638729 - RNA, 16 nt, Escherichia coli CFT073
aacgggauugccagca

SEQ ID NO: 2638730 - RNA, 17 nt, Escherichia coli CFT073
aacgggcaccgccgcca

SEQ ID NO: 2638731 - RNA, 19 nt, Escherichia coli CFT073
aacgggcaccgccgccacu

SEQ ID NO: 2638732 - RNA, 15 nt, Escherichia coli CFT073
aacggggcugccagc

SEQ ID NO: 2638733 - RNA, 17 nt, Escherichia coli CFT073
aacgggggaauaacccg

SEQ ID NO: 2638734 - RNA, 20 nt, Escherichia coli CFT073
aacgggggcgauuuuccucc

SEQ ID NO: 2638735 - RNA, 13 nt, Escherichia coli CFT073
aacgggucaucaa

SEQ ID NO: 2638736 - RNA, 12 nt, Escherichia coli CFT073
aacgguaucuuu

SEQ ID NO: 2638737 - RNA, 13 nt, Escherichia coli CFT073
aacggucacggcu

SEQ ID NO: 2638738 - RNA, 21 nt, Escherichia coli CFT073
aacggucagcgcaccacacau

SEQ ID NO: 2638739 - RNA, 17 nt, Escherichia coli CFT073
aacggucuacauugcuc

SEQ ID NO: 2638740 - RNA, 15 nt, Escherichia coli CFT073
aacggugaaaacccu

SEQ ID NO: 2638741 - RNA, 24 nt, Escherichia coli CFT073
aacggugacuggcuuaauaauucc

SEQ ID NO: 2638742 - RNA, 20 nt, Escherichia coli CFT073
aacggugcaggcucaggcug

SEQ ID NO: 2638743 - RNA, 16 nt, Escherichia coli CFT073
aacgguggccacagca

SEQ ID NO: 2638744 - RNA, 21 nt, Escherichia coli CFT073
aacgguggugcuguuuucucc

SEQ ID NO: 2638745 - RNA, 15 nt, Escherichia coli CFT073
aacggugucgauacc

SEQ ID NO: 2638746 - RNA, 17 nt, Escherichia coli CFT073
aacgguuaaucuguuga

SEQ ID NO: 2638747 - RNA, 22 nt, Escherichia coli CFT073
aacgguuaugaauaacuccgcc

SEQ ID NO: 2638748 - RNA, 16 nt, Escherichia coli CFT073
aacgguugauagcgac

SEQ ID NO: 2638749 - RNA, 16 nt, Escherichia coli CFT073
aacgguugcaauaucg

SEQ ID NO: 2638750 - RNA, 19 nt, Escherichia coli CFT073
aacgguuucaaccagcagg

SEQ ID NO: 2638751 - RNA, 16 nt, Escherichia coli CFT073
aacguaacaguacaau

SEQ ID NO: 2638752 - RNA, 14 nt, Escherichia coli CFT073
aacguaaucaacgc

SEQ ID NO: 2638753 - RNA, 21 nt, Escherichia coli CFT073
aacguacaccgcagccgccac

SEQ ID NO: 2638754 - RNA, 19 nt, Escherichia coli CFT073
aacguacagacaccaauca

SEQ ID NO: 2638755 - RNA, 23 nt, Escherichia coli CFT073
aacguacagacaccaaucagccc

SEQ ID NO: 2638756 - RNA, 14 nt, Escherichia coli CFT073
aacguacugcugaa

SEQ ID NO: 2638757 - RNA, 19 nt, Escherichia coli CFT073
aacguacuguuauccgcca

SEQ ID NO: 2638758 - RNA, 13 nt, Escherichia coli CFT073
aacguagaauaaa

SEQ ID NO: 2638759 - RNA, 16 nt, Escherichia coli CFT073
aacguaggcacauucg

SEQ ID NO: 2638760 - RNA, 15 nt, Escherichia coli CFT073
aacgucaccucagga

SEQ ID NO: 2638761 - RNA, 16 nt, Escherichia coli CFT073
aacgucagucccaacu

SEQ ID NO: 2638762 - RNA, 21 nt, Escherichia coli CFT073
aacgucauauacccugccaga

SEQ ID NO: 2638763 - RNA, 13 nt, Escherichia coli CFT073
aacguccggcaau

SEQ ID NO: 2638764 - RNA, 17 nt, Escherichia coli CFT073
aacgucgcguaauucca

SEQ ID NO: 2638765 - RNA, 24 nt, Escherichia coli CFT073
aacgucgcguaauuccagaauucu

SEQ ID NO: 2638766 - RNA, 20 nt, Escherichia coli CFT073
aacgucgguuucauuacaua

SEQ ID NO: 2638767 - RNA, 20 nt, Escherichia coli CFT073
aacugaucgacaguugcugc

SEQ ID NO: 2638768 - RNA, 16 nt, Escherichia coli CFT073
aacugaucugccagca

SEQ ID NO: 2638769 - RNA, 23 nt, Escherichia coli CFT073
aacugaucuuuaucaagcaccaa

SEQ ID NO: 2638770 - RNA, 18 nt, Escherichia coli CFT073
aacugauuuagcaucagc

SEQ ID NO: 2638771 - RNA, 21 nt, Escherichia coli CFT073
aacugauuuagcaucagcgcu

SEQ ID NO: 2638772 - RNA, 20 nt, Escherichia coli CFT073
aacugauuuucaucuucuuc

SEQ ID NO: 2638773 - RNA, 13 nt, Escherichia coli CFT073
aacugcaaggaga

SEQ ID NO: 2638774 - RNA, 18 nt, Escherichia coli CFT073
aacugcacaccgcggaac

SEQ ID NO: 2638775 - RNA, 16 nt, Escherichia coli CFT073
aacugcagcaggcgag

SEQ ID NO: 2638776 - RNA, 21 nt, Escherichia coli CFT073
aacugcagcaggcgagcugcc

SEQ ID NO: 2638777 - RNA, 20 nt, Escherichia coli CFT073
aacugcaugaagccaaccgg

SEQ ID NO: 2638778 - RNA, 17 nt, Escherichia coli CFT073
aacugccaguaaagcag

SEQ ID NO: 2638779 - RNA, 19 nt, Escherichia coli CFT073
aacugccaguaaagcagcg

SEQ ID NO: 2638780 - RNA, 20 nt, Escherichia coli CFT073
aacugccgcgccugaaucug

SEQ ID NO: 2638781 - RNA, 19 nt, Escherichia coli CFT073
aacugccgucaauuuuaag

SEQ ID NO: 2638782 - RNA, 16 nt, Escherichia coli CFT073
aacugccgucagggcc

SEQ ID NO: 2638783 - RNA, 21 nt, Escherichia coli CFT073
aacugccguuaacgacaaagu

SEQ ID NO: 2638784 - RNA, 15 nt, Escherichia coli CFT073
aacugccuuaaacuc

SEQ ID NO: 2638785 - RNA, 17 nt, Escherichia coli CFT073
aacugccuuucccuuuc

SEQ ID NO: 2638786 - RNA, 19 nt, Escherichia coli CFT073
aacugccuuucccuuucuu

SEQ ID NO: 2638787 - RNA, 13 nt, Escherichia coli CFT073
aacugcgccagac

SEQ ID NO: 2638788 - RNA, 16 nt, Escherichia coli CFT073
aacugcgccagaccca

SEQ ID NO: 2638789 - RNA, 18 nt, Escherichia coli CFT073
aacugcguagaguccagc

SEQ ID NO: 2638790 - RNA, 15 nt, Escherichia coli CFT073
aacugcuccgggaau

SEQ ID NO: 2638791 - RNA, 18 nt, Escherichia coli CFT073
aacugcugcauuucugga

SEQ ID NO: 2638792 - RNA, 14 nt, Escherichia coli CFT073
aacugcugcgccag

SEQ ID NO: 2638793 - RNA, 21 nt, Escherichia coli CFT073
aacugcuggacgauuucaccc

SEQ ID NO: 2638794 - RNA, 14 nt, Escherichia coli CFT073
aacuggaauagcgc

SEQ ID NO: 2638795 - RNA, 15 nt, Escherichia coli CFT073
aacuggcaaaaacaa

SEQ ID NO: 2638796 - RNA, 18 nt, Escherichia coli CFT073
aacuggcugaugcuggca

SEQ ID NO: 2638797 - RNA, 18 nt, Escherichia coli CFT073
aacugggugcacuuacaa

SEQ ID NO: 2638798 - RNA, 19 nt, Escherichia coli CFT073
aacugguaacuguagguaa

SEQ ID NO: 2638799 - RNA, 18 nt, Escherichia coli CFT073
aacugguauaggccaugc

SEQ ID NO: 2638800 - RNA, 17 nt, Escherichia coli CFT073
aacuggucaucaaguua

SEQ ID NO: 2638801 - RNA, 22 nt, Escherichia coli CFT073
aacuggugacuuuugcccggca

SEQ ID NO: 2638802 - RNA, 16 nt, Escherichia coli CFT073
aacugguguaagucgg

SEQ ID NO: 2638803 - RNA, 19 nt, Escherichia coli CFT073
aacugguugaaauaaacca

SEQ ID NO: 2638804 - RNA, 20 nt, Escherichia coli CFT073
aacugguugaaauaaaccag

SEQ ID NO: 2638805 - RNA, 22 nt, Escherichia coli CFT073
aacugguugaaauaaaccagua

SEQ ID NO: 2638806 - RNA, 19 nt, Escherichia coli CFT073
aacuguaaugaaucgucgg

SEQ ID NO: 2638807 - RNA, 17 nt, Escherichia coli CFT073
aacuguaucccagccca

SEQ ID NO: 2638808 - RNA, 16 nt, Escherichia coli CFT073
aacugucaauaaacgc

SEQ ID NO: 2638809 - RNA, 17 nt, Escherichia coli CFT073
aacugucaauaaacgcc

SEQ ID NO: 2638810 - RNA, 16 nt, Escherichia coli CFT073
aacugugcaccgcccu

SEQ ID NO: 2638811 - RNA, 22 nt, Escherichia coli CFT073
aacugugcaccgcccugcauca

SEQ ID NO: 2638812 - RNA, 21 nt, Escherichia coli CFT073
aacugugccgcgaccaccucg

SEQ ID NO: 2638813 - RNA, 19 nt, Escherichia coli CFT073
aacuguuucgcggcaaacu

SEQ ID NO: 2638814 - RNA, 23 nt, Escherichia coli CFT073
aacuguuucgcggcaaacugcau

SEQ ID NO: 2638815 - RNA, 23 nt, Escherichia coli CFT073
aacuuaagauucggcuucuuccu

SEQ ID NO: 2638816 - RNA, 12 nt, Escherichia coli CFT073
aacuuaagucuc

SEQ ID NO: 2638817 - RNA, 15 nt, Escherichia coli CFT073
aacuuaagucuccau

SEQ ID NO: 2638818 - RNA, 17 nt, Escherichia coli CFT073
aacuuaaucgccaguuc

SEQ ID NO: 2638819 - RNA, 18 nt, Escherichia coli CFT073
aacuuaucaagaaagcuu

SEQ ID NO: 2638820 - RNA, 22 nt, Escherichia coli CFT073
aacuuaucaauugaugcuuuuu

SEQ ID NO: 2638821 - RNA, 15 nt, Escherichia coli CFT073
aacuuaucaucaguc

SEQ ID NO: 2638822 - RNA, 23 nt, Escherichia coli CFT073
aacuuaucaucgcaaaugaugca

SEQ ID NO: 2638823 - RNA, 18 nt, Escherichia coli CFT073
aacuuaucuguaauuaaa

SEQ ID NO: 2638824 - RNA, 18 nt, Escherichia coli CFT073
aacuuaucuuauucccac

SEQ ID NO: 2638825 - RNA, 14 nt, Escherichia coli CFT073
aacuucaccagcac

SEQ ID NO: 2638826 - RNA, 21 nt, Escherichia coli CFT073
aacuucaccgguucaucacga

SEQ ID NO: 2638827 - RNA, 18 nt, Escherichia coli CFT073
aacuucaguuuuauccua

SEQ ID NO: 2638828 - RNA, 21 nt, Escherichia coli CFT073
aacuucauuugucucaaaacu

SEQ ID NO: 2638829 - RNA, 18 nt, Escherichia coli CFT073
aacuuccagaauauguuc

SEQ ID NO: 2638830 - RNA, 20 nt, Escherichia coli CFT073
aacuuccccuuucacauuga

SEQ ID NO: 2638831 - RNA, 17 nt, Escherichia coli CFT073
aacuucccgcugugguu

SEQ ID NO: 2638832 - RNA, 19 nt, Escherichia coli CFT073
aacuucccgcugugguuca

SEQ ID NO: 2638833 - RNA, 17 nt, Escherichia coli CFT073
aacuuccugaaucgccg

SEQ ID NO: 2638834 - RNA, 18 nt, Escherichia coli CFT073
aacuuccugaaucgccga

SEQ ID NO: 2638835 - RNA, 10 nt, Escherichia coli CFT073
aacuuccugc

SEQ ID NO: 2638836 - RNA, 16 nt, Escherichia coli CFT073
aacuuccugcuggcug

SEQ ID NO: 2638837 - RNA, 14 nt, Escherichia coli CFT073
aacuucgccacagc

SEQ ID NO: 2638838 - RNA, 20 nt, Escherichia coli CFT073
aacuucgccaggauagaaaa

SEQ ID NO: 2638839 - RNA, 13 nt, Escherichia coli CFT073
aacuucgccauca

SEQ ID NO: 2638840 - RNA, 18 nt, Escherichia coli CFT073
aacuucgcguucuguggc

SEQ ID NO: 2638841 - RNA, 22 nt, Escherichia coli CFT073
aacuucggggagcgauaucagu

SEQ ID NO: 2638842 - RNA, 16 nt, Escherichia coli CFT073
aacuucgguuaccaca

SEQ ID NO: 2638843 - RNA, 17 nt, Escherichia coli CFT073
aacuucucaccaucaaa

SEQ ID NO: 2638844 - RNA, 21 nt, Escherichia coli CFT073
aacuucucuucuuccgcuuca

SEQ ID NO: 2638845 - RNA, 19 nt, Escherichia coli CFT073
aacuucuuaaaaugaugcu

SEQ ID NO: 2638846 - RNA, 14 nt, Escherichia coli CFT073
aacuucuucaguuu

SEQ ID NO: 2638847 - RNA, 21 nt, Escherichia coli CFT073
aacuugcaaucucugacauaa

SEQ ID NO: 2638848 - RNA, 13 nt, Escherichia coli CFT073
aacuugccaggcc

SEQ ID NO: 2638849 - RNA, 16 nt, Escherichia coli CFT073
aacuugcgacagccau

SEQ ID NO: 2638850 - RNA, 17 nt, Escherichia coli CFT073
aacuugcgacagccauc

SEQ ID NO: 2638851 - RNA, 19 nt, Escherichia coli CFT073
aacuuguagcuuucaacgc

SEQ ID NO: 2638852 - RNA, 14 nt, Escherichia coli CFT073
aacuuguugcgccg

SEQ ID NO: 2638853 - RNA, 15 nt, Escherichia coli CFT073
aacuuuaauuuugug

SEQ ID NO: 2638854 - RNA, 22 nt, Escherichia coli CFT073
aacuuuaauuuugugcagcaca

SEQ ID NO: 2638855 - RNA, 13 nt, Escherichia coli CFT073
aacuuuacuaaaa

SEQ ID NO: 2638856 - RNA, 15 nt, Escherichia coli CFT073
aacuuuacuaaaaag

SEQ ID NO: 2638857 - RNA, 13 nt, Escherichia coli CFT073
aacuuuacugccu

SEQ ID NO: 2638858 - RNA, 17 nt, Escherichia coli CFT073
aacuuugccgugaacaa

SEQ ID NO: 2638859 - RNA, 19 nt, Escherichia coli CFT073
aacuuuguauucaguucau

SEQ ID NO: 2638860 - RNA, 13 nt, Escherichia coli CFT073
aacuuuguugcga

SEQ ID NO: 2638861 - RNA, 15 nt, Escherichia coli CFT073
aacuuuuaucaauuu

SEQ ID NO: 2638862 - RNA, 20 nt, Escherichia coli CFT073
aacuuuuaucaauuuugauu

SEQ ID NO: 2638863 - RNA, 20 nt, Escherichia coli CFT073
aacuuuucaccagcgucagu

SEQ ID NO: 2638864 - RNA, 18 nt, Escherichia coli CFT073
aacuuuuguauuuuaccu

SEQ ID NO: 2638865 - RNA, 16 nt, Escherichia coli CFT073
aagaaaaaaugcugca

SEQ ID NO: 2638866 - RNA, 12 nt, Escherichia coli CFT073
aagaaaacauuu

SEQ ID NO: 2638867 - RNA, 22 nt, Escherichia coli CFT073
aagaaaacauuuuaaacaucag

SEQ ID NO: 2638868 - RNA, 17 nt, Escherichia coli CFT073
aagaaaacguuccacgc

SEQ ID NO: 2638869 - RNA, 13 nt, Escherichia coli CFT073
aagaaacacacuu

SEQ ID NO: 2638870 - RNA, 13 nt, Escherichia coli CFT073
aagaaacaccaga

SEQ ID NO: 2638871 - RNA, 13 nt, Escherichia coli CFT073
aagaaaccauugc

SEQ ID NO: 2638872 - RNA, 20 nt, Escherichia coli CFT073
aagaaaccauugcagccaau

SEQ ID NO: 2638873 - RNA, 15 nt, Escherichia coli CFT073
aagaaacgcuccacc

SEQ ID NO: 2638874 - RNA, 22 nt, Escherichia coli CFT073
aagaaacgcuccaccaccgcga

SEQ ID NO: 2638875 - RNA, 18 nt, Escherichia coli CFT073
aagaugaaaacgccacca

SEQ ID NO: 2638876 - RNA, 14 nt, Escherichia coli CFT073
aagaugaaacuuau

SEQ ID NO: 2638877 - RNA, 22 nt, Escherichia coli CFT073
aagaugaaauaaaaaagcccug

SEQ ID NO: 2638878 - RNA, 14 nt, Escherichia coli CFT073
aagaugcgccagca

SEQ ID NO: 2638879 - RNA, 14 nt, Escherichia coli CFT073
aagaugcguuaagc

SEQ ID NO: 2638880 - RNA, 21 nt, Escherichia coli CFT073
aagaugcguuaagcgucgcau

SEQ ID NO: 2638881 - RNA, 22 nt, Escherichia coli CFT073
aagaugggccagcacguugugc

SEQ ID NO: 2638882 - RNA, 16 nt, Escherichia coli CFT073
aagauguaaucgccuu

SEQ ID NO: 2638883 - RNA, 14 nt, Escherichia coli CFT073
aagauguagucugu

SEQ ID NO: 2638884 - RNA, 20 nt, Escherichia coli CFT073
aagaugugguuagcuggaga

SEQ ID NO: 2638885 - RNA, 12 nt, Escherichia coli CFT073
aagauguuuugc

SEQ ID NO: 2638886 - RNA, 23 nt, Escherichia coli CFT073
aagauguuuugccugaaaaauga

SEQ ID NO: 2638887 - RNA, 18 nt, Escherichia coli CFT073
aagauuagccaucauuuc

SEQ ID NO: 2638888 - RNA, 18 nt, Escherichia coli CFT073
aagauucgauaacauucg

SEQ ID NO: 2638889 - RNA, 16 nt, Escherichia coli CFT073
aagauucgcccauuaa

SEQ ID NO: 2638890 - RNA, 22 nt, Escherichia coli CFT073
aagauucgcccauuaacaaccg

SEQ ID NO: 2638891 - RNA, 17 nt, Escherichia coli CFT073
aagauucggcuucuucc

SEQ ID NO: 2638892 - RNA, 16 nt, Escherichia coli CFT073
aagauuguucuuuauc

SEQ ID NO: 2638893 - RNA, 22 nt, Escherichia coli CFT073
aagauuucugcgggggcggcaa

SEQ ID NO: 2638894 - RNA, 16 nt, Escherichia coli CFT073
aagcaaaaaaagaauc

SEQ ID NO: 2638895 - RNA, 22 nt, Escherichia coli CFT073
aagcaaaauaaccggcaagcaa

SEQ ID NO: 2638896 - RNA, 21 nt, Escherichia coli CFT073
aagcaaacugugcaaugaaaa

SEQ ID NO: 2638897 - RNA, 19 nt, Escherichia coli CFT073
aagcaaagcaaaggcgaca

SEQ ID NO: 2638898 - RNA, 15 nt, Escherichia coli CFT073
aagcaaauaauuccc

SEQ ID NO: 2638899 - RNA, 12 nt, Escherichia coli CFT073
aagcaacaaagu

SEQ ID NO: 2638900 - RNA, 12 nt, Escherichia coli CFT073
aagcaacuccau

SEQ ID NO: 2638901 - RNA, 21 nt, Escherichia coli CFT073
aagcaacugguuaucacgaaa

SEQ ID NO: 2638902 - RNA, 13 nt, Escherichia coli CFT073
aagcaauaaacca

SEQ ID NO: 2638903 - RNA, 14 nt, Escherichia coli CFT073
aagcaauaaaccau

SEQ ID NO: 2638904 - RNA, 15 nt, Escherichia coli CFT073
aagcaauaaaccaua

SEQ ID NO: 2638905 - RNA, 16 nt, Escherichia coli CFT073
aagcaauaaaccauaa

SEQ ID NO: 2638906 - RNA, 16 nt, Escherichia coli CFT073
aagcaauaauuucaac

SEQ ID NO: 2638907 - RNA, 16 nt, Escherichia coli CFT073
aagcaaucaagcccug

SEQ ID NO: 2638908 - RNA, 17 nt, Escherichia coli CFT073
aagcaaucaagcccugg

SEQ ID NO: 2638909 - RNA, 13 nt, Escherichia coli CFT073
aagcaauccauac

SEQ ID NO: 2638910 - RNA, 22 nt, Escherichia coli CFT073
aagcaaugauaaguccgaugcc

SEQ ID NO: 2638911 - RNA, 21 nt, Escherichia coli CFT073
aagcaauuaacagugacagug

SEQ ID NO: 2638912 - RNA, 15 nt, Escherichia coli CFT073
aagcaauuacaggug

SEQ ID NO: 2638913 - RNA, 15 nt, Escherichia coli CFT073
aagcacaaaaacccg

SEQ ID NO: 2638914 - RNA, 20 nt, Escherichia coli CFT073
aagcacaauccgccaggaca

SEQ ID NO: 2638915 - RNA, 13 nt, Escherichia coli CFT073
aagcacagaaucu

SEQ ID NO: 2638916 - RNA, 22 nt, Escherichia coli CFT073
aagcacagggcaacggccaaaa

SEQ ID NO: 2638917 - RNA, 23 nt, Escherichia coli CFT073
aagcaccaacucgccacgaucgg

SEQ ID NO: 2638918 - RNA, 15 nt, Escherichia coli CFT073
aagcaccacuccuca

SEQ ID NO: 2638919 - RNA, 15 nt, Escherichia coli CFT073
aagcacccagcaauc

SEQ ID NO: 2638920 - RNA, 17 nt, Escherichia coli CFT073
aagcaccgaacaagaaa

SEQ ID NO: 2638921 - RNA, 19 nt, Escherichia coli CFT073
aagcaccgaacaagaaaca

SEQ ID NO: 2638922 - RNA, 14 nt, Escherichia coli CFT073
aagcaccggcaccg

SEQ ID NO: 2638923 - RNA, 15 nt, Escherichia coli CFT073
aagcaccuaaaucca

SEQ ID NO: 2638924 - RNA, 13 nt, Escherichia coli CFT073
aagcacggcauca

SEQ ID NO: 2638925 - RNA, 21 nt, Escherichia coli CFT073
aagcacguuacccaaucgccc

SEQ ID NO: 2638926 - RNA, 19 nt, Escherichia coli CFT073
aagcacuguucgccgcagc

SEQ ID NO: 2638927 - RNA, 22 nt, Escherichia coli CFT073
aagcacuguucgccgcagccag

SEQ ID NO: 2638928 - RNA, 14 nt, Escherichia coli CFT073
aagcagaaugaaug

SEQ ID NO: 2638929 - RNA, 23 nt, Escherichia coli CFT073
aagcagagugugaaacaguaagu

SEQ ID NO: 2638930 - RNA, 14 nt, Escherichia coli CFT073
aagcagauaaccca

SEQ ID NO: 2638931 - RNA, 16 nt, Escherichia coli CFT073
aagcagauaacccagc

SEQ ID NO: 2638932 - RNA, 18 nt, Escherichia coli CFT073
aagcagauaacccagcag

SEQ ID NO: 2638933 - RNA, 13 nt, Escherichia coli CFT073
aagcagcgcugga

SEQ ID NO: 2638934 - RNA, 15 nt, Escherichia coli CFT073
aagcagcuugagaaa

SEQ ID NO: 2638935 - RNA, 12 nt, Escherichia coli CFT073
aagcaggcaccg

SEQ ID NO: 2638936 - RNA, 16 nt, Escherichia coli CFT073
aagcagggcagggaag

SEQ ID NO: 2638937 - RNA, 17 nt, Escherichia coli CFT073
aagcaggguugcagcgg

SEQ ID NO: 2638938 - RNA, 23 nt, Escherichia coli CFT073
aagcagguagcgccuuuacugac

SEQ ID NO: 2638939 - RNA, 15 nt, Escherichia coli CFT073
aagcaggucaccaga

SEQ ID NO: 2638940 - RNA, 21 nt, Escherichia coli CFT073
aagcaguccagcgccugacgc

SEQ ID NO: 2638941 - RNA, 14 nt, Escherichia coli CFT073
aagcaguggcacua

SEQ ID NO: 2638942 - RNA, 16 nt, Escherichia coli CFT073
aagcaguuuauaaaau

SEQ ID NO: 2638943 - RNA, 18 nt, Escherichia coli CFT073
aagcaguuucaccagcag

SEQ ID NO: 2638944 - RNA, 17 nt, Escherichia coli CFT073
aagcauaacaaaaugcc

SEQ ID NO: 2638945 - RNA, 13 nt, Escherichia coli CFT073
aagcauaccggac

SEQ ID NO: 2638946 - RNA, 13 nt, Escherichia coli CFT073
aagcauagcccca

SEQ ID NO: 2638947 - RNA, 14 nt, Escherichia coli CFT073
aagcaucauuuugu

SEQ ID NO: 2638948 - RNA, 15 nt, Escherichia coli CFT073
aagcaucauuuugug

SEQ ID NO: 2638949 - RNA, 21 nt, Escherichia coli CFT073
aagcaucgcaacgcaucuuuu

SEQ ID NO: 2638950 - RNA, 22 nt, Escherichia coli CFT073
aagcaucgcuagauauauauua

SEQ ID NO: 2638951 - RNA, 12 nt, Escherichia coli CFT073
aagcaucugcuu

SEQ ID NO: 2638952 - RNA, 21 nt, Escherichia coli CFT073
aagcaugaauaucaaguuuau

SEQ ID NO: 2638953 - RNA, 19 nt, Escherichia coli CFT073
aagcauuaccuucaagaau

SEQ ID NO: 2638954 - RNA, 15 nt, Escherichia coli CFT073
aagcauuauuuuugc

SEQ ID NO: 2638955 - RNA, 15 nt, Escherichia coli CFT073
aagcauucucccgcc

SEQ ID NO: 2638956 - RNA, 18 nt, Escherichia coli CFT073
aagcauuggcaugcacgu

SEQ ID NO: 2638957 - RNA, 17 nt, Escherichia coli CFT073
aagcauuuucucacugg

SEQ ID NO: 2638958 - RNA, 14 nt, Escherichia coli CFT073
aagccaacagcagc

SEQ ID NO: 2638959 - RNA, 15 nt, Escherichia coli CFT073
aagccaacagcagcc

SEQ ID NO: 2638960 - RNA, 18 nt, Escherichia coli CFT073
aagccaaucugcuggaaa

SEQ ID NO: 2638961 - RNA, 12 nt, Escherichia coli CFT073
aagccaaucugu

SEQ ID NO: 2638962 - RNA, 14 nt, Escherichia coli CFT073
aagccaaucugugu

SEQ ID NO: 2638963 - RNA, 13 nt, Escherichia coli CFT073
aagccaccacgcc

SEQ ID NO: 2638964 - RNA, 17 nt, Escherichia coli CFT073
aagccaccacgccaaga

SEQ ID NO: 2638965 - RNA, 16 nt, Escherichia coli CFT073
aagccaccgaacaaaa

SEQ ID NO: 2638966 - RNA, 20 nt, Escherichia coli CFT073
aagccaccgaacaaaacagc

SEQ ID NO: 2638967 - RNA, 21 nt, Escherichia coli CFT073
aagccacuuccuuuagaagca

SEQ ID NO: 2638968 - RNA, 22 nt, Escherichia coli CFT073
aagccagaauaaucggcgucau

SEQ ID NO: 2638969 - RNA, 13 nt, Escherichia coli CFT073
aagccagacgugc

SEQ ID NO: 2638970 - RNA, 17 nt, Escherichia coli CFT073
aagccauuuaacucacc

SEQ ID NO: 2638971 - RNA, 12 nt, Escherichia coli CFT073
aagcccacaccg

SEQ ID NO: 2638972 - RNA, 20 nt, Escherichia coli CFT073
aagcccaccacaaaccagcc

SEQ ID NO: 2638973 - RNA, 22 nt, Escherichia coli CFT073
aagcccaccccaauguuuuucu

SEQ ID NO: 2638974 - RNA, 12 nt, Escherichia coli CFT073
aagcccagggaa

SEQ ID NO: 2638975 - RNA, 21 nt, Escherichia coli CFT073
aagcccaguaccgccagugca

SEQ ID NO: 2638976 - RNA, 22 nt, Escherichia coli CFT073
aagcccauaccacagcaaaacg

SEQ ID NO: 2638977 - RNA, 14 nt, Escherichia coli CFT073
aagcccccacaaca

SEQ ID NO: 2638978 - RNA, 19 nt, Escherichia coli CFT073
aagcccccacaacauugcg

SEQ ID NO: 2638979 - RNA, 14 nt, Escherichia coli CFT073
aagccccgcagcca

SEQ ID NO: 2638980 - RNA, 15 nt, Escherichia coli CFT073
aagccccgcagccau

SEQ ID NO: 2638981 - RNA, 21 nt, Escherichia coli CFT073
aagccccugagcgaauacccc

SEQ ID NO: 2638982 - RNA, 18 nt, Escherichia coli CFT073
aagcccgauguuaauuuc

SEQ ID NO: 2638983 - RNA, 24 nt, Escherichia coli CFT073
aagcccgcagcguccagcgccugg

SEQ ID NO: 2638984 - RNA, 23 nt, Escherichia coli CFT073
aaggaagcugauuuuauuucaaa

SEQ ID NO: 2638985 - RNA, 22 nt, Escherichia coli CFT073
aaggacggaauuugcugcuggc

SEQ ID NO: 2638986 - RNA, 22 nt, Escherichia coli CFT073
aaggaguuuuuccuuucugaua

SEQ ID NO: 2638987 - RNA, 18 nt, Escherichia coli CFT073
aaggauaaaaaaggguga

SEQ ID NO: 2638988 - RNA, 11 nt, Escherichia coli CFT073
aaggauaagac

SEQ ID NO: 2638989 - RNA, 17 nt, Escherichia coli CFT073
aaggauaauuaauccuu

SEQ ID NO: 2638990 - RNA, 21 nt, Escherichia coli CFT073
aaggauauggcuugaagcaau

SEQ ID NO: 2638991 - RNA, 21 nt, Escherichia coli CFT073
aaggauauucauuaauaacca

SEQ ID NO: 2638992 - RNA, 19 nt, Escherichia coli CFT073
aaggaugaaacugccggaa

SEQ ID NO: 2638993 - RNA, 15 nt, Escherichia coli CFT073
aaggauuagacgaau

SEQ ID NO: 2638994 - RNA, 18 nt, Escherichia coli CFT073
aaggauugcagcacugau

SEQ ID NO: 2638995 - RNA, 14 nt, Escherichia coli CFT073
aaggcaaaguccgc

SEQ ID NO: 2638996 - RNA, 14 nt, Escherichia coli CFT073
aaggcaacgcagcc

SEQ ID NO: 2638997 - RNA, 20 nt, Escherichia coli CFT073
aaggcaacgccccuucugcc

SEQ ID NO: 2638998 - RNA, 17 nt, Escherichia coli CFT073
aaggcacaacugcgacc

SEQ ID NO: 2638999 - RNA, 15 nt, Escherichia coli CFT073
aaggcaccuggaaau

SEQ ID NO: 2639000 - RNA, 23 nt, Escherichia coli CFT073
aaggcacgccaauuacgccugcc

SEQ ID NO: 2639001 - RNA, 12 nt, Escherichia coli CFT073
aaggcagagcca

SEQ ID NO: 2639002 - RNA, 22 nt, Escherichia coli CFT073
aaggccaacgaaaaauggggga

SEQ ID NO: 2639003 - RNA, 14 nt, Escherichia coli CFT073
aaggccaagagcaa

SEQ ID NO: 2639004 - RNA, 21 nt, Escherichia coli CFT073
aaggccaauacccguacgguu

SEQ ID NO: 2639005 - RNA, 15 nt, Escherichia coli CFT073
aaggccagccaggca

SEQ ID NO: 2639006 - RNA, 14 nt, Escherichia coli CFT073
aaggccgccaggca

SEQ ID NO: 2639007 - RNA, 21 nt, Escherichia coli CFT073
aaggccgcgaaccagaccagc

SEQ ID NO: 2639008 - RNA, 21 nt, Escherichia coli CFT073
aaggccggaaaagauguguca

SEQ ID NO: 2639009 - RNA, 20 nt, Escherichia coli CFT073
aaggccguuuucaacaccgc

SEQ ID NO: 2639010 - RNA, 18 nt, Escherichia coli CFT073
aaggcgcgagguuuuccu

SEQ ID NO: 2639011 - RNA, 16 nt, Escherichia coli CFT073
aaggcgcgucaagcgu

SEQ ID NO: 2639012 - RNA, 18 nt, Escherichia coli CFT073
aaggcgcucgcgccgcau

SEQ ID NO: 2639013 - RNA, 18 nt, Escherichia coli CFT073
aaggcgcuuggcuuccau

SEQ ID NO: 2639014 - RNA, 22 nt, Escherichia coli CFT073
aaggcggcucuggcggcgcgau

SEQ ID NO: 2639015 - RNA, 16 nt, Escherichia coli CFT073
aaggcgggaauaauuu

SEQ ID NO: 2639016 - RNA, 22 nt, Escherichia coli CFT073
aaggcgggaauaauuucccgcc

SEQ ID NO: 2639017 - RNA, 15 nt, Escherichia coli CFT073
aaggcgucauguaau

SEQ ID NO: 2639018 - RNA, 18 nt, Escherichia coli CFT073
aaggcguuaaacuggaaa

SEQ ID NO: 2639019 - RNA, 18 nt, Escherichia coli CFT073
aaggcguuaugcugcggc

SEQ ID NO: 2639020 - RNA, 17 nt, Escherichia coli CFT073
aaggcguucacgccgca

SEQ ID NO: 2639021 - RNA, 18 nt, Escherichia coli CFT073
aaggcguucacgccgcau

SEQ ID NO: 2639022 - RNA, 22 nt, Escherichia coli CFT073
aaggcguucacgccgcauccgg

SEQ ID NO: 2639023 - RNA, 17 nt, Escherichia coli CFT073
aaggcguuuacgccgca

SEQ ID NO: 2639024 - RNA, 18 nt, Escherichia coli CFT073
aaggcguuuacgccgcau

SEQ ID NO: 2639025 - RNA, 16 nt, Escherichia coli CFT073
aaggcguuugaacuga

SEQ ID NO: 2639026 - RNA, 17 nt, Escherichia coli CFT073
aaggcguuugaacugaa

SEQ ID NO: 2639027 - RNA, 17 nt, Escherichia coli CFT073
aaggcguuugcgucgca

SEQ ID NO: 2639028 - RNA, 20 nt, Escherichia coli CFT073
aaggcuauccucuaaacccc

SEQ ID NO: 2639029 - RNA, 22 nt, Escherichia coli CFT073
aaggcuauccucuaaaccccaa

SEQ ID NO: 2639030 - RNA, 15 nt, Escherichia coli CFT073
aaggcucucuuacca

SEQ ID NO: 2639031 - RNA, 14 nt, Escherichia coli CFT073
aaggcugccagagu

SEQ ID NO: 2639032 - RNA, 22 nt, Escherichia coli CFT073
aaggcugccggaccaucuucca

SEQ ID NO: 2639033 - RNA, 16 nt, Escherichia coli CFT073
aaggcugugaaaguug

SEQ ID NO: 2639034 - RNA, 24 nt, Escherichia coli CFT073
aaggcuuccagcgucgcggucaga

SEQ ID NO: 2639035 - RNA, 14 nt, Escherichia coli CFT073
aaggcuuuggauug

SEQ ID NO: 2639036 - RNA, 23 nt, Escherichia coli CFT073
aagggacaucagguaguugccag

SEQ ID NO: 2639037 - RNA, 16 nt, Escherichia coli CFT073
aagggagcagacugua

SEQ ID NO: 2639038 - RNA, 16 nt, Escherichia coli CFT073
aagggaugcugugcuc

SEQ ID NO: 2639039 - RNA, 13 nt, Escherichia coli CFT073
aagggcaucagcc

SEQ ID NO: 2639040 - RNA, 14 nt, Escherichia coli CFT073
aagggcuaacgugc

SEQ ID NO: 2639041 - RNA, 19 nt, Escherichia coli CFT073
aagggcuaacgugcagguu

SEQ ID NO: 2639042 - RNA, 12 nt, Escherichia coli CFT073
aaggguaaaaag

SEQ ID NO: 2639043 - RNA, 20 nt, Escherichia coli CFT073
aaggguaauauauaacagaa

SEQ ID NO: 2639044 - RNA, 18 nt, Escherichia coli CFT073
aaggguacgaaucacagc

SEQ ID NO: 2639045 - RNA, 13 nt, Escherichia coli CFT073
aaggguaugcugu

SEQ ID NO: 2639046 - RNA, 14 nt, Escherichia coli CFT073
aagggugcaggaga

SEQ ID NO: 2639047 - RNA, 20 nt, Escherichia coli CFT073
aagguaaugcgcgagccaua

SEQ ID NO: 2639048 - RNA, 19 nt, Escherichia coli CFT073
aagguaccgacgaucaaca

SEQ ID NO: 2639049 - RNA, 21 nt, Escherichia coli CFT073
aagguagugcuucuaaaggaa

SEQ ID NO: 2639050 - RNA, 22 nt, Escherichia coli CFT073
aagguaucgcgaaaaaaaagau

SEQ ID NO: 2639051 - RNA, 16 nt, Escherichia coli CFT073
aaggucaccaguucac

SEQ ID NO: 2639052 - RNA, 18 nt, Escherichia coli CFT073
aaggucaucacaucccag

SEQ ID NO: 2639053 - RNA, 23 nt, Escherichia coli CFT073
aaggucaucacaucccagcagag

SEQ ID NO: 2639054 - RNA, 22 nt, Escherichia coli CFT073
aaggucggggucgcgaguucga

SEQ ID NO: 2639055 - RNA, 19 nt, Escherichia coli CFT073
aaggugaacgccaccaacg

SEQ ID NO: 2639056 - RNA, 22 nt, Escherichia coli CFT073
aaggugaguuuugcgacucacc

SEQ ID NO: 2639057 - RNA, 19 nt, Escherichia coli CFT073
aaggugauucccagcaaca

SEQ ID NO: 2639058 - RNA, 20 nt, Escherichia coli CFT073
aaggugauuuauuucucauu

SEQ ID NO: 2639059 - RNA, 16 nt, Escherichia coli CFT073
aaggugcauugaaggc

SEQ ID NO: 2639060 - RNA, 23 nt, Escherichia coli CFT073
aaggugccuuuaauaccaucggc

SEQ ID NO: 2639061 - RNA, 15 nt, Escherichia coli CFT073
aaggugcgaaaaaaa

SEQ ID NO: 2639062 - RNA, 19 nt, Escherichia coli CFT073
aagguggucagacggaaca

SEQ ID NO: 2639063 - RNA, 22 nt, Escherichia coli CFT073
aagguggucagacggaacaucu

SEQ ID NO: 2639064 - RNA, 20 nt, Escherichia coli CFT073
aaggugguuaccgccagcac

SEQ ID NO: 2639065 - RNA, 14 nt, Escherichia coli CFT073
aagguuaaaccgcc

SEQ ID NO: 2639066 - RNA, 16 nt, Escherichia coli CFT073
aagguuaaaccgccag

SEQ ID NO: 2639067 - RNA, 17 nt, Escherichia coli CFT073
aagguuaacuguggcgu

SEQ ID NO: 2639068 - RNA, 17 nt, Escherichia coli CFT073
aagguuagaaacgcccc

SEQ ID NO: 2639069 - RNA, 14 nt, Escherichia coli CFT073
aagguuccaauauu

SEQ ID NO: 2639070 - RNA, 12 nt, Escherichia coli CFT073
aagguuccugca

SEQ ID NO: 2639071 - RNA, 21 nt, Escherichia coli CFT073
aagguucuuuagcaguucuua

SEQ ID NO: 2639072 - RNA, 19 nt, Escherichia coli CFT073
aagguugccauaucuuccc

SEQ ID NO: 2639073 - RNA, 14 nt, Escherichia coli CFT073
aagguuguugaaag

SEQ ID NO: 2639074 - RNA, 17 nt, Escherichia coli CFT073
aagguuuaauugucugu

SEQ ID NO: 2639075 - RNA, 15 nt, Escherichia coli CFT073
aagguuucaguaaca

SEQ ID NO: 2639076 - RNA, 20 nt, Escherichia coli CFT073
aagguuucaguaacaucaca

SEQ ID NO: 2639077 - RNA, 14 nt, Escherichia coli CFT073
aagguuuuuuccuu

SEQ ID NO: 2639078 - RNA, 22 nt, Escherichia coli CFT073
aagguuuuuucuguauucaucg

SEQ ID NO: 2639079 - RNA, 22 nt, Escherichia coli CFT073
aaguaaaacgguggccacagca

SEQ ID NO: 2639080 - RNA, 13 nt, Escherichia coli CFT073
aaguaaacaaaca

SEQ ID NO: 2639081 - RNA, 17 nt, Escherichia coli CFT073
aaguaaacaaacaugaa

SEQ ID NO: 2639082 - RNA, 15 nt, Escherichia coli CFT073
aaguaaauaagaaaa

SEQ ID NO: 2639083 - RNA, 19 nt, Escherichia coli CFT073
aaguaacaauagcgaacag

SEQ ID NO: 2639084 - RNA, 19 nt, Escherichia coli CFT073
aaguaaccuuugaacagcc

SEQ ID NO: 2639085 - RNA, 14 nt, Escherichia coli CFT073
aaguaaucaaugcg

SEQ ID NO: 2639086 - RNA, 22 nt, Escherichia coli CFT073
aaguaaucauaauuauaauaaa

SEQ ID NO: 2639087 - RNA, 17 nt, Escherichia coli CFT073
aaguaauuguuucaucg

SEQ ID NO: 2639088 - RNA, 12 nt, Escherichia coli CFT073
aaguacauuaaa

SEQ ID NO: 2639089 - RNA, 19 nt, Escherichia coli CFT073
aaguaccaucguccagcag

SEQ ID NO: 2639090 - RNA, 21 nt, Escherichia coli CFT073
aaguaccaucguccagcagca

SEQ ID NO: 2639091 - RNA, 14 nt, Escherichia coli CFT073
aauaaacacugcua

SEQ ID NO: 2639092 - RNA, 18 nt, Escherichia coli CFT073
aauaaacagcagauggca

SEQ ID NO: 2639093 - RNA, 20 nt, Escherichia coli CFT073
aauaaacagcagauggcagc

SEQ ID NO: 2639094 - RNA, 19 nt, Escherichia coli CFT073
aauaaacauugguccgauu

SEQ ID NO: 2639095 - RNA, 12 nt, Escherichia coli CFT073
aauaaaccacac

SEQ ID NO: 2639096 - RNA, 18 nt, Escherichia coli CFT073
aauaaacccuucacugua

SEQ ID NO: 2639097 - RNA, 23 nt, Escherichia coli CFT073
aauaaacgcuccugcuacaccau

SEQ ID NO: 2639098 - RNA, 15 nt, Escherichia coli CFT073
aauaaacgguacacg

SEQ ID NO: 2639099 - RNA, 11 nt, Escherichia coli CFT073
aauaaagauga

SEQ ID NO: 2639100 - RNA, 16 nt, Escherichia coli CFT073
aauaaagccgcccauu

SEQ ID NO: 2639101 - RNA, 22 nt, Escherichia coli CFT073
aauaaaucaaagucagaucaau

SEQ ID NO: 2639102 - RNA, 20 nt, Escherichia coli CFT073
aauaaaucguguaaaucgcu

SEQ ID NO: 2639103 - RNA, 13 nt, Escherichia coli CFT073
aauaaaugcuuga

SEQ ID NO: 2639104 - RNA, 16 nt, Escherichia coli CFT073
aauaacacccauaaaa

SEQ ID NO: 2639105 - RNA, 17 nt, Escherichia coli CFT073
aauaacagugauugcuu

SEQ ID NO: 2639106 - RNA, 16 nt, Escherichia coli CFT073
aauaaccacuucuucu

SEQ ID NO: 2639107 - RNA, 24 nt, Escherichia coli CFT073
aauaaccagcguuuccagcaccag

SEQ ID NO: 2639108 - RNA, 14 nt, Escherichia coli CFT073
aauaaccaucagcu

SEQ ID NO: 2639109 - RNA, 17 nt, Escherichia coli CFT073
aauaaccauuaaauagu

SEQ ID NO: 2639110 - RNA, 12 nt, Escherichia coli CFT073
aauaaccauucc

SEQ ID NO: 2639111 - RNA, 20 nt, Escherichia coli CFT073
aauaacccguuguaaaugcu

SEQ ID NO: 2639112 - RNA, 14 nt, Escherichia coli CFT073
aauaaccgccacca

SEQ ID NO: 2639113 - RNA, 16 nt, Escherichia coli CFT073
aauaaccggcacuuca

SEQ ID NO: 2639114 - RNA, 14 nt, Escherichia coli CFT073
aauaaccgucuuug

SEQ ID NO: 2639115 - RNA, 16 nt, Escherichia coli CFT073
aauaaccgucuuugcu

SEQ ID NO: 2639116 - RNA, 19 nt, Escherichia coli CFT073
aauaaccucaugguuuuua

SEQ ID NO: 2639117 - RNA, 14 nt, Escherichia coli CFT073
aauaaccuuauuau

SEQ ID NO: 2639118 - RNA, 15 nt, Escherichia coli CFT073
aauaacgaucaucac

SEQ ID NO: 2639119 - RNA, 19 nt, Escherichia coli CFT073
aauaacggcucaaacugcu

SEQ ID NO: 2639120 - RNA, 20 nt, Escherichia coli CFT073
aauaacggcugauaacaaua

SEQ ID NO: 2639121 - RNA, 20 nt, Escherichia coli CFT073
aauaacguaguguaaaugca

SEQ ID NO: 2639122 - RNA, 16 nt, Escherichia coli CFT073
aauaacucccaggcua

SEQ ID NO: 2639123 - RNA, 20 nt, Escherichia coli CFT073
aauaacucccuauaaugcgc

SEQ ID NO: 2639124 - RNA, 20 nt, Escherichia coli CFT073
aauaacuucuauucaccagc

SEQ ID NO: 2639125 - RNA, 13 nt, Escherichia coli CFT073
aauaagaaaaagg

SEQ ID NO: 2639126 - RNA, 22 nt, Escherichia coli CFT073
aauaagagauccaggccagaua

SEQ ID NO: 2639127 - RNA, 15 nt, Escherichia coli CFT073
aauaagcacaaagca

SEQ ID NO: 2639128 - RNA, 16 nt, Escherichia coli CFT073
aauaagcacaaagcaa

SEQ ID NO: 2639129 - RNA, 11 nt, Escherichia coli CFT073
aauaagcacuc

SEQ ID NO: 2639130 - RNA, 22 nt, Escherichia coli CFT073
aauaagcacucuggcgaaucgu

SEQ ID NO: 2639131 - RNA, 22 nt, Escherichia coli CFT073
aauaagcaggccauuugcucua

SEQ ID NO: 2639132 - RNA, 14 nt, Escherichia coli CFT073
aauaagcccggccu

SEQ ID NO: 2639133 - RNA, 17 nt, Escherichia coli CFT073
aauaagcgcccagcucu

SEQ ID NO: 2639134 - RNA, 22 nt, Escherichia coli CFT073
aauaagcgcccagcucuuuacc

SEQ ID NO: 2639135 - RNA, 21 nt, Escherichia coli CFT073
aauaagcuguucagauacacc

SEQ ID NO: 2639136 - RNA, 17 nt, Escherichia coli CFT073
aauaaguaagcauuaua

SEQ ID NO: 2639137 - RNA, 19 nt, Escherichia coli CFT073
aauaaguaagcauuauaua

SEQ ID NO: 2639138 - RNA, 17 nt, Escherichia coli CFT073
aauaauaauccgcugca

SEQ ID NO: 2639139 - RNA, 15 nt, Escherichia coli CFT073
aauaauauccgguuu

SEQ ID NO: 2639140 - RNA, 20 nt, Escherichia coli CFT073
aauaaucaaaugaaugccaa

SEQ ID NO: 2639141 - RNA, 11 nt, Escherichia coli CFT073
aauaaucagau

SEQ ID NO: 2639142 - RNA, 20 nt, Escherichia coli CFT073
aauaaucagauacaccgcga

SEQ ID NO: 2639143 - RNA, 12 nt, Escherichia coli CFT073
aauaauccccac

SEQ ID NO: 2639144 - RNA, 18 nt, Escherichia coli CFT073
aauaauccccacaucagg

SEQ ID NO: 2639145 - RNA, 22 nt, Escherichia coli CFT073
aauaaucgacgaggaaaaugau

SEQ ID NO: 2639146 - RNA, 22 nt, Escherichia coli CFT073
aauaaucgaucacguaauaaaa

SEQ ID NO: 2639147 - RNA, 14 nt, Escherichia coli CFT073
aauaaucgcaucaa

SEQ ID NO: 2639148 - RNA, 22 nt, Escherichia coli CFT073
aauaaucgggaauacagaaaau

SEQ ID NO: 2639149 - RNA, 13 nt, Escherichia coli CFT073
aauaaucguuccu

SEQ ID NO: 2639150 - RNA, 22 nt, Escherichia coli CFT073
aauaaucguuccuuuaccaccu

SEQ ID NO: 2639151 - RNA, 12 nt, Escherichia coli CFT073
aauaaucucaau

SEQ ID NO: 2639152 - RNA, 15 nt, Escherichia coli CFT073
aauaaucucaauauc

SEQ ID NO: 2639153 - RNA, 16 nt, Escherichia coli CFT073
aauaaucugaaaacca

SEQ ID NO: 2639154 - RNA, 16 nt, Escherichia coli CFT073
aauaaugcaaaaaggc

SEQ ID NO: 2639155 - RNA, 18 nt, Escherichia coli CFT073
aauaaugccaccagugcc

SEQ ID NO: 2639156 - RNA, 18 nt, Escherichia coli CFT073
aauaaugccguugaucag

SEQ ID NO: 2639157 - RNA, 21 nt, Escherichia coli CFT073
aauaauggccuuuucgccacc

SEQ ID NO: 2639158 - RNA, 23 nt, Escherichia coli CFT073
aauaauggccuuuucgccaccgg

SEQ ID NO: 2639159 - RNA, 14 nt, Escherichia coli CFT073
aauaauggugaauu

SEQ ID NO: 2639160 - RNA, 21 nt, Escherichia coli CFT073
aauaaugucgcugguaacauc

SEQ ID NO: 2639161 - RNA, 16 nt, Escherichia coli CFT073
aauaauucaaaaaccu

SEQ ID NO: 2639162 - RNA, 20 nt, Escherichia coli CFT073
aauaauucggcuuaacagau

SEQ ID NO: 2639163 - RNA, 21 nt, Escherichia coli CFT073
aauaauugaauaacggcccca

SEQ ID NO: 2639164 - RNA, 21 nt, Escherichia coli CFT073
aauaauugccauuacuacaaa

SEQ ID NO: 2639165 - RNA, 13 nt, Escherichia coli CFT073
aauaauugugcaa

SEQ ID NO: 2639166 - RNA, 12 nt, Escherichia coli CFT073
aauaauuucuca

SEQ ID NO: 2639167 - RNA, 21 nt, Escherichia coli CFT073
aauacaaacucacugccagca

SEQ ID NO: 2639168 - RNA, 11 nt, Escherichia coli CFT073
aauacacauca

SEQ ID NO: 2639169 - RNA, 15 nt, Escherichia coli CFT073
aauacagagcacgca

SEQ ID NO: 2639170 - RNA, 11 nt, Escherichia coli CFT073
aauacagcaau

SEQ ID NO: 2639171 - RNA, 17 nt, Escherichia coli CFT073
aauacagcaauggaaaa

SEQ ID NO: 2639172 - RNA, 19 nt, Escherichia coli CFT073
aauacagcaauggaaaaag

SEQ ID NO: 2639173 - RNA, 21 nt, Escherichia coli CFT073
aauacagccagccagcaccag

SEQ ID NO: 2639174 - RNA, 16 nt, Escherichia coli CFT073
aauacagcccgaacug

SEQ ID NO: 2639175 - RNA, 20 nt, Escherichia coli CFT073
aauacagcuuaaucaccagc

SEQ ID NO: 2639176 - RNA, 21 nt, Escherichia coli CFT073
aauacagcuuaaucaccagcg

SEQ ID NO: 2639177 - RNA, 12 nt, Escherichia coli CFT073
aauacaggaaau

SEQ ID NO: 2639178 - RNA, 19 nt, Escherichia coli CFT073
aauacaggcuacucccagu

SEQ ID NO: 2639179 - RNA, 14 nt, Escherichia coli CFT073
aauacauagaagcu

SEQ ID NO: 2639180 - RNA, 17 nt, Escherichia coli CFT073
aauacauauagccaaaa

SEQ ID NO: 2639181 - RNA, 20 nt, Escherichia coli CFT073
aauacauauagccaaaacuc

SEQ ID NO: 2639182 - RNA, 14 nt, Escherichia coli CFT073
aauaccaagcagac

SEQ ID NO: 2639183 - RNA, 19 nt, Escherichia coli CFT073
aauaccaagccaagccaga

SEQ ID NO: 2639184 - RNA, 21 nt, Escherichia coli CFT073
aauaccaagccaagccagagc

SEQ ID NO: 2639185 - RNA, 19 nt, Escherichia coli CFT073
aauaccaauaaucaauuua

SEQ ID NO: 2639186 - RNA, 19 nt, Escherichia coli CFT073
aauaccaaugaauuuucgc

SEQ ID NO: 2639187 - RNA, 16 nt, Escherichia coli CFT073
aauaccacaaacgccg

SEQ ID NO: 2639188 - RNA, 16 nt, Escherichia coli CFT073
aauaccacugcgccau

SEQ ID NO: 2639189 - RNA, 16 nt, Escherichia coli CFT073
aauaccagcccuggcu

SEQ ID NO: 2639190 - RNA, 12 nt, Escherichia coli CFT073
aauaccagccuu

SEQ ID NO: 2639191 - RNA, 22 nt, Escherichia coli CFT073
aauaccagccuucuucauccag

SEQ ID NO: 2639192 - RNA, 15 nt, Escherichia coli CFT073
aauacccaaaaaaua

SEQ ID NO: 2639193 - RNA, 16 nt, Escherichia coli CFT073
aauaccccagcggcaa

SEQ ID NO: 2639194 - RNA, 20 nt, Escherichia coli CFT073
aauaccccagcggcaaccag

SEQ ID NO: 2639195 - RNA, 14 nt, Escherichia coli CFT073
aauaccccgccagc

SEQ ID NO: 2639196 - RNA, 15 nt, Escherichia coli CFT073
aauaccccugccgcc

SEQ ID NO: 2639197 - RNA, 18 nt, Escherichia coli CFT073
aauacccgccagaaaagg

SEQ ID NO: 2639198 - RNA, 14 nt, Escherichia coli CFT073
aauacccgguccuu

SEQ ID NO: 2639199 - RNA, 15 nt, Escherichia coli CFT073
aauaccgaagaguaa

SEQ ID NO: 2639200 - RNA, 18 nt, Escherichia coli CFT073
aauauccggauuuuucgc

SEQ ID NO: 2639201 - RNA, 12 nt, Escherichia coli CFT073
aauauccugagu

SEQ ID NO: 2639202 - RNA, 22 nt, Escherichia coli CFT073
aauauccuguggacgcagcuca

SEQ ID NO: 2639203 - RNA, 15 nt, Escherichia coli CFT073
aauauccuguucaga

SEQ ID NO: 2639204 - RNA, 12 nt, Escherichia coli CFT073
aauauccuugca

SEQ ID NO: 2639205 - RNA, 21 nt, Escherichia coli CFT073
aauauccuugcagauauugca

SEQ ID NO: 2639206 - RNA, 23 nt, Escherichia coli CFT073
aauaucgaauggcguuaacaaua

SEQ ID NO: 2639207 - RNA, 15 nt, Escherichia coli CFT073
aauaucgauaucgua

SEQ ID NO: 2639208 - RNA, 18 nt, Escherichia coli CFT073
aauaucgccucuauucga

SEQ ID NO: 2639209 - RNA, 16 nt, Escherichia coli CFT073
aauaucguaauugaag

SEQ ID NO: 2639210 - RNA, 21 nt, Escherichia coli CFT073
aauaucguauccgguuuucca

SEQ ID NO: 2639211 - RNA, 17 nt, Escherichia coli CFT073
aauaucugcaccauuag

SEQ ID NO: 2639212 - RNA, 11 nt, Escherichia coli CFT073
aauaucuuccu

SEQ ID NO: 2639213 - RNA, 20 nt, Escherichia coli CFT073
aauaucuucuacuucacggc

SEQ ID NO: 2639214 - RNA, 19 nt, Escherichia coli CFT073
aauaucuuuaucugccagc

SEQ ID NO: 2639215 - RNA, 20 nt, Escherichia coli CFT073
aauaucuuuccuuaacaaaa

SEQ ID NO: 2639216 - RNA, 14 nt, Escherichia coli CFT073
aauaugaaaauggu

SEQ ID NO: 2639217 - RNA, 21 nt, Escherichia coli CFT073
aauaugaauuaacgucaggug

SEQ ID NO: 2639218 - RNA, 14 nt, Escherichia coli CFT073
aauaugcagcaguc

SEQ ID NO: 2639219 - RNA, 14 nt, Escherichia coli CFT073
aauaugcauaaacc

SEQ ID NO: 2639220 - RNA, 16 nt, Escherichia coli CFT073
aauaugcggugccauu

SEQ ID NO: 2639221 - RNA, 12 nt, Escherichia coli CFT073
aauauggcgcgc

SEQ ID NO: 2639222 - RNA, 20 nt, Escherichia coli CFT073
aauaugguuauuaccaaaaa

SEQ ID NO: 2639223 - RNA, 17 nt, Escherichia coli CFT073
aauaugucgcgccaggc

SEQ ID NO: 2639224 - RNA, 13 nt, Escherichia coli CFT073
aauauuaaaccac

SEQ ID NO: 2639225 - RNA, 13 nt, Escherichia coli CFT073
aauauuaaugcug

SEQ ID NO: 2639226 - RNA, 14 nt, Escherichia coli CFT073
aauauuacuucaga

SEQ ID NO: 2639227 - RNA, 18 nt, Escherichia coli CFT073
aauauucaagauaacgcc

SEQ ID NO: 2639228 - RNA, 22 nt, Escherichia coli CFT073
aauauucacccgaauaccuuuc

SEQ ID NO: 2639229 - RNA, 18 nt, Escherichia coli CFT073
aauauucacgacaugugc

SEQ ID NO: 2639230 - RNA, 22 nt, Escherichia coli CFT073
aauauucagccacuguuucaau

SEQ ID NO: 2639231 - RNA, 22 nt, Escherichia coli CFT073
aauauucgcgugaguggcgcgc

SEQ ID NO: 2639232 - RNA, 14 nt, Escherichia coli CFT073
aauauucuuccggc

SEQ ID NO: 2639233 - RNA, 16 nt, Escherichia coli CFT073
aauauucuuccggcuu

SEQ ID NO: 2639234 - RNA, 18 nt, Escherichia coli CFT073
aauauugagcaggaugac

SEQ ID NO: 2639235 - RNA, 14 nt, Escherichia coli CFT073
aauauugaugcaca

SEQ ID NO: 2639236 - RNA, 16 nt, Escherichia coli CFT073
aauauugaugcacacc

SEQ ID NO: 2639237 - RNA, 17 nt, Escherichia coli CFT073
aauauugaugcacacca

SEQ ID NO: 2639238 - RNA, 18 nt, Escherichia coli CFT073
aauauugaugcacaccau

SEQ ID NO: 2639239 - RNA, 16 nt, Escherichia coli CFT073
aauauugccauuacgg

SEQ ID NO: 2639240 - RNA, 19 nt, Escherichia coli CFT073
aauauugcugcuaaaucgg

SEQ ID NO: 2639241 - RNA, 17 nt, Escherichia coli CFT073
aauauugcuguaaagua

SEQ ID NO: 2639242 - RNA, 23 nt, Escherichia coli CFT073
aauauuggagagcgauaauuuau

SEQ ID NO: 2639243 - RNA, 21 nt, Escherichia coli CFT073
aauauuggucauucggcgcag

SEQ ID NO: 2639244 - RNA, 19 nt, Escherichia coli CFT073
aauauugguguugugaagu

SEQ ID NO: 2639245 - RNA, 12 nt, Escherichia coli CFT073
aauauuugcuua

SEQ ID NO: 2639246 - RNA, 13 nt, Escherichia coli CFT073
aauauuuucaggg

SEQ ID NO: 2639247 - RNA, 15 nt, Escherichia coli CFT073
aauauuuucgccgcc

SEQ ID NO: 2639248 - RNA, 23 nt, Escherichia coli CFT073
aauauuuuucgucaguuuauaca

SEQ ID NO: 2639249 - RNA, 16 nt, Escherichia coli CFT073
aauauuuuuuagcaca

SEQ ID NO: 2639250 - RNA, 18 nt, Escherichia coli CFT073
aaucaaaagaacacaacg

SEQ ID NO: 2639251 - RNA, 13 nt, Escherichia coli CFT073
aaucaaacuuccg

SEQ ID NO: 2639252 - RNA, 17 nt, Escherichia coli CFT073
aaucaaaguuaguaaaa

SEQ ID NO: 2639253 - RNA, 20 nt, Escherichia coli CFT073
aaucaaaguuaguaaaacua

SEQ ID NO: 2639254 - RNA, 21 nt, Escherichia coli CFT073
aaucaaauaaauaaucucuuc

SEQ ID NO: 2639255 - RNA, 12 nt, Escherichia coli CFT073
aaucaaauacau

SEQ ID NO: 2639256 - RNA, 12 nt, Escherichia coli CFT073
aaucaaaugacu

SEQ ID NO: 2639257 - RNA, 18 nt, Escherichia coli CFT073
aaucaaauuugccagcga

SEQ ID NO: 2639258 - RNA, 13 nt, Escherichia coli CFT073
aaucaacaaaagu

SEQ ID NO: 2639259 - RNA, 15 nt, Escherichia coli CFT073
aaucaacaaauucgc

SEQ ID NO: 2639260 - RNA, 19 nt, Escherichia coli CFT073
aaucaacaccaaacccgga

SEQ ID NO: 2639261 - RNA, 17 nt, Escherichia coli CFT073
aaucaacacuucuuuga

SEQ ID NO: 2639262 - RNA, 14 nt, Escherichia coli CFT073
aaucaacagauaaa

SEQ ID NO: 2639263 - RNA, 22 nt, Escherichia coli CFT073
aaucaacagauaaauggcacag

SEQ ID NO: 2639264 - RNA, 18 nt, Escherichia coli CFT073
aaucaacagccacucuua

SEQ ID NO: 2639265 - RNA, 16 nt, Escherichia coli CFT073
aaucaacauauuucuc

SEQ ID NO: 2639266 - RNA, 15 nt, Escherichia coli CFT073
aaucaaccauuaaac

SEQ ID NO: 2639267 - RNA, 21 nt, Escherichia coli CFT073
aaucaaccgcgccugaccauu

SEQ ID NO: 2639268 - RNA, 16 nt, Escherichia coli CFT073
aaucaacgaugucaau

SEQ ID NO: 2639269 - RNA, 15 nt, Escherichia coli CFT073
aaucaacgcgaaaau

SEQ ID NO: 2639270 - RNA, 20 nt, Escherichia coli CFT073
aaucaacgcuacguuauuua

SEQ ID NO: 2639271 - RNA, 22 nt, Escherichia coli CFT073
aaucaacggcaacaauuuccgc

SEQ ID NO: 2639272 - RNA, 14 nt, Escherichia coli CFT073
aaucaagguaauug

SEQ ID NO: 2639273 - RNA, 16 nt, Escherichia coli CFT073
aaucaagguugcacaa

SEQ ID NO: 2639274 - RNA, 19 nt, Escherichia coli CFT073
aaucaauaauuaaucuggu

SEQ ID NO: 2639275 - RNA, 20 nt, Escherichia coli CFT073
aaucaauauaaacagccccu

SEQ ID NO: 2639276 - RNA, 13 nt, Escherichia coli CFT073
aaucaauaugcau

SEQ ID NO: 2639277 - RNA, 16 nt, Escherichia coli CFT073
aaucaauaugcauaaa

SEQ ID NO: 2639278 - RNA, 11 nt, Escherichia coli CFT073
aaucaaucacc

SEQ ID NO: 2639279 - RNA, 15 nt, Escherichia coli CFT073
aaucaauccggcaau

SEQ ID NO: 2639280 - RNA, 17 nt, Escherichia coli CFT073
aaucaauccggcaauca

SEQ ID NO: 2639281 - RNA, 21 nt, Escherichia coli CFT073
aaucaauccggcaaucaacau

SEQ ID NO: 2639282 - RNA, 22 nt, Escherichia coli CFT073
aaucaauccggcaaucaacauc

SEQ ID NO: 2639283 - RNA, 14 nt, Escherichia coli CFT073
aaucaaugccagga

SEQ ID NO: 2639284 - RNA, 15 nt, Escherichia coli CFT073
aaucaauugcaggaa

SEQ ID NO: 2639285 - RNA, 18 nt, Escherichia coli CFT073
aaucaauugcaggaaggu

SEQ ID NO: 2639286 - RNA, 20 nt, Escherichia coli CFT073
aaucaauuuuuugauauguu

SEQ ID NO: 2639287 - RNA, 23 nt, Escherichia coli CFT073
aaucacacagcgguuuaccgaug

SEQ ID NO: 2639288 - RNA, 21 nt, Escherichia coli CFT073
aaucacaguauuuaagugaca

SEQ ID NO: 2639289 - RNA, 14 nt, Escherichia coli CFT073
aaucacaucaccau

SEQ ID NO: 2639290 - RNA, 17 nt, Escherichia coli CFT073
aaucacaucaccauaaa

SEQ ID NO: 2639291 - RNA, 12 nt, Escherichia coli CFT073
aaucacauccac

SEQ ID NO: 2639292 - RNA, 12 nt, Escherichia coli CFT073
aaucacaucgcg

SEQ ID NO: 2639293 - RNA, 17 nt, Escherichia coli CFT073
aaucacaucgcgcucgu

SEQ ID NO: 2639294 - RNA, 14 nt, Escherichia coli CFT073
aaucaccaaaccaa

SEQ ID NO: 2639295 - RNA, 19 nt, Escherichia coli CFT073
aaucaccaaaccaacaagc

SEQ ID NO: 2639296 - RNA, 19 nt, Escherichia coli CFT073
aaucaccaaacugcucgua

SEQ ID NO: 2639297 - RNA, 21 nt, Escherichia coli CFT073
aaucaccaccagcggaauauc

SEQ ID NO: 2639298 - RNA, 14 nt, Escherichia coli CFT073
aaucaccagcaaca

SEQ ID NO: 2639299 - RNA, 15 nt, Escherichia coli CFT073
aaucaccagcaacac

SEQ ID NO: 2639300 - RNA, 20 nt, Escherichia coli CFT073
aaucaccauauucagcagca

SEQ ID NO: 2639301 - RNA, 22 nt, Escherichia coli CFT073
aaucaccauauucagcagcaga

SEQ ID NO: 2639302 - RNA, 17 nt, Escherichia coli CFT073
aaucaccaucagcagca

SEQ ID NO: 2639303 - RNA, 21 nt, Escherichia coli CFT073
aaucaccaucagcagcaacaa

SEQ ID NO: 2639304 - RNA, 20 nt, Escherichia coli CFT073
aaucaccccgagcgaauaaa

SEQ ID NO: 2639305 - RNA, 20 nt, Escherichia coli CFT073
aaucacccgagagaacugcu

SEQ ID NO: 2639306 - RNA, 17 nt, Escherichia coli CFT073
aaucacccgagcuaaca

SEQ ID NO: 2639307 - RNA, 19 nt, Escherichia coli CFT073
aaucaccgaugacagaauc

SEQ ID NO: 2639308 - RNA, 19 nt, Escherichia coli CFT073
aaucaccgccaccagcguc

SEQ ID NO: 2639309 - RNA, 19 nt, Escherichia coli CFT073
aaucccgcgaucgggacuu

SEQ ID NO: 2639310 - RNA, 20 nt, Escherichia coli CFT073
aaucccggaaugagauucaa

SEQ ID NO: 2639311 - RNA, 13 nt, Escherichia coli CFT073
aaucccggcacca

SEQ ID NO: 2639312 - RNA, 18 nt, Escherichia coli CFT073
aaucccggucaugauaca

SEQ ID NO: 2639313 - RNA, 18 nt, Escherichia coli CFT073
aaucccguaauccguaaa

SEQ ID NO: 2639314 - RNA, 23 nt, Escherichia coli CFT073
aaucccgucuucgucuggcugua

SEQ ID NO: 2639315 - RNA, 23 nt, Escherichia coli CFT073
aaucccguugccacucaggcaaa

SEQ ID NO: 2639316 - RNA, 15 nt, Escherichia coli CFT073
aaucccugccgccau

SEQ ID NO: 2639317 - RNA, 19 nt, Escherichia coli CFT073
aaucccugcgaacugcgca

SEQ ID NO: 2639318 - RNA, 22 nt, Escherichia coli CFT073
aaucccugcgaacugcgcagau

SEQ ID NO: 2639319 - RNA, 16 nt, Escherichia coli CFT073
aaucccuuuacaggcg

SEQ ID NO: 2639320 - RNA, 18 nt, Escherichia coli CFT073
aaucccuuuacaggcgug

SEQ ID NO: 2639321 - RNA, 18 nt, Escherichia coli CFT073
aauccgccaggacaucag

SEQ ID NO: 2639322 - RNA, 17 nt, Escherichia coli CFT073
aauccgccaucaacacu

SEQ ID NO: 2639323 - RNA, 11 nt, Escherichia coli CFT073
aauccgccgcc

SEQ ID NO: 2639324 - RNA, 13 nt, Escherichia coli CFT073
aauccgccgccac

SEQ ID NO: 2639325 - RNA, 18 nt, Escherichia coli CFT073
aauccggcauacauuuau

SEQ ID NO: 2639326 - RNA, 21 nt, Escherichia coli CFT073
aauccggguucggauaaauga

SEQ ID NO: 2639327 - RNA, 14 nt, Escherichia coli CFT073
aauccguaaucgcu

SEQ ID NO: 2639328 - RNA, 21 nt, Escherichia coli CFT073
aauccguacgcuuuuccacuc

SEQ ID NO: 2639329 - RNA, 19 nt, Escherichia coli CFT073
aauccgucccaauucuucc

SEQ ID NO: 2639330 - RNA, 17 nt, Escherichia coli CFT073
aauccgucgcgccaggc

SEQ ID NO: 2639331 - RNA, 18 nt, Escherichia coli CFT073
aauccgucgcgccaggcg

SEQ ID NO: 2639332 - RNA, 15 nt, Escherichia coli CFT073
aauccgucucaaugg

SEQ ID NO: 2639333 - RNA, 18 nt, Escherichia coli CFT073
aauccguggcaaauugcc

SEQ ID NO: 2639334 - RNA, 21 nt, Escherichia coli CFT073
aauccguggcaaauugcccaa

SEQ ID NO: 2639335 - RNA, 22 nt, Escherichia coli CFT073
aauccguuagcgaguugaucac

SEQ ID NO: 2639336 - RNA, 23 nt, Escherichia coli CFT073
aauccguuauguuucauccaggc

SEQ ID NO: 2639337 - RNA, 20 nt, Escherichia coli CFT073
aauccucccggaugcaccau

SEQ ID NO: 2639338 - RNA, 16 nt, Escherichia coli CFT073
aauccugccagugcaa

SEQ ID NO: 2639339 - RNA, 17 nt, Escherichia coli CFT073
aauccuggccauaccau

SEQ ID NO: 2639340 - RNA, 22 nt, Escherichia coli CFT073
aauccuggccauaccaugacga

SEQ ID NO: 2639341 - RNA, 21 nt, Escherichia coli CFT073
aauccuguagauauucuucca

SEQ ID NO: 2639342 - RNA, 14 nt, Escherichia coli CFT073
aauccuguaucuuc

SEQ ID NO: 2639343 - RNA, 15 nt, Escherichia coli CFT073
aauccuuauauaaaa

SEQ ID NO: 2639344 - RNA, 18 nt, Escherichia coli CFT073
aauccuuauauaaaacac

SEQ ID NO: 2639345 - RNA, 20 nt, Escherichia coli CFT073
aauccuucccccaccaccau

SEQ ID NO: 2639346 - RNA, 13 nt, Escherichia coli CFT073
aaucgaaaucaac

SEQ ID NO: 2639347 - RNA, 14 nt, Escherichia coli CFT073
aaucgacaaaauca

SEQ ID NO: 2639348 - RNA, 19 nt, Escherichia coli CFT073
aaucgacaaaaucagaaac

SEQ ID NO: 2639349 - RNA, 13 nt, Escherichia coli CFT073
aaucgacaccagu

SEQ ID NO: 2639350 - RNA, 23 nt, Escherichia coli CFT073
aaucgaccaggccaucagcagcg

SEQ ID NO: 2639351 - RNA, 21 nt, Escherichia coli CFT073
aaucgacggccaguuugacau

SEQ ID NO: 2639352 - RNA, 17 nt, Escherichia coli CFT073
aaucgacguucugccaa

SEQ ID NO: 2639353 - RNA, 20 nt, Escherichia coli CFT073
aaucgacucugaaugccagu

SEQ ID NO: 2639354 - RNA, 18 nt, Escherichia coli CFT073
aaucgagcaauaaacacu

SEQ ID NO: 2639355 - RNA, 22 nt, Escherichia coli CFT073
aaucgagcaauaaacacugcua

SEQ ID NO: 2639356 - RNA, 17 nt, Escherichia coli CFT073
aaucgauaacugcucuc

SEQ ID NO: 2639357 - RNA, 20 nt, Escherichia coli CFT073
aaucgaucacguaauaaaau

SEQ ID NO: 2639358 - RNA, 15 nt, Escherichia coli CFT073
aaucgaucaucaccu

SEQ ID NO: 2639359 - RNA, 23 nt, Escherichia coli CFT073
aaucgaucaucaccugcgcuggc

SEQ ID NO: 2639360 - RNA, 14 nt, Escherichia coli CFT073
aaucgcaaccagcc

SEQ ID NO: 2639361 - RNA, 22 nt, Escherichia coli CFT073
aaucgcacccgccaucaucccu

SEQ ID NO: 2639362 - RNA, 18 nt, Escherichia coli CFT073
aaucgcacguugccagca

SEQ ID NO: 2639363 - RNA, 19 nt, Escherichia coli CFT073
aaucgcagccacguuaaua

SEQ ID NO: 2639364 - RNA, 13 nt, Escherichia coli CFT073
aaucgcagcgcaa

SEQ ID NO: 2639365 - RNA, 16 nt, Escherichia coli CFT073
aaucgcagucucuuua

SEQ ID NO: 2639366 - RNA, 18 nt, Escherichia coli CFT073
aaucgcauauuucaacga

SEQ ID NO: 2639367 - RNA, 12 nt, Escherichia coli CFT073
aaucgcaucaau

SEQ ID NO: 2639368 - RNA, 20 nt, Escherichia coli CFT073
aaucgccaacgccugcggcu

SEQ ID NO: 2639369 - RNA, 19 nt, Escherichia coli CFT073
aaucgccacaacuucaacg

SEQ ID NO: 2639370 - RNA, 20 nt, Escherichia coli CFT073
aaucgccacaacuucaacgu

SEQ ID NO: 2639371 - RNA, 20 nt, Escherichia coli CFT073
aaucgccagcaucggcaacg

SEQ ID NO: 2639372 - RNA, 16 nt, Escherichia coli CFT073
aaucgccagcggcagc

SEQ ID NO: 2639373 - RNA, 18 nt, Escherichia coli CFT073
aaucgcccccaucaccgg

SEQ ID NO: 2639374 - RNA, 17 nt, Escherichia coli CFT073
aaucgcccgggcuuuau

SEQ ID NO: 2639375 - RNA, 22 nt, Escherichia coli CFT073
aaucgccgcauaauaucuuucc

SEQ ID NO: 2639376 - RNA, 23 nt, Escherichia coli CFT073
aaucgccgcauaauaucuuuccu

SEQ ID NO: 2639377 - RNA, 18 nt, Escherichia coli CFT073
aaucgccugaacaccaga

SEQ ID NO: 2639378 - RNA, 20 nt, Escherichia coli CFT073
aaucgccugcugaauauugc

SEQ ID NO: 2639379 - RNA, 14 nt, Escherichia coli CFT073
aaucgcguuuuaca

SEQ ID NO: 2639380 - RNA, 18 nt, Escherichia coli CFT073
aaucgcuaucagcgccac

SEQ ID NO: 2639381 - RNA, 13 nt, Escherichia coli CFT073
aaucgcucccucu

SEQ ID NO: 2639382 - RNA, 17 nt, Escherichia coli CFT073
aaucgcucccucuccac

SEQ ID NO: 2639383 - RNA, 13 nt, Escherichia coli CFT073
aaucgcugcggua

SEQ ID NO: 2639384 - RNA, 16 nt, Escherichia coli CFT073
aaucgcuguacucacc

SEQ ID NO: 2639385 - RNA, 19 nt, Escherichia coli CFT073
aaucgcuguacucaccaac

SEQ ID NO: 2639386 - RNA, 15 nt, Escherichia coli CFT073
aaucgcuucaucgcc

SEQ ID NO: 2639387 - RNA, 14 nt, Escherichia coli CFT073
aaucgcuucauuua

SEQ ID NO: 2639388 - RNA, 20 nt, Escherichia coli CFT073
aaucggaaaacaaccgccau

SEQ ID NO: 2639389 - RNA, 17 nt, Escherichia coli CFT073
aaucggcaccgccgcca

SEQ ID NO: 2639390 - RNA, 15 nt, Escherichia coli CFT073
aaucggccuuccaua

SEQ ID NO: 2639391 - RNA, 21 nt, Escherichia coli CFT073
aaucggcgaagagagcgccag

SEQ ID NO: 2639392 - RNA, 22 nt, Escherichia coli CFT073
aaucggcgaagagagcgccagu

SEQ ID NO: 2639393 - RNA, 13 nt, Escherichia coli CFT073
aaucggcgcggcg

SEQ ID NO: 2639394 - RNA, 13 nt, Escherichia coli CFT073
aaucggcugcacc

SEQ ID NO: 2639395 - RNA, 22 nt, Escherichia coli CFT073
aaucgggaucccuuuguaagca

SEQ ID NO: 2639396 - RNA, 18 nt, Escherichia coli CFT073
aaucgggcgacagcugcg

SEQ ID NO: 2639397 - RNA, 14 nt, Escherichia coli CFT073
aaucgguccgccac

SEQ ID NO: 2639398 - RNA, 16 nt, Escherichia coli CFT073
aaucggugcuggcggc

SEQ ID NO: 2639399 - RNA, 12 nt, Escherichia coli CFT073
aaucguaaucgg

SEQ ID NO: 2639400 - RNA, 20 nt, Escherichia coli CFT073
aaucgucagacgaugcgucu

SEQ ID NO: 2639401 - RNA, 14 nt, Escherichia coli CFT073
aaucgucagcucgc

SEQ ID NO: 2639402 - RNA, 19 nt, Escherichia coli CFT073
aaucgucaggaucagccau

SEQ ID NO: 2639403 - RNA, 13 nt, Escherichia coli CFT073
aaucgucaucagc

SEQ ID NO: 2639404 - RNA, 19 nt, Escherichia coli CFT073
aaucgucaucagcgccaac

SEQ ID NO: 2639405 - RNA, 22 nt, Escherichia coli CFT073
aaucguccuccgaauaaauuug

SEQ ID NO: 2639406 - RNA, 17 nt, Escherichia coli CFT073
aaucgucgauuguuaua

SEQ ID NO: 2639407 - RNA, 20 nt, Escherichia coli CFT073
aaucguugauuguugcagau

SEQ ID NO: 2639408 - RNA, 16 nt, Escherichia coli CFT073
aaucguugcccgcaga

SEQ ID NO: 2639409 - RNA, 20 nt, Escherichia coli CFT073
aaucuacaaaagauuauugc

SEQ ID NO: 2639410 - RNA, 16 nt, Escherichia coli CFT073
aaucuacggaagaguu

SEQ ID NO: 2639411 - RNA, 20 nt, Escherichia coli CFT073
aaucuacggaagaguuuuuc

SEQ ID NO: 2639412 - RNA, 13 nt, Escherichia coli CFT073
aaucucaccaaua

SEQ ID NO: 2639413 - RNA, 21 nt, Escherichia coli CFT073
aaucucacccgguacaucaau

SEQ ID NO: 2639414 - RNA, 24 nt, Escherichia coli CFT073
aaucucacccgguacaucaauacc

SEQ ID NO: 2639415 - RNA, 17 nt, Escherichia coli CFT073
aaucucaucggcgucgg

SEQ ID NO: 2639416 - RNA, 20 nt, Escherichia coli CFT073
aaucuccuguugugaugcaa

SEQ ID NO: 2639417 - RNA, 17 nt, Escherichia coli CFT073
aaugccauccuugauca

SEQ ID NO: 2639418 - RNA, 18 nt, Escherichia coli CFT073
aaugccauuaacaucccu

SEQ ID NO: 2639419 - RNA, 19 nt, Escherichia coli CFT073
aaugccauucacaaaaaca

SEQ ID NO: 2639420 - RNA, 22 nt, Escherichia coli CFT073
aaugcccaucgugauaaacgua

SEQ ID NO: 2639421 - RNA, 20 nt, Escherichia coli CFT073
aaugccccaccacucugugg

SEQ ID NO: 2639422 - RNA, 19 nt, Escherichia coli CFT073
aaugccccacuuuacggcc

SEQ ID NO: 2639423 - RNA, 13 nt, Escherichia coli CFT073
aaugccccagaau

SEQ ID NO: 2639424 - RNA, 23 nt, Escherichia coli CFT073
aaugcccgacaaaaauuauugcc

SEQ ID NO: 2639425 - RNA, 14 nt, Escherichia coli CFT073
aaugccgacauagg

SEQ ID NO: 2639426 - RNA, 14 nt, Escherichia coli CFT073
aaugccgcgcccca

SEQ ID NO: 2639427 - RNA, 18 nt, Escherichia coli CFT073
aaugccggaaucagaauc

SEQ ID NO: 2639428 - RNA, 21 nt, Escherichia coli CFT073
aaugccggaugcgacgcuagc

SEQ ID NO: 2639429 - RNA, 23 nt, Escherichia coli CFT073
aaugccggguaaagauuguucuu

SEQ ID NO: 2639430 - RNA, 17 nt, Escherichia coli CFT073
aaugccguaaccagcgc

SEQ ID NO: 2639431 - RNA, 17 nt, Escherichia coli CFT073
aaugccguaauccugca

SEQ ID NO: 2639432 - RNA, 16 nt, Escherichia coli CFT073
aaugccgucaccagca

SEQ ID NO: 2639433 - RNA, 16 nt, Escherichia coli CFT073
aaugccguuugcugca

SEQ ID NO: 2639434 - RNA, 23 nt, Escherichia coli CFT073
aaugccucucgcgaggagaggcc

SEQ ID NO: 2639435 - RNA, 17 nt, Escherichia coli CFT073
aaugccugauuguuugu

SEQ ID NO: 2639436 - RNA, 13 nt, Escherichia coli CFT073
aaugccugcaaca

SEQ ID NO: 2639437 - RNA, 22 nt, Escherichia coli CFT073
aaugccugcuguugcggggaau

SEQ ID NO: 2639438 - RNA, 18 nt, Escherichia coli CFT073
aaugcgaaugaaagauga

SEQ ID NO: 2639439 - RNA, 14 nt, Escherichia coli CFT073
aaugcgauggugaa

SEQ ID NO: 2639440 - RNA, 22 nt, Escherichia coli CFT073
aaugcgcaacaccguaagaaag

SEQ ID NO: 2639441 - RNA, 12 nt, Escherichia coli CFT073
aaugcgccagac

SEQ ID NO: 2639442 - RNA, 19 nt, Escherichia coli CFT073
aaugcgccagacgugcacg

SEQ ID NO: 2639443 - RNA, 12 nt, Escherichia coli CFT073
aaugcgccgcca

SEQ ID NO: 2639444 - RNA, 13 nt, Escherichia coli CFT073
aaugcgccgccaa

SEQ ID NO: 2639445 - RNA, 19 nt, Escherichia coli CFT073
aaugcgccuauaaggcucu

SEQ ID NO: 2639446 - RNA, 14 nt, Escherichia coli CFT073
aaugcgccugcaua

SEQ ID NO: 2639447 - RNA, 13 nt, Escherichia coli CFT073
aaugcgcgagcca

SEQ ID NO: 2639448 - RNA, 18 nt, Escherichia coli CFT073
aaugcgcggucagaaaau

SEQ ID NO: 2639449 - RNA, 20 nt, Escherichia coli CFT073
aaugcggagauuccgcuugc

SEQ ID NO: 2639450 - RNA, 20 nt, Escherichia coli CFT073
aaugcguagguuaacccagc

SEQ ID NO: 2639451 - RNA, 15 nt, Escherichia coli CFT073
aaugcguuccagcau

SEQ ID NO: 2639452 - RNA, 19 nt, Escherichia coli CFT073
aaugcguuccaguucgcug

SEQ ID NO: 2639453 - RNA, 15 nt, Escherichia coli CFT073
aaugcguucgccagc

SEQ ID NO: 2639454 - RNA, 19 nt, Escherichia coli CFT073
aaugcuccccguaggccag

SEQ ID NO: 2639455 - RNA, 19 nt, Escherichia coli CFT073
aaugcuccccuuucuuauu

SEQ ID NO: 2639456 - RNA, 20 nt, Escherichia coli CFT073
aaugcuccccuuucuuauuu

SEQ ID NO: 2639457 - RNA, 16 nt, Escherichia coli CFT073
aaugcucucuucgcca

SEQ ID NO: 2639458 - RNA, 14 nt, Escherichia coli CFT073
aaugcugaaagcag

SEQ ID NO: 2639459 - RNA, 15 nt, Escherichia coli CFT073
aaugcugcaaucauu

SEQ ID NO: 2639460 - RNA, 23 nt, Escherichia coli CFT073
aaugcugcaccccacaaacagaa

SEQ ID NO: 2639461 - RNA, 21 nt, Escherichia coli CFT073
aaugcugccuucggugggaaa

SEQ ID NO: 2639462 - RNA, 22 nt, Escherichia coli CFT073
aaugcugcucgcaaaauaaaaa

SEQ ID NO: 2639463 - RNA, 23 nt, Escherichia coli CFT073
aaugcugguuuugugcgccacau

SEQ ID NO: 2639464 - RNA, 20 nt, Escherichia coli CFT073
aaugcuuaacgccagacagc

SEQ ID NO: 2639465 - RNA, 13 nt, Escherichia coli CFT073
aaugcuucuaccg

SEQ ID NO: 2639466 - RNA, 14 nt, Escherichia coli CFT073
aaugcuugacgcgu

SEQ ID NO: 2639467 - RNA, 15 nt, Escherichia coli CFT073
aaugcuuucaguacu

SEQ ID NO: 2639468 - RNA, 14 nt, Escherichia coli CFT073
aauggaaacagcac

SEQ ID NO: 2639469 - RNA, 16 nt, Escherichia coli CFT073
aauggaaacagcacca

SEQ ID NO: 2639470 - RNA, 18 nt, Escherichia coli CFT073
aauggacgucgauaaaca

SEQ ID NO: 2639471 - RNA, 12 nt, Escherichia coli CFT073
aauggagaaacg

SEQ ID NO: 2639472 - RNA, 19 nt, Escherichia coli CFT073
aauggagcuaaacagagcu

SEQ ID NO: 2639473 - RNA, 22 nt, Escherichia coli CFT073
aauggagcuaaacagagcugca

SEQ ID NO: 2639474 - RNA, 22 nt, Escherichia coli CFT073
aauggauucagucuuaaaaagc

SEQ ID NO: 2639475 - RNA, 20 nt, Escherichia coli CFT073
aauggcaauggucuugacau

SEQ ID NO: 2639476 - RNA, 11 nt, Escherichia coli CFT073
aauggcagcau

SEQ ID NO: 2639477 - RNA, 22 nt, Escherichia coli CFT073
aauggcauccuugcuaaccaac

SEQ ID NO: 2639478 - RNA, 15 nt, Escherichia coli CFT073
aauggcauugggugc

SEQ ID NO: 2639479 - RNA, 14 nt, Escherichia coli CFT073
aauggcccgcgcag

SEQ ID NO: 2639480 - RNA, 18 nt, Escherichia coli CFT073
aauggcgacguaccagcg

SEQ ID NO: 2639481 - RNA, 16 nt, Escherichia coli CFT073
aauggcgcccaucggc

SEQ ID NO: 2639482 - RNA, 14 nt, Escherichia coli CFT073
aauggcgcgaaaac

SEQ ID NO: 2639483 - RNA, 20 nt, Escherichia coli CFT073
aauggcgcuaacucauccgg

SEQ ID NO: 2639484 - RNA, 15 nt, Escherichia coli CFT073
aauggcgucaacaac

SEQ ID NO: 2639485 - RNA, 21 nt, Escherichia coli CFT073
aauggcuaucgaaaucaaagu

SEQ ID NO: 2639486 - RNA, 23 nt, Escherichia coli CFT073
aauggcuccgggugugacaacaa

SEQ ID NO: 2639487 - RNA, 22 nt, Escherichia coli CFT073
aauggcugaccggaauuuaccc

SEQ ID NO: 2639488 - RNA, 23 nt, Escherichia coli CFT073
aauggcugcacuuucaguacguu

SEQ ID NO: 2639489 - RNA, 15 nt, Escherichia coli CFT073
aauggcugccgccag

SEQ ID NO: 2639490 - RNA, 14 nt, Escherichia coli CFT073
aauggcugcggacg

SEQ ID NO: 2639491 - RNA, 13 nt, Escherichia coli CFT073
aauggcuuccagu

SEQ ID NO: 2639492 - RNA, 19 nt, Escherichia coli CFT073
aaugggcaagcgaccaucg

SEQ ID NO: 2639493 - RNA, 16 nt, Escherichia coli CFT073
aaugggcgcgggcaau

SEQ ID NO: 2639494 - RNA, 16 nt, Escherichia coli CFT073
aaugggcgugaaaggu

SEQ ID NO: 2639495 - RNA, 19 nt, Escherichia coli CFT073
aauggguuuuuuguugccu

SEQ ID NO: 2639496 - RNA, 20 nt, Escherichia coli CFT073
aaugguaaucagcgacugcu

SEQ ID NO: 2639497 - RNA, 21 nt, Escherichia coli CFT073
aaugguacucggcacguuacu

SEQ ID NO: 2639498 - RNA, 14 nt, Escherichia coli CFT073
aaugguagccgccc

SEQ ID NO: 2639499 - RNA, 16 nt, Escherichia coli CFT073
aaugguauuaagccag

SEQ ID NO: 2639500 - RNA, 16 nt, Escherichia coli CFT073
aauggucacacacaac

SEQ ID NO: 2639501 - RNA, 18 nt, Escherichia coli CFT073
aauggucauuuuucacuc

SEQ ID NO: 2639502 - RNA, 21 nt, Escherichia coli CFT073
aauggucauuuuucacucccc

SEQ ID NO: 2639503 - RNA, 12 nt, Escherichia coli CFT073
aauggugaaguu

SEQ ID NO: 2639504 - RNA, 13 nt, Escherichia coli CFT073
aauggugaccugc

SEQ ID NO: 2639505 - RNA, 22 nt, Escherichia coli CFT073
aaugguguccaaaugcagcacg

SEQ ID NO: 2639506 - RNA, 17 nt, Escherichia coli CFT073
aaugguucugcacagcu

SEQ ID NO: 2639507 - RNA, 18 nt, Escherichia coli CFT073
aaugguuucauuccagua

SEQ ID NO: 2639508 - RNA, 21 nt, Escherichia coli CFT073
aaugguuuccagcaucgacca

SEQ ID NO: 2639509 - RNA, 16 nt, Escherichia coli CFT073
aaugguuucgcuuugc

SEQ ID NO: 2639510 - RNA, 12 nt, Escherichia coli CFT073
aauguaaccaca

SEQ ID NO: 2639511 - RNA, 14 nt, Escherichia coli CFT073
aauguaauaugcag

SEQ ID NO: 2639512 - RNA, 17 nt, Escherichia coli CFT073
aauguaucuuucaucau

SEQ ID NO: 2639513 - RNA, 21 nt, Escherichia coli CFT073
aaugucaccuaauuuaaaauu

SEQ ID NO: 2639514 - RNA, 22 nt, Escherichia coli CFT073
aaugucagggacguaccaauga

SEQ ID NO: 2639515 - RNA, 19 nt, Escherichia coli CFT073
aaugucauaccacauacau

SEQ ID NO: 2639516 - RNA, 21 nt, Escherichia coli CFT073
aaugucaucucuggcacgaga

SEQ ID NO: 2639517 - RNA, 23 nt, Escherichia coli CFT073
aaugucaucucuggcacgagauc

SEQ ID NO: 2639518 - RNA, 20 nt, Escherichia coli CFT073
aaugucauuacgaucaagaa

SEQ ID NO: 2639519 - RNA, 17 nt, Escherichia coli CFT073
aauguccauauauaaaa

SEQ ID NO: 2639520 - RNA, 21 nt, Escherichia coli CFT073
aaugucgccaugcgguaaguu

SEQ ID NO: 2639521 - RNA, 16 nt, Escherichia coli CFT073
aaugucggaugcggcg

SEQ ID NO: 2639522 - RNA, 20 nt, Escherichia coli CFT073
aaugucggaugcggcgugaa

SEQ ID NO: 2639523 - RNA, 20 nt, Escherichia coli CFT073
aaugucuuuuaugguagaaa

SEQ ID NO: 2639524 - RNA, 13 nt, Escherichia coli CFT073
aauguggaaagcc

SEQ ID NO: 2639525 - RNA, 14 nt, Escherichia coli CFT073
aauugcaaacagag

SEQ ID NO: 2639526 - RNA, 23 nt, Escherichia coli CFT073
aauugcaccauccccuuuucacg

SEQ ID NO: 2639527 - RNA, 16 nt, Escherichia coli CFT073
aauugcaccucagcau

SEQ ID NO: 2639528 - RNA, 22 nt, Escherichia coli CFT073
aauugcacguccaguggcaucc

SEQ ID NO: 2639529 - RNA, 20 nt, Escherichia coli CFT073
aauugcagaggcucaaccgc

SEQ ID NO: 2639530 - RNA, 19 nt, Escherichia coli CFT073
aauugcaggaacuucguaa

SEQ ID NO: 2639531 - RNA, 11 nt, Escherichia coli CFT073
aauugcagggu

SEQ ID NO: 2639532 - RNA, 23 nt, Escherichia coli CFT073
aauugcaguacgauaauggcuuc

SEQ ID NO: 2639533 - RNA, 22 nt, Escherichia coli CFT073
aauugcaucuacgcucucuuca

SEQ ID NO: 2639534 - RNA, 12 nt, Escherichia coli CFT073
aauugccagaca

SEQ ID NO: 2639535 - RNA, 14 nt, Escherichia coli CFT073
aauugccagcuugc

SEQ ID NO: 2639536 - RNA, 16 nt, Escherichia coli CFT073
aauugccauaaaaacg

SEQ ID NO: 2639537 - RNA, 18 nt, Escherichia coli CFT073
aauugccauauaugccau

SEQ ID NO: 2639538 - RNA, 14 nt, Escherichia coli CFT073
aauugccauuacua

SEQ ID NO: 2639539 - RNA, 18 nt, Escherichia coli CFT073
aauugccauuacuacaaa

SEQ ID NO: 2639540 - RNA, 16 nt, Escherichia coli CFT073
aauugcccaaagccaa

SEQ ID NO: 2639541 - RNA, 20 nt, Escherichia coli CFT073
aauugcccccagucgccagu

SEQ ID NO: 2639542 - RNA, 21 nt, Escherichia coli CFT073
aauugcccgcagauguagcuc

SEQ ID NO: 2639543 - RNA, 19 nt, Escherichia coli CFT073
aauugccgcaccaaccauc

SEQ ID NO: 2639544 - RNA, 21 nt, Escherichia coli CFT073
aauugccgcaccaaccaucag

SEQ ID NO: 2639545 - RNA, 21 nt, Escherichia coli CFT073
aauugccggaugcggcgugaa

SEQ ID NO: 2639546 - RNA, 17 nt, Escherichia coli CFT073
aauugccucuucugaua

SEQ ID NO: 2639547 - RNA, 18 nt, Escherichia coli CFT073
aauugccugauggccugc

SEQ ID NO: 2639548 - RNA, 23 nt, Escherichia coli CFT073
aauugccugcggaucaagugaac

SEQ ID NO: 2639549 - RNA, 17 nt, Escherichia coli CFT073
aauugccuguucaaccu

SEQ ID NO: 2639550 - RNA, 23 nt, Escherichia coli CFT073
aauugcgcagcggaggcgauaau

SEQ ID NO: 2639551 - RNA, 12 nt, Escherichia coli CFT073
aauugcggcagg

SEQ ID NO: 2639552 - RNA, 20 nt, Escherichia coli CFT073
aauugcgggccaaagaccag

SEQ ID NO: 2639553 - RNA, 19 nt, Escherichia coli CFT073
aauugcguaaagccugcug

SEQ ID NO: 2639554 - RNA, 22 nt, Escherichia coli CFT073
aauugcguaaagccugcuggca

SEQ ID NO: 2639555 - RNA, 15 nt, Escherichia coli CFT073
aauugcguucugucg

SEQ ID NO: 2639556 - RNA, 22 nt, Escherichia coli CFT073
aauugcuauugguucacuugcu

SEQ ID NO: 2639557 - RNA, 18 nt, Escherichia coli CFT073
aauugcucauagagcgca

SEQ ID NO: 2639558 - RNA, 22 nt, Escherichia coli CFT073
aauuguaguguugcaguaaauu

SEQ ID NO: 2639559 - RNA, 14 nt, Escherichia coli CFT073
aauuguauccaugc

SEQ ID NO: 2639560 - RNA, 19 nt, Escherichia coli CFT073
aauuguauuagcccguucu

SEQ ID NO: 2639561 - RNA, 22 nt, Escherichia coli CFT073
aauugucaacggcacggaaagc

SEQ ID NO: 2639562 - RNA, 17 nt, Escherichia coli CFT073
aauugucaccgucacau

SEQ ID NO: 2639563 - RNA, 19 nt, Escherichia coli CFT073
aauuguccagaucuuucgc

SEQ ID NO: 2639564 - RNA, 20 nt, Escherichia coli CFT073
aauuguccagaucuuucgcc

SEQ ID NO: 2639565 - RNA, 19 nt, Escherichia coli CFT073
aauugugguuuucucuugu

SEQ ID NO: 2639566 - RNA, 19 nt, Escherichia coli CFT073
aauugugucgacauagcca

SEQ ID NO: 2639567 - RNA, 20 nt, Escherichia coli CFT073
aauuguuccgucagccgccc

SEQ ID NO: 2639568 - RNA, 12 nt, Escherichia coli CFT073
aauuguuucauc

SEQ ID NO: 2639569 - RNA, 15 nt, Escherichia coli CFT073
aauuuaaaauugaua

SEQ ID NO: 2639570 - RNA, 20 nt, Escherichia coli CFT073
aauuuaaaauugauaaccaa

SEQ ID NO: 2639571 - RNA, 14 nt, Escherichia coli CFT073
aauuuaucagauuu

SEQ ID NO: 2639572 - RNA, 18 nt, Escherichia coli CFT073
aauuuaucgcauauccuc

SEQ ID NO: 2639573 - RNA, 16 nt, Escherichia coli CFT073
aauuuaucuucaccaa

SEQ ID NO: 2639574 - RNA, 17 nt, Escherichia coli CFT073
aauuuauuccgagcagc

SEQ ID NO: 2639575 - RNA, 17 nt, Escherichia coli CFT073
aauuuauugaauuugua

SEQ ID NO: 2639576 - RNA, 12 nt, Escherichia coli CFT073
aauuucacacca

SEQ ID NO: 2639577 - RNA, 19 nt, Escherichia coli CFT073
aauuucacaccaucaacaa

SEQ ID NO: 2639578 - RNA, 16 nt, Escherichia coli CFT073
aauuucaccacugccu

SEQ ID NO: 2639579 - RNA, 17 nt, Escherichia coli CFT073
aauuucacgcucaccca

SEQ ID NO: 2639580 - RNA, 18 nt, Escherichia coli CFT073
aauuucacuuucugacca

SEQ ID NO: 2639581 - RNA, 12 nt, Escherichia coli CFT073
aauuucagaaaa

SEQ ID NO: 2639582 - RNA, 13 nt, Escherichia coli CFT073
aauuucagcaaua

SEQ ID NO: 2639583 - RNA, 17 nt, Escherichia coli CFT073
aauuucagcggcacugu

SEQ ID NO: 2639584 - RNA, 19 nt, Escherichia coli CFT073
aauuucagcggcacuguuu

SEQ ID NO: 2639585 - RNA, 15 nt, Escherichia coli CFT073
aauuucaggcaacaa

SEQ ID NO: 2639586 - RNA, 18 nt, Escherichia coli CFT073
aauuucaggcaacaaaaa

SEQ ID NO: 2639587 - RNA, 23 nt, Escherichia coli CFT073
aauuucagguucugaccagccag

SEQ ID NO: 2639588 - RNA, 17 nt, Escherichia coli CFT073
aauuucauaugcgccag

SEQ ID NO: 2639589 - RNA, 17 nt, Escherichia coli CFT073
aauuucaucaucacgaa

SEQ ID NO: 2639590 - RNA, 21 nt, Escherichia coli CFT073
aauuucauccuguaugacaaa

SEQ ID NO: 2639591 - RNA, 19 nt, Escherichia coli CFT073
aauuucaucgcuacaccaa

SEQ ID NO: 2639592 - RNA, 22 nt, Escherichia coli CFT073
aauuucaucgcugaauuucgcc

SEQ ID NO: 2639593 - RNA, 16 nt, Escherichia coli CFT073
aauuucauuauucauu

SEQ ID NO: 2639594 - RNA, 11 nt, Escherichia coli CFT073
aauuucauuuu

SEQ ID NO: 2639595 - RNA, 16 nt, Escherichia coli CFT073
aauuucauuuucaggg

SEQ ID NO: 2639596 - RNA, 18 nt, Escherichia coli CFT073
aauuucauuuucagggca

SEQ ID NO: 2639597 - RNA, 18 nt, Escherichia coli CFT073
aauuuccgcuuucaacgc

SEQ ID NO: 2639598 - RNA, 22 nt, Escherichia coli CFT073
aauuuccggcaccguccucacu

SEQ ID NO: 2639599 - RNA, 15 nt, Escherichia coli CFT073
aauuuccucuucccg

SEQ ID NO: 2639600 - RNA, 13 nt, Escherichia coli CFT073
aauuucgccgcac

SEQ ID NO: 2639601 - RNA, 21 nt, Escherichia coli CFT073
aauuucugugcagccaaaaau

SEQ ID NO: 2639602 - RNA, 18 nt, Escherichia coli CFT073
aauuucuuucgcacuggu

SEQ ID NO: 2639603 - RNA, 15 nt, Escherichia coli CFT073
aauuucuuuuuuuca

SEQ ID NO: 2639604 - RNA, 18 nt, Escherichia coli CFT073
aauuucuuuuuuucauug

SEQ ID NO: 2639605 - RNA, 14 nt, Escherichia coli CFT073
aauuugaacugguu

SEQ ID NO: 2639606 - RNA, 18 nt, Escherichia coli CFT073
aauuugcaggcuaaaaac

SEQ ID NO: 2639607 - RNA, 22 nt, Escherichia coli CFT073
aauuugccaggcuugauccagc

SEQ ID NO: 2639608 - RNA, 16 nt, Escherichia coli CFT073
aauuugccaucucugc

SEQ ID NO: 2639609 - RNA, 21 nt, Escherichia coli CFT073
aauuugccaucucugcaacgu

SEQ ID NO: 2639610 - RNA, 23 nt, Escherichia coli CFT073
aauuugccaucucugcaacgucu

SEQ ID NO: 2639611 - RNA, 20 nt, Escherichia coli CFT073
aauuugcgcucaauaaucaa

SEQ ID NO: 2639612 - RNA, 16 nt, Escherichia coli CFT073
aauuugcgucaaugcc

SEQ ID NO: 2639613 - RNA, 14 nt, Escherichia coli CFT073
aauuugcuccagaa

SEQ ID NO: 2639614 - RNA, 16 nt, Escherichia coli CFT073
aauuugcuccgccacu

SEQ ID NO: 2639615 - RNA, 13 nt, Escherichia coli CFT073
aauuugcucuucu

SEQ ID NO: 2639616 - RNA, 15 nt, Escherichia coli CFT073
aauuuggugcucagu

SEQ ID NO: 2639617 - RNA, 18 nt, Escherichia coli CFT073
aauuuguaggccugauaa

SEQ ID NO: 2639618 - RNA, 17 nt, Escherichia coli CFT073
aauuuguccacccauag

SEQ ID NO: 2639619 - RNA, 13 nt, Escherichia coli CFT073
aauuuguuaacaa

SEQ ID NO: 2639620 - RNA, 17 nt, Escherichia coli CFT073
aauuuguuaacaauauu

SEQ ID NO: 2639621 - RNA, 18 nt, Escherichia coli CFT073
aauuuguuugacgcgcaa

SEQ ID NO: 2639622 - RNA, 12 nt, Escherichia coli CFT073
aauuuuaggaug

SEQ ID NO: 2639623 - RNA, 17 nt, Escherichia coli CFT073
aauuuuaggaugcugca

SEQ ID NO: 2639624 - RNA, 15 nt, Escherichia coli CFT073
aauuuucaaugcccc

SEQ ID NO: 2639625 - RNA, 19 nt, Escherichia coli CFT073
aauuuuccuugaaaaagag

SEQ ID NO: 2639626 - RNA, 20 nt, Escherichia coli CFT073
aauuuuccuugaaaaagagg

SEQ ID NO: 2639627 - RNA, 13 nt, Escherichia coli CFT073
aauuuugaaauaa

SEQ ID NO: 2639628 - RNA, 14 nt, Escherichia coli CFT073
aauuuugaacagaa

SEQ ID NO: 2639629 - RNA, 23 nt, Escherichia coli CFT073
aauuuugaaggaaaaaucgcacu

SEQ ID NO: 2639630 - RNA, 15 nt, Escherichia coli CFT073
aauuuugcagcauuc

SEQ ID NO: 2639631 - RNA, 17 nt, Escherichia coli CFT073
aauuuugcagcauucau

SEQ ID NO: 2639632 - RNA, 14 nt, Escherichia coli CFT073
aauuuuuacuucuu

SEQ ID NO: 2639633 - RNA, 13 nt, Escherichia coli CFT073
acaacucauuccc

SEQ ID NO: 2639634 - RNA, 23 nt, Escherichia coli CFT073
acaacugcgaccguacaaccaaa

SEQ ID NO: 2639635 - RNA, 21 nt, Escherichia coli CFT073
acaacuucaacguugaauuuc

SEQ ID NO: 2639636 - RNA, 23 nt, Escherichia coli CFT073
acaagaaugccugccagcuugcg

SEQ ID NO: 2639637 - RNA, 13 nt, Escherichia coli CFT073
acaagacuguaaa

SEQ ID NO: 2639638 - RNA, 17 nt, Escherichia coli CFT073
acaagaucgcccugagg

SEQ ID NO: 2639639 - RNA, 13 nt, Escherichia coli CFT073
acaagauuagcca

SEQ ID NO: 2639640 - RNA, 16 nt, Escherichia coli CFT073
acaagauuagccauca

SEQ ID NO: 2639641 - RNA, 13 nt, Escherichia coli CFT073
acaagcagcuuga

SEQ ID NO: 2639642 - RNA, 17 nt, Escherichia coli CFT073
acaagcauaacaaaaug

SEQ ID NO: 2639643 - RNA, 22 nt, Escherichia coli CFT073
acaagcauaacaaaaugccgua

SEQ ID NO: 2639644 - RNA, 17 nt, Escherichia coli CFT073
acaagccaaauccagca

SEQ ID NO: 2639645 - RNA, 18 nt, Escherichia coli CFT073
acaagccaaauccagcac

SEQ ID NO: 2639646 - RNA, 21 nt, Escherichia coli CFT073
acaagccaaauccagcaccac

SEQ ID NO: 2639647 - RNA, 17 nt, Escherichia coli CFT073
acaagcccaggccaucg

SEQ ID NO: 2639648 - RNA, 14 nt, Escherichia coli CFT073
acaagcccgccaga

SEQ ID NO: 2639649 - RNA, 15 nt, Escherichia coli CFT073
acaagcguaagagaa

SEQ ID NO: 2639650 - RNA, 22 nt, Escherichia coli CFT073
acaagcgucauauccgacacua

SEQ ID NO: 2639651 - RNA, 18 nt, Escherichia coli CFT073
acaagcucauuucccaac

SEQ ID NO: 2639652 - RNA, 15 nt, Escherichia coli CFT073
acaagcucucuucau

SEQ ID NO: 2639653 - RNA, 15 nt, Escherichia coli CFT073
acaagcugaacgcag

SEQ ID NO: 2639654 - RNA, 17 nt, Escherichia coli CFT073
acaaggcgcuaaaagca

SEQ ID NO: 2639655 - RNA, 20 nt, Escherichia coli CFT073
acaaggcgcucgcgccgcau

SEQ ID NO: 2639656 - RNA, 20 nt, Escherichia coli CFT073
acaaggcuauccucuaaacc

SEQ ID NO: 2639657 - RNA, 21 nt, Escherichia coli CFT073
acaaggguaugcuguaaacaa

SEQ ID NO: 2639658 - RNA, 13 nt, Escherichia coli CFT073
acaaguccagcac

SEQ ID NO: 2639659 - RNA, 15 nt, Escherichia coli CFT073
acaaguccagcaccg

SEQ ID NO: 2639660 - RNA, 17 nt, Escherichia coli CFT073
acaagucuuuuuugguu

SEQ ID NO: 2639661 - RNA, 18 nt, Escherichia coli CFT073
acaaguggcgacaaagug

SEQ ID NO: 2639662 - RNA, 13 nt, Escherichia coli CFT073
acaaguucuucga

SEQ ID NO: 2639663 - RNA, 18 nt, Escherichia coli CFT073
acaauaaaaggugcguua

SEQ ID NO: 2639664 - RNA, 16 nt, Escherichia coli CFT073
acaauaaacuggcugu

SEQ ID NO: 2639665 - RNA, 15 nt, Escherichia coli CFT073
acaauaacucuugaa

SEQ ID NO: 2639666 - RNA, 12 nt, Escherichia coli CFT073
acaauaauaucu

SEQ ID NO: 2639667 - RNA, 13 nt, Escherichia coli CFT073
acaauaauaucuu

SEQ ID NO: 2639668 - RNA, 14 nt, Escherichia coli CFT073
acaauaauaucuuu

SEQ ID NO: 2639669 - RNA, 16 nt, Escherichia coli CFT073
acaauaauaucuuucu

SEQ ID NO: 2639670 - RNA, 17 nt, Escherichia coli CFT073
acaauaaucaacgcgaa

SEQ ID NO: 2639671 - RNA, 16 nt, Escherichia coli CFT073
acaauacgcccacgcu

SEQ ID NO: 2639672 - RNA, 20 nt, Escherichia coli CFT073
acaauacgcccgguggcggu

SEQ ID NO: 2639673 - RNA, 18 nt, Escherichia coli CFT073
acaauagcaaucuguaac

SEQ ID NO: 2639674 - RNA, 15 nt, Escherichia coli CFT073
acaauaucuaaaaug

SEQ ID NO: 2639675 - RNA, 13 nt, Escherichia coli CFT073
acaauauuaacaa

SEQ ID NO: 2639676 - RNA, 16 nt, Escherichia coli CFT073
acaauauuaacaacau

SEQ ID NO: 2639677 - RNA, 20 nt, Escherichia coli CFT073
acaauauugaugcucgcugc

SEQ ID NO: 2639678 - RNA, 15 nt, Escherichia coli CFT073
acaauauugcggaua

SEQ ID NO: 2639679 - RNA, 10 nt, Escherichia coli CFT073
acaaucacca

SEQ ID NO: 2639680 - RNA, 13 nt, Escherichia coli CFT073
acaaucagccaga

SEQ ID NO: 2639681 - RNA, 19 nt, Escherichia coli CFT073
acaaucaucaacccgcgcg

SEQ ID NO: 2639682 - RNA, 17 nt, Escherichia coli CFT073
acaaucaucacgaucac

SEQ ID NO: 2639683 - RNA, 21 nt, Escherichia coli CFT073
acaaucaucgcauccagcgug

SEQ ID NO: 2639684 - RNA, 20 nt, Escherichia coli CFT073
acaaucccguugaaaaugcu

SEQ ID NO: 2639685 - RNA, 20 nt, Escherichia coli CFT073
acaaucccuuaguaacgcca

SEQ ID NO: 2639686 - RNA, 21 nt, Escherichia coli CFT073
acaaucccuuaguaacgccag

SEQ ID NO: 2639687 - RNA, 15 nt, Escherichia coli CFT073
acaaucccuuccacc

SEQ ID NO: 2639688 - RNA, 15 nt, Escherichia coli CFT073
acaauccgauaaucc

SEQ ID NO: 2639689 - RNA, 22 nt, Escherichia coli CFT073
acaauccgauauaaaaaauacg

SEQ ID NO: 2639690 - RNA, 16 nt, Escherichia coli CFT073
acaauccgcucuuuca

SEQ ID NO: 2639691 - RNA, 12 nt, Escherichia coli CFT073
acaauccuuccc

SEQ ID NO: 2639692 - RNA, 14 nt, Escherichia coli CFT073
acaauccuucccug

SEQ ID NO: 2639693 - RNA, 16 nt, Escherichia coli CFT073
acaaucgcaaauaugu

SEQ ID NO: 2639694 - RNA, 17 nt, Escherichia coli CFT073
acaaucgcccccaucac

SEQ ID NO: 2639695 - RNA, 11 nt, Escherichia coli CFT073
acaaucgccgc

SEQ ID NO: 2639696 - RNA, 21 nt, Escherichia coli CFT073
acaaucgcucacaacaauauc

SEQ ID NO: 2639697 - RNA, 20 nt, Escherichia coli CFT073
acaaucggcguaccgcacac

SEQ ID NO: 2639698 - RNA, 23 nt, Escherichia coli CFT073
acaaucgggaaaaucugcgggaa

SEQ ID NO: 2639699 - RNA, 11 nt, Escherichia coli CFT073
acaaucgguaa

SEQ ID NO: 2639700 - RNA, 14 nt, Escherichia coli CFT073
acaaucgucugguu

SEQ ID NO: 2639701 - RNA, 17 nt, Escherichia coli CFT073
acaaucucaaccgcuuc

SEQ ID NO: 2639702 - RNA, 18 nt, Escherichia coli CFT073
acaaucucaauuuucacu

SEQ ID NO: 2639703 - RNA, 21 nt, Escherichia coli CFT073
acaaucugguuuuugguuuca

SEQ ID NO: 2639704 - RNA, 22 nt, Escherichia coli CFT073
acaaucuugccauuccacaaaa

SEQ ID NO: 2639705 - RNA, 14 nt, Escherichia coli CFT073
acaaugaucgacag

SEQ ID NO: 2639706 - RNA, 23 nt, Escherichia coli CFT073
acaaugauuacucucuuucgcuu

SEQ ID NO: 2639707 - RNA, 22 nt, Escherichia coli CFT073
acaaugcaauauuuugaauuag

SEQ ID NO: 2639708 - RNA, 16 nt, Escherichia coli CFT073
acaaugccagaaacau

SEQ ID NO: 2639709 - RNA, 18 nt, Escherichia coli CFT073
acaaugccgaauagaaca

SEQ ID NO: 2639710 - RNA, 23 nt, Escherichia coli CFT073
acaaugccgaauagaacauaaug

SEQ ID NO: 2639711 - RNA, 17 nt, Escherichia coli CFT073
acaaugccguaaccagc

SEQ ID NO: 2639712 - RNA, 17 nt, Escherichia coli CFT073
acaaugcguaaauugcu

SEQ ID NO: 2639713 - RNA, 20 nt, Escherichia coli CFT073
acaauggagcacauugccug

SEQ ID NO: 2639714 - RNA, 18 nt, Escherichia coli CFT073
acaauggagcuaaacaga

SEQ ID NO: 2639715 - RNA, 23 nt, Escherichia coli CFT073
acaauggagcuaaacagagcugc

SEQ ID NO: 2639716 - RNA, 15 nt, Escherichia coli CFT073
acaauggcgcggcua

SEQ ID NO: 2639717 - RNA, 21 nt, Escherichia coli CFT073
acaaugguuaaauugaaauuu

SEQ ID NO: 2639718 - RNA, 14 nt, Escherichia coli CFT073
acaauguaaaucau

SEQ ID NO: 2639719 - RNA, 21 nt, Escherichia coli CFT073
acaauguaccagucaauaaua

SEQ ID NO: 2639720 - RNA, 22 nt, Escherichia coli CFT073
acaaugucauggcagucuuaau

SEQ ID NO: 2639721 - RNA, 20 nt, Escherichia coli CFT073
acaaugucuucacaaccgcc

SEQ ID NO: 2639722 - RNA, 15 nt, Escherichia coli CFT073
acaauguucaaaugu

SEQ ID NO: 2639723 - RNA, 20 nt, Escherichia coli CFT073
acaauuaauacaauccagua

SEQ ID NO: 2639724 - RNA, 15 nt, Escherichia coli CFT073
acaauuacgccgagc

SEQ ID NO: 2639725 - RNA, 23 nt, Escherichia coli CFT073
acaauuccugugccucgccauua

SEQ ID NO: 2639726 - RNA, 19 nt, Escherichia coli CFT073
acaauucgugugguaaaac

SEQ ID NO: 2639727 - RNA, 18 nt, Escherichia coli CFT073
acaauugcgggccaaaga

SEQ ID NO: 2639728 - RNA, 15 nt, Escherichia coli CFT073
acaauuucagcaaua

SEQ ID NO: 2639729 - RNA, 12 nt, Escherichia coli CFT073
acaauuugccag

SEQ ID NO: 2639730 - RNA, 13 nt, Escherichia coli CFT073
acacaacaauacc

SEQ ID NO: 2639731 - RNA, 13 nt, Escherichia coli CFT073
acacaaccgccgg

SEQ ID NO: 2639732 - RNA, 21 nt, Escherichia coli CFT073
acacaacgugucguugaguuu

SEQ ID NO: 2639733 - RNA, 16 nt, Escherichia coli CFT073
acacaaguccagcacc

SEQ ID NO: 2639734 - RNA, 16 nt, Escherichia coli CFT073
acacaauaccuucugc

SEQ ID NO: 2639735 - RNA, 19 nt, Escherichia coli CFT073
acacaauauugcggauaaa

SEQ ID NO: 2639736 - RNA, 13 nt, Escherichia coli CFT073
acacaaugcaaga

SEQ ID NO: 2639737 - RNA, 20 nt, Escherichia coli CFT073
acacaaugggcaagcgacca

SEQ ID NO: 2639738 - RNA, 14 nt, Escherichia coli CFT073
acacaauuuguggc

SEQ ID NO: 2639739 - RNA, 21 nt, Escherichia coli CFT073
acacaauuuguggcccuugcg

SEQ ID NO: 2639740 - RNA, 17 nt, Escherichia coli CFT073
acacacaacacaucgcc

SEQ ID NO: 2639741 - RNA, 20 nt, Escherichia coli CFT073
acacucguccagucgccugc

SEQ ID NO: 2639742 - RNA, 15 nt, Escherichia coli CFT073
acacugagcaccaca

SEQ ID NO: 2639743 - RNA, 18 nt, Escherichia coli CFT073
acacugagcgugagugcg

SEQ ID NO: 2639744 - RNA, 22 nt, Escherichia coli CFT073
acacugagguaacucucaugcu

SEQ ID NO: 2639745 - RNA, 18 nt, Escherichia coli CFT073
acacugaugacaggcuac

SEQ ID NO: 2639746 - RNA, 20 nt, Escherichia coli CFT073
acacugauuuccccccggca

SEQ ID NO: 2639747 - RNA, 20 nt, Escherichia coli CFT073
acacugccagcccggcagcu

SEQ ID NO: 2639748 - RNA, 14 nt, Escherichia coli CFT073
acacugcgccgcca

SEQ ID NO: 2639749 - RNA, 22 nt, Escherichia coli CFT073
acacuggaaacagccaaucaua

SEQ ID NO: 2639750 - RNA, 20 nt, Escherichia coli CFT073
acacugguucccaacaacag

SEQ ID NO: 2639751 - RNA, 15 nt, Escherichia coli CFT073
acacugguucccaga

SEQ ID NO: 2639752 - RNA, 19 nt, Escherichia coli CFT073
acacuguaccuggucgaua

SEQ ID NO: 2639753 - RNA, 17 nt, Escherichia coli CFT073
acacuguuaccgcugcu

SEQ ID NO: 2639754 - RNA, 19 nt, Escherichia coli CFT073
acacuucauuggcuugcac

SEQ ID NO: 2639755 - RNA, 17 nt, Escherichia coli CFT073
acacuucugccgcuuua

SEQ ID NO: 2639756 - RNA, 22 nt, Escherichia coli CFT073
acacuucuucagccaguuuuuc

SEQ ID NO: 2639757 - RNA, 20 nt, Escherichia coli CFT073
acacuucuucuguuucuguc

SEQ ID NO: 2639758 - RNA, 21 nt, Escherichia coli CFT073
acacuuuccaguuccggcauu

SEQ ID NO: 2639759 - RNA, 14 nt, Escherichia coli CFT073
acacuuuccugcuc

SEQ ID NO: 2639760 - RNA, 19 nt, Escherichia coli CFT073
acacuuucugcaaacaaga

SEQ ID NO: 2639761 - RNA, 16 nt, Escherichia coli CFT073
acagaaacgccaucca

SEQ ID NO: 2639762 - RNA, 20 nt, Escherichia coli CFT073
acagaaaguagcggaaccgc

SEQ ID NO: 2639763 - RNA, 18 nt, Escherichia coli CFT073
acagaaauagagaaagag

SEQ ID NO: 2639764 - RNA, 12 nt, Escherichia coli CFT073
acagaacaaaau

SEQ ID NO: 2639765 - RNA, 18 nt, Escherichia coli CFT073
acagaacuggcgcgaaga

SEQ ID NO: 2639766 - RNA, 23 nt, Escherichia coli CFT073
acagaagagagauaauucagcag

SEQ ID NO: 2639767 - RNA, 19 nt, Escherichia coli CFT073
acagaauacccagcaaugc

SEQ ID NO: 2639768 - RNA, 15 nt, Escherichia coli CFT073
acagaaucagcagcg

SEQ ID NO: 2639769 - RNA, 21 nt, Escherichia coli CFT073
acagaaugauauugauaauaa

SEQ ID NO: 2639770 - RNA, 19 nt, Escherichia coli CFT073
acagaaugcgcgcgaaaac

SEQ ID NO: 2639771 - RNA, 15 nt, Escherichia coli CFT073
acagaauggcaucug

SEQ ID NO: 2639772 - RNA, 16 nt, Escherichia coli CFT073
acagaauuaucauuuu

SEQ ID NO: 2639773 - RNA, 18 nt, Escherichia coli CFT073
acagacaccaaucagccc

SEQ ID NO: 2639774 - RNA, 20 nt, Escherichia coli CFT073
acagacagccucaagcaccc

SEQ ID NO: 2639775 - RNA, 14 nt, Escherichia coli CFT073
acagacaucggcca

SEQ ID NO: 2639776 - RNA, 24 nt, Escherichia coli CFT073
acagaccaaaacgugcagcugccu

SEQ ID NO: 2639777 - RNA, 15 nt, Escherichia coli CFT073
acagaccccggcauu

SEQ ID NO: 2639778 - RNA, 23 nt, Escherichia coli CFT073
acagacgaauaauccgcccggca

SEQ ID NO: 2639779 - RNA, 11 nt, Escherichia coli CFT073
acagacgccag

SEQ ID NO: 2639780 - RNA, 12 nt, Escherichia coli CFT073
acagacggcaga

SEQ ID NO: 2639781 - RNA, 18 nt, Escherichia coli CFT073
acagacucaaaccaaugg

SEQ ID NO: 2639782 - RNA, 19 nt, Escherichia coli CFT073
acagacucaaaccaauggc

SEQ ID NO: 2639783 - RNA, 16 nt, Escherichia coli CFT073
acagagauucgcuggc

SEQ ID NO: 2639784 - RNA, 12 nt, Escherichia coli CFT073
acagagcugcaa

SEQ ID NO: 2639785 - RNA, 16 nt, Escherichia coli CFT073
acagaggucuuuucuc

SEQ ID NO: 2639786 - RNA, 12 nt, Escherichia coli CFT073
acagaguagaaa

SEQ ID NO: 2639787 - RNA, 15 nt, Escherichia coli CFT073
acagaguauaaaaaa

SEQ ID NO: 2639788 - RNA, 18 nt, Escherichia coli CFT073
acagaguguauucaugcc

SEQ ID NO: 2639789 - RNA, 14 nt, Escherichia coli CFT073
acagauaaacuaca

SEQ ID NO: 2639790 - RNA, 14 nt, Escherichia coli CFT073
acagauaaaucauc

SEQ ID NO: 2639791 - RNA, 17 nt, Escherichia coli CFT073
acagauaauaaaaaaga

SEQ ID NO: 2639792 - RNA, 18 nt, Escherichia coli CFT073
acagaugaaugaaaacga

SEQ ID NO: 2639793 - RNA, 19 nt, Escherichia coli CFT073
acagaugaaugaaaacgaa

SEQ ID NO: 2639794 - RNA, 12 nt, Escherichia coli CFT073
acagaugcgacg

SEQ ID NO: 2639795 - RNA, 18 nt, Escherichia coli CFT073
acagaugcugcucuucac

SEQ ID NO: 2639796 - RNA, 15 nt, Escherichia coli CFT073
acagauuagcuggcc

SEQ ID NO: 2639797 - RNA, 15 nt, Escherichia coli CFT073
acagauuuauaaaau

SEQ ID NO: 2639798 - RNA, 18 nt, Escherichia coli CFT073
acagauuuauaaaaucca

SEQ ID NO: 2639799 - RNA, 17 nt, Escherichia coli CFT073
acagauuuugcaggccu

SEQ ID NO: 2639800 - RNA, 21 nt, Escherichia coli CFT073
acagauuuugcaggccugaua

SEQ ID NO: 2639801 - RNA, 12 nt, Escherichia coli CFT073
acagcaaaacac

SEQ ID NO: 2639802 - RNA, 16 nt, Escherichia coli CFT073
acagcaaaacaccccg

SEQ ID NO: 2639803 - RNA, 12 nt, Escherichia coli CFT073
acagcaccaucc

SEQ ID NO: 2639804 - RNA, 19 nt, Escherichia coli CFT073
acagcaccccauagccagc

SEQ ID NO: 2639805 - RNA, 13 nt, Escherichia coli CFT073
acagcaccgcccg

SEQ ID NO: 2639806 - RNA, 13 nt, Escherichia coli CFT073
acagcaccgugca

SEQ ID NO: 2639807 - RNA, 20 nt, Escherichia coli CFT073
acagcacggcagcaacagca

SEQ ID NO: 2639808 - RNA, 21 nt, Escherichia coli CFT073
acagcacggcagcaacagcag

SEQ ID NO: 2639809 - RNA, 22 nt, Escherichia coli CFT073
acagcagaucgaacucaaugcc

SEQ ID NO: 2639810 - RNA, 16 nt, Escherichia coli CFT073
acagcagccacaccaa

SEQ ID NO: 2639811 - RNA, 15 nt, Escherichia coli CFT073
acagcagcggcagaa

SEQ ID NO: 2639812 - RNA, 17 nt, Escherichia coli CFT073
acagcaggaaaaugaga

SEQ ID NO: 2639813 - RNA, 19 nt, Escherichia coli CFT073
acagcaggcagauccaguu

SEQ ID NO: 2639814 - RNA, 21 nt, Escherichia coli CFT073
acagcaguacgccgagaauaa

SEQ ID NO: 2639815 - RNA, 13 nt, Escherichia coli CFT073
acagcauaccuuc

SEQ ID NO: 2639816 - RNA, 22 nt, Escherichia coli CFT073
acagcauaccuucacaaaaugc

SEQ ID NO: 2639817 - RNA, 22 nt, Escherichia coli CFT073
acagcauaucgcgugcacuaca

SEQ ID NO: 2639818 - RNA, 20 nt, Escherichia coli CFT073
acagcauccgaacgcugaca

SEQ ID NO: 2639819 - RNA, 13 nt, Escherichia coli CFT073
acagcaugcguuu

SEQ ID NO: 2639820 - RNA, 17 nt, Escherichia coli CFT073
acagcauuugcugucaa

SEQ ID NO: 2639821 - RNA, 15 nt, Escherichia coli CFT073
acagccaaaucauca

SEQ ID NO: 2639822 - RNA, 17 nt, Escherichia coli CFT073
acagccaaaucaucagu

SEQ ID NO: 2639823 - RNA, 18 nt, Escherichia coli CFT073
acagccaaaucaucagua

SEQ ID NO: 2639824 - RNA, 15 nt, Escherichia coli CFT073
acagccaaucauaaa

SEQ ID NO: 2639825 - RNA, 12 nt, Escherichia coli CFT073
acagccacaucc

SEQ ID NO: 2639826 - RNA, 23 nt, Escherichia coli CFT073
acagccagcagcgaaucagccca

SEQ ID NO: 2639827 - RNA, 22 nt, Escherichia coli CFT073
acagccagccagcaccaggcuu

SEQ ID NO: 2639828 - RNA, 21 nt, Escherichia coli CFT073
acagccagccgcuaacuuccu

SEQ ID NO: 2639829 - RNA, 16 nt, Escherichia coli CFT073
acagccagcgcaggca

SEQ ID NO: 2639830 - RNA, 19 nt, Escherichia coli CFT073
acagccaggcgcugcugga

SEQ ID NO: 2639831 - RNA, 16 nt, Escherichia coli CFT073
acagccaugccgccac

SEQ ID NO: 2639832 - RNA, 22 nt, Escherichia coli CFT073
acagccaugccgccaccaccag

SEQ ID NO: 2639833 - RNA, 23 nt, Escherichia coli CFT073
acagccaugccgccaccaccagc

SEQ ID NO: 2639834 - RNA, 19 nt, Escherichia coli CFT073
acagccaugcgaaugccaa

SEQ ID NO: 2639835 - RNA, 19 nt, Escherichia coli CFT073
acagcccaugacaggcaga

SEQ ID NO: 2639836 - RNA, 14 nt, Escherichia coli CFT073
acagccccaccagc

SEQ ID NO: 2639837 - RNA, 17 nt, Escherichia coli CFT073
acagccccaguuccuua

SEQ ID NO: 2639838 - RNA, 15 nt, Escherichia coli CFT073
acagcccgccgccau

SEQ ID NO: 2639839 - RNA, 13 nt, Escherichia coli CFT073
acagcccggcaug

SEQ ID NO: 2639840 - RNA, 22 nt, Escherichia coli CFT073
acagcccuuugauuugucugcc

SEQ ID NO: 2639841 - RNA, 13 nt, Escherichia coli CFT073
acagccuaccaga

SEQ ID NO: 2639842 - RNA, 18 nt, Escherichia coli CFT073
acagccucuuccagagag

SEQ ID NO: 2639843 - RNA, 17 nt, Escherichia coli CFT073
acagccugauaacgaau

SEQ ID NO: 2639844 - RNA, 23 nt, Escherichia coli CFT073
acagccuucggacguuugccaug

SEQ ID NO: 2639845 - RNA, 18 nt, Escherichia coli CFT073
acagcgcaucucugucau

SEQ ID NO: 2639846 - RNA, 17 nt, Escherichia coli CFT073
acagcgccagacacugg

SEQ ID NO: 2639847 - RNA, 14 nt, Escherichia coli CFT073
acagcgcccaacac

SEQ ID NO: 2639848 - RNA, 23 nt, Escherichia coli CFT073
acagcgccugcacaaagcgccag

SEQ ID NO: 2639849 - RNA, 23 nt, Escherichia coli CFT073
acauacucagcgccugcugcaca

SEQ ID NO: 2639850 - RNA, 20 nt, Escherichia coli CFT073
acauacucaucuuccgggca

SEQ ID NO: 2639851 - RNA, 18 nt, Escherichia coli CFT073
acauacugagaaccuuua

SEQ ID NO: 2639852 - RNA, 17 nt, Escherichia coli CFT073
acauacugcuugccauu

SEQ ID NO: 2639853 - RNA, 22 nt, Escherichia coli CFT073
acauacuguaaauaguauuauu

SEQ ID NO: 2639854 - RNA, 15 nt, Escherichia coli CFT073
acauagacgccaccc

SEQ ID NO: 2639855 - RNA, 18 nt, Escherichia coli CFT073
acauagacgccacccgau

SEQ ID NO: 2639856 - RNA, 14 nt, Escherichia coli CFT073
acauagauaaagcc

SEQ ID NO: 2639857 - RNA, 18 nt, Escherichia coli CFT073
acauagaucuaaaugcca

SEQ ID NO: 2639858 - RNA, 16 nt, Escherichia coli CFT073
acauagcacauaaaau

SEQ ID NO: 2639859 - RNA, 13 nt, Escherichia coli CFT073
acauagccgaaaa

SEQ ID NO: 2639860 - RNA, 19 nt, Escherichia coli CFT073
acauagcgugacaccagca

SEQ ID NO: 2639861 - RNA, 16 nt, Escherichia coli CFT073
acauagcuaaaaauaa

SEQ ID NO: 2639862 - RNA, 20 nt, Escherichia coli CFT073
acauauaaccggcaacagaa

SEQ ID NO: 2639863 - RNA, 13 nt, Escherichia coli CFT073
acauauagccaaa

SEQ ID NO: 2639864 - RNA, 16 nt, Escherichia coli CFT073
acauauagccaaaacu

SEQ ID NO: 2639865 - RNA, 19 nt, Escherichia coli CFT073
acauauauuacucauuaau

SEQ ID NO: 2639866 - RNA, 18 nt, Escherichia coli CFT073
acauaucacuuuuauaua

SEQ ID NO: 2639867 - RNA, 16 nt, Escherichia coli CFT073
acauaugcacaugaug

SEQ ID NO: 2639868 - RNA, 11 nt, Escherichia coli CFT073
acauauucauu

SEQ ID NO: 2639869 - RNA, 19 nt, Escherichia coli CFT073
acauauuccgcaccugcca

SEQ ID NO: 2639870 - RNA, 22 nt, Escherichia coli CFT073
acauauuccgcaccugccagcg

SEQ ID NO: 2639871 - RNA, 22 nt, Escherichia coli CFT073
acauauucgacacauucagaau

SEQ ID NO: 2639872 - RNA, 23 nt, Escherichia coli CFT073
acauauucgacacauucagaauu

SEQ ID NO: 2639873 - RNA, 23 nt, Escherichia coli CFT073
acauauugcagcuucuucuccag

SEQ ID NO: 2639874 - RNA, 22 nt, Escherichia coli CFT073
acauauugcuccauaauugcca

SEQ ID NO: 2639875 - RNA, 22 nt, Escherichia coli CFT073
acauauuuuuguugaaauaaua

SEQ ID NO: 2639876 - RNA, 14 nt, Escherichia coli CFT073
acaucaaacuguuc

SEQ ID NO: 2639877 - RNA, 16 nt, Escherichia coli CFT073
acaucaaagaaaagca

SEQ ID NO: 2639878 - RNA, 19 nt, Escherichia coli CFT073
acaucaaaucacagcaccu

SEQ ID NO: 2639879 - RNA, 13 nt, Escherichia coli CFT073
acaucaaccagau

SEQ ID NO: 2639880 - RNA, 14 nt, Escherichia coli CFT073
acaucaacgccuga

SEQ ID NO: 2639881 - RNA, 22 nt, Escherichia coli CFT073
acaucaacgccugaugcgacgc

SEQ ID NO: 2639882 - RNA, 10 nt, Escherichia coli CFT073
acaucaauac

SEQ ID NO: 2639883 - RNA, 20 nt, Escherichia coli CFT073
acaucaauggaugcaucuuc

SEQ ID NO: 2639884 - RNA, 16 nt, Escherichia coli CFT073
acaucaauuacaccau

SEQ ID NO: 2639885 - RNA, 17 nt, Escherichia coli CFT073
acaucaccaacugcccg

SEQ ID NO: 2639886 - RNA, 21 nt, Escherichia coli CFT073
acaucaccugaauaugaccca

SEQ ID NO: 2639887 - RNA, 16 nt, Escherichia coli CFT073
acaucacgauuuuucc

SEQ ID NO: 2639888 - RNA, 13 nt, Escherichia coli CFT073
acaucacgccacu

SEQ ID NO: 2639889 - RNA, 18 nt, Escherichia coli CFT073
acaucacgccuucaauau

SEQ ID NO: 2639890 - RNA, 22 nt, Escherichia coli CFT073
acaucacgguugagagcaaaca

SEQ ID NO: 2639891 - RNA, 21 nt, Escherichia coli CFT073
acaucacguaaauguggcgga

SEQ ID NO: 2639892 - RNA, 17 nt, Escherichia coli CFT073
acaucacugcaaauacc

SEQ ID NO: 2639893 - RNA, 17 nt, Escherichia coli CFT073
acaucagaacagcccca

SEQ ID NO: 2639894 - RNA, 17 nt, Escherichia coli CFT073
acaucagaguacagauu

SEQ ID NO: 2639895 - RNA, 22 nt, Escherichia coli CFT073
acaucagauaaucgccauccug

SEQ ID NO: 2639896 - RNA, 15 nt, Escherichia coli CFT073
acaucagcgcaccau

SEQ ID NO: 2639897 - RNA, 16 nt, Escherichia coli CFT073
acaucaggcaaaguca

SEQ ID NO: 2639898 - RNA, 17 nt, Escherichia coli CFT073
acaucaggcacaucggc

SEQ ID NO: 2639899 - RNA, 23 nt, Escherichia coli CFT073
acaucaggcagaacgccaugcca

SEQ ID NO: 2639900 - RNA, 17 nt, Escherichia coli CFT073
acaucaggcccacuaca

SEQ ID NO: 2639901 - RNA, 14 nt, Escherichia coli CFT073
acaucagugauaca

SEQ ID NO: 2639902 - RNA, 16 nt, Escherichia coli CFT073
acaucagugauacauc

SEQ ID NO: 2639903 - RNA, 16 nt, Escherichia coli CFT073
acaucaucaaagccaa

SEQ ID NO: 2639904 - RNA, 15 nt, Escherichia coli CFT073
acaucaucacgcaga

SEQ ID NO: 2639905 - RNA, 14 nt, Escherichia coli CFT073
acaucauccccaca

SEQ ID NO: 2639906 - RNA, 23 nt, Escherichia coli CFT073
acaucauccccacaccugacaau

SEQ ID NO: 2639907 - RNA, 13 nt, Escherichia coli CFT073
acaucauccccau

SEQ ID NO: 2639908 - RNA, 14 nt, Escherichia coli CFT073
acaucauccccauc

SEQ ID NO: 2639909 - RNA, 19 nt, Escherichia coli CFT073
acaucauccccaucgccgc

SEQ ID NO: 2639910 - RNA, 23 nt, Escherichia coli CFT073
acaucaugauuuuaaacggcaua

SEQ ID NO: 2639911 - RNA, 14 nt, Escherichia coli CFT073
acaucauugccgcc

SEQ ID NO: 2639912 - RNA, 17 nt, Escherichia coli CFT073
acaucauuucccacgcg

SEQ ID NO: 2639913 - RNA, 20 nt, Escherichia coli CFT073
acaucauuucccacgcggca

SEQ ID NO: 2639914 - RNA, 16 nt, Escherichia coli CFT073
acauccaccagcgccu

SEQ ID NO: 2639915 - RNA, 21 nt, Escherichia coli CFT073
acauccagccgucgaagcccc

SEQ ID NO: 2639916 - RNA, 23 nt, Escherichia coli CFT073
acauccagcucgcguucugucag

SEQ ID NO: 2639917 - RNA, 17 nt, Escherichia coli CFT073
acauccaguacgccuuc

SEQ ID NO: 2639918 - RNA, 14 nt, Escherichia coli CFT073
acauccaucugcuu

SEQ ID NO: 2639919 - RNA, 20 nt, Escherichia coli CFT073
acauccaugcuuguuuauua

SEQ ID NO: 2639920 - RNA, 13 nt, Escherichia coli CFT073
acaucccagcaga

SEQ ID NO: 2639921 - RNA, 14 nt, Escherichia coli CFT073
acaucccagcagag

SEQ ID NO: 2639922 - RNA, 19 nt, Escherichia coli CFT073
acauccccauaucccggaa

SEQ ID NO: 2639923 - RNA, 21 nt, Escherichia coli CFT073
acauccccauaucccggaagg

SEQ ID NO: 2639924 - RNA, 15 nt, Escherichia coli CFT073
acaucccggcagaga

SEQ ID NO: 2639925 - RNA, 20 nt, Escherichia coli CFT073
acauccggcaauauccauua

SEQ ID NO: 2639926 - RNA, 15 nt, Escherichia coli CFT073
acauccggcaaugaa

SEQ ID NO: 2639927 - RNA, 23 nt, Escherichia coli CFT073
acauccgggcgagcuuauauacu

SEQ ID NO: 2639928 - RNA, 23 nt, Escherichia coli CFT073
acauccgguuucaucagccaauu

SEQ ID NO: 2639929 - RNA, 23 nt, Escherichia coli CFT073
acauccugaguuaaucgccgcau

SEQ ID NO: 2639930 - RNA, 15 nt, Escherichia coli CFT073
acaucgauguuugac

SEQ ID NO: 2639931 - RNA, 18 nt, Escherichia coli CFT073
acaucgauguuugacaac

SEQ ID NO: 2639932 - RNA, 13 nt, Escherichia coli CFT073
acaucgcauucgg

SEQ ID NO: 2639933 - RNA, 19 nt, Escherichia coli CFT073
acaucgccaggacgauucc

SEQ ID NO: 2639934 - RNA, 16 nt, Escherichia coli CFT073
acaucgccauaaacac

SEQ ID NO: 2639935 - RNA, 19 nt, Escherichia coli CFT073
acaucgcccgauucacaua

SEQ ID NO: 2639936 - RNA, 20 nt, Escherichia coli CFT073
acaucgcccugauggcgcgc

SEQ ID NO: 2639937 - RNA, 13 nt, Escherichia coli CFT073
acaucgcuuucca

SEQ ID NO: 2639938 - RNA, 14 nt, Escherichia coli CFT073
acaucgcuuuccag

SEQ ID NO: 2639939 - RNA, 23 nt, Escherichia coli CFT073
acaucgguauagauaaagucugc

SEQ ID NO: 2639940 - RNA, 14 nt, Escherichia coli CFT073
acaucgucaggggc

SEQ ID NO: 2639941 - RNA, 23 nt, Escherichia coli CFT073
acaucuagccugaugcgaugcug

SEQ ID NO: 2639942 - RNA, 16 nt, Escherichia coli CFT073
acaucugacaaaauca

SEQ ID NO: 2639943 - RNA, 23 nt, Escherichia coli CFT073
acaucugcaaugcgaauaucaac

SEQ ID NO: 2639944 - RNA, 17 nt, Escherichia coli CFT073
acaucugguaauugacg

SEQ ID NO: 2639945 - RNA, 23 nt, Escherichia coli CFT073
acaucugguaauugacgccauca

SEQ ID NO: 2639946 - RNA, 22 nt, Escherichia coli CFT073
acaucuggucgaggaucucugc

SEQ ID NO: 2639947 - RNA, 12 nt, Escherichia coli CFT073
acaucuguaucg

SEQ ID NO: 2639948 - RNA, 19 nt, Escherichia coli CFT073
acaucugucugauaaaaaa

SEQ ID NO: 2639949 - RNA, 17 nt, Escherichia coli CFT073
acaucuuaauagcugcc

SEQ ID NO: 2639950 - RNA, 13 nt, Escherichia coli CFT073
acaugaacaucaa

SEQ ID NO: 2639951 - RNA, 19 nt, Escherichia coli CFT073
acaugacaccaagcaccau

SEQ ID NO: 2639952 - RNA, 19 nt, Escherichia coli CFT073
acaugagaacaguucagca

SEQ ID NO: 2639953 - RNA, 16 nt, Escherichia coli CFT073
acaugagauccagcga

SEQ ID NO: 2639954 - RNA, 17 nt, Escherichia coli CFT073
acaugaugauggcuauc

SEQ ID NO: 2639955 - RNA, 15 nt, Escherichia coli CFT073
acaugauguggaucg

SEQ ID NO: 2639956 - RNA, 22 nt, Escherichia coli CFT073
acaugcacgcccgcagcggaau

SEQ ID NO: 2639957 - RNA, 20 nt, Escherichia coli CFT073
accaagcccgaugaucauca

SEQ ID NO: 2639958 - RNA, 21 nt, Escherichia coli CFT073
accaagcccgaugaucaucau

SEQ ID NO: 2639959 - RNA, 22 nt, Escherichia coli CFT073
accaagcccgaugaucaucauc

SEQ ID NO: 2639960 - RNA, 15 nt, Escherichia coli CFT073
accaagccugcuggc

SEQ ID NO: 2639961 - RNA, 18 nt, Escherichia coli CFT073
accaaggaagcuuucgca

SEQ ID NO: 2639962 - RNA, 16 nt, Escherichia coli CFT073
accaagucucaagagu

SEQ ID NO: 2639963 - RNA, 15 nt, Escherichia coli CFT073
accaaguucuucacu

SEQ ID NO: 2639964 - RNA, 15 nt, Escherichia coli CFT073
accaauaaacgccag

SEQ ID NO: 2639965 - RNA, 16 nt, Escherichia coli CFT073
accaauaaguaagcau

SEQ ID NO: 2639966 - RNA, 15 nt, Escherichia coli CFT073
accaauaccagcauc

SEQ ID NO: 2639967 - RNA, 22 nt, Escherichia coli CFT073
accaauaccgcccacuaccagc

SEQ ID NO: 2639968 - RNA, 20 nt, Escherichia coli CFT073
accaaucaauucucgccagu

SEQ ID NO: 2639969 - RNA, 12 nt, Escherichia coli CFT073
accaaucaccac

SEQ ID NO: 2639970 - RNA, 20 nt, Escherichia coli CFT073
accaaucagguaagcgaagg

SEQ ID NO: 2639971 - RNA, 19 nt, Escherichia coli CFT073
accaaucaucgacauugac

SEQ ID NO: 2639972 - RNA, 14 nt, Escherichia coli CFT073
accaauccagccgg

SEQ ID NO: 2639973 - RNA, 16 nt, Escherichia coli CFT073
accaauccgccagcca

SEQ ID NO: 2639974 - RNA, 16 nt, Escherichia coli CFT073
accaaucgcgggcaac

SEQ ID NO: 2639975 - RNA, 18 nt, Escherichia coli CFT073
accaaucgcgggcaacgu

SEQ ID NO: 2639976 - RNA, 17 nt, Escherichia coli CFT073
accaaucguccuccgaa

SEQ ID NO: 2639977 - RNA, 18 nt, Escherichia coli CFT073
accaaucugaaaccagcg

SEQ ID NO: 2639978 - RNA, 19 nt, Escherichia coli CFT073
accaaucugaaaccagcgu

SEQ ID NO: 2639979 - RNA, 22 nt, Escherichia coli CFT073
accaaucugcucuggcagcacc

SEQ ID NO: 2639980 - RNA, 23 nt, Escherichia coli CFT073
accaaucugcucuggcagcacca

SEQ ID NO: 2639981 - RNA, 18 nt, Escherichia coli CFT073
accaaucuucaacacuuc

SEQ ID NO: 2639982 - RNA, 18 nt, Escherichia coli CFT073
accaaugacagccccacc

SEQ ID NO: 2639983 - RNA, 19 nt, Escherichia coli CFT073
accaaugauaaguuucacu

SEQ ID NO: 2639984 - RNA, 19 nt, Escherichia coli CFT073
accaaugccgccagggaua

SEQ ID NO: 2639985 - RNA, 15 nt, Escherichia coli CFT073
accaauggccaaugc

SEQ ID NO: 2639986 - RNA, 13 nt, Escherichia coli CFT073
accaauggcuuuu

SEQ ID NO: 2639987 - RNA, 16 nt, Escherichia coli CFT073
accaauguggaaagcc

SEQ ID NO: 2639988 - RNA, 23 nt, Escherichia coli CFT073
accaauguggaaagccccagccc

SEQ ID NO: 2639989 - RNA, 22 nt, Escherichia coli CFT073
accaauguuacgaccuuccuga

SEQ ID NO: 2639990 - RNA, 20 nt, Escherichia coli CFT073
accaauguucaguuugccca

SEQ ID NO: 2639991 - RNA, 19 nt, Escherichia coli CFT073
accaauguugucgcagacg

SEQ ID NO: 2639992 - RNA, 21 nt, Escherichia coli CFT073
accaauucaaugccccacaga

SEQ ID NO: 2639993 - RNA, 18 nt, Escherichia coli CFT073
accaauugccgcaccaac

SEQ ID NO: 2639994 - RNA, 13 nt, Escherichia coli CFT073
accaauuuauuuu

SEQ ID NO: 2639995 - RNA, 12 nt, Escherichia coli CFT073
accaauuuuaaa

SEQ ID NO: 2639996 - RNA, 12 nt, Escherichia coli CFT073
accacaaaagcg

SEQ ID NO: 2639997 - RNA, 14 nt, Escherichia coli CFT073
accacaaaagcggu

SEQ ID NO: 2639998 - RNA, 14 nt, Escherichia coli CFT073
accacaaaccagcc

SEQ ID NO: 2639999 - RNA, 15 nt, Escherichia coli CFT073
accacaaaggcgcga

SEQ ID NO: 2640000 - RNA, 17 nt, Escherichia coli CFT073
accacaaauaccccacc

SEQ ID NO: 2640001 - RNA, 22 nt, Escherichia coli CFT073
accacaaauaccccaccgccga

SEQ ID NO: 2640002 - RNA, 21 nt, Escherichia coli CFT073
accacaacccagacaaauaac

SEQ ID NO: 2640003 - RNA, 14 nt, Escherichia coli CFT073
accacaaccucagc

SEQ ID NO: 2640004 - RNA, 18 nt, Escherichia coli CFT073
accacaaccucagcaguu

SEQ ID NO: 2640005 - RNA, 15 nt, Escherichia coli CFT073
accacaccagaccag

SEQ ID NO: 2640006 - RNA, 16 nt, Escherichia coli CFT073
accacaccagaccaga

SEQ ID NO: 2640007 - RNA, 16 nt, Escherichia coli CFT073
accacaccugccacca

SEQ ID NO: 2640008 - RNA, 21 nt, Escherichia coli CFT073
accacacgacgcgccagcagc

SEQ ID NO: 2640009 - RNA, 14 nt, Escherichia coli CFT073
accacacucaauga

SEQ ID NO: 2640010 - RNA, 18 nt, Escherichia coli CFT073
accacagugacccgcagc

SEQ ID NO: 2640011 - RNA, 21 nt, Escherichia coli CFT073
accacagugacccgcagccag

SEQ ID NO: 2640012 - RNA, 14 nt, Escherichia coli CFT073
accacauacauaau

SEQ ID NO: 2640013 - RNA, 17 nt, Escherichia coli CFT073
accacauacauaauaau

SEQ ID NO: 2640014 - RNA, 18 nt, Escherichia coli CFT073
accacauacugcuugcca

SEQ ID NO: 2640015 - RNA, 19 nt, Escherichia coli CFT073
accacauggagcuuuaaac

SEQ ID NO: 2640016 - RNA, 22 nt, Escherichia coli CFT073
accacauggagcuuuaaacacg

SEQ ID NO: 2640017 - RNA, 15 nt, Escherichia coli CFT073
accacauucagcagc

SEQ ID NO: 2640018 - RNA, 18 nt, Escherichia coli CFT073
accacauucugcauugcg

SEQ ID NO: 2640019 - RNA, 23 nt, Escherichia coli CFT073
accaccaaauaaaaaaacgccag

SEQ ID NO: 2640020 - RNA, 16 nt, Escherichia coli CFT073
accaccacgaccacga

SEQ ID NO: 2640021 - RNA, 18 nt, Escherichia coli CFT073
accaccacugaccaccaa

SEQ ID NO: 2640022 - RNA, 20 nt, Escherichia coli CFT073
accaccagacgcaacagaaa

SEQ ID NO: 2640023 - RNA, 12 nt, Escherichia coli CFT073
accaccagcagc

SEQ ID NO: 2640024 - RNA, 21 nt, Escherichia coli CFT073
accaccagcgacagccagccc

SEQ ID NO: 2640025 - RNA, 13 nt, Escherichia coli CFT073
accaccagcgcac

SEQ ID NO: 2640026 - RNA, 18 nt, Escherichia coli CFT073
accaccagcggaauauca

SEQ ID NO: 2640027 - RNA, 17 nt, Escherichia coli CFT073
accaccaucaaaugcgc

SEQ ID NO: 2640028 - RNA, 20 nt, Escherichia coli CFT073
accaccaugcuaauagcugc

SEQ ID NO: 2640029 - RNA, 13 nt, Escherichia coli CFT073
accacccagaaca

SEQ ID NO: 2640030 - RNA, 13 nt, Escherichia coli CFT073
accacccauggaa

SEQ ID NO: 2640031 - RNA, 23 nt, Escherichia coli CFT073
accacccgcggcgaucugcaccu

SEQ ID NO: 2640032 - RNA, 14 nt, Escherichia coli CFT073
accacccugcccgu

SEQ ID NO: 2640033 - RNA, 20 nt, Escherichia coli CFT073
accacccuugcccaccagcc

SEQ ID NO: 2640034 - RNA, 18 nt, Escherichia coli CFT073
accaccgaagaucaccac

SEQ ID NO: 2640035 - RNA, 16 nt, Escherichia coli CFT073
accaccgacgggccug

SEQ ID NO: 2640036 - RNA, 23 nt, Escherichia coli CFT073
accaccgaguaauaacaguaaug

SEQ ID NO: 2640037 - RNA, 17 nt, Escherichia coli CFT073
accaccgauaaaauaau

SEQ ID NO: 2640038 - RNA, 18 nt, Escherichia coli CFT073
accaccgauaaaauaauc

SEQ ID NO: 2640039 - RNA, 21 nt, Escherichia coli CFT073
accaccgauaaaauaaucacc

SEQ ID NO: 2640040 - RNA, 20 nt, Escherichia coli CFT073
accaccgcaucggcaucaaa

SEQ ID NO: 2640041 - RNA, 20 nt, Escherichia coli CFT073
accaccgccagauugcugcu

SEQ ID NO: 2640042 - RNA, 20 nt, Escherichia coli CFT073
accaccgcuaacugcugcgg

SEQ ID NO: 2640043 - RNA, 16 nt, Escherichia coli CFT073
accaccgucaauaaaa

SEQ ID NO: 2640044 - RNA, 16 nt, Escherichia coli CFT073
accaccucacccgccg

SEQ ID NO: 2640045 - RNA, 14 nt, Escherichia coli CFT073
accaccucuuccag

SEQ ID NO: 2640046 - RNA, 19 nt, Escherichia coli CFT073
accaccugauugcugcugc

SEQ ID NO: 2640047 - RNA, 23 nt, Escherichia coli CFT073
accaccuuacuuacacaucauga

SEQ ID NO: 2640048 - RNA, 17 nt, Escherichia coli CFT073
accacgagcggcguucc

SEQ ID NO: 2640049 - RNA, 14 nt, Escherichia coli CFT073
accacgauauccgc

SEQ ID NO: 2640050 - RNA, 14 nt, Escherichia coli CFT073
accacgauauguuc

SEQ ID NO: 2640051 - RNA, 13 nt, Escherichia coli CFT073
accacgcacagcc

SEQ ID NO: 2640052 - RNA, 15 nt, Escherichia coli CFT073
accacgcacagcccg

SEQ ID NO: 2640053 - RNA, 17 nt, Escherichia coli CFT073
accacgcaggcguaaau

SEQ ID NO: 2640054 - RNA, 17 nt, Escherichia coli CFT073
accacgccaagaaacac

SEQ ID NO: 2640055 - RNA, 13 nt, Escherichia coli CFT073
accacgccagccg

SEQ ID NO: 2640056 - RNA, 17 nt, Escherichia coli CFT073
accacgccagccgccag

SEQ ID NO: 2640057 - RNA, 18 nt, Escherichia coli CFT073
accacgccagccgccagc

SEQ ID NO: 2640058 - RNA, 12 nt, Escherichia coli CFT073
accacgccagug

SEQ ID NO: 2640059 - RNA, 16 nt, Escherichia coli CFT073
accacgccgauaauca

SEQ ID NO: 2640060 - RNA, 16 nt, Escherichia coli CFT073
accacgcgguagcgcg

SEQ ID NO: 2640061 - RNA, 17 nt, Escherichia coli CFT073
accacgcucagcaaucg

SEQ ID NO: 2640062 - RNA, 19 nt, Escherichia coli CFT073
accacgcugcgcugcacca

SEQ ID NO: 2640063 - RNA, 22 nt, Escherichia coli CFT073
accacgcugcgcugcaccagua

SEQ ID NO: 2640064 - RNA, 20 nt, Escherichia coli CFT073
accacggaguugaccagcuc

SEQ ID NO: 2640065 - RNA, 14 nt, Escherichia coli CFT073
accagcggcaacau

SEQ ID NO: 2640066 - RNA, 21 nt, Escherichia coli CFT073
accagcggcaacaucaucacg

SEQ ID NO: 2640067 - RNA, 22 nt, Escherichia coli CFT073
accagcggcaacaucaucacgc

SEQ ID NO: 2640068 - RNA, 13 nt, Escherichia coli CFT073
accagcggcaccu

SEQ ID NO: 2640069 - RNA, 19 nt, Escherichia coli CFT073
accagcggcgcauccgcca

SEQ ID NO: 2640070 - RNA, 13 nt, Escherichia coli CFT073
accagcggcugaa

SEQ ID NO: 2640071 - RNA, 16 nt, Escherichia coli CFT073
accagcggcuuccagc

SEQ ID NO: 2640072 - RNA, 21 nt, Escherichia coli CFT073
accagcgucaucaauccugca

SEQ ID NO: 2640073 - RNA, 17 nt, Escherichia coli CFT073
accagcgucgcaucagg

SEQ ID NO: 2640074 - RNA, 13 nt, Escherichia coli CFT073
accagcguuucca

SEQ ID NO: 2640075 - RNA, 18 nt, Escherichia coli CFT073
accagcguuuccagcacc

SEQ ID NO: 2640076 - RNA, 17 nt, Escherichia coli CFT073
accagcuaagcgcgcgg

SEQ ID NO: 2640077 - RNA, 13 nt, Escherichia coli CFT073
accagcuaccacg

SEQ ID NO: 2640078 - RNA, 15 nt, Escherichia coli CFT073
accagcuaccacgcc

SEQ ID NO: 2640079 - RNA, 14 nt, Escherichia coli CFT073
accagcuccagcag

SEQ ID NO: 2640080 - RNA, 16 nt, Escherichia coli CFT073
accagcuccggcacuu

SEQ ID NO: 2640081 - RNA, 13 nt, Escherichia coli CFT073
accagcugaaauc

SEQ ID NO: 2640082 - RNA, 21 nt, Escherichia coli CFT073
accagcugaaaucaccgccac

SEQ ID NO: 2640083 - RNA, 11 nt, Escherichia coli CFT073
accagcugccg

SEQ ID NO: 2640084 - RNA, 19 nt, Escherichia coli CFT073
accagcuuguuguccgguc

SEQ ID NO: 2640085 - RNA, 14 nt, Escherichia coli CFT073
accaggaaacccaa

SEQ ID NO: 2640086 - RNA, 14 nt, Escherichia coli CFT073
accaggaacgccau

SEQ ID NO: 2640087 - RNA, 16 nt, Escherichia coli CFT073
accaggaacgcgccaa

SEQ ID NO: 2640088 - RNA, 17 nt, Escherichia coli CFT073
accaggaucagcaaaau

SEQ ID NO: 2640089 - RNA, 23 nt, Escherichia coli CFT073
accaggcaauuggcacaucuagc

SEQ ID NO: 2640090 - RNA, 21 nt, Escherichia coli CFT073
accaggcaguuuauccagcca

SEQ ID NO: 2640091 - RNA, 14 nt, Escherichia coli CFT073
accaggccagcgca

SEQ ID NO: 2640092 - RNA, 14 nt, Escherichia coli CFT073
accaggcgaccguu

SEQ ID NO: 2640093 - RNA, 18 nt, Escherichia coli CFT073
accaggcgaccguuuuca

SEQ ID NO: 2640094 - RNA, 15 nt, Escherichia coli CFT073
accagggauaaagcu

SEQ ID NO: 2640095 - RNA, 19 nt, Escherichia coli CFT073
accagggugcguugaagau

SEQ ID NO: 2640096 - RNA, 19 nt, Escherichia coli CFT073
accaggguggcaaaugcau

SEQ ID NO: 2640097 - RNA, 16 nt, Escherichia coli CFT073
accagguaaagaccau

SEQ ID NO: 2640098 - RNA, 21 nt, Escherichia coli CFT073
accagguaucguuacgccagu

SEQ ID NO: 2640099 - RNA, 14 nt, Escherichia coli CFT073
accaggucaaugca

SEQ ID NO: 2640100 - RNA, 14 nt, Escherichia coli CFT073
accaggucgccagu

SEQ ID NO: 2640101 - RNA, 15 nt, Escherichia coli CFT073
accagguucaacagc

SEQ ID NO: 2640102 - RNA, 16 nt, Escherichia coli CFT073
accagguuguaucacc

SEQ ID NO: 2640103 - RNA, 12 nt, Escherichia coli CFT073
accagguuuuug

SEQ ID NO: 2640104 - RNA, 13 nt, Escherichia coli CFT073
accaguaaccaga

SEQ ID NO: 2640105 - RNA, 16 nt, Escherichia coli CFT073
accaguaacuuccccu

SEQ ID NO: 2640106 - RNA, 15 nt, Escherichia coli CFT073
accaguaaggcaucu

SEQ ID NO: 2640107 - RNA, 14 nt, Escherichia coli CFT073
accaguaauauccc

SEQ ID NO: 2640108 - RNA, 16 nt, Escherichia coli CFT073
accaguacaccaauug

SEQ ID NO: 2640109 - RNA, 17 nt, Escherichia coli CFT073
accaguacaccaauugu

SEQ ID NO: 2640110 - RNA, 17 nt, Escherichia coli CFT073
accaguaccauuuucgc

SEQ ID NO: 2640111 - RNA, 14 nt, Escherichia coli CFT073
accaguaccgccac

SEQ ID NO: 2640112 - RNA, 16 nt, Escherichia coli CFT073
accaguaccgccacca

SEQ ID NO: 2640113 - RNA, 14 nt, Escherichia coli CFT073
accaguaccgccgc

SEQ ID NO: 2640114 - RNA, 20 nt, Escherichia coli CFT073
accaguagugaaaaaagcaa

SEQ ID NO: 2640115 - RNA, 18 nt, Escherichia coli CFT073
accagucaaaacuuuuca

SEQ ID NO: 2640116 - RNA, 21 nt, Escherichia coli CFT073
accagucaaaacuuuucacca

SEQ ID NO: 2640117 - RNA, 18 nt, Escherichia coli CFT073
accagucacuaaauucag

SEQ ID NO: 2640118 - RNA, 18 nt, Escherichia coli CFT073
accagucccugaaugucu

SEQ ID NO: 2640119 - RNA, 14 nt, Escherichia coli CFT073
accagugaggaugc

SEQ ID NO: 2640120 - RNA, 12 nt, Escherichia coli CFT073
accagugcaaca

SEQ ID NO: 2640121 - RNA, 18 nt, Escherichia coli CFT073
accagugcagacucaccu

SEQ ID NO: 2640122 - RNA, 23 nt, Escherichia coli CFT073
accagugcagaugcacaagcggc

SEQ ID NO: 2640123 - RNA, 20 nt, Escherichia coli CFT073
accagugcaggcaccagccc

SEQ ID NO: 2640124 - RNA, 13 nt, Escherichia coli CFT073
accagugccagaa

SEQ ID NO: 2640125 - RNA, 15 nt, Escherichia coli CFT073
accagugccagaaca

SEQ ID NO: 2640126 - RNA, 17 nt, Escherichia coli CFT073
accagugccagaacaga

SEQ ID NO: 2640127 - RNA, 20 nt, Escherichia coli CFT073
accagugccagaacagaaau

SEQ ID NO: 2640128 - RNA, 14 nt, Escherichia coli CFT073
accagugcccgacc

SEQ ID NO: 2640129 - RNA, 16 nt, Escherichia coli CFT073
accaguucaccaccug

SEQ ID NO: 2640130 - RNA, 15 nt, Escherichia coli CFT073
accaguucagugacc

SEQ ID NO: 2640131 - RNA, 15 nt, Escherichia coli CFT073
accaguugaugaugu

SEQ ID NO: 2640132 - RNA, 21 nt, Escherichia coli CFT073
accaguugguagguccagccg

SEQ ID NO: 2640133 - RNA, 15 nt, Escherichia coli CFT073
accaguugugaugcc

SEQ ID NO: 2640134 - RNA, 17 nt, Escherichia coli CFT073
accaguugugaugccac

SEQ ID NO: 2640135 - RNA, 20 nt, Escherichia coli CFT073
accaguugugaugccacuuc

SEQ ID NO: 2640136 - RNA, 16 nt, Escherichia coli CFT073
accaguuuccagucac

SEQ ID NO: 2640137 - RNA, 20 nt, Escherichia coli CFT073
accaguuuuugcgcccauga

SEQ ID NO: 2640138 - RNA, 14 nt, Escherichia coli CFT073
accauaaaucagau

SEQ ID NO: 2640139 - RNA, 20 nt, Escherichia coli CFT073
accauaacccgcuuccagaa

SEQ ID NO: 2640140 - RNA, 17 nt, Escherichia coli CFT073
accauaacuagcaacaa

SEQ ID NO: 2640141 - RNA, 15 nt, Escherichia coli CFT073
accauaauccggguu

SEQ ID NO: 2640142 - RNA, 22 nt, Escherichia coli CFT073
accauaaugaugccgaagugaa

SEQ ID NO: 2640143 - RNA, 17 nt, Escherichia coli CFT073
accauaauuugugauuu

SEQ ID NO: 2640144 - RNA, 23 nt, Escherichia coli CFT073
accauaguauuuauccauaauuu

SEQ ID NO: 2640145 - RNA, 22 nt, Escherichia coli CFT073
accauaguccggcaccagcgcu

SEQ ID NO: 2640146 - RNA, 16 nt, Escherichia coli CFT073
accauauagcgcacau

SEQ ID NO: 2640147 - RNA, 22 nt, Escherichia coli CFT073
accauauaucagcgccacauca

SEQ ID NO: 2640148 - RNA, 23 nt, Escherichia coli CFT073
accauauuaaauggcccgcgcag

SEQ ID NO: 2640149 - RNA, 11 nt, Escherichia coli CFT073
accauauuaac

SEQ ID NO: 2640150 - RNA, 15 nt, Escherichia coli CFT073
accauauucagcagc

SEQ ID NO: 2640151 - RNA, 11 nt, Escherichia coli CFT073
accauauuuau

SEQ ID NO: 2640152 - RNA, 18 nt, Escherichia coli CFT073
accaucaacaaacgccag

SEQ ID NO: 2640153 - RNA, 14 nt, Escherichia coli CFT073
accaucaaccuuca

SEQ ID NO: 2640154 - RNA, 21 nt, Escherichia coli CFT073
accaucaaguagcagguaauc

SEQ ID NO: 2640155 - RNA, 22 nt, Escherichia coli CFT073
accaucaaguagcagguaaucu

SEQ ID NO: 2640156 - RNA, 11 nt, Escherichia coli CFT073
accaucaaucc

SEQ ID NO: 2640157 - RNA, 22 nt, Escherichia coli CFT073
accaucacuccccuccugcaag

SEQ ID NO: 2640158 - RNA, 17 nt, Escherichia coli CFT073
accaucagaccagacuu

SEQ ID NO: 2640159 - RNA, 13 nt, Escherichia coli CFT073
accaucagcagcg

SEQ ID NO: 2640160 - RNA, 23 nt, Escherichia coli CFT073
accaucagcucuguagcaacgau

SEQ ID NO: 2640161 - RNA, 23 nt, Escherichia coli CFT073
accaucaggcagucugcgcccug

SEQ ID NO: 2640162 - RNA, 22 nt, Escherichia coli CFT073
accaucagguauuuauggauga

SEQ ID NO: 2640163 - RNA, 20 nt, Escherichia coli CFT073
accaucaguacccaaucagc

SEQ ID NO: 2640164 - RNA, 19 nt, Escherichia coli CFT073
accaucaguggcagagaag

SEQ ID NO: 2640165 - RNA, 19 nt, Escherichia coli CFT073
accauccagcaacaacagc

SEQ ID NO: 2640166 - RNA, 15 nt, Escherichia coli CFT073
accauccagcagacg

SEQ ID NO: 2640167 - RNA, 21 nt, Escherichia coli CFT073
accaucccgccgaccaacgca

SEQ ID NO: 2640168 - RNA, 15 nt, Escherichia coli CFT073
accaucgaaauuagc

SEQ ID NO: 2640169 - RNA, 14 nt, Escherichia coli CFT073
accaucgacaccau

SEQ ID NO: 2640170 - RNA, 18 nt, Escherichia coli CFT073
accaucgcccacaccacg

SEQ ID NO: 2640171 - RNA, 22 nt, Escherichia coli CFT073
accaucgcccacaccacgccac

SEQ ID NO: 2640172 - RNA, 23 nt, Escherichia coli CFT073
accaucgcccacaccacgccacu

SEQ ID NO: 2640173 - RNA, 21 nt, Escherichia coli CFT073
accaucgcuacauaacgcagc

SEQ ID NO: 2640174 - RNA, 23 nt, Escherichia coli CFT073
accgauuaauuccccugccagaa

SEQ ID NO: 2640175 - RNA, 19 nt, Escherichia coli CFT073
accgauucccccggugccu

SEQ ID NO: 2640176 - RNA, 18 nt, Escherichia coli CFT073
accgcaaaaccaacgccu

SEQ ID NO: 2640177 - RNA, 19 nt, Escherichia coli CFT073
accgcaaacucaucgccgc

SEQ ID NO: 2640178 - RNA, 23 nt, Escherichia coli CFT073
accgcaaagaaacgcgcggcaau

SEQ ID NO: 2640179 - RNA, 21 nt, Escherichia coli CFT073
accgcaaagguugcagcuccc

SEQ ID NO: 2640180 - RNA, 19 nt, Escherichia coli CFT073
accgcaaagucggcaccag

SEQ ID NO: 2640181 - RNA, 20 nt, Escherichia coli CFT073
accgcaaccgccaacagcag

SEQ ID NO: 2640182 - RNA, 14 nt, Escherichia coli CFT073
accgcaacgacuac

SEQ ID NO: 2640183 - RNA, 19 nt, Escherichia coli CFT073
accgcaagaauucaauaua

SEQ ID NO: 2640184 - RNA, 13 nt, Escherichia coli CFT073
accgcaaugaucu

SEQ ID NO: 2640185 - RNA, 18 nt, Escherichia coli CFT073
accgcacaccgagauaau

SEQ ID NO: 2640186 - RNA, 15 nt, Escherichia coli CFT073
accgcaccaaaucca

SEQ ID NO: 2640187 - RNA, 23 nt, Escherichia coli CFT073
accgcaccuucgaaugccgcagc

SEQ ID NO: 2640188 - RNA, 17 nt, Escherichia coli CFT073
accgcacucagccagcc

SEQ ID NO: 2640189 - RNA, 16 nt, Escherichia coli CFT073
accgcacugguggcag

SEQ ID NO: 2640190 - RNA, 20 nt, Escherichia coli CFT073
accgcagaagcgauaaccuu

SEQ ID NO: 2640191 - RNA, 16 nt, Escherichia coli CFT073
accgcagauaagacca

SEQ ID NO: 2640192 - RNA, 16 nt, Escherichia coli CFT073
accgcagccgccacaa

SEQ ID NO: 2640193 - RNA, 20 nt, Escherichia coli CFT073
accgcaggcaguggaauauc

SEQ ID NO: 2640194 - RNA, 14 nt, Escherichia coli CFT073
accgcaggcggccg

SEQ ID NO: 2640195 - RNA, 16 nt, Escherichia coli CFT073
accgcaggcugauaac

SEQ ID NO: 2640196 - RNA, 22 nt, Escherichia coli CFT073
accgcaucaaagaacucacgcg

SEQ ID NO: 2640197 - RNA, 13 nt, Escherichia coli CFT073
accgcaucaauua

SEQ ID NO: 2640198 - RNA, 16 nt, Escherichia coli CFT073
accgcaucauguaaau

SEQ ID NO: 2640199 - RNA, 17 nt, Escherichia coli CFT073
accgcauccggcaucag

SEQ ID NO: 2640200 - RNA, 18 nt, Escherichia coli CFT073
accgcauccggcaucagu

SEQ ID NO: 2640201 - RNA, 13 nt, Escherichia coli CFT073
accgcaucggcau

SEQ ID NO: 2640202 - RNA, 17 nt, Escherichia coli CFT073
accgcaucggcaucaaa

SEQ ID NO: 2640203 - RNA, 16 nt, Escherichia coli CFT073
accgcaugcagcaugg

SEQ ID NO: 2640204 - RNA, 13 nt, Escherichia coli CFT073
accgccaacaagg

SEQ ID NO: 2640205 - RNA, 18 nt, Escherichia coli CFT073
accgccaauuaccacuga

SEQ ID NO: 2640206 - RNA, 14 nt, Escherichia coli CFT073
accgccaccaggaa

SEQ ID NO: 2640207 - RNA, 19 nt, Escherichia coli CFT073
accgccaccuccgcuaaau

SEQ ID NO: 2640208 - RNA, 17 nt, Escherichia coli CFT073
accgccacuaccaucag

SEQ ID NO: 2640209 - RNA, 23 nt, Escherichia coli CFT073
accgccagaagaaccgccaccuc

SEQ ID NO: 2640210 - RNA, 23 nt, Escherichia coli CFT073
accgccagcacagccagccucca

SEQ ID NO: 2640211 - RNA, 14 nt, Escherichia coli CFT073
accgccagcagcag

SEQ ID NO: 2640212 - RNA, 15 nt, Escherichia coli CFT073
accgccagcaggaac

SEQ ID NO: 2640213 - RNA, 15 nt, Escherichia coli CFT073
accgccagucacugc

SEQ ID NO: 2640214 - RNA, 19 nt, Escherichia coli CFT073
accgccauuaaacgcagua

SEQ ID NO: 2640215 - RNA, 15 nt, Escherichia coli CFT073
accgccauuugcauc

SEQ ID NO: 2640216 - RNA, 16 nt, Escherichia coli CFT073
accgcccaccauaauc

SEQ ID NO: 2640217 - RNA, 18 nt, Escherichia coli CFT073
accgcccagaccugcguu

SEQ ID NO: 2640218 - RNA, 17 nt, Escherichia coli CFT073
accgcccugagcaucaa

SEQ ID NO: 2640219 - RNA, 13 nt, Escherichia coli CFT073
accgccgaagaca

SEQ ID NO: 2640220 - RNA, 20 nt, Escherichia coli CFT073
accgccgaagacaaacaugc

SEQ ID NO: 2640221 - RNA, 21 nt, Escherichia coli CFT073
accgccgaagacaaacaugcu

SEQ ID NO: 2640222 - RNA, 16 nt, Escherichia coli CFT073
accgccgccaaacugu

SEQ ID NO: 2640223 - RNA, 16 nt, Escherichia coli CFT073
accgccgccacuucug

SEQ ID NO: 2640224 - RNA, 15 nt, Escherichia coli CFT073
accgccgcucaccug

SEQ ID NO: 2640225 - RNA, 21 nt, Escherichia coli CFT073
accgccgcucucuucguggcc

SEQ ID NO: 2640226 - RNA, 18 nt, Escherichia coli CFT073
accgccggcuucaucuuu

SEQ ID NO: 2640227 - RNA, 17 nt, Escherichia coli CFT073
accgccguugauuucac

SEQ ID NO: 2640228 - RNA, 19 nt, Escherichia coli CFT073
accgccguugauuucacag

SEQ ID NO: 2640229 - RNA, 16 nt, Escherichia coli CFT073
accgccguugccuuua

SEQ ID NO: 2640230 - RNA, 23 nt, Escherichia coli CFT073
accgccguugccuuuaccgccac

SEQ ID NO: 2640231 - RNA, 16 nt, Escherichia coli CFT073
accgccugaagaacca

SEQ ID NO: 2640232 - RNA, 16 nt, Escherichia coli CFT073
accgccugcaaauaaa

SEQ ID NO: 2640233 - RNA, 18 nt, Escherichia coli CFT073
accgccugccuucccuuc

SEQ ID NO: 2640234 - RNA, 14 nt, Escherichia coli CFT073
accgccugcggaga

SEQ ID NO: 2640235 - RNA, 19 nt, Escherichia coli CFT073
accgccugcggagaucacc

SEQ ID NO: 2640236 - RNA, 22 nt, Escherichia coli CFT073
accgccugcggagaucaccaca

SEQ ID NO: 2640237 - RNA, 17 nt, Escherichia coli CFT073
accgccuguaaacggau

SEQ ID NO: 2640238 - RNA, 16 nt, Escherichia coli CFT073
accgccuuaccaaacu

SEQ ID NO: 2640239 - RNA, 18 nt, Escherichia coli CFT073
accgcgacaauaucauca

SEQ ID NO: 2640240 - RNA, 15 nt, Escherichia coli CFT073
accgcgagauaucca

SEQ ID NO: 2640241 - RNA, 22 nt, Escherichia coli CFT073
accgcgagauauccacauuaac

SEQ ID NO: 2640242 - RNA, 14 nt, Escherichia coli CFT073
accgcgagcaaaau

SEQ ID NO: 2640243 - RNA, 18 nt, Escherichia coli CFT073
accgcgauauuggucugc

SEQ ID NO: 2640244 - RNA, 14 nt, Escherichia coli CFT073
accgcgccaagccu

SEQ ID NO: 2640245 - RNA, 15 nt, Escherichia coli CFT073
accgcggaacgcacu

SEQ ID NO: 2640246 - RNA, 18 nt, Escherichia coli CFT073
accgcgggcaaucgccag

SEQ ID NO: 2640247 - RNA, 22 nt, Escherichia coli CFT073
accgcguaugcccagcgcagaa

SEQ ID NO: 2640248 - RNA, 17 nt, Escherichia coli CFT073
accgcgugaugcggcau

SEQ ID NO: 2640249 - RNA, 18 nt, Escherichia coli CFT073
accgcguuggcgcagcaa

SEQ ID NO: 2640250 - RNA, 20 nt, Escherichia coli CFT073
accgcguuuuuuaacagucc

SEQ ID NO: 2640251 - RNA, 15 nt, Escherichia coli CFT073
accgcuaccgcccug

SEQ ID NO: 2640252 - RNA, 16 nt, Escherichia coli CFT073
accgcuaccgcccuga

SEQ ID NO: 2640253 - RNA, 10 nt, Escherichia coli CFT073
accgcuacgu

SEQ ID NO: 2640254 - RNA, 14 nt, Escherichia coli CFT073
accgcuacuggcaa

SEQ ID NO: 2640255 - RNA, 20 nt, Escherichia coli CFT073
accgcucugcaucccggcag

SEQ ID NO: 2640256 - RNA, 21 nt, Escherichia coli CFT073
accgcucugcaucccggcagg

SEQ ID NO: 2640257 - RNA, 21 nt, Escherichia coli CFT073
accgcucuucauacguggcag

SEQ ID NO: 2640258 - RNA, 11 nt, Escherichia coli CFT073
accgcugaccg

SEQ ID NO: 2640259 - RNA, 14 nt, Escherichia coli CFT073
accgcugauugcug

SEQ ID NO: 2640260 - RNA, 17 nt, Escherichia coli CFT073
accgcugauugcuggcg

SEQ ID NO: 2640261 - RNA, 14 nt, Escherichia coli CFT073
accgcugccaggca

SEQ ID NO: 2640262 - RNA, 15 nt, Escherichia coli CFT073
accgcugccaggcac

SEQ ID NO: 2640263 - RNA, 23 nt, Escherichia coli CFT073
accgcugcugccguuccuggcac

SEQ ID NO: 2640264 - RNA, 18 nt, Escherichia coli CFT073
accgcuggccaguuuuca

SEQ ID NO: 2640265 - RNA, 21 nt, Escherichia coli CFT073
accgcuggccaguuuucagaa

SEQ ID NO: 2640266 - RNA, 18 nt, Escherichia coli CFT073
accgcugucgaucagaga

SEQ ID NO: 2640267 - RNA, 19 nt, Escherichia coli CFT073
accgcugucgaucagagaa

SEQ ID NO: 2640268 - RNA, 17 nt, Escherichia coli CFT073
accgcuguuaugcacac

SEQ ID NO: 2640269 - RNA, 16 nt, Escherichia coli CFT073
accgcuguugccagca

SEQ ID NO: 2640270 - RNA, 17 nt, Escherichia coli CFT073
accgcuguugccagcag

SEQ ID NO: 2640271 - RNA, 18 nt, Escherichia coli CFT073
accgcuguugccagcagc

SEQ ID NO: 2640272 - RNA, 16 nt, Escherichia coli CFT073
accgcuucaggaacug

SEQ ID NO: 2640273 - RNA, 17 nt, Escherichia coli CFT073
accgcuucgcguaaaau

SEQ ID NO: 2640274 - RNA, 16 nt, Escherichia coli CFT073
accgcuuggcgauacc

SEQ ID NO: 2640275 - RNA, 21 nt, Escherichia coli CFT073
accgcuuggcgauaccccaac

SEQ ID NO: 2640276 - RNA, 23 nt, Escherichia coli CFT073
accgcuuuaaaauuauccagcgc

SEQ ID NO: 2640277 - RNA, 17 nt, Escherichia coli CFT073
accgcuuuuccggcaug

SEQ ID NO: 2640278 - RNA, 19 nt, Escherichia coli CFT073
accgcuuuuugauaaguac

SEQ ID NO: 2640279 - RNA, 14 nt, Escherichia coli CFT073
accggaaauugcug

SEQ ID NO: 2640280 - RNA, 13 nt, Escherichia coli CFT073
accggaaccagcg

SEQ ID NO: 2640281 - RNA, 16 nt, Escherichia coli CFT073
accggaaccagcgccu

SEQ ID NO: 2640282 - RNA, 22 nt, Escherichia coli CFT073
accgugccgcuguucugauuuu

SEQ ID NO: 2640283 - RNA, 22 nt, Escherichia coli CFT073
accgugcgccagcaaaucagcc

SEQ ID NO: 2640284 - RNA, 22 nt, Escherichia coli CFT073
accgugcugacucggcugcugc

SEQ ID NO: 2640285 - RNA, 11 nt, Escherichia coli CFT073
accgugcuuca

SEQ ID NO: 2640286 - RNA, 17 nt, Escherichia coli CFT073
accguguauuucugguc

SEQ ID NO: 2640287 - RNA, 23 nt, Escherichia coli CFT073
accgugucgccaucaaaggcuuc

SEQ ID NO: 2640288 - RNA, 13 nt, Escherichia coli CFT073
accguguucagcg

SEQ ID NO: 2640289 - RNA, 18 nt, Escherichia coli CFT073
accguucacgcauuugca

SEQ ID NO: 2640290 - RNA, 22 nt, Escherichia coli CFT073
accguucacugcgaccagcagc

SEQ ID NO: 2640291 - RNA, 18 nt, Escherichia coli CFT073
accguuccaacgccacca

SEQ ID NO: 2640292 - RNA, 22 nt, Escherichia coli CFT073
accguucgccaggucagagagc

SEQ ID NO: 2640293 - RNA, 20 nt, Escherichia coli CFT073
accguugcucagaaucacgc

SEQ ID NO: 2640294 - RNA, 20 nt, Escherichia coli CFT073
accguuggacggucuaccag

SEQ ID NO: 2640295 - RNA, 19 nt, Escherichia coli CFT073
accguuucguggaaaacac

SEQ ID NO: 2640296 - RNA, 13 nt, Escherichia coli CFT073
accguuucugccg

SEQ ID NO: 2640297 - RNA, 16 nt, Escherichia coli CFT073
accguuugauauaaac

SEQ ID NO: 2640298 - RNA, 22 nt, Escherichia coli CFT073
accguuugccccggcugcgcga

SEQ ID NO: 2640299 - RNA, 17 nt, Escherichia coli CFT073
accguuuguuuuuuaag

SEQ ID NO: 2640300 - RNA, 20 nt, Escherichia coli CFT073
accguuuucgacaauaaaca

SEQ ID NO: 2640301 - RNA, 19 nt, Escherichia coli CFT073
accuaaagccuguaaugcc

SEQ ID NO: 2640302 - RNA, 18 nt, Escherichia coli CFT073
accuaacaguucacccgg

SEQ ID NO: 2640303 - RNA, 13 nt, Escherichia coli CFT073
accuaacgccagc

SEQ ID NO: 2640304 - RNA, 15 nt, Escherichia coli CFT073
accuaacuccugcgu

SEQ ID NO: 2640305 - RNA, 23 nt, Escherichia coli CFT073
accuaacuccugcgucggaacau

SEQ ID NO: 2640306 - RNA, 13 nt, Escherichia coli CFT073
accuaagccgcgu

SEQ ID NO: 2640307 - RNA, 19 nt, Escherichia coli CFT073
accuaaugaauccagcgac

SEQ ID NO: 2640308 - RNA, 12 nt, Escherichia coli CFT073
accuaauuuuuu

SEQ ID NO: 2640309 - RNA, 19 nt, Escherichia coli CFT073
accuaccugcaguucauca

SEQ ID NO: 2640310 - RNA, 14 nt, Escherichia coli CFT073
accuaccugcucaa

SEQ ID NO: 2640311 - RNA, 14 nt, Escherichia coli CFT073
accucaaaaagaaa

SEQ ID NO: 2640312 - RNA, 13 nt, Escherichia coli CFT073
accucaaaaccaa

SEQ ID NO: 2640313 - RNA, 14 nt, Escherichia coli CFT073
accucaaaaugagu

SEQ ID NO: 2640314 - RNA, 16 nt, Escherichia coli CFT073
accucaaaaugaguca

SEQ ID NO: 2640315 - RNA, 19 nt, Escherichia coli CFT073
accucaacaaaauaauccg

SEQ ID NO: 2640316 - RNA, 19 nt, Escherichia coli CFT073
accucaacccgguugcuuu

SEQ ID NO: 2640317 - RNA, 14 nt, Escherichia coli CFT073
accucaauggcagc

SEQ ID NO: 2640318 - RNA, 12 nt, Escherichia coli CFT073
accucagaaauc

SEQ ID NO: 2640319 - RNA, 14 nt, Escherichia coli CFT073
accucagaaaucuc

SEQ ID NO: 2640320 - RNA, 14 nt, Escherichia coli CFT073
accucaggaaaagc

SEQ ID NO: 2640321 - RNA, 15 nt, Escherichia coli CFT073
accucaggaaaagca

SEQ ID NO: 2640322 - RNA, 17 nt, Escherichia coli CFT073
accucaggaaauugcac

SEQ ID NO: 2640323 - RNA, 19 nt, Escherichia coli CFT073
accucagguucaaccgcag

SEQ ID NO: 2640324 - RNA, 20 nt, Escherichia coli CFT073
accucagguucaaccgcagc

SEQ ID NO: 2640325 - RNA, 12 nt, Escherichia coli CFT073
accucagugacc

SEQ ID NO: 2640326 - RNA, 18 nt, Escherichia coli CFT073
accucauccgaugguuua

SEQ ID NO: 2640327 - RNA, 18 nt, Escherichia coli CFT073
accuccacgcccagcgca

SEQ ID NO: 2640328 - RNA, 14 nt, Escherichia coli CFT073
accuccagcaucag

SEQ ID NO: 2640329 - RNA, 14 nt, Escherichia coli CFT073
accucccgucgccc

SEQ ID NO: 2640330 - RNA, 19 nt, Escherichia coli CFT073
accuccgucuggccaguuc

SEQ ID NO: 2640331 - RNA, 23 nt, Escherichia coli CFT073
accuccugucuaaccgccugccu

SEQ ID NO: 2640332 - RNA, 21 nt, Escherichia coli CFT073
accucgguuaacagcgcacca

SEQ ID NO: 2640333 - RNA, 15 nt, Escherichia coli CFT073
accucgucaccaccu

SEQ ID NO: 2640334 - RNA, 16 nt, Escherichia coli CFT073
accucgucaccaccuc

SEQ ID NO: 2640335 - RNA, 20 nt, Escherichia coli CFT073
accucgucaccaccucaccc

SEQ ID NO: 2640336 - RNA, 15 nt, Escherichia coli CFT073
accucucagaauccc

SEQ ID NO: 2640337 - RNA, 17 nt, Escherichia coli CFT073
accucugucgaugcgcu

SEQ ID NO: 2640338 - RNA, 12 nt, Escherichia coli CFT073
accucuucauua

SEQ ID NO: 2640339 - RNA, 22 nt, Escherichia coli CFT073
accucuucuacugcaugauuag

SEQ ID NO: 2640340 - RNA, 13 nt, Escherichia coli CFT073
accucuucuuuaa

SEQ ID NO: 2640341 - RNA, 15 nt, Escherichia coli CFT073
accucuucuuuaaaa

SEQ ID NO: 2640342 - RNA, 18 nt, Escherichia coli CFT073
accucuucuuuaaaacgc

SEQ ID NO: 2640343 - RNA, 22 nt, Escherichia coli CFT073
accucuuuugcgauuguaauuu

SEQ ID NO: 2640344 - RNA, 19 nt, Escherichia coli CFT073
accugaaccagaccgccuu

SEQ ID NO: 2640345 - RNA, 15 nt, Escherichia coli CFT073
accugaauaugaccc

SEQ ID NO: 2640346 - RNA, 17 nt, Escherichia coli CFT073
accugacagaccgccag

SEQ ID NO: 2640347 - RNA, 21 nt, Escherichia coli CFT073
accugaccgagccagugcccg

SEQ ID NO: 2640348 - RNA, 17 nt, Escherichia coli CFT073
accugacgaugcgguuc

SEQ ID NO: 2640349 - RNA, 13 nt, Escherichia coli CFT073
accugacugugac

SEQ ID NO: 2640350 - RNA, 18 nt, Escherichia coli CFT073
accugaguaaaucaccug

SEQ ID NO: 2640351 - RNA, 16 nt, Escherichia coli CFT073
accugauaacggccgu

SEQ ID NO: 2640352 - RNA, 15 nt, Escherichia coli CFT073
accugauccagcucu

SEQ ID NO: 2640353 - RNA, 14 nt, Escherichia coli CFT073
accugaugcgcucc

SEQ ID NO: 2640354 - RNA, 14 nt, Escherichia coli CFT073
accugauuaccuac

SEQ ID NO: 2640355 - RNA, 17 nt, Escherichia coli CFT073
accugauugaccgccag

SEQ ID NO: 2640356 - RNA, 20 nt, Escherichia coli CFT073
accugauugaccgccagcgc

SEQ ID NO: 2640357 - RNA, 19 nt, Escherichia coli CFT073
accugcaacggcaucgcca

SEQ ID NO: 2640358 - RNA, 17 nt, Escherichia coli CFT073
accugcacaggcauuca

SEQ ID NO: 2640359 - RNA, 14 nt, Escherichia coli CFT073
accugcaguucauc

SEQ ID NO: 2640360 - RNA, 23 nt, Escherichia coli CFT073
accugccagagcugaauaucacg

SEQ ID NO: 2640361 - RNA, 16 nt, Escherichia coli CFT073
accugccagaggaucu

SEQ ID NO: 2640362 - RNA, 19 nt, Escherichia coli CFT073
accugccagcgccgacagu

SEQ ID NO: 2640363 - RNA, 22 nt, Escherichia coli CFT073
accugccagggagcgaaaaagc

SEQ ID NO: 2640364 - RNA, 19 nt, Escherichia coli CFT073
accugcccgguauccauca

SEQ ID NO: 2640365 - RNA, 16 nt, Escherichia coli CFT073
accugccgccaccaug

SEQ ID NO: 2640366 - RNA, 17 nt, Escherichia coli CFT073
accugccugcagcugcu

SEQ ID NO: 2640367 - RNA, 19 nt, Escherichia coli CFT073
accugcgaaaaucagccau

SEQ ID NO: 2640368 - RNA, 20 nt, Escherichia coli CFT073
accugcgcggccagugccag

SEQ ID NO: 2640369 - RNA, 14 nt, Escherichia coli CFT073
accugcgcuggcag

SEQ ID NO: 2640370 - RNA, 20 nt, Escherichia coli CFT073
accugcggaaucaccggcaa

SEQ ID NO: 2640371 - RNA, 16 nt, Escherichia coli CFT073
accugcgucugaugaa

SEQ ID NO: 2640372 - RNA, 22 nt, Escherichia coli CFT073
accugcguugccgcaucaguga

SEQ ID NO: 2640373 - RNA, 20 nt, Escherichia coli CFT073
accugcuauucccgcaaaau

SEQ ID NO: 2640374 - RNA, 16 nt, Escherichia coli CFT073
accugcucaaucgcau

SEQ ID NO: 2640375 - RNA, 21 nt, Escherichia coli CFT073
accugcucaaucgcauggcug

SEQ ID NO: 2640376 - RNA, 18 nt, Escherichia coli CFT073
accugcucaccagucacu

SEQ ID NO: 2640377 - RNA, 11 nt, Escherichia coli CFT073
accugcucagc

SEQ ID NO: 2640378 - RNA, 19 nt, Escherichia coli CFT073
accugcucagcacgccacu

SEQ ID NO: 2640379 - RNA, 20 nt, Escherichia coli CFT073
accugcucagcacgccacuc

SEQ ID NO: 2640380 - RNA, 23 nt, Escherichia coli CFT073
accugcucgaacgugaucgcccc

SEQ ID NO: 2640381 - RNA, 13 nt, Escherichia coli CFT073
accugcuguguaa

SEQ ID NO: 2640382 - RNA, 23 nt, Escherichia coli CFT073
accugcuguguaauuugcguuuu

SEQ ID NO: 2640383 - RNA, 17 nt, Escherichia coli CFT073
accuggccccuggcugg

SEQ ID NO: 2640384 - RNA, 19 nt, Escherichia coli CFT073
accuggccccuggcugguc

SEQ ID NO: 2640385 - RNA, 16 nt, Escherichia coli CFT073
accuggcgcaaaagag

SEQ ID NO: 2640386 - RNA, 17 nt, Escherichia coli CFT073
accuggcgcaaaagaga

SEQ ID NO: 2640387 - RNA, 14 nt, Escherichia coli CFT073
accuggcgcuucac

SEQ ID NO: 2640388 - RNA, 22 nt, Escherichia coli CFT073
accuggcgcuucacuggcgaca

SEQ ID NO: 2640389 - RNA, 20 nt, Escherichia coli CFT073
accuguaaaaaaggcagcca

SEQ ID NO: 2640390 - RNA, 20 nt, Escherichia coli CFT073
acgacgcugaagucagcaca

SEQ ID NO: 2640391 - RNA, 21 nt, Escherichia coli CFT073
acgacgcugguuacaucaaca

SEQ ID NO: 2640392 - RNA, 23 nt, Escherichia coli CFT073
acgacggaauuucauaugcgcca

SEQ ID NO: 2640393 - RNA, 14 nt, Escherichia coli CFT073
acgacgguaaacca

SEQ ID NO: 2640394 - RNA, 20 nt, Escherichia coli CFT073
acgacgguuaaauugaggcu

SEQ ID NO: 2640395 - RNA, 16 nt, Escherichia coli CFT073
acgacgguuuccaccg

SEQ ID NO: 2640396 - RNA, 19 nt, Escherichia coli CFT073
acgacgucgggcggaaaac

SEQ ID NO: 2640397 - RNA, 19 nt, Escherichia coli CFT073
acgacguuuuccaucgacc

SEQ ID NO: 2640398 - RNA, 21 nt, Escherichia coli CFT073
acgacucauucccauaccuuu

SEQ ID NO: 2640399 - RNA, 18 nt, Escherichia coli CFT073
acgacuguuggaaucacu

SEQ ID NO: 2640400 - RNA, 20 nt, Escherichia coli CFT073
acgacuucaaacggcgagau

SEQ ID NO: 2640401 - RNA, 13 nt, Escherichia coli CFT073
acgagaaaagcca

SEQ ID NO: 2640402 - RNA, 21 nt, Escherichia coli CFT073
acgagaacucggaagcagcgu

SEQ ID NO: 2640403 - RNA, 17 nt, Escherichia coli CFT073
acgagagaaccagccgu

SEQ ID NO: 2640404 - RNA, 12 nt, Escherichia coli CFT073
acgagaucguca

SEQ ID NO: 2640405 - RNA, 15 nt, Escherichia coli CFT073
acgagcaucaucuuc

SEQ ID NO: 2640406 - RNA, 18 nt, Escherichia coli CFT073
acgaguggcggacgggug

SEQ ID NO: 2640407 - RNA, 21 nt, Escherichia coli CFT073
acgaguuaccgugugcggcga

SEQ ID NO: 2640408 - RNA, 18 nt, Escherichia coli CFT073
acgaguuagcauggcuga

SEQ ID NO: 2640409 - RNA, 17 nt, Escherichia coli CFT073
acgauaacaaucaccaa

SEQ ID NO: 2640410 - RNA, 19 nt, Escherichia coli CFT073
acgauaauggcuuccagua

SEQ ID NO: 2640411 - RNA, 18 nt, Escherichia coli CFT073
acgauacaaaagcaccgu

SEQ ID NO: 2640412 - RNA, 14 nt, Escherichia coli CFT073
acgauaccgccgca

SEQ ID NO: 2640413 - RNA, 14 nt, Escherichia coli CFT073
acgauacgcuggcg

SEQ ID NO: 2640414 - RNA, 18 nt, Escherichia coli CFT073
acgauauccauaucuaac

SEQ ID NO: 2640415 - RNA, 13 nt, Escherichia coli CFT073
acgauaucgauaa

SEQ ID NO: 2640416 - RNA, 22 nt, Escherichia coli CFT073
acgauauguucaggauauuuau

SEQ ID NO: 2640417 - RNA, 19 nt, Escherichia coli CFT073
acgauauucuguaccaaaa

SEQ ID NO: 2640418 - RNA, 16 nt, Escherichia coli CFT073
acgaucaacagaauga

SEQ ID NO: 2640419 - RNA, 22 nt, Escherichia coli CFT073
acgaucaagaauaguuuccagu

SEQ ID NO: 2640420 - RNA, 21 nt, Escherichia coli CFT073
acgaucagggcgacaaucauc

SEQ ID NO: 2640421 - RNA, 21 nt, Escherichia coli CFT073
acgaucaucgacaguaccagc

SEQ ID NO: 2640422 - RNA, 12 nt, Escherichia coli CFT073
acgaucccaacu

SEQ ID NO: 2640423 - RNA, 21 nt, Escherichia coli CFT073
acgaucccggagaagagauaa

SEQ ID NO: 2640424 - RNA, 16 nt, Escherichia coli CFT073
acgauccgacaucccg

SEQ ID NO: 2640425 - RNA, 23 nt, Escherichia coli CFT073
acgauccugagcagcaaccacuu

SEQ ID NO: 2640426 - RNA, 17 nt, Escherichia coli CFT073
acgauccuggucaggaa

SEQ ID NO: 2640427 - RNA, 17 nt, Escherichia coli CFT073
acgaucgccgagaaucg

SEQ ID NO: 2640428 - RNA, 20 nt, Escherichia coli CFT073
acgaucgcgaauaugcuggg

SEQ ID NO: 2640429 - RNA, 15 nt, Escherichia coli CFT073
acgaucgcuuucaac

SEQ ID NO: 2640430 - RNA, 16 nt, Escherichia coli CFT073
acgaucgcuuucaacg

SEQ ID NO: 2640431 - RNA, 21 nt, Escherichia coli CFT073
acgaucggcguguuucaucuc

SEQ ID NO: 2640432 - RNA, 21 nt, Escherichia coli CFT073
acgaucuggcgucagcggcug

SEQ ID NO: 2640433 - RNA, 22 nt, Escherichia coli CFT073
acgaucuucgccugaaacagaa

SEQ ID NO: 2640434 - RNA, 19 nt, Escherichia coli CFT073
acgaucuucggcgucagaa

SEQ ID NO: 2640435 - RNA, 16 nt, Escherichia coli CFT073
acgaugaacaugcagc

SEQ ID NO: 2640436 - RNA, 13 nt, Escherichia coli CFT073
acgaugaaugcaa

SEQ ID NO: 2640437 - RNA, 22 nt, Escherichia coli CFT073
acgaugaccgcaucaauuaccu

SEQ ID NO: 2640438 - RNA, 20 nt, Escherichia coli CFT073
acgaugcaauuaucauugcu

SEQ ID NO: 2640439 - RNA, 15 nt, Escherichia coli CFT073
acgaugcacagcucu

SEQ ID NO: 2640440 - RNA, 22 nt, Escherichia coli CFT073
acgaugccgccgaggauacagc

SEQ ID NO: 2640441 - RNA, 16 nt, Escherichia coli CFT073
acgaugccucaucaca

SEQ ID NO: 2640442 - RNA, 20 nt, Escherichia coli CFT073
acgaugccugaugcgacgcu

SEQ ID NO: 2640443 - RNA, 18 nt, Escherichia coli CFT073
acgaugccugcaaugccg

SEQ ID NO: 2640444 - RNA, 15 nt, Escherichia coli CFT073
acgaugcgaccgccg

SEQ ID NO: 2640445 - RNA, 22 nt, Escherichia coli CFT073
acgaugcuuuacguauccguuc

SEQ ID NO: 2640446 - RNA, 17 nt, Escherichia coli CFT073
acgauggcaauuuucac

SEQ ID NO: 2640447 - RNA, 18 nt, Escherichia coli CFT073
acgauggcaauuuucacu

SEQ ID NO: 2640448 - RNA, 15 nt, Escherichia coli CFT073
acgauggcguaacca

SEQ ID NO: 2640449 - RNA, 15 nt, Escherichia coli CFT073
acgaugucaaucagg

SEQ ID NO: 2640450 - RNA, 15 nt, Escherichia coli CFT073
acgauguuugcugcg

SEQ ID NO: 2640451 - RNA, 17 nt, Escherichia coli CFT073
acgauuacaggaacugc

SEQ ID NO: 2640452 - RNA, 21 nt, Escherichia coli CFT073
acgauuccaacgaaaaugauu

SEQ ID NO: 2640453 - RNA, 21 nt, Escherichia coli CFT073
acgauuccggcaaauaacaga

SEQ ID NO: 2640454 - RNA, 17 nt, Escherichia coli CFT073
acgauucggcaaucaca

SEQ ID NO: 2640455 - RNA, 18 nt, Escherichia coli CFT073
acgauucggcaaucacaa

SEQ ID NO: 2640456 - RNA, 20 nt, Escherichia coli CFT073
acgauuugcguaaaaccugc

SEQ ID NO: 2640457 - RNA, 12 nt, Escherichia coli CFT073
acgauuuucccu

SEQ ID NO: 2640458 - RNA, 13 nt, Escherichia coli CFT073
acgcaaacaccag

SEQ ID NO: 2640459 - RNA, 13 nt, Escherichia coli CFT073
acgcaaaccaccu

SEQ ID NO: 2640460 - RNA, 10 nt, Escherichia coli CFT073
acgcaaagag

SEQ ID NO: 2640461 - RNA, 19 nt, Escherichia coli CFT073
acgcaaagagagaagccag

SEQ ID NO: 2640462 - RNA, 22 nt, Escherichia coli CFT073
acgcaacaugucagcaauuacc

SEQ ID NO: 2640463 - RNA, 17 nt, Escherichia coli CFT073
acgcaacggcugguagc

SEQ ID NO: 2640464 - RNA, 15 nt, Escherichia coli CFT073
acgcaacugauauuu

SEQ ID NO: 2640465 - RNA, 22 nt, Escherichia coli CFT073
acgcaacugccaguaaagcagc

SEQ ID NO: 2640466 - RNA, 13 nt, Escherichia coli CFT073
acgcaaggcacaa

SEQ ID NO: 2640467 - RNA, 22 nt, Escherichia coli CFT073
acgcaauaccugacgcaacugc

SEQ ID NO: 2640468 - RNA, 15 nt, Escherichia coli CFT073
acgcaauauccgcca

SEQ ID NO: 2640469 - RNA, 17 nt, Escherichia coli CFT073
acgcaauccccucuuca

SEQ ID NO: 2640470 - RNA, 21 nt, Escherichia coli CFT073
acgcaaugugcagcagugcca

SEQ ID NO: 2640471 - RNA, 17 nt, Escherichia coli CFT073
acgcaccaccagcgccu

SEQ ID NO: 2640472 - RNA, 11 nt, Escherichia coli CFT073
acgcaccaucc

SEQ ID NO: 2640473 - RNA, 12 nt, Escherichia coli CFT073
acgcaccaugca

SEQ ID NO: 2640474 - RNA, 15 nt, Escherichia coli CFT073
acgcaccaugcacgg

SEQ ID NO: 2640475 - RNA, 17 nt, Escherichia coli CFT073
acgcaccgggcagggua

SEQ ID NO: 2640476 - RNA, 15 nt, Escherichia coli CFT073
acgcacgccugcauc

SEQ ID NO: 2640477 - RNA, 18 nt, Escherichia coli CFT073
acgcacucgacgcagcag

SEQ ID NO: 2640478 - RNA, 14 nt, Escherichia coli CFT073
acgcacugcaauau

SEQ ID NO: 2640479 - RNA, 23 nt, Escherichia coli CFT073
acgcacuggcgagcgccagcaug

SEQ ID NO: 2640480 - RNA, 14 nt, Escherichia coli CFT073
acgcacuggcgcgc

SEQ ID NO: 2640481 - RNA, 16 nt, Escherichia coli CFT073
acgcacuucuuccggg

SEQ ID NO: 2640482 - RNA, 23 nt, Escherichia coli CFT073
acgcacuucuucguuuucugcgc

SEQ ID NO: 2640483 - RNA, 21 nt, Escherichia coli CFT073
acgcagaaaggaucacaauaa

SEQ ID NO: 2640484 - RNA, 22 nt, Escherichia coli CFT073
acgcagaaucuucuucucagcc

SEQ ID NO: 2640485 - RNA, 21 nt, Escherichia coli CFT073
acgcagacgcauacugauuac

SEQ ID NO: 2640486 - RNA, 13 nt, Escherichia coli CFT073
acgcagacgccgu

SEQ ID NO: 2640487 - RNA, 21 nt, Escherichia coli CFT073
acgcagacggcuuucuucagc

SEQ ID NO: 2640488 - RNA, 16 nt, Escherichia coli CFT073
acgcagcaaaagcagg

SEQ ID NO: 2640489 - RNA, 23 nt, Escherichia coli CFT073
acgcagcaaaagcaggcaccgcg

SEQ ID NO: 2640490 - RNA, 21 nt, Escherichia coli CFT073
acgcagcacaugcaacuugaa

SEQ ID NO: 2640491 - RNA, 17 nt, Escherichia coli CFT073
acgcagcagauuaaccg

SEQ ID NO: 2640492 - RNA, 16 nt, Escherichia coli CFT073
acgcagccccagcgca

SEQ ID NO: 2640493 - RNA, 18 nt, Escherichia coli CFT073
acgcagcgauaccggcuc

SEQ ID NO: 2640494 - RNA, 23 nt, Escherichia coli CFT073
acgcagcgcguuacgcccaagca

SEQ ID NO: 2640495 - RNA, 16 nt, Escherichia coli CFT073
acgcagcggcggcacu

SEQ ID NO: 2640496 - RNA, 19 nt, Escherichia coli CFT073
acgcagcgucaucggccac

SEQ ID NO: 2640497 - RNA, 18 nt, Escherichia coli CFT073
acgcagcuucucgugaaa

SEQ ID NO: 2640498 - RNA, 17 nt, Escherichia coli CFT073
acgccgcgauagagagc

SEQ ID NO: 2640499 - RNA, 22 nt, Escherichia coli CFT073
acgccgcguuuaucgacagacg

SEQ ID NO: 2640500 - RNA, 22 nt, Escherichia coli CFT073
acgccgcugcucuauacgcuca

SEQ ID NO: 2640501 - RNA, 13 nt, Escherichia coli CFT073
acgccgcugguga

SEQ ID NO: 2640502 - RNA, 22 nt, Escherichia coli CFT073
acgccgcuggugauucagggca

SEQ ID NO: 2640503 - RNA, 13 nt, Escherichia coli CFT073
acgccgcuggugg

SEQ ID NO: 2640504 - RNA, 20 nt, Escherichia coli CFT073
acgccgcugucuaccagcac

SEQ ID NO: 2640505 - RNA, 21 nt, Escherichia coli CFT073
acgccgcugucuaccagcacc

SEQ ID NO: 2640506 - RNA, 23 nt, Escherichia coli CFT073
acgccgcugucuaccagcaccug

SEQ ID NO: 2640507 - RNA, 17 nt, Escherichia coli CFT073
acgccgcuuuuuuacgc

SEQ ID NO: 2640508 - RNA, 15 nt, Escherichia coli CFT073
acgccggaugcggag

SEQ ID NO: 2640509 - RNA, 15 nt, Escherichia coli CFT073
acgccggauggcaca

SEQ ID NO: 2640510 - RNA, 22 nt, Escherichia coli CFT073
acgccggauggcacaugacuuc

SEQ ID NO: 2640511 - RNA, 22 nt, Escherichia coli CFT073
acgccggauuugagaucggaaa

SEQ ID NO: 2640512 - RNA, 24 nt, Escherichia coli CFT073
acgccgggaaauuuuuccguuuuc

SEQ ID NO: 2640513 - RNA, 15 nt, Escherichia coli CFT073
acgccgggcagccuu

SEQ ID NO: 2640514 - RNA, 21 nt, Escherichia coli CFT073
acgccguuuuuacccagcagc

SEQ ID NO: 2640515 - RNA, 23 nt, Escherichia coli CFT073
acgccguuuuuacccagcagcag

SEQ ID NO: 2640516 - RNA, 13 nt, Escherichia coli CFT073
acgccucacagag

SEQ ID NO: 2640517 - RNA, 16 nt, Escherichia coli CFT073
acgccucagccgaaac

SEQ ID NO: 2640518 - RNA, 23 nt, Escherichia coli CFT073
acgccucgggaaggucagguuug

SEQ ID NO: 2640519 - RNA, 22 nt, Escherichia coli CFT073
acgccuuaucaggccaaccgcc

SEQ ID NO: 2640520 - RNA, 15 nt, Escherichia coli CFT073
acgccuuauccgacu

SEQ ID NO: 2640521 - RNA, 16 nt, Escherichia coli CFT073
acgccuucaauaugga

SEQ ID NO: 2640522 - RNA, 14 nt, Escherichia coli CFT073
acgccuucccuuuc

SEQ ID NO: 2640523 - RNA, 14 nt, Escherichia coli CFT073
acgccuucuccggc

SEQ ID NO: 2640524 - RNA, 18 nt, Escherichia coli CFT073
acgccuuugacguugguu

SEQ ID NO: 2640525 - RNA, 22 nt, Escherichia coli CFT073
acgccuuugucgggcaggcuuc

SEQ ID NO: 2640526 - RNA, 16 nt, Escherichia coli CFT073
acgcgaagcacacaua

SEQ ID NO: 2640527 - RNA, 18 nt, Escherichia coli CFT073
acgcgacaauaccgguua

SEQ ID NO: 2640528 - RNA, 14 nt, Escherichia coli CFT073
acgcgacauuuuua

SEQ ID NO: 2640529 - RNA, 17 nt, Escherichia coli CFT073
acgcgacauuuuuauga

SEQ ID NO: 2640530 - RNA, 20 nt, Escherichia coli CFT073
acgcgaccuuuuuugcacgc

SEQ ID NO: 2640531 - RNA, 17 nt, Escherichia coli CFT073
acgcgagugugauuaca

SEQ ID NO: 2640532 - RNA, 20 nt, Escherichia coli CFT073
acgcgauaaaaaaccccgac

SEQ ID NO: 2640533 - RNA, 17 nt, Escherichia coli CFT073
acgcgaucgcgaaacca

SEQ ID NO: 2640534 - RNA, 23 nt, Escherichia coli CFT073
acgcgauucccagucgcgcaauu

SEQ ID NO: 2640535 - RNA, 14 nt, Escherichia coli CFT073
acgcgcaacugucc

SEQ ID NO: 2640536 - RNA, 20 nt, Escherichia coli CFT073
acgcgcaauggaccagaacg

SEQ ID NO: 2640537 - RNA, 19 nt, Escherichia coli CFT073
acgcgcagcgucgcaucag

SEQ ID NO: 2640538 - RNA, 22 nt, Escherichia coli CFT073
acgcgcagggugcagaaucaau

SEQ ID NO: 2640539 - RNA, 19 nt, Escherichia coli CFT073
acgcgccaagauagaacca

SEQ ID NO: 2640540 - RNA, 17 nt, Escherichia coli CFT073
acgcgccacgcacgccu

SEQ ID NO: 2640541 - RNA, 22 nt, Escherichia coli CFT073
acgcgccacgcacgccugcauc

SEQ ID NO: 2640542 - RNA, 14 nt, Escherichia coli CFT073
acgcgccagcagcg

SEQ ID NO: 2640543 - RNA, 16 nt, Escherichia coli CFT073
acgcgccagcaucgca

SEQ ID NO: 2640544 - RNA, 20 nt, Escherichia coli CFT073
acgcgccagcaucgcaucag

SEQ ID NO: 2640545 - RNA, 20 nt, Escherichia coli CFT073
acgcgccagcgccguauccg

SEQ ID NO: 2640546 - RNA, 13 nt, Escherichia coli CFT073
acgcgccagcguc

SEQ ID NO: 2640547 - RNA, 20 nt, Escherichia coli CFT073
acgcgccagcgucgcaucag

SEQ ID NO: 2640548 - RNA, 20 nt, Escherichia coli CFT073
acgcgccagcgucgcauccg

SEQ ID NO: 2640549 - RNA, 22 nt, Escherichia coli CFT073
acgcgccaggaucagaaugcgc

SEQ ID NO: 2640550 - RNA, 23 nt, Escherichia coli CFT073
acgcgcccaguggaugcgccaua

SEQ ID NO: 2640551 - RNA, 14 nt, Escherichia coli CFT073
acgcgccgacgaau

SEQ ID NO: 2640552 - RNA, 11 nt, Escherichia coli CFT073
acgcgccgcca

SEQ ID NO: 2640553 - RNA, 17 nt, Escherichia coli CFT073
acgcgccgccagccaca

SEQ ID NO: 2640554 - RNA, 22 nt, Escherichia coli CFT073
acgcgccuuaaaaaccagagaa

SEQ ID NO: 2640555 - RNA, 15 nt, Escherichia coli CFT073
acgcgcgcaggcaac

SEQ ID NO: 2640556 - RNA, 16 nt, Escherichia coli CFT073
acgcgcuacugaaucc

SEQ ID NO: 2640557 - RNA, 16 nt, Escherichia coli CFT073
acgcgcugaccuucuu

SEQ ID NO: 2640558 - RNA, 18 nt, Escherichia coli CFT073
acgcgcuggcaaaucaaa

SEQ ID NO: 2640559 - RNA, 17 nt, Escherichia coli CFT073
acgcgcuguaauuucac

SEQ ID NO: 2640560 - RNA, 17 nt, Escherichia coli CFT073
acgcgcuuugaugcguu

SEQ ID NO: 2640561 - RNA, 22 nt, Escherichia coli CFT073
acgcgcuuugaugcguucuuca

SEQ ID NO: 2640562 - RNA, 17 nt, Escherichia coli CFT073
acgcgcuuuucaccgac

SEQ ID NO: 2640563 - RNA, 22 nt, Escherichia coli CFT073
acgcggaaacuuaaucgccagu

SEQ ID NO: 2640564 - RNA, 14 nt, Escherichia coli CFT073
acgcggauaaacgu

SEQ ID NO: 2640565 - RNA, 19 nt, Escherichia coli CFT073
acgcggcaaaacccugcgc

SEQ ID NO: 2640566 - RNA, 23 nt, Escherichia coli CFT073
acgcggcaaaacccugcgccagc

SEQ ID NO: 2640567 - RNA, 24 nt, Escherichia coli CFT073
acgcggcaagcgucgcaucaggca

SEQ ID NO: 2640568 - RNA, 23 nt, Escherichia coli CFT073
acgcggcaauccccgccagcacg

SEQ ID NO: 2640569 - RNA, 23 nt, Escherichia coli CFT073
acgcggcagcaaccgcuuccggu

SEQ ID NO: 2640570 - RNA, 13 nt, Escherichia coli CFT073
acgcggcaggaga

SEQ ID NO: 2640571 - RNA, 21 nt, Escherichia coli CFT073
acgcggcaggcgucgcaucag

SEQ ID NO: 2640572 - RNA, 21 nt, Escherichia coli CFT073
acgcggcccgcgucgcaucag

SEQ ID NO: 2640573 - RNA, 13 nt, Escherichia coli CFT073
acgcggugcgccg

SEQ ID NO: 2640574 - RNA, 13 nt, Escherichia coli CFT073
acgcgguuacgca

SEQ ID NO: 2640575 - RNA, 16 nt, Escherichia coli CFT073
acgcgguuucgccgcc

SEQ ID NO: 2640576 - RNA, 14 nt, Escherichia coli CFT073
acgcguaaauccag

SEQ ID NO: 2640577 - RNA, 17 nt, Escherichia coli CFT073
acgcguaaauccagcac

SEQ ID NO: 2640578 - RNA, 15 nt, Escherichia coli CFT073
acgcguaaguacagu

SEQ ID NO: 2640579 - RNA, 13 nt, Escherichia coli CFT073
acgcgucaagcgu

SEQ ID NO: 2640580 - RNA, 21 nt, Escherichia coli CFT073
acgcgucaagcgucgcauccg

SEQ ID NO: 2640581 - RNA, 16 nt, Escherichia coli CFT073
acgcgucagcgccgca

SEQ ID NO: 2640582 - RNA, 16 nt, Escherichia coli CFT073
acgcgucagugucuua

SEQ ID NO: 2640583 - RNA, 17 nt, Escherichia coli CFT073
acgcgucauacgaucag

SEQ ID NO: 2640584 - RNA, 20 nt, Escherichia coli CFT073
acgcgucugaccgucuuuca

SEQ ID NO: 2640585 - RNA, 19 nt, Escherichia coli CFT073
acgcguuaaauccugccaa

SEQ ID NO: 2640586 - RNA, 21 nt, Escherichia coli CFT073
acgcguuaaauccugccaacg

SEQ ID NO: 2640587 - RNA, 17 nt, Escherichia coli CFT073
acgcguuaagcccaguu

SEQ ID NO: 2640588 - RNA, 14 nt, Escherichia coli CFT073
acgcguuaauaccu

SEQ ID NO: 2640589 - RNA, 22 nt, Escherichia coli CFT073
acgcguuauaggcauucucgcc

SEQ ID NO: 2640590 - RNA, 19 nt, Escherichia coli CFT073
acgcguugcgcaugaccuu

SEQ ID NO: 2640591 - RNA, 18 nt, Escherichia coli CFT073
acgcuaccuaagcgccag

SEQ ID NO: 2640592 - RNA, 24 nt, Escherichia coli CFT073
acgcuacgcuaacuucgccaucag

SEQ ID NO: 2640593 - RNA, 16 nt, Escherichia coli CFT073
acgcuauuugcugaau

SEQ ID NO: 2640594 - RNA, 16 nt, Escherichia coli CFT073
acgcucaaacagcgua

SEQ ID NO: 2640595 - RNA, 12 nt, Escherichia coli CFT073
acgcucauaaau

SEQ ID NO: 2640596 - RNA, 16 nt, Escherichia coli CFT073
acgcucauaaauugca

SEQ ID NO: 2640597 - RNA, 17 nt, Escherichia coli CFT073
acgcucauuuucuuuca

SEQ ID NO: 2640598 - RNA, 13 nt, Escherichia coli CFT073
acgcuccaccacc

SEQ ID NO: 2640599 - RNA, 14 nt, Escherichia coli CFT073
acgcuccaccaccg

SEQ ID NO: 2640600 - RNA, 23 nt, Escherichia coli CFT073
acgcuccaguaccugcaaaccgu

SEQ ID NO: 2640601 - RNA, 14 nt, Escherichia coli CFT073
acgcuccaugcugc

SEQ ID NO: 2640602 - RNA, 18 nt, Escherichia coli CFT073
acgcuccauugcccgccc

SEQ ID NO: 2640603 - RNA, 15 nt, Escherichia coli CFT073
acgcucccucaauau

SEQ ID NO: 2640604 - RNA, 19 nt, Escherichia coli CFT073
acgcuccgcacuugaguaa

SEQ ID NO: 2640605 - RNA, 18 nt, Escherichia coli CFT073
acggcccguacugaaccc

SEQ ID NO: 2640606 - RNA, 16 nt, Escherichia coli CFT073
acggccgugaacuggc

SEQ ID NO: 2640607 - RNA, 15 nt, Escherichia coli CFT073
acggcgacaagaaua

SEQ ID NO: 2640608 - RNA, 15 nt, Escherichia coli CFT073
acggcgacagcaaaa

SEQ ID NO: 2640609 - RNA, 16 nt, Escherichia coli CFT073
acggcgacgcgcgcgg

SEQ ID NO: 2640610 - RNA, 16 nt, Escherichia coli CFT073
acggcgagccagcgca

SEQ ID NO: 2640611 - RNA, 13 nt, Escherichia coli CFT073
acggcgagcguuc

SEQ ID NO: 2640612 - RNA, 22 nt, Escherichia coli CFT073
acggcgaucguucgccauccgu

SEQ ID NO: 2640613 - RNA, 19 nt, Escherichia coli CFT073
acggcgcacaggcaaucca

SEQ ID NO: 2640614 - RNA, 15 nt, Escherichia coli CFT073
acggcgcaccagaau

SEQ ID NO: 2640615 - RNA, 15 nt, Escherichia coli CFT073
acggcgcguuucauu

SEQ ID NO: 2640616 - RNA, 19 nt, Escherichia coli CFT073
acggcgcuaaaaagcgccg

SEQ ID NO: 2640617 - RNA, 17 nt, Escherichia coli CFT073
acggcgucagccacaac

SEQ ID NO: 2640618 - RNA, 20 nt, Escherichia coli CFT073
acggcgugagaaccgcaccg

SEQ ID NO: 2640619 - RNA, 21 nt, Escherichia coli CFT073
acggcguuaacuuguugcgcc

SEQ ID NO: 2640620 - RNA, 19 nt, Escherichia coli CFT073
acggcguuuccagcucggc

SEQ ID NO: 2640621 - RNA, 20 nt, Escherichia coli CFT073
acggcguuuuuucaucacug

SEQ ID NO: 2640622 - RNA, 13 nt, Escherichia coli CFT073
acggcuaaaaaaa

SEQ ID NO: 2640623 - RNA, 21 nt, Escherichia coli CFT073
acggcuaccguugcggcguca

SEQ ID NO: 2640624 - RNA, 14 nt, Escherichia coli CFT073
acggcuccccgccc

SEQ ID NO: 2640625 - RNA, 22 nt, Escherichia coli CFT073
acggcucgugcgguaucaccac

SEQ ID NO: 2640626 - RNA, 18 nt, Escherichia coli CFT073
acggcugcuucggucagc

SEQ ID NO: 2640627 - RNA, 16 nt, Escherichia coli CFT073
acggcugggaaaucac

SEQ ID NO: 2640628 - RNA, 19 nt, Escherichia coli CFT073
acggcugggaaaucaccac

SEQ ID NO: 2640629 - RNA, 19 nt, Escherichia coli CFT073
acggcugucauccagcagu

SEQ ID NO: 2640630 - RNA, 22 nt, Escherichia coli CFT073
acggcuucugacauagccacuc

SEQ ID NO: 2640631 - RNA, 19 nt, Escherichia coli CFT073
acggcuugcgcgcaaucag

SEQ ID NO: 2640632 - RNA, 20 nt, Escherichia coli CFT073
acggcuugcgcgcaaucagc

SEQ ID NO: 2640633 - RNA, 21 nt, Escherichia coli CFT073
acggcuuguguguaaagauug

SEQ ID NO: 2640634 - RNA, 15 nt, Escherichia coli CFT073
acggcuuucauauaa

SEQ ID NO: 2640635 - RNA, 22 nt, Escherichia coli CFT073
acggcuuuggcgguuuucucuu

SEQ ID NO: 2640636 - RNA, 18 nt, Escherichia coli CFT073
acggcuuugucauuaaau

SEQ ID NO: 2640637 - RNA, 19 nt, Escherichia coli CFT073
acggcuuuuuucauuuccc

SEQ ID NO: 2640638 - RNA, 15 nt, Escherichia coli CFT073
acgggaacagugcuc

SEQ ID NO: 2640639 - RNA, 15 nt, Escherichia coli CFT073
acgggaacagugcuu

SEQ ID NO: 2640640 - RNA, 12 nt, Escherichia coli CFT073
acgggagaucgc

SEQ ID NO: 2640641 - RNA, 14 nt, Escherichia coli CFT073
acgggcaaucucau

SEQ ID NO: 2640642 - RNA, 18 nt, Escherichia coli CFT073
acgggcaguugcgcgcgu

SEQ ID NO: 2640643 - RNA, 15 nt, Escherichia coli CFT073
acgggccauccauca

SEQ ID NO: 2640644 - RNA, 20 nt, Escherichia coli CFT073
acgggcgauggaaccacaug

SEQ ID NO: 2640645 - RNA, 16 nt, Escherichia coli CFT073
acgggcggaggggagg

SEQ ID NO: 2640646 - RNA, 17 nt, Escherichia coli CFT073
acgggcggaggggagga

SEQ ID NO: 2640647 - RNA, 19 nt, Escherichia coli CFT073
acgggcggugcggugccag

SEQ ID NO: 2640648 - RNA, 22 nt, Escherichia coli CFT073
acgggcugaagaaguaaaacag

SEQ ID NO: 2640649 - RNA, 18 nt, Escherichia coli CFT073
acggggacuccacaccgg

SEQ ID NO: 2640650 - RNA, 19 nt, Escherichia coli CFT073
acgggguguguagcgggug

SEQ ID NO: 2640651 - RNA, 23 nt, Escherichia coli CFT073
acgggguugugauuacaggaugc

SEQ ID NO: 2640652 - RNA, 15 nt, Escherichia coli CFT073
acggguaaggcgcga

SEQ ID NO: 2640653 - RNA, 22 nt, Escherichia coli CFT073
acgggugauaggguacgaccca

SEQ ID NO: 2640654 - RNA, 16 nt, Escherichia coli CFT073
acgguaaaauacagga

SEQ ID NO: 2640655 - RNA, 19 nt, Escherichia coli CFT073
acgguaagccgcaaccacc

SEQ ID NO: 2640656 - RNA, 13 nt, Escherichia coli CFT073
acgguaauauuuu

SEQ ID NO: 2640657 - RNA, 22 nt, Escherichia coli CFT073
acgguaccuaccgguggcguga

SEQ ID NO: 2640658 - RNA, 16 nt, Escherichia coli CFT073
acgguacucaucacgu

SEQ ID NO: 2640659 - RNA, 21 nt, Escherichia coli CFT073
acgguacuugcggucaggugc

SEQ ID NO: 2640660 - RNA, 21 nt, Escherichia coli CFT073
acgguaguggcaaccagcagg

SEQ ID NO: 2640661 - RNA, 16 nt, Escherichia coli CFT073
acgguaguugaacucg

SEQ ID NO: 2640662 - RNA, 17 nt, Escherichia coli CFT073
acgguaugacccagcgc

SEQ ID NO: 2640663 - RNA, 21 nt, Escherichia coli CFT073
acgguaugacccagcgcggua

SEQ ID NO: 2640664 - RNA, 15 nt, Escherichia coli CFT073
acgguauuaacucgg

SEQ ID NO: 2640665 - RNA, 20 nt, Escherichia coli CFT073
acggucacggcuguagccag

SEQ ID NO: 2640666 - RNA, 13 nt, Escherichia coli CFT073
acggucagcgcac

SEQ ID NO: 2640667 - RNA, 19 nt, Escherichia coli CFT073
acggucagcgcaccacaca

SEQ ID NO: 2640668 - RNA, 17 nt, Escherichia coli CFT073
acggucaguuuucgccc

SEQ ID NO: 2640669 - RNA, 13 nt, Escherichia coli CFT073
acgguccggcauc

SEQ ID NO: 2640670 - RNA, 16 nt, Escherichia coli CFT073
acggugagacgccaga

SEQ ID NO: 2640671 - RNA, 17 nt, Escherichia coli CFT073
acggugauaaucauccc

SEQ ID NO: 2640672 - RNA, 16 nt, Escherichia coli CFT073
acggugccaugcugag

SEQ ID NO: 2640673 - RNA, 15 nt, Escherichia coli CFT073
acggugguaaagccg

SEQ ID NO: 2640674 - RNA, 19 nt, Escherichia coli CFT073
acgguguaaccaccgcagg

SEQ ID NO: 2640675 - RNA, 15 nt, Escherichia coli CFT073
acgguuaaaaacagc

SEQ ID NO: 2640676 - RNA, 17 nt, Escherichia coli CFT073
acgguuaaaaacagcca

SEQ ID NO: 2640677 - RNA, 21 nt, Escherichia coli CFT073
acgguuaaaaacagccagcag

SEQ ID NO: 2640678 - RNA, 17 nt, Escherichia coli CFT073
acgguuaacgccagcca

SEQ ID NO: 2640679 - RNA, 18 nt, Escherichia coli CFT073
acgguuaacgccagccac

SEQ ID NO: 2640680 - RNA, 16 nt, Escherichia coli CFT073
acgguuagcauauacg

SEQ ID NO: 2640681 - RNA, 22 nt, Escherichia coli CFT073
acgguucauuggguucaucuga

SEQ ID NO: 2640682 - RNA, 17 nt, Escherichia coli CFT073
acgguugagagcaaaca

SEQ ID NO: 2640683 - RNA, 20 nt, Escherichia coli CFT073
acgguugaucucaucuucca

SEQ ID NO: 2640684 - RNA, 16 nt, Escherichia coli CFT073
acgguugaugccguuc

SEQ ID NO: 2640685 - RNA, 17 nt, Escherichia coli CFT073
acgguugaugccguucc

SEQ ID NO: 2640686 - RNA, 17 nt, Escherichia coli CFT073
acgguugcggcuuacca

SEQ ID NO: 2640687 - RNA, 20 nt, Escherichia coli CFT073
acgguuucaaagaaacggaa

SEQ ID NO: 2640688 - RNA, 16 nt, Escherichia coli CFT073
acgguuucaaccagca

SEQ ID NO: 2640689 - RNA, 17 nt, Escherichia coli CFT073
acgguuucaaccagcag

SEQ ID NO: 2640690 - RNA, 18 nt, Escherichia coli CFT073
acgguuuucucgccaccg

SEQ ID NO: 2640691 - RNA, 15 nt, Escherichia coli CFT073
acgguuuuuccagcu

SEQ ID NO: 2640692 - RNA, 16 nt, Escherichia coli CFT073
acguaaaaacccgcuu

SEQ ID NO: 2640693 - RNA, 18 nt, Escherichia coli CFT073
acguaacagagcaucggu

SEQ ID NO: 2640694 - RNA, 19 nt, Escherichia coli CFT073
acguaacaguacaauauua

SEQ ID NO: 2640695 - RNA, 23 nt, Escherichia coli CFT073
acguaaggacggaauuugcugcu

SEQ ID NO: 2640696 - RNA, 21 nt, Escherichia coli CFT073
acguaauuaucaaucuccgcc

SEQ ID NO: 2640697 - RNA, 14 nt, Escherichia coli CFT073
acguaccagaugca

SEQ ID NO: 2640698 - RNA, 18 nt, Escherichia coli CFT073
acguacgcuguucgccag

SEQ ID NO: 2640699 - RNA, 23 nt, Escherichia coli CFT073
acguacggcccauaacccacacc

SEQ ID NO: 2640700 - RNA, 23 nt, Escherichia coli CFT073
acguacggcuucgacaauaacgc

SEQ ID NO: 2640701 - RNA, 14 nt, Escherichia coli CFT073
acguaggccucagg

SEQ ID NO: 2640702 - RNA, 19 nt, Escherichia coli CFT073
acguaggcgaucccagcgc

SEQ ID NO: 2640703 - RNA, 20 nt, Escherichia coli CFT073
acguaguacccucugcacca

SEQ ID NO: 2640704 - RNA, 15 nt, Escherichia coli CFT073
acguauaacucgccu

SEQ ID NO: 2640705 - RNA, 16 nt, Escherichia coli CFT073
acguaucaacaucaca

SEQ ID NO: 2640706 - RNA, 19 nt, Escherichia coli CFT073
acguaucaacaucacacca

SEQ ID NO: 2640707 - RNA, 21 nt, Escherichia coli CFT073
acguaucuuacagagcgauua

SEQ ID NO: 2640708 - RNA, 18 nt, Escherichia coli CFT073
acguauggcgauagccca

SEQ ID NO: 2640709 - RNA, 20 nt, Escherichia coli CFT073
acguauggcgauagcccaga

SEQ ID NO: 2640710 - RNA, 22 nt, Escherichia coli CFT073
acgucacaggccaucacauccu

SEQ ID NO: 2640711 - RNA, 16 nt, Escherichia coli CFT073
acgucacucuuuauga

SEQ ID NO: 2640712 - RNA, 18 nt, Escherichia coli CFT073
acgucacuggugugucau

SEQ ID NO: 2640713 - RNA, 19 nt, Escherichia coli CFT073
acguuuuaagcaaauaauu

SEQ ID NO: 2640714 - RNA, 18 nt, Escherichia coli CFT073
acguuuuccuucaaugau

SEQ ID NO: 2640715 - RNA, 14 nt, Escherichia coli CFT073
acguuuugccaguu

SEQ ID NO: 2640716 - RNA, 12 nt, Escherichia coli CFT073
acguuuugcugg

SEQ ID NO: 2640717 - RNA, 14 nt, Escherichia coli CFT073
acguuuuucaucca

SEQ ID NO: 2640718 - RNA, 19 nt, Escherichia coli CFT073
acguuuuucauccagcggc

SEQ ID NO: 2640719 - RNA, 20 nt, Escherichia coli CFT073
acguuuuucuuccggcagca

SEQ ID NO: 2640720 - RNA, 23 nt, Escherichia coli CFT073
acuaaaacugaagcgcgccuggc

SEQ ID NO: 2640721 - RNA, 16 nt, Escherichia coli CFT073
acuaaaacuuuauuca

SEQ ID NO: 2640722 - RNA, 17 nt, Escherichia coli CFT073
acuaaacccgaccacuu

SEQ ID NO: 2640723 - RNA, 20 nt, Escherichia coli CFT073
acuaaacccgaccacuucca

SEQ ID NO: 2640724 - RNA, 23 nt, Escherichia coli CFT073
acuaaauuuuaagccauuaaauc

SEQ ID NO: 2640725 - RNA, 19 nt, Escherichia coli CFT073
acuaacugacuuucuuuuc

SEQ ID NO: 2640726 - RNA, 12 nt, Escherichia coli CFT073
acuaacuggcaa

SEQ ID NO: 2640727 - RNA, 17 nt, Escherichia coli CFT073
acuaacuguuucgcggc

SEQ ID NO: 2640728 - RNA, 23 nt, Escherichia coli CFT073
acuaacuucugaucuacagccuu

SEQ ID NO: 2640729 - RNA, 15 nt, Escherichia coli CFT073
acuaagcguuuucug

SEQ ID NO: 2640730 - RNA, 19 nt, Escherichia coli CFT073
acuaagcugcgggaaauaa

SEQ ID NO: 2640731 - RNA, 22 nt, Escherichia coli CFT073
acuaagcugcgggaaauaacaa

SEQ ID NO: 2640732 - RNA, 14 nt, Escherichia coli CFT073
acuaauagcaaaau

SEQ ID NO: 2640733 - RNA, 22 nt, Escherichia coli CFT073
acuaaucgggccgacaaaauca

SEQ ID NO: 2640734 - RNA, 14 nt, Escherichia coli CFT073
acuaaugccgccau

SEQ ID NO: 2640735 - RNA, 17 nt, Escherichia coli CFT073
acuaauugagcgugaag

SEQ ID NO: 2640736 - RNA, 24 nt, Escherichia coli CFT073
acuacagaggguuuuuuauacuca

SEQ ID NO: 2640737 - RNA, 21 nt, Escherichia coli CFT073
acuacagcggaacuuuuuuca

SEQ ID NO: 2640738 - RNA, 22 nt, Escherichia coli CFT073
acuaccacguaacgacugacuu

SEQ ID NO: 2640739 - RNA, 15 nt, Escherichia coli CFT073
acuaccagugccaga

SEQ ID NO: 2640740 - RNA, 16 nt, Escherichia coli CFT073
acuaccagugccagaa

SEQ ID NO: 2640741 - RNA, 18 nt, Escherichia coli CFT073
acuaccagugccagaaca

SEQ ID NO: 2640742 - RNA, 20 nt, Escherichia coli CFT073
acuaccagugccagaacaga

SEQ ID NO: 2640743 - RNA, 21 nt, Escherichia coli CFT073
acuaccagugccagaacagaa

SEQ ID NO: 2640744 - RNA, 13 nt, Escherichia coli CFT073
acuaccauaaaaa

SEQ ID NO: 2640745 - RNA, 24 nt, Escherichia coli CFT073
acuaccccaauaauucuuccuuca

SEQ ID NO: 2640746 - RNA, 23 nt, Escherichia coli CFT073
acuacccgcauuuucuucauucg

SEQ ID NO: 2640747 - RNA, 16 nt, Escherichia coli CFT073
acuaccgcccgaugaa

SEQ ID NO: 2640748 - RNA, 14 nt, Escherichia coli CFT073
acuaccggaaccaa

SEQ ID NO: 2640749 - RNA, 17 nt, Escherichia coli CFT073
acuacgccagaaacggg

SEQ ID NO: 2640750 - RNA, 19 nt, Escherichia coli CFT073
acuacgccgcaaaucgccg

SEQ ID NO: 2640751 - RNA, 22 nt, Escherichia coli CFT073
acuacgcugcggcgaaagcggg

SEQ ID NO: 2640752 - RNA, 19 nt, Escherichia coli CFT073
acuacgcuguagccgccau

SEQ ID NO: 2640753 - RNA, 16 nt, Escherichia coli CFT073
acuacggagauuaaac

SEQ ID NO: 2640754 - RNA, 18 nt, Escherichia coli CFT073
acuacggcucagcaauau

SEQ ID NO: 2640755 - RNA, 15 nt, Escherichia coli CFT073
acuacggcuuuuuuc

SEQ ID NO: 2640756 - RNA, 22 nt, Escherichia coli CFT073
acuacggcuuuuuucauuuccc

SEQ ID NO: 2640757 - RNA, 15 nt, Escherichia coli CFT073
acuacgugaucgucu

SEQ ID NO: 2640758 - RNA, 15 nt, Escherichia coli CFT073
acuacugacuccagg

SEQ ID NO: 2640759 - RNA, 22 nt, Escherichia coli CFT073
acuacuggagacagauuuauaa

SEQ ID NO: 2640760 - RNA, 16 nt, Escherichia coli CFT073
acuagcgcuuuuucug

SEQ ID NO: 2640761 - RNA, 16 nt, Escherichia coli CFT073
acuaguagcaugaagu

SEQ ID NO: 2640762 - RNA, 15 nt, Escherichia coli CFT073
acuagucccuccgca

SEQ ID NO: 2640763 - RNA, 18 nt, Escherichia coli CFT073
acuagucccuccgcacaa

SEQ ID NO: 2640764 - RNA, 13 nt, Escherichia coli CFT073
acuauaucccuca

SEQ ID NO: 2640765 - RNA, 16 nt, Escherichia coli CFT073
acuaucaaccacggca

SEQ ID NO: 2640766 - RNA, 20 nt, Escherichia coli CFT073
acuaucaaccucuuuuucug

SEQ ID NO: 2640767 - RNA, 22 nt, Escherichia coli CFT073
acuaucacucccucauuuucaa

SEQ ID NO: 2640768 - RNA, 18 nt, Escherichia coli CFT073
acuaucaggucuuucuga

SEQ ID NO: 2640769 - RNA, 21 nt, Escherichia coli CFT073
acuauccugaaagcugagaaa

SEQ ID NO: 2640770 - RNA, 17 nt, Escherichia coli CFT073
acuauccuggacuuuaa

SEQ ID NO: 2640771 - RNA, 18 nt, Escherichia coli CFT073
acuaucgccgagauacuc

SEQ ID NO: 2640772 - RNA, 16 nt, Escherichia coli CFT073
acuaucugaaaaugaa

SEQ ID NO: 2640773 - RNA, 13 nt, Escherichia coli CFT073
acuaucugauaau

SEQ ID NO: 2640774 - RNA, 16 nt, Escherichia coli CFT073
acuaucuucaaagcca

SEQ ID NO: 2640775 - RNA, 19 nt, Escherichia coli CFT073
acuauggauauaauuuuuu

SEQ ID NO: 2640776 - RNA, 16 nt, Escherichia coli CFT073
acuauuaaagaaagua

SEQ ID NO: 2640777 - RNA, 18 nt, Escherichia coli CFT073
acuauuaaagaaaguaau

SEQ ID NO: 2640778 - RNA, 17 nt, Escherichia coli CFT073
acuauuaauauauauua

SEQ ID NO: 2640779 - RNA, 11 nt, Escherichia coli CFT073
acuauuacuga

SEQ ID NO: 2640780 - RNA, 15 nt, Escherichia coli CFT073
acuauuacugaccuc

SEQ ID NO: 2640781 - RNA, 12 nt, Escherichia coli CFT073
acuauugaagcc

SEQ ID NO: 2640782 - RNA, 14 nt, Escherichia coli CFT073
acuauuguauacca

SEQ ID NO: 2640783 - RNA, 19 nt, Escherichia coli CFT073
acuauuucaaacacgaugc

SEQ ID NO: 2640784 - RNA, 18 nt, Escherichia coli CFT073
acucaaaaauaaucaucu

SEQ ID NO: 2640785 - RNA, 13 nt, Escherichia coli CFT073
acucaaaaugccg

SEQ ID NO: 2640786 - RNA, 17 nt, Escherichia coli CFT073
acucaacagccagaagg

SEQ ID NO: 2640787 - RNA, 15 nt, Escherichia coli CFT073
acucaacgguccaau

SEQ ID NO: 2640788 - RNA, 15 nt, Escherichia coli CFT073
acucaacguggacau

SEQ ID NO: 2640789 - RNA, 17 nt, Escherichia coli CFT073
acucaacuuauugauca

SEQ ID NO: 2640790 - RNA, 22 nt, Escherichia coli CFT073
acucaacuuauugaucaucccg

SEQ ID NO: 2640791 - RNA, 19 nt, Escherichia coli CFT073
acucaagagucggaagauu

SEQ ID NO: 2640792 - RNA, 13 nt, Escherichia coli CFT073
acucaaugacuuc

SEQ ID NO: 2640793 - RNA, 18 nt, Escherichia coli CFT073
acucaaugccagcgacug

SEQ ID NO: 2640794 - RNA, 13 nt, Escherichia coli CFT073
acucacacaaaua

SEQ ID NO: 2640795 - RNA, 23 nt, Escherichia coli CFT073
acucacacagcuuucucaaaaua

SEQ ID NO: 2640796 - RNA, 21 nt, Escherichia coli CFT073
acucacaucaacaacgaaaau

SEQ ID NO: 2640797 - RNA, 12 nt, Escherichia coli CFT073
acucaccaaucg

SEQ ID NO: 2640798 - RNA, 17 nt, Escherichia coli CFT073
acucaccacggugauuc

SEQ ID NO: 2640799 - RNA, 13 nt, Escherichia coli CFT073
acucaccagcauc

SEQ ID NO: 2640800 - RNA, 13 nt, Escherichia coli CFT073
acucaccauccug

SEQ ID NO: 2640801 - RNA, 17 nt, Escherichia coli CFT073
acucaccgagcagcaca

SEQ ID NO: 2640802 - RNA, 20 nt, Escherichia coli CFT073
acucaccgagcagcacaaug

SEQ ID NO: 2640803 - RNA, 22 nt, Escherichia coli CFT073
acucaccgaugaucgccaucag

SEQ ID NO: 2640804 - RNA, 14 nt, Escherichia coli CFT073
acucaccugauuac

SEQ ID NO: 2640805 - RNA, 16 nt, Escherichia coli CFT073
acucaccugauuaccu

SEQ ID NO: 2640806 - RNA, 16 nt, Escherichia coli CFT073
acucaccuggcugaug

SEQ ID NO: 2640807 - RNA, 13 nt, Escherichia coli CFT073
acucaccuuuaaa

SEQ ID NO: 2640808 - RNA, 16 nt, Escherichia coli CFT073
acucacgaaucgccuc

SEQ ID NO: 2640809 - RNA, 17 nt, Escherichia coli CFT073
acucacgaaucgccuca

SEQ ID NO: 2640810 - RNA, 16 nt, Escherichia coli CFT073
acucacgauuguuaau

SEQ ID NO: 2640811 - RNA, 22 nt, Escherichia coli CFT073
acucacgcagauacuggaaaau

SEQ ID NO: 2640812 - RNA, 12 nt, Escherichia coli CFT073
acucacgcugcg

SEQ ID NO: 2640813 - RNA, 19 nt, Escherichia coli CFT073
acucacuaccagugccaga

SEQ ID NO: 2640814 - RNA, 20 nt, Escherichia coli CFT073
acucacuaccagugccagaa

SEQ ID NO: 2640815 - RNA, 14 nt, Escherichia coli CFT073
acucacuggcgcgc

SEQ ID NO: 2640816 - RNA, 16 nt, Escherichia coli CFT073
acucacuguaucaggu

SEQ ID NO: 2640817 - RNA, 18 nt, Escherichia coli CFT073
acucagcacaaccaccug

SEQ ID NO: 2640818 - RNA, 22 nt, Escherichia coli CFT073
acucagccaaaucccgugaugc

SEQ ID NO: 2640819 - RNA, 16 nt, Escherichia coli CFT073
acucagcgccugcugc

SEQ ID NO: 2640820 - RNA, 15 nt, Escherichia coli CFT073
acucaggaacaucag

SEQ ID NO: 2640821 - RNA, 20 nt, Escherichia coli CFT073
acucuugccagauuuucuuc

SEQ ID NO: 2640822 - RNA, 17 nt, Escherichia coli CFT073
acucuuggcaccgccuu

SEQ ID NO: 2640823 - RNA, 12 nt, Escherichia coli CFT073
acucuuucccgg

SEQ ID NO: 2640824 - RNA, 14 nt, Escherichia coli CFT073
acucuuucccggca

SEQ ID NO: 2640825 - RNA, 20 nt, Escherichia coli CFT073
acucuuucccggcaaucacc

SEQ ID NO: 2640826 - RNA, 15 nt, Escherichia coli CFT073
acucuuucugacgaa

SEQ ID NO: 2640827 - RNA, 21 nt, Escherichia coli CFT073
acucuuugggcagaaaaucca

SEQ ID NO: 2640828 - RNA, 17 nt, Escherichia coli CFT073
acugaacccggguaggc

SEQ ID NO: 2640829 - RNA, 20 nt, Escherichia coli CFT073
acugaagacucaacuuuaaa

SEQ ID NO: 2640830 - RNA, 22 nt, Escherichia coli CFT073
acugaagauugaacagcagaac

SEQ ID NO: 2640831 - RNA, 14 nt, Escherichia coli CFT073
acugaagcgcgccu

SEQ ID NO: 2640832 - RNA, 14 nt, Escherichia coli CFT073
acugaagucggcuu

SEQ ID NO: 2640833 - RNA, 14 nt, Escherichia coli CFT073
acugaauaaacagc

SEQ ID NO: 2640834 - RNA, 18 nt, Escherichia coli CFT073
acugaauaaacagcagau

SEQ ID NO: 2640835 - RNA, 12 nt, Escherichia coli CFT073
acugaauaauac

SEQ ID NO: 2640836 - RNA, 16 nt, Escherichia coli CFT073
acugaauaauacacac

SEQ ID NO: 2640837 - RNA, 20 nt, Escherichia coli CFT073
acugaauaccguaaaacuca

SEQ ID NO: 2640838 - RNA, 20 nt, Escherichia coli CFT073
acugaauggcgacguaccag

SEQ ID NO: 2640839 - RNA, 23 nt, Escherichia coli CFT073
acugaauggcgacguaccagcgu

SEQ ID NO: 2640840 - RNA, 14 nt, Escherichia coli CFT073
acugacaaaaccga

SEQ ID NO: 2640841 - RNA, 14 nt, Escherichia coli CFT073
acugacagacugcu

SEQ ID NO: 2640842 - RNA, 23 nt, Escherichia coli CFT073
acugacaucaaacccuucccggg

SEQ ID NO: 2640843 - RNA, 11 nt, Escherichia coli CFT073
acugacaucac

SEQ ID NO: 2640844 - RNA, 14 nt, Escherichia coli CFT073
acugaccaccacca

SEQ ID NO: 2640845 - RNA, 15 nt, Escherichia coli CFT073
acugaccaccaccac

SEQ ID NO: 2640846 - RNA, 18 nt, Escherichia coli CFT073
acugacgcgcuuuucacc

SEQ ID NO: 2640847 - RNA, 23 nt, Escherichia coli CFT073
acugacgcgcuuuucaccgacga

SEQ ID NO: 2640848 - RNA, 12 nt, Escherichia coli CFT073
acugacgcucug

SEQ ID NO: 2640849 - RNA, 14 nt, Escherichia coli CFT073
acugacgcucugcu

SEQ ID NO: 2640850 - RNA, 20 nt, Escherichia coli CFT073
acugacgggaaacucugcug

SEQ ID NO: 2640851 - RNA, 22 nt, Escherichia coli CFT073
acugacggucgguaaacccggc

SEQ ID NO: 2640852 - RNA, 20 nt, Escherichia coli CFT073
acugacgucacgcaccaacu

SEQ ID NO: 2640853 - RNA, 23 nt, Escherichia coli CFT073
acugacguuaagaucaaaccuca

SEQ ID NO: 2640854 - RNA, 18 nt, Escherichia coli CFT073
acugagaaccuuuaucac

SEQ ID NO: 2640855 - RNA, 22 nt, Escherichia coli CFT073
acugagaucugaccuauuucau

SEQ ID NO: 2640856 - RNA, 23 nt, Escherichia coli CFT073
acugagaucugaccuauuucauu

SEQ ID NO: 2640857 - RNA, 17 nt, Escherichia coli CFT073
acugagcgugagugcga

SEQ ID NO: 2640858 - RNA, 18 nt, Escherichia coli CFT073
acugaguaauagccugau

SEQ ID NO: 2640859 - RNA, 19 nt, Escherichia coli CFT073
acugaguaauagccugaug

SEQ ID NO: 2640860 - RNA, 19 nt, Escherichia coli CFT073
acugaguuacguccaugua

SEQ ID NO: 2640861 - RNA, 23 nt, Escherichia coli CFT073
acugaguuuuauucuuuuuugau

SEQ ID NO: 2640862 - RNA, 14 nt, Escherichia coli CFT073
acugauaacuuuuu

SEQ ID NO: 2640863 - RNA, 23 nt, Escherichia coli CFT073
acugauaacuuuuuauccgguaa

SEQ ID NO: 2640864 - RNA, 23 nt, Escherichia coli CFT073
acugauaauaaauaacagugccg

SEQ ID NO: 2640865 - RNA, 18 nt, Escherichia coli CFT073
acugauaaucccggcggc

SEQ ID NO: 2640866 - RNA, 19 nt, Escherichia coli CFT073
acugauagcggcggauuuc

SEQ ID NO: 2640867 - RNA, 21 nt, Escherichia coli CFT073
acugauaucuaacagugccug

SEQ ID NO: 2640868 - RNA, 14 nt, Escherichia coli CFT073
acugaucaauaaau

SEQ ID NO: 2640869 - RNA, 16 nt, Escherichia coli CFT073
acugaucaauaucagc

SEQ ID NO: 2640870 - RNA, 15 nt, Escherichia coli CFT073
acugaucaccugcga

SEQ ID NO: 2640871 - RNA, 22 nt, Escherichia coli CFT073
acugaucaccugcgauaaaccg

SEQ ID NO: 2640872 - RNA, 12 nt, Escherichia coli CFT073
acugaucaucau

SEQ ID NO: 2640873 - RNA, 14 nt, Escherichia coli CFT073
acugauccugacaa

SEQ ID NO: 2640874 - RNA, 22 nt, Escherichia coli CFT073
acugaucuuuaucaagcaccaa

SEQ ID NO: 2640875 - RNA, 14 nt, Escherichia coli CFT073
acugaugacaaacg

SEQ ID NO: 2640876 - RNA, 15 nt, Escherichia coli CFT073
acugaugacaaacgc

SEQ ID NO: 2640877 - RNA, 15 nt, Escherichia coli CFT073
acugaugacaaaguc

SEQ ID NO: 2640878 - RNA, 20 nt, Escherichia coli CFT073
acugaugauaaguucaaguu

SEQ ID NO: 2640879 - RNA, 16 nt, Escherichia coli CFT073
acugauggcccaucgu

SEQ ID NO: 2640880 - RNA, 19 nt, Escherichia coli CFT073
acugaugugucccuuuacu

SEQ ID NO: 2640881 - RNA, 15 nt, Escherichia coli CFT073
acugauuacccuucg

SEQ ID NO: 2640882 - RNA, 20 nt, Escherichia coli CFT073
acugauuguacuguuacuca

SEQ ID NO: 2640883 - RNA, 22 nt, Escherichia coli CFT073
acugauuuguaugguuuuguag

SEQ ID NO: 2640884 - RNA, 23 nt, Escherichia coli CFT073
acugauuuguaugguuuuguagg

SEQ ID NO: 2640885 - RNA, 15 nt, Escherichia coli CFT073
acugcaacucaccuu

SEQ ID NO: 2640886 - RNA, 13 nt, Escherichia coli CFT073
acugcaacugugc

SEQ ID NO: 2640887 - RNA, 16 nt, Escherichia coli CFT073
acugcacaccgcggaa

SEQ ID NO: 2640888 - RNA, 20 nt, Escherichia coli CFT073
acugcacaguguuuguugaa

SEQ ID NO: 2640889 - RNA, 21 nt, Escherichia coli CFT073
acugcacgaugccucaucaca

SEQ ID NO: 2640890 - RNA, 21 nt, Escherichia coli CFT073
acugcagccagcguuacccag

SEQ ID NO: 2640891 - RNA, 23 nt, Escherichia coli CFT073
acugcauggccagacauuacaaa

SEQ ID NO: 2640892 - RNA, 15 nt, Escherichia coli CFT073
acugcauggcggcgu

SEQ ID NO: 2640893 - RNA, 17 nt, Escherichia coli CFT073
acugcauucggcgacca

SEQ ID NO: 2640894 - RNA, 16 nt, Escherichia coli CFT073
acugccacuuuuuccc

SEQ ID NO: 2640895 - RNA, 21 nt, Escherichia coli CFT073
acugccagaauagccgcagcu

SEQ ID NO: 2640896 - RNA, 15 nt, Escherichia coli CFT073
acugccccgccagug

SEQ ID NO: 2640897 - RNA, 15 nt, Escherichia coli CFT073
acugccgaccagaau

SEQ ID NO: 2640898 - RNA, 19 nt, Escherichia coli CFT073
acugccgaccaucuguucu

SEQ ID NO: 2640899 - RNA, 19 nt, Escherichia coli CFT073
acugccgagaaugacgaca

SEQ ID NO: 2640900 - RNA, 23 nt, Escherichia coli CFT073
acugccgcgauggguuguugagg

SEQ ID NO: 2640901 - RNA, 16 nt, Escherichia coli CFT073
acugccggacguucgc

SEQ ID NO: 2640902 - RNA, 23 nt, Escherichia coli CFT073
acugccgucgagaaucaacacac

SEQ ID NO: 2640903 - RNA, 18 nt, Escherichia coli CFT073
acugccuccugcaaaugc

SEQ ID NO: 2640904 - RNA, 18 nt, Escherichia coli CFT073
acugccuuaaacuccaua

SEQ ID NO: 2640905 - RNA, 15 nt, Escherichia coli CFT073
acugccuugcgauau

SEQ ID NO: 2640906 - RNA, 14 nt, Escherichia coli CFT073
acugccuuuaucaa

SEQ ID NO: 2640907 - RNA, 18 nt, Escherichia coli CFT073
acugcgaauuuccugcca

SEQ ID NO: 2640908 - RNA, 23 nt, Escherichia coli CFT073
acugcgaauuuccugccagaccu

SEQ ID NO: 2640909 - RNA, 18 nt, Escherichia coli CFT073
acugcgacaccagcaugu

SEQ ID NO: 2640910 - RNA, 15 nt, Escherichia coli CFT073
acugcgaccagggau

SEQ ID NO: 2640911 - RNA, 18 nt, Escherichia coli CFT073
acugcgaccagugaaaau

SEQ ID NO: 2640912 - RNA, 14 nt, Escherichia coli CFT073
acugcgaccguaca

SEQ ID NO: 2640913 - RNA, 19 nt, Escherichia coli CFT073
acugcgaccguacaaccaa

SEQ ID NO: 2640914 - RNA, 13 nt, Escherichia coli CFT073
acugcgcauggaa

SEQ ID NO: 2640915 - RNA, 15 nt, Escherichia coli CFT073
acugcgcauuaaaua

SEQ ID NO: 2640916 - RNA, 19 nt, Escherichia coli CFT073
acugcgccaacgucugccu

SEQ ID NO: 2640917 - RNA, 15 nt, Escherichia coli CFT073
acugcgccacucgau

SEQ ID NO: 2640918 - RNA, 13 nt, Escherichia coli CFT073
acugcgccagacc

SEQ ID NO: 2640919 - RNA, 16 nt, Escherichia coli CFT073
acugcgcccgccagca

SEQ ID NO: 2640920 - RNA, 13 nt, Escherichia coli CFT073
acugcgccguguc

SEQ ID NO: 2640921 - RNA, 22 nt, Escherichia coli CFT073
acugcgcgagcgucauauagcc

SEQ ID NO: 2640922 - RNA, 20 nt, Escherichia coli CFT073
acugcgcguggucagcacaa

SEQ ID NO: 2640923 - RNA, 20 nt, Escherichia coli CFT073
acugcgcuauaucgcugaua

SEQ ID NO: 2640924 - RNA, 22 nt, Escherichia coli CFT073
acugcgcucuaaaaucaucacg

SEQ ID NO: 2640925 - RNA, 15 nt, Escherichia coli CFT073
acugcgcucuucugg

SEQ ID NO: 2640926 - RNA, 19 nt, Escherichia coli CFT073
acugcgcuucaauacgcuc

SEQ ID NO: 2640927 - RNA, 15 nt, Escherichia coli CFT073
acugcggauaaacau

SEQ ID NO: 2640928 - RNA, 14 nt, Escherichia coli CFT073
acugcggcagguug

SEQ ID NO: 2640929 - RNA, 16 nt, Escherichia coli CFT073
acuuauaagucucaga

SEQ ID NO: 2640930 - RNA, 12 nt, Escherichia coli CFT073
acuuauauguug

SEQ ID NO: 2640931 - RNA, 13 nt, Escherichia coli CFT073
acuuaucggaaca

SEQ ID NO: 2640932 - RNA, 15 nt, Escherichia coli CFT073
acuuaucuuauuccc

SEQ ID NO: 2640933 - RNA, 19 nt, Escherichia coli CFT073
acuuaugcccgcuauccuc

SEQ ID NO: 2640934 - RNA, 13 nt, Escherichia coli CFT073
acuuauucaccac

SEQ ID NO: 2640935 - RNA, 18 nt, Escherichia coli CFT073
acuuauugaaagcaaaaa

SEQ ID NO: 2640936 - RNA, 23 nt, Escherichia coli CFT073
acuucaaaaauaaguugccacgc

SEQ ID NO: 2640937 - RNA, 13 nt, Escherichia coli CFT073
acuucaaccacau

SEQ ID NO: 2640938 - RNA, 14 nt, Escherichia coli CFT073
acuucaaccacauu

SEQ ID NO: 2640939 - RNA, 13 nt, Escherichia coli CFT073
acuucaaccagcg

SEQ ID NO: 2640940 - RNA, 14 nt, Escherichia coli CFT073
acuucaaccagcgg

SEQ ID NO: 2640941 - RNA, 18 nt, Escherichia coli CFT073
acuucaaccagcggcgca

SEQ ID NO: 2640942 - RNA, 21 nt, Escherichia coli CFT073
acuucaaccagcggcgcaucc

SEQ ID NO: 2640943 - RNA, 14 nt, Escherichia coli CFT073
acuucaacgcugcg

SEQ ID NO: 2640944 - RNA, 13 nt, Escherichia coli CFT073
acuucaaucgcca

SEQ ID NO: 2640945 - RNA, 12 nt, Escherichia coli CFT073
acuucacauacu

SEQ ID NO: 2640946 - RNA, 18 nt, Escherichia coli CFT073
acuucacaucauccggca

SEQ ID NO: 2640947 - RNA, 16 nt, Escherichia coli CFT073
acuucacaugauaaua

SEQ ID NO: 2640948 - RNA, 17 nt, Escherichia coli CFT073
acuucacccaucgccag

SEQ ID NO: 2640949 - RNA, 15 nt, Escherichia coli CFT073
acuucacgcugccag

SEQ ID NO: 2640950 - RNA, 23 nt, Escherichia coli CFT073
acuucacggcugcuaauauuuuc

SEQ ID NO: 2640951 - RNA, 12 nt, Escherichia coli CFT073
acuucagcagca

SEQ ID NO: 2640952 - RNA, 15 nt, Escherichia coli CFT073
acuucagguucagca

SEQ ID NO: 2640953 - RNA, 16 nt, Escherichia coli CFT073
acuucauacauugcca

SEQ ID NO: 2640954 - RNA, 18 nt, Escherichia coli CFT073
acuucauccgacaccagc

SEQ ID NO: 2640955 - RNA, 20 nt, Escherichia coli CFT073
acuucauccgacaccagccg

SEQ ID NO: 2640956 - RNA, 15 nt, Escherichia coli CFT073
acuucauccggauac

SEQ ID NO: 2640957 - RNA, 22 nt, Escherichia coli CFT073
acuucauccggauacagcccca

SEQ ID NO: 2640958 - RNA, 19 nt, Escherichia coli CFT073
acuucaucggaaugcacag

SEQ ID NO: 2640959 - RNA, 21 nt, Escherichia coli CFT073
acuucaucggaaugcacagcc

SEQ ID NO: 2640960 - RNA, 16 nt, Escherichia coli CFT073
acuucaucggcaaagg

SEQ ID NO: 2640961 - RNA, 11 nt, Escherichia coli CFT073
acuucaugacc

SEQ ID NO: 2640962 - RNA, 19 nt, Escherichia coli CFT073
acuucaugaccuuccagcg

SEQ ID NO: 2640963 - RNA, 22 nt, Escherichia coli CFT073
acuucaugaccuuccagcgcug

SEQ ID NO: 2640964 - RNA, 20 nt, Escherichia coli CFT073
acuucauuaucuucuuucuc

SEQ ID NO: 2640965 - RNA, 17 nt, Escherichia coli CFT073
acuucauucagaaaaac

SEQ ID NO: 2640966 - RNA, 18 nt, Escherichia coli CFT073
acuucauucagaaaaacu

SEQ ID NO: 2640967 - RNA, 22 nt, Escherichia coli CFT073
acuucauuugucucaaaacuga

SEQ ID NO: 2640968 - RNA, 23 nt, Escherichia coli CFT073
acuucauuugucucaaaacugaa

SEQ ID NO: 2640969 - RNA, 13 nt, Escherichia coli CFT073
acuuccaacgaac

SEQ ID NO: 2640970 - RNA, 22 nt, Escherichia coli CFT073
acuuccaacgaacguuccccgc

SEQ ID NO: 2640971 - RNA, 14 nt, Escherichia coli CFT073
acuuccaccacuuc

SEQ ID NO: 2640972 - RNA, 14 nt, Escherichia coli CFT073
acuuccaccagcgg

SEQ ID NO: 2640973 - RNA, 22 nt, Escherichia coli CFT073
acuuccagaauauguucgcuua

SEQ ID NO: 2640974 - RNA, 20 nt, Escherichia coli CFT073
acuuccagcaguucgcccgc

SEQ ID NO: 2640975 - RNA, 23 nt, Escherichia coli CFT073
acuuccagcguagugaaggcaaa

SEQ ID NO: 2640976 - RNA, 13 nt, Escherichia coli CFT073
acuuccagcuuca

SEQ ID NO: 2640977 - RNA, 21 nt, Escherichia coli CFT073
acuuccauacggcguuaacuu

SEQ ID NO: 2640978 - RNA, 16 nt, Escherichia coli CFT073
acuuccauuccaccau

SEQ ID NO: 2640979 - RNA, 20 nt, Escherichia coli CFT073
acuucccccugagcgguggc

SEQ ID NO: 2640980 - RNA, 13 nt, Escherichia coli CFT073
acuuccccugcca

SEQ ID NO: 2640981 - RNA, 18 nt, Escherichia coli CFT073
acuucccgcugugguuca

SEQ ID NO: 2640982 - RNA, 15 nt, Escherichia coli CFT073
acuuccgauccagac

SEQ ID NO: 2640983 - RNA, 18 nt, Escherichia coli CFT073
acuuccgcgucaaucugc

SEQ ID NO: 2640984 - RNA, 20 nt, Escherichia coli CFT073
acuuccgcgucaaucugccc

SEQ ID NO: 2640985 - RNA, 19 nt, Escherichia coli CFT073
acuuccggacguucagcca

SEQ ID NO: 2640986 - RNA, 17 nt, Escherichia coli CFT073
acuuccugaaucacaau

SEQ ID NO: 2640987 - RNA, 18 nt, Escherichia coli CFT073
acuuccugcgccagcguu

SEQ ID NO: 2640988 - RNA, 19 nt, Escherichia coli CFT073
acuuccugcgccagcguuu

SEQ ID NO: 2640989 - RNA, 21 nt, Escherichia coli CFT073
acuuccugcggagcaaccugc

SEQ ID NO: 2640990 - RNA, 13 nt, Escherichia coli CFT073
acuuccugcucgg

SEQ ID NO: 2640991 - RNA, 16 nt, Escherichia coli CFT073
acuuccugcucuuucg

SEQ ID NO: 2640992 - RNA, 15 nt, Escherichia coli CFT073
acuuccugucuuccc

SEQ ID NO: 2640993 - RNA, 15 nt, Escherichia coli CFT073
acuuccuucgccgcu

SEQ ID NO: 2640994 - RNA, 20 nt, Escherichia coli CFT073
acuuccuucgccgcuuuaau

SEQ ID NO: 2640995 - RNA, 12 nt, Escherichia coli CFT073
acuuccuuuaga

SEQ ID NO: 2640996 - RNA, 17 nt, Escherichia coli CFT073
acuucgaguacauccac

SEQ ID NO: 2640997 - RNA, 17 nt, Escherichia coli CFT073
acuucgauccagugauu

SEQ ID NO: 2640998 - RNA, 18 nt, Escherichia coli CFT073
acuucgauguccgcucca

SEQ ID NO: 2640999 - RNA, 16 nt, Escherichia coli CFT073
acuucgccacagcggc

SEQ ID NO: 2641000 - RNA, 17 nt, Escherichia coli CFT073
acuucgccacagcggca

SEQ ID NO: 2641001 - RNA, 23 nt, Escherichia coli CFT073
acuucgccagacguugauaacca

SEQ ID NO: 2641002 - RNA, 22 nt, Escherichia coli CFT073
acuucgccagcgugacuauuaa

SEQ ID NO: 2641003 - RNA, 21 nt, Escherichia coli CFT073
acuucgccggaauuucuuuca

SEQ ID NO: 2641004 - RNA, 23 nt, Escherichia coli CFT073
acuucgccggaauuucuuucagc

SEQ ID NO: 2641005 - RNA, 23 nt, Escherichia coli CFT073
acuucgcguucuguggcagggca

SEQ ID NO: 2641006 - RNA, 18 nt, Escherichia coli CFT073
acuucgcucuuaucacca

SEQ ID NO: 2641007 - RNA, 16 nt, Escherichia coli CFT073
acuucgcugacgccug

SEQ ID NO: 2641008 - RNA, 18 nt, Escherichia coli CFT073
acuucgcugguguacugc

SEQ ID NO: 2641009 - RNA, 13 nt, Escherichia coli CFT073
acuucggcaucaa

SEQ ID NO: 2641010 - RNA, 15 nt, Escherichia coli CFT073
acuucgguuaccaca

SEQ ID NO: 2641011 - RNA, 19 nt, Escherichia coli CFT073
acuucgucaacugacgcag

SEQ ID NO: 2641012 - RNA, 15 nt, Escherichia coli CFT073
acuucuauucaccag

SEQ ID NO: 2641013 - RNA, 23 nt, Escherichia coli CFT073
acuucucuucuuccgcuucaauc

SEQ ID NO: 2641014 - RNA, 15 nt, Escherichia coli CFT073
acuucugaugcaggu

SEQ ID NO: 2641015 - RNA, 22 nt, Escherichia coli CFT073
acuucugcugugacuucagcga

SEQ ID NO: 2641016 - RNA, 17 nt, Escherichia coli CFT073
acuucuguuugcgccac

SEQ ID NO: 2641017 - RNA, 20 nt, Escherichia coli CFT073
acuucuuaaugcccaucucu

SEQ ID NO: 2641018 - RNA, 22 nt, Escherichia coli CFT073
acuucuuagucccaaacagcag

SEQ ID NO: 2641019 - RNA, 15 nt, Escherichia coli CFT073
acuucuucacaucaa

SEQ ID NO: 2641020 - RNA, 16 nt, Escherichia coli CFT073
acuucuucacaucaau

SEQ ID NO: 2641021 - RNA, 15 nt, Escherichia coli CFT073
acuucuucauucauc

SEQ ID NO: 2641022 - RNA, 15 nt, Escherichia coli CFT073
acuucuuccagcggc

SEQ ID NO: 2641023 - RNA, 18 nt, Escherichia coli CFT073
acuucuucguuuucugcg

SEQ ID NO: 2641024 - RNA, 14 nt, Escherichia coli CFT073
acuucuucuguuuc

SEQ ID NO: 2641025 - RNA, 16 nt, Escherichia coli CFT073
acuucuucuguuucug

SEQ ID NO: 2641026 - RNA, 14 nt, Escherichia coli CFT073
acuucuucuucgcu

SEQ ID NO: 2641027 - RNA, 20 nt, Escherichia coli CFT073
acuucuuucgcccagcguug

SEQ ID NO: 2641028 - RNA, 20 nt, Escherichia coli CFT073
acuucuuuugucgcuuuaac

SEQ ID NO: 2641029 - RNA, 24 nt, Escherichia coli CFT073
acuugacuaagcguuuucugccag

SEQ ID NO: 2641030 - RNA, 16 nt, Escherichia coli CFT073
acuugagccgccacca

SEQ ID NO: 2641031 - RNA, 17 nt, Escherichia coli CFT073
acuugagguaaucacuc

SEQ ID NO: 2641032 - RNA, 21 nt, Escherichia coli CFT073
acuugcaagaucgcgcaucag

SEQ ID NO: 2641033 - RNA, 17 nt, Escherichia coli CFT073
acuugcaggaacaaugc

SEQ ID NO: 2641034 - RNA, 22 nt, Escherichia coli CFT073
acuugcaggaacaaugccucgc

SEQ ID NO: 2641035 - RNA, 12 nt, Escherichia coli CFT073
acuugccaggcc

SEQ ID NO: 2641036 - RNA, 22 nt, Escherichia coli CFT073
acuugccggagauucaaagacu

SEQ ID NO: 2641037 - RNA, 15 nt, Escherichia coli CFT073
agaaaguuuuucaac

SEQ ID NO: 2641038 - RNA, 22 nt, Escherichia coli CFT073
agaaaguuuuucaacaccguga

SEQ ID NO: 2641039 - RNA, 15 nt, Escherichia coli CFT073
agaaauaccccgcca

SEQ ID NO: 2641040 - RNA, 19 nt, Escherichia coli CFT073
agaaauacgcccugaccgu

SEQ ID NO: 2641041 - RNA, 18 nt, Escherichia coli CFT073
agaaauagaccggagaaa

SEQ ID NO: 2641042 - RNA, 18 nt, Escherichia coli CFT073
agaaauagcggaaagcgu

SEQ ID NO: 2641043 - RNA, 15 nt, Escherichia coli CFT073
agaaauaucagcagc

SEQ ID NO: 2641044 - RNA, 19 nt, Escherichia coli CFT073
agaaauaucagcagcacaa

SEQ ID NO: 2641045 - RNA, 14 nt, Escherichia coli CFT073
agaaaucaacaaau

SEQ ID NO: 2641046 - RNA, 9 nt, Escherichia coli CFT073
agaaaucag

SEQ ID NO: 2641047 - RNA, 23 nt, Escherichia coli CFT073
agaaaucagacuuugaauaaagc

SEQ ID NO: 2641048 - RNA, 15 nt, Escherichia coli CFT073
agaaaucagauaaaa

SEQ ID NO: 2641049 - RNA, 15 nt, Escherichia coli CFT073
agaaaucagcaggcu

SEQ ID NO: 2641050 - RNA, 19 nt, Escherichia coli CFT073
agaaauccggggcaauuuc

SEQ ID NO: 2641051 - RNA, 20 nt, Escherichia coli CFT073
agaaauccggggcaauuuca

SEQ ID NO: 2641052 - RNA, 22 nt, Escherichia coli CFT073
agaaauccggggcaauuucagu

SEQ ID NO: 2641053 - RNA, 17 nt, Escherichia coli CFT073
agaaaucuaucgccggu

SEQ ID NO: 2641054 - RNA, 18 nt, Escherichia coli CFT073
agaaaucucuuccagcga

SEQ ID NO: 2641055 - RNA, 13 nt, Escherichia coli CFT073
agaaaugaugggg

SEQ ID NO: 2641056 - RNA, 14 nt, Escherichia coli CFT073
agaaaugccaguaa

SEQ ID NO: 2641057 - RNA, 15 nt, Escherichia coli CFT073
agaaauggcuggcag

SEQ ID NO: 2641058 - RNA, 18 nt, Escherichia coli CFT073
agaaaugucggcccgcau

SEQ ID NO: 2641059 - RNA, 11 nt, Escherichia coli CFT073
agaaauuaaac

SEQ ID NO: 2641060 - RNA, 18 nt, Escherichia coli CFT073
agaaauugagauaagcaa

SEQ ID NO: 2641061 - RNA, 18 nt, Escherichia coli CFT073
agaaauuucggauauuuu

SEQ ID NO: 2641062 - RNA, 19 nt, Escherichia coli CFT073
agaacaccugucuucggua

SEQ ID NO: 2641063 - RNA, 17 nt, Escherichia coli CFT073
agaacacgaccugccag

SEQ ID NO: 2641064 - RNA, 17 nt, Escherichia coli CFT073
agaacagagucugacca

SEQ ID NO: 2641065 - RNA, 15 nt, Escherichia coli CFT073
agaacagaucccaca

SEQ ID NO: 2641066 - RNA, 15 nt, Escherichia coli CFT073
agaacagcggagcaa

SEQ ID NO: 2641067 - RNA, 19 nt, Escherichia coli CFT073
agaacaggaauaaaucuau

SEQ ID NO: 2641068 - RNA, 11 nt, Escherichia coli CFT073
agaacaggcgc

SEQ ID NO: 2641069 - RNA, 17 nt, Escherichia coli CFT073
agaacaguucagcaaca

SEQ ID NO: 2641070 - RNA, 19 nt, Escherichia coli CFT073
agaacaguucagcaacacu

SEQ ID NO: 2641071 - RNA, 22 nt, Escherichia coli CFT073
agaacaguucagcaacacuaca

SEQ ID NO: 2641072 - RNA, 16 nt, Escherichia coli CFT073
agaacauaauguaaac

SEQ ID NO: 2641073 - RNA, 13 nt, Escherichia coli CFT073
agaacauucauca

SEQ ID NO: 2641074 - RNA, 22 nt, Escherichia coli CFT073
agaaccaaaguuugcaaaccca

SEQ ID NO: 2641075 - RNA, 18 nt, Escherichia coli CFT073
agaaccagcgcacagagc

SEQ ID NO: 2641076 - RNA, 19 nt, Escherichia coli CFT073
agaaccagcgcacagagca

SEQ ID NO: 2641077 - RNA, 11 nt, Escherichia coli CFT073
agaaccaugca

SEQ ID NO: 2641078 - RNA, 13 nt, Escherichia coli CFT073
agaaccgccaccu

SEQ ID NO: 2641079 - RNA, 15 nt, Escherichia coli CFT073
agaaccgccaccucc

SEQ ID NO: 2641080 - RNA, 22 nt, Escherichia coli CFT073
agaaccgccaccuccgcuaaau

SEQ ID NO: 2641081 - RNA, 22 nt, Escherichia coli CFT073
agaaccgccgcugucugaauga

SEQ ID NO: 2641082 - RNA, 15 nt, Escherichia coli CFT073
agaaccggagucagu

SEQ ID NO: 2641083 - RNA, 20 nt, Escherichia coli CFT073
agaaccggagucagucccug

SEQ ID NO: 2641084 - RNA, 20 nt, Escherichia coli CFT073
agaaccgguugccgguagcu

SEQ ID NO: 2641085 - RNA, 16 nt, Escherichia coli CFT073
agaaccguaaacagau

SEQ ID NO: 2641086 - RNA, 18 nt, Escherichia coli CFT073
agaaccuaagaaccagaa

SEQ ID NO: 2641087 - RNA, 19 nt, Escherichia coli CFT073
agaaccuaagaaccagaau

SEQ ID NO: 2641088 - RNA, 15 nt, Escherichia coli CFT073
agaacgacgaccgcc

SEQ ID NO: 2641089 - RNA, 22 nt, Escherichia coli CFT073
agaacgcaccgaccaucggcac

SEQ ID NO: 2641090 - RNA, 16 nt, Escherichia coli CFT073
agaacgccaugccaaa

SEQ ID NO: 2641091 - RNA, 18 nt, Escherichia coli CFT073
agaacgccgaauaacgcg

SEQ ID NO: 2641092 - RNA, 22 nt, Escherichia coli CFT073
agaacgccgaauaacgcgcagc

SEQ ID NO: 2641093 - RNA, 15 nt, Escherichia coli CFT073
agaacgccugugcga

SEQ ID NO: 2641094 - RNA, 13 nt, Escherichia coli CFT073
agaacgcugcaau

SEQ ID NO: 2641095 - RNA, 16 nt, Escherichia coli CFT073
agaacggaucaggcag

SEQ ID NO: 2641096 - RNA, 20 nt, Escherichia coli CFT073
agaacggcagagaaaccaca

SEQ ID NO: 2641097 - RNA, 16 nt, Escherichia coli CFT073
agaacggcuuucauau

SEQ ID NO: 2641098 - RNA, 14 nt, Escherichia coli CFT073
agaacguccgcagg

SEQ ID NO: 2641099 - RNA, 18 nt, Escherichia coli CFT073
agaacgucugccucccau

SEQ ID NO: 2641100 - RNA, 23 nt, Escherichia coli CFT073
agaacguuuaucugccggaaccg

SEQ ID NO: 2641101 - RNA, 14 nt, Escherichia coli CFT073
agaacuacccgguu

SEQ ID NO: 2641102 - RNA, 16 nt, Escherichia coli CFT073
agaacuaguagcauga

SEQ ID NO: 2641103 - RNA, 12 nt, Escherichia coli CFT073
agaacucaucuu

SEQ ID NO: 2641104 - RNA, 18 nt, Escherichia coli CFT073
agaacuccugaaagcgaa

SEQ ID NO: 2641105 - RNA, 13 nt, Escherichia coli CFT073
agaacuccuggcg

SEQ ID NO: 2641106 - RNA, 16 nt, Escherichia coli CFT073
agaacucggaagcagc

SEQ ID NO: 2641107 - RNA, 19 nt, Escherichia coli CFT073
agaacugacgcccaguuuc

SEQ ID NO: 2641108 - RNA, 19 nt, Escherichia coli CFT073
agaacugagcgaucauuag

SEQ ID NO: 2641109 - RNA, 16 nt, Escherichia coli CFT073
agaacugaucaauaaa

SEQ ID NO: 2641110 - RNA, 19 nt, Escherichia coli CFT073
agaacugcaacucaccuuu

SEQ ID NO: 2641111 - RNA, 13 nt, Escherichia coli CFT073
agaacugcugcau

SEQ ID NO: 2641112 - RNA, 12 nt, Escherichia coli CFT073
agaacugcugcg

SEQ ID NO: 2641113 - RNA, 14 nt, Escherichia coli CFT073
agaacugugccaga

SEQ ID NO: 2641114 - RNA, 14 nt, Escherichia coli CFT073
agaacuguuccagc

SEQ ID NO: 2641115 - RNA, 12 nt, Escherichia coli CFT073
agaacuuaauca

SEQ ID NO: 2641116 - RNA, 23 nt, Escherichia coli CFT073
agaacuucggcagagaaagcaaa

SEQ ID NO: 2641117 - RNA, 11 nt, Escherichia coli CFT073
agaagaaaaaa

SEQ ID NO: 2641118 - RNA, 20 nt, Escherichia coli CFT073
agaagaaaaaaugcugcaau

SEQ ID NO: 2641119 - RNA, 15 nt, Escherichia coli CFT073
agaagaaaacgcuau

SEQ ID NO: 2641120 - RNA, 17 nt, Escherichia coli CFT073
agaagaaccgccaccuc

SEQ ID NO: 2641121 - RNA, 17 nt, Escherichia coli CFT073
agaagacaauccccgcc

SEQ ID NO: 2641122 - RNA, 20 nt, Escherichia coli CFT073
agaagacaauccccgccagc

SEQ ID NO: 2641123 - RNA, 14 nt, Escherichia coli CFT073
agaagaccgccgcu

SEQ ID NO: 2641124 - RNA, 13 nt, Escherichia coli CFT073
agaagacugugau

SEQ ID NO: 2641125 - RNA, 13 nt, Escherichia coli CFT073
agaagaggagagu

SEQ ID NO: 2641126 - RNA, 15 nt, Escherichia coli CFT073
agaagaucaugccga

SEQ ID NO: 2641127 - RNA, 20 nt, Escherichia coli CFT073
agaagauccaugaagcaaug

SEQ ID NO: 2641128 - RNA, 19 nt, Escherichia coli CFT073
agaagauuuuuugccagca

SEQ ID NO: 2641129 - RNA, 17 nt, Escherichia coli CFT073
agaagcauaaccgagca

SEQ ID NO: 2641130 - RNA, 16 nt, Escherichia coli CFT073
agaagcauccugcacu

SEQ ID NO: 2641131 - RNA, 14 nt, Escherichia coli CFT073
agaagccaccgcac

SEQ ID NO: 2641132 - RNA, 12 nt, Escherichia coli CFT073
agaagccaggua

SEQ ID NO: 2641133 - RNA, 22 nt, Escherichia coli CFT073
agaagccaguacacgcugaaga

SEQ ID NO: 2641134 - RNA, 22 nt, Escherichia coli CFT073
agaagccauuaaacaccaguac

SEQ ID NO: 2641135 - RNA, 15 nt, Escherichia coli CFT073
agaagcccaucagug

SEQ ID NO: 2641136 - RNA, 21 nt, Escherichia coli CFT073
agaagcccaucaguguccaga

SEQ ID NO: 2641137 - RNA, 17 nt, Escherichia coli CFT073
agaagccgggcagguga

SEQ ID NO: 2641138 - RNA, 15 nt, Escherichia coli CFT073
agaagcgacugacgu

SEQ ID NO: 2641139 - RNA, 18 nt, Escherichia coli CFT073
agaagcuugcuucuuugc

SEQ ID NO: 2641140 - RNA, 23 nt, Escherichia coli CFT073
agaaggaaaauacagcaauggaa

SEQ ID NO: 2641141 - RNA, 19 nt, Escherichia coli CFT073
agaaggauaauuaauccuu

SEQ ID NO: 2641142 - RNA, 19 nt, Escherichia coli CFT073
agaaggccagugguaaaaa

SEQ ID NO: 2641143 - RNA, 18 nt, Escherichia coli CFT073
agaagguauacugcaaau

SEQ ID NO: 2641144 - RNA, 17 nt, Escherichia coli CFT073
agaaguggugauucagu

SEQ ID NO: 2641145 - RNA, 22 nt, Escherichia coli CFT073
agaaguguacgaacacgucuuu

SEQ ID NO: 2641146 - RNA, 14 nt, Escherichia coli CFT073
agaccgaacagcau

SEQ ID NO: 2641147 - RNA, 15 nt, Escherichia coli CFT073
agaccgaagucaaac

SEQ ID NO: 2641148 - RNA, 20 nt, Escherichia coli CFT073
agaccgcaucacgacagcac

SEQ ID NO: 2641149 - RNA, 14 nt, Escherichia coli CFT073
agaccgcgcuugcc

SEQ ID NO: 2641150 - RNA, 19 nt, Escherichia coli CFT073
agaccggagaaaagaccag

SEQ ID NO: 2641151 - RNA, 13 nt, Escherichia coli CFT073
agaccggcaacca

SEQ ID NO: 2641152 - RNA, 17 nt, Escherichia coli CFT073
agaccggcaaccagcac

SEQ ID NO: 2641153 - RNA, 18 nt, Escherichia coli CFT073
agaccggcaaccagcacc

SEQ ID NO: 2641154 - RNA, 20 nt, Escherichia coli CFT073
agaccggcaaucgcgccaga

SEQ ID NO: 2641155 - RNA, 20 nt, Escherichia coli CFT073
agaccgucggaauccaacaa

SEQ ID NO: 2641156 - RNA, 16 nt, Escherichia coli CFT073
agaccgugagcaaugc

SEQ ID NO: 2641157 - RNA, 22 nt, Escherichia coli CFT073
agaccguugcucagaaucacgc

SEQ ID NO: 2641158 - RNA, 13 nt, Escherichia coli CFT073
agaccucaucguu

SEQ ID NO: 2641159 - RNA, 18 nt, Escherichia coli CFT073
agaccuccguuuuucugu

SEQ ID NO: 2641160 - RNA, 20 nt, Escherichia coli CFT073
agaccugaauuugcuccaga

SEQ ID NO: 2641161 - RNA, 22 nt, Escherichia coli CFT073
agaccugauaagacgcgccagc

SEQ ID NO: 2641162 - RNA, 13 nt, Escherichia coli CFT073
agaccugcguuca

SEQ ID NO: 2641163 - RNA, 17 nt, Escherichia coli CFT073
agaccuggcgcuucacu

SEQ ID NO: 2641164 - RNA, 16 nt, Escherichia coli CFT073
agaccugucucuuaua

SEQ ID NO: 2641165 - RNA, 14 nt, Escherichia coli CFT073
agaccuuccagaaa

SEQ ID NO: 2641166 - RNA, 14 nt, Escherichia coli CFT073
agaccuuccgcagg

SEQ ID NO: 2641167 - RNA, 19 nt, Escherichia coli CFT073
agacgaaaguuugaaagau

SEQ ID NO: 2641168 - RNA, 17 nt, Escherichia coli CFT073
agacgaaugaagcagaa

SEQ ID NO: 2641169 - RNA, 13 nt, Escherichia coli CFT073
agacgacggcugc

SEQ ID NO: 2641170 - RNA, 19 nt, Escherichia coli CFT073
agacgauagaaccuuccac

SEQ ID NO: 2641171 - RNA, 13 nt, Escherichia coli CFT073
agacgaucgccac

SEQ ID NO: 2641172 - RNA, 15 nt, Escherichia coli CFT073
agacgaucgcgcagg

SEQ ID NO: 2641173 - RNA, 22 nt, Escherichia coli CFT073
agacgaucgcgcagguuuucca

SEQ ID NO: 2641174 - RNA, 20 nt, Escherichia coli CFT073
agacgauggcuccggaagcu

SEQ ID NO: 2641175 - RNA, 12 nt, Escherichia coli CFT073
agacgauuuucc

SEQ ID NO: 2641176 - RNA, 17 nt, Escherichia coli CFT073
agacgcacccucaaaau

SEQ ID NO: 2641177 - RNA, 20 nt, Escherichia coli CFT073
agacgccacuuuuuucaccc

SEQ ID NO: 2641178 - RNA, 21 nt, Escherichia coli CFT073
agacgccacuuuuuucaccca

SEQ ID NO: 2641179 - RNA, 20 nt, Escherichia coli CFT073
agacgccagaaccgagcaca

SEQ ID NO: 2641180 - RNA, 22 nt, Escherichia coli CFT073
agacgccauugaugagaacauc

SEQ ID NO: 2641181 - RNA, 16 nt, Escherichia coli CFT073
agacgccccaguaaac

SEQ ID NO: 2641182 - RNA, 19 nt, Escherichia coli CFT073
agacgccccaguaaacaca

SEQ ID NO: 2641183 - RNA, 22 nt, Escherichia coli CFT073
agacgccccaguaaacacacca

SEQ ID NO: 2641184 - RNA, 21 nt, Escherichia coli CFT073
agacgcgaacagcgucgcauc

SEQ ID NO: 2641185 - RNA, 20 nt, Escherichia coli CFT073
agacgcgccagcaucgcauc

SEQ ID NO: 2641186 - RNA, 13 nt, Escherichia coli CFT073
agacgcgccagcg

SEQ ID NO: 2641187 - RNA, 14 nt, Escherichia coli CFT073
agacgcgccagcgc

SEQ ID NO: 2641188 - RNA, 15 nt, Escherichia coli CFT073
agacgcgccagcguc

SEQ ID NO: 2641189 - RNA, 21 nt, Escherichia coli CFT073
agacgcgccagcgucgcauca

SEQ ID NO: 2641190 - RNA, 21 nt, Escherichia coli CFT073
agacgcgccagcgucgcaucc

SEQ ID NO: 2641191 - RNA, 13 nt, Escherichia coli CFT073
agacgcgccgcca

SEQ ID NO: 2641192 - RNA, 15 nt, Escherichia coli CFT073
agacgcgcugaguca

SEQ ID NO: 2641193 - RNA, 21 nt, Escherichia coli CFT073
agacgcggcaagcgucgcauc

SEQ ID NO: 2641194 - RNA, 21 nt, Escherichia coli CFT073
agacgcggcagcgucgcaucc

SEQ ID NO: 2641195 - RNA, 21 nt, Escherichia coli CFT073
agacgcggcuagcgucgcauc

SEQ ID NO: 2641196 - RNA, 20 nt, Escherichia coli CFT073
agacgcgggcaaucggcugc

SEQ ID NO: 2641197 - RNA, 13 nt, Escherichia coli CFT073
agacgcgguggga

SEQ ID NO: 2641198 - RNA, 21 nt, Escherichia coli CFT073
agacgcguaaagcgucgcauc

SEQ ID NO: 2641199 - RNA, 19 nt, Escherichia coli CFT073
agacgcguagugucgcauc

SEQ ID NO: 2641200 - RNA, 21 nt, Escherichia coli CFT073
agacgcgucaagcgucgcauc

SEQ ID NO: 2641201 - RNA, 22 nt, Escherichia coli CFT073
agacgcgucaagcgucgcaucc

SEQ ID NO: 2641202 - RNA, 15 nt, Escherichia coli CFT073
agacgcgucagcgcc

SEQ ID NO: 2641203 - RNA, 21 nt, Escherichia coli CFT073
agacgcgucagcgccgcaucc

SEQ ID NO: 2641204 - RNA, 20 nt, Escherichia coli CFT073
agacgcgucagcgucgcauc

SEQ ID NO: 2641205 - RNA, 21 nt, Escherichia coli CFT073
agacgcguuaagcgucgcauc

SEQ ID NO: 2641206 - RNA, 18 nt, Escherichia coli CFT073
agacgcguuaauaccuga

SEQ ID NO: 2641207 - RNA, 18 nt, Escherichia coli CFT073
agacgcucugcgguaucg

SEQ ID NO: 2641208 - RNA, 23 nt, Escherichia coli CFT073
agacgcucugcgguaucggccau

SEQ ID NO: 2641209 - RNA, 20 nt, Escherichia coli CFT073
agacgcucuuucaccagugg

SEQ ID NO: 2641210 - RNA, 23 nt, Escherichia coli CFT073
agacgcugauucacuuucugaag

SEQ ID NO: 2641211 - RNA, 16 nt, Escherichia coli CFT073
agacgcuugucaccgu

SEQ ID NO: 2641212 - RNA, 21 nt, Escherichia coli CFT073
agacggcagaaguaguugcug

SEQ ID NO: 2641213 - RNA, 16 nt, Escherichia coli CFT073
agacggcgcaacaucc

SEQ ID NO: 2641214 - RNA, 17 nt, Escherichia coli CFT073
agacggcggaaagggcc

SEQ ID NO: 2641215 - RNA, 23 nt, Escherichia coli CFT073
agacggcugucauccagcagugg

SEQ ID NO: 2641216 - RNA, 23 nt, Escherichia coli CFT073
agacggugccagguaaugacguc

SEQ ID NO: 2641217 - RNA, 17 nt, Escherichia coli CFT073
agacggugccaugcuga

SEQ ID NO: 2641218 - RNA, 16 nt, Escherichia coli CFT073
agacgguuaaaaacag

SEQ ID NO: 2641219 - RNA, 22 nt, Escherichia coli CFT073
agacgguuaaaaacagccagca

SEQ ID NO: 2641220 - RNA, 23 nt, Escherichia coli CFT073
agacgguugaucucaucuuccac

SEQ ID NO: 2641221 - RNA, 18 nt, Escherichia coli CFT073
agacguccggcgcugcaa

SEQ ID NO: 2641222 - RNA, 20 nt, Escherichia coli CFT073
agacgugcacgcagcaaacg

SEQ ID NO: 2641223 - RNA, 23 nt, Escherichia coli CFT073
agacguucuucugcuucauguug

SEQ ID NO: 2641224 - RNA, 23 nt, Escherichia coli CFT073
agacguuuguaacccaccaugcc

SEQ ID NO: 2641225 - RNA, 13 nt, Escherichia coli CFT073
agacuaauaucgc

SEQ ID NO: 2641226 - RNA, 23 nt, Escherichia coli CFT073
agacuacugacgaaggugccgga

SEQ ID NO: 2641227 - RNA, 19 nt, Escherichia coli CFT073
agacucaauggcauccgcc

SEQ ID NO: 2641228 - RNA, 14 nt, Escherichia coli CFT073
agacucaccaaucg

SEQ ID NO: 2641229 - RNA, 14 nt, Escherichia coli CFT073
agacucauuaaaac

SEQ ID NO: 2641230 - RNA, 11 nt, Escherichia coli CFT073
agacuccagca

SEQ ID NO: 2641231 - RNA, 23 nt, Escherichia coli CFT073
agacuccagcagugcugcauccu

SEQ ID NO: 2641232 - RNA, 14 nt, Escherichia coli CFT073
agacuccgguuuuu

SEQ ID NO: 2641233 - RNA, 17 nt, Escherichia coli CFT073
agacucucgccagagau

SEQ ID NO: 2641234 - RNA, 16 nt, Escherichia coli CFT073
agacugaucaauauca

SEQ ID NO: 2641235 - RNA, 15 nt, Escherichia coli CFT073
agacugaucaucgcc

SEQ ID NO: 2641236 - RNA, 10 nt, Escherichia coli CFT073
agacugcgca

SEQ ID NO: 2641237 - RNA, 14 nt, Escherichia coli CFT073
agacugcgcauuaa

SEQ ID NO: 2641238 - RNA, 16 nt, Escherichia coli CFT073
agacugcgcauuaaau

SEQ ID NO: 2641239 - RNA, 16 nt, Escherichia coli CFT073
agacuguugaaauaca

SEQ ID NO: 2641240 - RNA, 20 nt, Escherichia coli CFT073
agacuucacugaaaaucacc

SEQ ID NO: 2641241 - RNA, 16 nt, Escherichia coli CFT073
agacuuugaauaaagc

SEQ ID NO: 2641242 - RNA, 17 nt, Escherichia coli CFT073
agacuuugucaucaguc

SEQ ID NO: 2641243 - RNA, 13 nt, Escherichia coli CFT073
agacuuuucagau

SEQ ID NO: 2641244 - RNA, 17 nt, Escherichia coli CFT073
agacuuuuuucaugggu

SEQ ID NO: 2641245 - RNA, 23 nt, Escherichia coli CFT073
agacuuuuuucaugggugccgga

SEQ ID NO: 2641246 - RNA, 12 nt, Escherichia coli CFT073
agagaaaauaau

SEQ ID NO: 2641247 - RNA, 14 nt, Escherichia coli CFT073
agagaaaaucacac

SEQ ID NO: 2641248 - RNA, 15 nt, Escherichia coli CFT073
agagaaagcaaaaau

SEQ ID NO: 2641249 - RNA, 20 nt, Escherichia coli CFT073
agagaacaucaauccaaaca

SEQ ID NO: 2641250 - RNA, 14 nt, Escherichia coli CFT073
agagaaccagcgca

SEQ ID NO: 2641251 - RNA, 21 nt, Escherichia coli CFT073
agagaaccagcgcacagagca

SEQ ID NO: 2641252 - RNA, 22 nt, Escherichia coli CFT073
agagaaccagcgcacagagcac

SEQ ID NO: 2641253 - RNA, 18 nt, Escherichia coli CFT073
agagaaccagcugccgaa

SEQ ID NO: 2641254 - RNA, 12 nt, Escherichia coli CFT073
agauaauaggua

SEQ ID NO: 2641255 - RNA, 13 nt, Escherichia coli CFT073
agauaauagucag

SEQ ID NO: 2641256 - RNA, 17 nt, Escherichia coli CFT073
agauaaucaaauacacc

SEQ ID NO: 2641257 - RNA, 18 nt, Escherichia coli CFT073
agauaaucacacagcggu

SEQ ID NO: 2641258 - RNA, 20 nt, Escherichia coli CFT073
agauaaucgcgguuacucug

SEQ ID NO: 2641259 - RNA, 14 nt, Escherichia coli CFT073
agauaaugacuucc

SEQ ID NO: 2641260 - RNA, 12 nt, Escherichia coli CFT073
agauaaugccag

SEQ ID NO: 2641261 - RNA, 17 nt, Escherichia coli CFT073
agauaauggcuguuaaa

SEQ ID NO: 2641262 - RNA, 20 nt, Escherichia coli CFT073
agauaaugugccgaauccaa

SEQ ID NO: 2641263 - RNA, 15 nt, Escherichia coli CFT073
agauaauuuugaaau

SEQ ID NO: 2641264 - RNA, 18 nt, Escherichia coli CFT073
agauaauuuugaaauaaa

SEQ ID NO: 2641265 - RNA, 21 nt, Escherichia coli CFT073
agauaauuuugaaauaaaauc

SEQ ID NO: 2641266 - RNA, 14 nt, Escherichia coli CFT073
agauacacagccca

SEQ ID NO: 2641267 - RNA, 21 nt, Escherichia coli CFT073
agauacacggugcgaugcaaa

SEQ ID NO: 2641268 - RNA, 15 nt, Escherichia coli CFT073
agauaccaacccugg

SEQ ID NO: 2641269 - RNA, 17 nt, Escherichia coli CFT073
agauaccaccacagcac

SEQ ID NO: 2641270 - RNA, 22 nt, Escherichia coli CFT073
agauacccgacagauaaaucau

SEQ ID NO: 2641271 - RNA, 21 nt, Escherichia coli CFT073
agauacgcaucgcgcaccagc

SEQ ID NO: 2641272 - RNA, 17 nt, Escherichia coli CFT073
agauacggauucuuaac

SEQ ID NO: 2641273 - RNA, 19 nt, Escherichia coli CFT073
agauacggcgcaucaguuu

SEQ ID NO: 2641274 - RNA, 11 nt, Escherichia coli CFT073
agauacugcau

SEQ ID NO: 2641275 - RNA, 19 nt, Escherichia coli CFT073
agauacugccgaccagagc

SEQ ID NO: 2641276 - RNA, 13 nt, Escherichia coli CFT073
agauagaaccacg

SEQ ID NO: 2641277 - RNA, 14 nt, Escherichia coli CFT073
agauagaacugcau

SEQ ID NO: 2641278 - RNA, 18 nt, Escherichia coli CFT073
agauagacuguugaaaua

SEQ ID NO: 2641279 - RNA, 20 nt, Escherichia coli CFT073
agauagcacgacguuucuuu

SEQ ID NO: 2641280 - RNA, 15 nt, Escherichia coli CFT073
agauagccagcaaca

SEQ ID NO: 2641281 - RNA, 19 nt, Escherichia coli CFT073
agauagccagguuuaccag

SEQ ID NO: 2641282 - RNA, 22 nt, Escherichia coli CFT073
agauagccagguuuaccagcag

SEQ ID NO: 2641283 - RNA, 16 nt, Escherichia coli CFT073
agauagcgaaccgcag

SEQ ID NO: 2641284 - RNA, 18 nt, Escherichia coli CFT073
agauagcguggaaauaau

SEQ ID NO: 2641285 - RNA, 15 nt, Escherichia coli CFT073
agauaggcaucagca

SEQ ID NO: 2641286 - RNA, 17 nt, Escherichia coli CFT073
agauagggcgagaaauu

SEQ ID NO: 2641287 - RNA, 16 nt, Escherichia coli CFT073
agauaggucaccagag

SEQ ID NO: 2641288 - RNA, 19 nt, Escherichia coli CFT073
agauagucgaaucaguaaa

SEQ ID NO: 2641289 - RNA, 13 nt, Escherichia coli CFT073
agauauagcccca

SEQ ID NO: 2641290 - RNA, 14 nt, Escherichia coli CFT073
agauauauccugaa

SEQ ID NO: 2641291 - RNA, 15 nt, Escherichia coli CFT073
agauauccacaacaa

SEQ ID NO: 2641292 - RNA, 13 nt, Escherichia coli CFT073
agauauccacauu

SEQ ID NO: 2641293 - RNA, 20 nt, Escherichia coli CFT073
agauaucccgccagcaccag

SEQ ID NO: 2641294 - RNA, 21 nt, Escherichia coli CFT073
agauaucccgccagcaccagc

SEQ ID NO: 2641295 - RNA, 23 nt, Escherichia coli CFT073
agauaucgugcgggaccagcacg

SEQ ID NO: 2641296 - RNA, 12 nt, Escherichia coli CFT073
agauauuauuaa

SEQ ID NO: 2641297 - RNA, 14 nt, Escherichia coli CFT073
agauauucaguacc

SEQ ID NO: 2641298 - RNA, 22 nt, Escherichia coli CFT073
agauauucaucagcaucacgaa

SEQ ID NO: 2641299 - RNA, 13 nt, Escherichia coli CFT073
agauauuccccca

SEQ ID NO: 2641300 - RNA, 21 nt, Escherichia coli CFT073
agauauucuuccaguggcuuu

SEQ ID NO: 2641301 - RNA, 15 nt, Escherichia coli CFT073
agauauuucagagcu

SEQ ID NO: 2641302 - RNA, 23 nt, Escherichia coli CFT073
agaucaaacaaccguucacgcau

SEQ ID NO: 2641303 - RNA, 16 nt, Escherichia coli CFT073
agaucaaaccucaccu

SEQ ID NO: 2641304 - RNA, 24 nt, Escherichia coli CFT073
agaucaaauucaaugacaguauca

SEQ ID NO: 2641305 - RNA, 15 nt, Escherichia coli CFT073
agaucaccaauauca

SEQ ID NO: 2641306 - RNA, 13 nt, Escherichia coli CFT073
agaucaccacaua

SEQ ID NO: 2641307 - RNA, 15 nt, Escherichia coli CFT073
agaucaccacauacu

SEQ ID NO: 2641308 - RNA, 18 nt, Escherichia coli CFT073
agaucaccacauacugcu

SEQ ID NO: 2641309 - RNA, 14 nt, Escherichia coli CFT073
agaucacgcaucac

SEQ ID NO: 2641310 - RNA, 15 nt, Escherichia coli CFT073
agaucacgcaucacc

SEQ ID NO: 2641311 - RNA, 19 nt, Escherichia coli CFT073
agaucacucacccgccagc

SEQ ID NO: 2641312 - RNA, 23 nt, Escherichia coli CFT073
agaucagaacgcagcauuuccuc

SEQ ID NO: 2641313 - RNA, 13 nt, Escherichia coli CFT073
agaucagauaaua

SEQ ID NO: 2641314 - RNA, 12 nt, Escherichia coli CFT073
agaucagcaaau

SEQ ID NO: 2641315 - RNA, 13 nt, Escherichia coli CFT073
agaucagcaaaua

SEQ ID NO: 2641316 - RNA, 15 nt, Escherichia coli CFT073
agaucagcaaauaau

SEQ ID NO: 2641317 - RNA, 13 nt, Escherichia coli CFT073
agaucaucaccag

SEQ ID NO: 2641318 - RNA, 14 nt, Escherichia coli CFT073
agaucaucaccagg

SEQ ID NO: 2641319 - RNA, 23 nt, Escherichia coli CFT073
agaucaugccgacaaacagcgua

SEQ ID NO: 2641320 - RNA, 13 nt, Escherichia coli CFT073
agauccagcaagg

SEQ ID NO: 2641321 - RNA, 21 nt, Escherichia coli CFT073
agauccagugcucauccuuca

SEQ ID NO: 2641322 - RNA, 17 nt, Escherichia coli CFT073
agauccaugaagcaaug

SEQ ID NO: 2641323 - RNA, 19 nt, Escherichia coli CFT073
agauccaugaagcaaugau

SEQ ID NO: 2641324 - RNA, 20 nt, Escherichia coli CFT073
agaucccacucaucaagcau

SEQ ID NO: 2641325 - RNA, 19 nt, Escherichia coli CFT073
agaucccccgcacacucca

SEQ ID NO: 2641326 - RNA, 16 nt, Escherichia coli CFT073
agauccgccaguuugu

SEQ ID NO: 2641327 - RNA, 20 nt, Escherichia coli CFT073
agauccgcugaugaaucggg

SEQ ID NO: 2641328 - RNA, 18 nt, Escherichia coli CFT073
agauccgggcauauuucc

SEQ ID NO: 2641329 - RNA, 15 nt, Escherichia coli CFT073
agauccugaaauucc

SEQ ID NO: 2641330 - RNA, 17 nt, Escherichia coli CFT073
agauccugccauuggca

SEQ ID NO: 2641331 - RNA, 21 nt, Escherichia coli CFT073
agauccuggcgaaaacgcccg

SEQ ID NO: 2641332 - RNA, 14 nt, Escherichia coli CFT073
agauccuggcugua

SEQ ID NO: 2641333 - RNA, 22 nt, Escherichia coli CFT073
agaucgaaaucuuuuuacugcc

SEQ ID NO: 2641334 - RNA, 15 nt, Escherichia coli CFT073
agaucgacaccggua

SEQ ID NO: 2641335 - RNA, 14 nt, Escherichia coli CFT073
agaucgcacauguc

SEQ ID NO: 2641336 - RNA, 12 nt, Escherichia coli CFT073
agaucgccagaa

SEQ ID NO: 2641337 - RNA, 13 nt, Escherichia coli CFT073
agaucgccagccc

SEQ ID NO: 2641338 - RNA, 17 nt, Escherichia coli CFT073
agaucgccccggcaaga

SEQ ID NO: 2641339 - RNA, 16 nt, Escherichia coli CFT073
agaucgcuucaauacc

SEQ ID NO: 2641340 - RNA, 18 nt, Escherichia coli CFT073
agaucgcuucaauaccac

SEQ ID NO: 2641341 - RNA, 15 nt, Escherichia coli CFT073
agaucggcaaucgcc

SEQ ID NO: 2641342 - RNA, 13 nt, Escherichia coli CFT073
agaucggccaucg

SEQ ID NO: 2641343 - RNA, 22 nt, Escherichia coli CFT073
agaucgggcuuguggcucgcca

SEQ ID NO: 2641344 - RNA, 18 nt, Escherichia coli CFT073
agaucggugccgccacga

SEQ ID NO: 2641345 - RNA, 15 nt, Escherichia coli CFT073
agaucgguugccaua

SEQ ID NO: 2641346 - RNA, 16 nt, Escherichia coli CFT073
agaucgguugccauaa

SEQ ID NO: 2641347 - RNA, 18 nt, Escherichia coli CFT073
agaucguacagguaagca

SEQ ID NO: 2641348 - RNA, 16 nt, Escherichia coli CFT073
agaucgugcagcaccg

SEQ ID NO: 2641349 - RNA, 21 nt, Escherichia coli CFT073
agaucguguuuugcaaucauc

SEQ ID NO: 2641350 - RNA, 18 nt, Escherichia coli CFT073
agaucguucgcaccaaau

SEQ ID NO: 2641351 - RNA, 14 nt, Escherichia coli CFT073
agaucguugaccug

SEQ ID NO: 2641352 - RNA, 16 nt, Escherichia coli CFT073
agaucuaugucgcauc

SEQ ID NO: 2641353 - RNA, 18 nt, Escherichia coli CFT073
agaucugacgauuauuuu

SEQ ID NO: 2641354 - RNA, 20 nt, Escherichia coli CFT073
agaucugccuuugccggaug

SEQ ID NO: 2641355 - RNA, 18 nt, Escherichia coli CFT073
agaucuucaggaguagaa

SEQ ID NO: 2641356 - RNA, 16 nt, Escherichia coli CFT073
agaucuucaucaccga

SEQ ID NO: 2641357 - RNA, 20 nt, Escherichia coli CFT073
agaugaaauaccacucagcu

SEQ ID NO: 2641358 - RNA, 19 nt, Escherichia coli CFT073
agaugaaauacuaaauaug

SEQ ID NO: 2641359 - RNA, 23 nt, Escherichia coli CFT073
agaugaaauaguugcauuccagu

SEQ ID NO: 2641360 - RNA, 19 nt, Escherichia coli CFT073
agaugaacggcuuuuucug

SEQ ID NO: 2641361 - RNA, 19 nt, Escherichia coli CFT073
agaugaaugaaaacgaauu

SEQ ID NO: 2641362 - RNA, 18 nt, Escherichia coli CFT073
agaugaauuuauaaucau

SEQ ID NO: 2641363 - RNA, 16 nt, Escherichia coli CFT073
agcaaccacuugcagc

SEQ ID NO: 2641364 - RNA, 16 nt, Escherichia coli CFT073
agcaaccagcaaugcc

SEQ ID NO: 2641365 - RNA, 12 nt, Escherichia coli CFT073
agcaaccaggua

SEQ ID NO: 2641366 - RNA, 13 nt, Escherichia coli CFT073
agcaaccagguua

SEQ ID NO: 2641367 - RNA, 18 nt, Escherichia coli CFT073
agcaaccauuuaaacuca

SEQ ID NO: 2641368 - RNA, 22 nt, Escherichia coli CFT073
agcaaccggauuuuuaugacgc

SEQ ID NO: 2641369 - RNA, 15 nt, Escherichia coli CFT073
agcaaccggggcauu

SEQ ID NO: 2641370 - RNA, 21 nt, Escherichia coli CFT073
agcaaccugcacguuaucaga

SEQ ID NO: 2641371 - RNA, 19 nt, Escherichia coli CFT073
agcaacgagacucaauggc

SEQ ID NO: 2641372 - RNA, 17 nt, Escherichia coli CFT073
agcaacgauaacaauca

SEQ ID NO: 2641373 - RNA, 13 nt, Escherichia coli CFT073
agcaacgccaaau

SEQ ID NO: 2641374 - RNA, 18 nt, Escherichia coli CFT073
agcaacgcugauuucucu

SEQ ID NO: 2641375 - RNA, 17 nt, Escherichia coli CFT073
agcaacgcuucaaccag

SEQ ID NO: 2641376 - RNA, 15 nt, Escherichia coli CFT073
agcaacggaaaagca

SEQ ID NO: 2641377 - RNA, 16 nt, Escherichia coli CFT073
agcaacuccaucaagc

SEQ ID NO: 2641378 - RNA, 21 nt, Escherichia coli CFT073
agcaacuggcuugccagcagg

SEQ ID NO: 2641379 - RNA, 11 nt, Escherichia coli CFT073
agcaacugguu

SEQ ID NO: 2641380 - RNA, 23 nt, Escherichia coli CFT073
agcaagaaacugaucauuaucac

SEQ ID NO: 2641381 - RNA, 13 nt, Escherichia coli CFT073
agcaagaaccaug

SEQ ID NO: 2641382 - RNA, 15 nt, Escherichia coli CFT073
agcaagaccgcgacc

SEQ ID NO: 2641383 - RNA, 14 nt, Escherichia coli CFT073
agcaagagcaaaua

SEQ ID NO: 2641384 - RNA, 16 nt, Escherichia coli CFT073
agcaagagcaaauaaa

SEQ ID NO: 2641385 - RNA, 20 nt, Escherichia coli CFT073
agcaagagcaaauaaaacau

SEQ ID NO: 2641386 - RNA, 22 nt, Escherichia coli CFT073
agcaagagugguuagccggaua

SEQ ID NO: 2641387 - RNA, 16 nt, Escherichia coli CFT073
agcaagaguuuuaaaa

SEQ ID NO: 2641388 - RNA, 21 nt, Escherichia coli CFT073
agcaagaguuuuaaaaccauu

SEQ ID NO: 2641389 - RNA, 18 nt, Escherichia coli CFT073
agcaagcgcaucggaaga

SEQ ID NO: 2641390 - RNA, 20 nt, Escherichia coli CFT073
agcaagcgcaucggaagacu

SEQ ID NO: 2641391 - RNA, 16 nt, Escherichia coli CFT073
agcaagcgcugugaaa

SEQ ID NO: 2641392 - RNA, 21 nt, Escherichia coli CFT073
agcaagcgcugugaaacaccu

SEQ ID NO: 2641393 - RNA, 23 nt, Escherichia coli CFT073
agcaagcugugcgauagcaauga

SEQ ID NO: 2641394 - RNA, 19 nt, Escherichia coli CFT073
agcaaggaagcugauuuua

SEQ ID NO: 2641395 - RNA, 15 nt, Escherichia coli CFT073
agcaaggcaaucugc

SEQ ID NO: 2641396 - RNA, 14 nt, Escherichia coli CFT073
agcaaggccagguu

SEQ ID NO: 2641397 - RNA, 21 nt, Escherichia coli CFT073
agcaaggccagguuuucuuuc

SEQ ID NO: 2641398 - RNA, 17 nt, Escherichia coli CFT073
agcaaggcuuuccagac

SEQ ID NO: 2641399 - RNA, 18 nt, Escherichia coli CFT073
agcaagguagugcuucua

SEQ ID NO: 2641400 - RNA, 16 nt, Escherichia coli CFT073
agcaaggucaggcgaa

SEQ ID NO: 2641401 - RNA, 14 nt, Escherichia coli CFT073
agcaagugcggcgc

SEQ ID NO: 2641402 - RNA, 22 nt, Escherichia coli CFT073
agcaagugcggcgcaccagcag

SEQ ID NO: 2641403 - RNA, 22 nt, Escherichia coli CFT073
agcaauaaaaaaaugaguauua

SEQ ID NO: 2641404 - RNA, 16 nt, Escherichia coli CFT073
agcaauaaaaaaccgc

SEQ ID NO: 2641405 - RNA, 14 nt, Escherichia coli CFT073
agcaauaagcacuc

SEQ ID NO: 2641406 - RNA, 13 nt, Escherichia coli CFT073
agcaauaagccag

SEQ ID NO: 2641407 - RNA, 14 nt, Escherichia coli CFT073
agcaauaagccagu

SEQ ID NO: 2641408 - RNA, 17 nt, Escherichia coli CFT073
agcaauaagccagucca

SEQ ID NO: 2641409 - RNA, 13 nt, Escherichia coli CFT073
agcaauaaucagu

SEQ ID NO: 2641410 - RNA, 17 nt, Escherichia coli CFT073
agcaauaaucagugccg

SEQ ID NO: 2641411 - RNA, 22 nt, Escherichia coli CFT073
agcaauaaucagugccgcgccg

SEQ ID NO: 2641412 - RNA, 16 nt, Escherichia coli CFT073
agcaauaauuucaaca

SEQ ID NO: 2641413 - RNA, 11 nt, Escherichia coli CFT073
agcaauacaaa

SEQ ID NO: 2641414 - RNA, 22 nt, Escherichia coli CFT073
agcaauacaaaugaguuaucac

SEQ ID NO: 2641415 - RNA, 16 nt, Escherichia coli CFT073
agcaauacguuucaua

SEQ ID NO: 2641416 - RNA, 15 nt, Escherichia coli CFT073
agcaauagcgcaauc

SEQ ID NO: 2641417 - RNA, 21 nt, Escherichia coli CFT073
agcaauagcgcaaucgcugua

SEQ ID NO: 2641418 - RNA, 19 nt, Escherichia coli CFT073
agcaauauguugauaauca

SEQ ID NO: 2641419 - RNA, 21 nt, Escherichia coli CFT073
agcaauauguugcaguacucg

SEQ ID NO: 2641420 - RNA, 17 nt, Escherichia coli CFT073
agcaaucaggucuuuca

SEQ ID NO: 2641421 - RNA, 12 nt, Escherichia coli CFT073
agcaauccccag

SEQ ID NO: 2641422 - RNA, 20 nt, Escherichia coli CFT073
agcaaucgaccaggccauca

SEQ ID NO: 2641423 - RNA, 19 nt, Escherichia coli CFT073
agcaaucgucgauuguuau

SEQ ID NO: 2641424 - RNA, 22 nt, Escherichia coli CFT073
agcaaucuggcguacagagggc

SEQ ID NO: 2641425 - RNA, 22 nt, Escherichia coli CFT073
agcaaugauaaguccgaugccg

SEQ ID NO: 2641426 - RNA, 15 nt, Escherichia coli CFT073
agcaaugaucucaau

SEQ ID NO: 2641427 - RNA, 19 nt, Escherichia coli CFT073
agcaaugaucucaauaguu

SEQ ID NO: 2641428 - RNA, 20 nt, Escherichia coli CFT073
agcaaugaucucaauaguuc

SEQ ID NO: 2641429 - RNA, 22 nt, Escherichia coli CFT073
agcaaugccagcguauaacaca

SEQ ID NO: 2641430 - RNA, 16 nt, Escherichia coli CFT073
agcaaugcuuacuugc

SEQ ID NO: 2641431 - RNA, 16 nt, Escherichia coli CFT073
agcaauggacaccagg

SEQ ID NO: 2641432 - RNA, 22 nt, Escherichia coli CFT073
agcaauggacaccaggcaagaa

SEQ ID NO: 2641433 - RNA, 16 nt, Escherichia coli CFT073
agcaauggcacugucg

SEQ ID NO: 2641434 - RNA, 17 nt, Escherichia coli CFT073
agcaauguaaggugcau

SEQ ID NO: 2641435 - RNA, 20 nt, Escherichia coli CFT073
agcaauguagccuguuuuuu

SEQ ID NO: 2641436 - RNA, 17 nt, Escherichia coli CFT073
agcaauguuauccggcu

SEQ ID NO: 2641437 - RNA, 22 nt, Escherichia coli CFT073
agcaauuucuccgccggaauca

SEQ ID NO: 2641438 - RNA, 17 nt, Escherichia coli CFT073
agcaauuuuaauaucca

SEQ ID NO: 2641439 - RNA, 20 nt, Escherichia coli CFT073
agcaauuuuacccgugcauc

SEQ ID NO: 2641440 - RNA, 21 nt, Escherichia coli CFT073
agcaauuuuccuugaaaaaga

SEQ ID NO: 2641441 - RNA, 22 nt, Escherichia coli CFT073
agcaauuuuccuugaaaaagag

SEQ ID NO: 2641442 - RNA, 22 nt, Escherichia coli CFT073
agcaauuuucggggugcuccgg

SEQ ID NO: 2641443 - RNA, 15 nt, Escherichia coli CFT073
agcacaaacaauuug

SEQ ID NO: 2641444 - RNA, 13 nt, Escherichia coli CFT073
agcacaaagcaau

SEQ ID NO: 2641445 - RNA, 21 nt, Escherichia coli CFT073
agcacaaaguggcggcuaccc

SEQ ID NO: 2641446 - RNA, 16 nt, Escherichia coli CFT073
agcacaauaaucagcc

SEQ ID NO: 2641447 - RNA, 14 nt, Escherichia coli CFT073
agcacaauccgcca

SEQ ID NO: 2641448 - RNA, 21 nt, Escherichia coli CFT073
agcacaccgucagccagcacu

SEQ ID NO: 2641449 - RNA, 20 nt, Escherichia coli CFT073
agcacaccugcaacggcauc

SEQ ID NO: 2641450 - RNA, 19 nt, Escherichia coli CFT073
agcacacgauuccaacgaa

SEQ ID NO: 2641451 - RNA, 20 nt, Escherichia coli CFT073
agcacacgauuccaacgaaa

SEQ ID NO: 2641452 - RNA, 14 nt, Escherichia coli CFT073
agcacagaucgcac

SEQ ID NO: 2641453 - RNA, 14 nt, Escherichia coli CFT073
agcacagccagccu

SEQ ID NO: 2641454 - RNA, 13 nt, Escherichia coli CFT073
agcacauaaaaug

SEQ ID NO: 2641455 - RNA, 21 nt, Escherichia coli CFT073
agcacaucacucauaaugaug

SEQ ID NO: 2641456 - RNA, 14 nt, Escherichia coli CFT073
agcacaucagcgcc

SEQ ID NO: 2641457 - RNA, 14 nt, Escherichia coli CFT073
agcacaucaucaaa

SEQ ID NO: 2641458 - RNA, 16 nt, Escherichia coli CFT073
agcacaucaucaaagc

SEQ ID NO: 2641459 - RNA, 22 nt, Escherichia coli CFT073
agcaccaaacuggaauagcgcc

SEQ ID NO: 2641460 - RNA, 13 nt, Escherichia coli CFT073
agcaccaacaaag

SEQ ID NO: 2641461 - RNA, 13 nt, Escherichia coli CFT073
agcaccaacucgc

SEQ ID NO: 2641462 - RNA, 18 nt, Escherichia coli CFT073
agcaccacauaagaucau

SEQ ID NO: 2641463 - RNA, 18 nt, Escherichia coli CFT073
agcaccacggaguaaccu

SEQ ID NO: 2641464 - RNA, 14 nt, Escherichia coli CFT073
agcaccacuggcga

SEQ ID NO: 2641465 - RNA, 22 nt, Escherichia coli CFT073
agcaccagaucguguuuugcaa

SEQ ID NO: 2641466 - RNA, 12 nt, Escherichia coli CFT073
agcaccagcaac

SEQ ID NO: 2641467 - RNA, 22 nt, Escherichia coli CFT073
agcaccagcccgacgauaccgc

SEQ ID NO: 2641468 - RNA, 21 nt, Escherichia coli CFT073
agcaccauccgcccacaccag

SEQ ID NO: 2641469 - RNA, 15 nt, Escherichia coli CFT073
agcacccaaugccau

SEQ ID NO: 2641470 - RNA, 19 nt, Escherichia coli CFT073
agcacccagaacgccgaau

SEQ ID NO: 2641471 - RNA, 12 nt, Escherichia coli CFT073
agcacccagcaa

SEQ ID NO: 2641472 - RNA, 14 nt, Escherichia coli CFT073
agcacccagcaauc

SEQ ID NO: 2641473 - RNA, 16 nt, Escherichia coli CFT073
agcaccccauagccag

SEQ ID NO: 2641474 - RNA, 18 nt, Escherichia coli CFT073
agcaccccauagccagcg

SEQ ID NO: 2641475 - RNA, 23 nt, Escherichia coli CFT073
agcaccccgacagcaugcguuuc

SEQ ID NO: 2641476 - RNA, 14 nt, Escherichia coli CFT073
agcacccgccagcg

SEQ ID NO: 2641477 - RNA, 17 nt, Escherichia coli CFT073
agcacccgguaaacaaa

SEQ ID NO: 2641478 - RNA, 16 nt, Escherichia coli CFT073
agcacccugaguuuuc

SEQ ID NO: 2641479 - RNA, 20 nt, Escherichia coli CFT073
agcacccugaguuuucagua

SEQ ID NO: 2641480 - RNA, 21 nt, Escherichia coli CFT073
agcacccuguuugucuauucc

SEQ ID NO: 2641481 - RNA, 15 nt, Escherichia coli CFT073
agcaccgaacaagaa

SEQ ID NO: 2641482 - RNA, 14 nt, Escherichia coli CFT073
agcaccgccagcag

SEQ ID NO: 2641483 - RNA, 15 nt, Escherichia coli CFT073
agcaccgccagcagc

SEQ ID NO: 2641484 - RNA, 16 nt, Escherichia coli CFT073
agcaccgccagcagca

SEQ ID NO: 2641485 - RNA, 22 nt, Escherichia coli CFT073
agcaccgccagcagcagcgaau

SEQ ID NO: 2641486 - RNA, 17 nt, Escherichia coli CFT073
agcaccgccgccagggu

SEQ ID NO: 2641487 - RNA, 23 nt, Escherichia coli CFT073
agcaccgcuuuaaaauuauccag

SEQ ID NO: 2641488 - RNA, 11 nt, Escherichia coli CFT073
agcaccggcac

SEQ ID NO: 2641489 - RNA, 23 nt, Escherichia coli CFT073
agcaccgggggguugccgccacu

SEQ ID NO: 2641490 - RNA, 15 nt, Escherichia coli CFT073
agcaccgugcauuuu

SEQ ID NO: 2641491 - RNA, 14 nt, Escherichia coli CFT073
agcaccucuccacg

SEQ ID NO: 2641492 - RNA, 17 nt, Escherichia coli CFT073
agcaccugcaucacgcu

SEQ ID NO: 2641493 - RNA, 21 nt, Escherichia coli CFT073
agcaccugcuugaacgcaccg

SEQ ID NO: 2641494 - RNA, 17 nt, Escherichia coli CFT073
agcaccuuuuccagugg

SEQ ID NO: 2641495 - RNA, 19 nt, Escherichia coli CFT073
agcacgaagaggccgccgu

SEQ ID NO: 2641496 - RNA, 15 nt, Escherichia coli CFT073
agcacgaccgccauu

SEQ ID NO: 2641497 - RNA, 21 nt, Escherichia coli CFT073
agcacgaccgccauuaaacgc

SEQ ID NO: 2641498 - RNA, 18 nt, Escherichia coli CFT073
agcacgaccuugccaagg

SEQ ID NO: 2641499 - RNA, 17 nt, Escherichia coli CFT073
agcacgacuuucucuuc

SEQ ID NO: 2641500 - RNA, 13 nt, Escherichia coli CFT073
agcacgagugagu

SEQ ID NO: 2641501 - RNA, 13 nt, Escherichia coli CFT073
agcacgccacuca

SEQ ID NO: 2641502 - RNA, 13 nt, Escherichia coli CFT073
agcacgccagaca

SEQ ID NO: 2641503 - RNA, 21 nt, Escherichia coli CFT073
agcacgcuuagcuuuggugcc

SEQ ID NO: 2641504 - RNA, 13 nt, Escherichia coli CFT073
agcacggcagcaa

SEQ ID NO: 2641505 - RNA, 20 nt, Escherichia coli CFT073
agcacggcgcgacucagcgg

SEQ ID NO: 2641506 - RNA, 22 nt, Escherichia coli CFT073
agcacguaaaucuuuaccacgu

SEQ ID NO: 2641507 - RNA, 14 nt, Escherichia coli CFT073
agcacgucacggac

SEQ ID NO: 2641508 - RNA, 14 nt, Escherichia coli CFT073
agcacguugaacug

SEQ ID NO: 2641509 - RNA, 21 nt, Escherichia coli CFT073
agcacuaacaugacaccaagc

SEQ ID NO: 2641510 - RNA, 19 nt, Escherichia coli CFT073
agcacuacggagauuaaac

SEQ ID NO: 2641511 - RNA, 16 nt, Escherichia coli CFT073
agcacuaucaaugaau

SEQ ID NO: 2641512 - RNA, 20 nt, Escherichia coli CFT073
agcacugacauuauccggcu

SEQ ID NO: 2641513 - RNA, 20 nt, Escherichia coli CFT073
agcacuucacccaucgccag

SEQ ID NO: 2641514 - RNA, 16 nt, Escherichia coli CFT073
agcacuucgcugacau

SEQ ID NO: 2641515 - RNA, 17 nt, Escherichia coli CFT073
agcacuucgcugacauu

SEQ ID NO: 2641516 - RNA, 15 nt, Escherichia coli CFT073
agcacuucggcauca

SEQ ID NO: 2641517 - RNA, 14 nt, Escherichia coli CFT073
agcacuugcaggaa

SEQ ID NO: 2641518 - RNA, 17 nt, Escherichia coli CFT073
agcacuugcaggaacaa

SEQ ID NO: 2641519 - RNA, 20 nt, Escherichia coli CFT073
agcacuugcaggaacaaugc

SEQ ID NO: 2641520 - RNA, 19 nt, Escherichia coli CFT073
agcacuuuucgcacugcag

SEQ ID NO: 2641521 - RNA, 13 nt, Escherichia coli CFT073
agcagaacaucag

SEQ ID NO: 2641522 - RNA, 15 nt, Escherichia coli CFT073
agcagaaccagggaa

SEQ ID NO: 2641523 - RNA, 23 nt, Escherichia coli CFT073
agcagaagggccuuuggcaccgu

SEQ ID NO: 2641524 - RNA, 18 nt, Escherichia coli CFT073
agcagaaucauccaggcu

SEQ ID NO: 2641525 - RNA, 20 nt, Escherichia coli CFT073
agcagaaucauccaggcuuu

SEQ ID NO: 2641526 - RNA, 21 nt, Escherichia coli CFT073
agcagaaugacaucaucgccc

SEQ ID NO: 2641527 - RNA, 15 nt, Escherichia coli CFT073
agcagaaugguuuug

SEQ ID NO: 2641528 - RNA, 20 nt, Escherichia coli CFT073
agcagaauuggcaucaggcu

SEQ ID NO: 2641529 - RNA, 17 nt, Escherichia coli CFT073
agcagaccaaucuggac

SEQ ID NO: 2641530 - RNA, 15 nt, Escherichia coli CFT073
agcagaccagcaaua

SEQ ID NO: 2641531 - RNA, 16 nt, Escherichia coli CFT073
agcagaccagcaauaa

SEQ ID NO: 2641532 - RNA, 13 nt, Escherichia coli CFT073
agcagacgcaucg

SEQ ID NO: 2641533 - RNA, 13 nt, Escherichia coli CFT073
agcagacgccggu

SEQ ID NO: 2641534 - RNA, 18 nt, Escherichia coli CFT073
agcagacgcuccauugcc

SEQ ID NO: 2641535 - RNA, 22 nt, Escherichia coli CFT073
agcagacuguaaaucugccguc

SEQ ID NO: 2641536 - RNA, 20 nt, Escherichia coli CFT073
agcagagagacgaucgccac

SEQ ID NO: 2641537 - RNA, 18 nt, Escherichia coli CFT073
agcagagauacaggccac

SEQ ID NO: 2641538 - RNA, 14 nt, Escherichia coli CFT073
agcagagaucuuuc

SEQ ID NO: 2641539 - RNA, 18 nt, Escherichia coli CFT073
agcagauaacccagcagc

SEQ ID NO: 2641540 - RNA, 16 nt, Escherichia coli CFT073
agcagauaucccgcca

SEQ ID NO: 2641541 - RNA, 16 nt, Escherichia coli CFT073
agcagauccaucgccu

SEQ ID NO: 2641542 - RNA, 19 nt, Escherichia coli CFT073
agcagauccaucgccuggg

SEQ ID NO: 2641543 - RNA, 23 nt, Escherichia coli CFT073
agcagauccauugcgaauaagaa

SEQ ID NO: 2641544 - RNA, 17 nt, Escherichia coli CFT073
agcagaucgaucuuguu

SEQ ID NO: 2641545 - RNA, 22 nt, Escherichia coli CFT073
agcagcaaacgccgaggcaaug

SEQ ID NO: 2641546 - RNA, 15 nt, Escherichia coli CFT073
agcagcaaccauuua

SEQ ID NO: 2641547 - RNA, 18 nt, Escherichia coli CFT073
agcagcaauauguugaua

SEQ ID NO: 2641548 - RNA, 21 nt, Escherichia coli CFT073
agcagcaauauguugauaauc

SEQ ID NO: 2641549 - RNA, 15 nt, Escherichia coli CFT073
agcagcacagccaga

SEQ ID NO: 2641550 - RNA, 20 nt, Escherichia coli CFT073
agcagcacagccagaaucaa

SEQ ID NO: 2641551 - RNA, 14 nt, Escherichia coli CFT073
agcagcaccaccgc

SEQ ID NO: 2641552 - RNA, 18 nt, Escherichia coli CFT073
agcagcaccaccgcccgu

SEQ ID NO: 2641553 - RNA, 13 nt, Escherichia coli CFT073
agcagcagcgaau

SEQ ID NO: 2641554 - RNA, 13 nt, Escherichia coli CFT073
agcagcagcgcca

SEQ ID NO: 2641555 - RNA, 20 nt, Escherichia coli CFT073
agcagcagcgccaacgguga

SEQ ID NO: 2641556 - RNA, 15 nt, Escherichia coli CFT073
agcagcagcgccagg

SEQ ID NO: 2641557 - RNA, 15 nt, Escherichia coli CFT073
agcagcauacccacc

SEQ ID NO: 2641558 - RNA, 14 nt, Escherichia coli CFT073
agcagcaucacggu

SEQ ID NO: 2641559 - RNA, 12 nt, Escherichia coli CFT073
agcagccagaga

SEQ ID NO: 2641560 - RNA, 17 nt, Escherichia coli CFT073
agcagccaguuguugau

SEQ ID NO: 2641561 - RNA, 18 nt, Escherichia coli CFT073
agcagcccugccggaacg

SEQ ID NO: 2641562 - RNA, 13 nt, Escherichia coli CFT073
agcagcgaauaau

SEQ ID NO: 2641563 - RNA, 22 nt, Escherichia coli CFT073
agcagcgaauaauucagcccaa

SEQ ID NO: 2641564 - RNA, 19 nt, Escherichia coli CFT073
agcagcgaaucagcccagc

SEQ ID NO: 2641565 - RNA, 23 nt, Escherichia coli CFT073
agcagcgacucacgaaucgccuc

SEQ ID NO: 2641566 - RNA, 19 nt, Escherichia coli CFT073
agcagcgauaucugccgag

SEQ ID NO: 2641567 - RNA, 15 nt, Escherichia coli CFT073
agcagcgcaaagccc

SEQ ID NO: 2641568 - RNA, 22 nt, Escherichia coli CFT073
agcagcgccaacggugaaaaac

SEQ ID NO: 2641569 - RNA, 16 nt, Escherichia coli CFT073
agcagcgccaggcaca

SEQ ID NO: 2641570 - RNA, 14 nt, Escherichia coli CFT073
agcagcgcgugcgc

SEQ ID NO: 2641571 - RNA, 15 nt, Escherichia coli CFT073
agcagcggagaaaug

SEQ ID NO: 2641572 - RNA, 16 nt, Escherichia coli CFT073
agcagcgguaagguga

SEQ ID NO: 2641573 - RNA, 19 nt, Escherichia coli CFT073
agcagcgguugagagaaga

SEQ ID NO: 2641574 - RNA, 21 nt, Escherichia coli CFT073
agcagcguaccucuaucuuga

SEQ ID NO: 2641575 - RNA, 23 nt, Escherichia coli CFT073
agcagcguaccucuaucuugauu

SEQ ID NO: 2641576 - RNA, 16 nt, Escherichia coli CFT073
agcagcgucagcacuu

SEQ ID NO: 2641577 - RNA, 16 nt, Escherichia coli CFT073
agcagcguguugcggc

SEQ ID NO: 2641578 - RNA, 19 nt, Escherichia coli CFT073
agcagcguucccagccagu

SEQ ID NO: 2641579 - RNA, 18 nt, Escherichia coli CFT073
agcauuuugcggaucugc

SEQ ID NO: 2641580 - RNA, 12 nt, Escherichia coli CFT073
agccaaaaauga

SEQ ID NO: 2641581 - RNA, 23 nt, Escherichia coli CFT073
agccaaaaucaaaguuaguaaaa

SEQ ID NO: 2641582 - RNA, 16 nt, Escherichia coli CFT073
agccaaacgcccagcu

SEQ ID NO: 2641583 - RNA, 21 nt, Escherichia coli CFT073
agccaaacgcccagcuaaucg

SEQ ID NO: 2641584 - RNA, 19 nt, Escherichia coli CFT073
agccaaacucauccaccac

SEQ ID NO: 2641585 - RNA, 13 nt, Escherichia coli CFT073
agccaaagcgaca

SEQ ID NO: 2641586 - RNA, 14 nt, Escherichia coli CFT073
agccaaauaaaauc

SEQ ID NO: 2641587 - RNA, 16 nt, Escherichia coli CFT073
agccaaauccagcacc

SEQ ID NO: 2641588 - RNA, 18 nt, Escherichia coli CFT073
agccaaauccagcaccac

SEQ ID NO: 2641589 - RNA, 16 nt, Escherichia coli CFT073
agccaaauccagcgca

SEQ ID NO: 2641590 - RNA, 23 nt, Escherichia coli CFT073
agccaaaucgccccgcagccgau

SEQ ID NO: 2641591 - RNA, 17 nt, Escherichia coli CFT073
agccaacaaucgcugcg

SEQ ID NO: 2641592 - RNA, 13 nt, Escherichia coli CFT073
agccaacagcagc

SEQ ID NO: 2641593 - RNA, 23 nt, Escherichia coli CFT073
agccaaccacaugaucauucacc

SEQ ID NO: 2641594 - RNA, 19 nt, Escherichia coli CFT073
agccaaccucaaaaagaaa

SEQ ID NO: 2641595 - RNA, 19 nt, Escherichia coli CFT073
agccaacgaucuggcguca

SEQ ID NO: 2641596 - RNA, 22 nt, Escherichia coli CFT073
agccaacgaugaugacguaauc

SEQ ID NO: 2641597 - RNA, 23 nt, Escherichia coli CFT073
agccaacguuucuggaaguaauc

SEQ ID NO: 2641598 - RNA, 14 nt, Escherichia coli CFT073
agccaacucuucuu

SEQ ID NO: 2641599 - RNA, 12 nt, Escherichia coli CFT073
agccaagccaga

SEQ ID NO: 2641600 - RNA, 13 nt, Escherichia coli CFT073
agccaagccagag

SEQ ID NO: 2641601 - RNA, 13 nt, Escherichia coli CFT073
agccaagcgccgc

SEQ ID NO: 2641602 - RNA, 13 nt, Escherichia coli CFT073
agccaaucccgga

SEQ ID NO: 2641603 - RNA, 20 nt, Escherichia coli CFT073
agccaaucccggaagccacc

SEQ ID NO: 2641604 - RNA, 13 nt, Escherichia coli CFT073
agccaaucggccc

SEQ ID NO: 2641605 - RNA, 12 nt, Escherichia coli CFT073
agccaaucugug

SEQ ID NO: 2641606 - RNA, 13 nt, Escherichia coli CFT073
agccaaugcaggc

SEQ ID NO: 2641607 - RNA, 18 nt, Escherichia coli CFT073
agccaaugcauuauugau

SEQ ID NO: 2641608 - RNA, 19 nt, Escherichia coli CFT073
agccaauuaacgaaaucuc

SEQ ID NO: 2641609 - RNA, 15 nt, Escherichia coli CFT073
agccaauugccauau

SEQ ID NO: 2641610 - RNA, 12 nt, Escherichia coli CFT073
agccacaacaaa

SEQ ID NO: 2641611 - RNA, 18 nt, Escherichia coli CFT073
agccacaaucgcagcgca

SEQ ID NO: 2641612 - RNA, 16 nt, Escherichia coli CFT073
agccacacagcaaaau

SEQ ID NO: 2641613 - RNA, 20 nt, Escherichia coli CFT073
agccacacugcggccagcau

SEQ ID NO: 2641614 - RNA, 22 nt, Escherichia coli CFT073
agccacaggccggucaucccua

SEQ ID NO: 2641615 - RNA, 16 nt, Escherichia coli CFT073
agccacaguuugcugc

SEQ ID NO: 2641616 - RNA, 19 nt, Escherichia coli CFT073
agccacaguuuuccgccau

SEQ ID NO: 2641617 - RNA, 22 nt, Escherichia coli CFT073
agccacauccaugcuuguuuau

SEQ ID NO: 2641618 - RNA, 17 nt, Escherichia coli CFT073
agccaccacgccaagaa

SEQ ID NO: 2641619 - RNA, 23 nt, Escherichia coli CFT073
agccaccacgcgggguaaaaccc

SEQ ID NO: 2641620 - RNA, 13 nt, Escherichia coli CFT073
agccaccaucccg

SEQ ID NO: 2641621 - RNA, 16 nt, Escherichia coli CFT073
agccaccgcccagaga

SEQ ID NO: 2641622 - RNA, 20 nt, Escherichia coli CFT073
agccaccgcguggcagaccu

SEQ ID NO: 2641623 - RNA, 22 nt, Escherichia coli CFT073
agccacgacguuugguggaaug

SEQ ID NO: 2641624 - RNA, 16 nt, Escherichia coli CFT073
agccacgcaccauccc

SEQ ID NO: 2641625 - RNA, 18 nt, Escherichia coli CFT073
agccacggaauaaaccgu

SEQ ID NO: 2641626 - RNA, 19 nt, Escherichia coli CFT073
agccacggcuccagcaaug

SEQ ID NO: 2641627 - RNA, 20 nt, Escherichia coli CFT073
agccacggcuccagcaaugu

SEQ ID NO: 2641628 - RNA, 20 nt, Escherichia coli CFT073
agccacgguccgccauuucc

SEQ ID NO: 2641629 - RNA, 21 nt, Escherichia coli CFT073
agccacgguuuggcgaaaugu

SEQ ID NO: 2641630 - RNA, 15 nt, Escherichia coli CFT073
agccacgucugccac

SEQ ID NO: 2641631 - RNA, 21 nt, Escherichia coli CFT073
agccacgucugccacggcaga

SEQ ID NO: 2641632 - RNA, 15 nt, Escherichia coli CFT073
agccacucaccgccg

SEQ ID NO: 2641633 - RNA, 23 nt, Escherichia coli CFT073
agccacucuuaacgccacucgcc

SEQ ID NO: 2641634 - RNA, 13 nt, Escherichia coli CFT073
agccacugcgcau

SEQ ID NO: 2641635 - RNA, 13 nt, Escherichia coli CFT073
agccacugcgcca

SEQ ID NO: 2641636 - RNA, 12 nt, Escherichia coli CFT073
agccacugcgcg

SEQ ID NO: 2641637 - RNA, 22 nt, Escherichia coli CFT073
agccacugcugcgcgaaaacgc

SEQ ID NO: 2641638 - RNA, 15 nt, Escherichia coli CFT073
agccacuucaaccag

SEQ ID NO: 2641639 - RNA, 18 nt, Escherichia coli CFT073
agccacuuccuuuagaag

SEQ ID NO: 2641640 - RNA, 20 nt, Escherichia coli CFT073
agccacuuccuuuagaagca

SEQ ID NO: 2641641 - RNA, 13 nt, Escherichia coli CFT073
agccagaacucau

SEQ ID NO: 2641642 - RNA, 14 nt, Escherichia coli CFT073
agccagacaaaugu

SEQ ID NO: 2641643 - RNA, 17 nt, Escherichia coli CFT073
agccagacucagcaaca

SEQ ID NO: 2641644 - RNA, 20 nt, Escherichia coli CFT073
agccagagaagcgacuugug

SEQ ID NO: 2641645 - RNA, 19 nt, Escherichia coli CFT073
agccagauaaaucgauaac

SEQ ID NO: 2641646 - RNA, 19 nt, Escherichia coli CFT073
agccagauaucgagaaucu

SEQ ID NO: 2641647 - RNA, 22 nt, Escherichia coli CFT073
agccagauaucgagaaucugcc

SEQ ID NO: 2641648 - RNA, 24 nt, Escherichia coli CFT073
agccagauaucgagaaucugccgc

SEQ ID NO: 2641649 - RNA, 20 nt, Escherichia coli CFT073
agccagauggggugaccguu

SEQ ID NO: 2641650 - RNA, 13 nt, Escherichia coli CFT073
agccagcaaugua

SEQ ID NO: 2641651 - RNA, 16 nt, Escherichia coli CFT073
agccagcagcgaauca

SEQ ID NO: 2641652 - RNA, 12 nt, Escherichia coli CFT073
agccagccaagc

SEQ ID NO: 2641653 - RNA, 19 nt, Escherichia coli CFT073
agccagccgcuaacuuccu

SEQ ID NO: 2641654 - RNA, 23 nt, Escherichia coli CFT073
agccagccucauccaugcggcag

SEQ ID NO: 2641655 - RNA, 16 nt, Escherichia coli CFT073
agccagcgccgcgcgg

SEQ ID NO: 2641656 - RNA, 18 nt, Escherichia coli CFT073
agccagcggcaccgagga

SEQ ID NO: 2641657 - RNA, 15 nt, Escherichia coli CFT073
agccagcguaccuug

SEQ ID NO: 2641658 - RNA, 16 nt, Escherichia coli CFT073
agccagcguuacccag

SEQ ID NO: 2641659 - RNA, 12 nt, Escherichia coli CFT073
agccagcugccu

SEQ ID NO: 2641660 - RNA, 22 nt, Escherichia coli CFT073
agccagcugccugccaguaaau

SEQ ID NO: 2641661 - RNA, 17 nt, Escherichia coli CFT073
agccaggagccaacacu

SEQ ID NO: 2641662 - RNA, 22 nt, Escherichia coli CFT073
agccaggagccaacacuuucac

SEQ ID NO: 2641663 - RNA, 23 nt, Escherichia coli CFT073
agccaggagccaacacuuucacu

SEQ ID NO: 2641664 - RNA, 15 nt, Escherichia coli CFT073
agccaggcacgccgc

SEQ ID NO: 2641665 - RNA, 15 nt, Escherichia coli CFT073
agccaggccgccagu

SEQ ID NO: 2641666 - RNA, 20 nt, Escherichia coli CFT073
agccaggcgaugaaauucac

SEQ ID NO: 2641667 - RNA, 19 nt, Escherichia coli CFT073
agccaggcgcugcuggagc

SEQ ID NO: 2641668 - RNA, 15 nt, Escherichia coli CFT073
agccaggcuuuaccu

SEQ ID NO: 2641669 - RNA, 17 nt, Escherichia coli CFT073
agccaggcuuuaccuuc

SEQ ID NO: 2641670 - RNA, 18 nt, Escherichia coli CFT073
agccagggcaccaguaaa

SEQ ID NO: 2641671 - RNA, 12 nt, Escherichia coli CFT073
agccagguagau

SEQ ID NO: 2641672 - RNA, 19 nt, Escherichia coli CFT073
agccagguuuaccagcagc

SEQ ID NO: 2641673 - RNA, 13 nt, Escherichia coli CFT073
agccaguaaacca

SEQ ID NO: 2641674 - RNA, 19 nt, Escherichia coli CFT073
agccaguaaaccaaucaau

SEQ ID NO: 2641675 - RNA, 17 nt, Escherichia coli CFT073
agccaguacacgcugaa

SEQ ID NO: 2641676 - RNA, 17 nt, Escherichia coli CFT073
agccaguagaacaauua

SEQ ID NO: 2641677 - RNA, 13 nt, Escherichia coli CFT073
agccaguagcacc

SEQ ID NO: 2641678 - RNA, 15 nt, Escherichia coli CFT073
agccaguagcaccuc

SEQ ID NO: 2641679 - RNA, 17 nt, Escherichia coli CFT073
agccaguauaauauaca

SEQ ID NO: 2641680 - RNA, 16 nt, Escherichia coli CFT073
agccaguccggcaaug

SEQ ID NO: 2641681 - RNA, 22 nt, Escherichia coli CFT073
agccagucgauauggccuucuu

SEQ ID NO: 2641682 - RNA, 22 nt, Escherichia coli CFT073
agccagugauuccggugccgca

SEQ ID NO: 2641683 - RNA, 14 nt, Escherichia coli CFT073
agccagugcuaccc

SEQ ID NO: 2641684 - RNA, 20 nt, Escherichia coli CFT073
agccaguucaugacgcaggc

SEQ ID NO: 2641685 - RNA, 18 nt, Escherichia coli CFT073
agccaguucucaccaaag

SEQ ID NO: 2641686 - RNA, 21 nt, Escherichia coli CFT073
agccaguucucaccaaaggca

SEQ ID NO: 2641687 - RNA, 21 nt, Escherichia coli CFT073
agcgauaaauggcgaacggga

SEQ ID NO: 2641688 - RNA, 14 nt, Escherichia coli CFT073
agcgauagaaauca

SEQ ID NO: 2641689 - RNA, 22 nt, Escherichia coli CFT073
agcgauauccagcgccagaaug

SEQ ID NO: 2641690 - RNA, 19 nt, Escherichia coli CFT073
agcgauauccgggcaaaaa

SEQ ID NO: 2641691 - RNA, 19 nt, Escherichia coli CFT073
agcgauaugccccagcccg

SEQ ID NO: 2641692 - RNA, 21 nt, Escherichia coli CFT073
agcgauccggguaauaaacca

SEQ ID NO: 2641693 - RNA, 13 nt, Escherichia coli CFT073
agcgaucuguuca

SEQ ID NO: 2641694 - RNA, 22 nt, Escherichia coli CFT073
agcgaugguacuucaaucgcca

SEQ ID NO: 2641695 - RNA, 15 nt, Escherichia coli CFT073
agcgauuaacugcgc

SEQ ID NO: 2641696 - RNA, 18 nt, Escherichia coli CFT073
agcgauuaccauuucacu

SEQ ID NO: 2641697 - RNA, 15 nt, Escherichia coli CFT073
agcgauuccaguuca

SEQ ID NO: 2641698 - RNA, 22 nt, Escherichia coli CFT073
agcgauucgucacuuugcuguc

SEQ ID NO: 2641699 - RNA, 23 nt, Escherichia coli CFT073
agcgauuucacgcucagcaacau

SEQ ID NO: 2641700 - RNA, 19 nt, Escherichia coli CFT073
agcgauuuguaggccugau

SEQ ID NO: 2641701 - RNA, 19 nt, Escherichia coli CFT073
agcgauuuugccagccgca

SEQ ID NO: 2641702 - RNA, 15 nt, Escherichia coli CFT073
agcgauuuuucauca

SEQ ID NO: 2641703 - RNA, 23 nt, Escherichia coli CFT073
agcgauuuuucaucacugccgac

SEQ ID NO: 2641704 - RNA, 15 nt, Escherichia coli CFT073
agcgcaaaauaccag

SEQ ID NO: 2641705 - RNA, 20 nt, Escherichia coli CFT073
agcgcaaaauaccagcaauu

SEQ ID NO: 2641706 - RNA, 14 nt, Escherichia coli CFT073
agcgcaaggcgcga

SEQ ID NO: 2641707 - RNA, 22 nt, Escherichia coli CFT073
agcgcaaucugcuucuuaccac

SEQ ID NO: 2641708 - RNA, 15 nt, Escherichia coli CFT073
agcgcacaugcagcu

SEQ ID NO: 2641709 - RNA, 23 nt, Escherichia coli CFT073
agcgcacaugcagcuucgccauu

SEQ ID NO: 2641710 - RNA, 22 nt, Escherichia coli CFT073
agcgcaccaaccacugcucuga

SEQ ID NO: 2641711 - RNA, 22 nt, Escherichia coli CFT073
agcgcaccauaguccggcacca

SEQ ID NO: 2641712 - RNA, 23 nt, Escherichia coli CFT073
agcgcaccauaguccggcaccag

SEQ ID NO: 2641713 - RNA, 17 nt, Escherichia coli CFT073
agcgcacuacgccgcaa

SEQ ID NO: 2641714 - RNA, 19 nt, Escherichia coli CFT073
agcgcacugccgccaugcg

SEQ ID NO: 2641715 - RNA, 20 nt, Escherichia coli CFT073
agcgcacuuuauuaacaagc

SEQ ID NO: 2641716 - RNA, 23 nt, Escherichia coli CFT073
agcgcacuuucacccugacuguu

SEQ ID NO: 2641717 - RNA, 20 nt, Escherichia coli CFT073
agcgcagauuaauugggcga

SEQ ID NO: 2641718 - RNA, 16 nt, Escherichia coli CFT073
agcgcagcaacaucac

SEQ ID NO: 2641719 - RNA, 12 nt, Escherichia coli CFT073
agcgcagcagau

SEQ ID NO: 2641720 - RNA, 16 nt, Escherichia coli CFT073
agcgcagcagauaaaa

SEQ ID NO: 2641721 - RNA, 15 nt, Escherichia coli CFT073
agcgcagcaggcaau

SEQ ID NO: 2641722 - RNA, 17 nt, Escherichia coli CFT073
agcgcagcgcaucaggc

SEQ ID NO: 2641723 - RNA, 17 nt, Escherichia coli CFT073
agcgcaggggcaaucag

SEQ ID NO: 2641724 - RNA, 20 nt, Escherichia coli CFT073
agcgcaggggcaaucagcac

SEQ ID NO: 2641725 - RNA, 19 nt, Escherichia coli CFT073
agcgcaucaggcaaucuug

SEQ ID NO: 2641726 - RNA, 23 nt, Escherichia coli CFT073
agcgcaucagguaauuuugcuua

SEQ ID NO: 2641727 - RNA, 20 nt, Escherichia coli CFT073
agcgcaucaugaaacgccca

SEQ ID NO: 2641728 - RNA, 18 nt, Escherichia coli CFT073
agcgcauccaggcaaagu

SEQ ID NO: 2641729 - RNA, 22 nt, Escherichia coli CFT073
agcgcaugaacguucaccuaaa

SEQ ID NO: 2641730 - RNA, 15 nt, Escherichia coli CFT073
agcgcaugacccagu

SEQ ID NO: 2641731 - RNA, 17 nt, Escherichia coli CFT073
agcgcauggcagccagg

SEQ ID NO: 2641732 - RNA, 19 nt, Escherichia coli CFT073
agcgcauguugacaaaaau

SEQ ID NO: 2641733 - RNA, 20 nt, Escherichia coli CFT073
agcgccaacggugaaaaacc

SEQ ID NO: 2641734 - RNA, 16 nt, Escherichia coli CFT073
agcgccaccagcgcca

SEQ ID NO: 2641735 - RNA, 18 nt, Escherichia coli CFT073
agcgccacccauguugau

SEQ ID NO: 2641736 - RNA, 14 nt, Escherichia coli CFT073
agcgccaccgguuu

SEQ ID NO: 2641737 - RNA, 20 nt, Escherichia coli CFT073
agcgccagcaagagcaaaua

SEQ ID NO: 2641738 - RNA, 16 nt, Escherichia coli CFT073
agcgccagcacuuuaa

SEQ ID NO: 2641739 - RNA, 22 nt, Escherichia coli CFT073
agcgccagcauaugcacacgca

SEQ ID NO: 2641740 - RNA, 12 nt, Escherichia coli CFT073
agcgccagcaug

SEQ ID NO: 2641741 - RNA, 14 nt, Escherichia coli CFT073
agcgccaggaaucu

SEQ ID NO: 2641742 - RNA, 20 nt, Escherichia coli CFT073
agcgccaguaguugcucaag

SEQ ID NO: 2641743 - RNA, 21 nt, Escherichia coli CFT073
agcgccaguaguugcucaagc

SEQ ID NO: 2641744 - RNA, 21 nt, Escherichia coli CFT073
agcgccaguuuuugcuucuga

SEQ ID NO: 2641745 - RNA, 17 nt, Escherichia coli CFT073
agcgccauaaucagcgc

SEQ ID NO: 2641746 - RNA, 16 nt, Escherichia coli CFT073
agcgccauaucggcau

SEQ ID NO: 2641747 - RNA, 14 nt, Escherichia coli CFT073
agcgccaucgccag

SEQ ID NO: 2641748 - RNA, 17 nt, Escherichia coli CFT073
agcgcccgccaagcagu

SEQ ID NO: 2641749 - RNA, 15 nt, Escherichia coli CFT073
agcgcccguaaacca

SEQ ID NO: 2641750 - RNA, 16 nt, Escherichia coli CFT073
agcgccgccagaauca

SEQ ID NO: 2641751 - RNA, 20 nt, Escherichia coli CFT073
agcgccgccagaaucaccuc

SEQ ID NO: 2641752 - RNA, 23 nt, Escherichia coli CFT073
agcgccgccagaaucaccucuuu

SEQ ID NO: 2641753 - RNA, 15 nt, Escherichia coli CFT073
agcgccgccucagcc

SEQ ID NO: 2641754 - RNA, 21 nt, Escherichia coli CFT073
agcgccgccucagccagaaua

SEQ ID NO: 2641755 - RNA, 21 nt, Escherichia coli CFT073
agcgccgcgauaaaaucccau

SEQ ID NO: 2641756 - RNA, 20 nt, Escherichia coli CFT073
agcgccgcgcuauuuuccug

SEQ ID NO: 2641757 - RNA, 22 nt, Escherichia coli CFT073
agcgccgggaaugccacgcaaa

SEQ ID NO: 2641758 - RNA, 19 nt, Escherichia coli CFT073
agcgccgggauguugcugc

SEQ ID NO: 2641759 - RNA, 18 nt, Escherichia coli CFT073
agcgccgggcaaaugcuc

SEQ ID NO: 2641760 - RNA, 23 nt, Escherichia coli CFT073
agcgccgucaguuuuucacccgc

SEQ ID NO: 2641761 - RNA, 21 nt, Escherichia coli CFT073
agcgccucuuccaguaaacca

SEQ ID NO: 2641762 - RNA, 18 nt, Escherichia coli CFT073
agcgccucuuccauaauc

SEQ ID NO: 2641763 - RNA, 15 nt, Escherichia coli CFT073
agcgccugaauaauc

SEQ ID NO: 2641764 - RNA, 22 nt, Escherichia coli CFT073
agcgccugcacaaagcgccaga

SEQ ID NO: 2641765 - RNA, 23 nt, Escherichia coli CFT073
agcgccugcaggcggcucaucac

SEQ ID NO: 2641766 - RNA, 21 nt, Escherichia coli CFT073
agcgccugcgcggcaaugcgc

SEQ ID NO: 2641767 - RNA, 18 nt, Escherichia coli CFT073
agcgccugcugcacacca

SEQ ID NO: 2641768 - RNA, 14 nt, Escherichia coli CFT073
agcgccugcugcug

SEQ ID NO: 2641769 - RNA, 15 nt, Escherichia coli CFT073
agcgccuggcagcau

SEQ ID NO: 2641770 - RNA, 14 nt, Escherichia coli CFT073
agcgccugggaauc

SEQ ID NO: 2641771 - RNA, 13 nt, Escherichia coli CFT073
agcgccuguugau

SEQ ID NO: 2641772 - RNA, 19 nt, Escherichia coli CFT073
agcgccuuaccaauaccgc

SEQ ID NO: 2641773 - RNA, 18 nt, Escherichia coli CFT073
agcgccuuauccggccua

SEQ ID NO: 2641774 - RNA, 20 nt, Escherichia coli CFT073
agcgccuuauccggccuacc

SEQ ID NO: 2641775 - RNA, 20 nt, Escherichia coli CFT073
agcgcgaaaccuuacgccau

SEQ ID NO: 2641776 - RNA, 16 nt, Escherichia coli CFT073
agcgcgaaaucgcccu

SEQ ID NO: 2641777 - RNA, 21 nt, Escherichia coli CFT073
agcgcgacacaacagaccaga

SEQ ID NO: 2641778 - RNA, 13 nt, Escherichia coli CFT073
agcgcgcagguag

SEQ ID NO: 2641779 - RNA, 13 nt, Escherichia coli CFT073
agcgcgccagccg

SEQ ID NO: 2641780 - RNA, 19 nt, Escherichia coli CFT073
agcgcgccugaaugccaca

SEQ ID NO: 2641781 - RNA, 11 nt, Escherichia coli CFT073
agcgcgccugg

SEQ ID NO: 2641782 - RNA, 22 nt, Escherichia coli CFT073
agcgcgcuuuaccaucgcgcac

SEQ ID NO: 2641783 - RNA, 19 nt, Escherichia coli CFT073
agcgcggauuuuauucagc

SEQ ID NO: 2641784 - RNA, 21 nt, Escherichia coli CFT073
agcgcggauuuuauucagcag

SEQ ID NO: 2641785 - RNA, 22 nt, Escherichia coli CFT073
agcgcggauuuuauucagcaga

SEQ ID NO: 2641786 - RNA, 11 nt, Escherichia coli CFT073
agcgcggcagc

SEQ ID NO: 2641787 - RNA, 15 nt, Escherichia coli CFT073
agcgcggcagcggga

SEQ ID NO: 2641788 - RNA, 16 nt, Escherichia coli CFT073
agcgcggcggcaauca

SEQ ID NO: 2641789 - RNA, 19 nt, Escherichia coli CFT073
agcgcgggagaucccuaau

SEQ ID NO: 2641790 - RNA, 17 nt, Escherichia coli CFT073
agcgcggggaguucuga

SEQ ID NO: 2641791 - RNA, 16 nt, Escherichia coli CFT073
agcgcggggaucacug

SEQ ID NO: 2641792 - RNA, 19 nt, Escherichia coli CFT073
agcgcggggaucacuggca

SEQ ID NO: 2641793 - RNA, 20 nt, Escherichia coli CFT073
agcgcggggaucacuggcag

SEQ ID NO: 2641794 - RNA, 14 nt, Escherichia coli CFT073
agcgucagcagcaa

SEQ ID NO: 2641795 - RNA, 15 nt, Escherichia coli CFT073
agcgucagcagcaau

SEQ ID NO: 2641796 - RNA, 16 nt, Escherichia coli CFT073
agcgucagcagcaaua

SEQ ID NO: 2641797 - RNA, 17 nt, Escherichia coli CFT073
agcgucaguucucuggc

SEQ ID NO: 2641798 - RNA, 20 nt, Escherichia coli CFT073
agcgucaucaauccugcagc

SEQ ID NO: 2641799 - RNA, 11 nt, Escherichia coli CFT073
agcguccagcg

SEQ ID NO: 2641800 - RNA, 18 nt, Escherichia coli CFT073
agcguccagcgugucugu

SEQ ID NO: 2641801 - RNA, 17 nt, Escherichia coli CFT073
agcguccauuuacccac

SEQ ID NO: 2641802 - RNA, 19 nt, Escherichia coli CFT073
agcguccauuuacccacag

SEQ ID NO: 2641803 - RNA, 15 nt, Escherichia coli CFT073
agcguccggcugcca

SEQ ID NO: 2641804 - RNA, 22 nt, Escherichia coli CFT073
agcguccgggaaauccucaacc

SEQ ID NO: 2641805 - RNA, 14 nt, Escherichia coli CFT073
agcguccugcucgc

SEQ ID NO: 2641806 - RNA, 13 nt, Escherichia coli CFT073
agcgucgcaucag

SEQ ID NO: 2641807 - RNA, 16 nt, Escherichia coli CFT073
agcgucgcauccgaca

SEQ ID NO: 2641808 - RNA, 21 nt, Escherichia coli CFT073
agcgucgcauccgacuuugaa

SEQ ID NO: 2641809 - RNA, 22 nt, Escherichia coli CFT073
agcgucgccaauggaauagcga

SEQ ID NO: 2641810 - RNA, 14 nt, Escherichia coli CFT073
agcgucgccagcag

SEQ ID NO: 2641811 - RNA, 17 nt, Escherichia coli CFT073
agcgucgccgccgccag

SEQ ID NO: 2641812 - RNA, 13 nt, Escherichia coli CFT073
agcgucgggaagc

SEQ ID NO: 2641813 - RNA, 18 nt, Escherichia coli CFT073
agcgucgggccacgcugc

SEQ ID NO: 2641814 - RNA, 22 nt, Escherichia coli CFT073
agcgucgggccacgcugcgcuu

SEQ ID NO: 2641815 - RNA, 23 nt, Escherichia coli CFT073
agcgucggugucaucgacaucaa

SEQ ID NO: 2641816 - RNA, 16 nt, Escherichia coli CFT073
agcgucguuaaucgcc

SEQ ID NO: 2641817 - RNA, 17 nt, Escherichia coli CFT073
agcgucguuaaucgccu

SEQ ID NO: 2641818 - RNA, 21 nt, Escherichia coli CFT073
agcgucguucgcgccaacagc

SEQ ID NO: 2641819 - RNA, 18 nt, Escherichia coli CFT073
agcgucucuucaauccgc

SEQ ID NO: 2641820 - RNA, 16 nt, Escherichia coli CFT073
agcgucugagcaggcg

SEQ ID NO: 2641821 - RNA, 22 nt, Escherichia coli CFT073
agcgucuguuuuaucacaucca

SEQ ID NO: 2641822 - RNA, 12 nt, Escherichia coli CFT073
agcgucuugaau

SEQ ID NO: 2641823 - RNA, 14 nt, Escherichia coli CFT073
agcgugaaccgccu

SEQ ID NO: 2641824 - RNA, 17 nt, Escherichia coli CFT073
agcgugaaccgccucac

SEQ ID NO: 2641825 - RNA, 12 nt, Escherichia coli CFT073
agcgugagggaa

SEQ ID NO: 2641826 - RNA, 15 nt, Escherichia coli CFT073
agcgugagugcgaaa

SEQ ID NO: 2641827 - RNA, 22 nt, Escherichia coli CFT073
agcgugagugcgaaacagaaau

SEQ ID NO: 2641828 - RNA, 16 nt, Escherichia coli CFT073
agcgugcauagcagca

SEQ ID NO: 2641829 - RNA, 14 nt, Escherichia coli CFT073
agcgugcucucaaa

SEQ ID NO: 2641830 - RNA, 17 nt, Escherichia coli CFT073
agcguggcgaaucgcuu

SEQ ID NO: 2641831 - RNA, 21 nt, Escherichia coli CFT073
agcguguacggcauugucuga

SEQ ID NO: 2641832 - RNA, 20 nt, Escherichia coli CFT073
agcguguuaaugcccaucag

SEQ ID NO: 2641833 - RNA, 15 nt, Escherichia coli CFT073
agcguguuccagcgu

SEQ ID NO: 2641834 - RNA, 14 nt, Escherichia coli CFT073
agcguuaaaauuuc

SEQ ID NO: 2641835 - RNA, 17 nt, Escherichia coli CFT073
agcguuaauuuccucuu

SEQ ID NO: 2641836 - RNA, 15 nt, Escherichia coli CFT073
agcguuacccagaca

SEQ ID NO: 2641837 - RNA, 16 nt, Escherichia coli CFT073
agcguuauauuauuau

SEQ ID NO: 2641838 - RNA, 18 nt, Escherichia coli CFT073
agcguuauauuauuauuc

SEQ ID NO: 2641839 - RNA, 17 nt, Escherichia coli CFT073
agcguucaaaacggcug

SEQ ID NO: 2641840 - RNA, 13 nt, Escherichia coli CFT073
agcguucauaaau

SEQ ID NO: 2641841 - RNA, 13 nt, Escherichia coli CFT073
agcguuccagcag

SEQ ID NO: 2641842 - RNA, 20 nt, Escherichia coli CFT073
agcguuccauaauggcgcga

SEQ ID NO: 2641843 - RNA, 12 nt, Escherichia coli CFT073
agcguuccccag

SEQ ID NO: 2641844 - RNA, 22 nt, Escherichia coli CFT073
agcguucgcacgguucgccauc

SEQ ID NO: 2641845 - RNA, 18 nt, Escherichia coli CFT073
agcguucuaucagggcuu

SEQ ID NO: 2641846 - RNA, 18 nt, Escherichia coli CFT073
agcguucuuuaacugccg

SEQ ID NO: 2641847 - RNA, 19 nt, Escherichia coli CFT073
agcguucuuuaacugccgc

SEQ ID NO: 2641848 - RNA, 21 nt, Escherichia coli CFT073
agcguugaggaacucaaacca

SEQ ID NO: 2641849 - RNA, 20 nt, Escherichia coli CFT073
agcguugaugcucagccucg

SEQ ID NO: 2641850 - RNA, 23 nt, Escherichia coli CFT073
agcguugcagagagucacgcagc

SEQ ID NO: 2641851 - RNA, 21 nt, Escherichia coli CFT073
agcguugguauauuacagguu

SEQ ID NO: 2641852 - RNA, 15 nt, Escherichia coli CFT073
agcguuguaacaauc

SEQ ID NO: 2641853 - RNA, 17 nt, Escherichia coli CFT073
agcguuuaauaaaacgg

SEQ ID NO: 2641854 - RNA, 15 nt, Escherichia coli CFT073
agcguuucauuagcc

SEQ ID NO: 2641855 - RNA, 18 nt, Escherichia coli CFT073
agcguuuucugccagaca

SEQ ID NO: 2641856 - RNA, 15 nt, Escherichia coli CFT073
agcguuuuuucauuu

SEQ ID NO: 2641857 - RNA, 15 nt, Escherichia coli CFT073
agcuaaaaauaauca

SEQ ID NO: 2641858 - RNA, 15 nt, Escherichia coli CFT073
agcuaaaaucgccaa

SEQ ID NO: 2641859 - RNA, 18 nt, Escherichia coli CFT073
agcuaaacagagcugcaa

SEQ ID NO: 2641860 - RNA, 22 nt, Escherichia coli CFT073
agcuaaaccaauaaagaacccg

SEQ ID NO: 2641861 - RNA, 17 nt, Escherichia coli CFT073
agcuaacagcgccgcga

SEQ ID NO: 2641862 - RNA, 19 nt, Escherichia coli CFT073
agcuaaccauccacauuuu

SEQ ID NO: 2641863 - RNA, 13 nt, Escherichia coli CFT073
agcuaauaaaacc

SEQ ID NO: 2641864 - RNA, 14 nt, Escherichia coli CFT073
agcuaaucaucauc

SEQ ID NO: 2641865 - RNA, 20 nt, Escherichia coli CFT073
agcuaaucaucaucagcgcu

SEQ ID NO: 2641866 - RNA, 20 nt, Escherichia coli CFT073
agcuaauccccuccagcgag

SEQ ID NO: 2641867 - RNA, 13 nt, Escherichia coli CFT073
agcuaaugccaac

SEQ ID NO: 2641868 - RNA, 19 nt, Escherichia coli CFT073
agcuaauuuguuaacaaua

SEQ ID NO: 2641869 - RNA, 16 nt, Escherichia coli CFT073
agcuacaccgaucacc

SEQ ID NO: 2641870 - RNA, 15 nt, Escherichia coli CFT073
agcuaccacgccgau

SEQ ID NO: 2641871 - RNA, 18 nt, Escherichia coli CFT073
agcuaccagaauugacca

SEQ ID NO: 2641872 - RNA, 13 nt, Escherichia coli CFT073
agcuaccagcccc

SEQ ID NO: 2641873 - RNA, 20 nt, Escherichia coli CFT073
agcuauauuuugccggacgc

SEQ ID NO: 2641874 - RNA, 22 nt, Escherichia coli CFT073
agcucaaacuggcugaugcugg

SEQ ID NO: 2641875 - RNA, 19 nt, Escherichia coli CFT073
agcucaacaguaaggccug

SEQ ID NO: 2641876 - RNA, 14 nt, Escherichia coli CFT073
agcucaacgcaucg

SEQ ID NO: 2641877 - RNA, 21 nt, Escherichia coli CFT073
agcucaacgccgcuaucagau

SEQ ID NO: 2641878 - RNA, 20 nt, Escherichia coli CFT073
agcucaagugccagaucaga

SEQ ID NO: 2641879 - RNA, 17 nt, Escherichia coli CFT073
agcucaauauauuaaaa

SEQ ID NO: 2641880 - RNA, 13 nt, Escherichia coli CFT073
agcucaaucgccu

SEQ ID NO: 2641881 - RNA, 22 nt, Escherichia coli CFT073
agcucaaugguguuuuccaccg

SEQ ID NO: 2641882 - RNA, 16 nt, Escherichia coli CFT073
agcucacggccaguca

SEQ ID NO: 2641883 - RNA, 19 nt, Escherichia coli CFT073
agcucacggccagucauuu

SEQ ID NO: 2641884 - RNA, 15 nt, Escherichia coli CFT073
agcucacugauaaua

SEQ ID NO: 2641885 - RNA, 18 nt, Escherichia coli CFT073
agcucacugauaauaaua

SEQ ID NO: 2641886 - RNA, 20 nt, Escherichia coli CFT073
agcucacuuugucugcaauc

SEQ ID NO: 2641887 - RNA, 19 nt, Escherichia coli CFT073
agcucagcuggauagagua

SEQ ID NO: 2641888 - RNA, 19 nt, Escherichia coli CFT073
agcucauaaccuguuccuu

SEQ ID NO: 2641889 - RNA, 20 nt, Escherichia coli CFT073
agcucauaggccugcugaau

SEQ ID NO: 2641890 - RNA, 11 nt, Escherichia coli CFT073
agcucaucaac

SEQ ID NO: 2641891 - RNA, 19 nt, Escherichia coli CFT073
agcucaucagguauugcua

SEQ ID NO: 2641892 - RNA, 15 nt, Escherichia coli CFT073
agcucauccagcguc

SEQ ID NO: 2641893 - RNA, 18 nt, Escherichia coli CFT073
agcucaucguuacgccca

SEQ ID NO: 2641894 - RNA, 22 nt, Escherichia coli CFT073
agcuccacaagaaugccugcca

SEQ ID NO: 2641895 - RNA, 14 nt, Escherichia coli CFT073
agcuccacacgcuc

SEQ ID NO: 2641896 - RNA, 12 nt, Escherichia coli CFT073
agcuccagagua

SEQ ID NO: 2641897 - RNA, 21 nt, Escherichia coli CFT073
agcuccagccgcuccccucag

SEQ ID NO: 2641898 - RNA, 20 nt, Escherichia coli CFT073
agcuccaggagggguuuuug

SEQ ID NO: 2641899 - RNA, 14 nt, Escherichia coli CFT073
agcuccagugccug

SEQ ID NO: 2641900 - RNA, 16 nt, Escherichia coli CFT073
agcucccacaguuuca

SEQ ID NO: 2641901 - RNA, 22 nt, Escherichia coli CFT073
agcucccacaguuucagcccca

SEQ ID NO: 2641902 - RNA, 12 nt, Escherichia coli CFT073
agcuugcuucuu

SEQ ID NO: 2641903 - RNA, 15 nt, Escherichia coli CFT073
agcuugcuucuuugc

SEQ ID NO: 2641904 - RNA, 18 nt, Escherichia coli CFT073
agcuugcuuuccagcuuc

SEQ ID NO: 2641905 - RNA, 13 nt, Escherichia coli CFT073
agcuuggcagagc

SEQ ID NO: 2641906 - RNA, 17 nt, Escherichia coli CFT073
agcuugugcaccagcug

SEQ ID NO: 2641907 - RNA, 17 nt, Escherichia coli CFT073
agcuuguuauccaucag

SEQ ID NO: 2641908 - RNA, 12 nt, Escherichia coli CFT073
agcuuucaacgc

SEQ ID NO: 2641909 - RNA, 13 nt, Escherichia coli CFT073
agcuuucaccaga

SEQ ID NO: 2641910 - RNA, 16 nt, Escherichia coli CFT073
agcuuucgcaucagcu

SEQ ID NO: 2641911 - RNA, 15 nt, Escherichia coli CFT073
agcuuugcacucugc

SEQ ID NO: 2641912 - RNA, 19 nt, Escherichia coli CFT073
agcuuugcguuucuuccug

SEQ ID NO: 2641913 - RNA, 15 nt, Escherichia coli CFT073
agcuuuggcggccuu

SEQ ID NO: 2641914 - RNA, 17 nt, Escherichia coli CFT073
agcuuugugcuucaguu

SEQ ID NO: 2641915 - RNA, 15 nt, Escherichia coli CFT073
agcuuuucgcccagg

SEQ ID NO: 2641916 - RNA, 19 nt, Escherichia coli CFT073
agcuuuuucagcguuuucu

SEQ ID NO: 2641917 - RNA, 19 nt, Escherichia coli CFT073
agcuuuuuuggcagcgugc

SEQ ID NO: 2641918 - RNA, 14 nt, Escherichia coli CFT073
aggaaaaacggaau

SEQ ID NO: 2641919 - RNA, 22 nt, Escherichia coli CFT073
aggaaaacgugccacugacauc

SEQ ID NO: 2641920 - RNA, 19 nt, Escherichia coli CFT073
aggaaaagucggggagaaa

SEQ ID NO: 2641921 - RNA, 18 nt, Escherichia coli CFT073
aggaaaauacagcaaugg

SEQ ID NO: 2641922 - RNA, 23 nt, Escherichia coli CFT073
aggaaaauagguguaaauaucag

SEQ ID NO: 2641923 - RNA, 14 nt, Escherichia coli CFT073
aggaaacccaacgc

SEQ ID NO: 2641924 - RNA, 21 nt, Escherichia coli CFT073
aggaaaguccgggcuccauag

SEQ ID NO: 2641925 - RNA, 13 nt, Escherichia coli CFT073
aggaaaucagcac

SEQ ID NO: 2641926 - RNA, 17 nt, Escherichia coli CFT073
aggaaauguuccggguu

SEQ ID NO: 2641927 - RNA, 13 nt, Escherichia coli CFT073
aggaacaaugccu

SEQ ID NO: 2641928 - RNA, 15 nt, Escherichia coli CFT073
aggaacagccacugg

SEQ ID NO: 2641929 - RNA, 12 nt, Escherichia coli CFT073
aggaacauaaag

SEQ ID NO: 2641930 - RNA, 16 nt, Escherichia coli CFT073
aggaacauucggcaau

SEQ ID NO: 2641931 - RNA, 19 nt, Escherichia coli CFT073
aggaacucaaaccauuucu

SEQ ID NO: 2641932 - RNA, 23 nt, Escherichia coli CFT073
aggaacucagcgugccaucaaag

SEQ ID NO: 2641933 - RNA, 17 nt, Escherichia coli CFT073
aggaacugcaaggagag

SEQ ID NO: 2641934 - RNA, 19 nt, Escherichia coli CFT073
aggaacugcauacucgcgu

SEQ ID NO: 2641935 - RNA, 19 nt, Escherichia coli CFT073
aggaacuuaaccugcgaau

SEQ ID NO: 2641936 - RNA, 20 nt, Escherichia coli CFT073
aggaacuuaguaggccugau

SEQ ID NO: 2641937 - RNA, 18 nt, Escherichia coli CFT073
aggaacuucguaagccug

SEQ ID NO: 2641938 - RNA, 16 nt, Escherichia coli CFT073
aggaagaagcccauca

SEQ ID NO: 2641939 - RNA, 20 nt, Escherichia coli CFT073
aggaagaagcuugcuucuuu

SEQ ID NO: 2641940 - RNA, 22 nt, Escherichia coli CFT073
aggaagcgcaacagcgcgcccg

SEQ ID NO: 2641941 - RNA, 20 nt, Escherichia coli CFT073
aggaagcuuucgcaguagau

SEQ ID NO: 2641942 - RNA, 21 nt, Escherichia coli CFT073
aggaagcuuucgcaguagauc

SEQ ID NO: 2641943 - RNA, 16 nt, Escherichia coli CFT073
aggaauauaccuuccg

SEQ ID NO: 2641944 - RNA, 22 nt, Escherichia coli CFT073
aggaauaucuucccgccgcuga

SEQ ID NO: 2641945 - RNA, 12 nt, Escherichia coli CFT073
aggaaugaaaua

SEQ ID NO: 2641946 - RNA, 21 nt, Escherichia coli CFT073
aggaauggcgauuuugugcaa

SEQ ID NO: 2641947 - RNA, 20 nt, Escherichia coli CFT073
aggaauucagcguggcgaau

SEQ ID NO: 2641948 - RNA, 13 nt, Escherichia coli CFT073
aggacaucagcgc

SEQ ID NO: 2641949 - RNA, 16 nt, Escherichia coli CFT073
aggacaucccggcaga

SEQ ID NO: 2641950 - RNA, 14 nt, Escherichia coli CFT073
aggacgaauacaag

SEQ ID NO: 2641951 - RNA, 14 nt, Escherichia coli CFT073
aggacgauaaacca

SEQ ID NO: 2641952 - RNA, 20 nt, Escherichia coli CFT073
aggacgauuccggcaaauaa

SEQ ID NO: 2641953 - RNA, 13 nt, Escherichia coli CFT073
aggacggaauuug

SEQ ID NO: 2641954 - RNA, 21 nt, Escherichia coli CFT073
aggacuauuuacagauuuccc

SEQ ID NO: 2641955 - RNA, 22 nt, Escherichia coli CFT073
aggacuauuuacagauuuccca

SEQ ID NO: 2641956 - RNA, 20 nt, Escherichia coli CFT073
aggacugacgcagcagaccg

SEQ ID NO: 2641957 - RNA, 19 nt, Escherichia coli CFT073
aggacuucaucacgaugca

SEQ ID NO: 2641958 - RNA, 22 nt, Escherichia coli CFT073
aggacuucaucacgaugcaaau

SEQ ID NO: 2641959 - RNA, 19 nt, Escherichia coli CFT073
aggagaagcauccugcacu

SEQ ID NO: 2641960 - RNA, 14 nt, Escherichia coli CFT073
aggagagcaggcca

SEQ ID NO: 2641961 - RNA, 19 nt, Escherichia coli CFT073
aggagaggccuucgacuga

SEQ ID NO: 2641962 - RNA, 20 nt, Escherichia coli CFT073
aggagaguaugcgcgucaga

SEQ ID NO: 2641963 - RNA, 15 nt, Escherichia coli CFT073
aggagccgcauagac

SEQ ID NO: 2641964 - RNA, 23 nt, Escherichia coli CFT073
aggagcugagugcgaaaaucaau

SEQ ID NO: 2641965 - RNA, 19 nt, Escherichia coli CFT073
aggagggauuaauuaccag

SEQ ID NO: 2641966 - RNA, 18 nt, Escherichia coli CFT073
aggagucuuucagacuga

SEQ ID NO: 2641967 - RNA, 16 nt, Escherichia coli CFT073
aggauaaacuccugca

SEQ ID NO: 2641968 - RNA, 19 nt, Escherichia coli CFT073
aggauaaacuccugcacgc

SEQ ID NO: 2641969 - RNA, 20 nt, Escherichia coli CFT073
aggauaaauaaaauaaccac

SEQ ID NO: 2641970 - RNA, 13 nt, Escherichia coli CFT073
aggauagaaaacg

SEQ ID NO: 2641971 - RNA, 13 nt, Escherichia coli CFT073
aggauauaaaaau

SEQ ID NO: 2641972 - RNA, 16 nt, Escherichia coli CFT073
aggauauaaaaauaac

SEQ ID NO: 2641973 - RNA, 17 nt, Escherichia coli CFT073
aggauauaaaaauaaca

SEQ ID NO: 2641974 - RNA, 21 nt, Escherichia coli CFT073
aggauaugcauguucauauca

SEQ ID NO: 2641975 - RNA, 12 nt, Escherichia coli CFT073
aggauauucugc

SEQ ID NO: 2641976 - RNA, 20 nt, Escherichia coli CFT073
aggauauucugcggcuucag

SEQ ID NO: 2641977 - RNA, 15 nt, Escherichia coli CFT073
aggaucaccaauacc

SEQ ID NO: 2641978 - RNA, 16 nt, Escherichia coli CFT073
aggaucaccaauacca

SEQ ID NO: 2641979 - RNA, 21 nt, Escherichia coli CFT073
aggaucaccaauaccagcauc

SEQ ID NO: 2641980 - RNA, 23 nt, Escherichia coli CFT073
aggaucaccaauaccagcaucag

SEQ ID NO: 2641981 - RNA, 21 nt, Escherichia coli CFT073
aggaucagaccgccaaucagc

SEQ ID NO: 2641982 - RNA, 16 nt, Escherichia coli CFT073
aggaucagcaaaaugg

SEQ ID NO: 2641983 - RNA, 19 nt, Escherichia coli CFT073
aggaucgggcagugcucgu

SEQ ID NO: 2641984 - RNA, 15 nt, Escherichia coli CFT073
aggaucuccaguucc

SEQ ID NO: 2641985 - RNA, 18 nt, Escherichia coli CFT073
aggaugagaaaagagaug

SEQ ID NO: 2641986 - RNA, 22 nt, Escherichia coli CFT073
aggaugauggcgugaaagaaaa

SEQ ID NO: 2641987 - RNA, 20 nt, Escherichia coli CFT073
aggaugccugaugcgacgcu

SEQ ID NO: 2641988 - RNA, 20 nt, Escherichia coli CFT073
aggaugcgagucaggccagg

SEQ ID NO: 2641989 - RNA, 21 nt, Escherichia coli CFT073
aggaugcucgcgaaaagaaac

SEQ ID NO: 2641990 - RNA, 22 nt, Escherichia coli CFT073
aggauggcauuugcaacaccgu

SEQ ID NO: 2641991 - RNA, 19 nt, Escherichia coli CFT073
aggaugugagcuggcggac

SEQ ID NO: 2641992 - RNA, 20 nt, Escherichia coli CFT073
aggauguuacaaccuccucc

SEQ ID NO: 2641993 - RNA, 14 nt, Escherichia coli CFT073
aggauuaccggugu

SEQ ID NO: 2641994 - RNA, 15 nt, Escherichia coli CFT073
aggauuagacgaaua

SEQ ID NO: 2641995 - RNA, 14 nt, Escherichia coli CFT073
aggauuuacuaaaa

SEQ ID NO: 2641996 - RNA, 15 nt, Escherichia coli CFT073
aggauuuacuaaaac

SEQ ID NO: 2641997 - RNA, 15 nt, Escherichia coli CFT073
aggcaaaaaggccua

SEQ ID NO: 2641998 - RNA, 15 nt, Escherichia coli CFT073
aggcaaaauccuucc

SEQ ID NO: 2641999 - RNA, 17 nt, Escherichia coli CFT073
aggcaaaauccuuccag

SEQ ID NO: 2642000 - RNA, 17 nt, Escherichia coli CFT073
aggcaaaaugccagccc

SEQ ID NO: 2642001 - RNA, 12 nt, Escherichia coli CFT073
aggcaaaccagu

SEQ ID NO: 2642002 - RNA, 22 nt, Escherichia coli CFT073
aggcaaacuucucaccaucaaa

SEQ ID NO: 2642003 - RNA, 21 nt, Escherichia coli CFT073
aggcaaauucuguuucauuaa

SEQ ID NO: 2642004 - RNA, 21 nt, Escherichia coli CFT073
aggcaacaaaaaacccaucaa

SEQ ID NO: 2642005 - RNA, 18 nt, Escherichia coli CFT073
aggcaacagauaauaaaa

SEQ ID NO: 2642006 - RNA, 21 nt, Escherichia coli CFT073
aggcaaccguucgggaaaaua

SEQ ID NO: 2642007 - RNA, 19 nt, Escherichia coli CFT073
aggcaacgaccagaaaugc

SEQ ID NO: 2642008 - RNA, 22 nt, Escherichia coli CFT073
aggcaagccgcuaacagcagca

SEQ ID NO: 2642009 - RNA, 20 nt, Escherichia coli CFT073
aggcaaguaauuguuucauc

SEQ ID NO: 2642010 - RNA, 14 nt, Escherichia coli CFT073
aggcgaucuucccg

SEQ ID NO: 2642011 - RNA, 16 nt, Escherichia coli CFT073
aggcgaugaaauucac

SEQ ID NO: 2642012 - RNA, 15 nt, Escherichia coli CFT073
aggcgcaaccuucac

SEQ ID NO: 2642013 - RNA, 13 nt, Escherichia coli CFT073
aggcgcagaacuu

SEQ ID NO: 2642014 - RNA, 19 nt, Escherichia coli CFT073
aggcgcagaacuucacucu

SEQ ID NO: 2642015 - RNA, 18 nt, Escherichia coli CFT073
aggcgcaggguuugcauc

SEQ ID NO: 2642016 - RNA, 23 nt, Escherichia coli CFT073
aggcgcaggguuugcaucgccau

SEQ ID NO: 2642017 - RNA, 18 nt, Escherichia coli CFT073
aggcgcauugcuggcugc

SEQ ID NO: 2642018 - RNA, 22 nt, Escherichia coli CFT073
aggcgcauugcuggcugcggga

SEQ ID NO: 2642019 - RNA, 19 nt, Escherichia coli CFT073
aggcgcggacauacgcauc

SEQ ID NO: 2642020 - RNA, 21 nt, Escherichia coli CFT073
aggcgcgucaagcgucgcauc

SEQ ID NO: 2642021 - RNA, 23 nt, Escherichia coli CFT073
aggcgcuaaaagcauagccccag

SEQ ID NO: 2642022 - RNA, 14 nt, Escherichia coli CFT073
aggcgcugauuacc

SEQ ID NO: 2642023 - RNA, 16 nt, Escherichia coli CFT073
aggcgcugcuggagca

SEQ ID NO: 2642024 - RNA, 23 nt, Escherichia coli CFT073
aggcgcuggcgcauguuggcgcg

SEQ ID NO: 2642025 - RNA, 14 nt, Escherichia coli CFT073
aggcggaaacgcug

SEQ ID NO: 2642026 - RNA, 17 nt, Escherichia coli CFT073
aggcggcucaccugcac

SEQ ID NO: 2642027 - RNA, 17 nt, Escherichia coli CFT073
aggcggcucaucacccc

SEQ ID NO: 2642028 - RNA, 14 nt, Escherichia coli CFT073
aggcggcucuggcg

SEQ ID NO: 2642029 - RNA, 21 nt, Escherichia coli CFT073
aggcgggaauaauuucccgcc

SEQ ID NO: 2642030 - RNA, 19 nt, Escherichia coli CFT073
aggcggucauaaaaucaau

SEQ ID NO: 2642031 - RNA, 18 nt, Escherichia coli CFT073
aggcggucuguauuuggc

SEQ ID NO: 2642032 - RNA, 16 nt, Escherichia coli CFT073
aggcgguggaacaagu

SEQ ID NO: 2642033 - RNA, 15 nt, Escherichia coli CFT073
aggcggugguggcuu

SEQ ID NO: 2642034 - RNA, 15 nt, Escherichia coli CFT073
aggcgguuacgccgc

SEQ ID NO: 2642035 - RNA, 23 nt, Escherichia coli CFT073
aggcgguuacgccgcauccgaca

SEQ ID NO: 2642036 - RNA, 22 nt, Escherichia coli CFT073
aggcgucagccaaucacaucag

SEQ ID NO: 2642037 - RNA, 17 nt, Escherichia coli CFT073
aggcgugaagccccaac

SEQ ID NO: 2642038 - RNA, 20 nt, Escherichia coli CFT073
aggcgugaagccccaacgua

SEQ ID NO: 2642039 - RNA, 15 nt, Escherichia coli CFT073
aggcgugcagcgugc

SEQ ID NO: 2642040 - RNA, 18 nt, Escherichia coli CFT073
aggcguggauacaggcgg

SEQ ID NO: 2642041 - RNA, 16 nt, Escherichia coli CFT073
aggcguggcgccccac

SEQ ID NO: 2642042 - RNA, 18 nt, Escherichia coli CFT073
aggcguucaagccgcauc

SEQ ID NO: 2642043 - RNA, 16 nt, Escherichia coli CFT073
aggcguucaagcugca

SEQ ID NO: 2642044 - RNA, 19 nt, Escherichia coli CFT073
aggcguugauuggcgcagg

SEQ ID NO: 2642045 - RNA, 20 nt, Escherichia coli CFT073
aggcguuuacgccgcauccg

SEQ ID NO: 2642046 - RNA, 23 nt, Escherichia coli CFT073
aggcguuuacgccgcauccggca

SEQ ID NO: 2642047 - RNA, 13 nt, Escherichia coli CFT073
aggcguuucacuu

SEQ ID NO: 2642048 - RNA, 17 nt, Escherichia coli CFT073
aggcguuucacuuucag

SEQ ID NO: 2642049 - RNA, 18 nt, Escherichia coli CFT073
aggcguuuuagccgcauc

SEQ ID NO: 2642050 - RNA, 15 nt, Escherichia coli CFT073
aggcguuuuccagau

SEQ ID NO: 2642051 - RNA, 22 nt, Escherichia coli CFT073
aggcuaauaccgucgaugccaa

SEQ ID NO: 2642052 - RNA, 23 nt, Escherichia coli CFT073
aggcuaauaccgucgaugccaau

SEQ ID NO: 2642053 - RNA, 16 nt, Escherichia coli CFT073
aggcuacgcagcaugg

SEQ ID NO: 2642054 - RNA, 13 nt, Escherichia coli CFT073
aggcuacgccaga

SEQ ID NO: 2642055 - RNA, 13 nt, Escherichia coli CFT073
aggcuacucccag

SEQ ID NO: 2642056 - RNA, 14 nt, Escherichia coli CFT073
aggcuccagauaac

SEQ ID NO: 2642057 - RNA, 21 nt, Escherichia coli CFT073
aggcuccgccugauuuacuua

SEQ ID NO: 2642058 - RNA, 20 nt, Escherichia coli CFT073
aggcucugauugccuuccac

SEQ ID NO: 2642059 - RNA, 19 nt, Escherichia coli CFT073
aggcugaaaaucuucucuc

SEQ ID NO: 2642060 - RNA, 21 nt, Escherichia coli CFT073
aggcugaaaaucuucucucau

SEQ ID NO: 2642061 - RNA, 19 nt, Escherichia coli CFT073
aggcugacggcguuugguu

SEQ ID NO: 2642062 - RNA, 21 nt, Escherichia coli CFT073
aggcugagaaccgcacagguu

SEQ ID NO: 2642063 - RNA, 14 nt, Escherichia coli CFT073
aggcugaggcguuu

SEQ ID NO: 2642064 - RNA, 19 nt, Escherichia coli CFT073
aggcugaggcguuucaacu

SEQ ID NO: 2642065 - RNA, 18 nt, Escherichia coli CFT073
aggcugauguugauaaag

SEQ ID NO: 2642066 - RNA, 16 nt, Escherichia coli CFT073
aggcugcauuauccac

SEQ ID NO: 2642067 - RNA, 21 nt, Escherichia coli CFT073
aggcugcauuauccacgccgg

SEQ ID NO: 2642068 - RNA, 12 nt, Escherichia coli CFT073
aggcugccgacg

SEQ ID NO: 2642069 - RNA, 19 nt, Escherichia coli CFT073
aggcugcuugagccaguga

SEQ ID NO: 2642070 - RNA, 20 nt, Escherichia coli CFT073
aggcugcuugagccagugag

SEQ ID NO: 2642071 - RNA, 23 nt, Escherichia coli CFT073
aggcuggcaacgacgguaaacca

SEQ ID NO: 2642072 - RNA, 14 nt, Escherichia coli CFT073
aggcuggcugaccc

SEQ ID NO: 2642073 - RNA, 19 nt, Escherichia coli CFT073
aggcuguaacgaucaauuu

SEQ ID NO: 2642074 - RNA, 17 nt, Escherichia coli CFT073
aggcugucgcaaauucg

SEQ ID NO: 2642075 - RNA, 15 nt, Escherichia coli CFT073
aggcuguuaccccug

SEQ ID NO: 2642076 - RNA, 16 nt, Escherichia coli CFT073
aggcuguucccacgca

SEQ ID NO: 2642077 - RNA, 21 nt, Escherichia coli CFT073
aggcuuaauugcgcagcggag

SEQ ID NO: 2642078 - RNA, 16 nt, Escherichia coli CFT073
aggcuuauccggcauu

SEQ ID NO: 2642079 - RNA, 15 nt, Escherichia coli CFT073
aggcuucccacggua

SEQ ID NO: 2642080 - RNA, 22 nt, Escherichia coli CFT073
aggcuuccuggcuugccagcca

SEQ ID NO: 2642081 - RNA, 16 nt, Escherichia coli CFT073
aggcuucuauggaagu

SEQ ID NO: 2642082 - RNA, 20 nt, Escherichia coli CFT073
aggcuuuggcaccuucgcca

SEQ ID NO: 2642083 - RNA, 15 nt, Escherichia coli CFT073
agggaaacuccagcc

SEQ ID NO: 2642084 - RNA, 20 nt, Escherichia coli CFT073
agggaaaggauggcgaugcu

SEQ ID NO: 2642085 - RNA, 20 nt, Escherichia coli CFT073
agggaacagagagcgccuca

SEQ ID NO: 2642086 - RNA, 13 nt, Escherichia coli CFT073
agggaagcaauaa

SEQ ID NO: 2642087 - RNA, 15 nt, Escherichia coli CFT073
agggaagcgaguuac

SEQ ID NO: 2642088 - RNA, 22 nt, Escherichia coli CFT073
agggaauauaccaccgauugac

SEQ ID NO: 2642089 - RNA, 12 nt, Escherichia coli CFT073
agggacgcgcaa

SEQ ID NO: 2642090 - RNA, 18 nt, Escherichia coli CFT073
agggagcagacuguaaau

SEQ ID NO: 2642091 - RNA, 13 nt, Escherichia coli CFT073
agggagcaggcca

SEQ ID NO: 2642092 - RNA, 18 nt, Escherichia coli CFT073
agggagguuucgaccaca

SEQ ID NO: 2642093 - RNA, 23 nt, Escherichia coli CFT073
agggaguaugcggucaaaagcug

SEQ ID NO: 2642094 - RNA, 21 nt, Escherichia coli CFT073
agggauaagccagaccacagg

SEQ ID NO: 2642095 - RNA, 16 nt, Escherichia coli CFT073
agggaucaacauucag

SEQ ID NO: 2642096 - RNA, 14 nt, Escherichia coli CFT073
agggaugcugugcu

SEQ ID NO: 2642097 - RNA, 15 nt, Escherichia coli CFT073
agggauuaugcaggc

SEQ ID NO: 2642098 - RNA, 20 nt, Escherichia coli CFT073
agggauucgacgcaaacaac

SEQ ID NO: 2642099 - RNA, 14 nt, Escherichia coli CFT073
agggauuguuuaaa

SEQ ID NO: 2642100 - RNA, 13 nt, Escherichia coli CFT073
agggcaucaagaa

SEQ ID NO: 2642101 - RNA, 15 nt, Escherichia coli CFT073
agggccaaacagcag

SEQ ID NO: 2642102 - RNA, 18 nt, Escherichia coli CFT073
agggccaucauuuugcua

SEQ ID NO: 2642103 - RNA, 15 nt, Escherichia coli CFT073
agggcgaauuccuga

SEQ ID NO: 2642104 - RNA, 21 nt, Escherichia coli CFT073
agggcgagaaauugagauaag

SEQ ID NO: 2642105 - RNA, 21 nt, Escherichia coli CFT073
agggcggacugauaacuuuuu

SEQ ID NO: 2642106 - RNA, 16 nt, Escherichia coli CFT073
agggcggcuaucccaa

SEQ ID NO: 2642107 - RNA, 17 nt, Escherichia coli CFT073
agggcuaacgugcaggu

SEQ ID NO: 2642108 - RNA, 15 nt, Escherichia coli CFT073
aggggcaaucagcac

SEQ ID NO: 2642109 - RNA, 18 nt, Escherichia coli CFT073
aggggcaaucagcacuac

SEQ ID NO: 2642110 - RNA, 13 nt, Escherichia coli CFT073
aggggcuaaaagc

SEQ ID NO: 2642111 - RNA, 21 nt, Escherichia coli CFT073
aggggcuuccagcaaauccau

SEQ ID NO: 2642112 - RNA, 18 nt, Escherichia coli CFT073
agggguuauaucuucuuu

SEQ ID NO: 2642113 - RNA, 18 nt, Escherichia coli CFT073
aggguaaaaaccagggug

SEQ ID NO: 2642114 - RNA, 15 nt, Escherichia coli CFT073
aggguaaacaucggu

SEQ ID NO: 2642115 - RNA, 20 nt, Escherichia coli CFT073
aggguaauauauaacagaag

SEQ ID NO: 2642116 - RNA, 17 nt, Escherichia coli CFT073
agggucgcguuccaggc

SEQ ID NO: 2642117 - RNA, 20 nt, Escherichia coli CFT073
agggucuuuuaaauccugca

SEQ ID NO: 2642118 - RNA, 17 nt, Escherichia coli CFT073
aguaaaaggcaccauaa

SEQ ID NO: 2642119 - RNA, 20 nt, Escherichia coli CFT073
aguaaaauauucgaaagcca

SEQ ID NO: 2642120 - RNA, 19 nt, Escherichia coli CFT073
aguaaacaauugcauauca

SEQ ID NO: 2642121 - RNA, 17 nt, Escherichia coli CFT073
aguaaacacaccacagc

SEQ ID NO: 2642122 - RNA, 15 nt, Escherichia coli CFT073
aguaaacaucuucuu

SEQ ID NO: 2642123 - RNA, 18 nt, Escherichia coli CFT073
aguaaaccacaucagcga

SEQ ID NO: 2642124 - RNA, 12 nt, Escherichia coli CFT073
aguaaauaaccu

SEQ ID NO: 2642125 - RNA, 15 nt, Escherichia coli CFT073
aguaaauaagaaaau

SEQ ID NO: 2642126 - RNA, 13 nt, Escherichia coli CFT073
aguaaauacugcg

SEQ ID NO: 2642127 - RNA, 14 nt, Escherichia coli CFT073
aguaaauauugucg

SEQ ID NO: 2642128 - RNA, 16 nt, Escherichia coli CFT073
aguaaauauugucgau

SEQ ID NO: 2642129 - RNA, 15 nt, Escherichia coli CFT073
aguaaaugcuggcgc

SEQ ID NO: 2642130 - RNA, 17 nt, Escherichia coli CFT073
aguaaauggugauauca

SEQ ID NO: 2642131 - RNA, 14 nt, Escherichia coli CFT073
aguaacaaaugugc

SEQ ID NO: 2642132 - RNA, 17 nt, Escherichia coli CFT073
aguaacaaaugugccau

SEQ ID NO: 2642133 - RNA, 16 nt, Escherichia coli CFT073
aguaacagaagaucau

SEQ ID NO: 2642134 - RNA, 23 nt, Escherichia coli CFT073
aguaacagaagaucaugccgaca

SEQ ID NO: 2642135 - RNA, 18 nt, Escherichia coli CFT073
aguaaccgcauccggcgc

SEQ ID NO: 2642136 - RNA, 16 nt, Escherichia coli CFT073
aguaaccuuuaucacg

SEQ ID NO: 2642137 - RNA, 15 nt, Escherichia coli CFT073
aguaaccuuugaaca

SEQ ID NO: 2642138 - RNA, 15 nt, Escherichia coli CFT073
aguaacgccagcggu

SEQ ID NO: 2642139 - RNA, 14 nt, Escherichia coli CFT073
aguaacgcggcaau

SEQ ID NO: 2642140 - RNA, 19 nt, Escherichia coli CFT073
aguaacguugggugcaauc

SEQ ID NO: 2642141 - RNA, 17 nt, Escherichia coli CFT073
aguaacguuugauuaac

SEQ ID NO: 2642142 - RNA, 22 nt, Escherichia coli CFT073
aguaacguuugauuaacgccag

SEQ ID NO: 2642143 - RNA, 23 nt, Escherichia coli CFT073
aguaacguuugauuaacgccaga

SEQ ID NO: 2642144 - RNA, 19 nt, Escherichia coli CFT073
aguaacucauugccagccc

SEQ ID NO: 2642145 - RNA, 22 nt, Escherichia coli CFT073
aguaacucauugccagcccuaa

SEQ ID NO: 2642146 - RNA, 17 nt, Escherichia coli CFT073
aguaacugugaucauau

SEQ ID NO: 2642147 - RNA, 16 nt, Escherichia coli CFT073
aguaagaauaaaacgc

SEQ ID NO: 2642148 - RNA, 20 nt, Escherichia coli CFT073
aguaagaggaggacagccag

SEQ ID NO: 2642149 - RNA, 21 nt, Escherichia coli CFT073
aguaagcaaucacuuuuuacc

SEQ ID NO: 2642150 - RNA, 15 nt, Escherichia coli CFT073
aguaagcccaccaca

SEQ ID NO: 2642151 - RNA, 15 nt, Escherichia coli CFT073
aguaagccgguaauc

SEQ ID NO: 2642152 - RNA, 21 nt, Escherichia coli CFT073
aguaagccgguaaucaccagc

SEQ ID NO: 2642153 - RNA, 23 nt, Escherichia coli CFT073
aguaagcgacgggcgacaaacgc

SEQ ID NO: 2642154 - RNA, 21 nt, Escherichia coli CFT073
aguaagcguuuucucaaaaaa

SEQ ID NO: 2642155 - RNA, 23 nt, Escherichia coli CFT073
aguaaggccugguucaucgcuac

SEQ ID NO: 2642156 - RNA, 23 nt, Escherichia coli CFT073
aguaaggcugcgagguuauccgc

SEQ ID NO: 2642157 - RNA, 13 nt, Escherichia coli CFT073
aguaagugccgga

SEQ ID NO: 2642158 - RNA, 15 nt, Escherichia coli CFT073
aguaaguguuguauu

SEQ ID NO: 2642159 - RNA, 20 nt, Escherichia coli CFT073
aguaaguucacacucugcuu

SEQ ID NO: 2642160 - RNA, 16 nt, Escherichia coli CFT073
aguaauaacaguaaug

SEQ ID NO: 2642161 - RNA, 21 nt, Escherichia coli CFT073
aguaauaacccgucagcagau

SEQ ID NO: 2642162 - RNA, 12 nt, Escherichia coli CFT073
aguaauaaugcc

SEQ ID NO: 2642163 - RNA, 17 nt, Escherichia coli CFT073
aguaauagccugaugua

SEQ ID NO: 2642164 - RNA, 18 nt, Escherichia coli CFT073
aguaauauccccagccua

SEQ ID NO: 2642165 - RNA, 19 nt, Escherichia coli CFT073
aguaauauccccagccuaa

SEQ ID NO: 2642166 - RNA, 14 nt, Escherichia coli CFT073
aguaaucaaucacc

SEQ ID NO: 2642167 - RNA, 18 nt, Escherichia coli CFT073
aguaaucaaucaccucuu

SEQ ID NO: 2642168 - RNA, 13 nt, Escherichia coli CFT073
aguaaucaaugcg

SEQ ID NO: 2642169 - RNA, 13 nt, Escherichia coli CFT073
aguaaucacgaau

SEQ ID NO: 2642170 - RNA, 14 nt, Escherichia coli CFT073
aguaaucaggcuau

SEQ ID NO: 2642171 - RNA, 19 nt, Escherichia coli CFT073
aguaaucaggcuaucuucg

SEQ ID NO: 2642172 - RNA, 13 nt, Escherichia coli CFT073
aguaauccagcaa

SEQ ID NO: 2642173 - RNA, 15 nt, Escherichia coli CFT073
aguaauccagcaaac

SEQ ID NO: 2642174 - RNA, 19 nt, Escherichia coli CFT073
aguaaucgggcaacugcug

SEQ ID NO: 2642175 - RNA, 10 nt, Escherichia coli CFT073
aguaaugaaa

SEQ ID NO: 2642176 - RNA, 14 nt, Escherichia coli CFT073
aguaaugaaaccga

SEQ ID NO: 2642177 - RNA, 21 nt, Escherichia coli CFT073
aguaaugccggaggcaaguuu

SEQ ID NO: 2642178 - RNA, 15 nt, Escherichia coli CFT073
aguaaugcgcccaug

SEQ ID NO: 2642179 - RNA, 20 nt, Escherichia coli CFT073
aguaauguuuucuuuaccac

SEQ ID NO: 2642180 - RNA, 14 nt, Escherichia coli CFT073
aguaauuaaacuga

SEQ ID NO: 2642181 - RNA, 16 nt, Escherichia coli CFT073
aguaauuaaacugaug

SEQ ID NO: 2642182 - RNA, 14 nt, Escherichia coli CFT073
aguaauuccacacc

SEQ ID NO: 2642183 - RNA, 20 nt, Escherichia coli CFT073
aguaauuuauagauucuacg

SEQ ID NO: 2642184 - RNA, 12 nt, Escherichia coli CFT073
aguaauuuuucu

SEQ ID NO: 2642185 - RNA, 14 nt, Escherichia coli CFT073
aguacaaaaauaag

SEQ ID NO: 2642186 - RNA, 19 nt, Escherichia coli CFT073
aguacaacgccgauuaaua

SEQ ID NO: 2642187 - RNA, 22 nt, Escherichia coli CFT073
aguacacugguucccaacaaca

SEQ ID NO: 2642188 - RNA, 17 nt, Escherichia coli CFT073
aguacagccgccagaca

SEQ ID NO: 2642189 - RNA, 16 nt, Escherichia coli CFT073
aguacauuguuuucca

SEQ ID NO: 2642190 - RNA, 13 nt, Escherichia coli CFT073
aguacauuucuuc

SEQ ID NO: 2642191 - RNA, 13 nt, Escherichia coli CFT073
aguaccagcagcg

SEQ ID NO: 2642192 - RNA, 18 nt, Escherichia coli CFT073
aguaccagcccgccgaga

SEQ ID NO: 2642193 - RNA, 16 nt, Escherichia coli CFT073
aguaccaggcaauaaa

SEQ ID NO: 2642194 - RNA, 18 nt, Escherichia coli CFT073
aguaccaggcaauaaaca

SEQ ID NO: 2642195 - RNA, 20 nt, Escherichia coli CFT073
aguaccaucguccagcagca

SEQ ID NO: 2642196 - RNA, 18 nt, Escherichia coli CFT073
aguaccaucuccgcaggc

SEQ ID NO: 2642197 - RNA, 18 nt, Escherichia coli CFT073
aguaccauugaagcaauc

SEQ ID NO: 2642198 - RNA, 16 nt, Escherichia coli CFT073
aguacccaaucagcga

SEQ ID NO: 2642199 - RNA, 22 nt, Escherichia coli CFT073
aguacccagacgcaguacgcca

SEQ ID NO: 2642200 - RNA, 13 nt, Escherichia coli CFT073
aguacccucugca

SEQ ID NO: 2642201 - RNA, 18 nt, Escherichia coli CFT073
aguaccgaacagccaggc

SEQ ID NO: 2642202 - RNA, 19 nt, Escherichia coli CFT073
aguaccgaacggagucggg

SEQ ID NO: 2642203 - RNA, 19 nt, Escherichia coli CFT073
aguaccgccaccaccagac

SEQ ID NO: 2642204 - RNA, 16 nt, Escherichia coli CFT073
aguaccgccagugcag

SEQ ID NO: 2642205 - RNA, 20 nt, Escherichia coli CFT073
aguaccgugcagcgcaaucg

SEQ ID NO: 2642206 - RNA, 15 nt, Escherichia coli CFT073
aguaccugcaaaccg

SEQ ID NO: 2642207 - RNA, 15 nt, Escherichia coli CFT073
aguacgauacaaaag

SEQ ID NO: 2642208 - RNA, 17 nt, Escherichia coli CFT073
aguacgaugauugccac

SEQ ID NO: 2642209 - RNA, 18 nt, Escherichia coli CFT073
aguacgcaguaaauaaaa

SEQ ID NO: 2642210 - RNA, 18 nt, Escherichia coli CFT073
aguacgcaguugcugacg

SEQ ID NO: 2642211 - RNA, 18 nt, Escherichia coli CFT073
aguacgcggacacuuucc

SEQ ID NO: 2642212 - RNA, 19 nt, Escherichia coli CFT073
aguacgcggacacuuuccu

SEQ ID NO: 2642213 - RNA, 22 nt, Escherichia coli CFT073
aguacgcgggcaacgccuucca

SEQ ID NO: 2642214 - RNA, 13 nt, Escherichia coli CFT073
aguacggcagcaa

SEQ ID NO: 2642215 - RNA, 12 nt, Escherichia coli CFT073
aguacgggcaau

SEQ ID NO: 2642216 - RNA, 22 nt, Escherichia coli CFT073
aguacguaaaacaagaucgccc

SEQ ID NO: 2642217 - RNA, 23 nt, Escherichia coli CFT073
aguacgucgagcaguugcugaau

SEQ ID NO: 2642218 - RNA, 21 nt, Escherichia coli CFT073
aguacguucacgcagcucacg

SEQ ID NO: 2642219 - RNA, 20 nt, Escherichia coli CFT073
aguacucgcacuuuucccac

SEQ ID NO: 2642220 - RNA, 18 nt, Escherichia coli CFT073
aguacuuuaccuggaacu

SEQ ID NO: 2642221 - RNA, 20 nt, Escherichia coli CFT073
aguagaacaauuaauacaau

SEQ ID NO: 2642222 - RNA, 15 nt, Escherichia coli CFT073
aguagaacgggaagu

SEQ ID NO: 2642223 - RNA, 23 nt, Escherichia coli CFT073
aguagaacgggaagugcgcccag

SEQ ID NO: 2642224 - RNA, 17 nt, Escherichia coli CFT073
aguagacaauuuuucau

SEQ ID NO: 2642225 - RNA, 22 nt, Escherichia coli CFT073
aguagacaauuuuucauaauca

SEQ ID NO: 2642226 - RNA, 20 nt, Escherichia coli CFT073
agucgcugugacauccagau

SEQ ID NO: 2642227 - RNA, 16 nt, Escherichia coli CFT073
agucgcuugcaggauc

SEQ ID NO: 2642228 - RNA, 19 nt, Escherichia coli CFT073
agucgcuuucauucagaac

SEQ ID NO: 2642229 - RNA, 16 nt, Escherichia coli CFT073
agucggacgacauggu

SEQ ID NO: 2642230 - RNA, 15 nt, Escherichia coli CFT073
agucggcgcaaccuu

SEQ ID NO: 2642231 - RNA, 23 nt, Escherichia coli CFT073
agucggcuucuggccucgcuuug

SEQ ID NO: 2642232 - RNA, 17 nt, Escherichia coli CFT073
agucggggggaggcugc

SEQ ID NO: 2642233 - RNA, 22 nt, Escherichia coli CFT073
agucgggucgccguaagcaaac

SEQ ID NO: 2642234 - RNA, 14 nt, Escherichia coli CFT073
agucggugccaugg

SEQ ID NO: 2642235 - RNA, 17 nt, Escherichia coli CFT073
agucguaaugaaucagc

SEQ ID NO: 2642236 - RNA, 21 nt, Escherichia coli CFT073
agucguaaugaaucagcagau

SEQ ID NO: 2642237 - RNA, 20 nt, Escherichia coli CFT073
agucguauccucagaaauca

SEQ ID NO: 2642238 - RNA, 13 nt, Escherichia coli CFT073
agucgucauccca

SEQ ID NO: 2642239 - RNA, 16 nt, Escherichia coli CFT073
agucgugcccaacugc

SEQ ID NO: 2642240 - RNA, 17 nt, Escherichia coli CFT073
agucguuuuaguaacaa

SEQ ID NO: 2642241 - RNA, 21 nt, Escherichia coli CFT073
  misc_feature (8)..(8): n is a, c, g or u
agucucangagugaacacgua

SEQ ID NO: 2642242 - RNA, 17 nt, Escherichia coli CFT073
agucuccaaccaucacc

SEQ ID NO: 2642243 - RNA, 14 nt, Escherichia coli CFT073
agucuccauuuuuu

SEQ ID NO: 2642244 - RNA, 16 nt, Escherichia coli CFT073
agucuccauuuuuuug

SEQ ID NO: 2642245 - RNA, 21 nt, Escherichia coli CFT073
agucucuucuuugcagggagg

SEQ ID NO: 2642246 - RNA, 19 nt, Escherichia coli CFT073
agucugaccacuaucgccu

SEQ ID NO: 2642247 - RNA, 20 nt, Escherichia coli CFT073
agucugauaguaguuugaug

SEQ ID NO: 2642248 - RNA, 21 nt, Escherichia coli CFT073
agucugcaccuuuaaccccag

SEQ ID NO: 2642249 - RNA, 17 nt, Escherichia coli CFT073
agucugccguugccacg

SEQ ID NO: 2642250 - RNA, 20 nt, Escherichia coli CFT073
agucugcgucaucggcagca

SEQ ID NO: 2642251 - RNA, 17 nt, Escherichia coli CFT073
agucugcuccaucgcau

SEQ ID NO: 2642252 - RNA, 21 nt, Escherichia coli CFT073
agucugcuccaucgcaugcca

SEQ ID NO: 2642253 - RNA, 23 nt, Escherichia coli CFT073
agucugcuuuagggggggcucuu

SEQ ID NO: 2642254 - RNA, 17 nt, Escherichia coli CFT073
agucuggaagaauaguc

SEQ ID NO: 2642255 - RNA, 17 nt, Escherichia coli CFT073
agucuggaagaccagcg

SEQ ID NO: 2642256 - RNA, 19 nt, Escherichia coli CFT073
agucuggugcugcgcuucg

SEQ ID NO: 2642257 - RNA, 18 nt, Escherichia coli CFT073
agucuuauuuaauguaaa

SEQ ID NO: 2642258 - RNA, 18 nt, Escherichia coli CFT073
agucuucacgggaaauau

SEQ ID NO: 2642259 - RNA, 21 nt, Escherichia coli CFT073
agucuucauuguguaucaggu

SEQ ID NO: 2642260 - RNA, 11 nt, Escherichia coli CFT073
agucuuccugc

SEQ ID NO: 2642261 - RNA, 15 nt, Escherichia coli CFT073
agucuuccugcggca

SEQ ID NO: 2642262 - RNA, 15 nt, Escherichia coli CFT073
agucuuucagacuga

SEQ ID NO: 2642263 - RNA, 16 nt, Escherichia coli CFT073
agucuuucagacugag

SEQ ID NO: 2642264 - RNA, 20 nt, Escherichia coli CFT073
agucuuucugugcaaucaca

SEQ ID NO: 2642265 - RNA, 22 nt, Escherichia coli CFT073
agucuuuuuugguuauccagca

SEQ ID NO: 2642266 - RNA, 13 nt, Escherichia coli CFT073
agugaaaaaagca

SEQ ID NO: 2642267 - RNA, 14 nt, Escherichia coli CFT073
agugaaaaaagcaa

SEQ ID NO: 2642268 - RNA, 16 nt, Escherichia coli CFT073
agugaaaaaagcaaga

SEQ ID NO: 2642269 - RNA, 23 nt, Escherichia coli CFT073
agugaaaaaagcaagauuaaaau

SEQ ID NO: 2642270 - RNA, 22 nt, Escherichia coli CFT073
agugaaaacgcauaccagucga

SEQ ID NO: 2642271 - RNA, 17 nt, Escherichia coli CFT073
agugaaacacaugguuu

SEQ ID NO: 2642272 - RNA, 21 nt, Escherichia coli CFT073
agugaaagaggcggagguuuu

SEQ ID NO: 2642273 - RNA, 13 nt, Escherichia coli CFT073
agugaaaugcuuu

SEQ ID NO: 2642274 - RNA, 20 nt, Escherichia coli CFT073
agugaaauuucugccucguc

SEQ ID NO: 2642275 - RNA, 21 nt, Escherichia coli CFT073
agugaacccccugaaagcgac

SEQ ID NO: 2642276 - RNA, 14 nt, Escherichia coli CFT073
agugaacuuucucu

SEQ ID NO: 2642277 - RNA, 13 nt, Escherichia coli CFT073
agugaauccagca

SEQ ID NO: 2642278 - RNA, 14 nt, Escherichia coli CFT073
agugaauggugaag

SEQ ID NO: 2642279 - RNA, 15 nt, Escherichia coli CFT073
agugaauuucuacgu

SEQ ID NO: 2642280 - RNA, 14 nt, Escherichia coli CFT073
agugacaccgguga

SEQ ID NO: 2642281 - RNA, 21 nt, Escherichia coli CFT073
agugacaguguuauucccaac

SEQ ID NO: 2642282 - RNA, 21 nt, Escherichia coli CFT073
agugaccaucuuccagcauca

SEQ ID NO: 2642283 - RNA, 18 nt, Escherichia coli CFT073
agugacccgcagccagca

SEQ ID NO: 2642284 - RNA, 21 nt, Escherichia coli CFT073
agugaccgcuguuaugcacac

SEQ ID NO: 2642285 - RNA, 13 nt, Escherichia coli CFT073
agugacgccgcca

SEQ ID NO: 2642286 - RNA, 14 nt, Escherichia coli CFT073
agugacgccgccag

SEQ ID NO: 2642287 - RNA, 18 nt, Escherichia coli CFT073
agugagacucaccaaucg

SEQ ID NO: 2642288 - RNA, 13 nt, Escherichia coli CFT073
agugagaucauua

SEQ ID NO: 2642289 - RNA, 17 nt, Escherichia coli CFT073
agugagcgauucaaauu

SEQ ID NO: 2642290 - RNA, 21 nt, Escherichia coli CFT073
agugagcgauugcuggccuag

SEQ ID NO: 2642291 - RNA, 15 nt, Escherichia coli CFT073
agugagggccagcgu

SEQ ID NO: 2642292 - RNA, 23 nt, Escherichia coli CFT073
agugauaaaagucgcguuauuuu

SEQ ID NO: 2642293 - RNA, 20 nt, Escherichia coli CFT073
agugauaccccgcaucgugg

SEQ ID NO: 2642294 - RNA, 20 nt, Escherichia coli CFT073
agugaucagccucucucuga

SEQ ID NO: 2642295 - RNA, 16 nt, Escherichia coli CFT073
agugauggcacaccau

SEQ ID NO: 2642296 - RNA, 13 nt, Escherichia coli CFT073
agugauggcggca

SEQ ID NO: 2642297 - RNA, 12 nt, Escherichia coli CFT073
agugauuccggg

SEQ ID NO: 2642298 - RNA, 13 nt, Escherichia coli CFT073
agugauuccguuc

SEQ ID NO: 2642299 - RNA, 17 nt, Escherichia coli CFT073
agugauuccguucagua

SEQ ID NO: 2642300 - RNA, 16 nt, Escherichia coli CFT073
agugauuuacuuucuu

SEQ ID NO: 2642301 - RNA, 19 nt, Escherichia coli CFT073
agugcaaaaaaucaacagc

SEQ ID NO: 2642302 - RNA, 18 nt, Escherichia coli CFT073
agugcaacuuuacuaaaa

SEQ ID NO: 2642303 - RNA, 13 nt, Escherichia coli CFT073
agugcaccagcuu

SEQ ID NO: 2642304 - RNA, 20 nt, Escherichia coli CFT073
agugcacuucuucacaucaa

SEQ ID NO: 2642305 - RNA, 14 nt, Escherichia coli CFT073
agugcagaucgcca

SEQ ID NO: 2642306 - RNA, 20 nt, Escherichia coli CFT073
agugcagccauuuuacucau

SEQ ID NO: 2642307 - RNA, 16 nt, Escherichia coli CFT073
agugcagcgcaugauu

SEQ ID NO: 2642308 - RNA, 24 nt, Escherichia coli CFT073
agugcagcgcaugauuuucaucuu

SEQ ID NO: 2642309 - RNA, 20 nt, Escherichia coli CFT073
agugcauaaauaccggcaug

SEQ ID NO: 2642310 - RNA, 13 nt, Escherichia coli CFT073
agugccacgcccc

SEQ ID NO: 2642311 - RNA, 14 nt, Escherichia coli CFT073
agugccagaacaga

SEQ ID NO: 2642312 - RNA, 15 nt, Escherichia coli CFT073
agugccagaacagaa

SEQ ID NO: 2642313 - RNA, 19 nt, Escherichia coli CFT073
agugccagugccgagauau

SEQ ID NO: 2642314 - RNA, 15 nt, Escherichia coli CFT073
agugcccguccccug

SEQ ID NO: 2642315 - RNA, 19 nt, Escherichia coli CFT073
agugcccguccccugagca

SEQ ID NO: 2642316 - RNA, 16 nt, Escherichia coli CFT073
agugccgaaaucauca

SEQ ID NO: 2642317 - RNA, 19 nt, Escherichia coli CFT073
agugccgccugcgccagug

SEQ ID NO: 2642318 - RNA, 14 nt, Escherichia coli CFT073
agugccgcgcauag

SEQ ID NO: 2642319 - RNA, 16 nt, Escherichia coli CFT073
agugccgcgccgcgcg

SEQ ID NO: 2642320 - RNA, 15 nt, Escherichia coli CFT073
agugccguggcaggc

SEQ ID NO: 2642321 - RNA, 16 nt, Escherichia coli CFT073
agugccugaugcgacg

SEQ ID NO: 2642322 - RNA, 21 nt, Escherichia coli CFT073
agugccugaugcgacgcuuga

SEQ ID NO: 2642323 - RNA, 14 nt, Escherichia coli CFT073
agugccugcacaac

SEQ ID NO: 2642324 - RNA, 14 nt, Escherichia coli CFT073
agugccuggcauaa

SEQ ID NO: 2642325 - RNA, 15 nt, Escherichia coli CFT073
agugccuggcauaac

SEQ ID NO: 2642326 - RNA, 16 nt, Escherichia coli CFT073
agugcgaaaaucaaua

SEQ ID NO: 2642327 - RNA, 20 nt, Escherichia coli CFT073
agugcgaaaaucaauaacac

SEQ ID NO: 2642328 - RNA, 19 nt, Escherichia coli CFT073
agugcgaaacuucuuaaaa

SEQ ID NO: 2642329 - RNA, 14 nt, Escherichia coli CFT073
agugcgaauacccg

SEQ ID NO: 2642330 - RNA, 15 nt, Escherichia coli CFT073
agugcgaggaucauc

SEQ ID NO: 2642331 - RNA, 18 nt, Escherichia coli CFT073
agugcgauuaagauaacg

SEQ ID NO: 2642332 - RNA, 22 nt, Escherichia coli CFT073
agugcgcagcaucggccugcaa

SEQ ID NO: 2642333 - RNA, 16 nt, Escherichia coli CFT073
agugcgcaguugccgg

SEQ ID NO: 2642334 - RNA, 13 nt, Escherichia coli CFT073
aguuccagcaaau

SEQ ID NO: 2642335 - RNA, 22 nt, Escherichia coli CFT073
aguuccagcaucuguucuuuca

SEQ ID NO: 2642336 - RNA, 13 nt, Escherichia coli CFT073
aguuccagcauga

SEQ ID NO: 2642337 - RNA, 13 nt, Escherichia coli CFT073
aguuccaguucau

SEQ ID NO: 2642338 - RNA, 22 nt, Escherichia coli CFT073
aguuccaguuuauaucuuucuc

SEQ ID NO: 2642339 - RNA, 18 nt, Escherichia coli CFT073
aguucccagggcuuucgc

SEQ ID NO: 2642340 - RNA, 19 nt, Escherichia coli CFT073
aguucccccgauugccaug

SEQ ID NO: 2642341 - RNA, 13 nt, Escherichia coli CFT073
aguucccccugcc

SEQ ID NO: 2642342 - RNA, 22 nt, Escherichia coli CFT073
aguucccuacucucgcaugggg

SEQ ID NO: 2642343 - RNA, 21 nt, Escherichia coli CFT073
aguuccgcaaagcccaucacc

SEQ ID NO: 2642344 - RNA, 17 nt, Escherichia coli CFT073
aguuccgggaucaccag

SEQ ID NO: 2642345 - RNA, 18 nt, Escherichia coli CFT073
aguuccgggaucaccaga

SEQ ID NO: 2642346 - RNA, 19 nt, Escherichia coli CFT073
aguuccgggaucaccagac

SEQ ID NO: 2642347 - RNA, 14 nt, Escherichia coli CFT073
aguuccggguuuuc

SEQ ID NO: 2642348 - RNA, 14 nt, Escherichia coli CFT073
aguuccugcaauuu

SEQ ID NO: 2642349 - RNA, 20 nt, Escherichia coli CFT073
aguuccuuaacuucaucggc

SEQ ID NO: 2642350 - RNA, 14 nt, Escherichia coli CFT073
aguucgagaaaaau

SEQ ID NO: 2642351 - RNA, 14 nt, Escherichia coli CFT073
aguucgaugcucug

SEQ ID NO: 2642352 - RNA, 15 nt, Escherichia coli CFT073
aguucgaugcucugu

SEQ ID NO: 2642353 - RNA, 16 nt, Escherichia coli CFT073
aguucgcgaaaguuac

SEQ ID NO: 2642354 - RNA, 19 nt, Escherichia coli CFT073
aguucgcgcgcugccagaa

SEQ ID NO: 2642355 - RNA, 18 nt, Escherichia coli CFT073
aguucgguacguacaaug

SEQ ID NO: 2642356 - RNA, 17 nt, Escherichia coli CFT073
aguucguacacccgcca

SEQ ID NO: 2642357 - RNA, 19 nt, Escherichia coli CFT073
aguucguacacccgccaga

SEQ ID NO: 2642358 - RNA, 19 nt, Escherichia coli CFT073
aguucguccccaccaguga

SEQ ID NO: 2642359 - RNA, 18 nt, Escherichia coli CFT073
aguucgucgcguuugccc

SEQ ID NO: 2642360 - RNA, 15 nt, Escherichia coli CFT073
aguucgucuuccggg

SEQ ID NO: 2642361 - RNA, 16 nt, Escherichia coli CFT073
aguucguugaucaacu

SEQ ID NO: 2642362 - RNA, 14 nt, Escherichia coli CFT073
aguucguugaucag

SEQ ID NO: 2642363 - RNA, 18 nt, Escherichia coli CFT073
aguucucaccaaaggcac

SEQ ID NO: 2642364 - RNA, 22 nt, Escherichia coli CFT073
aguucugcgguugugcaaaaaa

SEQ ID NO: 2642365 - RNA, 18 nt, Escherichia coli CFT073
aguucuuccgcagaguaa

SEQ ID NO: 2642366 - RNA, 22 nt, Escherichia coli CFT073
aguucuucgguggucauuuuau

SEQ ID NO: 2642367 - RNA, 12 nt, Escherichia coli CFT073
aguugaaaucac

SEQ ID NO: 2642368 - RNA, 18 nt, Escherichia coli CFT073
aguugauauacaccugau

SEQ ID NO: 2642369 - RNA, 19 nt, Escherichia coli CFT073
aguugaucgccagagauac

SEQ ID NO: 2642370 - RNA, 22 nt, Escherichia coli CFT073
aguugaugaccagugcagauac

SEQ ID NO: 2642371 - RNA, 17 nt, Escherichia coli CFT073
aguugauugccagcagg

SEQ ID NO: 2642372 - RNA, 13 nt, Escherichia coli CFT073
aguugauuuuaac

SEQ ID NO: 2642373 - RNA, 21 nt, Escherichia coli CFT073
aguugauuuuucguuuuaaug

SEQ ID NO: 2642374 - RNA, 15 nt, Escherichia coli CFT073
aguugcaguccgcua

SEQ ID NO: 2642375 - RNA, 16 nt, Escherichia coli CFT073
aguugcaguuauuaua

SEQ ID NO: 2642376 - RNA, 15 nt, Escherichia coli CFT073
aguugcauaccauuc

SEQ ID NO: 2642377 - RNA, 21 nt, Escherichia coli CFT073
aguugcccgcaucugcgguug

SEQ ID NO: 2642378 - RNA, 15 nt, Escherichia coli CFT073
aguugccgagaaaau

SEQ ID NO: 2642379 - RNA, 13 nt, Escherichia coli CFT073
aguugcggcagga

SEQ ID NO: 2642380 - RNA, 23 nt, Escherichia coli CFT073
aguugcucacgaauagcuuuaac

SEQ ID NO: 2642381 - RNA, 22 nt, Escherichia coli CFT073
aguugcucccauaaugccccag

SEQ ID NO: 2642382 - RNA, 16 nt, Escherichia coli CFT073
aguugcucggcaaggc

SEQ ID NO: 2642383 - RNA, 19 nt, Escherichia coli CFT073
aguugcucggcaaggccaa

SEQ ID NO: 2642384 - RNA, 23 nt, Escherichia coli CFT073
aguugcucuucguuaauuucugc

SEQ ID NO: 2642385 - RNA, 15 nt, Escherichia coli CFT073
aguugcugacuuucc

SEQ ID NO: 2642386 - RNA, 15 nt, Escherichia coli CFT073
aguuggaguaaaacg

SEQ ID NO: 2642387 - RNA, 21 nt, Escherichia coli CFT073
aguuggcagagauucuucaua

SEQ ID NO: 2642388 - RNA, 20 nt, Escherichia coli CFT073
aguugguagagcacgaccuu

SEQ ID NO: 2642389 - RNA, 19 nt, Escherichia coli CFT073
aguuguaugucauaaaaau

SEQ ID NO: 2642390 - RNA, 21 nt, Escherichia coli CFT073
aguugugugggucuaaaaaca

SEQ ID NO: 2642391 - RNA, 21 nt, Escherichia coli CFT073
aguuguuccggagucaacauc

SEQ ID NO: 2642392 - RNA, 14 nt, Escherichia coli CFT073
aguuuaaacagaau

SEQ ID NO: 2642393 - RNA, 21 nt, Escherichia coli CFT073
aguuuaaacagaauacccagc

SEQ ID NO: 2642394 - RNA, 18 nt, Escherichia coli CFT073
aguuuaauccguauuccu

SEQ ID NO: 2642395 - RNA, 15 nt, Escherichia coli CFT073
aguuuaauucuuuga

SEQ ID NO: 2642396 - RNA, 15 nt, Escherichia coli CFT073
aguuuacccagugaa

SEQ ID NO: 2642397 - RNA, 17 nt, Escherichia coli CFT073
aguuuacgucgccaguu

SEQ ID NO: 2642398 - RNA, 21 nt, Escherichia coli CFT073
aguuuacucacaucugacaaa

SEQ ID NO: 2642399 - RNA, 15 nt, Escherichia coli CFT073
aguuuauucuuuacu

SEQ ID NO: 2642400 - RNA, 16 nt, Escherichia coli CFT073
aguuuauucuuuacug

SEQ ID NO: 2642401 - RNA, 13 nt, Escherichia coli CFT073
aguuucaacauca

SEQ ID NO: 2642402 - RNA, 14 nt, Escherichia coli CFT073
aguuucaccagcag

SEQ ID NO: 2642403 - RNA, 23 nt, Escherichia coli CFT073
aguuucaccucuccgggcggcgu

SEQ ID NO: 2642404 - RNA, 14 nt, Escherichia coli CFT073
aguuucagaccaau

SEQ ID NO: 2642405 - RNA, 17 nt, Escherichia coli CFT073
aguuucagccccaucag

SEQ ID NO: 2642406 - RNA, 20 nt, Escherichia coli CFT073
aguuucagccccaucagcgc

SEQ ID NO: 2642407 - RNA, 22 nt, Escherichia coli CFT073
aguuucagccccaucagcgcca

SEQ ID NO: 2642408 - RNA, 23 nt, Escherichia coli CFT073
aguuucagccccaucagcgccau

SEQ ID NO: 2642409 - RNA, 14 nt, Escherichia coli CFT073
aguuuccaguugaa

SEQ ID NO: 2642410 - RNA, 14 nt, Escherichia coli CFT073
aguuuccaucagac

SEQ ID NO: 2642411 - RNA, 16 nt, Escherichia coli CFT073
aguuucccaaugacgu

SEQ ID NO: 2642412 - RNA, 16 nt, Escherichia coli CFT073
aguuucgacaucacau

SEQ ID NO: 2642413 - RNA, 16 nt, Escherichia coli CFT073
aguuucgaucagcaau

SEQ ID NO: 2642414 - RNA, 13 nt, Escherichia coli CFT073
aguuucgccaguu

SEQ ID NO: 2642415 - RNA, 19 nt, Escherichia coli CFT073
aguuucggacgcggcacgc

SEQ ID NO: 2642416 - RNA, 15 nt, Escherichia coli CFT073
aguuucgggaucauc

SEQ ID NO: 2642417 - RNA, 16 nt, Escherichia coli CFT073
aguuucgugcccgcgu

SEQ ID NO: 2642418 - RNA, 15 nt, Escherichia coli CFT073
aguuucguuaaacgc

SEQ ID NO: 2642419 - RNA, 14 nt, Escherichia coli CFT073
aguuucuuaccuac

SEQ ID NO: 2642420 - RNA, 16 nt, Escherichia coli CFT073
aguuucuuuuaacaaa

SEQ ID NO: 2642421 - RNA, 17 nt, Escherichia coli CFT073
aguuugaaagaugcugg

SEQ ID NO: 2642422 - RNA, 19 nt, Escherichia coli CFT073
aguuugaacauaucagcgc

SEQ ID NO: 2642423 - RNA, 14 nt, Escherichia coli CFT073
aguuugcaaaccca

SEQ ID NO: 2642424 - RNA, 17 nt, Escherichia coli CFT073
aguuugcaggccaaaca

SEQ ID NO: 2642425 - RNA, 21 nt, Escherichia coli CFT073
aguuugccguuaaucucuccc

SEQ ID NO: 2642426 - RNA, 18 nt, Escherichia coli CFT073
aguuugcgaguggcgcgc

SEQ ID NO: 2642427 - RNA, 15 nt, Escherichia coli CFT073
aguuugcucaaaucc

SEQ ID NO: 2642428 - RNA, 16 nt, Escherichia coli CFT073
aguuugcugacaaagu

SEQ ID NO: 2642429 - RNA, 20 nt, Escherichia coli CFT073
aguuugggcguuacagcugg

SEQ ID NO: 2642430 - RNA, 18 nt, Escherichia coli CFT073
aguuugguuaagucacgg

SEQ ID NO: 2642431 - RNA, 18 nt, Escherichia coli CFT073
aguuuguuaaccaccagu

SEQ ID NO: 2642432 - RNA, 16 nt, Escherichia coli CFT073
aguuuguugagauaau

SEQ ID NO: 2642433 - RNA, 14 nt, Escherichia coli CFT073
aguuuguuuagcca

SEQ ID NO: 2642434 - RNA, 23 nt, Escherichia coli CFT073
aguuuuaguugccguucuucccg

SEQ ID NO: 2642435 - RNA, 20 nt, Escherichia coli CFT073
aguuuucauauaccgcauca

SEQ ID NO: 2642436 - RNA, 17 nt, Escherichia coli CFT073
aguuuuccgccauucag

SEQ ID NO: 2642437 - RNA, 20 nt, Escherichia coli CFT073
aguuuucgccggaucgaccg

SEQ ID NO: 2642438 - RNA, 21 nt, Escherichia coli CFT073
aguuuugucuucggccauuga

SEQ ID NO: 2642439 - RNA, 12 nt, Escherichia coli CFT073
aguuuuucaaca

SEQ ID NO: 2642440 - RNA, 22 nt, Escherichia coli CFT073
aguuuuuccuuucugauagaac

SEQ ID NO: 2642441 - RNA, 18 nt, Escherichia coli CFT073
aguuuuugcccaucaugc

SEQ ID NO: 2642442 - RNA, 10 nt, Escherichia coli CFT073
auaacagaau

SEQ ID NO: 2642443 - RNA, 18 nt, Escherichia coli CFT073
auaacagaaugcgcgcga

SEQ ID NO: 2642444 - RNA, 23 nt, Escherichia coli CFT073
auaacagaaugcgcgcgaaaaca

SEQ ID NO: 2642445 - RNA, 19 nt, Escherichia coli CFT073
auaacagacuuuguaagaa

SEQ ID NO: 2642446 - RNA, 14 nt, Escherichia coli CFT073
auaacagccaugcc

SEQ ID NO: 2642447 - RNA, 14 nt, Escherichia coli CFT073
auaacagcuggaua

SEQ ID NO: 2642448 - RNA, 18 nt, Escherichia coli CFT073
auaacagcuggauaucaa

SEQ ID NO: 2642449 - RNA, 18 nt, Escherichia coli CFT073
auaacaggcgauuucaaa

SEQ ID NO: 2642450 - RNA, 18 nt, Escherichia coli CFT073
auaacagugauugcuuuu

SEQ ID NO: 2642451 - RNA, 23 nt, Escherichia coli CFT073
auaaccaacggcgagccagcgca

SEQ ID NO: 2642452 - RNA, 18 nt, Escherichia coli CFT073
auaaccacgcucagcaau

SEQ ID NO: 2642453 - RNA, 19 nt, Escherichia coli CFT073
auaaccacgcucagcaauc

SEQ ID NO: 2642454 - RNA, 11 nt, Escherichia coli CFT073
auaaccaggca

SEQ ID NO: 2642455 - RNA, 14 nt, Escherichia coli CFT073
auaaccaggcaguu

SEQ ID NO: 2642456 - RNA, 20 nt, Escherichia coli CFT073
auaaccaugcagcgccgcgu

SEQ ID NO: 2642457 - RNA, 16 nt, Escherichia coli CFT073
auaaccauggcuggca

SEQ ID NO: 2642458 - RNA, 15 nt, Escherichia coli CFT073
auaacccagggguca

SEQ ID NO: 2642459 - RNA, 13 nt, Escherichia coli CFT073
auaacccccugcc

SEQ ID NO: 2642460 - RNA, 17 nt, Escherichia coli CFT073
auaaccccgcaauuuca

SEQ ID NO: 2642461 - RNA, 20 nt, Escherichia coli CFT073
auaacccgacaaggaacgcc

SEQ ID NO: 2642462 - RNA, 17 nt, Escherichia coli CFT073
auaacccgucagcagau

SEQ ID NO: 2642463 - RNA, 16 nt, Escherichia coli CFT073
auaacccugcggcgga

SEQ ID NO: 2642464 - RNA, 16 nt, Escherichia coli CFT073
auaaccgcaaaaccaa

SEQ ID NO: 2642465 - RNA, 19 nt, Escherichia coli CFT073
auaaccgccaccaggaaaa

SEQ ID NO: 2642466 - RNA, 18 nt, Escherichia coli CFT073
auaaccgccgucaacaau

SEQ ID NO: 2642467 - RNA, 21 nt, Escherichia coli CFT073
auaaccgcgcgugccggaacg

SEQ ID NO: 2642468 - RNA, 13 nt, Escherichia coli CFT073
auaaccggcaagc

SEQ ID NO: 2642469 - RNA, 22 nt, Escherichia coli CFT073
auaaccgguuacggauuucccg

SEQ ID NO: 2642470 - RNA, 13 nt, Escherichia coli CFT073
auaaccgucagcg

SEQ ID NO: 2642471 - RNA, 19 nt, Escherichia coli CFT073
auaaccgucagcgcaugau

SEQ ID NO: 2642472 - RNA, 19 nt, Escherichia coli CFT073
auaaccgugcgcaucgcca

SEQ ID NO: 2642473 - RNA, 22 nt, Escherichia coli CFT073
auaaccgugcgcaucgccagac

SEQ ID NO: 2642474 - RNA, 23 nt, Escherichia coli CFT073
auaaccuaacucuuccugcgcac

SEQ ID NO: 2642475 - RNA, 21 nt, Escherichia coli CFT073
auaaccugccgcgccugcgcc

SEQ ID NO: 2642476 - RNA, 19 nt, Escherichia coli CFT073
auaaccuguuaaugcgaau

SEQ ID NO: 2642477 - RNA, 17 nt, Escherichia coli CFT073
auaaccuguugaccaag

SEQ ID NO: 2642478 - RNA, 23 nt, Escherichia coli CFT073
auaaccuugcaggccauaugaca

SEQ ID NO: 2642479 - RNA, 17 nt, Escherichia coli CFT073
auaacgaaaguaucuuc

SEQ ID NO: 2642480 - RNA, 14 nt, Escherichia coli CFT073
auaacgaucggcgu

SEQ ID NO: 2642481 - RNA, 17 nt, Escherichia coli CFT073
auaacgccuggcagugg

SEQ ID NO: 2642482 - RNA, 23 nt, Escherichia coli CFT073
auaacgcgcagcguucauaaaua

SEQ ID NO: 2642483 - RNA, 12 nt, Escherichia coli CFT073
auaacgcgcgcg

SEQ ID NO: 2642484 - RNA, 14 nt, Escherichia coli CFT073
auaacgcggcagga

SEQ ID NO: 2642485 - RNA, 18 nt, Escherichia coli CFT073
auaacgcuggggccaucg

SEQ ID NO: 2642486 - RNA, 19 nt, Escherichia coli CFT073
auaacgggcuucccaacug

SEQ ID NO: 2642487 - RNA, 22 nt, Escherichia coli CFT073
auaacgggcuucccaacugaaa

SEQ ID NO: 2642488 - RNA, 18 nt, Escherichia coli CFT073
auaacggugcugcacauu

SEQ ID NO: 2642489 - RNA, 16 nt, Escherichia coli CFT073
auaacguaaaaacccg

SEQ ID NO: 2642490 - RNA, 14 nt, Escherichia coli CFT073
auaacguaaaccaa

SEQ ID NO: 2642491 - RNA, 14 nt, Escherichia coli CFT073
auaacguaguguaa

SEQ ID NO: 2642492 - RNA, 15 nt, Escherichia coli CFT073
auaacguccauuccc

SEQ ID NO: 2642493 - RNA, 18 nt, Escherichia coli CFT073
auaacgucgccagaaauc

SEQ ID NO: 2642494 - RNA, 20 nt, Escherichia coli CFT073
auaacgucgccagaaaucag

SEQ ID NO: 2642495 - RNA, 19 nt, Escherichia coli CFT073
auaacgugacggcuuuuuu

SEQ ID NO: 2642496 - RNA, 16 nt, Escherichia coli CFT073
auaacuacccaaccga

SEQ ID NO: 2642497 - RNA, 18 nt, Escherichia coli CFT073
auaacucaccaucaagua

SEQ ID NO: 2642498 - RNA, 14 nt, Escherichia coli CFT073
auaacuccgccgcu

SEQ ID NO: 2642499 - RNA, 15 nt, Escherichia coli CFT073
auaacuccgccgcua

SEQ ID NO: 2642500 - RNA, 19 nt, Escherichia coli CFT073
auaacucuccuguuuaaua

SEQ ID NO: 2642501 - RNA, 20 nt, Escherichia coli CFT073
auaacugaauaauacacaca

SEQ ID NO: 2642502 - RNA, 14 nt, Escherichia coli CFT073
auaacugcccgcau

SEQ ID NO: 2642503 - RNA, 12 nt, Escherichia coli CFT073
auaacuggccag

SEQ ID NO: 2642504 - RNA, 15 nt, Escherichia coli CFT073
auaacuggucaucaa

SEQ ID NO: 2642505 - RNA, 16 nt, Escherichia coli CFT073
auaacuggucaucaag

SEQ ID NO: 2642506 - RNA, 14 nt, Escherichia coli CFT073
auaacuugccaggc

SEQ ID NO: 2642507 - RNA, 15 nt, Escherichia coli CFT073
auaacuugccaggcc

SEQ ID NO: 2642508 - RNA, 17 nt, Escherichia coli CFT073
auaacuuugaucgcguu

SEQ ID NO: 2642509 - RNA, 13 nt, Escherichia coli CFT073
auaacuuuuagua

SEQ ID NO: 2642510 - RNA, 15 nt, Escherichia coli CFT073
auaagaaaaugccuc

SEQ ID NO: 2642511 - RNA, 18 nt, Escherichia coli CFT073
auaagaaagauacaaaac

SEQ ID NO: 2642512 - RNA, 22 nt, Escherichia coli CFT073
auaagaacugacuuccacuucc

SEQ ID NO: 2642513 - RNA, 16 nt, Escherichia coli CFT073
auaagaccgugagcaa

SEQ ID NO: 2642514 - RNA, 13 nt, Escherichia coli CFT073
auaagacgcgcca

SEQ ID NO: 2642515 - RNA, 16 nt, Escherichia coli CFT073
auaagacgcgccagca

SEQ ID NO: 2642516 - RNA, 22 nt, Escherichia coli CFT073
auaagacgcgccagcgucgcau

SEQ ID NO: 2642517 - RNA, 16 nt, Escherichia coli CFT073
auaagacgcggcagcg

SEQ ID NO: 2642518 - RNA, 22 nt, Escherichia coli CFT073
auaagacgcggcagcgucgcau

SEQ ID NO: 2642519 - RNA, 18 nt, Escherichia coli CFT073
auaagacgcggcaggcgu

SEQ ID NO: 2642520 - RNA, 22 nt, Escherichia coli CFT073
auaagacgcgucagcgccgcau

SEQ ID NO: 2642521 - RNA, 23 nt, Escherichia coli CFT073
auaagacgcguuaagcgucgcau

SEQ ID NO: 2642522 - RNA, 14 nt, Escherichia coli CFT073
auaagagaugaauu

SEQ ID NO: 2642523 - RNA, 20 nt, Escherichia coli CFT073
auaagaguaaugguuuguuu

SEQ ID NO: 2642524 - RNA, 17 nt, Escherichia coli CFT073
auaagauaacccugcau

SEQ ID NO: 2642525 - RNA, 16 nt, Escherichia coli CFT073
auaagaugcgccagca

SEQ ID NO: 2642526 - RNA, 17 nt, Escherichia coli CFT073
auaagcaaauccuuccg

SEQ ID NO: 2642527 - RNA, 13 nt, Escherichia coli CFT073
auaagcaaggcaa

SEQ ID NO: 2642528 - RNA, 16 nt, Escherichia coli CFT073
auaagcacaaagcaau

SEQ ID NO: 2642529 - RNA, 21 nt, Escherichia coli CFT073
auaagcacaaagcaauauuau

SEQ ID NO: 2642530 - RNA, 18 nt, Escherichia coli CFT073
auaagcaccgaacaagaa

SEQ ID NO: 2642531 - RNA, 13 nt, Escherichia coli CFT073
auaagcaggccau

SEQ ID NO: 2642532 - RNA, 20 nt, Escherichia coli CFT073
auaagcaggccauuugcucu

SEQ ID NO: 2642533 - RNA, 22 nt, Escherichia coli CFT073
auaagcaucgcuagauauauau

SEQ ID NO: 2642534 - RNA, 17 nt, Escherichia coli CFT073
auaagccaguccagaaa

SEQ ID NO: 2642535 - RNA, 17 nt, Escherichia coli CFT073
auaagccauauuuaacu

SEQ ID NO: 2642536 - RNA, 17 nt, Escherichia coli CFT073
auaagcgaacauccggc

SEQ ID NO: 2642537 - RNA, 22 nt, Escherichia coli CFT073
auaagcgcccagcucuuuaccu

SEQ ID NO: 2642538 - RNA, 23 nt, Escherichia coli CFT073
auaagcugccgcuccuucaccuu

SEQ ID NO: 2642539 - RNA, 20 nt, Escherichia coli CFT073
auaaggcauuuacgccgcau

SEQ ID NO: 2642540 - RNA, 20 nt, Escherichia coli CFT073
auaaggcgcucgcgccgcau

SEQ ID NO: 2642541 - RNA, 20 nt, Escherichia coli CFT073
auaaggcggcucuggcggcg

SEQ ID NO: 2642542 - RNA, 20 nt, Escherichia coli CFT073
auaaggcgguuacgccgcau

SEQ ID NO: 2642543 - RNA, 20 nt, Escherichia coli CFT073
auaaggcguuaacgccgcau

SEQ ID NO: 2642544 - RNA, 20 nt, Escherichia coli CFT073
auaaggcguucaagccgcau

SEQ ID NO: 2642545 - RNA, 19 nt, Escherichia coli CFT073
auaaggcguucacgccgca

SEQ ID NO: 2642546 - RNA, 20 nt, Escherichia coli CFT073
auaaggcguucacgccgcau

SEQ ID NO: 2642547 - RNA, 20 nt, Escherichia coli CFT073
auaaggcguucgcgccgcau

SEQ ID NO: 2642548 - RNA, 19 nt, Escherichia coli CFT073
auaaggcguuuacgccgca

SEQ ID NO: 2642549 - RNA, 20 nt, Escherichia coli CFT073
auaaggcguuuacgccgcau

SEQ ID NO: 2642550 - RNA, 13 nt, Escherichia coli CFT073
auaauuauuuuac

SEQ ID NO: 2642551 - RNA, 15 nt, Escherichia coli CFT073
auaauucaucuuuca

SEQ ID NO: 2642552 - RNA, 18 nt, Escherichia coli CFT073
auaauuccccaccugaac

SEQ ID NO: 2642553 - RNA, 23 nt, Escherichia coli CFT073
auaauuccccggcacugucaaca

SEQ ID NO: 2642554 - RNA, 23 nt, Escherichia coli CFT073
auaauuccucccguuaugaucag

SEQ ID NO: 2642555 - RNA, 19 nt, Escherichia coli CFT073
auaauucuggaucaaguau

SEQ ID NO: 2642556 - RNA, 12 nt, Escherichia coli CFT073
auaauugaauaa

SEQ ID NO: 2642557 - RNA, 22 nt, Escherichia coli CFT073
auaauugaccagaucuucauca

SEQ ID NO: 2642558 - RNA, 15 nt, Escherichia coli CFT073
auaauugagcagcaa

SEQ ID NO: 2642559 - RNA, 23 nt, Escherichia coli CFT073
auaauugcggcggcgcaaagcga

SEQ ID NO: 2642560 - RNA, 14 nt, Escherichia coli CFT073
auaauuucagcauc

SEQ ID NO: 2642561 - RNA, 21 nt, Escherichia coli CFT073
auaauuucuucguucgccgca

SEQ ID NO: 2642562 - RNA, 22 nt, Escherichia coli CFT073
auaauuucuucguucgccgcau

SEQ ID NO: 2642563 - RNA, 14 nt, Escherichia coli CFT073
auaauuugugacga

SEQ ID NO: 2642564 - RNA, 12 nt, Escherichia coli CFT073
auaauuugugau

SEQ ID NO: 2642565 - RNA, 22 nt, Escherichia coli CFT073
auaauuugugauuugucauaug

SEQ ID NO: 2642566 - RNA, 24 nt, Escherichia coli CFT073
auaauuugugauuugucauaugca

SEQ ID NO: 2642567 - RNA, 15 nt, Escherichia coli CFT073
auaauuuugaaauaa

SEQ ID NO: 2642568 - RNA, 19 nt, Escherichia coli CFT073
auaauuuugaaauaaaauc

SEQ ID NO: 2642569 - RNA, 20 nt, Escherichia coli CFT073
auaauuuuucuuuaacaucg

SEQ ID NO: 2642570 - RNA, 16 nt, Escherichia coli CFT073
auacaaaacaugugga

SEQ ID NO: 2642571 - RNA, 18 nt, Escherichia coli CFT073
auacaaacucacugccag

SEQ ID NO: 2642572 - RNA, 21 nt, Escherichia coli CFT073
auacaaacucacugccagcau

SEQ ID NO: 2642573 - RNA, 15 nt, Escherichia coli CFT073
auacaaauagccaau

SEQ ID NO: 2642574 - RNA, 19 nt, Escherichia coli CFT073
auacaaccaaucgcggcga

SEQ ID NO: 2642575 - RNA, 18 nt, Escherichia coli CFT073
auacaaccagauaaccau

SEQ ID NO: 2642576 - RNA, 20 nt, Escherichia coli CFT073
auacaacugccgcgccugaa

SEQ ID NO: 2642577 - RNA, 16 nt, Escherichia coli CFT073
auacaagaaauaugaa

SEQ ID NO: 2642578 - RNA, 13 nt, Escherichia coli CFT073
auacacacgcacc

SEQ ID NO: 2642579 - RNA, 18 nt, Escherichia coli CFT073
auacacagauaaacuaca

SEQ ID NO: 2642580 - RNA, 13 nt, Escherichia coli CFT073
auacacaucgucg

SEQ ID NO: 2642581 - RNA, 23 nt, Escherichia coli CFT073
auacacauuuuuuacucucguuc

SEQ ID NO: 2642582 - RNA, 13 nt, Escherichia coli CFT073
auacaccaccaca

SEQ ID NO: 2642583 - RNA, 18 nt, Escherichia coli CFT073
auacaccagaugguuagu

SEQ ID NO: 2642584 - RNA, 18 nt, Escherichia coli CFT073
auacaccggcaucaacgg

SEQ ID NO: 2642585 - RNA, 13 nt, Escherichia coli CFT073
auacacgaaacga

SEQ ID NO: 2642586 - RNA, 14 nt, Escherichia coli CFT073
auacacgaaaugaa

SEQ ID NO: 2642587 - RNA, 21 nt, Escherichia coli CFT073
auacacugcugauaauccagu

SEQ ID NO: 2642588 - RNA, 18 nt, Escherichia coli CFT073
auacagaugcugcucuuc

SEQ ID NO: 2642589 - RNA, 15 nt, Escherichia coli CFT073
auacagcaauggaaa

SEQ ID NO: 2642590 - RNA, 17 nt, Escherichia coli CFT073
auacagcaauggaaaaa

SEQ ID NO: 2642591 - RNA, 18 nt, Escherichia coli CFT073
auacagcguuuugccauc

SEQ ID NO: 2642592 - RNA, 20 nt, Escherichia coli CFT073
auacagcuuaaucaccagcg

SEQ ID NO: 2642593 - RNA, 21 nt, Escherichia coli CFT073
auacagcuuaaucaccagcgc

SEQ ID NO: 2642594 - RNA, 22 nt, Escherichia coli CFT073
auacagcuuaaucaccagcgca

SEQ ID NO: 2642595 - RNA, 17 nt, Escherichia coli CFT073
auacaggaaaccggcga

SEQ ID NO: 2642596 - RNA, 21 nt, Escherichia coli CFT073
auacaggaaauaagaagccau

SEQ ID NO: 2642597 - RNA, 22 nt, Escherichia coli CFT073
auacaggaaauaagaagccaua

SEQ ID NO: 2642598 - RNA, 16 nt, Escherichia coli CFT073
auacaggaacagccac

SEQ ID NO: 2642599 - RNA, 17 nt, Escherichia coli CFT073
auacaggaacagccacu

SEQ ID NO: 2642600 - RNA, 23 nt, Escherichia coli CFT073
auacaggaacagccacuggugag

SEQ ID NO: 2642601 - RNA, 23 nt, Escherichia coli CFT073
auacaggccaccgcccaccauaa

SEQ ID NO: 2642602 - RNA, 14 nt, Escherichia coli CFT073
auacaggggccagc

SEQ ID NO: 2642603 - RNA, 20 nt, Escherichia coli CFT073
auacaguuaucccguacucg

SEQ ID NO: 2642604 - RNA, 23 nt, Escherichia coli CFT073
auacauaagcaccgaacaagaaa

SEQ ID NO: 2642605 - RNA, 14 nt, Escherichia coli CFT073
auacauaccagcag

SEQ ID NO: 2642606 - RNA, 18 nt, Escherichia coli CFT073
auacauaccagcaggaau

SEQ ID NO: 2642607 - RNA, 19 nt, Escherichia coli CFT073
auacauaccagcaggaauc

SEQ ID NO: 2642608 - RNA, 15 nt, Escherichia coli CFT073
auacauauagccaaa

SEQ ID NO: 2642609 - RNA, 20 nt, Escherichia coli CFT073
auacaucgcgcuuaucgcca

SEQ ID NO: 2642610 - RNA, 13 nt, Escherichia coli CFT073
auacaucgcuuuc

SEQ ID NO: 2642611 - RNA, 14 nt, Escherichia coli CFT073
auacaucgcuuucc

SEQ ID NO: 2642612 - RNA, 13 nt, Escherichia coli CFT073
auacauguauaaa

SEQ ID NO: 2642613 - RNA, 20 nt, Escherichia coli CFT073
auacauguauaaaaagaaga

SEQ ID NO: 2642614 - RNA, 18 nt, Escherichia coli CFT073
auacauugcggaccagcg

SEQ ID NO: 2642615 - RNA, 17 nt, Escherichia coli CFT073
auaccaaaaucuaccag

SEQ ID NO: 2642616 - RNA, 11 nt, Escherichia coli CFT073
auaccaacaaa

SEQ ID NO: 2642617 - RNA, 22 nt, Escherichia coli CFT073
auaccaaccauguagacauagg

SEQ ID NO: 2642618 - RNA, 20 nt, Escherichia coli CFT073
auaccaacccuggugcaauu

SEQ ID NO: 2642619 - RNA, 17 nt, Escherichia coli CFT073
auaccaagccaagccag

SEQ ID NO: 2642620 - RNA, 21 nt, Escherichia coli CFT073
auaccaagcccgaugaucauc

SEQ ID NO: 2642621 - RNA, 23 nt, Escherichia coli CFT073
auaccaagucucaagagugaaca

SEQ ID NO: 2642622 - RNA, 23 nt, Escherichia coli CFT073
  misc_feature (14)..(14): n is a, c, g or u
auaccaagucucangagugaaca

SEQ ID NO: 2642623 - RNA, 14 nt, Escherichia coli CFT073
auaccaaucgcagg

SEQ ID NO: 2642624 - RNA, 15 nt, Escherichia coli CFT073
auaccaauuuauuuu

SEQ ID NO: 2642625 - RNA, 14 nt, Escherichia coli CFT073
auaccacacccgca

SEQ ID NO: 2642626 - RNA, 12 nt, Escherichia coli CFT073
auaccacaucaa

SEQ ID NO: 2642627 - RNA, 23 nt, Escherichia coli CFT073
auaccacccuugcccaccagccg

SEQ ID NO: 2642628 - RNA, 17 nt, Escherichia coli CFT073
auaccacgccaucaacg

SEQ ID NO: 2642629 - RNA, 15 nt, Escherichia coli CFT073
auaccacugcgccau

SEQ ID NO: 2642630 - RNA, 16 nt, Escherichia coli CFT073
auaccacuuccagcag

SEQ ID NO: 2642631 - RNA, 16 nt, Escherichia coli CFT073
auaccacuuucagcaa

SEQ ID NO: 2642632 - RNA, 18 nt, Escherichia coli CFT073
auaccagauaaacaucgg

SEQ ID NO: 2642633 - RNA, 17 nt, Escherichia coli CFT073
auaccagauuaauuauu

SEQ ID NO: 2642634 - RNA, 14 nt, Escherichia coli CFT073
auaccagcacauaa

SEQ ID NO: 2642635 - RNA, 14 nt, Escherichia coli CFT073
auaccagcagcauc

SEQ ID NO: 2642636 - RNA, 17 nt, Escherichia coli CFT073
auaccagcagcaucacg

SEQ ID NO: 2642637 - RNA, 16 nt, Escherichia coli CFT073
auaccagcaucaggau

SEQ ID NO: 2642638 - RNA, 23 nt, Escherichia coli CFT073
auaccagccuucuucauccagcg

SEQ ID NO: 2642639 - RNA, 22 nt, Escherichia coli CFT073
auaccagcguagugauaccccg

SEQ ID NO: 2642640 - RNA, 16 nt, Escherichia coli CFT073
auaccaguaauaagcc

SEQ ID NO: 2642641 - RNA, 19 nt, Escherichia coli CFT073
auaccaguugaucaaauaa

SEQ ID NO: 2642642 - RNA, 13 nt, Escherichia coli CFT073
auaccaucggcag

SEQ ID NO: 2642643 - RNA, 12 nt, Escherichia coli CFT073
auacccaaaaaa

SEQ ID NO: 2642644 - RNA, 13 nt, Escherichia coli CFT073
auacccaaaaaau

SEQ ID NO: 2642645 - RNA, 20 nt, Escherichia coli CFT073
auacccaaaaaauagcaaag

SEQ ID NO: 2642646 - RNA, 17 nt, Escherichia coli CFT073
auacccaccgguccuaa

SEQ ID NO: 2642647 - RNA, 20 nt, Escherichia coli CFT073
auacccagacuuuucagauu

SEQ ID NO: 2642648 - RNA, 16 nt, Escherichia coli CFT073
auacccagcaacgaaa

SEQ ID NO: 2642649 - RNA, 17 nt, Escherichia coli CFT073
auacccagcaaugccag

SEQ ID NO: 2642650 - RNA, 23 nt, Escherichia coli CFT073
auacccagcaaugccaggcucca

SEQ ID NO: 2642651 - RNA, 15 nt, Escherichia coli CFT073
auaccccaccgccga

SEQ ID NO: 2642652 - RNA, 13 nt, Escherichia coli CFT073
auaccccagcgca

SEQ ID NO: 2642653 - RNA, 17 nt, Escherichia coli CFT073
auaccccagcggcaacc

SEQ ID NO: 2642654 - RNA, 24 nt, Escherichia coli CFT073
auaccccagcggcaaccagcagca

SEQ ID NO: 2642655 - RNA, 14 nt, Escherichia coli CFT073
auaccccgcauccu

SEQ ID NO: 2642656 - RNA, 19 nt, Escherichia coli CFT073
auaccccugccguuuuuua

SEQ ID NO: 2642657 - RNA, 17 nt, Escherichia coli CFT073
auacccggcacacaaau

SEQ ID NO: 2642658 - RNA, 21 nt, Escherichia coli CFT073
auagaguauccugacgcuguu

SEQ ID NO: 2642659 - RNA, 13 nt, Escherichia coli CFT073
auagagugugugu

SEQ ID NO: 2642660 - RNA, 22 nt, Escherichia coli CFT073
auagauaauuuugaaauaaaau

SEQ ID NO: 2642661 - RNA, 19 nt, Escherichia coli CFT073
auagauauagccuaacaca

SEQ ID NO: 2642662 - RNA, 18 nt, Escherichia coli CFT073
auagauauucaucaaaau

SEQ ID NO: 2642663 - RNA, 19 nt, Escherichia coli CFT073
auagauauucaucaaaaug

SEQ ID NO: 2642664 - RNA, 20 nt, Escherichia coli CFT073
auagauauucaucaaaauga

SEQ ID NO: 2642665 - RNA, 17 nt, Escherichia coli CFT073
auagaucuaaaugccac

SEQ ID NO: 2642666 - RNA, 22 nt, Escherichia coli CFT073
auagcaauaaaugccuggauga

SEQ ID NO: 2642667 - RNA, 16 nt, Escherichia coli CFT073
auagcaaugccaucac

SEQ ID NO: 2642668 - RNA, 19 nt, Escherichia coli CFT073
auagcaaugccaucaccaa

SEQ ID NO: 2642669 - RNA, 17 nt, Escherichia coli CFT073
auagcacgacguuucuu

SEQ ID NO: 2642670 - RNA, 20 nt, Escherichia coli CFT073
auagccaaaacucgaacauu

SEQ ID NO: 2642671 - RNA, 15 nt, Escherichia coli CFT073
auagccaaagcacca

SEQ ID NO: 2642672 - RNA, 21 nt, Escherichia coli CFT073
auagccaccuggcugcguuuu

SEQ ID NO: 2642673 - RNA, 16 nt, Escherichia coli CFT073
auagccacucaccgcc

SEQ ID NO: 2642674 - RNA, 18 nt, Escherichia coli CFT073
auagccagccucauccau

SEQ ID NO: 2642675 - RNA, 13 nt, Escherichia coli CFT073
auagccaggcgga

SEQ ID NO: 2642676 - RNA, 11 nt, Escherichia coli CFT073
auagcccgguu

SEQ ID NO: 2642677 - RNA, 19 nt, Escherichia coli CFT073
auagccgcagcuaucagcg

SEQ ID NO: 2642678 - RNA, 15 nt, Escherichia coli CFT073
auagccgccauucca

SEQ ID NO: 2642679 - RNA, 16 nt, Escherichia coli CFT073
auagccgcuuucuaac

SEQ ID NO: 2642680 - RNA, 12 nt, Escherichia coli CFT073
auagccguuggg

SEQ ID NO: 2642681 - RNA, 17 nt, Escherichia coli CFT073
auagccuccucuuuuuc

SEQ ID NO: 2642682 - RNA, 12 nt, Escherichia coli CFT073
auagccugaugu

SEQ ID NO: 2642683 - RNA, 14 nt, Escherichia coli CFT073
auagccugauguag

SEQ ID NO: 2642684 - RNA, 23 nt, Escherichia coli CFT073
auagccugccaguggagccauca

SEQ ID NO: 2642685 - RNA, 14 nt, Escherichia coli CFT073
auagcgaaccgcag

SEQ ID NO: 2642686 - RNA, 19 nt, Escherichia coli CFT073
auagcgaaccgguaugacg

SEQ ID NO: 2642687 - RNA, 16 nt, Escherichia coli CFT073
auagcgaccaguuugc

SEQ ID NO: 2642688 - RNA, 19 nt, Escherichia coli CFT073
auagcgaccaguuugccuu

SEQ ID NO: 2642689 - RNA, 20 nt, Escherichia coli CFT073
auagcgauuuuucaucacug

SEQ ID NO: 2642690 - RNA, 20 nt, Escherichia coli CFT073
auagcgcacaauaauguggu

SEQ ID NO: 2642691 - RNA, 16 nt, Escherichia coli CFT073
auagcgcacaugcagc

SEQ ID NO: 2642692 - RNA, 19 nt, Escherichia coli CFT073
auagcgcaccaaccacugc

SEQ ID NO: 2642693 - RNA, 14 nt, Escherichia coli CFT073
auagcgcaucacuu

SEQ ID NO: 2642694 - RNA, 15 nt, Escherichia coli CFT073
auagcgcaugacaug

SEQ ID NO: 2642695 - RNA, 17 nt, Escherichia coli CFT073
auagcgcaugacaugcg

SEQ ID NO: 2642696 - RNA, 15 nt, Escherichia coli CFT073
auagcgccacgccaa

SEQ ID NO: 2642697 - RNA, 18 nt, Escherichia coli CFT073
auagcgccucuuuauaaa

SEQ ID NO: 2642698 - RNA, 15 nt, Escherichia coli CFT073
auagcgccugcugcu

SEQ ID NO: 2642699 - RNA, 21 nt, Escherichia coli CFT073
auagcggcgauuaagaaugcg

SEQ ID NO: 2642700 - RNA, 16 nt, Escherichia coli CFT073
auagcgggaaauacug

SEQ ID NO: 2642701 - RNA, 21 nt, Escherichia coli CFT073
auagcggguacagccggaacg

SEQ ID NO: 2642702 - RNA, 21 nt, Escherichia coli CFT073
auagcggguuuguuauucaca

SEQ ID NO: 2642703 - RNA, 17 nt, Escherichia coli CFT073
auagcgguaagcaugaa

SEQ ID NO: 2642704 - RNA, 15 nt, Escherichia coli CFT073
auagcguaaagccag

SEQ ID NO: 2642705 - RNA, 13 nt, Escherichia coli CFT073
auagcguaacuua

SEQ ID NO: 2642706 - RNA, 18 nt, Escherichia coli CFT073
auagcgugacaccagcac

SEQ ID NO: 2642707 - RNA, 16 nt, Escherichia coli CFT073
auagcuaaaaauaauc

SEQ ID NO: 2642708 - RNA, 22 nt, Escherichia coli CFT073
auagcuaaaaauaaucaggcga

SEQ ID NO: 2642709 - RNA, 12 nt, Escherichia coli CFT073
auagcuaauccc

SEQ ID NO: 2642710 - RNA, 16 nt, Escherichia coli CFT073
auagcucaacaguaag

SEQ ID NO: 2642711 - RNA, 16 nt, Escherichia coli CFT073
auagcugauaucaccu

SEQ ID NO: 2642712 - RNA, 17 nt, Escherichia coli CFT073
auagcugccagccccuc

SEQ ID NO: 2642713 - RNA, 21 nt, Escherichia coli CFT073
auagcugccagccccucagcg

SEQ ID NO: 2642714 - RNA, 23 nt, Escherichia coli CFT073
auagcugccagccccucagcggu

SEQ ID NO: 2642715 - RNA, 19 nt, Escherichia coli CFT073
auagcuucuuccacauugu

SEQ ID NO: 2642716 - RNA, 15 nt, Escherichia coli CFT073
auagcuuuggcggca

SEQ ID NO: 2642717 - RNA, 21 nt, Escherichia coli CFT073
auagcuuuugcggucgccuuu

SEQ ID NO: 2642718 - RNA, 14 nt, Escherichia coli CFT073
auaggcaccgccaa

SEQ ID NO: 2642719 - RNA, 21 nt, Escherichia coli CFT073
auaggcaggcaucaucagauu

SEQ ID NO: 2642720 - RNA, 18 nt, Escherichia coli CFT073
auaggccgccgauaacca

SEQ ID NO: 2642721 - RNA, 20 nt, Escherichia coli CFT073
auaggccuuaaccgccgcca

SEQ ID NO: 2642722 - RNA, 22 nt, Escherichia coli CFT073
auagggaguuggaguaaaacgg

SEQ ID NO: 2642723 - RNA, 15 nt, Escherichia coli CFT073
auagguaaacaucac

SEQ ID NO: 2642724 - RNA, 19 nt, Escherichia coli CFT073
auagguaaacaucacauau

SEQ ID NO: 2642725 - RNA, 18 nt, Escherichia coli CFT073
auaggugcccgcauagcc

SEQ ID NO: 2642726 - RNA, 14 nt, Escherichia coli CFT073
auagguggcaaaga

SEQ ID NO: 2642727 - RNA, 16 nt, Escherichia coli CFT073
auagguugaaauaaac

SEQ ID NO: 2642728 - RNA, 16 nt, Escherichia coli CFT073
auaguaagaaccacag

SEQ ID NO: 2642729 - RNA, 21 nt, Escherichia coli CFT073
auaguaagaagcaagguagug

SEQ ID NO: 2642730 - RNA, 20 nt, Escherichia coli CFT073
auaguaagccggauaauucc

SEQ ID NO: 2642731 - RNA, 13 nt, Escherichia coli CFT073
auaguacauuucu

SEQ ID NO: 2642732 - RNA, 19 nt, Escherichia coli CFT073
auaguacuggaagaaaaca

SEQ ID NO: 2642733 - RNA, 22 nt, Escherichia coli CFT073
auaguaggagaagcauccugca

SEQ ID NO: 2642734 - RNA, 17 nt, Escherichia coli CFT073
auaguaguugauauaca

SEQ ID NO: 2642735 - RNA, 23 nt, Escherichia coli CFT073
auaguauauuucgggaugaccga

SEQ ID NO: 2642736 - RNA, 13 nt, Escherichia coli CFT073
auaguauccaacu

SEQ ID NO: 2642737 - RNA, 15 nt, Escherichia coli CFT073
auagucaaauacgcc

SEQ ID NO: 2642738 - RNA, 18 nt, Escherichia coli CFT073
auagucacaaaauaagua

SEQ ID NO: 2642739 - RNA, 19 nt, Escherichia coli CFT073
auagucacgcagcagggca

SEQ ID NO: 2642740 - RNA, 14 nt, Escherichia coli CFT073
auagucaggugggg

SEQ ID NO: 2642741 - RNA, 17 nt, Escherichia coli CFT073
auagucagugaagccau

SEQ ID NO: 2642742 - RNA, 15 nt, Escherichia coli CFT073
auagucaucacuugc

SEQ ID NO: 2642743 - RNA, 16 nt, Escherichia coli CFT073
auagucaugaugacgc

SEQ ID NO: 2642744 - RNA, 19 nt, Escherichia coli CFT073
auaguccgccagaauaccc

SEQ ID NO: 2642745 - RNA, 15 nt, Escherichia coli CFT073
auagugaucagccuc

SEQ ID NO: 2642746 - RNA, 15 nt, Escherichia coli CFT073
auagugcuucaaaua

SEQ ID NO: 2642747 - RNA, 17 nt, Escherichia coli CFT073
auagugcuucaaauauu

SEQ ID NO: 2642748 - RNA, 16 nt, Escherichia coli CFT073
auagugguaccaggau

SEQ ID NO: 2642749 - RNA, 19 nt, Escherichia coli CFT073
auagugguaccaggaucag

SEQ ID NO: 2642750 - RNA, 18 nt, Escherichia coli CFT073
auaguucuucaacaccaa

SEQ ID NO: 2642751 - RNA, 16 nt, Escherichia coli CFT073
auaguugcauuccagu

SEQ ID NO: 2642752 - RNA, 22 nt, Escherichia coli CFT073
auaguuucacggcaccagccau

SEQ ID NO: 2642753 - RNA, 20 nt, Escherichia coli CFT073
auaguuuccaguugaacaau

SEQ ID NO: 2642754 - RNA, 21 nt, Escherichia coli CFT073
auaguuugggcguuacagcug

SEQ ID NO: 2642755 - RNA, 14 nt, Escherichia coli CFT073
auauaaacauauca

SEQ ID NO: 2642756 - RNA, 17 nt, Escherichia coli CFT073
auauaaaccgccgacgc

SEQ ID NO: 2642757 - RNA, 21 nt, Escherichia coli CFT073
auauaaaccguccccaaaaaa

SEQ ID NO: 2642758 - RNA, 13 nt, Escherichia coli CFT073
auauaaacgacag

SEQ ID NO: 2642759 - RNA, 22 nt, Escherichia coli CFT073
auauaaacucgccaaaccauug

SEQ ID NO: 2642760 - RNA, 14 nt, Escherichia coli CFT073
auauaaagaaugaa

SEQ ID NO: 2642761 - RNA, 14 nt, Escherichia coli CFT073
auauaauaagaaua

SEQ ID NO: 2642762 - RNA, 16 nt, Escherichia coli CFT073
auauaauguaucugaa

SEQ ID NO: 2642763 - RNA, 20 nt, Escherichia coli CFT073
auauacaaauagaucgccag

SEQ ID NO: 2642764 - RNA, 14 nt, Escherichia coli CFT073
auauacaaccaaua

SEQ ID NO: 2642765 - RNA, 18 nt, Escherichia coli CFT073
auauacacgaaaugaaua

SEQ ID NO: 2642766 - RNA, 14 nt, Escherichia coli CFT073
auauggcggcggcu

SEQ ID NO: 2642767 - RNA, 19 nt, Escherichia coli CFT073
auauggcugcauccagaaa

SEQ ID NO: 2642768 - RNA, 22 nt, Escherichia coli CFT073
auaugggcaaacaaaaaaccua

SEQ ID NO: 2642769 - RNA, 18 nt, Escherichia coli CFT073
auauggggcagaugggcu

SEQ ID NO: 2642770 - RNA, 14 nt, Escherichia coli CFT073
auauguauuauaag

SEQ ID NO: 2642771 - RNA, 22 nt, Escherichia coli CFT073
auaugucaccagcauuagcauu

SEQ ID NO: 2642772 - RNA, 20 nt, Escherichia coli CFT073
auaugucgcgccaggcgcug

SEQ ID NO: 2642773 - RNA, 18 nt, Escherichia coli CFT073
auaugugaucgaauauau

SEQ ID NO: 2642774 - RNA, 19 nt, Escherichia coli CFT073
auaugugaucgaauauauc

SEQ ID NO: 2642775 - RNA, 16 nt, Escherichia coli CFT073
auauguucccgcgccu

SEQ ID NO: 2642776 - RNA, 19 nt, Escherichia coli CFT073
auauguucgcuuaacucac

SEQ ID NO: 2642777 - RNA, 20 nt, Escherichia coli CFT073
auauguugauaaucaacagg

SEQ ID NO: 2642778 - RNA, 21 nt, Escherichia coli CFT073
auauguuguguaggccugaga

SEQ ID NO: 2642779 - RNA, 18 nt, Escherichia coli CFT073
auauguuuaaccggcagc

SEQ ID NO: 2642780 - RNA, 22 nt, Escherichia coli CFT073
auauguuuacgcguuuuucaga

SEQ ID NO: 2642781 - RNA, 23 nt, Escherichia coli CFT073
auauguuuacgcguuuuucagaa

SEQ ID NO: 2642782 - RNA, 19 nt, Escherichia coli CFT073
auauguuuuuuuuaucacu

SEQ ID NO: 2642783 - RNA, 13 nt, Escherichia coli CFT073
auauuaacaacau

SEQ ID NO: 2642784 - RNA, 16 nt, Escherichia coli CFT073
auauuaagcggcacca

SEQ ID NO: 2642785 - RNA, 19 nt, Escherichia coli CFT073
auauuaauguuuucaguua

SEQ ID NO: 2642786 - RNA, 13 nt, Escherichia coli CFT073
auauuaauuacuu

SEQ ID NO: 2642787 - RNA, 20 nt, Escherichia coli CFT073
auauuaauuacuucucuuuc

SEQ ID NO: 2642788 - RNA, 17 nt, Escherichia coli CFT073
auauuacauaccagcag

SEQ ID NO: 2642789 - RNA, 19 nt, Escherichia coli CFT073
auauuacauaccagcagca

SEQ ID NO: 2642790 - RNA, 15 nt, Escherichia coli CFT073
auauuaccuuuaugc

SEQ ID NO: 2642791 - RNA, 19 nt, Escherichia coli CFT073
auauuacgggucacaaaca

SEQ ID NO: 2642792 - RNA, 23 nt, Escherichia coli CFT073
auauuacgggucacaaacaucau

SEQ ID NO: 2642793 - RNA, 17 nt, Escherichia coli CFT073
auauuacgugccgcguu

SEQ ID NO: 2642794 - RNA, 14 nt, Escherichia coli CFT073
auauuacugacgcc

SEQ ID NO: 2642795 - RNA, 15 nt, Escherichia coli CFT073
auauuacugacgccg

SEQ ID NO: 2642796 - RNA, 19 nt, Escherichia coli CFT073
auauuaguggcaaccgcaa

SEQ ID NO: 2642797 - RNA, 18 nt, Escherichia coli CFT073
auauuauguuaaauugcc

SEQ ID NO: 2642798 - RNA, 19 nt, Escherichia coli CFT073
auauucaauucgucuauca

SEQ ID NO: 2642799 - RNA, 20 nt, Escherichia coli CFT073
auauucaauuuguuaucgcu

SEQ ID NO: 2642800 - RNA, 23 nt, Escherichia coli CFT073
auauucacgcuuacucuucguuc

SEQ ID NO: 2642801 - RNA, 13 nt, Escherichia coli CFT073
auauucagcagca

SEQ ID NO: 2642802 - RNA, 14 nt, Escherichia coli CFT073
auauucagcagcag

SEQ ID NO: 2642803 - RNA, 19 nt, Escherichia coli CFT073
auauucaguccacaucuca

SEQ ID NO: 2642804 - RNA, 21 nt, Escherichia coli CFT073
auauucagucccuguuccacu

SEQ ID NO: 2642805 - RNA, 22 nt, Escherichia coli CFT073
auauucauauuuuuucccgccc

SEQ ID NO: 2642806 - RNA, 15 nt, Escherichia coli CFT073
auauucaucaaaaug

SEQ ID NO: 2642807 - RNA, 18 nt, Escherichia coli CFT073
auauucaugaauaaaaaa

SEQ ID NO: 2642808 - RNA, 21 nt, Escherichia coli CFT073
auauucauuaauaaccauuaa

SEQ ID NO: 2642809 - RNA, 11 nt, Escherichia coli CFT073
auauucauuuu

SEQ ID NO: 2642810 - RNA, 11 nt, Escherichia coli CFT073
auauuccccag

SEQ ID NO: 2642811 - RNA, 20 nt, Escherichia coli CFT073
auauucccccaccgccgccg

SEQ ID NO: 2642812 - RNA, 18 nt, Escherichia coli CFT073
auauuccccggucagcag

SEQ ID NO: 2642813 - RNA, 21 nt, Escherichia coli CFT073
auauuccccggucagcagcac

SEQ ID NO: 2642814 - RNA, 22 nt, Escherichia coli CFT073
auauucccuacgccuaccacca

SEQ ID NO: 2642815 - RNA, 17 nt, Escherichia coli CFT073
auauuccgcaacgccgc

SEQ ID NO: 2642816 - RNA, 19 nt, Escherichia coli CFT073
auauuccgcaacgccgcca

SEQ ID NO: 2642817 - RNA, 22 nt, Escherichia coli CFT073
auauuccgccaccugcgaacug

SEQ ID NO: 2642818 - RNA, 21 nt, Escherichia coli CFT073
auauuccggugucauuauauc

SEQ ID NO: 2642819 - RNA, 19 nt, Escherichia coli CFT073
auauuccgucuccggaaug

SEQ ID NO: 2642820 - RNA, 18 nt, Escherichia coli CFT073
auauuccugacccagcac

SEQ ID NO: 2642821 - RNA, 11 nt, Escherichia coli CFT073
auauuccugca

SEQ ID NO: 2642822 - RNA, 14 nt, Escherichia coli CFT073
auauucgacacauu

SEQ ID NO: 2642823 - RNA, 16 nt, Escherichia coli CFT073
auauucgccaucagcc

SEQ ID NO: 2642824 - RNA, 18 nt, Escherichia coli CFT073
auauucggcuccagauua

SEQ ID NO: 2642825 - RNA, 15 nt, Escherichia coli CFT073
auauucguccauuga

SEQ ID NO: 2642826 - RNA, 19 nt, Escherichia coli CFT073
auauucguccauugaagac

SEQ ID NO: 2642827 - RNA, 11 nt, Escherichia coli CFT073
auauucguuau

SEQ ID NO: 2642828 - RNA, 16 nt, Escherichia coli CFT073
auauucucgcccgucu

SEQ ID NO: 2642829 - RNA, 20 nt, Escherichia coli CFT073
auauucugcggcuucagcga

SEQ ID NO: 2642830 - RNA, 22 nt, Escherichia coli CFT073
auauucuguaacucgaauuauu

SEQ ID NO: 2642831 - RNA, 18 nt, Escherichia coli CFT073
auauucuguaccaaaauu

SEQ ID NO: 2642832 - RNA, 16 nt, Escherichia coli CFT073
auauucuguucaugca

SEQ ID NO: 2642833 - RNA, 13 nt, Escherichia coli CFT073
auauucuuuugca

SEQ ID NO: 2642834 - RNA, 23 nt, Escherichia coli CFT073
auauugcaccagaucuuccagcg

SEQ ID NO: 2642835 - RNA, 19 nt, Escherichia coli CFT073
auauugccgaagaccagau

SEQ ID NO: 2642836 - RNA, 17 nt, Escherichia coli CFT073
auauugcguaccugcau

SEQ ID NO: 2642837 - RNA, 22 nt, Escherichia coli CFT073
auauugcucuaccgcuucgcgu

SEQ ID NO: 2642838 - RNA, 16 nt, Escherichia coli CFT073
auauuggcaacagcca

SEQ ID NO: 2642839 - RNA, 13 nt, Escherichia coli CFT073
auauuuaacauca

SEQ ID NO: 2642840 - RNA, 18 nt, Escherichia coli CFT073
auauuuaagccugcauca

SEQ ID NO: 2642841 - RNA, 23 nt, Escherichia coli CFT073
auauuuaagccugcaucacgagc

SEQ ID NO: 2642842 - RNA, 22 nt, Escherichia coli CFT073
auauuuaguucauauaauuauu

SEQ ID NO: 2642843 - RNA, 18 nt, Escherichia coli CFT073
auauuuauucaucagcgu

SEQ ID NO: 2642844 - RNA, 16 nt, Escherichia coli CFT073
auauuuauucuguugg

SEQ ID NO: 2642845 - RNA, 14 nt, Escherichia coli CFT073
auauuuauuuccuu

SEQ ID NO: 2642846 - RNA, 18 nt, Escherichia coli CFT073
auauuucauucuccauuu

SEQ ID NO: 2642847 - RNA, 12 nt, Escherichia coli CFT073
auauuucgucgc

SEQ ID NO: 2642848 - RNA, 22 nt, Escherichia coli CFT073
auauuugcugguggcauuuuua

SEQ ID NO: 2642849 - RNA, 23 nt, Escherichia coli CFT073
auauuugcugguggcauuuuuau

SEQ ID NO: 2642850 - RNA, 18 nt, Escherichia coli CFT073
auauuuguuuucauccac

SEQ ID NO: 2642851 - RNA, 13 nt, Escherichia coli CFT073
auauuuuccagca

SEQ ID NO: 2642852 - RNA, 20 nt, Escherichia coli CFT073
auauuuugcuuuaaguucag

SEQ ID NO: 2642853 - RNA, 22 nt, Escherichia coli CFT073
auauuuuucaguaacggcgcuu

SEQ ID NO: 2642854 - RNA, 14 nt, Escherichia coli CFT073
auauuuuucccuga

SEQ ID NO: 2642855 - RNA, 15 nt, Escherichia coli CFT073
auauuuuuugaaaaa

SEQ ID NO: 2642856 - RNA, 20 nt, Escherichia coli CFT073
auauuuuuuuccuaaacccu

SEQ ID NO: 2642857 - RNA, 12 nt, Escherichia coli CFT073
aucaaaaacucu

SEQ ID NO: 2642858 - RNA, 21 nt, Escherichia coli CFT073
aucaaaaucaccgaugacaga

SEQ ID NO: 2642859 - RNA, 13 nt, Escherichia coli CFT073
aucaaaaugaucg

SEQ ID NO: 2642860 - RNA, 15 nt, Escherichia coli CFT073
aucaaaaugguaauu

SEQ ID NO: 2642861 - RNA, 18 nt, Escherichia coli CFT073
aucaaaauuccauuuuca

SEQ ID NO: 2642862 - RNA, 15 nt, Escherichia coli CFT073
aucaaacacaggcag

SEQ ID NO: 2642863 - RNA, 18 nt, Escherichia coli CFT073
aucaaacagaaaaacgaa

SEQ ID NO: 2642864 - RNA, 20 nt, Escherichia coli CFT073
aucaaacagccccugacugg

SEQ ID NO: 2642865 - RNA, 13 nt, Escherichia coli CFT073
aucaaacaggcug

SEQ ID NO: 2642866 - RNA, 17 nt, Escherichia coli CFT073
aucaaacgguugauaaa

SEQ ID NO: 2642867 - RNA, 19 nt, Escherichia coli CFT073
aucaaacgugacauucuga

SEQ ID NO: 2642868 - RNA, 16 nt, Escherichia coli CFT073
aucaaacuguucggua

SEQ ID NO: 2642869 - RNA, 14 nt, Escherichia coli CFT073
aucaaagaaaagca

SEQ ID NO: 2642870 - RNA, 20 nt, Escherichia coli CFT073
aucaaagcguuaaaagcggu

SEQ ID NO: 2642871 - RNA, 21 nt, Escherichia coli CFT073
aucaaaguuaauagucaagcc

SEQ ID NO: 2642872 - RNA, 19 nt, Escherichia coli CFT073
aucaaaguuaguaaaacua

SEQ ID NO: 2642873 - RNA, 22 nt, Escherichia coli CFT073
aucaaauaaauaaucucuuccg

SEQ ID NO: 2642874 - RNA, 19 nt, Escherichia coli CFT073
aucaauuuuuugauauguu

SEQ ID NO: 2642875 - RNA, 12 nt, Escherichia coli CFT073
aucacaaaauag

SEQ ID NO: 2642876 - RNA, 16 nt, Escherichia coli CFT073
aucacaaaauagaaau

SEQ ID NO: 2642877 - RNA, 19 nt, Escherichia coli CFT073
aucacaaaauuuauccagc

SEQ ID NO: 2642878 - RNA, 22 nt, Escherichia coli CFT073
aucacaaaauuuauccagcgca

SEQ ID NO: 2642879 - RNA, 15 nt, Escherichia coli CFT073
aucacaauaaucgcc

SEQ ID NO: 2642880 - RNA, 21 nt, Escherichia coli CFT073
aucacaaugccgccaauaaug

SEQ ID NO: 2642881 - RNA, 21 nt, Escherichia coli CFT073
aucacaauuccgguacgccag

SEQ ID NO: 2642882 - RNA, 16 nt, Escherichia coli CFT073
aucacaccauccagca

SEQ ID NO: 2642883 - RNA, 18 nt, Escherichia coli CFT073
aucacaccucguauucca

SEQ ID NO: 2642884 - RNA, 13 nt, Escherichia coli CFT073
aucacagaaaaaa

SEQ ID NO: 2642885 - RNA, 21 nt, Escherichia coli CFT073
aucacagagccugacauuucc

SEQ ID NO: 2642886 - RNA, 22 nt, Escherichia coli CFT073
aucacagagccugacauuuccg

SEQ ID NO: 2642887 - RNA, 21 nt, Escherichia coli CFT073
aucacaggucgcaaacggcga

SEQ ID NO: 2642888 - RNA, 13 nt, Escherichia coli CFT073
aucacaguauuua

SEQ ID NO: 2642889 - RNA, 18 nt, Escherichia coli CFT073
aucacauaaucgaaaaca

SEQ ID NO: 2642890 - RNA, 24 nt, Escherichia coli CFT073
aucacaucaaauccccacaggcga

SEQ ID NO: 2642891 - RNA, 14 nt, Escherichia coli CFT073
aucacaucaccaua

SEQ ID NO: 2642892 - RNA, 14 nt, Escherichia coli CFT073
aucacaucauaaau

SEQ ID NO: 2642893 - RNA, 20 nt, Escherichia coli CFT073
aucacaucaucuaccagcau

SEQ ID NO: 2642894 - RNA, 15 nt, Escherichia coli CFT073
aucacauccaccagc

SEQ ID NO: 2642895 - RNA, 12 nt, Escherichia coli CFT073
aucacauccagc

SEQ ID NO: 2642896 - RNA, 18 nt, Escherichia coli CFT073
aucacauccggcaauauc

SEQ ID NO: 2642897 - RNA, 15 nt, Escherichia coli CFT073
aucacauccugauag

SEQ ID NO: 2642898 - RNA, 19 nt, Escherichia coli CFT073
aucacaucgcuaccgcgca

SEQ ID NO: 2642899 - RNA, 23 nt, Escherichia coli CFT073
aucaccaaaauaccacugcgcca

SEQ ID NO: 2642900 - RNA, 21 nt, Escherichia coli CFT073
aucaccaauauaaacauuacu

SEQ ID NO: 2642901 - RNA, 15 nt, Escherichia coli CFT073
aucaccacagacaaa

SEQ ID NO: 2642902 - RNA, 13 nt, Escherichia coli CFT073
aucaccaccagca

SEQ ID NO: 2642903 - RNA, 19 nt, Escherichia coli CFT073
aucaccaccagcaccgcga

SEQ ID NO: 2642904 - RNA, 22 nt, Escherichia coli CFT073
aucaccaccgcaucggcaucaa

SEQ ID NO: 2642905 - RNA, 13 nt, Escherichia coli CFT073
aucaccaccguca

SEQ ID NO: 2642906 - RNA, 20 nt, Escherichia coli CFT073
aucaccaguaccgccgccau

SEQ ID NO: 2642907 - RNA, 21 nt, Escherichia coli CFT073
aucaccaguugugaugccacu

SEQ ID NO: 2642908 - RNA, 16 nt, Escherichia coli CFT073
aucaccauaaaucaga

SEQ ID NO: 2642909 - RNA, 20 nt, Escherichia coli CFT073
aucaccauauucagcagcag

SEQ ID NO: 2642910 - RNA, 16 nt, Escherichia coli CFT073
aucaccaucagcagca

SEQ ID NO: 2642911 - RNA, 16 nt, Escherichia coli CFT073
aucacccacaucaacg

SEQ ID NO: 2642912 - RNA, 13 nt, Escherichia coli CFT073
aucaccccgagcg

SEQ ID NO: 2642913 - RNA, 20 nt, Escherichia coli CFT073
aucaccccgcgcucacacca

SEQ ID NO: 2642914 - RNA, 15 nt, Escherichia coli CFT073
aucacccgagagaac

SEQ ID NO: 2642915 - RNA, 22 nt, Escherichia coli CFT073
aucaccgacaaacagcgagaac

SEQ ID NO: 2642916 - RNA, 19 nt, Escherichia coli CFT073
aucaccgaugacagaauca

SEQ ID NO: 2642917 - RNA, 20 nt, Escherichia coli CFT073
aucaccgaugacagaaucag

SEQ ID NO: 2642918 - RNA, 22 nt, Escherichia coli CFT073
aucaccgcaccaguaauacggc

SEQ ID NO: 2642919 - RNA, 17 nt, Escherichia coli CFT073
aucaccgcacggcgagu

SEQ ID NO: 2642920 - RNA, 20 nt, Escherichia coli CFT073
aucaccgccacuaucgccau

SEQ ID NO: 2642921 - RNA, 22 nt, Escherichia coli CFT073
aucaccgccacuaucgccauca

SEQ ID NO: 2642922 - RNA, 12 nt, Escherichia coli CFT073
aucaccggaucg

SEQ ID NO: 2642923 - RNA, 20 nt, Escherichia coli CFT073
aucaccggaugcccggucaa

SEQ ID NO: 2642924 - RNA, 21 nt, Escherichia coli CFT073
aucaccggcacaaaacuguau

SEQ ID NO: 2642925 - RNA, 19 nt, Escherichia coli CFT073
aucaccggcaucugcuguu

SEQ ID NO: 2642926 - RNA, 20 nt, Escherichia coli CFT073
aucaccggcauuuuuugcug

SEQ ID NO: 2642927 - RNA, 13 nt, Escherichia coli CFT073
aucaccguagaag

SEQ ID NO: 2642928 - RNA, 16 nt, Escherichia coli CFT073
aucaccguagaaggcg

SEQ ID NO: 2642929 - RNA, 18 nt, Escherichia coli CFT073
aucaccucuguucaggug

SEQ ID NO: 2642930 - RNA, 11 nt, Escherichia coli CFT073
aucaccucuuc

SEQ ID NO: 2642931 - RNA, 14 nt, Escherichia coli CFT073
aucaccugccggag

SEQ ID NO: 2642932 - RNA, 15 nt, Escherichia coli CFT073
aucaccugcgauaaa

SEQ ID NO: 2642933 - RNA, 22 nt, Escherichia coli CFT073
aucaccuguucacgaccaucaa

SEQ ID NO: 2642934 - RNA, 14 nt, Escherichia coli CFT073
aucaccuuacugga

SEQ ID NO: 2642935 - RNA, 15 nt, Escherichia coli CFT073
aucacgaauaaacga

SEQ ID NO: 2642936 - RNA, 15 nt, Escherichia coli CFT073
aucacgaucagcgga

SEQ ID NO: 2642937 - RNA, 18 nt, Escherichia coli CFT073
aucacgcaacauuccggc

SEQ ID NO: 2642938 - RNA, 21 nt, Escherichia coli CFT073
aucacgcaacauuccggcgcu

SEQ ID NO: 2642939 - RNA, 17 nt, Escherichia coli CFT073
aucacgcacugcaauau

SEQ ID NO: 2642940 - RNA, 17 nt, Escherichia coli CFT073
aucacgcagcaagccgu

SEQ ID NO: 2642941 - RNA, 21 nt, Escherichia coli CFT073
aucacgccacucacuaccagu

SEQ ID NO: 2642942 - RNA, 14 nt, Escherichia coli CFT073
aucacgcccgccag

SEQ ID NO: 2642943 - RNA, 13 nt, Escherichia coli CFT073
aucacgcugccaa

SEQ ID NO: 2642944 - RNA, 20 nt, Escherichia coli CFT073
aucacggaucaguuuaucca

SEQ ID NO: 2642945 - RNA, 20 nt, Escherichia coli CFT073
aucacggcuuugaucagcgu

SEQ ID NO: 2642946 - RNA, 21 nt, Escherichia coli CFT073
aucacguaaauguggcggaau

SEQ ID NO: 2642947 - RNA, 12 nt, Escherichia coli CFT073
aucacguagcca

SEQ ID NO: 2642948 - RNA, 14 nt, Escherichia coli CFT073
aucacguagccacg

SEQ ID NO: 2642949 - RNA, 21 nt, Escherichia coli CFT073
aucacgucauauucgccauca

SEQ ID NO: 2642950 - RNA, 16 nt, Escherichia coli CFT073
aucacuaccagcgcca

SEQ ID NO: 2642951 - RNA, 21 nt, Escherichia coli CFT073
aucacuauacuccugauggcc

SEQ ID NO: 2642952 - RNA, 13 nt, Escherichia coli CFT073
aucacucacccgc

SEQ ID NO: 2642953 - RNA, 21 nt, Escherichia coli CFT073
aucacucacgacacauaaaua

SEQ ID NO: 2642954 - RNA, 22 nt, Escherichia coli CFT073
aucacucccuuucugccacgcc

SEQ ID NO: 2642955 - RNA, 22 nt, Escherichia coli CFT073
aucacucuuuucgccgagcagg

SEQ ID NO: 2642956 - RNA, 13 nt, Escherichia coli CFT073
aucacugaaauug

SEQ ID NO: 2642957 - RNA, 16 nt, Escherichia coli CFT073
aucacugacaucacgc

SEQ ID NO: 2642958 - RNA, 18 nt, Escherichia coli CFT073
aucacuggccucuucucu

SEQ ID NO: 2642959 - RNA, 14 nt, Escherichia coli CFT073
aucacuggcgucau

SEQ ID NO: 2642960 - RNA, 16 nt, Escherichia coli CFT073
aucacuguuuuuucau

SEQ ID NO: 2642961 - RNA, 18 nt, Escherichia coli CFT073
aucacuuacgauuuuaau

SEQ ID NO: 2642962 - RNA, 14 nt, Escherichia coli CFT073
aucacuucaucgcc

SEQ ID NO: 2642963 - RNA, 14 nt, Escherichia coli CFT073
aucacuuccagcag

SEQ ID NO: 2642964 - RNA, 19 nt, Escherichia coli CFT073
aucacuuccagcaguucgc

SEQ ID NO: 2642965 - RNA, 16 nt, Escherichia coli CFT073
aucacuugcugcaccu

SEQ ID NO: 2642966 - RNA, 18 nt, Escherichia coli CFT073
aucacuuguucagcgaug

SEQ ID NO: 2642967 - RNA, 15 nt, Escherichia coli CFT073
aucacuuucaccggu

SEQ ID NO: 2642968 - RNA, 12 nt, Escherichia coli CFT073
aucacuuucugc

SEQ ID NO: 2642969 - RNA, 17 nt, Escherichia coli CFT073
aucacuuuuuccggugc

SEQ ID NO: 2642970 - RNA, 14 nt, Escherichia coli CFT073
aucagaaacgcgac

SEQ ID NO: 2642971 - RNA, 14 nt, Escherichia coli CFT073
aucagaaaugccag

SEQ ID NO: 2642972 - RNA, 19 nt, Escherichia coli CFT073
aucagaaaugccaguaacu

SEQ ID NO: 2642973 - RNA, 15 nt, Escherichia coli CFT073
aucagaacaucgcca

SEQ ID NO: 2642974 - RNA, 15 nt, Escherichia coli CFT073
aucagaagauuaaga

SEQ ID NO: 2642975 - RNA, 16 nt, Escherichia coli CFT073
aucagacaccagccag

SEQ ID NO: 2642976 - RNA, 23 nt, Escherichia coli CFT073
aucagacaccggcgcacaaccgc

SEQ ID NO: 2642977 - RNA, 17 nt, Escherichia coli CFT073
aucagaccgccaaucag

SEQ ID NO: 2642978 - RNA, 19 nt, Escherichia coli CFT073
aucagaccgccaaucagca

SEQ ID NO: 2642979 - RNA, 14 nt, Escherichia coli CFT073
aucagacgcaggcg

SEQ ID NO: 2642980 - RNA, 15 nt, Escherichia coli CFT073
aucagacugcuuuuc

SEQ ID NO: 2642981 - RNA, 19 nt, Escherichia coli CFT073
aucagacugcuuuucccuu

SEQ ID NO: 2642982 - RNA, 16 nt, Escherichia coli CFT073
aucaguaaucgcgcca

SEQ ID NO: 2642983 - RNA, 18 nt, Escherichia coli CFT073
aucaguacccaaucagcg

SEQ ID NO: 2642984 - RNA, 21 nt, Escherichia coli CFT073
aucaguauuaucaaaucacca

SEQ ID NO: 2642985 - RNA, 18 nt, Escherichia coli CFT073
aucagucagagccugcca

SEQ ID NO: 2642986 - RNA, 16 nt, Escherichia coli CFT073
aucagucagguuggca

SEQ ID NO: 2642987 - RNA, 22 nt, Escherichia coli CFT073
aucaguccauggcagaugauca

SEQ ID NO: 2642988 - RNA, 24 nt, Escherichia coli CFT073
aucagucccugaaucgccacgcca

SEQ ID NO: 2642989 - RNA, 18 nt, Escherichia coli CFT073
aucagucuuaagcggcua

SEQ ID NO: 2642990 - RNA, 18 nt, Escherichia coli CFT073
aucaguguuggcggcaga

SEQ ID NO: 2642991 - RNA, 15 nt, Escherichia coli CFT073
aucaguuacucugca

SEQ ID NO: 2642992 - RNA, 16 nt, Escherichia coli CFT073
aucaguuccaguucau

SEQ ID NO: 2642993 - RNA, 20 nt, Escherichia coli CFT073
aucaguuucgaucagcaauu

SEQ ID NO: 2642994 - RNA, 20 nt, Escherichia coli CFT073
aucaguuuguuauauucacu

SEQ ID NO: 2642995 - RNA, 23 nt, Escherichia coli CFT073
aucaguuuguuauauucacuugc

SEQ ID NO: 2642996 - RNA, 20 nt, Escherichia coli CFT073
aucauaaaaaucaaaugcug

SEQ ID NO: 2642997 - RNA, 18 nt, Escherichia coli CFT073
aucauaaaacaccacgcg

SEQ ID NO: 2642998 - RNA, 15 nt, Escherichia coli CFT073
aucauaagcgccagg

SEQ ID NO: 2642999 - RNA, 15 nt, Escherichia coli CFT073
aucauaauuauaaua

SEQ ID NO: 2643000 - RNA, 13 nt, Escherichia coli CFT073
aucauacuggcuc

SEQ ID NO: 2643001 - RNA, 18 nt, Escherichia coli CFT073
aucauaucgucauuaucg

SEQ ID NO: 2643002 - RNA, 13 nt, Escherichia coli CFT073
aucauaugcacaa

SEQ ID NO: 2643003 - RNA, 17 nt, Escherichia coli CFT073
aucauaugcacaaucag

SEQ ID NO: 2643004 - RNA, 15 nt, Escherichia coli CFT073
aucaucaaagaacag

SEQ ID NO: 2643005 - RNA, 19 nt, Escherichia coli CFT073
aucaucaagacccggcgca

SEQ ID NO: 2643006 - RNA, 22 nt, Escherichia coli CFT073
aucaucaagguaauuguucgcu

SEQ ID NO: 2643007 - RNA, 15 nt, Escherichia coli CFT073
aucaucaaugccagc

SEQ ID NO: 2643008 - RNA, 23 nt, Escherichia coli CFT073
aucaucaccugcgcuggcaggcc

SEQ ID NO: 2643009 - RNA, 22 nt, Escherichia coli CFT073
aucaucacgacauaauuuuucu

SEQ ID NO: 2643010 - RNA, 13 nt, Escherichia coli CFT073
aucaucacgauca

SEQ ID NO: 2643011 - RNA, 12 nt, Escherichia coli CFT073
aucaucacuccc

SEQ ID NO: 2643012 - RNA, 15 nt, Escherichia coli CFT073
aucaucacuuuuucc

SEQ ID NO: 2643013 - RNA, 16 nt, Escherichia coli CFT073
aucaucacuuuuuccg

SEQ ID NO: 2643014 - RNA, 17 nt, Escherichia coli CFT073
aucaucagcgcuuuauc

SEQ ID NO: 2643015 - RNA, 14 nt, Escherichia coli CFT073
aucaucaggcauga

SEQ ID NO: 2643016 - RNA, 20 nt, Escherichia coli CFT073
aucaucauaucgucauuauc

SEQ ID NO: 2643017 - RNA, 20 nt, Escherichia coli CFT073
aucaucauccagcacgguga

SEQ ID NO: 2643018 - RNA, 12 nt, Escherichia coli CFT073
aucaucaucgcg

SEQ ID NO: 2643019 - RNA, 20 nt, Escherichia coli CFT073
aucaucaucggcaccgccag

SEQ ID NO: 2643020 - RNA, 18 nt, Escherichia coli CFT073
aucaucaucggucaguuu

SEQ ID NO: 2643021 - RNA, 18 nt, Escherichia coli CFT073
aucaucaugcuuaaauau

SEQ ID NO: 2643022 - RNA, 14 nt, Escherichia coli CFT073
aucaucauuauuaa

SEQ ID NO: 2643023 - RNA, 21 nt, Escherichia coli CFT073
aucauccagacguuucacggu

SEQ ID NO: 2643024 - RNA, 12 nt, Escherichia coli CFT073
aucauccagcac

SEQ ID NO: 2643025 - RNA, 16 nt, Escherichia coli CFT073
aucauccaggugaaaa

SEQ ID NO: 2643026 - RNA, 15 nt, Escherichia coli CFT073
aucaucccggcaaac

SEQ ID NO: 2643027 - RNA, 18 nt, Escherichia coli CFT073
aucauccgcaauaacuaa

SEQ ID NO: 2643028 - RNA, 22 nt, Escherichia coli CFT073
aucauccgcaauaacuaaacgc

SEQ ID NO: 2643029 - RNA, 15 nt, Escherichia coli CFT073
aucauccgcacaauc

SEQ ID NO: 2643030 - RNA, 17 nt, Escherichia coli CFT073
aucauccgcacaauccc

SEQ ID NO: 2643031 - RNA, 18 nt, Escherichia coli CFT073
aucauccgcacaaucccu

SEQ ID NO: 2643032 - RNA, 15 nt, Escherichia coli CFT073
aucauccucuucacc

SEQ ID NO: 2643033 - RNA, 20 nt, Escherichia coli CFT073
aucauccucuucaccgguac

SEQ ID NO: 2643034 - RNA, 17 nt, Escherichia coli CFT073
aucauccucuucagcaa

SEQ ID NO: 2643035 - RNA, 22 nt, Escherichia coli CFT073
aucauccugcggcagcuccagc

SEQ ID NO: 2643036 - RNA, 19 nt, Escherichia coli CFT073
aucauccugcugcacgccc

SEQ ID NO: 2643037 - RNA, 22 nt, Escherichia coli CFT073
aucauccugcugcacgcccuga

SEQ ID NO: 2643038 - RNA, 19 nt, Escherichia coli CFT073
aucauccuguucauuuuua

SEQ ID NO: 2643039 - RNA, 16 nt, Escherichia coli CFT073
aucaucgauuuucugc

SEQ ID NO: 2643040 - RNA, 18 nt, Escherichia coli CFT073
aucaucgcggcacacagc

SEQ ID NO: 2643041 - RNA, 19 nt, Escherichia coli CFT073
aucaucgcguacucaccgc

SEQ ID NO: 2643042 - RNA, 17 nt, Escherichia coli CFT073
aucaucggcaccgccag

SEQ ID NO: 2643043 - RNA, 16 nt, Escherichia coli CFT073
aucaucggcugcgcuu

SEQ ID NO: 2643044 - RNA, 18 nt, Escherichia coli CFT073
aucaucggguugcugauu

SEQ ID NO: 2643045 - RNA, 22 nt, Escherichia coli CFT073
aucaucggucaguuugccccau

SEQ ID NO: 2643046 - RNA, 15 nt, Escherichia coli CFT073
aucaucuaccagcau

SEQ ID NO: 2643047 - RNA, 16 nt, Escherichia coli CFT073
aucaucucaacaaacg

SEQ ID NO: 2643048 - RNA, 20 nt, Escherichia coli CFT073
aucaucucggguuguugcau

SEQ ID NO: 2643049 - RNA, 14 nt, Escherichia coli CFT073
aucaucugcgccac

SEQ ID NO: 2643050 - RNA, 21 nt, Escherichia coli CFT073
aucaucuguugugccacaucc

SEQ ID NO: 2643051 - RNA, 18 nt, Escherichia coli CFT073
aucaugcaguaccagaua

SEQ ID NO: 2643052 - RNA, 17 nt, Escherichia coli CFT073
aucaugccaaaaauaau

SEQ ID NO: 2643053 - RNA, 19 nt, Escherichia coli CFT073
aucaugcccuuuuuucuua

SEQ ID NO: 2643054 - RNA, 17 nt, Escherichia coli CFT073
aucaugcucugccagcg

SEQ ID NO: 2643055 - RNA, 20 nt, Escherichia coli CFT073
aucaugcuuaaauauuuuuu

SEQ ID NO: 2643056 - RNA, 21 nt, Escherichia coli CFT073
aucauggcauccuguuuucug

SEQ ID NO: 2643057 - RNA, 13 nt, Escherichia coli CFT073
aucauggcgugaa

SEQ ID NO: 2643058 - RNA, 20 nt, Escherichia coli CFT073
aucaugguagcgugauggcc

SEQ ID NO: 2643059 - RNA, 22 nt, Escherichia coli CFT073
aucauguaaaucaauuaaucca

SEQ ID NO: 2643060 - RNA, 23 nt, Escherichia coli CFT073
aucauuaacaccacgccagccgc

SEQ ID NO: 2643061 - RNA, 20 nt, Escherichia coli CFT073
aucauuaacgcagaaucuuc

SEQ ID NO: 2643062 - RNA, 21 nt, Escherichia coli CFT073
aucauuagcccuauaaucacc

SEQ ID NO: 2643063 - RNA, 23 nt, Escherichia coli CFT073
aucauuagucacaaaucucccuu

SEQ ID NO: 2643064 - RNA, 12 nt, Escherichia coli CFT073
aucauuaucacc

SEQ ID NO: 2643065 - RNA, 15 nt, Escherichia coli CFT073
aucauucaccagccc

SEQ ID NO: 2643066 - RNA, 19 nt, Escherichia coli CFT073
aucauucgcccgccgagaa

SEQ ID NO: 2643067 - RNA, 17 nt, Escherichia coli CFT073
aucauucugcaaggcaa

SEQ ID NO: 2643068 - RNA, 18 nt, Escherichia coli CFT073
aucauucugcaaggcaaa

SEQ ID NO: 2643069 - RNA, 20 nt, Escherichia coli CFT073
aucauugacaaucgccgcca

SEQ ID NO: 2643070 - RNA, 12 nt, Escherichia coli CFT073
aucauugcucuu

SEQ ID NO: 2643071 - RNA, 23 nt, Escherichia coli CFT073
aucauugcuguuuuacagcugcu

SEQ ID NO: 2643072 - RNA, 14 nt, Escherichia coli CFT073
aucauuugcaccag

SEQ ID NO: 2643073 - RNA, 19 nt, Escherichia coli CFT073
aucauuuucagcuuucgca

SEQ ID NO: 2643074 - RNA, 20 nt, Escherichia coli CFT073
aucauuuucagcuuucgcau

SEQ ID NO: 2643075 - RNA, 14 nt, Escherichia coli CFT073
aucauuuuuucccc

SEQ ID NO: 2643076 - RNA, 19 nt, Escherichia coli CFT073
auccaaaccgacugccugc

SEQ ID NO: 2643077 - RNA, 15 nt, Escherichia coli CFT073
auccaacaacugcgc

SEQ ID NO: 2643078 - RNA, 15 nt, Escherichia coli CFT073
auccaacaucgguac

SEQ ID NO: 2643079 - RNA, 17 nt, Escherichia coli CFT073
auccaacugauuuucau

SEQ ID NO: 2643080 - RNA, 14 nt, Escherichia coli CFT073
auccaacuucguua

SEQ ID NO: 2643081 - RNA, 17 nt, Escherichia coli CFT073
auccaacuuuucccagc

SEQ ID NO: 2643082 - RNA, 21 nt, Escherichia coli CFT073
auccacaacaaugucuucaca

SEQ ID NO: 2643083 - RNA, 15 nt, Escherichia coli CFT073
auccacauuaacgaa

SEQ ID NO: 2643084 - RNA, 21 nt, Escherichia coli CFT073
auccacauuagucauuacuca

SEQ ID NO: 2643085 - RNA, 18 nt, Escherichia coli CFT073
auccacauuuucagccag

SEQ ID NO: 2643086 - RNA, 18 nt, Escherichia coli CFT073
auccaccacaaaagcaaa

SEQ ID NO: 2643087 - RNA, 14 nt, Escherichia coli CFT073
auccacccgcagcc

SEQ ID NO: 2643088 - RNA, 20 nt, Escherichia coli CFT073
auccaccguuggcagauaac

SEQ ID NO: 2643089 - RNA, 13 nt, Escherichia coli CFT073
auccacgaccaga

SEQ ID NO: 2643090 - RNA, 14 nt, Escherichia coli CFT073
aucccgacaaucau

SEQ ID NO: 2643091 - RNA, 16 nt, Escherichia coli CFT073
aucccgccaaccggaa

SEQ ID NO: 2643092 - RNA, 14 nt, Escherichia coli CFT073
aucccgccagcacc

SEQ ID NO: 2643093 - RNA, 14 nt, Escherichia coli CFT073
aucccgccagccgc

SEQ ID NO: 2643094 - RNA, 20 nt, Escherichia coli CFT073
aucccgccgaccaacgcaga

SEQ ID NO: 2643095 - RNA, 21 nt, Escherichia coli CFT073
aucccgccgaccaacgcagaa

SEQ ID NO: 2643096 - RNA, 22 nt, Escherichia coli CFT073
aucccgccgggaucauaaccaa

SEQ ID NO: 2643097 - RNA, 15 nt, Escherichia coli CFT073
aucccgcgauaugcc

SEQ ID NO: 2643098 - RNA, 16 nt, Escherichia coli CFT073
aucccgcgauaugccg

SEQ ID NO: 2643099 - RNA, 17 nt, Escherichia coli CFT073
aucccgcuguuuguuca

SEQ ID NO: 2643100 - RNA, 14 nt, Escherichia coli CFT073
aucccggaagccac

SEQ ID NO: 2643101 - RNA, 20 nt, Escherichia coli CFT073
aucccggaagccaccacgcc

SEQ ID NO: 2643102 - RNA, 22 nt, Escherichia coli CFT073
aucccggaagccaccacgccaa

SEQ ID NO: 2643103 - RNA, 16 nt, Escherichia coli CFT073
aucccggcaaccgcaa

SEQ ID NO: 2643104 - RNA, 18 nt, Escherichia coli CFT073
aucccggcaaccgcaacg

SEQ ID NO: 2643105 - RNA, 14 nt, Escherichia coli CFT073
aucccggcaggaau

SEQ ID NO: 2643106 - RNA, 16 nt, Escherichia coli CFT073
aucccggcaggaauau

SEQ ID NO: 2643107 - RNA, 15 nt, Escherichia coli CFT073
aucccggcucauccc

SEQ ID NO: 2643108 - RNA, 23 nt, Escherichia coli CFT073
aucccgguauaacuugccaggcc

SEQ ID NO: 2643109 - RNA, 20 nt, Escherichia coli CFT073
aucccggugucaugcgggcg

SEQ ID NO: 2643110 - RNA, 19 nt, Escherichia coli CFT073
aucccguaggauuucuucg

SEQ ID NO: 2643111 - RNA, 13 nt, Escherichia coli CFT073
aucccguugaaaa

SEQ ID NO: 2643112 - RNA, 22 nt, Escherichia coli CFT073
aucccguugccacucaggcaaa

SEQ ID NO: 2643113 - RNA, 21 nt, Escherichia coli CFT073
aucccuaaugucgacauaauc

SEQ ID NO: 2643114 - RNA, 22 nt, Escherichia coli CFT073
aucccuaaugucgacauaauca

SEQ ID NO: 2643115 - RNA, 13 nt, Escherichia coli CFT073
aucccugcaacau

SEQ ID NO: 2643116 - RNA, 13 nt, Escherichia coli CFT073
aucccugccgcca

SEQ ID NO: 2643117 - RNA, 19 nt, Escherichia coli CFT073
aucccugccgccaucacca

SEQ ID NO: 2643118 - RNA, 22 nt, Escherichia coli CFT073
aucccugcgaacugcgcagauu

SEQ ID NO: 2643119 - RNA, 22 nt, Escherichia coli CFT073
aucccuucaagcguccauuuac

SEQ ID NO: 2643120 - RNA, 17 nt, Escherichia coli CFT073
aucccuucacuucugga

SEQ ID NO: 2643121 - RNA, 22 nt, Escherichia coli CFT073
aucccuuccgcuuuuaacaucu

SEQ ID NO: 2643122 - RNA, 22 nt, Escherichia coli CFT073
aucccuuccugcccuuuuaaua

SEQ ID NO: 2643123 - RNA, 13 nt, Escherichia coli CFT073
aucccuucuccac

SEQ ID NO: 2643124 - RNA, 14 nt, Escherichia coli CFT073
aucccuucuccaca

SEQ ID NO: 2643125 - RNA, 15 nt, Escherichia coli CFT073
aucccuucuccacac

SEQ ID NO: 2643126 - RNA, 14 nt, Escherichia coli CFT073
aucccuuuauucag

SEQ ID NO: 2643127 - RNA, 14 nt, Escherichia coli CFT073
aucccuuuucacua

SEQ ID NO: 2643128 - RNA, 21 nt, Escherichia coli CFT073
auccgacaaauguguucagcg

SEQ ID NO: 2643129 - RNA, 14 nt, Escherichia coli CFT073
auccgacacuggca

SEQ ID NO: 2643130 - RNA, 20 nt, Escherichia coli CFT073
auccgacauuucugcugccu

SEQ ID NO: 2643131 - RNA, 20 nt, Escherichia coli CFT073
auccgaccuacguucggcac

SEQ ID NO: 2643132 - RNA, 20 nt, Escherichia coli CFT073
auccgagcagcaaugcuuac

SEQ ID NO: 2643133 - RNA, 17 nt, Escherichia coli CFT073
auccgauaaucccuucc

SEQ ID NO: 2643134 - RNA, 18 nt, Escherichia coli CFT073
auccgauuaaucaccgga

SEQ ID NO: 2643135 - RNA, 15 nt, Escherichia coli CFT073
auccgauuguuccug

SEQ ID NO: 2643136 - RNA, 23 nt, Escherichia coli CFT073
auccgcacccgcacgcuuaaucg

SEQ ID NO: 2643137 - RNA, 21 nt, Escherichia coli CFT073
auccgcacucaacuuauugau

SEQ ID NO: 2643138 - RNA, 23 nt, Escherichia coli CFT073
auccgcacucaacuuauugauca

SEQ ID NO: 2643139 - RNA, 13 nt, Escherichia coli CFT073
auccgcaggugac

SEQ ID NO: 2643140 - RNA, 14 nt, Escherichia coli CFT073
auccgccagccaau

SEQ ID NO: 2643141 - RNA, 15 nt, Escherichia coli CFT073
auccgccagcgccuc

SEQ ID NO: 2643142 - RNA, 19 nt, Escherichia coli CFT073
auccgccaggacaucagcg

SEQ ID NO: 2643143 - RNA, 21 nt, Escherichia coli CFT073
auccgccaggacaucagcgca

SEQ ID NO: 2643144 - RNA, 13 nt, Escherichia coli CFT073
auccgcccacacc

SEQ ID NO: 2643145 - RNA, 16 nt, Escherichia coli CFT073
auccgcccacaccagu

SEQ ID NO: 2643146 - RNA, 23 nt, Escherichia coli CFT073
auccgccccgcguuucaccacca

SEQ ID NO: 2643147 - RNA, 13 nt, Escherichia coli CFT073
auccgcccucuuc

SEQ ID NO: 2643148 - RNA, 11 nt, Escherichia coli CFT073
auccgccgcau

SEQ ID NO: 2643149 - RNA, 22 nt, Escherichia coli CFT073
auccgccuuuuuaauuugccag

SEQ ID NO: 2643150 - RNA, 17 nt, Escherichia coli CFT073
auccgcgguaucgccgu

SEQ ID NO: 2643151 - RNA, 17 nt, Escherichia coli CFT073
auccgcgugacgcuggc

SEQ ID NO: 2643152 - RNA, 20 nt, Escherichia coli CFT073
auccgcucgucaaaaacaaa

SEQ ID NO: 2643153 - RNA, 22 nt, Escherichia coli CFT073
auccgcucgucaaaaacaaaau

SEQ ID NO: 2643154 - RNA, 23 nt, Escherichia coli CFT073
auccgcucugcccugccaucacu

SEQ ID NO: 2643155 - RNA, 17 nt, Escherichia coli CFT073
auccgcugaaaaacgaa

SEQ ID NO: 2643156 - RNA, 17 nt, Escherichia coli CFT073
auccgcugaugcagcgu

SEQ ID NO: 2643157 - RNA, 23 nt, Escherichia coli CFT073
auccgcuuuugguuuuucaacca

SEQ ID NO: 2643158 - RNA, 18 nt, Escherichia coli CFT073
auccggauggauccccgc

SEQ ID NO: 2643159 - RNA, 22 nt, Escherichia coli CFT073
auccggcaacaaaauauccugu

SEQ ID NO: 2643160 - RNA, 18 nt, Escherichia coli CFT073
auccggcaauauccauua

SEQ ID NO: 2643161 - RNA, 15 nt, Escherichia coli CFT073
auccggcaaucaacc

SEQ ID NO: 2643162 - RNA, 20 nt, Escherichia coli CFT073
auccggcaaucaacgccuga

SEQ ID NO: 2643163 - RNA, 18 nt, Escherichia coli CFT073
auccggcaaugcgcacgg

SEQ ID NO: 2643164 - RNA, 19 nt, Escherichia coli CFT073
auccggcaauuuugcgccg

SEQ ID NO: 2643165 - RNA, 13 nt, Escherichia coli CFT073
auccggcaccaau

SEQ ID NO: 2643166 - RNA, 19 nt, Escherichia coli CFT073
auccggcacgcauugccgc

SEQ ID NO: 2643167 - RNA, 17 nt, Escherichia coli CFT073
auccggcacguaucaac

SEQ ID NO: 2643168 - RNA, 19 nt, Escherichia coli CFT073
auccggcacuuuuucauca

SEQ ID NO: 2643169 - RNA, 21 nt, Escherichia coli CFT073
auccggcauaaacuacgcucg

SEQ ID NO: 2643170 - RNA, 16 nt, Escherichia coli CFT073
auccggcaucuuguuc

SEQ ID NO: 2643171 - RNA, 18 nt, Escherichia coli CFT073
auccggcaucuuguucau

SEQ ID NO: 2643172 - RNA, 15 nt, Escherichia coli CFT073
auccggcauuaucac

SEQ ID NO: 2643173 - RNA, 19 nt, Escherichia coli CFT073
auccggcauuuauuccgca

SEQ ID NO: 2643174 - RNA, 16 nt, Escherichia coli CFT073
auccggccauuuucau

SEQ ID NO: 2643175 - RNA, 21 nt, Escherichia coli CFT073
auccggccauuuucauuuaag

SEQ ID NO: 2643176 - RNA, 18 nt, Escherichia coli CFT073
auccggccuacauauuca

SEQ ID NO: 2643177 - RNA, 16 nt, Escherichia coli CFT073
auccggccuaccggac

SEQ ID NO: 2643178 - RNA, 15 nt, Escherichia coli CFT073
auccggccuacggga

SEQ ID NO: 2643179 - RNA, 22 nt, Escherichia coli CFT073
auccggccuacgggaacagugc

SEQ ID NO: 2643180 - RNA, 17 nt, Escherichia coli CFT073
auccggcgacaggaacc

SEQ ID NO: 2643181 - RNA, 18 nt, Escherichia coli CFT073
auccggcgacaggaacca

SEQ ID NO: 2643182 - RNA, 19 nt, Escherichia coli CFT073
auccggcgcaaaaaacuau

SEQ ID NO: 2643183 - RNA, 16 nt, Escherichia coli CFT073
auccggcguagauucg

SEQ ID NO: 2643184 - RNA, 20 nt, Escherichia coli CFT073
auccggcgucaucuuacugc

SEQ ID NO: 2643185 - RNA, 23 nt, Escherichia coli CFT073
auccggcuucuuuugcugccuuc

SEQ ID NO: 2643186 - RNA, 15 nt, Escherichia coli CFT073
auccggcuuucacuu

SEQ ID NO: 2643187 - RNA, 21 nt, Escherichia coli CFT073
auccggcuuuuuuacaucauc

SEQ ID NO: 2643188 - RNA, 17 nt, Escherichia coli CFT073
auccgggcaaaaauuau

SEQ ID NO: 2643189 - RNA, 12 nt, Escherichia coli CFT073
auccgggcuauc

SEQ ID NO: 2643190 - RNA, 17 nt, Escherichia coli CFT073
auccgggcuaucaugcc

SEQ ID NO: 2643191 - RNA, 17 nt, Escherichia coli CFT073
auccggggcaauuucag

SEQ ID NO: 2643192 - RNA, 18 nt, Escherichia coli CFT073
auccggggcaauuucagu

SEQ ID NO: 2643193 - RNA, 19 nt, Escherichia coli CFT073
auccggggcaauuucaguu

SEQ ID NO: 2643194 - RNA, 17 nt, Escherichia coli CFT073
auccggguucggauaaa

SEQ ID NO: 2643195 - RNA, 13 nt, Escherichia coli CFT073
auccgguaacccu

SEQ ID NO: 2643196 - RNA, 22 nt, Escherichia coli CFT073
auccggucuaccgauccggcac

SEQ ID NO: 2643197 - RNA, 16 nt, Escherichia coli CFT073
auccggugauugcugc

SEQ ID NO: 2643198 - RNA, 15 nt, Escherichia coli CFT073
aucgauauacaaaca

SEQ ID NO: 2643199 - RNA, 17 nt, Escherichia coli CFT073
aucgaucacguaauaaa

SEQ ID NO: 2643200 - RNA, 21 nt, Escherichia coli CFT073
aucgauuaccgccagcaacaa

SEQ ID NO: 2643201 - RNA, 23 nt, Escherichia coli CFT073
aucgauucagaugccauuuugca

SEQ ID NO: 2643202 - RNA, 14 nt, Escherichia coli CFT073
aucgcaaacagcac

SEQ ID NO: 2643203 - RNA, 20 nt, Escherichia coli CFT073
aucgcaaaggacaucccggc

SEQ ID NO: 2643204 - RNA, 19 nt, Escherichia coli CFT073
aucgcaacgcaucuuuuuc

SEQ ID NO: 2643205 - RNA, 23 nt, Escherichia coli CFT073
aucgcaaucauuuuuuccccuua

SEQ ID NO: 2643206 - RNA, 20 nt, Escherichia coli CFT073
aucgcaaucggguuaccgga

SEQ ID NO: 2643207 - RNA, 17 nt, Escherichia coli CFT073
aucgcacguugccagca

SEQ ID NO: 2643208 - RNA, 18 nt, Escherichia coli CFT073
aucgcacuuaaucgcccu

SEQ ID NO: 2643209 - RNA, 17 nt, Escherichia coli CFT073
aucgcaggcgagaacau

SEQ ID NO: 2643210 - RNA, 18 nt, Escherichia coli CFT073
aucgcaucaaucuuuuuc

SEQ ID NO: 2643211 - RNA, 19 nt, Escherichia coli CFT073
aucgcaucaaucuuuuuca

SEQ ID NO: 2643212 - RNA, 22 nt, Escherichia coli CFT073
aucgcaucuuuuuuuaccugaa

SEQ ID NO: 2643213 - RNA, 14 nt, Escherichia coli CFT073
aucgcaugccagcg

SEQ ID NO: 2643214 - RNA, 15 nt, Escherichia coli CFT073
aucgcaugccagcgc

SEQ ID NO: 2643215 - RNA, 14 nt, Escherichia coli CFT073
aucgccaacgccug

SEQ ID NO: 2643216 - RNA, 19 nt, Escherichia coli CFT073
aucgccaaucugguugccc

SEQ ID NO: 2643217 - RNA, 18 nt, Escherichia coli CFT073
aucgccaccacguucagg

SEQ ID NO: 2643218 - RNA, 16 nt, Escherichia coli CFT073
aucgccaccgcgggca

SEQ ID NO: 2643219 - RNA, 23 nt, Escherichia coli CFT073
aucgccaccggauauagcguaaa

SEQ ID NO: 2643220 - RNA, 21 nt, Escherichia coli CFT073
aucgccacggcaugaaagcga

SEQ ID NO: 2643221 - RNA, 22 nt, Escherichia coli CFT073
aucgccacgucguuccccauca

SEQ ID NO: 2643222 - RNA, 21 nt, Escherichia coli CFT073
aucgccacuuucacgccgcca

SEQ ID NO: 2643223 - RNA, 14 nt, Escherichia coli CFT073
aucgccagaaagug

SEQ ID NO: 2643224 - RNA, 11 nt, Escherichia coli CFT073
aucgccagaga

SEQ ID NO: 2643225 - RNA, 16 nt, Escherichia coli CFT073
aucgccagcaaaauca

SEQ ID NO: 2643226 - RNA, 20 nt, Escherichia coli CFT073
aucgccagcaaaaucaccau

SEQ ID NO: 2643227 - RNA, 22 nt, Escherichia coli CFT073
aucgccagcaaaaucaccauca

SEQ ID NO: 2643228 - RNA, 12 nt, Escherichia coli CFT073
aucgccagcagc

SEQ ID NO: 2643229 - RNA, 15 nt, Escherichia coli CFT073
aucgccagcagccau

SEQ ID NO: 2643230 - RNA, 12 nt, Escherichia coli CFT073
aucgccagcauc

SEQ ID NO: 2643231 - RNA, 17 nt, Escherichia coli CFT073
aucgccagcaucggcaa

SEQ ID NO: 2643232 - RNA, 20 nt, Escherichia coli CFT073
aucgccaggaacaacgacag

SEQ ID NO: 2643233 - RNA, 20 nt, Escherichia coli CFT073
aucgccauaaacaccagcag

SEQ ID NO: 2643234 - RNA, 13 nt, Escherichia coli CFT073
aucgccauauccg

SEQ ID NO: 2643235 - RNA, 15 nt, Escherichia coli CFT073
aucgccaugaugagc

SEQ ID NO: 2643236 - RNA, 16 nt, Escherichia coli CFT073
aucgccauugcuggug

SEQ ID NO: 2643237 - RNA, 20 nt, Escherichia coli CFT073
aucgccauuuaacgcaucac

SEQ ID NO: 2643238 - RNA, 14 nt, Escherichia coli CFT073
aucgcccacaccac

SEQ ID NO: 2643239 - RNA, 21 nt, Escherichia coli CFT073
aucgcccaguugaugaccagu

SEQ ID NO: 2643240 - RNA, 18 nt, Escherichia coli CFT073
aucgcccauggucgcgaa

SEQ ID NO: 2643241 - RNA, 13 nt, Escherichia coli CFT073
aucgcccccauca

SEQ ID NO: 2643242 - RNA, 21 nt, Escherichia coli CFT073
aucgcccccaucaccggcaca

SEQ ID NO: 2643243 - RNA, 21 nt, Escherichia coli CFT073
aucgcccccggagagggggcg

SEQ ID NO: 2643244 - RNA, 17 nt, Escherichia coli CFT073
aucgccccggucaucaa

SEQ ID NO: 2643245 - RNA, 15 nt, Escherichia coli CFT073
aucgcccgcaaucag

SEQ ID NO: 2643246 - RNA, 18 nt, Escherichia coli CFT073
aucgcccgcaaucagcgu

SEQ ID NO: 2643247 - RNA, 16 nt, Escherichia coli CFT073
aucgcccggcaccagc

SEQ ID NO: 2643248 - RNA, 17 nt, Escherichia coli CFT073
aucgcccggcaccagca

SEQ ID NO: 2643249 - RNA, 18 nt, Escherichia coli CFT073
aucgcccggcaccagcac

SEQ ID NO: 2643250 - RNA, 19 nt, Escherichia coli CFT073
aucgcccggcaccagcacc

SEQ ID NO: 2643251 - RNA, 17 nt, Escherichia coli CFT073
aucgcccggcguggugc

SEQ ID NO: 2643252 - RNA, 23 nt, Escherichia coli CFT073
aucgcccugaauuucaauaauuc

SEQ ID NO: 2643253 - RNA, 18 nt, Escherichia coli CFT073
aucgcccugauggcgcgc

SEQ ID NO: 2643254 - RNA, 15 nt, Escherichia coli CFT073
aucgcccugccagcg

SEQ ID NO: 2643255 - RNA, 18 nt, Escherichia coli CFT073
aucgcccugcuccagcag

SEQ ID NO: 2643256 - RNA, 20 nt, Escherichia coli CFT073
aucgcccugcuccagcagcu

SEQ ID NO: 2643257 - RNA, 15 nt, Escherichia coli CFT073
aucgcccuuaccauu

SEQ ID NO: 2643258 - RNA, 17 nt, Escherichia coli CFT073
aucgccgaaccagugcu

SEQ ID NO: 2643259 - RNA, 23 nt, Escherichia coli CFT073
aucgccgacaaucucuucgagaa

SEQ ID NO: 2643260 - RNA, 14 nt, Escherichia coli CFT073
aucgccgagauacu

SEQ ID NO: 2643261 - RNA, 20 nt, Escherichia coli CFT073
aucgccgcauaauaucuuuc

SEQ ID NO: 2643262 - RNA, 16 nt, Escherichia coli CFT073
aucgccgccagcgggg

SEQ ID NO: 2643263 - RNA, 20 nt, Escherichia coli CFT073
aucgccggaauaucaccacu

SEQ ID NO: 2643264 - RNA, 20 nt, Escherichia coli CFT073
aucgccggaugcggcaggcg

SEQ ID NO: 2643265 - RNA, 23 nt, Escherichia coli CFT073
aucgccgggauauaugucaccag

SEQ ID NO: 2643266 - RNA, 21 nt, Escherichia coli CFT073
aucgccggggcgggcauuuuu

SEQ ID NO: 2643267 - RNA, 21 nt, Escherichia coli CFT073
aucgccguuaaccauaauccg

SEQ ID NO: 2643268 - RNA, 23 nt, Escherichia coli CFT073
aucgccguuuuuuucuucucgca

SEQ ID NO: 2643269 - RNA, 14 nt, Escherichia coli CFT073
aucgccugcgaauc

SEQ ID NO: 2643270 - RNA, 18 nt, Escherichia coli CFT073
aucgccugcgccaccaca

SEQ ID NO: 2643271 - RNA, 13 nt, Escherichia coli CFT073
aucgccugcugga

SEQ ID NO: 2643272 - RNA, 15 nt, Escherichia coli CFT073
aucgccugcuggaca

SEQ ID NO: 2643273 - RNA, 21 nt, Escherichia coli CFT073
aucgccuuccggcaguuucau

SEQ ID NO: 2643274 - RNA, 19 nt, Escherichia coli CFT073
aucgccuuucagaucaaaa

SEQ ID NO: 2643275 - RNA, 23 nt, Escherichia coli CFT073
aucgccuuuugcccggcaacaac

SEQ ID NO: 2643276 - RNA, 16 nt, Escherichia coli CFT073
aucgcgacaaaauaca

SEQ ID NO: 2643277 - RNA, 17 nt, Escherichia coli CFT073
aucgcgacaaaauacag

SEQ ID NO: 2643278 - RNA, 12 nt, Escherichia coli CFT073
aucgcgaccaau

SEQ ID NO: 2643279 - RNA, 15 nt, Escherichia coli CFT073
aucgcgaccaaucac

SEQ ID NO: 2643280 - RNA, 14 nt, Escherichia coli CFT073
aucgcgacggcaga

SEQ ID NO: 2643281 - RNA, 15 nt, Escherichia coli CFT073
aucgcgaucaucagu

SEQ ID NO: 2643282 - RNA, 20 nt, Escherichia coli CFT073
aucgcgaucccccagaaaau

SEQ ID NO: 2643283 - RNA, 14 nt, Escherichia coli CFT073
aucgcgcauaucgu

SEQ ID NO: 2643284 - RNA, 14 nt, Escherichia coli CFT073
aucgcgccaaucag

SEQ ID NO: 2643285 - RNA, 14 nt, Escherichia coli CFT073
aucgcgccagccag

SEQ ID NO: 2643286 - RNA, 18 nt, Escherichia coli CFT073
aucgcgccaucaaaucug

SEQ ID NO: 2643287 - RNA, 12 nt, Escherichia coli CFT073
aucgcgccgcga

SEQ ID NO: 2643288 - RNA, 20 nt, Escherichia coli CFT073
aucgcgcgggcauugaugaa

SEQ ID NO: 2643289 - RNA, 21 nt, Escherichia coli CFT073
aucgcgcgggcauugaugaac

SEQ ID NO: 2643290 - RNA, 17 nt, Escherichia coli CFT073
aucgcgcguguugcgcc

SEQ ID NO: 2643291 - RNA, 18 nt, Escherichia coli CFT073
aucgcgcguguugcgcca

SEQ ID NO: 2643292 - RNA, 22 nt, Escherichia coli CFT073
aucgcgcguuaauuucuuuuca

SEQ ID NO: 2643293 - RNA, 21 nt, Escherichia coli CFT073
aucgcgcucguagguuucugc

SEQ ID NO: 2643294 - RNA, 23 nt, Escherichia coli CFT073
aucgcgcucguagguuucugcca

SEQ ID NO: 2643295 - RNA, 14 nt, Escherichia coli CFT073
aucgcgcuuagcaa

SEQ ID NO: 2643296 - RNA, 18 nt, Escherichia coli CFT073
aucgcggauaugcagcag

SEQ ID NO: 2643297 - RNA, 14 nt, Escherichia coli CFT073
aucgcggcacacag

SEQ ID NO: 2643298 - RNA, 14 nt, Escherichia coli CFT073
aucgcggcacagaa

SEQ ID NO: 2643299 - RNA, 21 nt, Escherichia coli CFT073
aucgcggcgauauccagcgcg

SEQ ID NO: 2643300 - RNA, 24 nt, Escherichia coli CFT073
aucgcggcgauauccagcgcggcg

SEQ ID NO: 2643301 - RNA, 17 nt, Escherichia coli CFT073
aucgcgguaacagauga

SEQ ID NO: 2643302 - RNA, 19 nt, Escherichia coli CFT073
aucgcgguaacagaugaau

SEQ ID NO: 2643303 - RNA, 13 nt, Escherichia coli CFT073
aucgcguaaggcu

SEQ ID NO: 2643304 - RNA, 22 nt, Escherichia coli CFT073
aucgcguaaggcuucaaucaau

SEQ ID NO: 2643305 - RNA, 18 nt, Escherichia coli CFT073
aucgcguacucaccgcuc

SEQ ID NO: 2643306 - RNA, 22 nt, Escherichia coli CFT073
aucguguuuaucuuccagcauu

SEQ ID NO: 2643307 - RNA, 21 nt, Escherichia coli CFT073
aucguuaaaaagauuaagaac

SEQ ID NO: 2643308 - RNA, 16 nt, Escherichia coli CFT073
aucguuaaagagauca

SEQ ID NO: 2643309 - RNA, 19 nt, Escherichia coli CFT073
aucguuaaagagaucaaag

SEQ ID NO: 2643310 - RNA, 17 nt, Escherichia coli CFT073
aucguuacucuuaucaa

SEQ ID NO: 2643311 - RNA, 15 nt, Escherichia coli CFT073
aucguucgccagcuc

SEQ ID NO: 2643312 - RNA, 20 nt, Escherichia coli CFT073
aucguucucgcgauaaaacu

SEQ ID NO: 2643313 - RNA, 24 nt, Escherichia coli CFT073
aucguugaaaaaauuuuauccaua

SEQ ID NO: 2643314 - RNA, 14 nt, Escherichia coli CFT073
aucguugaccugga

SEQ ID NO: 2643315 - RNA, 17 nt, Escherichia coli CFT073
aucguugauuucaccau

SEQ ID NO: 2643316 - RNA, 20 nt, Escherichia coli CFT073
aucguuguuggcuuccugcc

SEQ ID NO: 2643317 - RNA, 16 nt, Escherichia coli CFT073
aucuaaaagcaaacug

SEQ ID NO: 2643318 - RNA, 22 nt, Escherichia coli CFT073
aucuaaaaugucaccuaauuua

SEQ ID NO: 2643319 - RNA, 17 nt, Escherichia coli CFT073
aucuaaaugccacugaa

SEQ ID NO: 2643320 - RNA, 22 nt, Escherichia coli CFT073
aucuaaccggauaucuaaugcc

SEQ ID NO: 2643321 - RNA, 16 nt, Escherichia coli CFT073
aucuaagaucccugcc

SEQ ID NO: 2643322 - RNA, 20 nt, Escherichia coli CFT073
aucuaagaucccugccauuu

SEQ ID NO: 2643323 - RNA, 19 nt, Escherichia coli CFT073
aucuaaugccauuaacauc

SEQ ID NO: 2643324 - RNA, 15 nt, Escherichia coli CFT073
aucuaccacugccug

SEQ ID NO: 2643325 - RNA, 21 nt, Escherichia coli CFT073
aucuaccaguuccagcgccug

SEQ ID NO: 2643326 - RNA, 18 nt, Escherichia coli CFT073
aucuacuacuggagacag

SEQ ID NO: 2643327 - RNA, 22 nt, Escherichia coli CFT073
aucuagccugaugcgaugcugg

SEQ ID NO: 2643328 - RNA, 15 nt, Escherichia coli CFT073
aucuauagcacccgc

SEQ ID NO: 2643329 - RNA, 22 nt, Escherichia coli CFT073
aucuauccgaugcaaaaaauga

SEQ ID NO: 2643330 - RNA, 16 nt, Escherichia coli CFT073
aucuaugccaucuucu

SEQ ID NO: 2643331 - RNA, 15 nt, Escherichia coli CFT073
aucucaacaaacgca

SEQ ID NO: 2643332 - RNA, 17 nt, Escherichia coli CFT073
aucucaacaaacgcaua

SEQ ID NO: 2643333 - RNA, 17 nt, Escherichia coli CFT073
aucucaagcgguaaacc

SEQ ID NO: 2643334 - RNA, 15 nt, Escherichia coli CFT073
aucucaaucaaaaga

SEQ ID NO: 2643335 - RNA, 22 nt, Escherichia coli CFT073
aucucaauuccuuugcugcucu

SEQ ID NO: 2643336 - RNA, 16 nt, Escherichia coli CFT073
aucucacccgguacau

SEQ ID NO: 2643337 - RNA, 19 nt, Escherichia coli CFT073
aucucacccgguacaucaa

SEQ ID NO: 2643338 - RNA, 16 nt, Escherichia coli CFT073
aucucacuacaacaac

SEQ ID NO: 2643339 - RNA, 16 nt, Escherichia coli CFT073
aucucagauaaaugca

SEQ ID NO: 2643340 - RNA, 22 nt, Escherichia coli CFT073
aucucagauaaaugcaaacgca

SEQ ID NO: 2643341 - RNA, 22 nt, Escherichia coli CFT073
aucucagcgauauagaucauau

SEQ ID NO: 2643342 - RNA, 11 nt, Escherichia coli CFT073
aucucaucaau

SEQ ID NO: 2643343 - RNA, 23 nt, Escherichia coli CFT073
aucucaucaauggauucaugaua

SEQ ID NO: 2643344 - RNA, 16 nt, Escherichia coli CFT073
aucuccagugagagau

SEQ ID NO: 2643345 - RNA, 16 nt, Escherichia coli CFT073
aucuccaguuccccgc

SEQ ID NO: 2643346 - RNA, 18 nt, Escherichia coli CFT073
aucuccaguuucgagaaa

SEQ ID NO: 2643347 - RNA, 13 nt, Escherichia coli CFT073
aucuccaucaucu

SEQ ID NO: 2643348 - RNA, 15 nt, Escherichia coli CFT073
aucuccauugccggc

SEQ ID NO: 2643349 - RNA, 13 nt, Escherichia coli CFT073
aucucccgcuggc

SEQ ID NO: 2643350 - RNA, 18 nt, Escherichia coli CFT073
aucuccgaaguuaaccuu

SEQ ID NO: 2643351 - RNA, 11 nt, Escherichia coli CFT073
aucuccggcgg

SEQ ID NO: 2643352 - RNA, 18 nt, Escherichia coli CFT073
aucuccggcgguaaaugc

SEQ ID NO: 2643353 - RNA, 22 nt, Escherichia coli CFT073
aucuccggcgguaaaugcucau

SEQ ID NO: 2643354 - RNA, 19 nt, Escherichia coli CFT073
aucucgaauugucaccguc

SEQ ID NO: 2643355 - RNA, 15 nt, Escherichia coli CFT073
aucucgccauccuua

SEQ ID NO: 2643356 - RNA, 23 nt, Escherichia coli CFT073
aucucgcgccaguaccgccgcag

SEQ ID NO: 2643357 - RNA, 20 nt, Escherichia coli CFT073
aucucggauaaggcuuccua

SEQ ID NO: 2643358 - RNA, 15 nt, Escherichia coli CFT073
aucucggucaccagg

SEQ ID NO: 2643359 - RNA, 16 nt, Escherichia coli CFT073
aucucgguggaaaaua

SEQ ID NO: 2643360 - RNA, 17 nt, Escherichia coli CFT073
aucucgguggaaaauag

SEQ ID NO: 2643361 - RNA, 22 nt, Escherichia coli CFT073
aucucgguggaaaauagcauaa

SEQ ID NO: 2643362 - RNA, 14 nt, Escherichia coli CFT073
aucucgguuuucag

SEQ ID NO: 2643363 - RNA, 16 nt, Escherichia coli CFT073
aucucgguuuucaggu

SEQ ID NO: 2643364 - RNA, 17 nt, Escherichia coli CFT073
aucucguggucaauauc

SEQ ID NO: 2643365 - RNA, 14 nt, Escherichia coli CFT073
aucucguugaucac

SEQ ID NO: 2643366 - RNA, 16 nt, Escherichia coli CFT073
aucucguugaucaccc

SEQ ID NO: 2643367 - RNA, 18 nt, Escherichia coli CFT073
aucucguugaucacccac

SEQ ID NO: 2643368 - RNA, 17 nt, Escherichia coli CFT073
aucucuaacgguucuuu

SEQ ID NO: 2643369 - RNA, 15 nt, Escherichia coli CFT073
aucucuauuacccua

SEQ ID NO: 2643370 - RNA, 18 nt, Escherichia coli CFT073
aucucuccgggcaugaac

SEQ ID NO: 2643371 - RNA, 23 nt, Escherichia coli CFT073
aucucugacgcgcauacucuccu

SEQ ID NO: 2643372 - RNA, 21 nt, Escherichia coli CFT073
aucucugccuugaguuuuuca

SEQ ID NO: 2643373 - RNA, 23 nt, Escherichia coli CFT073
aucucuggcggcaaaccuuucgc

SEQ ID NO: 2643374 - RNA, 21 nt, Escherichia coli CFT073
aucucuuaucauccaggugaa

SEQ ID NO: 2643375 - RNA, 13 nt, Escherichia coli CFT073
aucucuucaagcu

SEQ ID NO: 2643376 - RNA, 21 nt, Escherichia coli CFT073
aucucuucaauaugggcacgc

SEQ ID NO: 2643377 - RNA, 20 nt, Escherichia coli CFT073
aucucuucaccauaaaacgc

SEQ ID NO: 2643378 - RNA, 23 nt, Escherichia coli CFT073
aucucuucaccugccugcagcug

SEQ ID NO: 2643379 - RNA, 13 nt, Escherichia coli CFT073
aucucuuccagcg

SEQ ID NO: 2643380 - RNA, 17 nt, Escherichia coli CFT073
aucucuuccagcgacac

SEQ ID NO: 2643381 - RNA, 21 nt, Escherichia coli CFT073
aucucuuccagcgucuccaga

SEQ ID NO: 2643382 - RNA, 12 nt, Escherichia coli CFT073
aucucuuccgca

SEQ ID NO: 2643383 - RNA, 14 nt, Escherichia coli CFT073
aucucuucuucgcu

SEQ ID NO: 2643384 - RNA, 12 nt, Escherichia coli CFT073
aucucuuuaugg

SEQ ID NO: 2643385 - RNA, 22 nt, Escherichia coli CFT073
aucucuuucuuugaaugacgau

SEQ ID NO: 2643386 - RNA, 23 nt, Escherichia coli CFT073
aucugaaaaccaggcuuacacuu

SEQ ID NO: 2643387 - RNA, 13 nt, Escherichia coli CFT073
aucugaaaaugaa

SEQ ID NO: 2643388 - RNA, 14 nt, Escherichia coli CFT073
aucugaaaaugaaa

SEQ ID NO: 2643389 - RNA, 22 nt, Escherichia coli CFT073
aucugaaguaaagaaacugguu

SEQ ID NO: 2643390 - RNA, 11 nt, Escherichia coli CFT073
aucugaauauu

SEQ ID NO: 2643391 - RNA, 21 nt, Escherichia coli CFT073
aucugaauauucggcuccaga

SEQ ID NO: 2643392 - RNA, 14 nt, Escherichia coli CFT073
aucugacacagcgc

SEQ ID NO: 2643393 - RNA, 18 nt, Escherichia coli CFT073
aucugaccuauuucauuc

SEQ ID NO: 2643394 - RNA, 22 nt, Escherichia coli CFT073
aucugacuuuccggggaaaugc

SEQ ID NO: 2643395 - RNA, 18 nt, Escherichia coli CFT073
aucugaugauauuuuucc

SEQ ID NO: 2643396 - RNA, 23 nt, Escherichia coli CFT073
aucugauuccgggccaccaugcc

SEQ ID NO: 2643397 - RNA, 14 nt, Escherichia coli CFT073
aucugauucuuccc

SEQ ID NO: 2643398 - RNA, 15 nt, Escherichia coli CFT073
aucugauucuuccca

SEQ ID NO: 2643399 - RNA, 19 nt, Escherichia coli CFT073
aucugauuuaaaaaugcca

SEQ ID NO: 2643400 - RNA, 23 nt, Escherichia coli CFT073
aucugauuuaaaaaugccagccu

SEQ ID NO: 2643401 - RNA, 11 nt, Escherichia coli CFT073
aucugauuuuc

SEQ ID NO: 2643402 - RNA, 17 nt, Escherichia coli CFT073
aucugcaaaauaccaau

SEQ ID NO: 2643403 - RNA, 15 nt, Escherichia coli CFT073
aucugcaaauucaau

SEQ ID NO: 2643404 - RNA, 18 nt, Escherichia coli CFT073
aucugcaaauucaauaaa

SEQ ID NO: 2643405 - RNA, 18 nt, Escherichia coli CFT073
aucugcacagcauucagc

SEQ ID NO: 2643406 - RNA, 14 nt, Escherichia coli CFT073
aucugccagccagu

SEQ ID NO: 2643407 - RNA, 19 nt, Escherichia coli CFT073
aucugcccguacccaacac

SEQ ID NO: 2643408 - RNA, 15 nt, Escherichia coli CFT073
aucugcccguagccc

SEQ ID NO: 2643409 - RNA, 22 nt, Escherichia coli CFT073
aucugccguagcggcgauaaac

SEQ ID NO: 2643410 - RNA, 20 nt, Escherichia coli CFT073
aucugccugauccugagcua

SEQ ID NO: 2643411 - RNA, 17 nt, Escherichia coli CFT073
aucugccuuugccggau

SEQ ID NO: 2643412 - RNA, 22 nt, Escherichia coli CFT073
aucugcgccuacggcauucugc

SEQ ID NO: 2643413 - RNA, 19 nt, Escherichia coli CFT073
aucugcguaucgcccugcc

SEQ ID NO: 2643414 - RNA, 22 nt, Escherichia coli CFT073
aucuuuccgcaauagucauuaa

SEQ ID NO: 2643415 - RNA, 16 nt, Escherichia coli CFT073
aucuuuccggcagaag

SEQ ID NO: 2643416 - RNA, 18 nt, Escherichia coli CFT073
aucuuuccggcagaagca

SEQ ID NO: 2643417 - RNA, 12 nt, Escherichia coli CFT073
aucuuucgagua

SEQ ID NO: 2643418 - RNA, 13 nt, Escherichia coli CFT073
aucuuucgaguaa

SEQ ID NO: 2643419 - RNA, 21 nt, Escherichia coli CFT073
aucuuucugcgcaucuucccc

SEQ ID NO: 2643420 - RNA, 12 nt, Escherichia coli CFT073
aucuuugaaaua

SEQ ID NO: 2643421 - RNA, 16 nt, Escherichia coli CFT073
aucuuugacugaaauu

SEQ ID NO: 2643422 - RNA, 18 nt, Escherichia coli CFT073
aucuuugacugaaauuua

SEQ ID NO: 2643423 - RNA, 16 nt, Escherichia coli CFT073
aucuuugagucaacau

SEQ ID NO: 2643424 - RNA, 15 nt, Escherichia coli CFT073
aucuuuuaaaucauc

SEQ ID NO: 2643425 - RNA, 13 nt, Escherichia coli CFT073
augaaaaaaccag

SEQ ID NO: 2643426 - RNA, 18 nt, Escherichia coli CFT073
augaaaaaaccagaaagg

SEQ ID NO: 2643427 - RNA, 15 nt, Escherichia coli CFT073
augaaaaacguugcc

SEQ ID NO: 2643428 - RNA, 12 nt, Escherichia coli CFT073
augaaaaagcgu

SEQ ID NO: 2643429 - RNA, 22 nt, Escherichia coli CFT073
augaaaacgaauugucccauuu

SEQ ID NO: 2643430 - RNA, 11 nt, Escherichia coli CFT073
augaaaacucg

SEQ ID NO: 2643431 - RNA, 17 nt, Escherichia coli CFT073
augaaaaguuagccaca

SEQ ID NO: 2643432 - RNA, 15 nt, Escherichia coli CFT073
augaaaaugccgggg

SEQ ID NO: 2643433 - RNA, 16 nt, Escherichia coli CFT073
augaaacgcaaauacu

SEQ ID NO: 2643434 - RNA, 18 nt, Escherichia coli CFT073
augaaacgcaaauacuga

SEQ ID NO: 2643435 - RNA, 20 nt, Escherichia coli CFT073
augaaacucaagcuaaacca

SEQ ID NO: 2643436 - RNA, 21 nt, Escherichia coli CFT073
augaaacucaagcuaaaccaa

SEQ ID NO: 2643437 - RNA, 12 nt, Escherichia coli CFT073
augaaacugggu

SEQ ID NO: 2643438 - RNA, 15 nt, Escherichia coli CFT073
augaaagcaugucag

SEQ ID NO: 2643439 - RNA, 19 nt, Escherichia coli CFT073
augaaagcaugucaggcag

SEQ ID NO: 2643440 - RNA, 20 nt, Escherichia coli CFT073
augaaaggauucgcuugcaa

SEQ ID NO: 2643441 - RNA, 16 nt, Escherichia coli CFT073
augaaauacuaaauau

SEQ ID NO: 2643442 - RNA, 20 nt, Escherichia coli CFT073
augaaauauugccucaugcg

SEQ ID NO: 2643443 - RNA, 14 nt, Escherichia coli CFT073
augaaaugcaggca

SEQ ID NO: 2643444 - RNA, 23 nt, Escherichia coli CFT073
augaaauguaggguuacgcgcag

SEQ ID NO: 2643445 - RNA, 15 nt, Escherichia coli CFT073
augaacaaagcaaau

SEQ ID NO: 2643446 - RNA, 13 nt, Escherichia coli CFT073
augaacgcgcaga

SEQ ID NO: 2643447 - RNA, 18 nt, Escherichia coli CFT073
augaacggcgguaaagaa

SEQ ID NO: 2643448 - RNA, 21 nt, Escherichia coli CFT073
augaacggcuuuuucuggcgu

SEQ ID NO: 2643449 - RNA, 19 nt, Escherichia coli CFT073
augaagagauaaacgacca

SEQ ID NO: 2643450 - RNA, 12 nt, Escherichia coli CFT073
augaagcaauga

SEQ ID NO: 2643451 - RNA, 16 nt, Escherichia coli CFT073
augaaguaacagaaga

SEQ ID NO: 2643452 - RNA, 16 nt, Escherichia coli CFT073
augaaguaguaacugu

SEQ ID NO: 2643453 - RNA, 17 nt, Escherichia coli CFT073
augaagucgcagaccaa

SEQ ID NO: 2643454 - RNA, 14 nt, Escherichia coli CFT073
augaaguugaaauc

SEQ ID NO: 2643455 - RNA, 16 nt, Escherichia coli CFT073
augaaguugaaaucac

SEQ ID NO: 2643456 - RNA, 13 nt, Escherichia coli CFT073
augaauaaaaaaa

SEQ ID NO: 2643457 - RNA, 16 nt, Escherichia coli CFT073
augaauaacuuccugu

SEQ ID NO: 2643458 - RNA, 19 nt, Escherichia coli CFT073
augaauaaucugaaaacca

SEQ ID NO: 2643459 - RNA, 22 nt, Escherichia coli CFT073
augaauagcggaaaucuccaga

SEQ ID NO: 2643460 - RNA, 18 nt, Escherichia coli CFT073
augaauaucauaggucag

SEQ ID NO: 2643461 - RNA, 22 nt, Escherichia coli CFT073
augaauaucauaggucaggaau

SEQ ID NO: 2643462 - RNA, 16 nt, Escherichia coli CFT073
augaauauucuguuca

SEQ ID NO: 2643463 - RNA, 19 nt, Escherichia coli CFT073
augaauauugcugaaaagg

SEQ ID NO: 2643464 - RNA, 20 nt, Escherichia coli CFT073
augaaucacgauacuggcgu

SEQ ID NO: 2643465 - RNA, 14 nt, Escherichia coli CFT073
augaaucagcagau

SEQ ID NO: 2643466 - RNA, 14 nt, Escherichia coli CFT073
augaaucauggcgu

SEQ ID NO: 2643467 - RNA, 18 nt, Escherichia coli CFT073
augaauccaggccagaua

SEQ ID NO: 2643468 - RNA, 19 nt, Escherichia coli CFT073
augaaucgggucggcggca

SEQ ID NO: 2643469 - RNA, 14 nt, Escherichia coli CFT073
augaaugaaaacga

SEQ ID NO: 2643470 - RNA, 15 nt, Escherichia coli CFT073
augaaugauacagaa

SEQ ID NO: 2643471 - RNA, 18 nt, Escherichia coli CFT073
augaaugauaugcccagg

SEQ ID NO: 2643472 - RNA, 15 nt, Escherichia coli CFT073
augaauuaccccugg

SEQ ID NO: 2643473 - RNA, 11 nt, Escherichia coli CFT073
augaauugagg

SEQ ID NO: 2643474 - RNA, 23 nt, Escherichia coli CFT073
augaauuuccgguuguuuugguu

SEQ ID NO: 2643475 - RNA, 14 nt, Escherichia coli CFT073
augaauuuucgaca

SEQ ID NO: 2643476 - RNA, 18 nt, Escherichia coli CFT073
augaauuuucgacagcac

SEQ ID NO: 2643477 - RNA, 18 nt, Escherichia coli CFT073
augacaaacgcaaaacug

SEQ ID NO: 2643478 - RNA, 19 nt, Escherichia coli CFT073
augacaaacgcaaaacugc

SEQ ID NO: 2643479 - RNA, 20 nt, Escherichia coli CFT073
augacaaacguauaauugcc

SEQ ID NO: 2643480 - RNA, 21 nt, Escherichia coli CFT073
augacaacaccaucgaaauua

SEQ ID NO: 2643481 - RNA, 23 nt, Escherichia coli CFT073
augacaauguggccuuaauuggc

SEQ ID NO: 2643482 - RNA, 15 nt, Escherichia coli CFT073
augacaauuacaaaa

SEQ ID NO: 2643483 - RNA, 23 nt, Escherichia coli CFT073
augacaccaacgcuaaauacuga

SEQ ID NO: 2643484 - RNA, 15 nt, Escherichia coli CFT073
augacacucacgcau

SEQ ID NO: 2643485 - RNA, 14 nt, Escherichia coli CFT073
augacagaaucagc

SEQ ID NO: 2643486 - RNA, 17 nt, Escherichia coli CFT073
augacagaaucagcagc

SEQ ID NO: 2643487 - RNA, 18 nt, Escherichia coli CFT073
augacagaaucagcagcg

SEQ ID NO: 2643488 - RNA, 19 nt, Escherichia coli CFT073
augacagccccaccagcaa

SEQ ID NO: 2643489 - RNA, 20 nt, Escherichia coli CFT073
augacagccccaccagcaaa

SEQ ID NO: 2643490 - RNA, 16 nt, Escherichia coli CFT073
augacaguaucaccaa

SEQ ID NO: 2643491 - RNA, 12 nt, Escherichia coli CFT073
augacauaaccu

SEQ ID NO: 2643492 - RNA, 18 nt, Escherichia coli CFT073
augacauacagcaccgcc

SEQ ID NO: 2643493 - RNA, 13 nt, Escherichia coli CFT073
augacaucgcccu

SEQ ID NO: 2643494 - RNA, 23 nt, Escherichia coli CFT073
augacaucgcccucuuucaccag

SEQ ID NO: 2643495 - RNA, 16 nt, Escherichia coli CFT073
augaccaccaaauaaa

SEQ ID NO: 2643496 - RNA, 16 nt, Escherichia coli CFT073
augaccagugcagaua

SEQ ID NO: 2643497 - RNA, 17 nt, Escherichia coli CFT073
augaccagugcagauac

SEQ ID NO: 2643498 - RNA, 22 nt, Escherichia coli CFT073
augaccagugcagauaccacca

SEQ ID NO: 2643499 - RNA, 23 nt, Escherichia coli CFT073
augaccagugcagauaccaccag

SEQ ID NO: 2643500 - RNA, 13 nt, Escherichia coli CFT073
augacccacgccu

SEQ ID NO: 2643501 - RNA, 18 nt, Escherichia coli CFT073
augaccgaggcgcggcga

SEQ ID NO: 2643502 - RNA, 22 nt, Escherichia coli CFT073
augaccgcuaauagcgcagcgg

SEQ ID NO: 2643503 - RNA, 15 nt, Escherichia coli CFT073
augaccgugaucgug

SEQ ID NO: 2643504 - RNA, 16 nt, Escherichia coli CFT073
augaccguuugccccg

SEQ ID NO: 2643505 - RNA, 23 nt, Escherichia coli CFT073
augacgaauaccguauucaacga

SEQ ID NO: 2643506 - RNA, 18 nt, Escherichia coli CFT073
augacgaauagcagacaa

SEQ ID NO: 2643507 - RNA, 17 nt, Escherichia coli CFT073
augacgaguauauucug

SEQ ID NO: 2643508 - RNA, 19 nt, Escherichia coli CFT073
augacgaguauauucugua

SEQ ID NO: 2643509 - RNA, 17 nt, Escherichia coli CFT073
augacgauacggaauau

SEQ ID NO: 2643510 - RNA, 15 nt, Escherichia coli CFT073
augacgccacuggcu

SEQ ID NO: 2643511 - RNA, 16 nt, Escherichia coli CFT073
augacgcgcucaccgc

SEQ ID NO: 2643512 - RNA, 13 nt, Escherichia coli CFT073
augacggggauuc

SEQ ID NO: 2643513 - RNA, 17 nt, Escherichia coli CFT073
augacguguaugcauaa

SEQ ID NO: 2643514 - RNA, 23 nt, Escherichia coli CFT073
augacguguaugcauaaccaaca

SEQ ID NO: 2643515 - RNA, 16 nt, Escherichia coli CFT073
augacuaaugccgcca

SEQ ID NO: 2643516 - RNA, 18 nt, Escherichia coli CFT073
augacuaucacagaaaaa

SEQ ID NO: 2643517 - RNA, 22 nt, Escherichia coli CFT073
augacucgccgcaaaacccagg

SEQ ID NO: 2643518 - RNA, 15 nt, Escherichia coli CFT073
augacuuaaaucucu

SEQ ID NO: 2643519 - RNA, 16 nt, Escherichia coli CFT073
augacuuccgccacca

SEQ ID NO: 2643520 - RNA, 16 nt, Escherichia coli CFT073
augacuuucaaagaga

SEQ ID NO: 2643521 - RNA, 18 nt, Escherichia coli CFT073
augagaacaucaucccca

SEQ ID NO: 2643522 - RNA, 23 nt, Escherichia coli CFT073
augagaacaucauccccacaccu

SEQ ID NO: 2643523 - RNA, 15 nt, Escherichia coli CFT073
augcagccaggccau

SEQ ID NO: 2643524 - RNA, 20 nt, Escherichia coli CFT073
augcagccccauaugcagca

SEQ ID NO: 2643525 - RNA, 23 nt, Escherichia coli CFT073
augcagccccauaugcagcacuu

SEQ ID NO: 2643526 - RNA, 13 nt, Escherichia coli CFT073
augcagccuucau

SEQ ID NO: 2643527 - RNA, 13 nt, Escherichia coli CFT073
augcagcugcucg

SEQ ID NO: 2643528 - RNA, 16 nt, Escherichia coli CFT073
augcaggcaucgguga

SEQ ID NO: 2643529 - RNA, 22 nt, Escherichia coli CFT073
augcaggcaucggugaugcucu

SEQ ID NO: 2643530 - RNA, 17 nt, Escherichia coli CFT073
augcaggcaugcaauau

SEQ ID NO: 2643531 - RNA, 23 nt, Escherichia coli CFT073
augcaggcugggcacucuuggca

SEQ ID NO: 2643532 - RNA, 15 nt, Escherichia coli CFT073
augcagggcaaacuc

SEQ ID NO: 2643533 - RNA, 15 nt, Escherichia coli CFT073
augcagguacucacc

SEQ ID NO: 2643534 - RNA, 15 nt, Escherichia coli CFT073
augcaguaccagaua

SEQ ID NO: 2643535 - RNA, 14 nt, Escherichia coli CFT073
augcauaaagcggu

SEQ ID NO: 2643536 - RNA, 18 nt, Escherichia coli CFT073
augcauagcguucuucca

SEQ ID NO: 2643537 - RNA, 13 nt, Escherichia coli CFT073
augcaucagcugg

SEQ ID NO: 2643538 - RNA, 20 nt, Escherichia coli CFT073
augcauccggcacauuucau

SEQ ID NO: 2643539 - RNA, 23 nt, Escherichia coli CFT073
augcauccggcacauuucauuca

SEQ ID NO: 2643540 - RNA, 15 nt, Escherichia coli CFT073
augcaucuucauuaa

SEQ ID NO: 2643541 - RNA, 17 nt, Escherichia coli CFT073
augccaaagaaugcagu

SEQ ID NO: 2643542 - RNA, 19 nt, Escherichia coli CFT073
augccaaagaaugcaguca

SEQ ID NO: 2643543 - RNA, 22 nt, Escherichia coli CFT073
augccaaauauuucuuuaucac

SEQ ID NO: 2643544 - RNA, 24 nt, Escherichia coli CFT073
augccaaauauuucuuuaucacca

SEQ ID NO: 2643545 - RNA, 19 nt, Escherichia coli CFT073
augccaaauguauccauca

SEQ ID NO: 2643546 - RNA, 20 nt, Escherichia coli CFT073
augccaaccgcgacaauauc

SEQ ID NO: 2643547 - RNA, 22 nt, Escherichia coli CFT073
augccaaccgcgacaauaucau

SEQ ID NO: 2643548 - RNA, 20 nt, Escherichia coli CFT073
augccaauaaauccuuugua

SEQ ID NO: 2643549 - RNA, 13 nt, Escherichia coli CFT073
augccacaguaaa

SEQ ID NO: 2643550 - RNA, 14 nt, Escherichia coli CFT073
augccacaguaaaa

SEQ ID NO: 2643551 - RNA, 19 nt, Escherichia coli CFT073
augccaccacaccagacca

SEQ ID NO: 2643552 - RNA, 19 nt, Escherichia coli CFT073
augccaccagaaacagagu

SEQ ID NO: 2643553 - RNA, 15 nt, Escherichia coli CFT073
augccacccauuaca

SEQ ID NO: 2643554 - RNA, 18 nt, Escherichia coli CFT073
augccacugucaacugcu

SEQ ID NO: 2643555 - RNA, 15 nt, Escherichia coli CFT073
augccagaaucccca

SEQ ID NO: 2643556 - RNA, 17 nt, Escherichia coli CFT073
augccagaauccccacu

SEQ ID NO: 2643557 - RNA, 21 nt, Escherichia coli CFT073
augccagaauccccacugcau

SEQ ID NO: 2643558 - RNA, 24 nt, Escherichia coli CFT073
augccagaauccccacugcauggc

SEQ ID NO: 2643559 - RNA, 18 nt, Escherichia coli CFT073
augccagacuuuguugaa

SEQ ID NO: 2643560 - RNA, 14 nt, Escherichia coli CFT073
augccagcaacugg

SEQ ID NO: 2643561 - RNA, 21 nt, Escherichia coli CFT073
augccagcacagaucgcacuu

SEQ ID NO: 2643562 - RNA, 14 nt, Escherichia coli CFT073
augccagcagcacc

SEQ ID NO: 2643563 - RNA, 15 nt, Escherichia coli CFT073
augccagcagcaccc

SEQ ID NO: 2643564 - RNA, 16 nt, Escherichia coli CFT073
augccagcauaccgcc

SEQ ID NO: 2643565 - RNA, 18 nt, Escherichia coli CFT073
augccaggcuccagauaa

SEQ ID NO: 2643566 - RNA, 16 nt, Escherichia coli CFT073
augccaguaacucauu

SEQ ID NO: 2643567 - RNA, 12 nt, Escherichia coli CFT073
augccaguaauc

SEQ ID NO: 2643568 - RNA, 15 nt, Escherichia coli CFT073
augccagucaaugaa

SEQ ID NO: 2643569 - RNA, 22 nt, Escherichia coli CFT073
augccagugaugggcagaauaa

SEQ ID NO: 2643570 - RNA, 18 nt, Escherichia coli CFT073
augccaguucaguaaaac

SEQ ID NO: 2643571 - RNA, 13 nt, Escherichia coli CFT073
augccaucaccaa

SEQ ID NO: 2643572 - RNA, 23 nt, Escherichia coli CFT073
augccaucauggcgaugagaauc

SEQ ID NO: 2643573 - RNA, 16 nt, Escherichia coli CFT073
augccauccgcaucgg

SEQ ID NO: 2643574 - RNA, 17 nt, Escherichia coli CFT073
augccaucugccagcaa

SEQ ID NO: 2643575 - RNA, 22 nt, Escherichia coli CFT073
augccauucacaaaaacaguaa

SEQ ID NO: 2643576 - RNA, 23 nt, Escherichia coli CFT073
augcccaaaaaaacggcaacggc

SEQ ID NO: 2643577 - RNA, 21 nt, Escherichia coli CFT073
augcccacugcacaguguuug

SEQ ID NO: 2643578 - RNA, 23 nt, Escherichia coli CFT073
augcccauuccccagccgaucag

SEQ ID NO: 2643579 - RNA, 20 nt, Escherichia coli CFT073
augccccacagagugguggg

SEQ ID NO: 2643580 - RNA, 18 nt, Escherichia coli CFT073
augccccagaauaacgcg

SEQ ID NO: 2643581 - RNA, 19 nt, Escherichia coli CFT073
augccccagcccgccaaua

SEQ ID NO: 2643582 - RNA, 18 nt, Escherichia coli CFT073
augccccauaauauugcc

SEQ ID NO: 2643583 - RNA, 12 nt, Escherichia coli CFT073
augcccgcagua

SEQ ID NO: 2643584 - RNA, 23 nt, Escherichia coli CFT073
augcccgcaguaauauuugcuua

SEQ ID NO: 2643585 - RNA, 20 nt, Escherichia coli CFT073
augcccucaauaucuuuccc

SEQ ID NO: 2643586 - RNA, 18 nt, Escherichia coli CFT073
augcccucagccuucugu

SEQ ID NO: 2643587 - RNA, 21 nt, Escherichia coli CFT073
augcccugaugcgugcgccag

SEQ ID NO: 2643588 - RNA, 19 nt, Escherichia coli CFT073
augccgaaaucaaggcgga

SEQ ID NO: 2643589 - RNA, 17 nt, Escherichia coli CFT073
augccgaagugguucca

SEQ ID NO: 2643590 - RNA, 16 nt, Escherichia coli CFT073
augccgaaugccgggu

SEQ ID NO: 2643591 - RNA, 15 nt, Escherichia coli CFT073
augccgaugccgacg

SEQ ID NO: 2643592 - RNA, 14 nt, Escherichia coli CFT073
augccgcacaucac

SEQ ID NO: 2643593 - RNA, 16 nt, Escherichia coli CFT073
augccgcacaucaccg

SEQ ID NO: 2643594 - RNA, 14 nt, Escherichia coli CFT073
augccgcagcaccc

SEQ ID NO: 2643595 - RNA, 13 nt, Escherichia coli CFT073
augccgcccagca

SEQ ID NO: 2643596 - RNA, 14 nt, Escherichia coli CFT073
augccgcccagcag

SEQ ID NO: 2643597 - RNA, 17 nt, Escherichia coli CFT073
augccgcuacaaaaugc

SEQ ID NO: 2643598 - RNA, 13 nt, Escherichia coli CFT073
augccgcuauccg

SEQ ID NO: 2643599 - RNA, 14 nt, Escherichia coli CFT073
augccggaaucaga

SEQ ID NO: 2643600 - RNA, 18 nt, Escherichia coli CFT073
augccggaauuaauaauc

SEQ ID NO: 2643601 - RNA, 15 nt, Escherichia coli CFT073
augccggacuccagc

SEQ ID NO: 2643602 - RNA, 20 nt, Escherichia coli CFT073
augccggaggagugcgccag

SEQ ID NO: 2643603 - RNA, 22 nt, Escherichia coli CFT073
augccggaggagugcgccaguu

SEQ ID NO: 2643604 - RNA, 16 nt, Escherichia coli CFT073
augccggguaaagauu

SEQ ID NO: 2643605 - RNA, 21 nt, Escherichia coli CFT073
augccggguaauuucauuaaa

SEQ ID NO: 2643606 - RNA, 16 nt, Escherichia coli CFT073
augccggguuugccau

SEQ ID NO: 2643607 - RNA, 22 nt, Escherichia coli CFT073
augccggguuugccaugugccg

SEQ ID NO: 2643608 - RNA, 21 nt, Escherichia coli CFT073
augccggucuuguuaccggca

SEQ ID NO: 2643609 - RNA, 16 nt, Escherichia coli CFT073
augccgguuaauacgc

SEQ ID NO: 2643610 - RNA, 15 nt, Escherichia coli CFT073
augccguaaccagcg

SEQ ID NO: 2643611 - RNA, 17 nt, Escherichia coli CFT073
augccguaaccagcgca

SEQ ID NO: 2643612 - RNA, 14 nt, Escherichia coli CFT073
augccguacagcag

SEQ ID NO: 2643613 - RNA, 17 nt, Escherichia coli CFT073
augccguagaacagcau

SEQ ID NO: 2643614 - RNA, 21 nt, Escherichia coli CFT073
augccgucaccagcaucaaca

SEQ ID NO: 2643615 - RNA, 17 nt, Escherichia coli CFT073
augccuaaagugcuggg

SEQ ID NO: 2643616 - RNA, 20 nt, Escherichia coli CFT073
augccucgcuaaucucuuca

SEQ ID NO: 2643617 - RNA, 13 nt, Escherichia coli CFT073
augccucgcugau

SEQ ID NO: 2643618 - RNA, 17 nt, Escherichia coli CFT073
augccucguuggucagc

SEQ ID NO: 2643619 - RNA, 13 nt, Escherichia coli CFT073
augccucuccugu

SEQ ID NO: 2643620 - RNA, 20 nt, Escherichia coli CFT073
augccucuugucucguuuca

SEQ ID NO: 2643621 - RNA, 18 nt, Escherichia coli CFT073
augccucuuucauccgau

SEQ ID NO: 2643622 - RNA, 12 nt, Escherichia coli CFT073
augccuggauga

SEQ ID NO: 2643623 - RNA, 22 nt, Escherichia coli CFT073
augccuguauugguuucgagga

SEQ ID NO: 2643624 - RNA, 22 nt, Escherichia coli CFT073
augccugugcgauuuccuucag

SEQ ID NO: 2643625 - RNA, 18 nt, Escherichia coli CFT073
augccuugauauguauua

SEQ ID NO: 2643626 - RNA, 21 nt, Escherichia coli CFT073
augccuugugggccugaaagc

SEQ ID NO: 2643627 - RNA, 18 nt, Escherichia coli CFT073
augccuuucuuuguucuu

SEQ ID NO: 2643628 - RNA, 13 nt, Escherichia coli CFT073
augcgaagaccgc

SEQ ID NO: 2643629 - RNA, 14 nt, Escherichia coli CFT073
augcgaaugccaau

SEQ ID NO: 2643630 - RNA, 22 nt, Escherichia coli CFT073
augcgacauagaucuaaaugcc

SEQ ID NO: 2643631 - RNA, 12 nt, Escherichia coli CFT073
auggagaaaaca

SEQ ID NO: 2643632 - RNA, 18 nt, Escherichia coli CFT073
auggagagaaccagcgca

SEQ ID NO: 2643633 - RNA, 15 nt, Escherichia coli CFT073
auggagcuaaacaga

SEQ ID NO: 2643634 - RNA, 17 nt, Escherichia coli CFT073
auggaguaguugaucgc

SEQ ID NO: 2643635 - RNA, 17 nt, Escherichia coli CFT073
auggauauaauucauca

SEQ ID NO: 2643636 - RNA, 19 nt, Escherichia coli CFT073
auggaucagcguuucuucc

SEQ ID NO: 2643637 - RNA, 15 nt, Escherichia coli CFT073
auggauggugcuaau

SEQ ID NO: 2643638 - RNA, 14 nt, Escherichia coli CFT073
auggauucaagcau

SEQ ID NO: 2643639 - RNA, 15 nt, Escherichia coli CFT073
auggcaaacaaacug

SEQ ID NO: 2643640 - RNA, 15 nt, Escherichia coli CFT073
auggcaaaugcaaca

SEQ ID NO: 2643641 - RNA, 18 nt, Escherichia coli CFT073
auggcaacagcagccaac

SEQ ID NO: 2643642 - RNA, 22 nt, Escherichia coli CFT073
auggcaaucuuccucgccagcg

SEQ ID NO: 2643643 - RNA, 20 nt, Escherichia coli CFT073
auggcagaccaaacggugag

SEQ ID NO: 2643644 - RNA, 16 nt, Escherichia coli CFT073
auggcauacaacgcca

SEQ ID NO: 2643645 - RNA, 13 nt, Escherichia coli CFT073
auggcaucaccau

SEQ ID NO: 2643646 - RNA, 15 nt, Escherichia coli CFT073
auggcaucaccaucg

SEQ ID NO: 2643647 - RNA, 13 nt, Escherichia coli CFT073
auggcauccaagc

SEQ ID NO: 2643648 - RNA, 13 nt, Escherichia coli CFT073
auggcauccccug

SEQ ID NO: 2643649 - RNA, 21 nt, Escherichia coli CFT073
auggcauccgccacuuuaugc

SEQ ID NO: 2643650 - RNA, 20 nt, Escherichia coli CFT073
auggcauccuguuuucugga

SEQ ID NO: 2643651 - RNA, 23 nt, Escherichia coli CFT073
auggcauccuguuuucuggaugc

SEQ ID NO: 2643652 - RNA, 15 nt, Escherichia coli CFT073
auggcauuaauaugc

SEQ ID NO: 2643653 - RNA, 18 nt, Escherichia coli CFT073
auggccagacauuacaaa

SEQ ID NO: 2643654 - RNA, 21 nt, Escherichia coli CFT073
auggccagacauuacaaaaua

SEQ ID NO: 2643655 - RNA, 23 nt, Escherichia coli CFT073
auggcccaguguuuuaccggcaa

SEQ ID NO: 2643656 - RNA, 11 nt, Escherichia coli CFT073
auggcccauga

SEQ ID NO: 2643657 - RNA, 14 nt, Escherichia coli CFT073
auggcccauucagc

SEQ ID NO: 2643658 - RNA, 17 nt, Escherichia coli CFT073
auggcccauucagcaug

SEQ ID NO: 2643659 - RNA, 19 nt, Escherichia coli CFT073
auggcccgccgcauuggua

SEQ ID NO: 2643660 - RNA, 17 nt, Escherichia coli CFT073
auggccgcuccaagguc

SEQ ID NO: 2643661 - RNA, 21 nt, Escherichia coli CFT073
auggccgggcgaugcagcgca

SEQ ID NO: 2643662 - RNA, 15 nt, Escherichia coli CFT073
auggccucugccagc

SEQ ID NO: 2643663 - RNA, 13 nt, Escherichia coli CFT073
auggccuggugag

SEQ ID NO: 2643664 - RNA, 20 nt, Escherichia coli CFT073
auggcgaacauaaggaugcg

SEQ ID NO: 2643665 - RNA, 19 nt, Escherichia coli CFT073
auggcgaacgggauaaacg

SEQ ID NO: 2643666 - RNA, 13 nt, Escherichia coli CFT073
auggcgauaaucg

SEQ ID NO: 2643667 - RNA, 18 nt, Escherichia coli CFT073
auggcgauacugccgccc

SEQ ID NO: 2643668 - RNA, 15 nt, Escherichia coli CFT073
auggcgauucagcaa

SEQ ID NO: 2643669 - RNA, 20 nt, Escherichia coli CFT073
auggcgauuucacaagacug

SEQ ID NO: 2643670 - RNA, 15 nt, Escherichia coli CFT073
auggcgauuuugugc

SEQ ID NO: 2643671 - RNA, 23 nt, Escherichia coli CFT073
auggcgcaguugccggaugcggc

SEQ ID NO: 2643672 - RNA, 16 nt, Escherichia coli CFT073
auggcgcgaaaacaac

SEQ ID NO: 2643673 - RNA, 14 nt, Escherichia coli CFT073
auggcgcgccaccu

SEQ ID NO: 2643674 - RNA, 15 nt, Escherichia coli CFT073
auggcgcugcugcac

SEQ ID NO: 2643675 - RNA, 16 nt, Escherichia coli CFT073
auggcgguauucccga

SEQ ID NO: 2643676 - RNA, 13 nt, Escherichia coli CFT073
auggcguacucaa

SEQ ID NO: 2643677 - RNA, 16 nt, Escherichia coli CFT073
auggcguauaccugau

SEQ ID NO: 2643678 - RNA, 16 nt, Escherichia coli CFT073
auggcguaugccggau

SEQ ID NO: 2643679 - RNA, 22 nt, Escherichia coli CFT073
auggcgucaucaccuugcucga

SEQ ID NO: 2643680 - RNA, 21 nt, Escherichia coli CFT073
auggcgucuucuucaaaacca

SEQ ID NO: 2643681 - RNA, 15 nt, Escherichia coli CFT073
auggcgugcacggca

SEQ ID NO: 2643682 - RNA, 19 nt, Escherichia coli CFT073
auggcguuuccuuccagaa

SEQ ID NO: 2643683 - RNA, 22 nt, Escherichia coli CFT073
auggcguuuccuuccagaaaca

SEQ ID NO: 2643684 - RNA, 16 nt, Escherichia coli CFT073
auggcuacguagcuca

SEQ ID NO: 2643685 - RNA, 14 nt, Escherichia coli CFT073
auggcuaucaagau

SEQ ID NO: 2643686 - RNA, 16 nt, Escherichia coli CFT073
auggcucagauugaac

SEQ ID NO: 2643687 - RNA, 20 nt, Escherichia coli CFT073
auggcuccggaagcuuauuu

SEQ ID NO: 2643688 - RNA, 17 nt, Escherichia coli CFT073
auggcucuucccuuuca

SEQ ID NO: 2643689 - RNA, 23 nt, Escherichia coli CFT073
auggcugacacuauucgccagca

SEQ ID NO: 2643690 - RNA, 18 nt, Escherichia coli CFT073
auggcuggaaucaucaag

SEQ ID NO: 2643691 - RNA, 20 nt, Escherichia coli CFT073
auggcuguuaaacgccgguu

SEQ ID NO: 2643692 - RNA, 21 nt, Escherichia coli CFT073
auggcuguuuucagcaccaga

SEQ ID NO: 2643693 - RNA, 22 nt, Escherichia coli CFT073
auggcuugaagcaauagcauua

SEQ ID NO: 2643694 - RNA, 16 nt, Escherichia coli CFT073
auggcuuuccaccugc

SEQ ID NO: 2643695 - RNA, 20 nt, Escherichia coli CFT073
augggaacugcugaccagcg

SEQ ID NO: 2643696 - RNA, 19 nt, Escherichia coli CFT073
augggcaauuguauccaug

SEQ ID NO: 2643697 - RNA, 15 nt, Escherichia coli CFT073
augggcauccacagu

SEQ ID NO: 2643698 - RNA, 19 nt, Escherichia coli CFT073
augggcauuucuuuuaugg

SEQ ID NO: 2643699 - RNA, 17 nt, Escherichia coli CFT073
augggcgccauuuuuca

SEQ ID NO: 2643700 - RNA, 14 nt, Escherichia coli CFT073
augggcgugauaau

SEQ ID NO: 2643701 - RNA, 15 nt, Escherichia coli CFT073
augggcuuaaugaga

SEQ ID NO: 2643702 - RNA, 19 nt, Escherichia coli CFT073
augggcuucgauacugccu

SEQ ID NO: 2643703 - RNA, 21 nt, Escherichia coli CFT073
auggggcgucaacgcugccau

SEQ ID NO: 2643704 - RNA, 14 nt, Escherichia coli CFT073
augggggaguaugu

SEQ ID NO: 2643705 - RNA, 14 nt, Escherichia coli CFT073
auggguuacgcgaa

SEQ ID NO: 2643706 - RNA, 19 nt, Escherichia coli CFT073
augguacuggcgacugcca

SEQ ID NO: 2643707 - RNA, 20 nt, Escherichia coli CFT073
augguagaaacgcugaaugc

SEQ ID NO: 2643708 - RNA, 21 nt, Escherichia coli CFT073
augguauaucguuuuucauua

SEQ ID NO: 2643709 - RNA, 17 nt, Escherichia coli CFT073
augguauccacacuggu

SEQ ID NO: 2643710 - RNA, 18 nt, Escherichia coli CFT073
augguaucgacacaggua

SEQ ID NO: 2643711 - RNA, 16 nt, Escherichia coli CFT073
augguauuguccugca

SEQ ID NO: 2643712 - RNA, 15 nt, Escherichia coli CFT073
auggucaccacaaau

SEQ ID NO: 2643713 - RNA, 16 nt, Escherichia coli CFT073
auggucaccacaaaug

SEQ ID NO: 2643714 - RNA, 15 nt, Escherichia coli CFT073
auggucaccacaccg

SEQ ID NO: 2643715 - RNA, 14 nt, Escherichia coli CFT073
auggucagccagcg

SEQ ID NO: 2643716 - RNA, 13 nt, Escherichia coli CFT073
auggucgcuugcg

SEQ ID NO: 2643717 - RNA, 23 nt, Escherichia coli CFT073
auggucugcgccgcauucagggc

SEQ ID NO: 2643718 - RNA, 20 nt, Escherichia coli CFT073
auggugaaaaauaaugccac

SEQ ID NO: 2643719 - RNA, 15 nt, Escherichia coli CFT073
auggugaaagcaaaa

SEQ ID NO: 2643720 - RNA, 23 nt, Escherichia coli CFT073
auggugaaguuauuaaugacaau

SEQ ID NO: 2643721 - RNA, 18 nt, Escherichia coli CFT073
auggugacaaacacagca

SEQ ID NO: 2643722 - RNA, 20 nt, Escherichia coli CFT073
auggugccguguaaaaucac

SEQ ID NO: 2643723 - RNA, 16 nt, Escherichia coli CFT073
augguggucgcaucau

SEQ ID NO: 2643724 - RNA, 18 nt, Escherichia coli CFT073
augguguuggcaaucagc

SEQ ID NO: 2643725 - RNA, 23 nt, Escherichia coli CFT073
augguuaaauugaaauuugcaua

SEQ ID NO: 2643726 - RNA, 20 nt, Escherichia coli CFT073
augguuagccuguaauguca

SEQ ID NO: 2643727 - RNA, 17 nt, Escherichia coli CFT073
augguuauuaccaaaaa

SEQ ID NO: 2643728 - RNA, 16 nt, Escherichia coli CFT073
augguucccuuuuuca

SEQ ID NO: 2643729 - RNA, 15 nt, Escherichia coli CFT073
augguucugcacagc

SEQ ID NO: 2643730 - RNA, 18 nt, Escherichia coli CFT073
augguuggaauugaagcu

SEQ ID NO: 2643731 - RNA, 14 nt, Escherichia coli CFT073
augguuggcgaguu

SEQ ID NO: 2643732 - RNA, 17 nt, Escherichia coli CFT073
augguuguaauccaccu

SEQ ID NO: 2643733 - RNA, 17 nt, Escherichia coli CFT073
augguuugccagcagag

SEQ ID NO: 2643734 - RNA, 18 nt, Escherichia coli CFT073
augguuuggucuccugca

SEQ ID NO: 2643735 - RNA, 16 nt, Escherichia coli CFT073
augguuuucaauuauc

SEQ ID NO: 2643736 - RNA, 20 nt, Escherichia coli CFT073
augguuuuguaggccggaua

SEQ ID NO: 2643737 - RNA, 11 nt, Escherichia coli CFT073
auguaaauauu

SEQ ID NO: 2643738 - RNA, 15 nt, Escherichia coli CFT073
auguaaauauuggug

SEQ ID NO: 2643739 - RNA, 18 nt, Escherichia coli CFT073
auguuguacaugcugcuu

SEQ ID NO: 2643740 - RNA, 16 nt, Escherichia coli CFT073
auguugucccagucga

SEQ ID NO: 2643741 - RNA, 22 nt, Escherichia coli CFT073
auguuguuuuccguugugcgau

SEQ ID NO: 2643742 - RNA, 19 nt, Escherichia coli CFT073
auguuucaacggaccaaua

SEQ ID NO: 2643743 - RNA, 14 nt, Escherichia coli CFT073
auguuuccagcauc

SEQ ID NO: 2643744 - RNA, 13 nt, Escherichia coli CFT073
auguuuccauccg

SEQ ID NO: 2643745 - RNA, 21 nt, Escherichia coli CFT073
auguuugucaucagucuuaag

SEQ ID NO: 2643746 - RNA, 21 nt, Escherichia coli CFT073
auguuuuaacacacaauuacc

SEQ ID NO: 2643747 - RNA, 14 nt, Escherichia coli CFT073
auguuuuccagcac

SEQ ID NO: 2643748 - RNA, 22 nt, Escherichia coli CFT073
auguuuugcacgcggugaguuu

SEQ ID NO: 2643749 - RNA, 20 nt, Escherichia coli CFT073
auguuuuuauuaaaguagua

SEQ ID NO: 2643750 - RNA, 23 nt, Escherichia coli CFT073
auguuuuucaccuugagggauuc

SEQ ID NO: 2643751 - RNA, 22 nt, Escherichia coli CFT073
auuaaaauguguacuucucugu

SEQ ID NO: 2643752 - RNA, 20 nt, Escherichia coli CFT073
auuaaacaacgccaguccag

SEQ ID NO: 2643753 - RNA, 13 nt, Escherichia coli CFT073
auuaaacagcccu

SEQ ID NO: 2643754 - RNA, 15 nt, Escherichia coli CFT073
auuaaaccaggaaca

SEQ ID NO: 2643755 - RNA, 16 nt, Escherichia coli CFT073
auuaaaccaggaacag

SEQ ID NO: 2643756 - RNA, 21 nt, Escherichia coli CFT073
auuaaagaguuguaauuuaaa

SEQ ID NO: 2643757 - RNA, 11 nt, Escherichia coli CFT073
auuaaagaugu

SEQ ID NO: 2643758 - RNA, 11 nt, Escherichia coli CFT073
auuaaagcagc

SEQ ID NO: 2643759 - RNA, 15 nt, Escherichia coli CFT073
auuaaaggcaccaau

SEQ ID NO: 2643760 - RNA, 17 nt, Escherichia coli CFT073
auuaaaggcaccaauau

SEQ ID NO: 2643761 - RNA, 15 nt, Escherichia coli CFT073
auuaaauaguuuuuu

SEQ ID NO: 2643762 - RNA, 12 nt, Escherichia coli CFT073
auuaaauauuau

SEQ ID NO: 2643763 - RNA, 18 nt, Escherichia coli CFT073
auuaaauauuauaugugu

SEQ ID NO: 2643764 - RNA, 21 nt, Escherichia coli CFT073
auuaaaucugcuuuucauaca

SEQ ID NO: 2643765 - RNA, 22 nt, Escherichia coli CFT073
auuaaauucaaugaauuaaaaa

SEQ ID NO: 2643766 - RNA, 22 nt, Escherichia coli CFT073
auuaaauucgaacggugaauuc

SEQ ID NO: 2643767 - RNA, 22 nt, Escherichia coli CFT073
auuaacaccacgccagccgcca

SEQ ID NO: 2643768 - RNA, 21 nt, Escherichia coli CFT073
auuaacaccuuaaccucagga

SEQ ID NO: 2643769 - RNA, 16 nt, Escherichia coli CFT073
auuaacagguauagaa

SEQ ID NO: 2643770 - RNA, 12 nt, Escherichia coli CFT073
auuaacagucag

SEQ ID NO: 2643771 - RNA, 16 nt, Escherichia coli CFT073
auuaacagucagucac

SEQ ID NO: 2643772 - RNA, 15 nt, Escherichia coli CFT073
auuaacaucccuuca

SEQ ID NO: 2643773 - RNA, 12 nt, Escherichia coli CFT073
auuaacccauuu

SEQ ID NO: 2643774 - RNA, 16 nt, Escherichia coli CFT073
auuaacccguuuacau

SEQ ID NO: 2643775 - RNA, 18 nt, Escherichia coli CFT073
auuaaccgcccaccgcca

SEQ ID NO: 2643776 - RNA, 14 nt, Escherichia coli CFT073
auuaaccguugguu

SEQ ID NO: 2643777 - RNA, 20 nt, Escherichia coli CFT073
auuaacgacacucucuucaa

SEQ ID NO: 2643778 - RNA, 18 nt, Escherichia coli CFT073
auuaacgcagcaaaagca

SEQ ID NO: 2643779 - RNA, 23 nt, Escherichia coli CFT073
auuaacgcagcaaaagcaggcac

SEQ ID NO: 2643780 - RNA, 11 nt, Escherichia coli CFT073
auuaacgccag

SEQ ID NO: 2643781 - RNA, 14 nt, Escherichia coli CFT073
auuaacgccccaau

SEQ ID NO: 2643782 - RNA, 22 nt, Escherichia coli CFT073
auuaacgcgaaauaaucaaaug

SEQ ID NO: 2643783 - RNA, 22 nt, Escherichia coli CFT073
auuaacgcugaagccaugaccu

SEQ ID NO: 2643784 - RNA, 21 nt, Escherichia coli CFT073
auuaacggccacgaugcacag

SEQ ID NO: 2643785 - RNA, 22 nt, Escherichia coli CFT073
auuaacggccuuuugccagaua

SEQ ID NO: 2643786 - RNA, 23 nt, Escherichia coli CFT073
auuaacggcguuuccuucguuau

SEQ ID NO: 2643787 - RNA, 18 nt, Escherichia coli CFT073
auuaacgucaaccacuca

SEQ ID NO: 2643788 - RNA, 18 nt, Escherichia coli CFT073
auuaacgugaccgcuuuu

SEQ ID NO: 2643789 - RNA, 13 nt, Escherichia coli CFT073
auuaacucacugg

SEQ ID NO: 2643790 - RNA, 15 nt, Escherichia coli CFT073
auuaacucacuggcg

SEQ ID NO: 2643791 - RNA, 20 nt, Escherichia coli CFT073
auuaacugcuggaauacugg

SEQ ID NO: 2643792 - RNA, 19 nt, Escherichia coli CFT073
auuaacuugcgacagccau

SEQ ID NO: 2643793 - RNA, 13 nt, Escherichia coli CFT073
auuaagaagcggc

SEQ ID NO: 2643794 - RNA, 15 nt, Escherichia coli CFT073
auuaagaagcggcua

SEQ ID NO: 2643795 - RNA, 12 nt, Escherichia coli CFT073
auuaagaaucac

SEQ ID NO: 2643796 - RNA, 14 nt, Escherichia coli CFT073
auuaagaaucacug

SEQ ID NO: 2643797 - RNA, 17 nt, Escherichia coli CFT073
auuaagaaucacuguuu

SEQ ID NO: 2643798 - RNA, 19 nt, Escherichia coli CFT073
auuaagacgcagauuuuua

SEQ ID NO: 2643799 - RNA, 16 nt, Escherichia coli CFT073
auuaagaucagaagca

SEQ ID NO: 2643800 - RNA, 20 nt, Escherichia coli CFT073
auuaagcgcaaaggccagca

SEQ ID NO: 2643801 - RNA, 21 nt, Escherichia coli CFT073
auuaagcgccggaauauauuc

SEQ ID NO: 2643802 - RNA, 14 nt, Escherichia coli CFT073
auuaagcggcacca

SEQ ID NO: 2643803 - RNA, 18 nt, Escherichia coli CFT073
auuaaguaacaauaucua

SEQ ID NO: 2643804 - RNA, 16 nt, Escherichia coli CFT073
auuaaguguccgccaa

SEQ ID NO: 2643805 - RNA, 19 nt, Escherichia coli CFT073
auuaaguuaccgguagugc

SEQ ID NO: 2643806 - RNA, 15 nt, Escherichia coli CFT073
auuaaguugauuuug

SEQ ID NO: 2643807 - RNA, 13 nt, Escherichia coli CFT073
auuaauaaccauu

SEQ ID NO: 2643808 - RNA, 14 nt, Escherichia coli CFT073
auuaauacaucaac

SEQ ID NO: 2643809 - RNA, 22 nt, Escherichia coli CFT073
auuaauaccgccaacaugcgca

SEQ ID NO: 2643810 - RNA, 13 nt, Escherichia coli CFT073
auuaauauauauu

SEQ ID NO: 2643811 - RNA, 16 nt, Escherichia coli CFT073
auuaauauuaaaccac

SEQ ID NO: 2643812 - RNA, 19 nt, Escherichia coli CFT073
auuaauccagggaucaaca

SEQ ID NO: 2643813 - RNA, 23 nt, Escherichia coli CFT073
auuaauccagggaucaacauuca

SEQ ID NO: 2643814 - RNA, 23 nt, Escherichia coli CFT073
auuaaucgccaguuucugcccaa

SEQ ID NO: 2643815 - RNA, 20 nt, Escherichia coli CFT073
auuaaucugcucggcgagca

SEQ ID NO: 2643816 - RNA, 21 nt, Escherichia coli CFT073
auuaaugacauucaggccgcc

SEQ ID NO: 2643817 - RNA, 17 nt, Escherichia coli CFT073
auuaaugccuucaaauc

SEQ ID NO: 2643818 - RNA, 14 nt, Escherichia coli CFT073
auuaaugcuuucag

SEQ ID NO: 2643819 - RNA, 18 nt, Escherichia coli CFT073
auuaaugggaagcaaguu

SEQ ID NO: 2643820 - RNA, 20 nt, Escherichia coli CFT073
auuaauguaugugcgaaaau

SEQ ID NO: 2643821 - RNA, 23 nt, Escherichia coli CFT073
auuaauuaccagcgguaaucaug

SEQ ID NO: 2643822 - RNA, 20 nt, Escherichia coli CFT073
auuaauuauugauuccagca

SEQ ID NO: 2643823 - RNA, 18 nt, Escherichia coli CFT073
auuaauuccccugccaga

SEQ ID NO: 2643824 - RNA, 14 nt, Escherichia coli CFT073
auuaauugccgcca

SEQ ID NO: 2643825 - RNA, 13 nt, Escherichia coli CFT073
auuaauuugccag

SEQ ID NO: 2643826 - RNA, 15 nt, Escherichia coli CFT073
auuaauuuguauggu

SEQ ID NO: 2643827 - RNA, 22 nt, Escherichia coli CFT073
auuaauuuucaauugauaauaa

SEQ ID NO: 2643828 - RNA, 21 nt, Escherichia coli CFT073
auuaauuuuuuaauaaaaagg

SEQ ID NO: 2643829 - RNA, 18 nt, Escherichia coli CFT073
auuacaagaaucaugcca

SEQ ID NO: 2643830 - RNA, 20 nt, Escherichia coli CFT073
auuacaagaaucaugccaaa

SEQ ID NO: 2643831 - RNA, 17 nt, Escherichia coli CFT073
auuacacaaguccagca

SEQ ID NO: 2643832 - RNA, 14 nt, Escherichia coli CFT073
auuacacacaacac

SEQ ID NO: 2643833 - RNA, 17 nt, Escherichia coli CFT073
auuacacacaacacauc

SEQ ID NO: 2643834 - RNA, 18 nt, Escherichia coli CFT073
auuacacacaacacaucg

SEQ ID NO: 2643835 - RNA, 14 nt, Escherichia coli CFT073
auuacaccaucacg

SEQ ID NO: 2643836 - RNA, 15 nt, Escherichia coli CFT073
auuacacugaaaaaa

SEQ ID NO: 2643837 - RNA, 21 nt, Escherichia coli CFT073
auuacagccgggagugaauuc

SEQ ID NO: 2643838 - RNA, 23 nt, Escherichia coli CFT073
auuacagcgcaauacgaaucaca

SEQ ID NO: 2643839 - RNA, 23 nt, Escherichia coli CFT073
auuacagguuguugaagaugcgg

SEQ ID NO: 2643840 - RNA, 14 nt, Escherichia coli CFT073
auuacauaccagca

SEQ ID NO: 2643841 - RNA, 18 nt, Escherichia coli CFT073
auuacauaccagcagcau

SEQ ID NO: 2643842 - RNA, 20 nt, Escherichia coli CFT073
auuacauaccagcagcauca

SEQ ID NO: 2643843 - RNA, 21 nt, Escherichia coli CFT073
auuacauaccagcagcaucac

SEQ ID NO: 2643844 - RNA, 22 nt, Escherichia coli CFT073
auuacauaccagcagcaucacg

SEQ ID NO: 2643845 - RNA, 22 nt, Escherichia coli CFT073
auuacauugggaagauaaaaac

SEQ ID NO: 2643846 - RNA, 16 nt, Escherichia coli CFT073
auuaccaaaaacgguc

SEQ ID NO: 2643847 - RNA, 17 nt, Escherichia coli CFT073
auucaacguccuggcgc

SEQ ID NO: 2643848 - RNA, 19 nt, Escherichia coli CFT073
auucaagauaacgccuggc

SEQ ID NO: 2643849 - RNA, 19 nt, Escherichia coli CFT073
auucaagauuggccugaau

SEQ ID NO: 2643850 - RNA, 13 nt, Escherichia coli CFT073
auucaagcauuau

SEQ ID NO: 2643851 - RNA, 22 nt, Escherichia coli CFT073
auucaagcauuauuuuugcuau

SEQ ID NO: 2643852 - RNA, 14 nt, Escherichia coli CFT073
auucaagcauugau

SEQ ID NO: 2643853 - RNA, 15 nt, Escherichia coli CFT073
auucaauguguugau

SEQ ID NO: 2643854 - RNA, 13 nt, Escherichia coli CFT073
auucacaaaaaca

SEQ ID NO: 2643855 - RNA, 15 nt, Escherichia coli CFT073
auucacaaaaacagu

SEQ ID NO: 2643856 - RNA, 24 nt, Escherichia coli CFT073
auucacacagugaaucucuuauca

SEQ ID NO: 2643857 - RNA, 21 nt, Escherichia coli CFT073
auucacacucugccagcgaca

SEQ ID NO: 2643858 - RNA, 17 nt, Escherichia coli CFT073
auucacauuuuuaagcc

SEQ ID NO: 2643859 - RNA, 17 nt, Escherichia coli CFT073
auucaccaccaucaaau

SEQ ID NO: 2643860 - RNA, 17 nt, Escherichia coli CFT073
auucaccagcaaaucca

SEQ ID NO: 2643861 - RNA, 19 nt, Escherichia coli CFT073
auucaccagcaaauccagc

SEQ ID NO: 2643862 - RNA, 18 nt, Escherichia coli CFT073
auucacccgcgccuaaau

SEQ ID NO: 2643863 - RNA, 17 nt, Escherichia coli CFT073
auucaccgccugcugau

SEQ ID NO: 2643864 - RNA, 16 nt, Escherichia coli CFT073
auucaccguucaauuc

SEQ ID NO: 2643865 - RNA, 22 nt, Escherichia coli CFT073
auucaccguucaauuccgcaac

SEQ ID NO: 2643866 - RNA, 11 nt, Escherichia coli CFT073
auucaccucug

SEQ ID NO: 2643867 - RNA, 16 nt, Escherichia coli CFT073
auucaccucugcggca

SEQ ID NO: 2643868 - RNA, 17 nt, Escherichia coli CFT073
auucaccuguaauugcu

SEQ ID NO: 2643869 - RNA, 13 nt, Escherichia coli CFT073
auucacgccccag

SEQ ID NO: 2643870 - RNA, 16 nt, Escherichia coli CFT073
auucacguugauggua

SEQ ID NO: 2643871 - RNA, 16 nt, Escherichia coli CFT073
auucacuucaucccug

SEQ ID NO: 2643872 - RNA, 19 nt, Escherichia coli CFT073
auucacuucgcucuuauca

SEQ ID NO: 2643873 - RNA, 19 nt, Escherichia coli CFT073
auucacuucuguuuuauca

SEQ ID NO: 2643874 - RNA, 15 nt, Escherichia coli CFT073
auucagaaaaacuac

SEQ ID NO: 2643875 - RNA, 18 nt, Escherichia coli CFT073
auucagaaauaaucaccu

SEQ ID NO: 2643876 - RNA, 23 nt, Escherichia coli CFT073
auucagaacacaaaaccgauuaa

SEQ ID NO: 2643877 - RNA, 14 nt, Escherichia coli CFT073
auucagacaggcga

SEQ ID NO: 2643878 - RNA, 17 nt, Escherichia coli CFT073
auucagaguauauauuc

SEQ ID NO: 2643879 - RNA, 19 nt, Escherichia coli CFT073
auucagaugccauuuugca

SEQ ID NO: 2643880 - RNA, 13 nt, Escherichia coli CFT073
auucagauucaaa

SEQ ID NO: 2643881 - RNA, 14 nt, Escherichia coli CFT073
auucagauucaaau

SEQ ID NO: 2643882 - RNA, 16 nt, Escherichia coli CFT073
auucagcaacaucacc

SEQ ID NO: 2643883 - RNA, 17 nt, Escherichia coli CFT073
auucagcagagcaauau

SEQ ID NO: 2643884 - RNA, 11 nt, Escherichia coli CFT073
auucagcagca

SEQ ID NO: 2643885 - RNA, 14 nt, Escherichia coli CFT073
auucagcagcagac

SEQ ID NO: 2643886 - RNA, 18 nt, Escherichia coli CFT073
auucagcagcagacagcc

SEQ ID NO: 2643887 - RNA, 17 nt, Escherichia coli CFT073
auucagccacuguuuca

SEQ ID NO: 2643888 - RNA, 22 nt, Escherichia coli CFT073
auucagccacuguuucaauccg

SEQ ID NO: 2643889 - RNA, 20 nt, Escherichia coli CFT073
auucagcccgagguuauuuu

SEQ ID NO: 2643890 - RNA, 14 nt, Escherichia coli CFT073
auucagcccggcaa

SEQ ID NO: 2643891 - RNA, 17 nt, Escherichia coli CFT073
auucagcccggcaacgu

SEQ ID NO: 2643892 - RNA, 22 nt, Escherichia coli CFT073
auucagcccggcaacguugcca

SEQ ID NO: 2643893 - RNA, 19 nt, Escherichia coli CFT073
auucagcccggguuugccg

SEQ ID NO: 2643894 - RNA, 20 nt, Escherichia coli CFT073
auucagccuucuugcugucc

SEQ ID NO: 2643895 - RNA, 22 nt, Escherichia coli CFT073
auucagcgucgccagcagcuca

SEQ ID NO: 2643896 - RNA, 12 nt, Escherichia coli CFT073
auucagcguuug

SEQ ID NO: 2643897 - RNA, 20 nt, Escherichia coli CFT073
auucaggccaaagccgccga

SEQ ID NO: 2643898 - RNA, 17 nt, Escherichia coli CFT073
auucaggggaagccaga

SEQ ID NO: 2643899 - RNA, 14 nt, Escherichia coli CFT073
auucaguaccagca

SEQ ID NO: 2643900 - RNA, 15 nt, Escherichia coli CFT073
auucaguaccagcac

SEQ ID NO: 2643901 - RNA, 16 nt, Escherichia coli CFT073
auucaguccacaucuc

SEQ ID NO: 2643902 - RNA, 20 nt, Escherichia coli CFT073
auucaguccacaucucaauc

SEQ ID NO: 2643903 - RNA, 13 nt, Escherichia coli CFT073
auucagucccugu

SEQ ID NO: 2643904 - RNA, 14 nt, Escherichia coli CFT073
auucagucuuaaaa

SEQ ID NO: 2643905 - RNA, 19 nt, Escherichia coli CFT073
auucagucuuaaaaagcag

SEQ ID NO: 2643906 - RNA, 19 nt, Escherichia coli CFT073
auucaguucaucuacuacu

SEQ ID NO: 2643907 - RNA, 20 nt, Escherichia coli CFT073
auucaguucgucacaguuaa

SEQ ID NO: 2643908 - RNA, 13 nt, Escherichia coli CFT073
auucauaaagaua

SEQ ID NO: 2643909 - RNA, 21 nt, Escherichia coli CFT073
auucauaaagcuauuaaucca

SEQ ID NO: 2643910 - RNA, 16 nt, Escherichia coli CFT073
auucauaaugcccagc

SEQ ID NO: 2643911 - RNA, 20 nt, Escherichia coli CFT073
auucauaguaagcagauucu

SEQ ID NO: 2643912 - RNA, 16 nt, Escherichia coli CFT073
auucauaucuucaggc

SEQ ID NO: 2643913 - RNA, 15 nt, Escherichia coli CFT073
auucaucaaaaugaa

SEQ ID NO: 2643914 - RNA, 12 nt, Escherichia coli CFT073
auucaucaauuc

SEQ ID NO: 2643915 - RNA, 12 nt, Escherichia coli CFT073
auucaucacaaa

SEQ ID NO: 2643916 - RNA, 15 nt, Escherichia coli CFT073
auucaucacaaaaua

SEQ ID NO: 2643917 - RNA, 17 nt, Escherichia coli CFT073
auucaucacaaaauaga

SEQ ID NO: 2643918 - RNA, 12 nt, Escherichia coli CFT073
auucaucaccac

SEQ ID NO: 2643919 - RNA, 20 nt, Escherichia coli CFT073
auucaucacgcacugcaaua

SEQ ID NO: 2643920 - RNA, 12 nt, Escherichia coli CFT073
auucaucagcgu

SEQ ID NO: 2643921 - RNA, 17 nt, Escherichia coli CFT073
auucauccaguagaaua

SEQ ID NO: 2643922 - RNA, 13 nt, Escherichia coli CFT073
auucauccggcaa

SEQ ID NO: 2643923 - RNA, 13 nt, Escherichia coli CFT073
auucaucgcaugu

SEQ ID NO: 2643924 - RNA, 14 nt, Escherichia coli CFT073
auucaucgccaccg

SEQ ID NO: 2643925 - RNA, 16 nt, Escherichia coli CFT073
auucaucgccuucuug

SEQ ID NO: 2643926 - RNA, 23 nt, Escherichia coli CFT073
auucaucgcucucaugcugcugg

SEQ ID NO: 2643927 - RNA, 20 nt, Escherichia coli CFT073
auucaucguaaucucuuucc

SEQ ID NO: 2643928 - RNA, 21 nt, Escherichia coli CFT073
auucaucguaaucucuuucca

SEQ ID NO: 2643929 - RNA, 12 nt, Escherichia coli CFT073
auucauguucgg

SEQ ID NO: 2643930 - RNA, 16 nt, Escherichia coli CFT073
auucauucaaauuaaa

SEQ ID NO: 2643931 - RNA, 18 nt, Escherichia coli CFT073
auucauugcuauuucccc

SEQ ID NO: 2643932 - RNA, 20 nt, Escherichia coli CFT073
auucauugcuauuucccccu

SEQ ID NO: 2643933 - RNA, 21 nt, Escherichia coli CFT073
auucauuuggcguaguugcug

SEQ ID NO: 2643934 - RNA, 18 nt, Escherichia coli CFT073
auucauuuugcuggaaaa

SEQ ID NO: 2643935 - RNA, 21 nt, Escherichia coli CFT073
auucauuuugcuggaaaagua

SEQ ID NO: 2643936 - RNA, 22 nt, Escherichia coli CFT073
auucauuuuucgcuaccagcaa

SEQ ID NO: 2643937 - RNA, 15 nt, Escherichia coli CFT073
auuccaacgaaaaug

SEQ ID NO: 2643938 - RNA, 14 nt, Escherichia coli CFT073
auuccaauauuaaa

SEQ ID NO: 2643939 - RNA, 20 nt, Escherichia coli CFT073
auuccaccguacgccagcgu

SEQ ID NO: 2643940 - RNA, 14 nt, Escherichia coli CFT073
auuccacucaucgc

SEQ ID NO: 2643941 - RNA, 12 nt, Escherichia coli CFT073
auuccagaugaa

SEQ ID NO: 2643942 - RNA, 22 nt, Escherichia coli CFT073
auuccagaugaacggcuuuuuc

SEQ ID NO: 2643943 - RNA, 15 nt, Escherichia coli CFT073
auuccagaugcgcca

SEQ ID NO: 2643944 - RNA, 17 nt, Escherichia coli CFT073
auuccaguaaguuaugu

SEQ ID NO: 2643945 - RNA, 16 nt, Escherichia coli CFT073
auuccagucagcacca

SEQ ID NO: 2643946 - RNA, 23 nt, Escherichia coli CFT073
auuccagucggucgauugucgcg

SEQ ID NO: 2643947 - RNA, 22 nt, Escherichia coli CFT073
auuccaucaauagcccggcaau

SEQ ID NO: 2643948 - RNA, 13 nt, Escherichia coli CFT073
auuccauccugcu

SEQ ID NO: 2643949 - RNA, 16 nt, Escherichia coli CFT073
auucccacuuuucagu

SEQ ID NO: 2643950 - RNA, 16 nt, Escherichia coli CFT073
auucccagcaccgcag

SEQ ID NO: 2643951 - RNA, 12 nt, Escherichia coli CFT073
auucccaguacc

SEQ ID NO: 2643952 - RNA, 22 nt, Escherichia coli CFT073
auucccaucaguagcauccccg

SEQ ID NO: 2643953 - RNA, 13 nt, Escherichia coli CFT073
auuccccacccca

SEQ ID NO: 2643954 - RNA, 13 nt, Escherichia coli CFT073
auuccccaccuga

SEQ ID NO: 2643955 - RNA, 16 nt, Escherichia coli CFT073
auucccccaccgccgc

SEQ ID NO: 2643956 - RNA, 16 nt, Escherichia coli CFT073
auugagguuagugaca

SEQ ID NO: 2643957 - RNA, 19 nt, Escherichia coli CFT073
auugaguagccucugcguu

SEQ ID NO: 2643958 - RNA, 21 nt, Escherichia coli CFT073
auugauacaggaaaccggcga

SEQ ID NO: 2643959 - RNA, 20 nt, Escherichia coli CFT073
auugauagauuucucuaaaa

SEQ ID NO: 2643960 - RNA, 13 nt, Escherichia coli CFT073
auugaucaucccg

SEQ ID NO: 2643961 - RNA, 20 nt, Escherichia coli CFT073
auugaucccggcuuccugca

SEQ ID NO: 2643962 - RNA, 22 nt, Escherichia coli CFT073
auugaucccggcuuccugcagc

SEQ ID NO: 2643963 - RNA, 18 nt, Escherichia coli CFT073
auugaucucguugaucac

SEQ ID NO: 2643964 - RNA, 16 nt, Escherichia coli CFT073
auugaugagaacauca

SEQ ID NO: 2643965 - RNA, 18 nt, Escherichia coli CFT073
auugaugagaacaucauc

SEQ ID NO: 2643966 - RNA, 21 nt, Escherichia coli CFT073
auugaugcugccaucaucuuc

SEQ ID NO: 2643967 - RNA, 14 nt, Escherichia coli CFT073
auugauggcaaaau

SEQ ID NO: 2643968 - RNA, 17 nt, Escherichia coli CFT073
auugaugugcuucagcu

SEQ ID NO: 2643969 - RNA, 21 nt, Escherichia coli CFT073
auugauucaucucuucuuccg

SEQ ID NO: 2643970 - RNA, 13 nt, Escherichia coli CFT073
auugauucgcuca

SEQ ID NO: 2643971 - RNA, 16 nt, Escherichia coli CFT073
auugauuguuuuaaau

SEQ ID NO: 2643972 - RNA, 19 nt, Escherichia coli CFT073
auugauuguuuuaaauauu

SEQ ID NO: 2643973 - RNA, 22 nt, Escherichia coli CFT073
auugauuuuaauaaaucacgcu

SEQ ID NO: 2643974 - RNA, 13 nt, Escherichia coli CFT073
auugcaauuuuua

SEQ ID NO: 2643975 - RNA, 19 nt, Escherichia coli CFT073
auugcacauucccugcagu

SEQ ID NO: 2643976 - RNA, 16 nt, Escherichia coli CFT073
auugcaccacaucggu

SEQ ID NO: 2643977 - RNA, 21 nt, Escherichia coli CFT073
auugcaccacaucgguuugcg

SEQ ID NO: 2643978 - RNA, 19 nt, Escherichia coli CFT073
auugcaccagaucuuccag

SEQ ID NO: 2643979 - RNA, 22 nt, Escherichia coli CFT073
auugcaccagaucuuccagcgg

SEQ ID NO: 2643980 - RNA, 14 nt, Escherichia coli CFT073
auugcaccaucccc

SEQ ID NO: 2643981 - RNA, 18 nt, Escherichia coli CFT073
auugcacgcgaccgucuu

SEQ ID NO: 2643982 - RNA, 19 nt, Escherichia coli CFT073
auugcacguccaguggcau

SEQ ID NO: 2643983 - RNA, 20 nt, Escherichia coli CFT073
auugcacgucuuugccgcgc

SEQ ID NO: 2643984 - RNA, 14 nt, Escherichia coli CFT073
auugcacuggcacc

SEQ ID NO: 2643985 - RNA, 22 nt, Escherichia coli CFT073
auugcagaggcucaaccgccgu

SEQ ID NO: 2643986 - RNA, 16 nt, Escherichia coli CFT073
auugcagauaccacau

SEQ ID NO: 2643987 - RNA, 17 nt, Escherichia coli CFT073
auugcagauaccacauc

SEQ ID NO: 2643988 - RNA, 14 nt, Escherichia coli CFT073
auugcagcaacgaa

SEQ ID NO: 2643989 - RNA, 12 nt, Escherichia coli CFT073
auugcagcucug

SEQ ID NO: 2643990 - RNA, 13 nt, Escherichia coli CFT073
auugcagcucugu

SEQ ID NO: 2643991 - RNA, 21 nt, Escherichia coli CFT073
auugcaggggcuuauauaggu

SEQ ID NO: 2643992 - RNA, 18 nt, Escherichia coli CFT073
auugcagggugcaagagu

SEQ ID NO: 2643993 - RNA, 17 nt, Escherichia coli CFT073
auugcauaggugcccgc

SEQ ID NO: 2643994 - RNA, 16 nt, Escherichia coli CFT073
auugcauaucaauuag

SEQ ID NO: 2643995 - RNA, 18 nt, Escherichia coli CFT073
auugcauccgauuguucc

SEQ ID NO: 2643996 - RNA, 19 nt, Escherichia coli CFT073
auugcauccgauuguuccu

SEQ ID NO: 2643997 - RNA, 20 nt, Escherichia coli CFT073
auugcaucuacgcucucuuc

SEQ ID NO: 2643998 - RNA, 18 nt, Escherichia coli CFT073
auugccaaguccugccag

SEQ ID NO: 2643999 - RNA, 17 nt, Escherichia coli CFT073
auugccaaucgggaaga

SEQ ID NO: 2644000 - RNA, 23 nt, Escherichia coli CFT073
auugccagcauaaucaccaucag

SEQ ID NO: 2644001 - RNA, 15 nt, Escherichia coli CFT073
auugccauaaaaacg

SEQ ID NO: 2644002 - RNA, 14 nt, Escherichia coli CFT073
auugccauacgccg

SEQ ID NO: 2644003 - RNA, 22 nt, Escherichia coli CFT073
auugccauacgccggaugggua

SEQ ID NO: 2644004 - RNA, 14 nt, Escherichia coli CFT073
auugccaucacggc

SEQ ID NO: 2644005 - RNA, 16 nt, Escherichia coli CFT073
auugcccaaagccaau

SEQ ID NO: 2644006 - RNA, 16 nt, Escherichia coli CFT073
auugcccgcagaugua

SEQ ID NO: 2644007 - RNA, 22 nt, Escherichia coli CFT073
auugcccuguuugucgaucauc

SEQ ID NO: 2644008 - RNA, 18 nt, Escherichia coli CFT073
auugccgaagaccagauu

SEQ ID NO: 2644009 - RNA, 20 nt, Escherichia coli CFT073
auugccgcaccaaccaucag

SEQ ID NO: 2644010 - RNA, 18 nt, Escherichia coli CFT073
auugccgcacuuaaaaug

SEQ ID NO: 2644011 - RNA, 16 nt, Escherichia coli CFT073
auugccgcgauagcaa

SEQ ID NO: 2644012 - RNA, 22 nt, Escherichia coli CFT073
auugccgcgccggaaaccagcg

SEQ ID NO: 2644013 - RNA, 14 nt, Escherichia coli CFT073
auugccgcguucgc

SEQ ID NO: 2644014 - RNA, 16 nt, Escherichia coli CFT073
auugccgcuaguucuc

SEQ ID NO: 2644015 - RNA, 18 nt, Escherichia coli CFT073
auugccgcuaucaggcca

SEQ ID NO: 2644016 - RNA, 15 nt, Escherichia coli CFT073
auugccggaugcggc

SEQ ID NO: 2644017 - RNA, 19 nt, Escherichia coli CFT073
auugccggaugugaugcau

SEQ ID NO: 2644018 - RNA, 18 nt, Escherichia coli CFT073
auugccgggcgcaucaga

SEQ ID NO: 2644019 - RNA, 21 nt, Escherichia coli CFT073
auugccguaauaagguucauu

SEQ ID NO: 2644020 - RNA, 12 nt, Escherichia coli CFT073
auugccucaugc

SEQ ID NO: 2644021 - RNA, 15 nt, Escherichia coli CFT073
auugccugaaccggu

SEQ ID NO: 2644022 - RNA, 12 nt, Escherichia coli CFT073
auugccugaugc

SEQ ID NO: 2644023 - RNA, 21 nt, Escherichia coli CFT073
auugccugaugcgacgcugcg

SEQ ID NO: 2644024 - RNA, 17 nt, Escherichia coli CFT073
auugccuggcugcccau

SEQ ID NO: 2644025 - RNA, 21 nt, Escherichia coli CFT073
auugccuggugcccaucacua

SEQ ID NO: 2644026 - RNA, 13 nt, Escherichia coli CFT073
auugccugugaag

SEQ ID NO: 2644027 - RNA, 15 nt, Escherichia coli CFT073
auugccugugaaggu

SEQ ID NO: 2644028 - RNA, 21 nt, Escherichia coli CFT073
auugcgacaagcucauuuccc

SEQ ID NO: 2644029 - RNA, 22 nt, Escherichia coli CFT073
auugcgcaacagagccaaagaa

SEQ ID NO: 2644030 - RNA, 16 nt, Escherichia coli CFT073
auugcgcaccagcuug

SEQ ID NO: 2644031 - RNA, 16 nt, Escherichia coli CFT073
auugcgccagcgagaa

SEQ ID NO: 2644032 - RNA, 14 nt, Escherichia coli CFT073
auugcgccgccgcc

SEQ ID NO: 2644033 - RNA, 15 nt, Escherichia coli CFT073
auugcgggccaggaa

SEQ ID NO: 2644034 - RNA, 22 nt, Escherichia coli CFT073
auugcgggcgagauuuuacuuu

SEQ ID NO: 2644035 - RNA, 18 nt, Escherichia coli CFT073
auugcguaaagccugcug

SEQ ID NO: 2644036 - RNA, 15 nt, Escherichia coli CFT073
auugcguaacgugac

SEQ ID NO: 2644037 - RNA, 14 nt, Escherichia coli CFT073
auugcguaucccac

SEQ ID NO: 2644038 - RNA, 22 nt, Escherichia coli CFT073
auugcguuauagcgauuuuuca

SEQ ID NO: 2644039 - RNA, 20 nt, Escherichia coli CFT073
auugcguucaaucuguccuu

SEQ ID NO: 2644040 - RNA, 14 nt, Escherichia coli CFT073
auugcguucugucg

SEQ ID NO: 2644041 - RNA, 14 nt, Escherichia coli CFT073
auugcuaucaacaa

SEQ ID NO: 2644042 - RNA, 21 nt, Escherichia coli CFT073
auugcuccauaauugccagcu

SEQ ID NO: 2644043 - RNA, 22 nt, Escherichia coli CFT073
auugcucccugcggcgaugacc

SEQ ID NO: 2644044 - RNA, 15 nt, Escherichia coli CFT073
auugcucuuucacuu

SEQ ID NO: 2644045 - RNA, 14 nt, Escherichia coli CFT073
auugcugcacaucc

SEQ ID NO: 2644046 - RNA, 18 nt, Escherichia coli CFT073
auugcugcacauccggua

SEQ ID NO: 2644047 - RNA, 16 nt, Escherichia coli CFT073
auugcugcaccagcag

SEQ ID NO: 2644048 - RNA, 11 nt, Escherichia coli CFT073
auugcugccag

SEQ ID NO: 2644049 - RNA, 18 nt, Escherichia coli CFT073
auugcugccgcuccagau

SEQ ID NO: 2644050 - RNA, 16 nt, Escherichia coli CFT073
auugcugcugccgcgc

SEQ ID NO: 2644051 - RNA, 14 nt, Escherichia coli CFT073
auugcuguuuuaca

SEQ ID NO: 2644052 - RNA, 17 nt, Escherichia coli CFT073
auugcuuugcugugaag

SEQ ID NO: 2644053 - RNA, 21 nt, Escherichia coli CFT073
auugcuuugcugugaagcacc

SEQ ID NO: 2644054 - RNA, 22 nt, Escherichia coli CFT073
auugcuuugcugugaagcaccu

SEQ ID NO: 2644055 - RNA, 17 nt, Escherichia coli CFT073
auugcuuuuguuaucaa

SEQ ID NO: 2644056 - RNA, 15 nt, Escherichia coli CFT073
auugcuuuuuugauu

SEQ ID NO: 2644057 - RNA, 12 nt, Escherichia coli CFT073
auuggaauacga

SEQ ID NO: 2644058 - RNA, 21 nt, Escherichia coli CFT073
auuggagaguugcaccagcaa

SEQ ID NO: 2644059 - RNA, 14 nt, Escherichia coli CFT073
auuggagccugccc

SEQ ID NO: 2644060 - RNA, 12 nt, Escherichia coli CFT073
auuggcaaaacc

SEQ ID NO: 2644061 - RNA, 15 nt, Escherichia coli CFT073
auuggcaaaaccaaa

SEQ ID NO: 2644062 - RNA, 18 nt, Escherichia coli CFT073
auuggcaaaaccaaacca

SEQ ID NO: 2644063 - RNA, 21 nt, Escherichia coli CFT073
auuggcaaaaccaaaccagcc

SEQ ID NO: 2644064 - RNA, 20 nt, Escherichia coli CFT073
auuuaucuucccagcccagc

SEQ ID NO: 2644065 - RNA, 21 nt, Escherichia coli CFT073
auuuaucuuugauugaagaaa

SEQ ID NO: 2644066 - RNA, 23 nt, Escherichia coli CFT073
auuuaugcagcagguccaucacu

SEQ ID NO: 2644067 - RNA, 14 nt, Escherichia coli CFT073
auuuauucagaauu

SEQ ID NO: 2644068 - RNA, 16 nt, Escherichia coli CFT073
auuuauucagaauuuu

SEQ ID NO: 2644069 - RNA, 18 nt, Escherichia coli CFT073
auuuauugaauuuucaau

SEQ ID NO: 2644070 - RNA, 21 nt, Escherichia coli CFT073
auuuauuuccuucgcuuuaau

SEQ ID NO: 2644071 - RNA, 11 nt, Escherichia coli CFT073
auuuauuucuc

SEQ ID NO: 2644072 - RNA, 17 nt, Escherichia coli CFT073
auuuauuugacauuuuu

SEQ ID NO: 2644073 - RNA, 20 nt, Escherichia coli CFT073
auuuauuugacauuuuuuca

SEQ ID NO: 2644074 - RNA, 22 nt, Escherichia coli CFT073
auuuauuuuuacucuucuuuaa

SEQ ID NO: 2644075 - RNA, 23 nt, Escherichia coli CFT073
auuuauuuuuacucuucuuuaau

SEQ ID NO: 2644076 - RNA, 19 nt, Escherichia coli CFT073
auuucaaaacggucacggc

SEQ ID NO: 2644077 - RNA, 15 nt, Escherichia coli CFT073
auuucaaaucaccaa

SEQ ID NO: 2644078 - RNA, 13 nt, Escherichia coli CFT073
auuucaacagauu

SEQ ID NO: 2644079 - RNA, 20 nt, Escherichia coli CFT073
auuucaauaucgccuuuugc

SEQ ID NO: 2644080 - RNA, 22 nt, Escherichia coli CFT073
auuucaauaucgccuuuugccc

SEQ ID NO: 2644081 - RNA, 16 nt, Escherichia coli CFT073
auuucacaccaucaac

SEQ ID NO: 2644082 - RNA, 18 nt, Escherichia coli CFT073
auuucacaccaucaacaa

SEQ ID NO: 2644083 - RNA, 15 nt, Escherichia coli CFT073
auuucaccagcgcac

SEQ ID NO: 2644084 - RNA, 13 nt, Escherichia coli CFT073
auuucaccaucuu

SEQ ID NO: 2644085 - RNA, 11 nt, Escherichia coli CFT073
auuucagaaaa

SEQ ID NO: 2644086 - RNA, 19 nt, Escherichia coli CFT073
auuucagcaucgccaucaa

SEQ ID NO: 2644087 - RNA, 15 nt, Escherichia coli CFT073
auuucagcgccgcgc

SEQ ID NO: 2644088 - RNA, 18 nt, Escherichia coli CFT073
auuucaggcaacaaaaaa

SEQ ID NO: 2644089 - RNA, 16 nt, Escherichia coli CFT073
auuucaggccccaucg

SEQ ID NO: 2644090 - RNA, 20 nt, Escherichia coli CFT073
auuucaggccccaucgaauc

SEQ ID NO: 2644091 - RNA, 24 nt, Escherichia coli CFT073
auuucagguucugaccagccagca

SEQ ID NO: 2644092 - RNA, 14 nt, Escherichia coli CFT073
auuucagugcugac

SEQ ID NO: 2644093 - RNA, 15 nt, Escherichia coli CFT073
auuucagugcugacu

SEQ ID NO: 2644094 - RNA, 15 nt, Escherichia coli CFT073
auuucauaugcgcca

SEQ ID NO: 2644095 - RNA, 16 nt, Escherichia coli CFT073
auuucaucaucacgaa

SEQ ID NO: 2644096 - RNA, 21 nt, Escherichia coli CFT073
auuucaucgccagcgaauucc

SEQ ID NO: 2644097 - RNA, 20 nt, Escherichia coli CFT073
auuucaucgcuacaccaauc

SEQ ID NO: 2644098 - RNA, 16 nt, Escherichia coli CFT073
auuucaugccgaacag

SEQ ID NO: 2644099 - RNA, 18 nt, Escherichia coli CFT073
auuucaugcucaccaauc

SEQ ID NO: 2644100 - RNA, 22 nt, Escherichia coli CFT073
auuucauuaagaacuccugaaa

SEQ ID NO: 2644101 - RNA, 13 nt, Escherichia coli CFT073
auuucauuauuca

SEQ ID NO: 2644102 - RNA, 15 nt, Escherichia coli CFT073
auuucauucagcgua

SEQ ID NO: 2644103 - RNA, 13 nt, Escherichia coli CFT073
auuuccaccgcua

SEQ ID NO: 2644104 - RNA, 18 nt, Escherichia coli CFT073
auuuccagaugcguauug

SEQ ID NO: 2644105 - RNA, 14 nt, Escherichia coli CFT073
auuuccagcucaaa

SEQ ID NO: 2644106 - RNA, 18 nt, Escherichia coli CFT073
auuuccagcucaaagaua

SEQ ID NO: 2644107 - RNA, 22 nt, Escherichia coli CFT073
auuuccagggccucuccuuuac

SEQ ID NO: 2644108 - RNA, 13 nt, Escherichia coli CFT073
auuuccaucucca

SEQ ID NO: 2644109 - RNA, 16 nt, Escherichia coli CFT073
auuuccaucuccagcu

SEQ ID NO: 2644110 - RNA, 17 nt, Escherichia coli CFT073
auuucccaacaguuugu

SEQ ID NO: 2644111 - RNA, 22 nt, Escherichia coli CFT073
auuucccaccacuauuguugaa

SEQ ID NO: 2644112 - RNA, 19 nt, Escherichia coli CFT073
auuucccagcaagaaccau

SEQ ID NO: 2644113 - RNA, 22 nt, Escherichia coli CFT073
auuucccagcaagaaccaugca

SEQ ID NO: 2644114 - RNA, 14 nt, Escherichia coli CFT073
auuuccccauuccg

SEQ ID NO: 2644115 - RNA, 15 nt, Escherichia coli CFT073
auuuccccauuccga

SEQ ID NO: 2644116 - RNA, 20 nt, Escherichia coli CFT073
auuuccccccggcagcugcc

SEQ ID NO: 2644117 - RNA, 22 nt, Escherichia coli CFT073
auuucccgauaaccuucuucau

SEQ ID NO: 2644118 - RNA, 15 nt, Escherichia coli CFT073
auuucccggauggca

SEQ ID NO: 2644119 - RNA, 15 nt, Escherichia coli CFT073
auuucccggccacgc

SEQ ID NO: 2644120 - RNA, 17 nt, Escherichia coli CFT073
auuucccgugaagacuu

SEQ ID NO: 2644121 - RNA, 19 nt, Escherichia coli CFT073
auuucccuguugccugcac

SEQ ID NO: 2644122 - RNA, 15 nt, Escherichia coli CFT073
auuuccgcagcucca

SEQ ID NO: 2644123 - RNA, 15 nt, Escherichia coli CFT073
auuuccgccaaucaa

SEQ ID NO: 2644124 - RNA, 12 nt, Escherichia coli CFT073
auuuccgccgcc

SEQ ID NO: 2644125 - RNA, 15 nt, Escherichia coli CFT073
auuuccgcugauuca

SEQ ID NO: 2644126 - RNA, 22 nt, Escherichia coli CFT073
auuuccgcugauucaagauugg

SEQ ID NO: 2644127 - RNA, 23 nt, Escherichia coli CFT073
auuuccggauacgguuuuuugaa

SEQ ID NO: 2644128 - RNA, 14 nt, Escherichia coli CFT073
auuuccggcaccgu

SEQ ID NO: 2644129 - RNA, 14 nt, Escherichia coli CFT073
auuuccucaacauc

SEQ ID NO: 2644130 - RNA, 22 nt, Escherichia coli CFT073
auuuccucaacaucuucaccaa

SEQ ID NO: 2644131 - RNA, 23 nt, Escherichia coli CFT073
auuuccucgagccuuauccgacu

SEQ ID NO: 2644132 - RNA, 13 nt, Escherichia coli CFT073
auuuccucuuccc

SEQ ID NO: 2644133 - RNA, 18 nt, Escherichia coli CFT073
auuuccucuucccgcuca

SEQ ID NO: 2644134 - RNA, 20 nt, Escherichia coli CFT073
auuuccugcgcuuucugcuu

SEQ ID NO: 2644135 - RNA, 15 nt, Escherichia coli CFT073
auuuccuucagcagc

SEQ ID NO: 2644136 - RNA, 12 nt, Escherichia coli CFT073
auuucgauauag

SEQ ID NO: 2644137 - RNA, 15 nt, Escherichia coli CFT073
auuucgccaucaaga

SEQ ID NO: 2644138 - RNA, 19 nt, Escherichia coli CFT073
auuucgccaucaagaacac

SEQ ID NO: 2644139 - RNA, 14 nt, Escherichia coli CFT073
auuucgcugcggau

SEQ ID NO: 2644140 - RNA, 21 nt, Escherichia coli CFT073
auuucgucaaacguuuaccuu

SEQ ID NO: 2644141 - RNA, 20 nt, Escherichia coli CFT073
auuucguccagcgaaccuuc

SEQ ID NO: 2644142 - RNA, 23 nt, Escherichia coli CFT073
auuucgucgcaucacagaccaaa

SEQ ID NO: 2644143 - RNA, 18 nt, Escherichia coli CFT073
auuucgucuugcaggaag

SEQ ID NO: 2644144 - RNA, 17 nt, Escherichia coli CFT073
auuucuacacccagccc

SEQ ID NO: 2644145 - RNA, 18 nt, Escherichia coli CFT073
auuucuacuuauucacca

SEQ ID NO: 2644146 - RNA, 12 nt, Escherichia coli CFT073
auuucuaucauc

SEQ ID NO: 2644147 - RNA, 13 nt, Escherichia coli CFT073
auuucuaucauca

SEQ ID NO: 2644148 - RNA, 17 nt, Escherichia coli CFT073
auuucuaucaucauauc

SEQ ID NO: 2644149 - RNA, 15 nt, Escherichia coli CFT073
auuucuccacuggga

SEQ ID NO: 2644150 - RNA, 14 nt, Escherichia coli CFT073
auuucugacuuccc

SEQ ID NO: 2644151 - RNA, 21 nt, Escherichia coli CFT073
auuucugcgcggauagccagc

SEQ ID NO: 2644152 - RNA, 14 nt, Escherichia coli CFT073
auuucugcugccua

SEQ ID NO: 2644153 - RNA, 16 nt, Escherichia coli CFT073
auuucugcuucguuaa

SEQ ID NO: 2644154 - RNA, 13 nt, Escherichia coli CFT073
auuucuguuugcg

SEQ ID NO: 2644155 - RNA, 13 nt, Escherichia coli CFT073
auuucuuauucau

SEQ ID NO: 2644156 - RNA, 21 nt, Escherichia coli CFT073
auuucuuauugaguaaauuca

SEQ ID NO: 2644157 - RNA, 15 nt, Escherichia coli CFT073
auuucuucagccaca

SEQ ID NO: 2644158 - RNA, 22 nt, Escherichia coli CFT073
auuucuucaucgguauaaccaa

SEQ ID NO: 2644159 - RNA, 22 nt, Escherichia coli CFT073
auuucuucauugguuucaccca

SEQ ID NO: 2644160 - RNA, 13 nt, Escherichia coli CFT073
auuucuucggcug

SEQ ID NO: 2644161 - RNA, 16 nt, Escherichia coli CFT073
auuucuuuaucaccaa

SEQ ID NO: 2644162 - RNA, 15 nt, Escherichia coli CFT073
auuucuuugcgcucu

SEQ ID NO: 2644163 - RNA, 15 nt, Escherichia coli CFT073
auuucuuuguuuccc

SEQ ID NO: 2644164 - RNA, 13 nt, Escherichia coli CFT073
auuucuuuuaugg

SEQ ID NO: 2644165 - RNA, 16 nt, Escherichia coli CFT073
auuucuuuucauaauc

SEQ ID NO: 2644166 - RNA, 14 nt, Escherichia coli CFT073
auuucuuuuuuuca

SEQ ID NO: 2644167 - RNA, 12 nt, Escherichia coli CFT073
auuugaaaugac

SEQ ID NO: 2644168 - RNA, 14 nt, Escherichia coli CFT073
auuugaacuggaaa

SEQ ID NO: 2644169 - RNA, 15 nt, Escherichia coli CFT073
auuugagcauagugc

SEQ ID NO: 2644170 - RNA, 15 nt, Escherichia coli CFT073
auuugaguucacugc

SEQ ID NO: 2644171 - RNA, 16 nt, Escherichia coli CFT073
auuugaguucacugcc

SEQ ID NO: 2644172 - RNA, 17 nt, Escherichia coli CFT073
auuugaguucacugccg

SEQ ID NO: 2644173 - RNA, 22 nt, Escherichia coli CFT073
auuuuugcugggaaccuucgga

SEQ ID NO: 2644174 - RNA, 19 nt, Escherichia coli CFT073
auuuuuguuucacacugac

SEQ ID NO: 2644175 - RNA, 13 nt, Escherichia coli CFT073
auuuuuuccccuu

SEQ ID NO: 2644176 - RNA, 20 nt, Escherichia coli CFT073
auuuuuuccgcaaaaacgac

SEQ ID NO: 2644177 - RNA, 20 nt, Escherichia coli CFT073
auuuuuucgauaaucaaaug

SEQ ID NO: 2644178 - RNA, 13 nt, Escherichia coli CFT073
auuuuuugaaaaa

SEQ ID NO: 2644179 - RNA, 12 nt, Escherichia coli CFT073
auuuuuugcaaa

SEQ ID NO: 2644180 - RNA, 15 nt, Escherichia coli CFT073
auuuuuuuacccagc

SEQ ID NO: 2644181 - RNA, 23 nt, Escherichia coli CFT073
auuuuuuugagaacauucaucau

SEQ ID NO: 2644182 - RNA, 22 nt, Escherichia coli CFT073
caaaaaaagccacggaauaaac

SEQ ID NO: 2644183 - RNA, 21 nt, Escherichia coli CFT073
caaaaaacaaaccccguacag

SEQ ID NO: 2644184 - RNA, 16 nt, Escherichia coli CFT073
caaaaaacacgacaug

SEQ ID NO: 2644185 - RNA, 19 nt, Escherichia coli CFT073
caaaaaacacucuucaaca

SEQ ID NO: 2644186 - RNA, 13 nt, Escherichia coli CFT073
caaaaaaccaucc

SEQ ID NO: 2644187 - RNA, 14 nt, Escherichia coli CFT073
caaaaaacggaaag

SEQ ID NO: 2644188 - RNA, 17 nt, Escherichia coli CFT073
caaaaaagaaggaaaau

SEQ ID NO: 2644189 - RNA, 12 nt, Escherichia coli CFT073
caaaaaagaggg

SEQ ID NO: 2644190 - RNA, 23 nt, Escherichia coli CFT073
caaaaaagccaauuacaaaaagu

SEQ ID NO: 2644191 - RNA, 18 nt, Escherichia coli CFT073
caaaaaagccggagcgac

SEQ ID NO: 2644192 - RNA, 13 nt, Escherichia coli CFT073
caaaaaauagcaa

SEQ ID NO: 2644193 - RNA, 19 nt, Escherichia coli CFT073
caaaaaaucaacgacaaaa

SEQ ID NO: 2644194 - RNA, 13 nt, Escherichia coli CFT073
caaaaacaaagaa

SEQ ID NO: 2644195 - RNA, 14 nt, Escherichia coli CFT073
caaaaacaccgcug

SEQ ID NO: 2644196 - RNA, 17 nt, Escherichia coli CFT073
caaaaacaguaagcaau

SEQ ID NO: 2644197 - RNA, 15 nt, Escherichia coli CFT073
caaaaacccugccgu

SEQ ID NO: 2644198 - RNA, 17 nt, Escherichia coli CFT073
caaaaacgcauacccca

SEQ ID NO: 2644199 - RNA, 15 nt, Escherichia coli CFT073
caaaaacuuucgcca

SEQ ID NO: 2644200 - RNA, 16 nt, Escherichia coli CFT073
caaaaagaaacucuau

SEQ ID NO: 2644201 - RNA, 17 nt, Escherichia coli CFT073
caaaaagaauaaauauc

SEQ ID NO: 2644202 - RNA, 22 nt, Escherichia coli CFT073
caaaaagagaguuacuggcgag

SEQ ID NO: 2644203 - RNA, 16 nt, Escherichia coli CFT073
caaaaaggccuaaugu

SEQ ID NO: 2644204 - RNA, 15 nt, Escherichia coli CFT073
caaaaaggggaaaaa

SEQ ID NO: 2644205 - RNA, 19 nt, Escherichia coli CFT073
caaaaaggggaaaaauuca

SEQ ID NO: 2644206 - RNA, 21 nt, Escherichia coli CFT073
caaaaaguaguuccagcauga

SEQ ID NO: 2644207 - RNA, 13 nt, Escherichia coli CFT073
caaaaauaaaugc

SEQ ID NO: 2644208 - RNA, 14 nt, Escherichia coli CFT073
caaaaauaaucauc

SEQ ID NO: 2644209 - RNA, 16 nt, Escherichia coli CFT073
caaaaauaccaccaau

SEQ ID NO: 2644210 - RNA, 14 nt, Escherichia coli CFT073
caaaaauaucgccu

SEQ ID NO: 2644211 - RNA, 14 nt, Escherichia coli CFT073
caaaaaucaauggc

SEQ ID NO: 2644212 - RNA, 12 nt, Escherichia coli CFT073
caaaaaucgaca

SEQ ID NO: 2644213 - RNA, 17 nt, Escherichia coli CFT073
caaaacagaaacccauu

SEQ ID NO: 2644214 - RNA, 19 nt, Escherichia coli CFT073
caaaacagcgacaccagcc

SEQ ID NO: 2644215 - RNA, 17 nt, Escherichia coli CFT073
caaaacaggucgccagu

SEQ ID NO: 2644216 - RNA, 14 nt, Escherichia coli CFT073
caaaacauacccag

SEQ ID NO: 2644217 - RNA, 20 nt, Escherichia coli CFT073
caaaacauacccaguuucau

SEQ ID NO: 2644218 - RNA, 19 nt, Escherichia coli CFT073
caaaacauguggauuaaau

SEQ ID NO: 2644219 - RNA, 14 nt, Escherichia coli CFT073
caaaaccaaaccag

SEQ ID NO: 2644220 - RNA, 20 nt, Escherichia coli CFT073
caaaaccaacgcauagacag

SEQ ID NO: 2644221 - RNA, 15 nt, Escherichia coli CFT073
caaaacccaggcuua

SEQ ID NO: 2644222 - RNA, 14 nt, Escherichia coli CFT073
caaaacccugcgcc

SEQ ID NO: 2644223 - RNA, 17 nt, Escherichia coli CFT073
caaaacccugcgccagc

SEQ ID NO: 2644224 - RNA, 14 nt, Escherichia coli CFT073
caaaaccggcucua

SEQ ID NO: 2644225 - RNA, 13 nt, Escherichia coli CFT073
caaaaccugccgc

SEQ ID NO: 2644226 - RNA, 14 nt, Escherichia coli CFT073
caaaaccuuucacc

SEQ ID NO: 2644227 - RNA, 14 nt, Escherichia coli CFT073
caaaacgaccaccu

SEQ ID NO: 2644228 - RNA, 16 nt, Escherichia coli CFT073
caaaacgcgcucacug

SEQ ID NO: 2644229 - RNA, 18 nt, Escherichia coli CFT073
caaaacgcgugacaccau

SEQ ID NO: 2644230 - RNA, 19 nt, Escherichia coli CFT073
caaaacgcgugacaccauc

SEQ ID NO: 2644231 - RNA, 18 nt, Escherichia coli CFT073
caaaacgugcagcugccu

SEQ ID NO: 2644232 - RNA, 20 nt, Escherichia coli CFT073
caaaacguggccuccaaaaa

SEQ ID NO: 2644233 - RNA, 17 nt, Escherichia coli CFT073
caaaacguuauuuugcu

SEQ ID NO: 2644234 - RNA, 19 nt, Escherichia coli CFT073
caaaacguuauuuugcuaa

SEQ ID NO: 2644235 - RNA, 20 nt, Escherichia coli CFT073
caaaacguugaaguacccgc

SEQ ID NO: 2644236 - RNA, 19 nt, Escherichia coli CFT073
caaaacucaccauccugau

SEQ ID NO: 2644237 - RNA, 16 nt, Escherichia coli CFT073
caaaacuguaucccag

SEQ ID NO: 2644238 - RNA, 17 nt, Escherichia coli CFT073
caaaacuguaucccagc

SEQ ID NO: 2644239 - RNA, 22 nt, Escherichia coli CFT073
caaaacuuuucaccagcgucag

SEQ ID NO: 2644240 - RNA, 18 nt, Escherichia coli CFT073
caaaagauuauugcuuga

SEQ ID NO: 2644241 - RNA, 22 nt, Escherichia coli CFT073
caaaagcaauauuggcacuggg

SEQ ID NO: 2644242 - RNA, 18 nt, Escherichia coli CFT073
caaaagcaggcaccgcgc

SEQ ID NO: 2644243 - RNA, 13 nt, Escherichia coli CFT073
caaaagccccuga

SEQ ID NO: 2644244 - RNA, 22 nt, Escherichia coli CFT073
caaaagccccugaauucucaaa

SEQ ID NO: 2644245 - RNA, 13 nt, Escherichia coli CFT073
caaaagcggcgcg

SEQ ID NO: 2644246 - RNA, 18 nt, Escherichia coli CFT073
caaaaggcaauucaauua

SEQ ID NO: 2644247 - RNA, 13 nt, Escherichia coli CFT073
caaaauaaaaacg

SEQ ID NO: 2644248 - RNA, 14 nt, Escherichia coli CFT073
caaaauacaggaaa

SEQ ID NO: 2644249 - RNA, 15 nt, Escherichia coli CFT073
caaaauacaggaaau

SEQ ID NO: 2644250 - RNA, 14 nt, Escherichia coli CFT073
caaaauaccagcaa

SEQ ID NO: 2644251 - RNA, 17 nt, Escherichia coli CFT073
caaaauagaaauuuagu

SEQ ID NO: 2644252 - RNA, 19 nt, Escherichia coli CFT073
caaaauagaguguuccucu

SEQ ID NO: 2644253 - RNA, 17 nt, Escherichia coli CFT073
caaaauagguaucguaa

SEQ ID NO: 2644254 - RNA, 18 nt, Escherichia coli CFT073
caaaauagguaucguaau

SEQ ID NO: 2644255 - RNA, 17 nt, Escherichia coli CFT073
caaaauaucgacauuca

SEQ ID NO: 2644256 - RNA, 19 nt, Escherichia coli CFT073
caaaauaugcccuuguggc

SEQ ID NO: 2644257 - RNA, 20 nt, Escherichia coli CFT073
caaaaucaaaguuaguaaaa

SEQ ID NO: 2644258 - RNA, 21 nt, Escherichia coli CFT073
caaaaucaauauaaacagccc

SEQ ID NO: 2644259 - RNA, 13 nt, Escherichia coli CFT073
caaaaucaaugcc

SEQ ID NO: 2644260 - RNA, 19 nt, Escherichia coli CFT073
caaaaucaccgaugacaga

SEQ ID NO: 2644261 - RNA, 21 nt, Escherichia coli CFT073
caaaaucaccgaugacagaau

SEQ ID NO: 2644262 - RNA, 11 nt, Escherichia coli CFT073
caaaaucauca

SEQ ID NO: 2644263 - RNA, 13 nt, Escherichia coli CFT073
caaaaucaucaca

SEQ ID NO: 2644264 - RNA, 19 nt, Escherichia coli CFT073
caaaaucaucacaacuucg

SEQ ID NO: 2644265 - RNA, 16 nt, Escherichia coli CFT073
caaaaucauccgucgg

SEQ ID NO: 2644266 - RNA, 12 nt, Escherichia coli CFT073
caaaauccgcca

SEQ ID NO: 2644267 - RNA, 19 nt, Escherichia coli CFT073
caaaauccuuccagcucca

SEQ ID NO: 2644268 - RNA, 19 nt, Escherichia coli CFT073
caaaaucggcguaauguug

SEQ ID NO: 2644269 - RNA, 16 nt, Escherichia coli CFT073
caaaaucguaagcagg

SEQ ID NO: 2644270 - RNA, 16 nt, Escherichia coli CFT073
caaaaucucacacuga

SEQ ID NO: 2644271 - RNA, 20 nt, Escherichia coli CFT073
caaaaucuucguuaucccag

SEQ ID NO: 2644272 - RNA, 18 nt, Escherichia coli CFT073
caaaaugccguacagcag

SEQ ID NO: 2644273 - RNA, 20 nt, Escherichia coli CFT073
caaaaugccguacagcagaa

SEQ ID NO: 2644274 - RNA, 16 nt, Escherichia coli CFT073
caaaaugucggaugcg

SEQ ID NO: 2644275 - RNA, 14 nt, Escherichia coli CFT073
caaaauuaccuuua

SEQ ID NO: 2644276 - RNA, 22 nt, Escherichia coli CFT073
caaaauucuccgcggucagcgc

SEQ ID NO: 2644277 - RNA, 18 nt, Escherichia coli CFT073
caaaauugacuaucugac

SEQ ID NO: 2644278 - RNA, 23 nt, Escherichia coli CFT073
caaaauugccgcuaucaggccac

SEQ ID NO: 2644279 - RNA, 15 nt, Escherichia coli CFT073
caaaauugccggaug

SEQ ID NO: 2644280 - RNA, 15 nt, Escherichia coli CFT073
caaaauuuaacauua

SEQ ID NO: 2644281 - RNA, 19 nt, Escherichia coli CFT073
caaaauuuaacauuacuaa

SEQ ID NO: 2644282 - RNA, 17 nt, Escherichia coli CFT073
caaagccucuauggaag

SEQ ID NO: 2644283 - RNA, 23 nt, Escherichia coli CFT073
caaagccuuuuuaggucgcccug

SEQ ID NO: 2644284 - RNA, 12 nt, Escherichia coli CFT073
caaagcgacaca

SEQ ID NO: 2644285 - RNA, 17 nt, Escherichia coli CFT073
caaagcgacgugcagua

SEQ ID NO: 2644286 - RNA, 19 nt, Escherichia coli CFT073
caaagcgauucgucacuuu

SEQ ID NO: 2644287 - RNA, 15 nt, Escherichia coli CFT073
caaagcgcacuuuau

SEQ ID NO: 2644288 - RNA, 13 nt, Escherichia coli CFT073
caaagcgccagcg

SEQ ID NO: 2644289 - RNA, 14 nt, Escherichia coli CFT073
caaaggcacaacug

SEQ ID NO: 2644290 - RNA, 14 nt, Escherichia coli CFT073
caaaggccagcaau

SEQ ID NO: 2644291 - RNA, 19 nt, Escherichia coli CFT073
caaaggccagcaaucccca

SEQ ID NO: 2644292 - RNA, 17 nt, Escherichia coli CFT073
caaaggcgacaauaaau

SEQ ID NO: 2644293 - RNA, 15 nt, Escherichia coli CFT073
caaaggcggaaacgc

SEQ ID NO: 2644294 - RNA, 19 nt, Escherichia coli CFT073
caaaggcugugaaaguugg

SEQ ID NO: 2644295 - RNA, 10 nt, Escherichia coli CFT073
caaagggagc

SEQ ID NO: 2644296 - RNA, 14 nt, Escherichia coli CFT073
caaagggagcagac

SEQ ID NO: 2644297 - RNA, 17 nt, Escherichia coli CFT073
caaagggcuaacgugca

SEQ ID NO: 2644298 - RNA, 22 nt, Escherichia coli CFT073
caaaggucugauguugaaugug

SEQ ID NO: 2644299 - RNA, 23 nt, Escherichia coli CFT073
caaaggucuuaauuuugguaauu

SEQ ID NO: 2644300 - RNA, 13 nt, Escherichia coli CFT073
caaaggucuuuug

SEQ ID NO: 2644301 - RNA, 15 nt, Escherichia coli CFT073
caaagguugcagcuc

SEQ ID NO: 2644302 - RNA, 19 nt, Escherichia coli CFT073
caaaguaauggaaggcguu

SEQ ID NO: 2644303 - RNA, 21 nt, Escherichia coli CFT073
caaaguaccaucguccagcag

SEQ ID NO: 2644304 - RNA, 14 nt, Escherichia coli CFT073
caaagucaaacugg

SEQ ID NO: 2644305 - RNA, 16 nt, Escherichia coli CFT073
caaaguggcggcuacc

SEQ ID NO: 2644306 - RNA, 23 nt, Escherichia coli CFT073
caaagugggcgacaaaguugaag

SEQ ID NO: 2644307 - RNA, 22 nt, Escherichia coli CFT073
caaaguguaaaaaaucccagcg

SEQ ID NO: 2644308 - RNA, 15 nt, Escherichia coli CFT073
caaaguuaaucagcg

SEQ ID NO: 2644309 - RNA, 16 nt, Escherichia coli CFT073
caaaguuaaucagcgc

SEQ ID NO: 2644310 - RNA, 13 nt, Escherichia coli CFT073
caaaguuuaugua

SEQ ID NO: 2644311 - RNA, 18 nt, Escherichia coli CFT073
caaaguuugugaucuuuu

SEQ ID NO: 2644312 - RNA, 20 nt, Escherichia coli CFT073
caaaguuugugaucuuuuuc

SEQ ID NO: 2644313 - RNA, 23 nt, Escherichia coli CFT073
caaauaaaacaucaccaaugaca

SEQ ID NO: 2644314 - RNA, 13 nt, Escherichia coli CFT073
caaauaaaauccc

SEQ ID NO: 2644315 - RNA, 19 nt, Escherichia coli CFT073
caaauaaagaaguggugau

SEQ ID NO: 2644316 - RNA, 13 nt, Escherichia coli CFT073
caaauaaauaauc

SEQ ID NO: 2644317 - RNA, 12 nt, Escherichia coli CFT073
caaauaaauacc

SEQ ID NO: 2644318 - RNA, 22 nt, Escherichia coli CFT073
caaauaaauaccguucauuaac

SEQ ID NO: 2644319 - RNA, 16 nt, Escherichia coli CFT073
caaauaacccgccaug

SEQ ID NO: 2644320 - RNA, 15 nt, Escherichia coli CFT073
caaauaagaaaaagg

SEQ ID NO: 2644321 - RNA, 21 nt, Escherichia coli CFT073
caaauaaucgacgaggaaaau

SEQ ID NO: 2644322 - RNA, 18 nt, Escherichia coli CFT073
caaauaauuacuucgccg

SEQ ID NO: 2644323 - RNA, 18 nt, Escherichia coli CFT073
caaauacacgcacggcau

SEQ ID NO: 2644324 - RNA, 13 nt, Escherichia coli CFT073
caaauacccaaaa

SEQ ID NO: 2644325 - RNA, 20 nt, Escherichia coli CFT073
caaauacccaaaaaauagca

SEQ ID NO: 2644326 - RNA, 16 nt, Escherichia coli CFT073
caaauaccccugccgc

SEQ ID NO: 2644327 - RNA, 18 nt, Escherichia coli CFT073
caaauaccccugccgccg

SEQ ID NO: 2644328 - RNA, 15 nt, Escherichia coli CFT073
caaauagccagcaga

SEQ ID NO: 2644329 - RNA, 16 nt, Escherichia coli CFT073
caaauagccagcagag

SEQ ID NO: 2644330 - RNA, 19 nt, Escherichia coli CFT073
caaauaguaagaaccacag

SEQ ID NO: 2644331 - RNA, 21 nt, Escherichia coli CFT073
caaauaguaagaaccacagcc

SEQ ID NO: 2644332 - RNA, 12 nt, Escherichia coli CFT073
caaauaucugga

SEQ ID NO: 2644333 - RNA, 14 nt, Escherichia coli CFT073
caaauauucagcca

SEQ ID NO: 2644334 - RNA, 15 nt, Escherichia coli CFT073
caaauauuucuuuau

SEQ ID NO: 2644335 - RNA, 16 nt, Escherichia coli CFT073
caaaucaaaucacgau

SEQ ID NO: 2644336 - RNA, 16 nt, Escherichia coli CFT073
caaaucaaaucauccu

SEQ ID NO: 2644337 - RNA, 17 nt, Escherichia coli CFT073
caaaucaaccaggccuu

SEQ ID NO: 2644338 - RNA, 11 nt, Escherichia coli CFT073
caaaucaccaa

SEQ ID NO: 2644339 - RNA, 22 nt, Escherichia coli CFT073
caaaucaccauauucagcagca

SEQ ID NO: 2644340 - RNA, 12 nt, Escherichia coli CFT073
caaaucacgcag

SEQ ID NO: 2644341 - RNA, 23 nt, Escherichia coli CFT073
caaaucagcggcagauccaccag

SEQ ID NO: 2644342 - RNA, 22 nt, Escherichia coli CFT073
caaauccagccagcgccgcgcg

SEQ ID NO: 2644343 - RNA, 12 nt, Escherichia coli CFT073
caaauccagcgc

SEQ ID NO: 2644344 - RNA, 15 nt, Escherichia coli CFT073
caaauccagucuuuc

SEQ ID NO: 2644345 - RNA, 18 nt, Escherichia coli CFT073
caaauccaucagaccuuc

SEQ ID NO: 2644346 - RNA, 17 nt, Escherichia coli CFT073
caaauccauuuucgaca

SEQ ID NO: 2644347 - RNA, 19 nt, Escherichia coli CFT073
caaauccccaguugugcug

SEQ ID NO: 2644348 - RNA, 18 nt, Escherichia coli CFT073
caaauccggcaaauaacg

SEQ ID NO: 2644349 - RNA, 22 nt, Escherichia coli CFT073
caaauccggcauacauuuauuu

SEQ ID NO: 2644350 - RNA, 16 nt, Escherichia coli CFT073
caaaucgaaaucaaca

SEQ ID NO: 2644351 - RNA, 16 nt, Escherichia coli CFT073
caaaucgccccgcagc

SEQ ID NO: 2644352 - RNA, 22 nt, Escherichia coli CFT073
caaaucgccgagaucaacagca

SEQ ID NO: 2644353 - RNA, 15 nt, Escherichia coli CFT073
caaaucgcucccucu

SEQ ID NO: 2644354 - RNA, 18 nt, Escherichia coli CFT073
caaaucgcucccucucca

SEQ ID NO: 2644355 - RNA, 18 nt, Escherichia coli CFT073
caaaucgucgguguccac

SEQ ID NO: 2644356 - RNA, 12 nt, Escherichia coli CFT073
caaaucguugcu

SEQ ID NO: 2644357 - RNA, 17 nt, Escherichia coli CFT073
caaaucugccguaacug

SEQ ID NO: 2644358 - RNA, 17 nt, Escherichia coli CFT073
caaaucuucucacugcc

SEQ ID NO: 2644359 - RNA, 21 nt, Escherichia coli CFT073
caaaucuuucacuuuugccag

SEQ ID NO: 2644360 - RNA, 16 nt, Escherichia coli CFT073
caaaugaccgacguua

SEQ ID NO: 2644361 - RNA, 14 nt, Escherichia coli CFT073
caaaugcagcaacc

SEQ ID NO: 2644362 - RNA, 16 nt, Escherichia coli CFT073
caaaugcagcaaccag

SEQ ID NO: 2644363 - RNA, 14 nt, Escherichia coli CFT073
caaaugcgccgcca

SEQ ID NO: 2644364 - RNA, 23 nt, Escherichia coli CFT073
caaaugcugacgugugauaaugu

SEQ ID NO: 2644365 - RNA, 15 nt, Escherichia coli CFT073
caaaugcugcggguc

SEQ ID NO: 2644366 - RNA, 14 nt, Escherichia coli CFT073
caaauggaccaucu

SEQ ID NO: 2644367 - RNA, 19 nt, Escherichia coli CFT073
caaauggaccaucuccgaa

SEQ ID NO: 2644368 - RNA, 16 nt, Escherichia coli CFT073
caaauguauccaucac

SEQ ID NO: 2644369 - RNA, 16 nt, Escherichia coli CFT073
caaaugucagaaagaa

SEQ ID NO: 2644370 - RNA, 17 nt, Escherichia coli CFT073
caaauuaaacgggcgau

SEQ ID NO: 2644371 - RNA, 18 nt, Escherichia coli CFT073
caaauuacuggcggcgaa

SEQ ID NO: 2644372 - RNA, 15 nt, Escherichia coli CFT073
caaauucgcuguaau

SEQ ID NO: 2644373 - RNA, 20 nt, Escherichia coli CFT073
caaauucgggcgcugauucu

SEQ ID NO: 2644374 - RNA, 19 nt, Escherichia coli CFT073
caaauucuuuaucgauaaa

SEQ ID NO: 2644375 - RNA, 12 nt, Escherichia coli CFT073
caaauuugccag

SEQ ID NO: 2644376 - RNA, 20 nt, Escherichia coli CFT073
caaauuugugcucuggcaua

SEQ ID NO: 2644377 - RNA, 11 nt, Escherichia coli CFT073
caaauuuuuaa

SEQ ID NO: 2644378 - RNA, 19 nt, Escherichia coli CFT073
caacaaaaaacggaaagca

SEQ ID NO: 2644379 - RNA, 14 nt, Escherichia coli CFT073
caacaaaaaauuga

SEQ ID NO: 2644380 - RNA, 19 nt, Escherichia coli CFT073
caacaaaaaucucgacuuc

SEQ ID NO: 2644381 - RNA, 21 nt, Escherichia coli CFT073
caacaaacgcaaacaccagcu

SEQ ID NO: 2644382 - RNA, 15 nt, Escherichia coli CFT073
caacaaacgccagau

SEQ ID NO: 2644383 - RNA, 18 nt, Escherichia coli CFT073
caacaaacgcugacauau

SEQ ID NO: 2644384 - RNA, 19 nt, Escherichia coli CFT073
caacaaacgcugacauauu

SEQ ID NO: 2644385 - RNA, 15 nt, Escherichia coli CFT073
caacaaacuuaugcu

SEQ ID NO: 2644386 - RNA, 19 nt, Escherichia coli CFT073
caacaaagccgcuuaauaa

SEQ ID NO: 2644387 - RNA, 19 nt, Escherichia coli CFT073
caacaacaauuucacgcgc

SEQ ID NO: 2644388 - RNA, 14 nt, Escherichia coli CFT073
caacaacagcgcga

SEQ ID NO: 2644389 - RNA, 23 nt, Escherichia coli CFT073
caacaacaucacaccugcucagc

SEQ ID NO: 2644390 - RNA, 16 nt, Escherichia coli CFT073
caacaaccuugcguuu

SEQ ID NO: 2644391 - RNA, 15 nt, Escherichia coli CFT073
caacccacaaaaaca

SEQ ID NO: 2644392 - RNA, 14 nt, Escherichia coli CFT073
caacccagacaaau

SEQ ID NO: 2644393 - RNA, 19 nt, Escherichia coli CFT073
caacccauuucgucaaacg

SEQ ID NO: 2644394 - RNA, 16 nt, Escherichia coli CFT073
caaccccaauguaacc

SEQ ID NO: 2644395 - RNA, 15 nt, Escherichia coli CFT073
caacccgagcgccag

SEQ ID NO: 2644396 - RNA, 16 nt, Escherichia coli CFT073
caacccgagcgccagc

SEQ ID NO: 2644397 - RNA, 18 nt, Escherichia coli CFT073
caacccgcacggucacua

SEQ ID NO: 2644398 - RNA, 14 nt, Escherichia coli CFT073
caacccgccaucgc

SEQ ID NO: 2644399 - RNA, 13 nt, Escherichia coli CFT073
caacccgcgcgcu

SEQ ID NO: 2644400 - RNA, 21 nt, Escherichia coli CFT073
caacccgguugcuuucgucga

SEQ ID NO: 2644401 - RNA, 20 nt, Escherichia coli CFT073
caacccgugagucuccuuua

SEQ ID NO: 2644402 - RNA, 22 nt, Escherichia coli CFT073
caaccgccagaugcggcgugaa

SEQ ID NO: 2644403 - RNA, 13 nt, Escherichia coli CFT073
caaccgccaucca

SEQ ID NO: 2644404 - RNA, 16 nt, Escherichia coli CFT073
caaccgccauccaggu

SEQ ID NO: 2644405 - RNA, 15 nt, Escherichia coli CFT073
caaccgccgcugcuu

SEQ ID NO: 2644406 - RNA, 14 nt, Escherichia coli CFT073
caaccgcgccaagc

SEQ ID NO: 2644407 - RNA, 22 nt, Escherichia coli CFT073
caaccgcugauugcuggcgggc

SEQ ID NO: 2644408 - RNA, 23 nt, Escherichia coli CFT073
caaccgggaucaccgaaccaggg

SEQ ID NO: 2644409 - RNA, 19 nt, Escherichia coli CFT073
caaccggggcauucaugaa

SEQ ID NO: 2644410 - RNA, 22 nt, Escherichia coli CFT073
caaccggugcgcgaucuuccuc

SEQ ID NO: 2644411 - RNA, 23 nt, Escherichia coli CFT073
caaccggugcgcgaucuuccucu

SEQ ID NO: 2644412 - RNA, 14 nt, Escherichia coli CFT073
caaccggugcugcg

SEQ ID NO: 2644413 - RNA, 23 nt, Escherichia coli CFT073
caaccgguggcaguagcgccucu

SEQ ID NO: 2644414 - RNA, 22 nt, Escherichia coli CFT073
caaccguaggucggauaagacg

SEQ ID NO: 2644415 - RNA, 15 nt, Escherichia coli CFT073
caaccgucagccacu

SEQ ID NO: 2644416 - RNA, 22 nt, Escherichia coli CFT073
caaccgucgccucgccgagcag

SEQ ID NO: 2644417 - RNA, 16 nt, Escherichia coli CFT073
caaccucaaaaagaaa

SEQ ID NO: 2644418 - RNA, 17 nt, Escherichia coli CFT073
caaccuccgucuggcca

SEQ ID NO: 2644419 - RNA, 19 nt, Escherichia coli CFT073
caaccuccuccggcaucuu

SEQ ID NO: 2644420 - RNA, 20 nt, Escherichia coli CFT073
caaccuccuccggcaucuuu

SEQ ID NO: 2644421 - RNA, 20 nt, Escherichia coli CFT073
caaccucuggugugcguugc

SEQ ID NO: 2644422 - RNA, 14 nt, Escherichia coli CFT073
caaccuucuucgcg

SEQ ID NO: 2644423 - RNA, 21 nt, Escherichia coli CFT073
caaccuuuguauuuuuccgca

SEQ ID NO: 2644424 - RNA, 14 nt, Escherichia coli CFT073
caacgaacguuccc

SEQ ID NO: 2644425 - RNA, 14 nt, Escherichia coli CFT073
caacgaaucacugg

SEQ ID NO: 2644426 - RNA, 13 nt, Escherichia coli CFT073
caacgaaugccgc

SEQ ID NO: 2644427 - RNA, 22 nt, Escherichia coli CFT073
caacgacgguaaaccacgccag

SEQ ID NO: 2644428 - RNA, 18 nt, Escherichia coli CFT073
caacgacguaccaacuga

SEQ ID NO: 2644429 - RNA, 18 nt, Escherichia coli CFT073
caacgacuggggcuggaa

SEQ ID NO: 2644430 - RNA, 21 nt, Escherichia coli CFT073
caacgagacucaauggcaucc

SEQ ID NO: 2644431 - RNA, 19 nt, Escherichia coli CFT073
caacgauaacaaucaccaa

SEQ ID NO: 2644432 - RNA, 16 nt, Escherichia coli CFT073
caacgauaauccagca

SEQ ID NO: 2644433 - RNA, 21 nt, Escherichia coli CFT073
caacgaugaagagauaaacga

SEQ ID NO: 2644434 - RNA, 20 nt, Escherichia coli CFT073
caacgaugcgaccgccgcuc

SEQ ID NO: 2644435 - RNA, 13 nt, Escherichia coli CFT073
caacgcaaagaga

SEQ ID NO: 2644436 - RNA, 18 nt, Escherichia coli CFT073
caacgcaaagagagaagc

SEQ ID NO: 2644437 - RNA, 20 nt, Escherichia coli CFT073
caacgcaaagagagaagcca

SEQ ID NO: 2644438 - RNA, 13 nt, Escherichia coli CFT073
caacgcaacucca

SEQ ID NO: 2644439 - RNA, 20 nt, Escherichia coli CFT073
caacgcaauauccgccacuu

SEQ ID NO: 2644440 - RNA, 19 nt, Escherichia coli CFT073
caacgcaccaaaguuaauc

SEQ ID NO: 2644441 - RNA, 14 nt, Escherichia coli CFT073
caacgcacccgcgc

SEQ ID NO: 2644442 - RNA, 15 nt, Escherichia coli CFT073
caacgcacccgcgcc

SEQ ID NO: 2644443 - RNA, 22 nt, Escherichia coli CFT073
caacgcacuggcgagcgccagc

SEQ ID NO: 2644444 - RNA, 15 nt, Escherichia coli CFT073
caacgcacuggcgcg

SEQ ID NO: 2644445 - RNA, 16 nt, Escherichia coli CFT073
caacgcacuggcgcgc

SEQ ID NO: 2644446 - RNA, 18 nt, Escherichia coli CFT073
caacgcacuggcgcgccu

SEQ ID NO: 2644447 - RNA, 12 nt, Escherichia coli CFT073
caacgcagacgc

SEQ ID NO: 2644448 - RNA, 14 nt, Escherichia coli CFT073
caacgcagccccag

SEQ ID NO: 2644449 - RNA, 14 nt, Escherichia coli CFT073
caacgcagcggcga

SEQ ID NO: 2644450 - RNA, 14 nt, Escherichia coli CFT073
caacgcaucaaacc

SEQ ID NO: 2644451 - RNA, 17 nt, Escherichia coli CFT073
caacgcaucccgguuua

SEQ ID NO: 2644452 - RNA, 19 nt, Escherichia coli CFT073
caacgccaaauuuaaacga

SEQ ID NO: 2644453 - RNA, 23 nt, Escherichia coli CFT073
caacgccaccacucaaaagcgua

SEQ ID NO: 2644454 - RNA, 20 nt, Escherichia coli CFT073
caacgccagcgaagccagcu

SEQ ID NO: 2644455 - RNA, 20 nt, Escherichia coli CFT073
caacgcccauacucaucuuc

SEQ ID NO: 2644456 - RNA, 22 nt, Escherichia coli CFT073
caacgcccauacucaucuucca

SEQ ID NO: 2644457 - RNA, 16 nt, Escherichia coli CFT073
caacgccccuucugcc

SEQ ID NO: 2644458 - RNA, 17 nt, Escherichia coli CFT073
caacgccccuucugccg

SEQ ID NO: 2644459 - RNA, 18 nt, Escherichia coli CFT073
caacgccccuucugccgc

SEQ ID NO: 2644460 - RNA, 15 nt, Escherichia coli CFT073
caacgcccugcaacu

SEQ ID NO: 2644461 - RNA, 23 nt, Escherichia coli CFT073
caacgccgauuaauauuaaacca

SEQ ID NO: 2644462 - RNA, 12 nt, Escherichia coli CFT073
caacgccgcaca

SEQ ID NO: 2644463 - RNA, 13 nt, Escherichia coli CFT073
caacgccgccaac

SEQ ID NO: 2644464 - RNA, 18 nt, Escherichia coli CFT073
caacgccgccaacgugac

SEQ ID NO: 2644465 - RNA, 14 nt, Escherichia coli CFT073
caacgccgccagac

SEQ ID NO: 2644466 - RNA, 15 nt, Escherichia coli CFT073
caacgccuaaacuga

SEQ ID NO: 2644467 - RNA, 15 nt, Escherichia coli CFT073
caacgccugcggcug

SEQ ID NO: 2644468 - RNA, 14 nt, Escherichia coli CFT073
caacgccuucuucg

SEQ ID NO: 2644469 - RNA, 18 nt, Escherichia coli CFT073
caacgccuuguucgcccu

SEQ ID NO: 2644470 - RNA, 18 nt, Escherichia coli CFT073
caacgccuuuaccaccag

SEQ ID NO: 2644471 - RNA, 19 nt, Escherichia coli CFT073
caacgccuuuaccaccagu

SEQ ID NO: 2644472 - RNA, 23 nt, Escherichia coli CFT073
caacgccuuucgcuguaaacggc

SEQ ID NO: 2644473 - RNA, 18 nt, Escherichia coli CFT073
caacgcgaaaaugcccca

SEQ ID NO: 2644474 - RNA, 14 nt, Escherichia coli CFT073
caacgcgccaccga

SEQ ID NO: 2644475 - RNA, 17 nt, Escherichia coli CFT073
caacgcgccgacgaauu

SEQ ID NO: 2644476 - RNA, 22 nt, Escherichia coli CFT073
caacgcgccgcaacaauaaccc

SEQ ID NO: 2644477 - RNA, 15 nt, Escherichia coli CFT073
caacgcggcaaaacc

SEQ ID NO: 2644478 - RNA, 18 nt, Escherichia coli CFT073
caacgcggcccaacauaa

SEQ ID NO: 2644479 - RNA, 20 nt, Escherichia coli CFT073
caacgcgguuucgccgccag

SEQ ID NO: 2644480 - RNA, 16 nt, Escherichia coli CFT073
caacgcuucaaccagu

SEQ ID NO: 2644481 - RNA, 20 nt, Escherichia coli CFT073
caacggaccaauaaacgcca

SEQ ID NO: 2644482 - RNA, 15 nt, Escherichia coli CFT073
caacggauauuguuu

SEQ ID NO: 2644483 - RNA, 13 nt, Escherichia coli CFT073
caacggcaacaau

SEQ ID NO: 2644484 - RNA, 21 nt, Escherichia coli CFT073
caacggcaacaauuuccgcag

SEQ ID NO: 2644485 - RNA, 22 nt, Escherichia coli CFT073
caacggcaggguacgacuuccu

SEQ ID NO: 2644486 - RNA, 21 nt, Escherichia coli CFT073
caacggcgucagccacaacaa

SEQ ID NO: 2644487 - RNA, 16 nt, Escherichia coli CFT073
caacggcuucgccaaa

SEQ ID NO: 2644488 - RNA, 15 nt, Escherichia coli CFT073
caacgggcugaagaa

SEQ ID NO: 2644489 - RNA, 17 nt, Escherichia coli CFT073
caacggucagcgcacca

SEQ ID NO: 2644490 - RNA, 18 nt, Escherichia coli CFT073
caacgguccaauggucau

SEQ ID NO: 2644491 - RNA, 22 nt, Escherichia coli CFT073
caacggugaaaaaccaaucucc

SEQ ID NO: 2644492 - RNA, 15 nt, Escherichia coli CFT073
caacggugcuuuaau

SEQ ID NO: 2644493 - RNA, 21 nt, Escherichia coli CFT073
caacggugcuuuaauuucaug

SEQ ID NO: 2644494 - RNA, 14 nt, Escherichia coli CFT073
caacgguucugcug

SEQ ID NO: 2644495 - RNA, 18 nt, Escherichia coli CFT073
caacgguucugcugccgc

SEQ ID NO: 2644496 - RNA, 19 nt, Escherichia coli CFT073
caacguacggcuucagaca

SEQ ID NO: 2644497 - RNA, 16 nt, Escherichia coli CFT073
caacguacucugccac

SEQ ID NO: 2644498 - RNA, 14 nt, Escherichia coli CFT073
caacguagaauaaa

SEQ ID NO: 2644499 - RNA, 15 nt, Escherichia coli CFT073
caagccaagccagag

SEQ ID NO: 2644500 - RNA, 22 nt, Escherichia coli CFT073
caagccaccaucccgccgacca

SEQ ID NO: 2644501 - RNA, 14 nt, Escherichia coli CFT073
caagccagguaaau

SEQ ID NO: 2644502 - RNA, 20 nt, Escherichia coli CFT073
caagccagguaaaucagacc

SEQ ID NO: 2644503 - RNA, 23 nt, Escherichia coli CFT073
caagcccaggccaucgccaccgg

SEQ ID NO: 2644504 - RNA, 17 nt, Escherichia coli CFT073
caagcccgccagaccag

SEQ ID NO: 2644505 - RNA, 22 nt, Escherichia coli CFT073
caagccgaauaacggcucaaac

SEQ ID NO: 2644506 - RNA, 14 nt, Escherichia coli CFT073
caagccguuaauuc

SEQ ID NO: 2644507 - RNA, 14 nt, Escherichia coli CFT073
caagccguuaccua

SEQ ID NO: 2644508 - RNA, 14 nt, Escherichia coli CFT073
caagccuaccggca

SEQ ID NO: 2644509 - RNA, 17 nt, Escherichia coli CFT073
caagccuuacuucacau

SEQ ID NO: 2644510 - RNA, 14 nt, Escherichia coli CFT073
caagcgcaauauca

SEQ ID NO: 2644511 - RNA, 14 nt, Escherichia coli CFT073
caagcgcgcuguca

SEQ ID NO: 2644512 - RNA, 17 nt, Escherichia coli CFT073
caagcgcugugaaacac

SEQ ID NO: 2644513 - RNA, 19 nt, Escherichia coli CFT073
caagcgcugugaaacaccu

SEQ ID NO: 2644514 - RNA, 17 nt, Escherichia coli CFT073
caagcgggaauagcuca

SEQ ID NO: 2644515 - RNA, 20 nt, Escherichia coli CFT073
caagcggggggaucagacug

SEQ ID NO: 2644516 - RNA, 21 nt, Escherichia coli CFT073
caagcgucauauccgacacua

SEQ ID NO: 2644517 - RNA, 14 nt, Escherichia coli CFT073
caagcgucgcauca

SEQ ID NO: 2644518 - RNA, 18 nt, Escherichia coli CFT073
caagcgucgcaucaggca

SEQ ID NO: 2644519 - RNA, 19 nt, Escherichia coli CFT073
caagcgucgcaucaggcau

SEQ ID NO: 2644520 - RNA, 21 nt, Escherichia coli CFT073
caagcgucgcauccggcauca

SEQ ID NO: 2644521 - RNA, 15 nt, Escherichia coli CFT073
caagcgucgcgccau

SEQ ID NO: 2644522 - RNA, 14 nt, Escherichia coli CFT073
caagcguugcuuca

SEQ ID NO: 2644523 - RNA, 14 nt, Escherichia coli CFT073
caagcuaaaccaau

SEQ ID NO: 2644524 - RNA, 19 nt, Escherichia coli CFT073
caagcuaacgaacgcagug

SEQ ID NO: 2644525 - RNA, 13 nt, Escherichia coli CFT073
caagcucauuucc

SEQ ID NO: 2644526 - RNA, 16 nt, Escherichia coli CFT073
caagcucucuucaucg

SEQ ID NO: 2644527 - RNA, 14 nt, Escherichia coli CFT073
caagcugcugacau

SEQ ID NO: 2644528 - RNA, 14 nt, Escherichia coli CFT073
caagcugguggcaa

SEQ ID NO: 2644529 - RNA, 20 nt, Escherichia coli CFT073
caaggaaaaacuacccgcca

SEQ ID NO: 2644530 - RNA, 22 nt, Escherichia coli CFT073
caaggaaaaacuacccgccagu

SEQ ID NO: 2644531 - RNA, 20 nt, Escherichia coli CFT073
caaggagagccaguacagcc

SEQ ID NO: 2644532 - RNA, 23 nt, Escherichia coli CFT073
caaggaugcguuuuucggucaga

SEQ ID NO: 2644533 - RNA, 23 nt, Escherichia coli CFT073
caaggcaaaauacguuuucaccu

SEQ ID NO: 2644534 - RNA, 16 nt, Escherichia coli CFT073
caaggcauauaccaca

SEQ ID NO: 2644535 - RNA, 21 nt, Escherichia coli CFT073
caaggcgauuuggguagaaac

SEQ ID NO: 2644536 - RNA, 16 nt, Escherichia coli CFT073
caaggcuauucagcag

SEQ ID NO: 2644537 - RNA, 17 nt, Escherichia coli CFT073
caaggcuucuauggaag

SEQ ID NO: 2644538 - RNA, 21 nt, Escherichia coli CFT073
caagggaaauaagaaaagcga

SEQ ID NO: 2644539 - RNA, 15 nt, Escherichia coli CFT073
caagggccgccgcuu

SEQ ID NO: 2644540 - RNA, 15 nt, Escherichia coli CFT073
caagguaguagaaau

SEQ ID NO: 2644541 - RNA, 17 nt, Escherichia coli CFT073
caagguaguagaaauca

SEQ ID NO: 2644542 - RNA, 14 nt, Escherichia coli CFT073
caagguauugcacg

SEQ ID NO: 2644543 - RNA, 13 nt, Escherichia coli CFT073
caagguggucaga

SEQ ID NO: 2644544 - RNA, 12 nt, Escherichia coli CFT073
caagguguuuca

SEQ ID NO: 2644545 - RNA, 17 nt, Escherichia coli CFT073
caagguugcacaaccaa

SEQ ID NO: 2644546 - RNA, 17 nt, Escherichia coli CFT073
caaguaaucaaucaccu

SEQ ID NO: 2644547 - RNA, 21 nt, Escherichia coli CFT073
caaguaaucaaucaccucuuu

SEQ ID NO: 2644548 - RNA, 16 nt, Escherichia coli CFT073
caaguaauuguuucau

SEQ ID NO: 2644549 - RNA, 15 nt, Escherichia coli CFT073
caaguagcgccagac

SEQ ID NO: 2644550 - RNA, 19 nt, Escherichia coli CFT073
caaguauucacucugcugu

SEQ ID NO: 2644551 - RNA, 20 nt, Escherichia coli CFT073
caaguauucacucugcugua

SEQ ID NO: 2644552 - RNA, 21 nt, Escherichia coli CFT073
caagucagcgcgaaaucgccc

SEQ ID NO: 2644553 - RNA, 13 nt, Escherichia coli CFT073
caaguccugccag

SEQ ID NO: 2644554 - RNA, 14 nt, Escherichia coli CFT073
caaguccugccaga

SEQ ID NO: 2644555 - RNA, 21 nt, Escherichia coli CFT073
  misc_feature (10)..(10): n is a, c, g or u
caagucucangagugaacacg

SEQ ID NO: 2644556 - RNA, 21 nt, Escherichia coli CFT073
caagucuuuuuugguuaucca

SEQ ID NO: 2644557 - RNA, 15 nt, Escherichia coli CFT073
caagugaacuuucuc

SEQ ID NO: 2644558 - RNA, 20 nt, Escherichia coli CFT073
caagugagucggcuuuuuug

SEQ ID NO: 2644559 - RNA, 15 nt, Escherichia coli CFT073
caagugccagaucag

SEQ ID NO: 2644560 - RNA, 19 nt, Escherichia coli CFT073
caagugccuguguuuaugc

SEQ ID NO: 2644561 - RNA, 18 nt, Escherichia coli CFT073
caagugcggcgcaccagc

SEQ ID NO: 2644562 - RNA, 21 nt, Escherichia coli CFT073
caaguggaaauccccaucagg

SEQ ID NO: 2644563 - RNA, 22 nt, Escherichia coli CFT073
caaguggaaauccccaucaggu

SEQ ID NO: 2644564 - RNA, 12 nt, Escherichia coli CFT073
caaguguauacc

SEQ ID NO: 2644565 - RNA, 21 nt, Escherichia coli CFT073
caagugugaugguauucaucg

SEQ ID NO: 2644566 - RNA, 21 nt, Escherichia coli CFT073
caaguuaagcauuggcaugca

SEQ ID NO: 2644567 - RNA, 18 nt, Escherichia coli CFT073
caaguucagcgucaucaa

SEQ ID NO: 2644568 - RNA, 19 nt, Escherichia coli CFT073
caaguuccguuuccagcca

SEQ ID NO: 2644569 - RNA, 23 nt, Escherichia coli CFT073
caaguucgaacgccgccaguacg

SEQ ID NO: 2644570 - RNA, 15 nt, Escherichia coli CFT073
caaguugauuuuucg

SEQ ID NO: 2644571 - RNA, 23 nt, Escherichia coli CFT073
caaguuguaauuccugaagagaa

SEQ ID NO: 2644572 - RNA, 13 nt, Escherichia coli CFT073
caaguuuaugcaa

SEQ ID NO: 2644573 - RNA, 16 nt, Escherichia coli CFT073
caaguuucaauauccg

SEQ ID NO: 2644574 - RNA, 14 nt, Escherichia coli CFT073
caauaaaaaagccg

SEQ ID NO: 2644575 - RNA, 20 nt, Escherichia coli CFT073
caauaaaaaucagauaugcg

SEQ ID NO: 2644576 - RNA, 12 nt, Escherichia coli CFT073
caauaaaagcau

SEQ ID NO: 2644577 - RNA, 16 nt, Escherichia coli CFT073
caauaaaccauaauau

SEQ ID NO: 2644578 - RNA, 18 nt, Escherichia coli CFT073
caauaaacugcgaccagg

SEQ ID NO: 2644579 - RNA, 12 nt, Escherichia coli CFT073
caauaaacuggc

SEQ ID NO: 2644580 - RNA, 14 nt, Escherichia coli CFT073
caauaaagccggua

SEQ ID NO: 2644581 - RNA, 12 nt, Escherichia coli CFT073
caauaaaguuuu

SEQ ID NO: 2644582 - RNA, 12 nt, Escherichia coli CFT073
caauaaauacaa

SEQ ID NO: 2644583 - RNA, 22 nt, Escherichia coli CFT073
caauaaauugcgauauguugug

SEQ ID NO: 2644584 - RNA, 21 nt, Escherichia coli CFT073
caauaaccagcguuuccagca

SEQ ID NO: 2644585 - RNA, 13 nt, Escherichia coli CFT073
caauaaccaucag

SEQ ID NO: 2644586 - RNA, 14 nt, Escherichia coli CFT073
caauaaccauucca

SEQ ID NO: 2644587 - RNA, 16 nt, Escherichia coli CFT073
caauaacccccugccc

SEQ ID NO: 2644588 - RNA, 21 nt, Escherichia coli CFT073
caauaacccguuguaaaugcu

SEQ ID NO: 2644589 - RNA, 22 nt, Escherichia coli CFT073
caauaacccguuguaaaugcug

SEQ ID NO: 2644590 - RNA, 17 nt, Escherichia coli CFT073
caauaacgguaguggca

SEQ ID NO: 2644591 - RNA, 19 nt, Escherichia coli CFT073
caauaacuccccuucuggc

SEQ ID NO: 2644592 - RNA, 18 nt, Escherichia coli CFT073
caauaagauaacccugca

SEQ ID NO: 2644593 - RNA, 16 nt, Escherichia coli CFT073
caauaagcuguucaga

SEQ ID NO: 2644594 - RNA, 22 nt, Escherichia coli CFT073
caauaaguacgauacaaaagca

SEQ ID NO: 2644595 - RNA, 19 nt, Escherichia coli CFT073
caauaauaucccaacgcaa

SEQ ID NO: 2644596 - RNA, 14 nt, Escherichia coli CFT073
caauaauaucuuuc

SEQ ID NO: 2644597 - RNA, 15 nt, Escherichia coli CFT073
caauaauaucuuucu

SEQ ID NO: 2644598 - RNA, 15 nt, Escherichia coli CFT073
caauaauauugcuaa

SEQ ID NO: 2644599 - RNA, 22 nt, Escherichia coli CFT073
caauaaucaaucuuuacacaca

SEQ ID NO: 2644600 - RNA, 18 nt, Escherichia coli CFT073
caauaaucaugcagcgca

SEQ ID NO: 2644601 - RNA, 21 nt, Escherichia coli CFT073
caauaaucaugcagcgcagac

SEQ ID NO: 2644602 - RNA, 13 nt, Escherichia coli CFT073
caauaauccacgg

SEQ ID NO: 2644603 - RNA, 16 nt, Escherichia coli CFT073
caauaaucgccuuacc

SEQ ID NO: 2644604 - RNA, 12 nt, Escherichia coli CFT073
caauaaucugcc

SEQ ID NO: 2644605 - RNA, 20 nt, Escherichia coli CFT073
caauaaucuuuacaccaacg

SEQ ID NO: 2644606 - RNA, 12 nt, Escherichia coli CFT073
caauaaugauga

SEQ ID NO: 2644607 - RNA, 19 nt, Escherichia coli CFT073
caaucaguuuuuguugaua

SEQ ID NO: 2644608 - RNA, 20 nt, Escherichia coli CFT073
caaucaucaacccgcgcgcu

SEQ ID NO: 2644609 - RNA, 18 nt, Escherichia coli CFT073
caaucaucgccuuaugcu

SEQ ID NO: 2644610 - RNA, 15 nt, Escherichia coli CFT073
caaucaucucuaccu

SEQ ID NO: 2644611 - RNA, 19 nt, Escherichia coli CFT073
caaucauugauaauaacgu

SEQ ID NO: 2644612 - RNA, 16 nt, Escherichia coli CFT073
caaucauuucugcaau

SEQ ID NO: 2644613 - RNA, 15 nt, Escherichia coli CFT073
caaucauuugcacca

SEQ ID NO: 2644614 - RNA, 16 nt, Escherichia coli CFT073
caaucauuugcaccag

SEQ ID NO: 2644615 - RNA, 18 nt, Escherichia coli CFT073
caaucauuugcaccaggc

SEQ ID NO: 2644616 - RNA, 19 nt, Escherichia coli CFT073
caaucauuugcaccaggcc

SEQ ID NO: 2644617 - RNA, 18 nt, Escherichia coli CFT073
caaucauuuuuuccccuu

SEQ ID NO: 2644618 - RNA, 19 nt, Escherichia coli CFT073
caaucauuuuuuccccuua

SEQ ID NO: 2644619 - RNA, 16 nt, Escherichia coli CFT073
caauccacaagcacag

SEQ ID NO: 2644620 - RNA, 21 nt, Escherichia coli CFT073
caauccacgcggguuuaccac

SEQ ID NO: 2644621 - RNA, 21 nt, Escherichia coli CFT073
caauccagggguuguuauuuc

SEQ ID NO: 2644622 - RNA, 23 nt, Escherichia coli CFT073
caauccagggguuguuauuuccg

SEQ ID NO: 2644623 - RNA, 18 nt, Escherichia coli CFT073
caauccaguacaugaagc

SEQ ID NO: 2644624 - RNA, 15 nt, Escherichia coli CFT073
caauccagucagcgg

SEQ ID NO: 2644625 - RNA, 18 nt, Escherichia coli CFT073
caauccauaccagcacau

SEQ ID NO: 2644626 - RNA, 13 nt, Escherichia coli CFT073
caauccaugccaa

SEQ ID NO: 2644627 - RNA, 14 nt, Escherichia coli CFT073
caauccccgccagc

SEQ ID NO: 2644628 - RNA, 19 nt, Escherichia coli CFT073
caaucccggaagccaccac

SEQ ID NO: 2644629 - RNA, 20 nt, Escherichia coli CFT073
caaucccguaggauuucuuc

SEQ ID NO: 2644630 - RNA, 22 nt, Escherichia coli CFT073
caaucccgucuucgucuggcug

SEQ ID NO: 2644631 - RNA, 17 nt, Escherichia coli CFT073
caaucccguugccacuc

SEQ ID NO: 2644632 - RNA, 22 nt, Escherichia coli CFT073
caaucccguugccacucaggca

SEQ ID NO: 2644633 - RNA, 13 nt, Escherichia coli CFT073
caaucccuuccac

SEQ ID NO: 2644634 - RNA, 22 nt, Escherichia coli CFT073
caauccgcagcaaagcccgggc

SEQ ID NO: 2644635 - RNA, 12 nt, Escherichia coli CFT073
caauccgccagc

SEQ ID NO: 2644636 - RNA, 14 nt, Escherichia coli CFT073
caauccgccaggac

SEQ ID NO: 2644637 - RNA, 21 nt, Escherichia coli CFT073
caauccgccaggacaucagcg

SEQ ID NO: 2644638 - RNA, 22 nt, Escherichia coli CFT073
caauccgccaggacaucagcgc

SEQ ID NO: 2644639 - RNA, 20 nt, Escherichia coli CFT073
caauccgcgagcgucuggcu

SEQ ID NO: 2644640 - RNA, 21 nt, Escherichia coli CFT073
caauccgcgauaacgccccaa

SEQ ID NO: 2644641 - RNA, 14 nt, Escherichia coli CFT073
caauccuucuugcu

SEQ ID NO: 2644642 - RNA, 21 nt, Escherichia coli CFT073
caaucgaaaaagaaucgauua

SEQ ID NO: 2644643 - RNA, 18 nt, Escherichia coli CFT073
caaucgaacgcagcaaca

SEQ ID NO: 2644644 - RNA, 19 nt, Escherichia coli CFT073
caaucgaccaggccaucag

SEQ ID NO: 2644645 - RNA, 20 nt, Escherichia coli CFT073
caaucgaucuguuuaucgcg

SEQ ID NO: 2644646 - RNA, 18 nt, Escherichia coli CFT073
caaucgcaaucuggcagc

SEQ ID NO: 2644647 - RNA, 12 nt, Escherichia coli CFT073
caaucgccagaa

SEQ ID NO: 2644648 - RNA, 13 nt, Escherichia coli CFT073
caaucgccagauc

SEQ ID NO: 2644649 - RNA, 16 nt, Escherichia coli CFT073
caaucgccagauccgc

SEQ ID NO: 2644650 - RNA, 23 nt, Escherichia coli CFT073
caaucgccgccaguuccaggcaa

SEQ ID NO: 2644651 - RNA, 14 nt, Escherichia coli CFT073
caaucgccuccagc

SEQ ID NO: 2644652 - RNA, 18 nt, Escherichia coli CFT073
caaucgccuccagcgcug

SEQ ID NO: 2644653 - RNA, 19 nt, Escherichia coli CFT073
caaucgccuccagcgcugg

SEQ ID NO: 2644654 - RNA, 21 nt, Escherichia coli CFT073
caaucgcgccagaacacgcuc

SEQ ID NO: 2644655 - RNA, 15 nt, Escherichia coli CFT073
caaucgcggcagcgg

SEQ ID NO: 2644656 - RNA, 15 nt, Escherichia coli CFT073
caaucgcggcgauau

SEQ ID NO: 2644657 - RNA, 22 nt, Escherichia coli CFT073
caaucgcggcgauauccagcgc

SEQ ID NO: 2644658 - RNA, 15 nt, Escherichia coli CFT073
caaucgcucccagcc

SEQ ID NO: 2644659 - RNA, 22 nt, Escherichia coli CFT073
caaucgcugcgguaauaauucc

SEQ ID NO: 2644660 - RNA, 14 nt, Escherichia coli CFT073
caaucgcugcuaau

SEQ ID NO: 2644661 - RNA, 18 nt, Escherichia coli CFT073
caaucgcuguacucacca

SEQ ID NO: 2644662 - RNA, 17 nt, Escherichia coli CFT073
caaucgcuuaauccgcg

SEQ ID NO: 2644663 - RNA, 16 nt, Escherichia coli CFT073
caaucgcuucaucgcc

SEQ ID NO: 2644664 - RNA, 17 nt, Escherichia coli CFT073
caaucgcuucaucgccc

SEQ ID NO: 2644665 - RNA, 19 nt, Escherichia coli CFT073
caaucggaaaacaaccgcc

SEQ ID NO: 2644666 - RNA, 22 nt, Escherichia coli CFT073
caaucggaaaacaaccgccaug

SEQ ID NO: 2644667 - RNA, 12 nt, Escherichia coli CFT073
caaucgggaaga

SEQ ID NO: 2644668 - RNA, 16 nt, Escherichia coli CFT073
caaucguaacccaacu

SEQ ID NO: 2644669 - RNA, 17 nt, Escherichia coli CFT073
caaucguaugaucaucc

SEQ ID NO: 2644670 - RNA, 16 nt, Escherichia coli CFT073
caaucgucugguuuuc

SEQ ID NO: 2644671 - RNA, 18 nt, Escherichia coli CFT073
caaucgucugguuuuccu

SEQ ID NO: 2644672 - RNA, 19 nt, Escherichia coli CFT073
caaucgucugguuuuccuu

SEQ ID NO: 2644673 - RNA, 13 nt, Escherichia coli CFT073
caaucuccugcgc

SEQ ID NO: 2644674 - RNA, 23 nt, Escherichia coli CFT073
caaucucgcugaucuuauugguu

SEQ ID NO: 2644675 - RNA, 19 nt, Escherichia coli CFT073
caaucucuucaccugccug

SEQ ID NO: 2644676 - RNA, 17 nt, Escherichia coli CFT073
caaucugcgcuucucgc

SEQ ID NO: 2644677 - RNA, 14 nt, Escherichia coli CFT073
caaucugcuccauu

SEQ ID NO: 2644678 - RNA, 20 nt, Escherichia coli CFT073
caaucugcucuggcagcacc

SEQ ID NO: 2644679 - RNA, 17 nt, Escherichia coli CFT073
caaucuggcugaugaag

SEQ ID NO: 2644680 - RNA, 13 nt, Escherichia coli CFT073
caaucuucaacac

SEQ ID NO: 2644681 - RNA, 17 nt, Escherichia coli CFT073
caaucuucaacacuuca

SEQ ID NO: 2644682 - RNA, 15 nt, Escherichia coli CFT073
caaucuucucuuccc

SEQ ID NO: 2644683 - RNA, 15 nt, Escherichia coli CFT073
caaucuuuccugcac

SEQ ID NO: 2644684 - RNA, 13 nt, Escherichia coli CFT073
caaugaaacucaa

SEQ ID NO: 2644685 - RNA, 19 nt, Escherichia coli CFT073
caaugaagaaccgcaccag

SEQ ID NO: 2644686 - RNA, 19 nt, Escherichia coli CFT073
caaugacagccccaccagc

SEQ ID NO: 2644687 - RNA, 20 nt, Escherichia coli CFT073
caaugacagccccaccagca

SEQ ID NO: 2644688 - RNA, 16 nt, Escherichia coli CFT073
caaugacauacagcac

SEQ ID NO: 2644689 - RNA, 15 nt, Escherichia coli CFT073
caaugacgucuucca

SEQ ID NO: 2644690 - RNA, 23 nt, Escherichia coli CFT073
caaugacgucuuccaccggcugu

SEQ ID NO: 2644691 - RNA, 17 nt, Escherichia coli CFT073
caaugacuauuugcgcc

SEQ ID NO: 2644692 - RNA, 23 nt, Escherichia coli CFT073
caaugagacgguuaaaaacagcc

SEQ ID NO: 2644693 - RNA, 14 nt, Escherichia coli CFT073
caaugagcacaaca

SEQ ID NO: 2644694 - RNA, 18 nt, Escherichia coli CFT073
caaugagcuauguuugaa

SEQ ID NO: 2644695 - RNA, 17 nt, Escherichia coli CFT073
caaugaguucgcgcgcu

SEQ ID NO: 2644696 - RNA, 19 nt, Escherichia coli CFT073
caaugauaaguccgaugcc

SEQ ID NO: 2644697 - RNA, 13 nt, Escherichia coli CFT073
caaugaugccgcc

SEQ ID NO: 2644698 - RNA, 20 nt, Escherichia coli CFT073
caaugauuguaggccggaua

SEQ ID NO: 2644699 - RNA, 15 nt, Escherichia coli CFT073
caaugcacacaaaau

SEQ ID NO: 2644700 - RNA, 21 nt, Escherichia coli CFT073
caaugcagaauuugcaccacu

SEQ ID NO: 2644701 - RNA, 15 nt, Escherichia coli CFT073
caaugcauaucauug

SEQ ID NO: 2644702 - RNA, 19 nt, Escherichia coli CFT073
caaugcauuauugauaccc

SEQ ID NO: 2644703 - RNA, 20 nt, Escherichia coli CFT073
caaugccagaaacaucggca

SEQ ID NO: 2644704 - RNA, 16 nt, Escherichia coli CFT073
caaugccagcauaccg

SEQ ID NO: 2644705 - RNA, 19 nt, Escherichia coli CFT073
caaugccagcguauaacac

SEQ ID NO: 2644706 - RNA, 19 nt, Escherichia coli CFT073
caaugccaggcuccagaua

SEQ ID NO: 2644707 - RNA, 18 nt, Escherichia coli CFT073
caaugccauauaacgggc

SEQ ID NO: 2644708 - RNA, 15 nt, Escherichia coli CFT073
caaugccaucaccaa

SEQ ID NO: 2644709 - RNA, 16 nt, Escherichia coli CFT073
caaugccaucaccaac

SEQ ID NO: 2644710 - RNA, 16 nt, Escherichia coli CFT073
caaugccauucacaaa

SEQ ID NO: 2644711 - RNA, 17 nt, Escherichia coli CFT073
caaugcccacugcacag

SEQ ID NO: 2644712 - RNA, 15 nt, Escherichia coli CFT073
caaugccccagaaua

SEQ ID NO: 2644713 - RNA, 16 nt, Escherichia coli CFT073
caaugccccagaauaa

SEQ ID NO: 2644714 - RNA, 14 nt, Escherichia coli CFT073
caaugcccgcagua

SEQ ID NO: 2644715 - RNA, 18 nt, Escherichia coli CFT073
cacaaaauagaaauuuag

SEQ ID NO: 2644716 - RNA, 13 nt, Escherichia coli CFT073
cacaaacaauuug

SEQ ID NO: 2644717 - RNA, 14 nt, Escherichia coli CFT073
cacaaacagaaugg

SEQ ID NO: 2644718 - RNA, 14 nt, Escherichia coli CFT073
cacaaacagcgccu

SEQ ID NO: 2644719 - RNA, 12 nt, Escherichia coli CFT073
cacaaacaucau

SEQ ID NO: 2644720 - RNA, 14 nt, Escherichia coli CFT073
cacaaacaucccug

SEQ ID NO: 2644721 - RNA, 16 nt, Escherichia coli CFT073
cacaaacaucccugaa

SEQ ID NO: 2644722 - RNA, 17 nt, Escherichia coli CFT073
cacaaacgccgugcaca

SEQ ID NO: 2644723 - RNA, 15 nt, Escherichia coli CFT073
cacaaagcgccagaa

SEQ ID NO: 2644724 - RNA, 19 nt, Escherichia coli CFT073
cacaaaggcgcgaagcugg

SEQ ID NO: 2644725 - RNA, 18 nt, Escherichia coli CFT073
cacaaaggcuugcugcau

SEQ ID NO: 2644726 - RNA, 16 nt, Escherichia coli CFT073
cacaaaguaaacaaua

SEQ ID NO: 2644727 - RNA, 14 nt, Escherichia coli CFT073
cacaaaucuuauag

SEQ ID NO: 2644728 - RNA, 15 nt, Escherichia coli CFT073
cacaacagaccagaa

SEQ ID NO: 2644729 - RNA, 20 nt, Escherichia coli CFT073
cacaacagccagguuuugcu

SEQ ID NO: 2644730 - RNA, 18 nt, Escherichia coli CFT073
cacaacauucccaucagu

SEQ ID NO: 2644731 - RNA, 15 nt, Escherichia coli CFT073
cacaacauugcgccu

SEQ ID NO: 2644732 - RNA, 17 nt, Escherichia coli CFT073
cacaacauugcgccuca

SEQ ID NO: 2644733 - RNA, 14 nt, Escherichia coli CFT073
cacaaccacuuugu

SEQ ID NO: 2644734 - RNA, 15 nt, Escherichia coli CFT073
cacaaccacuuugua

SEQ ID NO: 2644735 - RNA, 21 nt, Escherichia coli CFT073
cacaaccgaggcucaacaccg

SEQ ID NO: 2644736 - RNA, 16 nt, Escherichia coli CFT073
cacaaccgccagaugc

SEQ ID NO: 2644737 - RNA, 13 nt, Escherichia coli CFT073
cacaaccgccauc

SEQ ID NO: 2644738 - RNA, 17 nt, Escherichia coli CFT073
cacaaccgccggaugcg

SEQ ID NO: 2644739 - RNA, 18 nt, Escherichia coli CFT073
cacaaccgccggaugcgg

SEQ ID NO: 2644740 - RNA, 12 nt, Escherichia coli CFT073
cacaaccgucag

SEQ ID NO: 2644741 - RNA, 22 nt, Escherichia coli CFT073
cacaaccugaguaaaucaccug

SEQ ID NO: 2644742 - RNA, 19 nt, Escherichia coli CFT073
cacaacgagucgccuacca

SEQ ID NO: 2644743 - RNA, 14 nt, Escherichia coli CFT073
cacaacgcuuucaa

SEQ ID NO: 2644744 - RNA, 20 nt, Escherichia coli CFT073
cacaacgcuuucaacaaccu

SEQ ID NO: 2644745 - RNA, 16 nt, Escherichia coli CFT073
cacaacguacaccgca

SEQ ID NO: 2644746 - RNA, 20 nt, Escherichia coli CFT073
cacaacuucgcaaacacccg

SEQ ID NO: 2644747 - RNA, 13 nt, Escherichia coli CFT073
cacaagacugaca

SEQ ID NO: 2644748 - RNA, 11 nt, Escherichia coli CFT073
cacaagacugu

SEQ ID NO: 2644749 - RNA, 15 nt, Escherichia coli CFT073
cacaagccaccaucc

SEQ ID NO: 2644750 - RNA, 16 nt, Escherichia coli CFT073
cacaagcuaccagccc

SEQ ID NO: 2644751 - RNA, 22 nt, Escherichia coli CFT073
cacaauaaucagcccaaccacg

SEQ ID NO: 2644752 - RNA, 18 nt, Escherichia coli CFT073
cacaauacauagaagcuc

SEQ ID NO: 2644753 - RNA, 15 nt, Escherichia coli CFT073
cacaaucaaauccug

SEQ ID NO: 2644754 - RNA, 22 nt, Escherichia coli CFT073
cacaaucaacgccaccaucacu

SEQ ID NO: 2644755 - RNA, 22 nt, Escherichia coli CFT073
cacaauccccgcgccaaccaug

SEQ ID NO: 2644756 - RNA, 17 nt, Escherichia coli CFT073
cacaaucccuuccaccg

SEQ ID NO: 2644757 - RNA, 13 nt, Escherichia coli CFT073
cacaauccgcgag

SEQ ID NO: 2644758 - RNA, 16 nt, Escherichia coli CFT073
cacaaucgcagcgcaa

SEQ ID NO: 2644759 - RNA, 22 nt, Escherichia coli CFT073
cacaaucgcagcgcaagcugaa

SEQ ID NO: 2644760 - RNA, 18 nt, Escherichia coli CFT073
cacaaucggcguaccgca

SEQ ID NO: 2644761 - RNA, 20 nt, Escherichia coli CFT073
cacaaucgggaaaaucugcg

SEQ ID NO: 2644762 - RNA, 18 nt, Escherichia coli CFT073
cacaaugcccggaaugua

SEQ ID NO: 2644763 - RNA, 16 nt, Escherichia coli CFT073
cacaauguaaaucaug

SEQ ID NO: 2644764 - RNA, 16 nt, Escherichia coli CFT073
cacaauguucaaaugu

SEQ ID NO: 2644765 - RNA, 14 nt, Escherichia coli CFT073
cacaauuaccuucc

SEQ ID NO: 2644766 - RNA, 23 nt, Escherichia coli CFT073
cacaauuaccuuccacaauggca

SEQ ID NO: 2644767 - RNA, 16 nt, Escherichia coli CFT073
cacaauugcaguauga

SEQ ID NO: 2644768 - RNA, 14 nt, Escherichia coli CFT073
cacaauuuaaauca

SEQ ID NO: 2644769 - RNA, 22 nt, Escherichia coli CFT073
cacaauuuguggcccuugcgca

SEQ ID NO: 2644770 - RNA, 14 nt, Escherichia coli CFT073
cacacaaaauugcc

SEQ ID NO: 2644771 - RNA, 18 nt, Escherichia coli CFT073
cacacaaaauugccgcua

SEQ ID NO: 2644772 - RNA, 22 nt, Escherichia coli CFT073
cacacaagccgugaaucacucc

SEQ ID NO: 2644773 - RNA, 13 nt, Escherichia coli CFT073
cacacacacgccc

SEQ ID NO: 2644774 - RNA, 14 nt, Escherichia coli CFT073
cacacacaucaacc

SEQ ID NO: 2644775 - RNA, 18 nt, Escherichia coli CFT073
cacacacuaccgccgagc

SEQ ID NO: 2644776 - RNA, 19 nt, Escherichia coli CFT073
cacacacuaccgccgagca

SEQ ID NO: 2644777 - RNA, 15 nt, Escherichia coli CFT073
cacacagcuuucuca

SEQ ID NO: 2644778 - RNA, 14 nt, Escherichia coli CFT073
cacacaucggcagg

SEQ ID NO: 2644779 - RNA, 15 nt, Escherichia coli CFT073
cacaccacagcaccc

SEQ ID NO: 2644780 - RNA, 12 nt, Escherichia coli CFT073
cacaccaccaug

SEQ ID NO: 2644781 - RNA, 13 nt, Escherichia coli CFT073
cacaccacgcgcc

SEQ ID NO: 2644782 - RNA, 18 nt, Escherichia coli CFT073
cacaccagcaauagcgca

SEQ ID NO: 2644783 - RNA, 22 nt, Escherichia coli CFT073
cacaccagucagcgaacaccag

SEQ ID NO: 2644784 - RNA, 19 nt, Escherichia coli CFT073
cacaccauacuguucggac

SEQ ID NO: 2644785 - RNA, 13 nt, Escherichia coli CFT073
cacaccauaucca

SEQ ID NO: 2644786 - RNA, 13 nt, Escherichia coli CFT073
cacaccaucaaca

SEQ ID NO: 2644787 - RNA, 14 nt, Escherichia coli CFT073
cacaccauccagca

SEQ ID NO: 2644788 - RNA, 22 nt, Escherichia coli CFT073
cacacccggccuaucaacgucg

SEQ ID NO: 2644789 - RNA, 15 nt, Escherichia coli CFT073
cacaccgcggaacgc

SEQ ID NO: 2644790 - RNA, 15 nt, Escherichia coli CFT073
cacaccggcaccacg

SEQ ID NO: 2644791 - RNA, 15 nt, Escherichia coli CFT073
cacaccguaauugcc

SEQ ID NO: 2644792 - RNA, 19 nt, Escherichia coli CFT073
cacaccguaauugccagac

SEQ ID NO: 2644793 - RNA, 15 nt, Escherichia coli CFT073
cacaccuacgcccgc

SEQ ID NO: 2644794 - RNA, 16 nt, Escherichia coli CFT073
cacaccucacaccccg

SEQ ID NO: 2644795 - RNA, 22 nt, Escherichia coli CFT073
cacaccugcucagcacgccacu

SEQ ID NO: 2644796 - RNA, 14 nt, Escherichia coli CFT073
cacacgacgccagc

SEQ ID NO: 2644797 - RNA, 20 nt, Escherichia coli CFT073
cacacgaucugacauuugca

SEQ ID NO: 2644798 - RNA, 16 nt, Escherichia coli CFT073
cacacgcagcugaugc

SEQ ID NO: 2644799 - RNA, 12 nt, Escherichia coli CFT073
cacacgcgccca

SEQ ID NO: 2644800 - RNA, 14 nt, Escherichia coli CFT073
cacacgcgcccagc

SEQ ID NO: 2644801 - RNA, 14 nt, Escherichia coli CFT073
cacacgcucuucca

SEQ ID NO: 2644802 - RNA, 16 nt, Escherichia coli CFT073
cacacuaccaaaacgg

SEQ ID NO: 2644803 - RNA, 20 nt, Escherichia coli CFT073
cacacuccagucccaguuca

SEQ ID NO: 2644804 - RNA, 18 nt, Escherichia coli CFT073
cacacugaugacaggcua

SEQ ID NO: 2644805 - RNA, 17 nt, Escherichia coli CFT073
cacacugcggccagcau

SEQ ID NO: 2644806 - RNA, 18 nt, Escherichia coli CFT073
cacacuguaagccaccga

SEQ ID NO: 2644807 - RNA, 23 nt, Escherichia coli CFT073
cacacuguucauuaaagccgccc

SEQ ID NO: 2644808 - RNA, 12 nt, Escherichia coli CFT073
cacagaaaagca

SEQ ID NO: 2644809 - RNA, 15 nt, Escherichia coli CFT073
cacagaaaagcagag

SEQ ID NO: 2644810 - RNA, 18 nt, Escherichia coli CFT073
cacagaacaaaauguuua

SEQ ID NO: 2644811 - RNA, 17 nt, Escherichia coli CFT073
cacagaaccggagucag

SEQ ID NO: 2644812 - RNA, 15 nt, Escherichia coli CFT073
cacagaauggcauua

SEQ ID NO: 2644813 - RNA, 16 nt, Escherichia coli CFT073
cacagaaugugaugcc

SEQ ID NO: 2644814 - RNA, 12 nt, Escherichia coli CFT073
cacagacaaaca

SEQ ID NO: 2644815 - RNA, 14 nt, Escherichia coli CFT073
cacagaccaaaacu

SEQ ID NO: 2644816 - RNA, 18 nt, Escherichia coli CFT073
cacagagcgcuuauacac

SEQ ID NO: 2644817 - RNA, 20 nt, Escherichia coli CFT073
cacagagcuaugaauagucg

SEQ ID NO: 2644818 - RNA, 22 nt, Escherichia coli CFT073
cacagagggcgaacgagauaau

SEQ ID NO: 2644819 - RNA, 23 nt, Escherichia coli CFT073
cacagagggcgaacgagauaaug

SEQ ID NO: 2644820 - RNA, 22 nt, Escherichia coli CFT073
cacagauaauaauguguucaac

SEQ ID NO: 2644821 - RNA, 14 nt, Escherichia coli CFT073
cacagcaagcagcc

SEQ ID NO: 2644822 - RNA, 22 nt, Escherichia coli CFT073
cacagcaauuuugcccagccga

SEQ ID NO: 2644823 - RNA, 21 nt, Escherichia coli CFT073
cacagcaccccauagccagcg

SEQ ID NO: 2644824 - RNA, 17 nt, Escherichia coli CFT073
caccaacuccacuucac

SEQ ID NO: 2644825 - RNA, 16 nt, Escherichia coli CFT073
caccaacugccucguc

SEQ ID NO: 2644826 - RNA, 16 nt, Escherichia coli CFT073
caccaaguucuucacu

SEQ ID NO: 2644827 - RNA, 16 nt, Escherichia coli CFT073
caccaauaaugucgcu

SEQ ID NO: 2644828 - RNA, 12 nt, Escherichia coli CFT073
caccaauaccag

SEQ ID NO: 2644829 - RNA, 20 nt, Escherichia coli CFT073
caccaauaucaaucuucucu

SEQ ID NO: 2644830 - RNA, 14 nt, Escherichia coli CFT073
caccaaucacaaug

SEQ ID NO: 2644831 - RNA, 18 nt, Escherichia coli CFT073
caccaaucaccgccaaca

SEQ ID NO: 2644832 - RNA, 13 nt, Escherichia coli CFT073
caccaaucagcgg

SEQ ID NO: 2644833 - RNA, 12 nt, Escherichia coli CFT073
caccaaucggca

SEQ ID NO: 2644834 - RNA, 18 nt, Escherichia coli CFT073
caccaaucgucaaugccg

SEQ ID NO: 2644835 - RNA, 19 nt, Escherichia coli CFT073
caccaaucuucaacacuuc

SEQ ID NO: 2644836 - RNA, 23 nt, Escherichia coli CFT073
caccaaugacuauuugcgccgca

SEQ ID NO: 2644837 - RNA, 23 nt, Escherichia coli CFT073
caccaaugccaauguagccacgg

SEQ ID NO: 2644838 - RNA, 23 nt, Escherichia coli CFT073
caccaauguggaaagccccagcc

SEQ ID NO: 2644839 - RNA, 19 nt, Escherichia coli CFT073
caccaauuaaucccggauc

SEQ ID NO: 2644840 - RNA, 20 nt, Escherichia coli CFT073
caccaauugugguacgcuuu

SEQ ID NO: 2644841 - RNA, 22 nt, Escherichia coli CFT073
caccacaaaagcggugauaaac

SEQ ID NO: 2644842 - RNA, 16 nt, Escherichia coli CFT073
caccacaaaccagccc

SEQ ID NO: 2644843 - RNA, 14 nt, Escherichia coli CFT073
caccacaaaugcgc

SEQ ID NO: 2644844 - RNA, 13 nt, Escherichia coli CFT073
caccacaacaccu

SEQ ID NO: 2644845 - RNA, 20 nt, Escherichia coli CFT073
caccacaacaccuuucacgc

SEQ ID NO: 2644846 - RNA, 16 nt, Escherichia coli CFT073
caccacaccagaccag

SEQ ID NO: 2644847 - RNA, 23 nt, Escherichia coli CFT073
caccacacgacgcgccagcagcg

SEQ ID NO: 2644848 - RNA, 21 nt, Escherichia coli CFT073
caccacagacaaacagcucga

SEQ ID NO: 2644849 - RNA, 20 nt, Escherichia coli CFT073
caccacagcaccccauagcc

SEQ ID NO: 2644850 - RNA, 18 nt, Escherichia coli CFT073
caccacauaagaucaucg

SEQ ID NO: 2644851 - RNA, 14 nt, Escherichia coli CFT073
caccacaucgccga

SEQ ID NO: 2644852 - RNA, 18 nt, Escherichia coli CFT073
caccacauucagcagccc

SEQ ID NO: 2644853 - RNA, 19 nt, Escherichia coli CFT073
caccacauucagcagcccg

SEQ ID NO: 2644854 - RNA, 11 nt, Escherichia coli CFT073
caccacauucu

SEQ ID NO: 2644855 - RNA, 14 nt, Escherichia coli CFT073
caccacauucugca

SEQ ID NO: 2644856 - RNA, 17 nt, Escherichia coli CFT073
caccacauucugcauug

SEQ ID NO: 2644857 - RNA, 15 nt, Escherichia coli CFT073
caccaccaaagguua

SEQ ID NO: 2644858 - RNA, 15 nt, Escherichia coli CFT073
caccaccagcagcug

SEQ ID NO: 2644859 - RNA, 14 nt, Escherichia coli CFT073
caccaccagcgcca

SEQ ID NO: 2644860 - RNA, 14 nt, Escherichia coli CFT073
caccaccagcgccu

SEQ ID NO: 2644861 - RNA, 17 nt, Escherichia coli CFT073
caccaccagcgccuggu

SEQ ID NO: 2644862 - RNA, 22 nt, Escherichia coli CFT073
caccaccaucaaaugcgccugc

SEQ ID NO: 2644863 - RNA, 12 nt, Escherichia coli CFT073
caccacccaaca

SEQ ID NO: 2644864 - RNA, 14 nt, Escherichia coli CFT073
caccaccgcaaaau

SEQ ID NO: 2644865 - RNA, 21 nt, Escherichia coli CFT073
caccaccgcaucggcaucaaa

SEQ ID NO: 2644866 - RNA, 20 nt, Escherichia coli CFT073
caccaccgcuaacugcugcg

SEQ ID NO: 2644867 - RNA, 15 nt, Escherichia coli CFT073
caccaccucacccgc

SEQ ID NO: 2644868 - RNA, 13 nt, Escherichia coli CFT073
caccaccucuucc

SEQ ID NO: 2644869 - RNA, 14 nt, Escherichia coli CFT073
caccaccucuucca

SEQ ID NO: 2644870 - RNA, 16 nt, Escherichia coli CFT073
caccaccugcaucucc

SEQ ID NO: 2644871 - RNA, 16 nt, Escherichia coli CFT073
caccaccuggcggcgu

SEQ ID NO: 2644872 - RNA, 13 nt, Escherichia coli CFT073
caccaccugggug

SEQ ID NO: 2644873 - RNA, 16 nt, Escherichia coli CFT073
caccacgccacuaagc

SEQ ID NO: 2644874 - RNA, 20 nt, Escherichia coli CFT073
caccacgcccagcgaccaca

SEQ ID NO: 2644875 - RNA, 20 nt, Escherichia coli CFT073
caccacgccgauggcagaaa

SEQ ID NO: 2644876 - RNA, 20 nt, Escherichia coli CFT073
caccacgcgccugcagcggc

SEQ ID NO: 2644877 - RNA, 17 nt, Escherichia coli CFT073
caccacgcgggguaaaa

SEQ ID NO: 2644878 - RNA, 23 nt, Escherichia coli CFT073
caccacggccagguuaaccagca

SEQ ID NO: 2644879 - RNA, 19 nt, Escherichia coli CFT073
caccacgguuuuuugcagc

SEQ ID NO: 2644880 - RNA, 13 nt, Escherichia coli CFT073
caccacguagcau

SEQ ID NO: 2644881 - RNA, 15 nt, Escherichia coli CFT073
caccacuccucaaca

SEQ ID NO: 2644882 - RNA, 12 nt, Escherichia coli CFT073
caccacuuaauc

SEQ ID NO: 2644883 - RNA, 15 nt, Escherichia coli CFT073
caccacuucauacuc

SEQ ID NO: 2644884 - RNA, 21 nt, Escherichia coli CFT073
caccacuuccggcaacaaggc

SEQ ID NO: 2644885 - RNA, 16 nt, Escherichia coli CFT073
caccacuuccugcucg

SEQ ID NO: 2644886 - RNA, 13 nt, Escherichia coli CFT073
caccacuucuuuc

SEQ ID NO: 2644887 - RNA, 14 nt, Escherichia coli CFT073
caccacuucuuuca

SEQ ID NO: 2644888 - RNA, 22 nt, Escherichia coli CFT073
caccacuuguagaccaggaugc

SEQ ID NO: 2644889 - RNA, 22 nt, Escherichia coli CFT073
caccacuuuacgggcaaucucc

SEQ ID NO: 2644890 - RNA, 15 nt, Escherichia coli CFT073
caccacuuuaucggc

SEQ ID NO: 2644891 - RNA, 12 nt, Escherichia coli CFT073
caccagaaacag

SEQ ID NO: 2644892 - RNA, 21 nt, Escherichia coli CFT073
caccagaaacagaguauaaaa

SEQ ID NO: 2644893 - RNA, 12 nt, Escherichia coli CFT073
caccagaaccgc

SEQ ID NO: 2644894 - RNA, 23 nt, Escherichia coli CFT073
caccagaacgacgaccgccgcuc

SEQ ID NO: 2644895 - RNA, 18 nt, Escherichia coli CFT073
caccagaacucccuguuc

SEQ ID NO: 2644896 - RNA, 11 nt, Escherichia coli CFT073
caccagaauac

SEQ ID NO: 2644897 - RNA, 20 nt, Escherichia coli CFT073
caccagaauaccuugcugcu

SEQ ID NO: 2644898 - RNA, 15 nt, Escherichia coli CFT073
caccagaaucgccag

SEQ ID NO: 2644899 - RNA, 16 nt, Escherichia coli CFT073
caccagaaucgccagc

SEQ ID NO: 2644900 - RNA, 20 nt, Escherichia coli CFT073
caccagaaucgccagcaucg

SEQ ID NO: 2644901 - RNA, 19 nt, Escherichia coli CFT073
caccagacaucaaguaacc

SEQ ID NO: 2644902 - RNA, 13 nt, Escherichia coli CFT073
caccagaggaugc

SEQ ID NO: 2644903 - RNA, 14 nt, Escherichia coli CFT073
caccagauccagca

SEQ ID NO: 2644904 - RNA, 16 nt, Escherichia coli CFT073
caccagaucuuccagc

SEQ ID NO: 2644905 - RNA, 17 nt, Escherichia coli CFT073
caccagaucuuccagcg

SEQ ID NO: 2644906 - RNA, 14 nt, Escherichia coli CFT073
caccagauggcuuu

SEQ ID NO: 2644907 - RNA, 17 nt, Escherichia coli CFT073
caccagauggcuuucca

SEQ ID NO: 2644908 - RNA, 13 nt, Escherichia coli CFT073
caccagcaaauau

SEQ ID NO: 2644909 - RNA, 20 nt, Escherichia coli CFT073
caccagcaaauauugcauug

SEQ ID NO: 2644910 - RNA, 16 nt, Escherichia coli CFT073
caccagcaaauccagc

SEQ ID NO: 2644911 - RNA, 13 nt, Escherichia coli CFT073
caccagcaauaau

SEQ ID NO: 2644912 - RNA, 16 nt, Escherichia coli CFT073
caccagcaccagcaac

SEQ ID NO: 2644913 - RNA, 18 nt, Escherichia coli CFT073
caccagcaccagcaacaa

SEQ ID NO: 2644914 - RNA, 19 nt, Escherichia coli CFT073
caccagcaccagcaacaac

SEQ ID NO: 2644915 - RNA, 10 nt, Escherichia coli CFT073
caccagcagc

SEQ ID NO: 2644916 - RNA, 14 nt, Escherichia coli CFT073
caccagcagcugcu

SEQ ID NO: 2644917 - RNA, 17 nt, Escherichia coli CFT073
caccagcaucaacaaca

SEQ ID NO: 2644918 - RNA, 19 nt, Escherichia coli CFT073
caccagccaguagaacaau

SEQ ID NO: 2644919 - RNA, 14 nt, Escherichia coli CFT073
caccagccaguagc

SEQ ID NO: 2644920 - RNA, 18 nt, Escherichia coli CFT073
caccagccaguagcaccu

SEQ ID NO: 2644921 - RNA, 19 nt, Escherichia coli CFT073
caccagccaucuguuccgg

SEQ ID NO: 2644922 - RNA, 19 nt, Escherichia coli CFT073
caccagccccagaacucac

SEQ ID NO: 2644923 - RNA, 20 nt, Escherichia coli CFT073
caccagcgacagccagccca

SEQ ID NO: 2644924 - RNA, 20 nt, Escherichia coli CFT073
caccagcgcaauauguuucc

SEQ ID NO: 2644925 - RNA, 13 nt, Escherichia coli CFT073
caccagcgcacug

SEQ ID NO: 2644926 - RNA, 18 nt, Escherichia coli CFT073
caccagcgcauugacgau

SEQ ID NO: 2644927 - RNA, 22 nt, Escherichia coli CFT073
caccagcgccaccacccagaac

SEQ ID NO: 2644928 - RNA, 11 nt, Escherichia coli CFT073
caccagcgccg

SEQ ID NO: 2644929 - RNA, 14 nt, Escherichia coli CFT073
caccagcgccgccc

SEQ ID NO: 2644930 - RNA, 15 nt, Escherichia coli CFT073
caccagcgccucuuc

SEQ ID NO: 2644931 - RNA, 17 nt, Escherichia coli CFT073
caccagcgccucuucca

SEQ ID NO: 2644932 - RNA, 16 nt, Escherichia coli CFT073
caccagcgccugcgcg

SEQ ID NO: 2644933 - RNA, 15 nt, Escherichia coli CFT073
caccgcagcaaccgu

SEQ ID NO: 2644934 - RNA, 16 nt, Escherichia coli CFT073
caccgcaggcagugga

SEQ ID NO: 2644935 - RNA, 17 nt, Escherichia coli CFT073
caccgcauccggcauca

SEQ ID NO: 2644936 - RNA, 17 nt, Escherichia coli CFT073
caccgcauuggacaggu

SEQ ID NO: 2644937 - RNA, 14 nt, Escherichia coli CFT073
caccgccaaagaua

SEQ ID NO: 2644938 - RNA, 13 nt, Escherichia coli CFT073
caccgccaacaag

SEQ ID NO: 2644939 - RNA, 15 nt, Escherichia coli CFT073
caccgccaaccagcg

SEQ ID NO: 2644940 - RNA, 13 nt, Escherichia coli CFT073
caccgccagcagc

SEQ ID NO: 2644941 - RNA, 14 nt, Escherichia coli CFT073
caccgccagcagca

SEQ ID NO: 2644942 - RNA, 16 nt, Escherichia coli CFT073
caccgccagcaggaac

SEQ ID NO: 2644943 - RNA, 18 nt, Escherichia coli CFT073
caccgccaggcacuuccc

SEQ ID NO: 2644944 - RNA, 16 nt, Escherichia coli CFT073
caccgcccaccauaau

SEQ ID NO: 2644945 - RNA, 18 nt, Escherichia coli CFT073
caccgcccaccauaauca

SEQ ID NO: 2644946 - RNA, 15 nt, Escherichia coli CFT073
caccgcccauccagg

SEQ ID NO: 2644947 - RNA, 20 nt, Escherichia coli CFT073
caccgcccugcaucaugcgc

SEQ ID NO: 2644948 - RNA, 11 nt, Escherichia coli CFT073
caccgccgcca

SEQ ID NO: 2644949 - RNA, 12 nt, Escherichia coli CFT073
caccgccgccaa

SEQ ID NO: 2644950 - RNA, 19 nt, Escherichia coli CFT073
caccgccgccacuucuggc

SEQ ID NO: 2644951 - RNA, 15 nt, Escherichia coli CFT073
caccgccgccgccac

SEQ ID NO: 2644952 - RNA, 14 nt, Escherichia coli CFT073
caccgccuccagcg

SEQ ID NO: 2644953 - RNA, 21 nt, Escherichia coli CFT073
caccgccugcugauaagacgc

SEQ ID NO: 2644954 - RNA, 16 nt, Escherichia coli CFT073
caccgccuucguaacc

SEQ ID NO: 2644955 - RNA, 15 nt, Escherichia coli CFT073
caccgcgaaaacaau

SEQ ID NO: 2644956 - RNA, 18 nt, Escherichia coli CFT073
caccgcgaauauaagcgc

SEQ ID NO: 2644957 - RNA, 23 nt, Escherichia coli CFT073
caccgcgauauuggucugcagau

SEQ ID NO: 2644958 - RNA, 13 nt, Escherichia coli CFT073
caccgcgcccaca

SEQ ID NO: 2644959 - RNA, 23 nt, Escherichia coli CFT073
caccgcgcccacauaaccaauca

SEQ ID NO: 2644960 - RNA, 17 nt, Escherichia coli CFT073
caccgcgcggcugguaa

SEQ ID NO: 2644961 - RNA, 19 nt, Escherichia coli CFT073
caccgcgcggcugguaaca

SEQ ID NO: 2644962 - RNA, 19 nt, Escherichia coli CFT073
caccgcgcuaaggccgcca

SEQ ID NO: 2644963 - RNA, 16 nt, Escherichia coli CFT073
caccgcggaacgcacu

SEQ ID NO: 2644964 - RNA, 18 nt, Escherichia coli CFT073
caccgcguaugcccagcg

SEQ ID NO: 2644965 - RNA, 16 nt, Escherichia coli CFT073
caccgcgugagaacac

SEQ ID NO: 2644966 - RNA, 21 nt, Escherichia coli CFT073
caccgcgugagaacacgaccu

SEQ ID NO: 2644967 - RNA, 20 nt, Escherichia coli CFT073
caccgcguuuagcaguucau

SEQ ID NO: 2644968 - RNA, 23 nt, Escherichia coli CFT073
caccgcguuuagcaguucaucaa

SEQ ID NO: 2644969 - RNA, 17 nt, Escherichia coli CFT073
caccgcuaacugcugcg

SEQ ID NO: 2644970 - RNA, 21 nt, Escherichia coli CFT073
caccgcuguugccagcagcaa

SEQ ID NO: 2644971 - RNA, 22 nt, Escherichia coli CFT073
caccgcuguugcuuccaccauc

SEQ ID NO: 2644972 - RNA, 18 nt, Escherichia coli CFT073
caccgcuucaacagcggc

SEQ ID NO: 2644973 - RNA, 20 nt, Escherichia coli CFT073
caccgcuucacucccugccc

SEQ ID NO: 2644974 - RNA, 21 nt, Escherichia coli CFT073
caccgcuucgcucacaucaug

SEQ ID NO: 2644975 - RNA, 23 nt, Escherichia coli CFT073
caccggaaauugcugccgcucca

SEQ ID NO: 2644976 - RNA, 19 nt, Escherichia coli CFT073
caccggaacuuucaccacg

SEQ ID NO: 2644977 - RNA, 21 nt, Escherichia coli CFT073
caccggaauaauaaugucucu

SEQ ID NO: 2644978 - RNA, 22 nt, Escherichia coli CFT073
caccggaauaauaaugucucug

SEQ ID NO: 2644979 - RNA, 17 nt, Escherichia coli CFT073
caccggagcugccagcg

SEQ ID NO: 2644980 - RNA, 19 nt, Escherichia coli CFT073
caccggauaacgccggcuu

SEQ ID NO: 2644981 - RNA, 22 nt, Escherichia coli CFT073
caccggcaagcccugaucgcgc

SEQ ID NO: 2644982 - RNA, 13 nt, Escherichia coli CFT073
caccggcaccacu

SEQ ID NO: 2644983 - RNA, 14 nt, Escherichia coli CFT073
caccggcaccacuu

SEQ ID NO: 2644984 - RNA, 12 nt, Escherichia coli CFT073
caccggcaucaa

SEQ ID NO: 2644985 - RNA, 16 nt, Escherichia coli CFT073
caccggcaucaacggg

SEQ ID NO: 2644986 - RNA, 22 nt, Escherichia coli CFT073
caccggcauuuuuuagcgccag

SEQ ID NO: 2644987 - RNA, 18 nt, Escherichia coli CFT073
caccggcauuuuuugcug

SEQ ID NO: 2644988 - RNA, 19 nt, Escherichia coli CFT073
caccgggggguugccgcca

SEQ ID NO: 2644989 - RNA, 16 nt, Escherichia coli CFT073
caccgguacaaacauc

SEQ ID NO: 2644990 - RNA, 18 nt, Escherichia coli CFT073
caccgguacaaacaucau

SEQ ID NO: 2644991 - RNA, 15 nt, Escherichia coli CFT073
caccgguaucugcca

SEQ ID NO: 2644992 - RNA, 19 nt, Escherichia coli CFT073
caccgguaucugccagcac

SEQ ID NO: 2644993 - RNA, 24 nt, Escherichia coli CFT073
caccggugaccaucagcaugacaa

SEQ ID NO: 2644994 - RNA, 22 nt, Escherichia coli CFT073
caccggugauuauugucgugcc

SEQ ID NO: 2644995 - RNA, 17 nt, Escherichia coli CFT073
caccguacuccugugca

SEQ ID NO: 2644996 - RNA, 13 nt, Escherichia coli CFT073
caccguagaaggc

SEQ ID NO: 2644997 - RNA, 13 nt, Escherichia coli CFT073
caccguauccagu

SEQ ID NO: 2644998 - RNA, 15 nt, Escherichia coli CFT073
caccgucaaauccag

SEQ ID NO: 2644999 - RNA, 21 nt, Escherichia coli CFT073
caccgucaaauccagaccaau

SEQ ID NO: 2645000 - RNA, 15 nt, Escherichia coli CFT073
caccgucaacguuuu

SEQ ID NO: 2645001 - RNA, 15 nt, Escherichia coli CFT073
caccgucacuucuuc

SEQ ID NO: 2645002 - RNA, 14 nt, Escherichia coli CFT073
caccgucaucacgc

SEQ ID NO: 2645003 - RNA, 13 nt, Escherichia coli CFT073
caccguccagcgu

SEQ ID NO: 2645004 - RNA, 12 nt, Escherichia coli CFT073
caccgugaaaga

SEQ ID NO: 2645005 - RNA, 20 nt, Escherichia coli CFT073
caccgugaaagagaucaaag

SEQ ID NO: 2645006 - RNA, 16 nt, Escherichia coli CFT073
caccgugaauugcacu

SEQ ID NO: 2645007 - RNA, 16 nt, Escherichia coli CFT073
caccgugauccgccgc

SEQ ID NO: 2645008 - RNA, 16 nt, Escherichia coli CFT073
caccgugcacuucugc

SEQ ID NO: 2645009 - RNA, 16 nt, Escherichia coli CFT073
caccguguucaugacc

SEQ ID NO: 2645010 - RNA, 17 nt, Escherichia coli CFT073
caccguuaauccacgcu

SEQ ID NO: 2645011 - RNA, 20 nt, Escherichia coli CFT073
caccguuaauccacgcugua

SEQ ID NO: 2645012 - RNA, 14 nt, Escherichia coli CFT073
caccguuaccggac

SEQ ID NO: 2645013 - RNA, 18 nt, Escherichia coli CFT073
caccguugaaaucgucgc

SEQ ID NO: 2645014 - RNA, 21 nt, Escherichia coli CFT073
caccguugagguugaucuucu

SEQ ID NO: 2645015 - RNA, 18 nt, Escherichia coli CFT073
caccguugugaaaauaac

SEQ ID NO: 2645016 - RNA, 22 nt, Escherichia coli CFT073
caccguuuccauaucgcuggcu

SEQ ID NO: 2645017 - RNA, 17 nt, Escherichia coli CFT073
caccuacgcccgccagu

SEQ ID NO: 2645018 - RNA, 14 nt, Escherichia coli CFT073
caccuacgcuggca

SEQ ID NO: 2645019 - RNA, 18 nt, Escherichia coli CFT073
caccucaccuuucgguuc

SEQ ID NO: 2645020 - RNA, 15 nt, Escherichia coli CFT073
caccucagccagcgg

SEQ ID NO: 2645021 - RNA, 18 nt, Escherichia coli CFT073
caccucaguacccgcguu

SEQ ID NO: 2645022 - RNA, 15 nt, Escherichia coli CFT073
caccucaucaccaca

SEQ ID NO: 2645023 - RNA, 23 nt, Escherichia coli CFT073
caccucauccugacaggcccccc

SEQ ID NO: 2645024 - RNA, 21 nt, Escherichia coli CFT073
caccuccgcuaaauccgccgc

SEQ ID NO: 2645025 - RNA, 22 nt, Escherichia coli CFT073
caccuccgcuaaauccgccgcc

SEQ ID NO: 2645026 - RNA, 20 nt, Escherichia coli CFT073
caccucugcaacgucuuccc

SEQ ID NO: 2645027 - RNA, 17 nt, Escherichia coli CFT073
caccucugucgaugcgc

SEQ ID NO: 2645028 - RNA, 14 nt, Escherichia coli CFT073
caccucuuccagcg

SEQ ID NO: 2645029 - RNA, 17 nt, Escherichia coli CFT073
caccucuuccugaguaa

SEQ ID NO: 2645030 - RNA, 15 nt, Escherichia coli CFT073
caccucuuucaccaa

SEQ ID NO: 2645031 - RNA, 23 nt, Escherichia coli CFT073
caccucuuuuucgacuuccacca

SEQ ID NO: 2645032 - RNA, 16 nt, Escherichia coli CFT073
caccugaagaaaaucc

SEQ ID NO: 2645033 - RNA, 20 nt, Escherichia coli CFT073
caccugaccgagccagugcc

SEQ ID NO: 2645034 - RNA, 15 nt, Escherichia coli CFT073
caccugauaacggcc

SEQ ID NO: 2645035 - RNA, 18 nt, Escherichia coli CFT073
caccugauacgcgccaau

SEQ ID NO: 2645036 - RNA, 16 nt, Escherichia coli CFT073
caccugaucaauuucu

SEQ ID NO: 2645037 - RNA, 18 nt, Escherichia coli CFT073
caccugaucaauuucugc

SEQ ID NO: 2645038 - RNA, 20 nt, Escherichia coli CFT073
caccugaucaauuucugcgc

SEQ ID NO: 2645039 - RNA, 20 nt, Escherichia coli CFT073
caccugauuaguggcacacu

SEQ ID NO: 2645040 - RNA, 17 nt, Escherichia coli CFT073
caccugauugaccgcca

SEQ ID NO: 2645041 - RNA, 18 nt, Escherichia coli CFT073
cacgcccauaacgcgcgc

SEQ ID NO: 2645042 - RNA, 17 nt, Escherichia coli CFT073
cacgcccauacauacca

SEQ ID NO: 2645043 - RNA, 19 nt, Escherichia coli CFT073
cacgcccgcacugucgcca

SEQ ID NO: 2645044 - RNA, 16 nt, Escherichia coli CFT073
cacgccgcaucaggca

SEQ ID NO: 2645045 - RNA, 12 nt, Escherichia coli CFT073
cacgccgcaucc

SEQ ID NO: 2645046 - RNA, 19 nt, Escherichia coli CFT073
cacgccgcauccggcaagu

SEQ ID NO: 2645047 - RNA, 21 nt, Escherichia coli CFT073
cacgccgcauccggcaaucaa

SEQ ID NO: 2645048 - RNA, 15 nt, Escherichia coli CFT073
cacgccgccagacca

SEQ ID NO: 2645049 - RNA, 13 nt, Escherichia coli CFT073
cacgccgcuggca

SEQ ID NO: 2645050 - RNA, 20 nt, Escherichia coli CFT073
cacgccgcugucuaccagca

SEQ ID NO: 2645051 - RNA, 22 nt, Escherichia coli CFT073
cacgccgguaugcgugcuucau

SEQ ID NO: 2645052 - RNA, 17 nt, Escherichia coli CFT073
cacgccgguucccagac

SEQ ID NO: 2645053 - RNA, 20 nt, Escherichia coli CFT073
cacgccugcaagcgucgcgc

SEQ ID NO: 2645054 - RNA, 21 nt, Escherichia coli CFT073
cacgccuuccugauaacacag

SEQ ID NO: 2645055 - RNA, 16 nt, Escherichia coli CFT073
cacgccuucuuccagc

SEQ ID NO: 2645056 - RNA, 18 nt, Escherichia coli CFT073
cacgccuucuuccagcgc

SEQ ID NO: 2645057 - RNA, 18 nt, Escherichia coli CFT073
cacgcgauggcuuuccac

SEQ ID NO: 2645058 - RNA, 20 nt, Escherichia coli CFT073
cacgcgauggcuuuccaccu

SEQ ID NO: 2645059 - RNA, 15 nt, Escherichia coli CFT073
cacgcgccacgcacg

SEQ ID NO: 2645060 - RNA, 16 nt, Escherichia coli CFT073
cacgcgccagcuucac

SEQ ID NO: 2645061 - RNA, 19 nt, Escherichia coli CFT073
cacgcgccugcagcggcca

SEQ ID NO: 2645062 - RNA, 19 nt, Escherichia coli CFT073
cacgcgcguugauuaaccg

SEQ ID NO: 2645063 - RNA, 20 nt, Escherichia coli CFT073
cacgcgcugagacccggcca

SEQ ID NO: 2645064 - RNA, 20 nt, Escherichia coli CFT073
cacgcgcuguaauuucacac

SEQ ID NO: 2645065 - RNA, 23 nt, Escherichia coli CFT073
cacgcgcuguaauuucacaccau

SEQ ID NO: 2645066 - RNA, 14 nt, Escherichia coli CFT073
cacgcggaucgcca

SEQ ID NO: 2645067 - RNA, 23 nt, Escherichia coli CFT073
cacgcgggauaaucgcgccgcga

SEQ ID NO: 2645068 - RNA, 15 nt, Escherichia coli CFT073
cacgcgguaugguca

SEQ ID NO: 2645069 - RNA, 17 nt, Escherichia coli CFT073
cacgcguaauauccagc

SEQ ID NO: 2645070 - RNA, 14 nt, Escherichia coli CFT073
cacgcuacucgccu

SEQ ID NO: 2645071 - RNA, 19 nt, Escherichia coli CFT073
cacgcuacucgccugccac

SEQ ID NO: 2645072 - RNA, 16 nt, Escherichia coli CFT073
cacgcucaaagacgcg

SEQ ID NO: 2645073 - RNA, 12 nt, Escherichia coli CFT073
cacgcucaccca

SEQ ID NO: 2645074 - RNA, 15 nt, Escherichia coli CFT073
cacgcucagcaacau

SEQ ID NO: 2645075 - RNA, 14 nt, Escherichia coli CFT073
cacgcucagcaauc

SEQ ID NO: 2645076 - RNA, 22 nt, Escherichia coli CFT073
cacgcucagcaaucgcauauuu

SEQ ID NO: 2645077 - RNA, 14 nt, Escherichia coli CFT073
cacgcucaggcggu

SEQ ID NO: 2645078 - RNA, 13 nt, Escherichia coli CFT073
cacgcucccagca

SEQ ID NO: 2645079 - RNA, 15 nt, Escherichia coli CFT073
cacgcucgcuggcgu

SEQ ID NO: 2645080 - RNA, 17 nt, Escherichia coli CFT073
cacgcucuggaugaaau

SEQ ID NO: 2645081 - RNA, 14 nt, Escherichia coli CFT073
cacgcucuguucug

SEQ ID NO: 2645082 - RNA, 20 nt, Escherichia coli CFT073
cacgcucuguucugcgccug

SEQ ID NO: 2645083 - RNA, 16 nt, Escherichia coli CFT073
cacgcugacgcaucug

SEQ ID NO: 2645084 - RNA, 22 nt, Escherichia coli CFT073
cacgcugcaaggcaacgcagcc

SEQ ID NO: 2645085 - RNA, 12 nt, Escherichia coli CFT073
cacgcugccugg

SEQ ID NO: 2645086 - RNA, 21 nt, Escherichia coli CFT073
cacgcuggacgccgaugcgcu

SEQ ID NO: 2645087 - RNA, 14 nt, Escherichia coli CFT073
cacgcuguucaucc

SEQ ID NO: 2645088 - RNA, 15 nt, Escherichia coli CFT073
cacgcuuacugguca

SEQ ID NO: 2645089 - RNA, 17 nt, Escherichia coli CFT073
cacgcuucacugccgga

SEQ ID NO: 2645090 - RNA, 20 nt, Escherichia coli CFT073
cacgcuuugauccgccagau

SEQ ID NO: 2645091 - RNA, 21 nt, Escherichia coli CFT073
cacgcuuuuaacacguugcaa

SEQ ID NO: 2645092 - RNA, 22 nt, Escherichia coli CFT073
cacgcuuuucaucagaucgcga

SEQ ID NO: 2645093 - RNA, 17 nt, Escherichia coli CFT073
cacggaaagcagcauac

SEQ ID NO: 2645094 - RNA, 18 nt, Escherichia coli CFT073
cacggaacaacggcaaac

SEQ ID NO: 2645095 - RNA, 14 nt, Escherichia coli CFT073
cacggaauaaaccg

SEQ ID NO: 2645096 - RNA, 18 nt, Escherichia coli CFT073
cacggaauaaaccguggc

SEQ ID NO: 2645097 - RNA, 14 nt, Escherichia coli CFT073
cacggacuuaugag

SEQ ID NO: 2645098 - RNA, 16 nt, Escherichia coli CFT073
cacggauaaacguggu

SEQ ID NO: 2645099 - RNA, 21 nt, Escherichia coli CFT073
cacggauauauccguggcuuu

SEQ ID NO: 2645100 - RNA, 15 nt, Escherichia coli CFT073
cacggcaaacugcgc

SEQ ID NO: 2645101 - RNA, 14 nt, Escherichia coli CFT073
cacggcaacgccgu

SEQ ID NO: 2645102 - RNA, 13 nt, Escherichia coli CFT073
cacggcagcaacu

SEQ ID NO: 2645103 - RNA, 22 nt, Escherichia coli CFT073
cacggcaggaucugcgcggcaa

SEQ ID NO: 2645104 - RNA, 14 nt, Escherichia coli CFT073
cacggcaugaaagc

SEQ ID NO: 2645105 - RNA, 17 nt, Escherichia coli CFT073
cacggccauauccagcc

SEQ ID NO: 2645106 - RNA, 20 nt, Escherichia coli CFT073
cacggccauauccagccaac

SEQ ID NO: 2645107 - RNA, 15 nt, Escherichia coli CFT073
cacggccaucacgga

SEQ ID NO: 2645108 - RNA, 17 nt, Escherichia coli CFT073
cacggccugucggagcu

SEQ ID NO: 2645109 - RNA, 13 nt, Escherichia coli CFT073
cacggcgcaugac

SEQ ID NO: 2645110 - RNA, 21 nt, Escherichia coli CFT073
cacggcgcauuugcggcagag

SEQ ID NO: 2645111 - RNA, 22 nt, Escherichia coli CFT073
cacggcguuuauucuggagugu

SEQ ID NO: 2645112 - RNA, 18 nt, Escherichia coli CFT073
cacggcuaccguugcggc

SEQ ID NO: 2645113 - RNA, 14 nt, Escherichia coli CFT073
cacggcucaaccuu

SEQ ID NO: 2645114 - RNA, 19 nt, Escherichia coli CFT073
cacggcucaaccuucuucg

SEQ ID NO: 2645115 - RNA, 15 nt, Escherichia coli CFT073
cacggcuccagcaau

SEQ ID NO: 2645116 - RNA, 17 nt, Escherichia coli CFT073
cacggcuccagcaaugu

SEQ ID NO: 2645117 - RNA, 18 nt, Escherichia coli CFT073
cacggcuccagcaauguc

SEQ ID NO: 2645118 - RNA, 21 nt, Escherichia coli CFT073
cacggcugcuaauauuuucgc

SEQ ID NO: 2645119 - RNA, 22 nt, Escherichia coli CFT073
cacgggaaauagcuuaacggca

SEQ ID NO: 2645120 - RNA, 14 nt, Escherichia coli CFT073
cacgggacgcugca

SEQ ID NO: 2645121 - RNA, 21 nt, Escherichia coli CFT073
cacgggcaauaucgacgccag

SEQ ID NO: 2645122 - RNA, 14 nt, Escherichia coli CFT073
cacgggcgcggaaa

SEQ ID NO: 2645123 - RNA, 23 nt, Escherichia coli CFT073
cacgggugagggcguagagagau

SEQ ID NO: 2645124 - RNA, 15 nt, Escherichia coli CFT073
cacgguacucaucac

SEQ ID NO: 2645125 - RNA, 16 nt, Escherichia coli CFT073
cacgguaucaagcccg

SEQ ID NO: 2645126 - RNA, 23 nt, Escherichia coli CFT073
cacggucauaaucauuaacggcc

SEQ ID NO: 2645127 - RNA, 14 nt, Escherichia coli CFT073
cacggucauaugca

SEQ ID NO: 2645128 - RNA, 22 nt, Escherichia coli CFT073
cacggucggccaguauuugucu

SEQ ID NO: 2645129 - RNA, 22 nt, Escherichia coli CFT073
cacgguuaauggccggaagcua

SEQ ID NO: 2645130 - RNA, 23 nt, Escherichia coli CFT073
cacgguucgcuggcaaguucguc

SEQ ID NO: 2645131 - RNA, 21 nt, Escherichia coli CFT073
cacgguuucuacaagcagaga

SEQ ID NO: 2645132 - RNA, 22 nt, Escherichia coli CFT073
cacgguuuuuugcagcaaccag

SEQ ID NO: 2645133 - RNA, 13 nt, Escherichia coli CFT073
cacguaagcugga

SEQ ID NO: 2645134 - RNA, 18 nt, Escherichia coli CFT073
cacguaauaaaaucuauu

SEQ ID NO: 2645135 - RNA, 12 nt, Escherichia coli CFT073
cacguagccacg

SEQ ID NO: 2645136 - RNA, 15 nt, Escherichia coli CFT073
cacgucaucagcaau

SEQ ID NO: 2645137 - RNA, 17 nt, Escherichia coli CFT073
cacgucaucagcaauuu

SEQ ID NO: 2645138 - RNA, 18 nt, Escherichia coli CFT073
cacguccaguggcauccg

SEQ ID NO: 2645139 - RNA, 11 nt, Escherichia coli CFT073
cacgucugaag

SEQ ID NO: 2645140 - RNA, 20 nt, Escherichia coli CFT073
cacgugcuuauaacugcccg

SEQ ID NO: 2645141 - RNA, 21 nt, Escherichia coli CFT073
cacguucaaagcggugaucaa

SEQ ID NO: 2645142 - RNA, 23 nt, Escherichia coli CFT073
cacguuccuggaaccagugaaua

SEQ ID NO: 2645143 - RNA, 15 nt, Escherichia coli CFT073
cacguuccuugcugc

SEQ ID NO: 2645144 - RNA, 15 nt, Escherichia coli CFT073
cacguugccagcaac

SEQ ID NO: 2645145 - RNA, 17 nt, Escherichia coli CFT073
cacguugcgacaaacca

SEQ ID NO: 2645146 - RNA, 20 nt, Escherichia coli CFT073
cacguugcuuauugccggau

SEQ ID NO: 2645147 - RNA, 16 nt, Escherichia coli CFT073
cacguuuaacacgcuc

SEQ ID NO: 2645148 - RNA, 15 nt, Escherichia coli CFT073
cacguuuuucaucca

SEQ ID NO: 2645149 - RNA, 15 nt, Escherichia coli CFT073
cacugccacuuuuuc

SEQ ID NO: 2645150 - RNA, 14 nt, Escherichia coli CFT073
cacugccagaauag

SEQ ID NO: 2645151 - RNA, 21 nt, Escherichia coli CFT073
cacugccagaauagccgcagc

SEQ ID NO: 2645152 - RNA, 14 nt, Escherichia coli CFT073
cacugccagcccgg

SEQ ID NO: 2645153 - RNA, 18 nt, Escherichia coli CFT073
cacugccagcccggcagc

SEQ ID NO: 2645154 - RNA, 19 nt, Escherichia coli CFT073
cacugccagugucggaugc

SEQ ID NO: 2645155 - RNA, 14 nt, Escherichia coli CFT073
cacugccgccuucc

SEQ ID NO: 2645156 - RNA, 18 nt, Escherichia coli CFT073
cacugccggggaaguaaa

SEQ ID NO: 2645157 - RNA, 17 nt, Escherichia coli CFT073
cacugccguacaggcag

SEQ ID NO: 2645158 - RNA, 16 nt, Escherichia coli CFT073
cacugcgacaccagca

SEQ ID NO: 2645159 - RNA, 20 nt, Escherichia coli CFT073
cacugcgaccagugaaaaug

SEQ ID NO: 2645160 - RNA, 12 nt, Escherichia coli CFT073
cacugcgagaaa

SEQ ID NO: 2645161 - RNA, 13 nt, Escherichia coli CFT073
cacugcgagaaaa

SEQ ID NO: 2645162 - RNA, 18 nt, Escherichia coli CFT073
cacugcgagaaaaagccu

SEQ ID NO: 2645163 - RNA, 13 nt, Escherichia coli CFT073
cacugcgcccgcc

SEQ ID NO: 2645164 - RNA, 12 nt, Escherichia coli CFT073
cacugcgccgcc

SEQ ID NO: 2645165 - RNA, 18 nt, Escherichia coli CFT073
cacugcgcucuaaaauca

SEQ ID NO: 2645166 - RNA, 14 nt, Escherichia coli CFT073
cacugcgcucuucu

SEQ ID NO: 2645167 - RNA, 18 nt, Escherichia coli CFT073
cacugcucgcagaaauac

SEQ ID NO: 2645168 - RNA, 22 nt, Escherichia coli CFT073
cacugcucgcagaaauaccccg

SEQ ID NO: 2645169 - RNA, 18 nt, Escherichia coli CFT073
cacugcugauaauccagu

SEQ ID NO: 2645170 - RNA, 15 nt, Escherichia coli CFT073
cacuggccucuucuc

SEQ ID NO: 2645171 - RNA, 21 nt, Escherichia coli CFT073
cacuggccuuuucacaacgaa

SEQ ID NO: 2645172 - RNA, 22 nt, Escherichia coli CFT073
cacuggccuuuucacaacgaau

SEQ ID NO: 2645173 - RNA, 18 nt, Escherichia coli CFT073
cacuggcgacacgcauca

SEQ ID NO: 2645174 - RNA, 13 nt, Escherichia coli CFT073
cacuggcgcgccu

SEQ ID NO: 2645175 - RNA, 21 nt, Escherichia coli CFT073
cacuggcugggcgucaucccg

SEQ ID NO: 2645176 - RNA, 19 nt, Escherichia coli CFT073
cacuggguauaccggcguu

SEQ ID NO: 2645177 - RNA, 17 nt, Escherichia coli CFT073
cacuggugaaagagcca

SEQ ID NO: 2645178 - RNA, 14 nt, Escherichia coli CFT073
cacugguggcagug

SEQ ID NO: 2645179 - RNA, 19 nt, Escherichia coli CFT073
cacugguucccaacaacag

SEQ ID NO: 2645180 - RNA, 15 nt, Escherichia coli CFT073
cacugguucccagag

SEQ ID NO: 2645181 - RNA, 16 nt, Escherichia coli CFT073
cacuguaagccaccga

SEQ ID NO: 2645182 - RNA, 22 nt, Escherichia coli CFT073
cacugucaucgacaaaaacccu

SEQ ID NO: 2645183 - RNA, 18 nt, Escherichia coli CFT073
cacugucgagaucgcggc

SEQ ID NO: 2645184 - RNA, 13 nt, Escherichia coli CFT073
cacugugccggua

SEQ ID NO: 2645185 - RNA, 14 nt, Escherichia coli CFT073
cacuguucauuaaa

SEQ ID NO: 2645186 - RNA, 15 nt, Escherichia coli CFT073
cacuguucauugaua

SEQ ID NO: 2645187 - RNA, 22 nt, Escherichia coli CFT073
cacuguucuggcguaucuccag

SEQ ID NO: 2645188 - RNA, 12 nt, Escherichia coli CFT073
cacuguugcugu

SEQ ID NO: 2645189 - RNA, 19 nt, Escherichia coli CFT073
cacuguuugaucugcugcc

SEQ ID NO: 2645190 - RNA, 15 nt, Escherichia coli CFT073
cacuuaaagcaacac

SEQ ID NO: 2645191 - RNA, 17 nt, Escherichia coli CFT073
cacuuaaagcaacacca

SEQ ID NO: 2645192 - RNA, 16 nt, Escherichia coli CFT073
cacuuaccuucacgaa

SEQ ID NO: 2645193 - RNA, 18 nt, Escherichia coli CFT073
cacuuaucucuuccgcau

SEQ ID NO: 2645194 - RNA, 18 nt, Escherichia coli CFT073
cacuucaaauuucauaau

SEQ ID NO: 2645195 - RNA, 22 nt, Escherichia coli CFT073
cacuucaaauuucauaaucuga

SEQ ID NO: 2645196 - RNA, 17 nt, Escherichia coli CFT073
cacuucaaccacauuca

SEQ ID NO: 2645197 - RNA, 15 nt, Escherichia coli CFT073
cacuucaauauuaau

SEQ ID NO: 2645198 - RNA, 20 nt, Escherichia coli CFT073
cacuucacccaucgccagau

SEQ ID NO: 2645199 - RNA, 11 nt, Escherichia coli CFT073
cacuucaccuu

SEQ ID NO: 2645200 - RNA, 15 nt, Escherichia coli CFT073
cacuucacgcugcca

SEQ ID NO: 2645201 - RNA, 14 nt, Escherichia coli CFT073
cacuucaguaaaua

SEQ ID NO: 2645202 - RNA, 17 nt, Escherichia coli CFT073
cacuucauaauccaggu

SEQ ID NO: 2645203 - RNA, 21 nt, Escherichia coli CFT073
cacuucauacuccgucugcgc

SEQ ID NO: 2645204 - RNA, 16 nt, Escherichia coli CFT073
cacuucauaggucauu

SEQ ID NO: 2645205 - RNA, 20 nt, Escherichia coli CFT073
cacuucauauggcacuuuca

SEQ ID NO: 2645206 - RNA, 12 nt, Escherichia coli CFT073
cacuucaucaag

SEQ ID NO: 2645207 - RNA, 20 nt, Escherichia coli CFT073
cacuucaugggcuuucucgc

SEQ ID NO: 2645208 - RNA, 13 nt, Escherichia coli CFT073
cacuuccagcaga

SEQ ID NO: 2645209 - RNA, 23 nt, Escherichia coli CFT073
cacuuccagcaguucgcccgcuu

SEQ ID NO: 2645210 - RNA, 15 nt, Escherichia coli CFT073
cacuuccagcggcca

SEQ ID NO: 2645211 - RNA, 16 nt, Escherichia coli CFT073
cacuucccagccccgc

SEQ ID NO: 2645212 - RNA, 22 nt, Escherichia coli CFT073
cacuuccggugccgguuucacg

SEQ ID NO: 2645213 - RNA, 19 nt, Escherichia coli CFT073
cacuuccugauccgcuuua

SEQ ID NO: 2645214 - RNA, 11 nt, Escherichia coli CFT073
cacuuccugcg

SEQ ID NO: 2645215 - RNA, 14 nt, Escherichia coli CFT073
cacuucgauccagu

SEQ ID NO: 2645216 - RNA, 23 nt, Escherichia coli CFT073
cacuucgcuaccggcgacuuccu

SEQ ID NO: 2645217 - RNA, 18 nt, Escherichia coli CFT073
cacuucgcugacgccugc

SEQ ID NO: 2645218 - RNA, 22 nt, Escherichia coli CFT073
cacuucugaguucggcaugggg

SEQ ID NO: 2645219 - RNA, 23 nt, Escherichia coli CFT073
cacuucugaugcagguacucacc

SEQ ID NO: 2645220 - RNA, 15 nt, Escherichia coli CFT073
cacuucuucacauca

SEQ ID NO: 2645221 - RNA, 16 nt, Escherichia coli CFT073
cacuucuucacaucaa

SEQ ID NO: 2645222 - RNA, 14 nt, Escherichia coli CFT073
cacuucuucagcca

SEQ ID NO: 2645223 - RNA, 16 nt, Escherichia coli CFT073
cacuucuucagccagu

SEQ ID NO: 2645224 - RNA, 23 nt, Escherichia coli CFT073
cacuucuuccagcggcaggccgu

SEQ ID NO: 2645225 - RNA, 20 nt, Escherichia coli CFT073
cacuucuucuuguucaucau

SEQ ID NO: 2645226 - RNA, 20 nt, Escherichia coli CFT073
cacuucuuucacgcccgcgu

SEQ ID NO: 2645227 - RNA, 21 nt, Escherichia coli CFT073
cacuugagccgccaccagaac

SEQ ID NO: 2645228 - RNA, 19 nt, Escherichia coli CFT073
cacuugaguaauuaauacg

SEQ ID NO: 2645229 - RNA, 14 nt, Escherichia coli CFT073
cacuugccugcugu

SEQ ID NO: 2645230 - RNA, 15 nt, Escherichia coli CFT073
cacuugccugcugug

SEQ ID NO: 2645231 - RNA, 17 nt, Escherichia coli CFT073
cacuugccugcugugaa

SEQ ID NO: 2645232 - RNA, 16 nt, Escherichia coli CFT073
cacuugguuugcuggu

SEQ ID NO: 2645233 - RNA, 21 nt, Escherichia coli CFT073
cacuuguaguuacauuuuuau

SEQ ID NO: 2645234 - RNA, 23 nt, Escherichia coli CFT073
cacuugucaccaaucugaaacca

SEQ ID NO: 2645235 - RNA, 16 nt, Escherichia coli CFT073
cacuuuagacacauca

SEQ ID NO: 2645236 - RNA, 23 nt, Escherichia coli CFT073
cacuuuaucgagaaugcugaagu

SEQ ID NO: 2645237 - RNA, 22 nt, Escherichia coli CFT073
cacuuuaucgaucacauccagu

SEQ ID NO: 2645238 - RNA, 16 nt, Escherichia coli CFT073
cacuuuauuaacaagc

SEQ ID NO: 2645239 - RNA, 17 nt, Escherichia coli CFT073
cacuuucacccugacug

SEQ ID NO: 2645240 - RNA, 18 nt, Escherichia coli CFT073
cacuuucagaccgccgau

SEQ ID NO: 2645241 - RNA, 23 nt, Escherichia coli CFT073
cacuuucaucgcggucagcugcu

SEQ ID NO: 2645242 - RNA, 17 nt, Escherichia coli CFT073
cacuuucccuggcauga

SEQ ID NO: 2645243 - RNA, 12 nt, Escherichia coli CFT073
cacuuuccugcu

SEQ ID NO: 2645244 - RNA, 17 nt, Escherichia coli CFT073
cacuuucucgacaucca

SEQ ID NO: 2645245 - RNA, 12 nt, Escherichia coli CFT073
cacuuucugcgc

SEQ ID NO: 2645246 - RNA, 16 nt, Escherichia coli CFT073
cacuuugaucugcguc

SEQ ID NO: 2645247 - RNA, 22 nt, Escherichia coli CFT073
cacuuuggugaaugccugauca

SEQ ID NO: 2645248 - RNA, 14 nt, Escherichia coli CFT073
cacuuuguaggccu

SEQ ID NO: 2645249 - RNA, 18 nt, Escherichia coli CFT073
cacuuuguaggccugaua

SEQ ID NO: 2645250 - RNA, 21 nt, Escherichia coli CFT073
cacuuuguaggccugauaaga

SEQ ID NO: 2645251 - RNA, 15 nt, Escherichia coli CFT073
cacuuuguauccacu

SEQ ID NO: 2645252 - RNA, 14 nt, Escherichia coli CFT073
cacuuugucagcaa

SEQ ID NO: 2645253 - RNA, 15 nt, Escherichia coli CFT073
cacuuugucguaagc

SEQ ID NO: 2645254 - RNA, 17 nt, Escherichia coli CFT073
cacuuugucugcaaucu

SEQ ID NO: 2645255 - RNA, 13 nt, Escherichia coli CFT073
cacuuuucaguua

SEQ ID NO: 2645256 - RNA, 16 nt, Escherichia coli CFT073
cacuuuucaguuacca

SEQ ID NO: 2645257 - RNA, 14 nt, Escherichia coli CFT073
cacuuuucggcaac

SEQ ID NO: 2645258 - RNA, 15 nt, Escherichia coli CFT073
cagaaucgccagcau

SEQ ID NO: 2645259 - RNA, 14 nt, Escherichia coli CFT073
cagaaucgcgcccc

SEQ ID NO: 2645260 - RNA, 16 nt, Escherichia coli CFT073
cagaaucgguccgcca

SEQ ID NO: 2645261 - RNA, 19 nt, Escherichia coli CFT073
cagaaucgguccgccacau

SEQ ID NO: 2645262 - RNA, 22 nt, Escherichia coli CFT073
cagaaucuaagaucccugccau

SEQ ID NO: 2645263 - RNA, 21 nt, Escherichia coli CFT073
cagaaugauauugauaauaaa

SEQ ID NO: 2645264 - RNA, 16 nt, Escherichia coli CFT073
cagaaugaugcgguaa

SEQ ID NO: 2645265 - RNA, 14 nt, Escherichia coli CFT073
cagaaugccucaau

SEQ ID NO: 2645266 - RNA, 20 nt, Escherichia coli CFT073
cagaaugccucaaucagcgg

SEQ ID NO: 2645267 - RNA, 16 nt, Escherichia coli CFT073
cagaauggcauuauuu

SEQ ID NO: 2645268 - RNA, 18 nt, Escherichia coli CFT073
cagaaugguuucauucca

SEQ ID NO: 2645269 - RNA, 22 nt, Escherichia coli CFT073
cagaaugguuucauuccaguaa

SEQ ID NO: 2645270 - RNA, 17 nt, Escherichia coli CFT073
cagaaugguuuugucag

SEQ ID NO: 2645271 - RNA, 15 nt, Escherichia coli CFT073
cagaauuaacgcuga

SEQ ID NO: 2645272 - RNA, 14 nt, Escherichia coli CFT073
cagaauuaauugcu

SEQ ID NO: 2645273 - RNA, 21 nt, Escherichia coli CFT073
cagaauuccgugccagcacca

SEQ ID NO: 2645274 - RNA, 14 nt, Escherichia coli CFT073
cagaauugccgccu

SEQ ID NO: 2645275 - RNA, 14 nt, Escherichia coli CFT073
cagaauuugaggaa

SEQ ID NO: 2645276 - RNA, 17 nt, Escherichia coli CFT073
cagaauuugaggaagcu

SEQ ID NO: 2645277 - RNA, 20 nt, Escherichia coli CFT073
cagaauuugaggaagcugcc

SEQ ID NO: 2645278 - RNA, 14 nt, Escherichia coli CFT073
cagaauuuggugaa

SEQ ID NO: 2645279 - RNA, 13 nt, Escherichia coli CFT073
cagaauuuucccu

SEQ ID NO: 2645280 - RNA, 17 nt, Escherichia coli CFT073
cagacaaaaagaauacg

SEQ ID NO: 2645281 - RNA, 14 nt, Escherichia coli CFT073
cagacaaaacauac

SEQ ID NO: 2645282 - RNA, 12 nt, Escherichia coli CFT073
cagacaaauaac

SEQ ID NO: 2645283 - RNA, 13 nt, Escherichia coli CFT073
cagacaacaguca

SEQ ID NO: 2645284 - RNA, 12 nt, Escherichia coli CFT073
cagacaacauga

SEQ ID NO: 2645285 - RNA, 15 nt, Escherichia coli CFT073
cagacaaggcgauuu

SEQ ID NO: 2645286 - RNA, 18 nt, Escherichia coli CFT073
cagacaauccagcgaaau

SEQ ID NO: 2645287 - RNA, 12 nt, Escherichia coli CFT073
cagacaauugcc

SEQ ID NO: 2645288 - RNA, 11 nt, Escherichia coli CFT073
cagacaccacc

SEQ ID NO: 2645289 - RNA, 23 nt, Escherichia coli CFT073
cagacaccagaauaguguuaacc

SEQ ID NO: 2645290 - RNA, 17 nt, Escherichia coli CFT073
cagacaccgauugcccc

SEQ ID NO: 2645291 - RNA, 23 nt, Escherichia coli CFT073
cagacaccggcgcacaaccgcca

SEQ ID NO: 2645292 - RNA, 16 nt, Escherichia coli CFT073
cagacacgccgccaga

SEQ ID NO: 2645293 - RNA, 17 nt, Escherichia coli CFT073
cagacacgccgccagac

SEQ ID NO: 2645294 - RNA, 22 nt, Escherichia coli CFT073
cagacacuggaaacagccaauc

SEQ ID NO: 2645295 - RNA, 13 nt, Escherichia coli CFT073
cagacagaacgau

SEQ ID NO: 2645296 - RNA, 16 nt, Escherichia coli CFT073
cagacagaacgaugaa

SEQ ID NO: 2645297 - RNA, 12 nt, Escherichia coli CFT073
cagacagccuca

SEQ ID NO: 2645298 - RNA, 15 nt, Escherichia coli CFT073
cagacaucaccagua

SEQ ID NO: 2645299 - RNA, 18 nt, Escherichia coli CFT073
cagacauuaagcaucgca

SEQ ID NO: 2645300 - RNA, 18 nt, Escherichia coli CFT073
cagacauuacaaaauaca

SEQ ID NO: 2645301 - RNA, 21 nt, Escherichia coli CFT073
cagaccaaaacucgcuggcgg

SEQ ID NO: 2645302 - RNA, 21 nt, Escherichia coli CFT073
cagaccaaacucuucgacaau

SEQ ID NO: 2645303 - RNA, 11 nt, Escherichia coli CFT073
cagaccaauag

SEQ ID NO: 2645304 - RNA, 15 nt, Escherichia coli CFT073
cagaccaaucaccac

SEQ ID NO: 2645305 - RNA, 17 nt, Escherichia coli CFT073
cagaccaaucaccacuu

SEQ ID NO: 2645306 - RNA, 18 nt, Escherichia coli CFT073
cagaccaaucccgccaua

SEQ ID NO: 2645307 - RNA, 20 nt, Escherichia coli CFT073
cagaccaaucccgccauaac

SEQ ID NO: 2645308 - RNA, 13 nt, Escherichia coli CFT073
cagaccaauggcu

SEQ ID NO: 2645309 - RNA, 22 nt, Escherichia coli CFT073
cagaccaauggcuuuugccgcc

SEQ ID NO: 2645310 - RNA, 22 nt, Escherichia coli CFT073
cagaccaauuuuucccucuuca

SEQ ID NO: 2645311 - RNA, 13 nt, Escherichia coli CFT073
cagaccacugcgc

SEQ ID NO: 2645312 - RNA, 11 nt, Escherichia coli CFT073
cagaccagaaa

SEQ ID NO: 2645313 - RNA, 16 nt, Escherichia coli CFT073
cagaccagaaacgcca

SEQ ID NO: 2645314 - RNA, 17 nt, Escherichia coli CFT073
cagaccagaaacgccac

SEQ ID NO: 2645315 - RNA, 18 nt, Escherichia coli CFT073
cagaccagaaacgccacc

SEQ ID NO: 2645316 - RNA, 20 nt, Escherichia coli CFT073
cagaccagaaacgccaccau

SEQ ID NO: 2645317 - RNA, 14 nt, Escherichia coli CFT073
cagaccagauugaa

SEQ ID NO: 2645318 - RNA, 23 nt, Escherichia coli CFT073
cagaccagauugaacucgacaua

SEQ ID NO: 2645319 - RNA, 19 nt, Escherichia coli CFT073
cagaccagcaauaaaaaac

SEQ ID NO: 2645320 - RNA, 17 nt, Escherichia coli CFT073
cagaccagcuaccacgc

SEQ ID NO: 2645321 - RNA, 20 nt, Escherichia coli CFT073
cagaccagcuaccacgccga

SEQ ID NO: 2645322 - RNA, 16 nt, Escherichia coli CFT073
cagaccauaaaugcgc

SEQ ID NO: 2645323 - RNA, 19 nt, Escherichia coli CFT073
cagaccaucgucaguaaug

SEQ ID NO: 2645324 - RNA, 17 nt, Escherichia coli CFT073
cagaccccccaggcgca

SEQ ID NO: 2645325 - RNA, 21 nt, Escherichia coli CFT073
cagaccgauacacaucgucgc

SEQ ID NO: 2645326 - RNA, 16 nt, Escherichia coli CFT073
cagaccgcacaccgag

SEQ ID NO: 2645327 - RNA, 15 nt, Escherichia coli CFT073
cagaccgccgauaga

SEQ ID NO: 2645328 - RNA, 15 nt, Escherichia coli CFT073
cagaccgcgcaguac

SEQ ID NO: 2645329 - RNA, 21 nt, Escherichia coli CFT073
cagaccgggaaucgaaaugcc

SEQ ID NO: 2645330 - RNA, 22 nt, Escherichia coli CFT073
cagaccgggaaucgaaaugcca

SEQ ID NO: 2645331 - RNA, 23 nt, Escherichia coli CFT073
cagaccgggaaucgaaaugccaa

SEQ ID NO: 2645332 - RNA, 13 nt, Escherichia coli CFT073
cagaccgugcgca

SEQ ID NO: 2645333 - RNA, 23 nt, Escherichia coli CFT073
cagaccgugcgcagcaucggcgc

SEQ ID NO: 2645334 - RNA, 21 nt, Escherichia coli CFT073
cagaccguggucggaaaagua

SEQ ID NO: 2645335 - RNA, 14 nt, Escherichia coli CFT073
cagaccuaaaaauu

SEQ ID NO: 2645336 - RNA, 22 nt, Escherichia coli CFT073
cagaccuacggauucaaugcaa

SEQ ID NO: 2645337 - RNA, 12 nt, Escherichia coli CFT073
cagaccugaauu

SEQ ID NO: 2645338 - RNA, 20 nt, Escherichia coli CFT073
cagaccugaauuugcuccag

SEQ ID NO: 2645339 - RNA, 21 nt, Escherichia coli CFT073
cagaccugaauuugcuccaga

SEQ ID NO: 2645340 - RNA, 17 nt, Escherichia coli CFT073
cagaccuuaucccgccg

SEQ ID NO: 2645341 - RNA, 18 nt, Escherichia coli CFT073
cagaccuuaucccgccgg

SEQ ID NO: 2645342 - RNA, 23 nt, Escherichia coli CFT073
cagaccuucauagguaaacauca

SEQ ID NO: 2645343 - RNA, 20 nt, Escherichia coli CFT073
cagaccuucgcuaucaaacu

SEQ ID NO: 2645344 - RNA, 21 nt, Escherichia coli CFT073
cagaccuucgcuaucaaacug

SEQ ID NO: 2645345 - RNA, 22 nt, Escherichia coli CFT073
cagaccuuuacggcuugcgcgc

SEQ ID NO: 2645346 - RNA, 16 nt, Escherichia coli CFT073
cagacgacugucuucc

SEQ ID NO: 2645347 - RNA, 23 nt, Escherichia coli CFT073
cagacgacuguuggaaucacuca

SEQ ID NO: 2645348 - RNA, 14 nt, Escherichia coli CFT073
cagacgcaacagaa

SEQ ID NO: 2645349 - RNA, 16 nt, Escherichia coli CFT073
cagacgcaggcgcgcu

SEQ ID NO: 2645350 - RNA, 20 nt, Escherichia coli CFT073
cagacgcaucgcccagccau

SEQ ID NO: 2645351 - RNA, 23 nt, Escherichia coli CFT073
cagacgcaucgcccagccaucga

SEQ ID NO: 2645352 - RNA, 15 nt, Escherichia coli CFT073
cagacgcccgcgccc

SEQ ID NO: 2645353 - RNA, 16 nt, Escherichia coli CFT073
cagacgcccgcgccca

SEQ ID NO: 2645354 - RNA, 18 nt, Escherichia coli CFT073
cagacgccguuccagauu

SEQ ID NO: 2645355 - RNA, 13 nt, Escherichia coli CFT073
cagacgcgccgcc

SEQ ID NO: 2645356 - RNA, 15 nt, Escherichia coli CFT073
cagacgcgccgccac

SEQ ID NO: 2645357 - RNA, 21 nt, Escherichia coli CFT073
cagacgcgccgccaccgccag

SEQ ID NO: 2645358 - RNA, 22 nt, Escherichia coli CFT073
cagacgcgcugagucacaaaug

SEQ ID NO: 2645359 - RNA, 23 nt, Escherichia coli CFT073
cagacgcucuuucaccaguggga

SEQ ID NO: 2645360 - RNA, 16 nt, Escherichia coli CFT073
cagacggagcugccag

SEQ ID NO: 2645361 - RNA, 19 nt, Escherichia coli CFT073
cagacggccccgcgccagc

SEQ ID NO: 2645362 - RNA, 15 nt, Escherichia coli CFT073
cagacggcgacgcgc

SEQ ID NO: 2645363 - RNA, 14 nt, Escherichia coli CFT073
cagacgggcaccga

SEQ ID NO: 2645364 - RNA, 23 nt, Escherichia coli CFT073
cagacgggcauuuucuuccguua

SEQ ID NO: 2645365 - RNA, 17 nt, Escherichia coli CFT073
cagacgguccgcgagau

SEQ ID NO: 2645366 - RNA, 22 nt, Escherichia coli CFT073
cagacgguccgcgagauaacgc

SEQ ID NO: 2645367 - RNA, 13 nt, Escherichia coli CFT073
cagacggucuggu

SEQ ID NO: 2645368 - RNA, 18 nt, Escherichia coli CFT073
cagacgguuggcaauacg

SEQ ID NO: 2645369 - RNA, 18 nt, Escherichia coli CFT073
cagacguccggcgcugca

SEQ ID NO: 2645370 - RNA, 23 nt, Escherichia coli CFT073
cagacguguugucagcucaucca

SEQ ID NO: 2645371 - RNA, 12 nt, Escherichia coli CFT073
cagacguucuuc

SEQ ID NO: 2645372 - RNA, 15 nt, Escherichia coli CFT073
cagacguucuucugc

SEQ ID NO: 2645373 - RNA, 15 nt, Escherichia coli CFT073
cagacguugauaacc

SEQ ID NO: 2645374 - RNA, 17 nt, Escherichia coli CFT073
cagacguuucacggucg

SEQ ID NO: 2645375 - RNA, 16 nt, Escherichia coli CFT073
cagacguuucgccagc

SEQ ID NO: 2645376 - RNA, 17 nt, Escherichia coli CFT073
cagacguuucgccagcc

SEQ ID NO: 2645377 - RNA, 19 nt, Escherichia coli CFT073
cagacguuugcaauuugca

SEQ ID NO: 2645378 - RNA, 13 nt, Escherichia coli CFT073
cagacguuuuuuc

SEQ ID NO: 2645379 - RNA, 15 nt, Escherichia coli CFT073
cagacguuuuuucug

SEQ ID NO: 2645380 - RNA, 16 nt, Escherichia coli CFT073
cagacguuuuuucugc

SEQ ID NO: 2645381 - RNA, 17 nt, Escherichia coli CFT073
cagacuaaaccgcacug

SEQ ID NO: 2645382 - RNA, 23 nt, Escherichia coli CFT073
cagacuaagcugcgggaaauaac

SEQ ID NO: 2645383 - RNA, 14 nt, Escherichia coli CFT073
cagacuacugacga

SEQ ID NO: 2645384 - RNA, 15 nt, Escherichia coli CFT073
cagacuacugacgaa

SEQ ID NO: 2645385 - RNA, 14 nt, Escherichia coli CFT073
cagacucaaaccaa

SEQ ID NO: 2645386 - RNA, 24 nt, Escherichia coli CFT073
cagacucagcaacagguaacccag

SEQ ID NO: 2645387 - RNA, 16 nt, Escherichia coli CFT073
cagacucaucuucggc

SEQ ID NO: 2645388 - RNA, 15 nt, Escherichia coli CFT073
cagacuccagcagug

SEQ ID NO: 2645389 - RNA, 18 nt, Escherichia coli CFT073
cagacugaagcuccgcug

SEQ ID NO: 2645390 - RNA, 15 nt, Escherichia coli CFT073
cagacugaucaucgc

SEQ ID NO: 2645391 - RNA, 21 nt, Escherichia coli CFT073
cagacugaugacaaacgcaaa

SEQ ID NO: 2645392 - RNA, 22 nt, Escherichia coli CFT073
cagacuggagcacugcgcccgc

SEQ ID NO: 2645393 - RNA, 23 nt, Escherichia coli CFT073
cagacuggcgauuauccaugcca

SEQ ID NO: 2645394 - RNA, 15 nt, Escherichia coli CFT073
cagacuguaaaucug

SEQ ID NO: 2645395 - RNA, 21 nt, Escherichia coli CFT073
cagacuuggucgguauuuccg

SEQ ID NO: 2645396 - RNA, 12 nt, Escherichia coli CFT073
cagacuuuucag

SEQ ID NO: 2645397 - RNA, 15 nt, Escherichia coli CFT073
cagacuuuuugcggc

SEQ ID NO: 2645398 - RNA, 18 nt, Escherichia coli CFT073
cagacuuuuugcggcagc

SEQ ID NO: 2645399 - RNA, 16 nt, Escherichia coli CFT073
cagagaaaccacauca

SEQ ID NO: 2645400 - RNA, 20 nt, Escherichia coli CFT073
cagagaaacgccagcagcag

SEQ ID NO: 2645401 - RNA, 17 nt, Escherichia coli CFT073
cagagaacacccagaau

SEQ ID NO: 2645402 - RNA, 20 nt, Escherichia coli CFT073
cagagaacaucaauccaaac

SEQ ID NO: 2645403 - RNA, 20 nt, Escherichia coli CFT073
cagagaaucaugucagagcu

SEQ ID NO: 2645404 - RNA, 14 nt, Escherichia coli CFT073
cagagacaacccgc

SEQ ID NO: 2645405 - RNA, 18 nt, Escherichia coli CFT073
cagagagacauuggcaaa

SEQ ID NO: 2645406 - RNA, 23 nt, Escherichia coli CFT073
cagagagacauuggcaaaaccaa

SEQ ID NO: 2645407 - RNA, 19 nt, Escherichia coli CFT073
cagagagcaaaccgccgau

SEQ ID NO: 2645408 - RNA, 20 nt, Escherichia coli CFT073
cagagagccagccccacagc

SEQ ID NO: 2645409 - RNA, 17 nt, Escherichia coli CFT073
cagagagguuuucaacu

SEQ ID NO: 2645410 - RNA, 15 nt, Escherichia coli CFT073
cagagagucacgcag

SEQ ID NO: 2645411 - RNA, 16 nt, Escherichia coli CFT073
cagagauacaggccac

SEQ ID NO: 2645412 - RNA, 19 nt, Escherichia coli CFT073
cagagauagaacugcauug

SEQ ID NO: 2645413 - RNA, 20 nt, Escherichia coli CFT073
cagagauagaacugcauugu

SEQ ID NO: 2645414 - RNA, 18 nt, Escherichia coli CFT073
cagagaucagauaauauu

SEQ ID NO: 2645415 - RNA, 19 nt, Escherichia coli CFT073
cagagauguugaagaaguc

SEQ ID NO: 2645416 - RNA, 17 nt, Escherichia coli CFT073
cagagauuugcuccagc

SEQ ID NO: 2645417 - RNA, 19 nt, Escherichia coli CFT073
cagagauuugcuccagcga

SEQ ID NO: 2645418 - RNA, 15 nt, Escherichia coli CFT073
cagagcaaaaaucga

SEQ ID NO: 2645419 - RNA, 12 nt, Escherichia coli CFT073
cagagcaaacag

SEQ ID NO: 2645420 - RNA, 13 nt, Escherichia coli CFT073
cagagcaaacagg

SEQ ID NO: 2645421 - RNA, 12 nt, Escherichia coli CFT073
cagagcaauauc

SEQ ID NO: 2645422 - RNA, 23 nt, Escherichia coli CFT073
cagagcacuaacaugacaccaag

SEQ ID NO: 2645423 - RNA, 15 nt, Escherichia coli CFT073
cagagcagcaacaag

SEQ ID NO: 2645424 - RNA, 17 nt, Escherichia coli CFT073
cagagcagcaacaagcc

SEQ ID NO: 2645425 - RNA, 16 nt, Escherichia coli CFT073
cagagcauuacuuucg

SEQ ID NO: 2645426 - RNA, 14 nt, Escherichia coli CFT073
cagagcauucccgc

SEQ ID NO: 2645427 - RNA, 15 nt, Escherichia coli CFT073
cagagccugaauaaa

SEQ ID NO: 2645428 - RNA, 21 nt, Escherichia coli CFT073
cagagccugaauaaacgccau

SEQ ID NO: 2645429 - RNA, 13 nt, Escherichia coli CFT073
cagagccugccaa

SEQ ID NO: 2645430 - RNA, 18 nt, Escherichia coli CFT073
cagagcgauauccagcgc

SEQ ID NO: 2645431 - RNA, 22 nt, Escherichia coli CFT073
cagagcgauauccagcgccaga

SEQ ID NO: 2645432 - RNA, 16 nt, Escherichia coli CFT073
cagagcggccuucuuc

SEQ ID NO: 2645433 - RNA, 20 nt, Escherichia coli CFT073
cagagcggccuucuucuuuc

SEQ ID NO: 2645434 - RNA, 20 nt, Escherichia coli CFT073
cagagcgggcagacaaaaca

SEQ ID NO: 2645435 - RNA, 20 nt, Escherichia coli CFT073
cagagcuaaaaucgccaaac

SEQ ID NO: 2645436 - RNA, 15 nt, Escherichia coli CFT073
cagagcugaauauca

SEQ ID NO: 2645437 - RNA, 20 nt, Escherichia coli CFT073
cagagcugaauaucacgggc

SEQ ID NO: 2645438 - RNA, 22 nt, Escherichia coli CFT073
cagagcuuuguugcgcugaaau

SEQ ID NO: 2645439 - RNA, 16 nt, Escherichia coli CFT073
cagaggaggagagcag

SEQ ID NO: 2645440 - RNA, 15 nt, Escherichia coli CFT073
cagaggauauucugc

SEQ ID NO: 2645441 - RNA, 19 nt, Escherichia coli CFT073
cagaggcauaaagcugccu

SEQ ID NO: 2645442 - RNA, 21 nt, Escherichia coli CFT073
cagaggcauaaagcugccuug

SEQ ID NO: 2645443 - RNA, 15 nt, Escherichia coli CFT073
cagaggcggcaaaau

SEQ ID NO: 2645444 - RNA, 14 nt, Escherichia coli CFT073
cagaggucuuuucu

SEQ ID NO: 2645445 - RNA, 15 nt, Escherichia coli CFT073
cagaggucuuuucuc

SEQ ID NO: 2645446 - RNA, 20 nt, Escherichia coli CFT073
cagaguaacuucaccaguga

SEQ ID NO: 2645447 - RNA, 17 nt, Escherichia coli CFT073
cagaguacgcaguugcu

SEQ ID NO: 2645448 - RNA, 14 nt, Escherichia coli CFT073
cagaguagaaauau

SEQ ID NO: 2645449 - RNA, 13 nt, Escherichia coli CFT073
cagaguauauauu

SEQ ID NO: 2645450 - RNA, 14 nt, Escherichia coli CFT073
cagaguauauauuc

SEQ ID NO: 2645451 - RNA, 11 nt, Escherichia coli CFT073
cagaguaucgc

SEQ ID NO: 2645452 - RNA, 18 nt, Escherichia coli CFT073
cagaguauguauacaaaa

SEQ ID NO: 2645453 - RNA, 17 nt, Escherichia coli CFT073
cagaguauuacccggca

SEQ ID NO: 2645454 - RNA, 21 nt, Escherichia coli CFT073
cagaguauuacccggcacagc

SEQ ID NO: 2645455 - RNA, 19 nt, Escherichia coli CFT073
cagaguauuuccagcucaa

SEQ ID NO: 2645456 - RNA, 18 nt, Escherichia coli CFT073
cagagucagcaaugccag

SEQ ID NO: 2645457 - RNA, 14 nt, Escherichia coli CFT073
cagagucagcacga

SEQ ID NO: 2645458 - RNA, 16 nt, Escherichia coli CFT073
cagagucuuugcuugc

SEQ ID NO: 2645459 - RNA, 15 nt, Escherichia coli CFT073
cagagugaaugguga

SEQ ID NO: 2645460 - RNA, 15 nt, Escherichia coli CFT073
cagagugaccaccaa

SEQ ID NO: 2645461 - RNA, 17 nt, Escherichia coli CFT073
cagagugaccggauacu

SEQ ID NO: 2645462 - RNA, 22 nt, Escherichia coli CFT073
cagagugcccacguugcaucac

SEQ ID NO: 2645463 - RNA, 19 nt, Escherichia coli CFT073
cagagugugaaacaguaag

SEQ ID NO: 2645464 - RNA, 13 nt, Escherichia coli CFT073
cagaguuccugca

SEQ ID NO: 2645465 - RNA, 19 nt, Escherichia coli CFT073
cagaguuccugcauaucgg

SEQ ID NO: 2645466 - RNA, 20 nt, Escherichia coli CFT073
cagaguugagcaguccccac

SEQ ID NO: 2645467 - RNA, 21 nt, Escherichia coli CFT073
cagaguugagcaguccccaca

SEQ ID NO: 2645468 - RNA, 17 nt, Escherichia coli CFT073
cagaguugcaccagcaa

SEQ ID NO: 2645469 - RNA, 18 nt, Escherichia coli CFT073
cagaguuuagcgaauuuu

SEQ ID NO: 2645470 - RNA, 16 nt, Escherichia coli CFT073
cagauaaaacacauca

SEQ ID NO: 2645471 - RNA, 17 nt, Escherichia coli CFT073
cagauaaaacacaucag

SEQ ID NO: 2645472 - RNA, 14 nt, Escherichia coli CFT073
cagauaaaagcuuu

SEQ ID NO: 2645473 - RNA, 20 nt, Escherichia coli CFT073
cagauaaaaugcgaaaaaaa

SEQ ID NO: 2645474 - RNA, 13 nt, Escherichia coli CFT073
cagauuguugaua

SEQ ID NO: 2645475 - RNA, 14 nt, Escherichia coli CFT073
cagauuuugcaggc

SEQ ID NO: 2645476 - RNA, 17 nt, Escherichia coli CFT073
cagauuuugcaggccug

SEQ ID NO: 2645477 - RNA, 20 nt, Escherichia coli CFT073
cagauuuugcaggccugaua

SEQ ID NO: 2645478 - RNA, 21 nt, Escherichia coli CFT073
cagauuuugcaggccugauaa

SEQ ID NO: 2645479 - RNA, 22 nt, Escherichia coli CFT073
cagauuuuuauuaauaucguaa

SEQ ID NO: 2645480 - RNA, 13 nt, Escherichia coli CFT073
cagcaaaacaccc

SEQ ID NO: 2645481 - RNA, 15 nt, Escherichia coli CFT073
cagcaaaagcaggca

SEQ ID NO: 2645482 - RNA, 17 nt, Escherichia coli CFT073
cagcaaaagcaggcacc

SEQ ID NO: 2645483 - RNA, 23 nt, Escherichia coli CFT073
cagcaaaagcaggcaccgcgccc

SEQ ID NO: 2645484 - RNA, 16 nt, Escherichia coli CFT073
cagcaaaaucaccauc

SEQ ID NO: 2645485 - RNA, 17 nt, Escherichia coli CFT073
cagcaaaaucaccauca

SEQ ID NO: 2645486 - RNA, 22 nt, Escherichia coli CFT073
cagcaaaaugguacucggcacg

SEQ ID NO: 2645487 - RNA, 23 nt, Escherichia coli CFT073
cagcaaaaugguacucggcacgu

SEQ ID NO: 2645488 - RNA, 22 nt, Escherichia coli CFT073
cagcaaacugguugaaauaaac

SEQ ID NO: 2645489 - RNA, 17 nt, Escherichia coli CFT073
cagcaaaguaccaucgu

SEQ ID NO: 2645490 - RNA, 14 nt, Escherichia coli CFT073
cagcaaauaaaacu

SEQ ID NO: 2645491 - RNA, 20 nt, Escherichia coli CFT073
cagcaaauaauucaucuuuc

SEQ ID NO: 2645492 - RNA, 21 nt, Escherichia coli CFT073
cagcaaaucguaggaguaauc

SEQ ID NO: 2645493 - RNA, 23 nt, Escherichia coli CFT073
cagcaaauucaccgccugcugau

SEQ ID NO: 2645494 - RNA, 19 nt, Escherichia coli CFT073
cagcaaauucgggcgcuga

SEQ ID NO: 2645495 - RNA, 14 nt, Escherichia coli CFT073
cagcaacaccgcuu

SEQ ID NO: 2645496 - RNA, 19 nt, Escherichia coli CFT073
cagcaacagguaacccagu

SEQ ID NO: 2645497 - RNA, 17 nt, Escherichia coli CFT073
cagcaacaucacgcuga

SEQ ID NO: 2645498 - RNA, 18 nt, Escherichia coli CFT073
cagcaaccaaugccgcca

SEQ ID NO: 2645499 - RNA, 10 nt, Escherichia coli CFT073
cagcaaccac

SEQ ID NO: 2645500 - RNA, 21 nt, Escherichia coli CFT073
cagcaaccacuugcagcucau

SEQ ID NO: 2645501 - RNA, 22 nt, Escherichia coli CFT073
cagcaaccuccgucuggccagu

SEQ ID NO: 2645502 - RNA, 18 nt, Escherichia coli CFT073
cagcaacgaacuaaccgc

SEQ ID NO: 2645503 - RNA, 20 nt, Escherichia coli CFT073
cagcaacgcugauuucucug

SEQ ID NO: 2645504 - RNA, 20 nt, Escherichia coli CFT073
cagcaacggaaaagcaacaa

SEQ ID NO: 2645505 - RNA, 14 nt, Escherichia coli CFT073
cagcaacggccaaa

SEQ ID NO: 2645506 - RNA, 21 nt, Escherichia coli CFT073
cagcaacgggcugaagaagua

SEQ ID NO: 2645507 - RNA, 18 nt, Escherichia coli CFT073
cagcaacgugcuucgcgc

SEQ ID NO: 2645508 - RNA, 23 nt, Escherichia coli CFT073
cagcaacuggcuugccagcaggg

SEQ ID NO: 2645509 - RNA, 16 nt, Escherichia coli CFT073
cagcaacuuaaucauc

SEQ ID NO: 2645510 - RNA, 14 nt, Escherichia coli CFT073
cagcaagaaacuga

SEQ ID NO: 2645511 - RNA, 17 nt, Escherichia coli CFT073
cagcaagaccgcgacca

SEQ ID NO: 2645512 - RNA, 16 nt, Escherichia coli CFT073
cagcaagagcaaauaa

SEQ ID NO: 2645513 - RNA, 17 nt, Escherichia coli CFT073
cagcaagagcaaauaaa

SEQ ID NO: 2645514 - RNA, 18 nt, Escherichia coli CFT073
cagcaagagcaaauaaaa

SEQ ID NO: 2645515 - RNA, 23 nt, Escherichia coli CFT073
cagcaagagguaaauuugccauc

SEQ ID NO: 2645516 - RNA, 21 nt, Escherichia coli CFT073
cagcaagcugugcgauagcaa

SEQ ID NO: 2645517 - RNA, 13 nt, Escherichia coli CFT073
cagcaauaaaaaa

SEQ ID NO: 2645518 - RNA, 14 nt, Escherichia coli CFT073
cagcaauaaaaaaa

SEQ ID NO: 2645519 - RNA, 16 nt, Escherichia coli CFT073
cagcaauaaaaaaaug

SEQ ID NO: 2645520 - RNA, 14 nt, Escherichia coli CFT073
cagcaauaauaaua

SEQ ID NO: 2645521 - RNA, 14 nt, Escherichia coli CFT073
cagcaauaaucaga

SEQ ID NO: 2645522 - RNA, 22 nt, Escherichia coli CFT073
cagcaauaaucagauggcggcu

SEQ ID NO: 2645523 - RNA, 18 nt, Escherichia coli CFT073
cagcaauaaugccagucc

SEQ ID NO: 2645524 - RNA, 22 nt, Escherichia coli CFT073
cagcaauacaaaugaguuauca

SEQ ID NO: 2645525 - RNA, 18 nt, Escherichia coli CFT073
cagcaauacguuucauau

SEQ ID NO: 2645526 - RNA, 14 nt, Escherichia coli CFT073
cagcaauauagcgc

SEQ ID NO: 2645527 - RNA, 22 nt, Escherichia coli CFT073
cagcaauauagcgcauggcagc

SEQ ID NO: 2645528 - RNA, 13 nt, Escherichia coli CFT073
cagcaaucacugc

SEQ ID NO: 2645529 - RNA, 13 nt, Escherichia coli CFT073
cagcaauccccag

SEQ ID NO: 2645530 - RNA, 15 nt, Escherichia coli CFT073
cagcaauccccagac

SEQ ID NO: 2645531 - RNA, 15 nt, Escherichia coli CFT073
cagcaauccugcaug

SEQ ID NO: 2645532 - RNA, 14 nt, Escherichia coli CFT073
cagcaaucgaccag

SEQ ID NO: 2645533 - RNA, 23 nt, Escherichia coli CFT073
cagcaaucgaccaggccaucagc

SEQ ID NO: 2645534 - RNA, 23 nt, Escherichia coli CFT073
cagcaaugacauacagcaccgcc

SEQ ID NO: 2645535 - RNA, 19 nt, Escherichia coli CFT073
cagcaaugcagguaccugu

SEQ ID NO: 2645536 - RNA, 13 nt, Escherichia coli CFT073
cagcaauggaaaa

SEQ ID NO: 2645537 - RNA, 17 nt, Escherichia coli CFT073
cagcaauuuacguuuuu

SEQ ID NO: 2645538 - RNA, 22 nt, Escherichia coli CFT073
cagcaauuuaugaggaugcaga

SEQ ID NO: 2645539 - RNA, 13 nt, Escherichia coli CFT073
cagcaauuucucc

SEQ ID NO: 2645540 - RNA, 17 nt, Escherichia coli CFT073
cagcaauuuuaauaucc

SEQ ID NO: 2645541 - RNA, 15 nt, Escherichia coli CFT073
cagcaauuuuacccg

SEQ ID NO: 2645542 - RNA, 20 nt, Escherichia coli CFT073
cagcacaaacgcaauccagu

SEQ ID NO: 2645543 - RNA, 21 nt, Escherichia coli CFT073
cagcacaaacgcaauccagug

SEQ ID NO: 2645544 - RNA, 22 nt, Escherichia coli CFT073
cagcacaaacgcaauccagugg

SEQ ID NO: 2645545 - RNA, 17 nt, Escherichia coli CFT073
cagcacaauaaucagcc

SEQ ID NO: 2645546 - RNA, 22 nt, Escherichia coli CFT073
cagcacaauaaucagcccaacc

SEQ ID NO: 2645547 - RNA, 15 nt, Escherichia coli CFT073
cagcacacauaacag

SEQ ID NO: 2645548 - RNA, 22 nt, Escherichia coli CFT073
cagcacaccacaucgccgaccg

SEQ ID NO: 2645549 - RNA, 22 nt, Escherichia coli CFT073
cagcacacgauuccaacgaaaa

SEQ ID NO: 2645550 - RNA, 12 nt, Escherichia coli CFT073
cagcacagccag

SEQ ID NO: 2645551 - RNA, 16 nt, Escherichia coli CFT073
cagcacagccagaauc

SEQ ID NO: 2645552 - RNA, 15 nt, Escherichia coli CFT073
cagcacagccagccu

SEQ ID NO: 2645553 - RNA, 19 nt, Escherichia coli CFT073
cagcacagccagccuccaa

SEQ ID NO: 2645554 - RNA, 13 nt, Escherichia coli CFT073
cagcacaggcggg

SEQ ID NO: 2645555 - RNA, 21 nt, Escherichia coli CFT073
cagcacaggcgggugaugaac

SEQ ID NO: 2645556 - RNA, 16 nt, Escherichia coli CFT073
cagcacauagccgaaa

SEQ ID NO: 2645557 - RNA, 15 nt, Escherichia coli CFT073
cagcacaucaucaaa

SEQ ID NO: 2645558 - RNA, 15 nt, Escherichia coli CFT073
cagcacaugcaacuu

SEQ ID NO: 2645559 - RNA, 22 nt, Escherichia coli CFT073
cagcacauuacaggcaucuucc

SEQ ID NO: 2645560 - RNA, 14 nt, Escherichia coli CFT073
cagcaccaaacugg

SEQ ID NO: 2645561 - RNA, 17 nt, Escherichia coli CFT073
cagcaccaaacuggaau

SEQ ID NO: 2645562 - RNA, 22 nt, Escherichia coli CFT073
cagcaccaaacuggaauagcgc

SEQ ID NO: 2645563 - RNA, 14 nt, Escherichia coli CFT073
cagcaccaccgccc

SEQ ID NO: 2645564 - RNA, 16 nt, Escherichia coli CFT073
cagcaccaccgcccgu

SEQ ID NO: 2645565 - RNA, 15 nt, Escherichia coli CFT073
cagcaccacgcagaa

SEQ ID NO: 2645566 - RNA, 16 nt, Escherichia coli CFT073
cagcaccacuuccggc

SEQ ID NO: 2645567 - RNA, 19 nt, Escherichia coli CFT073
cagcaccacuuccggcaac

SEQ ID NO: 2645568 - RNA, 12 nt, Escherichia coli CFT073
cagcaccagaga

SEQ ID NO: 2645569 - RNA, 14 nt, Escherichia coli CFT073
cagcaccagagaac

SEQ ID NO: 2645570 - RNA, 17 nt, Escherichia coli CFT073
cagcaccagagaacuga

SEQ ID NO: 2645571 - RNA, 11 nt, Escherichia coli CFT073
cagcaccagau

SEQ ID NO: 2645572 - RNA, 12 nt, Escherichia coli CFT073
cagcaccagaua

SEQ ID NO: 2645573 - RNA, 23 nt, Escherichia coli CFT073
cagcaccagcaacaacaacacgc

SEQ ID NO: 2645574 - RNA, 14 nt, Escherichia coli CFT073
cagcaccagcuccg

SEQ ID NO: 2645575 - RNA, 24 nt, Escherichia coli CFT073
cagcacccugaguuuucaguaccg

SEQ ID NO: 2645576 - RNA, 21 nt, Escherichia coli CFT073
cagcaccgaaguuaugccagu

SEQ ID NO: 2645577 - RNA, 14 nt, Escherichia coli CFT073
cagcaccgcagaga

SEQ ID NO: 2645578 - RNA, 15 nt, Escherichia coli CFT073
cagcaccgcagagau

SEQ ID NO: 2645579 - RNA, 10 nt, Escherichia coli CFT073
cagcaccgcg

SEQ ID NO: 2645580 - RNA, 18 nt, Escherichia coli CFT073
cagcaccgcgacaaucag

SEQ ID NO: 2645581 - RNA, 15 nt, Escherichia coli CFT073
cagcaccgggccaaa

SEQ ID NO: 2645582 - RNA, 18 nt, Escherichia coli CFT073
cagcaucauaaaugggcu

SEQ ID NO: 2645583 - RNA, 21 nt, Escherichia coli CFT073
cagcaucaugucgcccacgcc

SEQ ID NO: 2645584 - RNA, 16 nt, Escherichia coli CFT073
cagcaucgacauucaa

SEQ ID NO: 2645585 - RNA, 14 nt, Escherichia coli CFT073
cagcaucgaccagg

SEQ ID NO: 2645586 - RNA, 14 nt, Escherichia coli CFT073
cagcaucgccacgg

SEQ ID NO: 2645587 - RNA, 15 nt, Escherichia coli CFT073
cagcaucgccaucaa

SEQ ID NO: 2645588 - RNA, 19 nt, Escherichia coli CFT073
cagcaucgcccccaucgcc

SEQ ID NO: 2645589 - RNA, 21 nt, Escherichia coli CFT073
cagcaucgccgggaguuucag

SEQ ID NO: 2645590 - RNA, 22 nt, Escherichia coli CFT073
cagcaucgcuuugugcucuucc

SEQ ID NO: 2645591 - RNA, 16 nt, Escherichia coli CFT073
cagcaucggcaacgcc

SEQ ID NO: 2645592 - RNA, 18 nt, Escherichia coli CFT073
cagcaucggcaacgccag

SEQ ID NO: 2645593 - RNA, 18 nt, Escherichia coli CFT073
cagcaucggcgcauucga

SEQ ID NO: 2645594 - RNA, 22 nt, Escherichia coli CFT073
cagcaucggugaggaucaccag

SEQ ID NO: 2645595 - RNA, 15 nt, Escherichia coli CFT073
cagcaucgucaucag

SEQ ID NO: 2645596 - RNA, 19 nt, Escherichia coli CFT073
cagcaucgucaucagcucc

SEQ ID NO: 2645597 - RNA, 17 nt, Escherichia coli CFT073
cagcaucgucaucauuc

SEQ ID NO: 2645598 - RNA, 20 nt, Escherichia coli CFT073
cagcaucuccugcaacaggu

SEQ ID NO: 2645599 - RNA, 22 nt, Escherichia coli CFT073
cagcaucucgcgcucuucuuca

SEQ ID NO: 2645600 - RNA, 17 nt, Escherichia coli CFT073
cagcaucuuaccgauga

SEQ ID NO: 2645601 - RNA, 22 nt, Escherichia coli CFT073
cagcaugauuucaucaucaggc

SEQ ID NO: 2645602 - RNA, 18 nt, Escherichia coli CFT073
cagcauggucgcagcggc

SEQ ID NO: 2645603 - RNA, 20 nt, Escherichia coli CFT073
cagcaugugguuaccaucaa

SEQ ID NO: 2645604 - RNA, 23 nt, Escherichia coli CFT073
cagcauuagcauuaacaguagag

SEQ ID NO: 2645605 - RNA, 18 nt, Escherichia coli CFT073
cagcauucaucacaaaau

SEQ ID NO: 2645606 - RNA, 19 nt, Escherichia coli CFT073
cagcauucaucacaaaaua

SEQ ID NO: 2645607 - RNA, 22 nt, Escherichia coli CFT073
cagcauucaucacaaaauagaa

SEQ ID NO: 2645608 - RNA, 19 nt, Escherichia coli CFT073
cagcauucccgccaccauu

SEQ ID NO: 2645609 - RNA, 15 nt, Escherichia coli CFT073
cagcauugcgccagc

SEQ ID NO: 2645610 - RNA, 23 nt, Escherichia coli CFT073
cagcauuguauauugcagcaacg

SEQ ID NO: 2645611 - RNA, 12 nt, Escherichia coli CFT073
cagcauuucuuc

SEQ ID NO: 2645612 - RNA, 14 nt, Escherichia coli CFT073
cagcauuucuucca

SEQ ID NO: 2645613 - RNA, 20 nt, Escherichia coli CFT073
cagccaaagcgacacaauca

SEQ ID NO: 2645614 - RNA, 15 nt, Escherichia coli CFT073
cagccaaauccagcg

SEQ ID NO: 2645615 - RNA, 22 nt, Escherichia coli CFT073
cagccaaaucccgugaugcggu

SEQ ID NO: 2645616 - RNA, 15 nt, Escherichia coli CFT073
cagccaaaucgcccc

SEQ ID NO: 2645617 - RNA, 15 nt, Escherichia coli CFT073
cagccaaccacauga

SEQ ID NO: 2645618 - RNA, 15 nt, Escherichia coli CFT073
cagccaacgaucugg

SEQ ID NO: 2645619 - RNA, 19 nt, Escherichia coli CFT073
cagccaaucacaucaggcu

SEQ ID NO: 2645620 - RNA, 21 nt, Escherichia coli CFT073
cagccaaucauaaacgccuga

SEQ ID NO: 2645621 - RNA, 21 nt, Escherichia coli CFT073
cagccaauugauuuaacgcag

SEQ ID NO: 2645622 - RNA, 14 nt, Escherichia coli CFT073
cagccacaaaccau

SEQ ID NO: 2645623 - RNA, 18 nt, Escherichia coli CFT073
cagccacaacaaacgacc

SEQ ID NO: 2645624 - RNA, 20 nt, Escherichia coli CFT073
cagccacaacaaacgaccgc

SEQ ID NO: 2645625 - RNA, 21 nt, Escherichia coli CFT073
cagccacaacaaacgaccgcg

SEQ ID NO: 2645626 - RNA, 14 nt, Escherichia coli CFT073
cagccacaccaauc

SEQ ID NO: 2645627 - RNA, 15 nt, Escherichia coli CFT073
cagccacaccaauca

SEQ ID NO: 2645628 - RNA, 20 nt, Escherichia coli CFT073
cagccacaccacgcgccugc

SEQ ID NO: 2645629 - RNA, 20 nt, Escherichia coli CFT073
cagccacaggccggucaucc

SEQ ID NO: 2645630 - RNA, 21 nt, Escherichia coli CFT073
cagccacgacguuugguggaa

SEQ ID NO: 2645631 - RNA, 17 nt, Escherichia coli CFT073
cagccacgcguucggac

SEQ ID NO: 2645632 - RNA, 12 nt, Escherichia coli CFT073
cagccacggcag

SEQ ID NO: 2645633 - RNA, 16 nt, Escherichia coli CFT073
cagccacggcuccagc

SEQ ID NO: 2645634 - RNA, 17 nt, Escherichia coli CFT073
cagccacggcuccagca

SEQ ID NO: 2645635 - RNA, 17 nt, Escherichia coli CFT073
cagccacucggacaccu

SEQ ID NO: 2645636 - RNA, 16 nt, Escherichia coli CFT073
cagccacugcgcgccu

SEQ ID NO: 2645637 - RNA, 12 nt, Escherichia coli CFT073
cagccacugcgg

SEQ ID NO: 2645638 - RNA, 14 nt, Escherichia coli CFT073
cagccacuguuuca

SEQ ID NO: 2645639 - RNA, 17 nt, Escherichia coli CFT073
cagccacuucaaccagc

SEQ ID NO: 2645640 - RNA, 20 nt, Escherichia coli CFT073
cagccacuucaaccagcggc

SEQ ID NO: 2645641 - RNA, 22 nt, Escherichia coli CFT073
cagccacuuccugcucgguaaa

SEQ ID NO: 2645642 - RNA, 17 nt, Escherichia coli CFT073
cagccagaacagcggag

SEQ ID NO: 2645643 - RNA, 16 nt, Escherichia coli CFT073
cagccagaauaucccc

SEQ ID NO: 2645644 - RNA, 18 nt, Escherichia coli CFT073
cagccagacgcgucacgc

SEQ ID NO: 2645645 - RNA, 15 nt, Escherichia coli CFT073
cagccagacucagca

SEQ ID NO: 2645646 - RNA, 22 nt, Escherichia coli CFT073
cagccagagaauaccguugacc

SEQ ID NO: 2645647 - RNA, 17 nt, Escherichia coli CFT073
cagccagauaaaucgau

SEQ ID NO: 2645648 - RNA, 15 nt, Escherichia coli CFT073
cagccagcaccaggc

SEQ ID NO: 2645649 - RNA, 15 nt, Escherichia coli CFT073
cagccagcagcgaau

SEQ ID NO: 2645650 - RNA, 18 nt, Escherichia coli CFT073
cagccagccaagcauguc

SEQ ID NO: 2645651 - RNA, 16 nt, Escherichia coli CFT073
cagccagcccaucgcu

SEQ ID NO: 2645652 - RNA, 14 nt, Escherichia coli CFT073
cagccagccgaaca

SEQ ID NO: 2645653 - RNA, 17 nt, Escherichia coli CFT073
cagccagcgcaccagcg

SEQ ID NO: 2645654 - RNA, 14 nt, Escherichia coli CFT073
cagccagcgcaccu

SEQ ID NO: 2645655 - RNA, 18 nt, Escherichia coli CFT073
cagccagcgccgcgcggg

SEQ ID NO: 2645656 - RNA, 16 nt, Escherichia coli CFT073
cagccagcgcuuugau

SEQ ID NO: 2645657 - RNA, 22 nt, Escherichia coli CFT073
cagccagcgcuuugauggcacu

SEQ ID NO: 2645658 - RNA, 13 nt, Escherichia coli CFT073
cagccagcggcga

SEQ ID NO: 2645659 - RNA, 17 nt, Escherichia coli CFT073
cagccagcguuacccag

SEQ ID NO: 2645660 - RNA, 15 nt, Escherichia coli CFT073
cagccaggaaacgca

SEQ ID NO: 2645661 - RNA, 15 nt, Escherichia coli CFT073
cagccaggaaagaac

SEQ ID NO: 2645662 - RNA, 19 nt, Escherichia coli CFT073
cagccaggaauccagcacg

SEQ ID NO: 2645663 - RNA, 15 nt, Escherichia coli CFT073
cagccaggcgcugcu

SEQ ID NO: 2645664 - RNA, 22 nt, Escherichia coli CFT073
cagccagggauaagccagacca

SEQ ID NO: 2645665 - RNA, 15 nt, Escherichia coli CFT073
cagccagguggcaga

SEQ ID NO: 2645666 - RNA, 16 nt, Escherichia coli CFT073
cagccaguaaaccaau

SEQ ID NO: 2645667 - RNA, 21 nt, Escherichia coli CFT073
cagccaguagaacaauuaaua

SEQ ID NO: 2645668 - RNA, 21 nt, Escherichia coli CFT073
cagccagugauuccggugccg

SEQ ID NO: 2645669 - RNA, 18 nt, Escherichia coli CFT073
cagccaguucgagaaaaa

SEQ ID NO: 2645670 - RNA, 19 nt, Escherichia coli CFT073
cagccaguucgagaaaaau

SEQ ID NO: 2645671 - RNA, 14 nt, Escherichia coli CFT073
cagccaguugaucu

SEQ ID NO: 2645672 - RNA, 15 nt, Escherichia coli CFT073
cagccaguuguugau

SEQ ID NO: 2645673 - RNA, 14 nt, Escherichia coli CFT073
cagccaguuuuuca

SEQ ID NO: 2645674 - RNA, 21 nt, Escherichia coli CFT073
cagccaguuuuucagcgccag

SEQ ID NO: 2645675 - RNA, 24 nt, Escherichia coli CFT073
cagccaguuuuucagcgccagcgc

SEQ ID NO: 2645676 - RNA, 17 nt, Escherichia coli CFT073
cagccauaaagaaauca

SEQ ID NO: 2645677 - RNA, 22 nt, Escherichia coli CFT073
cagccauaaagaaaucaccugc

SEQ ID NO: 2645678 - RNA, 23 nt, Escherichia coli CFT073
cagccauaaagaaaucaccugcc

SEQ ID NO: 2645679 - RNA, 16 nt, Escherichia coli CFT073
cagccaucgacaccag

SEQ ID NO: 2645680 - RNA, 20 nt, Escherichia coli CFT073
cagccaucgccaccgcuucg

SEQ ID NO: 2645681 - RNA, 16 nt, Escherichia coli CFT073
cagccaucgccacugc

SEQ ID NO: 2645682 - RNA, 19 nt, Escherichia coli CFT073
cagccaucgccacugcaaa

SEQ ID NO: 2645683 - RNA, 19 nt, Escherichia coli CFT073
cagccaucgccugcuggau

SEQ ID NO: 2645684 - RNA, 17 nt, Escherichia coli CFT073
cagccaugaugaauaac

SEQ ID NO: 2645685 - RNA, 13 nt, Escherichia coli CFT073
cagccaugccacg

SEQ ID NO: 2645686 - RNA, 14 nt, Escherichia coli CFT073
cagccaugccacgc

SEQ ID NO: 2645687 - RNA, 18 nt, Escherichia coli CFT073
cagccaugccgccaccac

SEQ ID NO: 2645688 - RNA, 21 nt, Escherichia coli CFT073
cagccaugguuuaaucgccgu

SEQ ID NO: 2645689 - RNA, 16 nt, Escherichia coli CFT073
cagccaugucgccacc

SEQ ID NO: 2645690 - RNA, 14 nt, Escherichia coli CFT073
cagcgcacugccgc

SEQ ID NO: 2645691 - RNA, 13 nt, Escherichia coli CFT073
cagcgcagcaccc

SEQ ID NO: 2645692 - RNA, 15 nt, Escherichia coli CFT073
cagcgcagcacccag

SEQ ID NO: 2645693 - RNA, 13 nt, Escherichia coli CFT073
cagcgcaggaaag

SEQ ID NO: 2645694 - RNA, 19 nt, Escherichia coli CFT073
cagcgcauagcuaaucccc

SEQ ID NO: 2645695 - RNA, 24 nt, Escherichia coli CFT073
cagcgcaucaugaaacgcccacgc

SEQ ID NO: 2645696 - RNA, 14 nt, Escherichia coli CFT073
cagcgcauccuggc

SEQ ID NO: 2645697 - RNA, 18 nt, Escherichia coli CFT073
cagcgcauccuggcuguu

SEQ ID NO: 2645698 - RNA, 23 nt, Escherichia coli CFT073
cagcgcaugauuuucaucuuuug

SEQ ID NO: 2645699 - RNA, 21 nt, Escherichia coli CFT073
cagcgcauggcggcagcgugc

SEQ ID NO: 2645700 - RNA, 12 nt, Escherichia coli CFT073
cagcgcauugac

SEQ ID NO: 2645701 - RNA, 20 nt, Escherichia coli CFT073
cagcgcauuuaccaggcggu

SEQ ID NO: 2645702 - RNA, 12 nt, Escherichia coli CFT073
cagcgccaaccc

SEQ ID NO: 2645703 - RNA, 15 nt, Escherichia coli CFT073
cagcgccaacgguga

SEQ ID NO: 2645704 - RNA, 18 nt, Escherichia coli CFT073
cagcgccaacggugaaaa

SEQ ID NO: 2645705 - RNA, 13 nt, Escherichia coli CFT073
cagcgccaaucgc

SEQ ID NO: 2645706 - RNA, 12 nt, Escherichia coli CFT073
cagcgccaccac

SEQ ID NO: 2645707 - RNA, 16 nt, Escherichia coli CFT073
cagcgccaccaccagu

SEQ ID NO: 2645708 - RNA, 20 nt, Escherichia coli CFT073
cagcgccaccacgccgaugg

SEQ ID NO: 2645709 - RNA, 17 nt, Escherichia coli CFT073
cagcgccaccgguuuau

SEQ ID NO: 2645710 - RNA, 21 nt, Escherichia coli CFT073
cagcgccacggaaacauucaa

SEQ ID NO: 2645711 - RNA, 15 nt, Escherichia coli CFT073
cagcgccagauagcc

SEQ ID NO: 2645712 - RNA, 15 nt, Escherichia coli CFT073
cagcgccagcgcgga

SEQ ID NO: 2645713 - RNA, 17 nt, Escherichia coli CFT073
cagcgccauaaucagcg

SEQ ID NO: 2645714 - RNA, 13 nt, Escherichia coli CFT073
cagcgccaucccc

SEQ ID NO: 2645715 - RNA, 14 nt, Escherichia coli CFT073
cagcgccaucgcca

SEQ ID NO: 2645716 - RNA, 22 nt, Escherichia coli CFT073
cagcgccaucgccaggaacaac

SEQ ID NO: 2645717 - RNA, 19 nt, Escherichia coli CFT073
cagcgccaugccaacgcgg

SEQ ID NO: 2645718 - RNA, 16 nt, Escherichia coli CFT073
cagcgccauuaacagu

SEQ ID NO: 2645719 - RNA, 14 nt, Escherichia coli CFT073
cagcgcccaacacu

SEQ ID NO: 2645720 - RNA, 14 nt, Escherichia coli CFT073
cagcgcccgcuuca

SEQ ID NO: 2645721 - RNA, 20 nt, Escherichia coli CFT073
cagcgcccguaaaccaagcu

SEQ ID NO: 2645722 - RNA, 21 nt, Escherichia coli CFT073
cagcgcccguaaaccaagcug

SEQ ID NO: 2645723 - RNA, 21 nt, Escherichia coli CFT073
cagcgccgcauccgacauuug

SEQ ID NO: 2645724 - RNA, 12 nt, Escherichia coli CFT073
cagcgccggauu

SEQ ID NO: 2645725 - RNA, 15 nt, Escherichia coli CFT073
cagcgccugcaaaau

SEQ ID NO: 2645726 - RNA, 13 nt, Escherichia coli CFT073
cagcgccugcagc

SEQ ID NO: 2645727 - RNA, 20 nt, Escherichia coli CFT073
cagcgccugcagcugcagau

SEQ ID NO: 2645728 - RNA, 19 nt, Escherichia coli CFT073
cagcgccugcugcacacca

SEQ ID NO: 2645729 - RNA, 22 nt, Escherichia coli CFT073
cagcgccuggcagcaugcugcc

SEQ ID NO: 2645730 - RNA, 21 nt, Escherichia coli CFT073
cagcgccugggaaucaaacca

SEQ ID NO: 2645731 - RNA, 15 nt, Escherichia coli CFT073
cagcgccuguugauu

SEQ ID NO: 2645732 - RNA, 21 nt, Escherichia coli CFT073
cagcgcgacacaacagaccag

SEQ ID NO: 2645733 - RNA, 23 nt, Escherichia coli CFT073
cagcgcgaccgccaugaugaucc

SEQ ID NO: 2645734 - RNA, 21 nt, Escherichia coli CFT073
cagcgcgaggguaaacaacau

SEQ ID NO: 2645735 - RNA, 12 nt, Escherichia coli CFT073
cagcgcgauacg

SEQ ID NO: 2645736 - RNA, 16 nt, Escherichia coli CFT073
cagcgcgaucgcgcca

SEQ ID NO: 2645737 - RNA, 19 nt, Escherichia coli CFT073
cagcgcgccugaaugccac

SEQ ID NO: 2645738 - RNA, 14 nt, Escherichia coli CFT073
cagcgcgcgcagca

SEQ ID NO: 2645739 - RNA, 16 nt, Escherichia coli CFT073
cagcgcgcggcuggca

SEQ ID NO: 2645740 - RNA, 22 nt, Escherichia coli CFT073
cagcgcggaaggaaugaaauag

SEQ ID NO: 2645741 - RNA, 15 nt, Escherichia coli CFT073
cagcgcggcagcggc

SEQ ID NO: 2645742 - RNA, 17 nt, Escherichia coli CFT073
cagcgcggcgagagccu

SEQ ID NO: 2645743 - RNA, 15 nt, Escherichia coli CFT073
cagcgcggcggcaau

SEQ ID NO: 2645744 - RNA, 16 nt, Escherichia coli CFT073
cagcgcgggcuggcgu

SEQ ID NO: 2645745 - RNA, 23 nt, Escherichia coli CFT073
cagcgcgucuucaucguccagcg

SEQ ID NO: 2645746 - RNA, 14 nt, Escherichia coli CFT073
cagcgcgugcgcca

SEQ ID NO: 2645747 - RNA, 17 nt, Escherichia coli CFT073
cagcgcgugcgccaccg

SEQ ID NO: 2645748 - RNA, 18 nt, Escherichia coli CFT073
cagcgcugcccaccacuc

SEQ ID NO: 2645749 - RNA, 12 nt, Escherichia coli CFT073
cagcgcuggaga

SEQ ID NO: 2645750 - RNA, 22 nt, Escherichia coli CFT073
cagcgcuuccagaaugacgccg

SEQ ID NO: 2645751 - RNA, 21 nt, Escherichia coli CFT073
cagcgcuuuuggcgcguuccc

SEQ ID NO: 2645752 - RNA, 23 nt, Escherichia coli CFT073
cagcggaaugcagucacgccagu

SEQ ID NO: 2645753 - RNA, 22 nt, Escherichia coli CFT073
cagcggaauuacgcgaucgcga

SEQ ID NO: 2645754 - RNA, 14 nt, Escherichia coli CFT073
cagcggacgcugcu

SEQ ID NO: 2645755 - RNA, 19 nt, Escherichia coli CFT073
cagcggagaucgccagccc

SEQ ID NO: 2645756 - RNA, 14 nt, Escherichia coli CFT073
cagcggaugaccca

SEQ ID NO: 2645757 - RNA, 14 nt, Escherichia coli CFT073
cagcggcaaaacgg

SEQ ID NO: 2645758 - RNA, 22 nt, Escherichia coli CFT073
cagcggcaacaucaucacgcag

SEQ ID NO: 2645759 - RNA, 16 nt, Escherichia coli CFT073
cagcggcaaccagcag

SEQ ID NO: 2645760 - RNA, 17 nt, Escherichia coli CFT073
cagcggcaagcuggcga

SEQ ID NO: 2645761 - RNA, 22 nt, Escherichia coli CFT073
cagcggcaccuaucgcgucgcc

SEQ ID NO: 2645762 - RNA, 14 nt, Escherichia coli CFT073
cagcggcaccuucg

SEQ ID NO: 2645763 - RNA, 15 nt, Escherichia coli CFT073
cagcggcacguucga

SEQ ID NO: 2645764 - RNA, 16 nt, Escherichia coli CFT073
cagcggcaucaaccgc

SEQ ID NO: 2645765 - RNA, 18 nt, Escherichia coli CFT073
cagcggcauuacgcgccu

SEQ ID NO: 2645766 - RNA, 20 nt, Escherichia coli CFT073
cagcggccagacgcgccgcc

SEQ ID NO: 2645767 - RNA, 22 nt, Escherichia coli CFT073
cagcggccagacgcgccgccac

SEQ ID NO: 2645768 - RNA, 15 nt, Escherichia coli CFT073
cagcggccagcgcac

SEQ ID NO: 2645769 - RNA, 19 nt, Escherichia coli CFT073
cagcggcgagcuuuucugg

SEQ ID NO: 2645770 - RNA, 13 nt, Escherichia coli CFT073
cagcggcgcaacc

SEQ ID NO: 2645771 - RNA, 13 nt, Escherichia coli CFT073
cagcggcgcaucc

SEQ ID NO: 2645772 - RNA, 22 nt, Escherichia coli CFT073
cagcggcgcauccgccagcagc

SEQ ID NO: 2645773 - RNA, 23 nt, Escherichia coli CFT073
cagcggcguguuauugccgagaa

SEQ ID NO: 2645774 - RNA, 23 nt, Escherichia coli CFT073
cagcggcguuuuaucacgcaucu

SEQ ID NO: 2645775 - RNA, 16 nt, Escherichia coli CFT073
cagcggcuacugaugu

SEQ ID NO: 2645776 - RNA, 22 nt, Escherichia coli CFT073
cagcggcuguuccggcacaccu

SEQ ID NO: 2645777 - RNA, 14 nt, Escherichia coli CFT073
cagcggcuuuuuac

SEQ ID NO: 2645778 - RNA, 16 nt, Escherichia coli CFT073
cagcggcuuuuuacgc

SEQ ID NO: 2645779 - RNA, 19 nt, Escherichia coli CFT073
cagcgggaugucgcggaaa

SEQ ID NO: 2645780 - RNA, 21 nt, Escherichia coli CFT073
cagcgggcgaaucaacuccag

SEQ ID NO: 2645781 - RNA, 18 nt, Escherichia coli CFT073
cagcgggcgucaaaauca

SEQ ID NO: 2645782 - RNA, 14 nt, Escherichia coli CFT073
cagcgggcuccaug

SEQ ID NO: 2645783 - RNA, 20 nt, Escherichia coli CFT073
cagcggggcgaaaucuucuc

SEQ ID NO: 2645784 - RNA, 21 nt, Escherichia coli CFT073
cagcgggguucuccugagaac

SEQ ID NO: 2645785 - RNA, 12 nt, Escherichia coli CFT073
cagcggguuaau

SEQ ID NO: 2645786 - RNA, 21 nt, Escherichia coli CFT073
cagcggguuaauuuccgcgaa

SEQ ID NO: 2645787 - RNA, 22 nt, Escherichia coli CFT073
cagcggguuaucuuccagcggc

SEQ ID NO: 2645788 - RNA, 15 nt, Escherichia coli CFT073
cagcggguuuucuac

SEQ ID NO: 2645789 - RNA, 21 nt, Escherichia coli CFT073
cagcgguaacuuaucuguaau

SEQ ID NO: 2645790 - RNA, 15 nt, Escherichia coli CFT073
cagcgguccguugau

SEQ ID NO: 2645791 - RNA, 19 nt, Escherichia coli CFT073
cagcggugauuuccgccgc

SEQ ID NO: 2645792 - RNA, 15 nt, Escherichia coli CFT073
cagcggugccgcgau

SEQ ID NO: 2645793 - RNA, 17 nt, Escherichia coli CFT073
cagcgguuccccgcucu

SEQ ID NO: 2645794 - RNA, 15 nt, Escherichia coli CFT073
cagcgguuccuggcg

SEQ ID NO: 2645795 - RNA, 15 nt, Escherichia coli CFT073
cagcgguugagagaa

SEQ ID NO: 2645796 - RNA, 17 nt, Escherichia coli CFT073
cagcgguuuacccugcu

SEQ ID NO: 2645797 - RNA, 21 nt, Escherichia coli CFT073
cagcguaacgcccacgcuacu

SEQ ID NO: 2645798 - RNA, 16 nt, Escherichia coli CFT073
cagcuguaccagcaac

SEQ ID NO: 2645799 - RNA, 18 nt, Escherichia coli CFT073
cagcuguccauaccggac

SEQ ID NO: 2645800 - RNA, 14 nt, Escherichia coli CFT073
cagcuguuccucaa

SEQ ID NO: 2645801 - RNA, 14 nt, Escherichia coli CFT073
cagcuguugcgcca

SEQ ID NO: 2645802 - RNA, 14 nt, Escherichia coli CFT073
cagcuguuucaucu

SEQ ID NO: 2645803 - RNA, 15 nt, Escherichia coli CFT073
cagcuguuucaucuc

SEQ ID NO: 2645804 - RNA, 18 nt, Escherichia coli CFT073
cagcuguuuugguaaacu

SEQ ID NO: 2645805 - RNA, 16 nt, Escherichia coli CFT073
cagcuuaaaaugcugg

SEQ ID NO: 2645806 - RNA, 18 nt, Escherichia coli CFT073
cagcuuaagcgaccaguu

SEQ ID NO: 2645807 - RNA, 18 nt, Escherichia coli CFT073
cagcuuaaucaccagcgc

SEQ ID NO: 2645808 - RNA, 15 nt, Escherichia coli CFT073
cagcuuacgcgccag

SEQ ID NO: 2645809 - RNA, 16 nt, Escherichia coli CFT073
cagcuuacgcgccaga

SEQ ID NO: 2645810 - RNA, 18 nt, Escherichia coli CFT073
cagcuuacgcgccagagc

SEQ ID NO: 2645811 - RNA, 19 nt, Escherichia coli CFT073
cagcuuaguaagcccaggg

SEQ ID NO: 2645812 - RNA, 14 nt, Escherichia coli CFT073
cagcuuauccagca

SEQ ID NO: 2645813 - RNA, 17 nt, Escherichia coli CFT073
cagcuuauccagcaacg

SEQ ID NO: 2645814 - RNA, 18 nt, Escherichia coli CFT073
cagcuucacaaaggcuug

SEQ ID NO: 2645815 - RNA, 13 nt, Escherichia coli CFT073
cagcuucacgcgc

SEQ ID NO: 2645816 - RNA, 16 nt, Escherichia coli CFT073
cagcuucacgcgcugg

SEQ ID NO: 2645817 - RNA, 13 nt, Escherichia coli CFT073
cagcuucacggaa

SEQ ID NO: 2645818 - RNA, 23 nt, Escherichia coli CFT073
cagcuucagacggauguauucuu

SEQ ID NO: 2645819 - RNA, 16 nt, Escherichia coli CFT073
cagcuucagcgucuuc

SEQ ID NO: 2645820 - RNA, 19 nt, Escherichia coli CFT073
cagcuuccggccagcaugc

SEQ ID NO: 2645821 - RNA, 15 nt, Escherichia coli CFT073
cagcuucgcuaccug

SEQ ID NO: 2645822 - RNA, 23 nt, Escherichia coli CFT073
cagcuucgcuucccaacgcagca

SEQ ID NO: 2645823 - RNA, 15 nt, Escherichia coli CFT073
cagcuucgucaccug

SEQ ID NO: 2645824 - RNA, 19 nt, Escherichia coli CFT073
cagcuucucgugaaauuca

SEQ ID NO: 2645825 - RNA, 21 nt, Escherichia coli CFT073
cagcuucucgugaaauucacg

SEQ ID NO: 2645826 - RNA, 18 nt, Escherichia coli CFT073
cagcuucugcacgaugcu

SEQ ID NO: 2645827 - RNA, 17 nt, Escherichia coli CFT073
cagcuucuucuccagcu

SEQ ID NO: 2645828 - RNA, 19 nt, Escherichia coli CFT073
cagcuucuucuccagcugc

SEQ ID NO: 2645829 - RNA, 20 nt, Escherichia coli CFT073
cagcuucuucuccagcugcg

SEQ ID NO: 2645830 - RNA, 12 nt, Escherichia coli CFT073
cagcuugagaaa

SEQ ID NO: 2645831 - RNA, 17 nt, Escherichia coli CFT073
cagcuugagaaaaucgu

SEQ ID NO: 2645832 - RNA, 16 nt, Escherichia coli CFT073
cagcuugcgauccugc

SEQ ID NO: 2645833 - RNA, 17 nt, Escherichia coli CFT073
cagcuugcgauccugca

SEQ ID NO: 2645834 - RNA, 15 nt, Escherichia coli CFT073
cagcuugcgccgccc

SEQ ID NO: 2645835 - RNA, 18 nt, Escherichia coli CFT073
cagcuugcgccgcccgcc

SEQ ID NO: 2645836 - RNA, 22 nt, Escherichia coli CFT073
cagcuugcuguuucgcugacga

SEQ ID NO: 2645837 - RNA, 18 nt, Escherichia coli CFT073
cagcuugugaaucaucgc

SEQ ID NO: 2645838 - RNA, 17 nt, Escherichia coli CFT073
cagcuuguuauccauca

SEQ ID NO: 2645839 - RNA, 13 nt, Escherichia coli CFT073
cagcuuucagaga

SEQ ID NO: 2645840 - RNA, 19 nt, Escherichia coli CFT073
cagcuuucggguggccagc

SEQ ID NO: 2645841 - RNA, 18 nt, Escherichia coli CFT073
cagcuuuuccauaucaag

SEQ ID NO: 2645842 - RNA, 21 nt, Escherichia coli CFT073
cagcuuuugaccaggucauaa

SEQ ID NO: 2645843 - RNA, 18 nt, Escherichia coli CFT073
caggaaaaagaucagcgg

SEQ ID NO: 2645844 - RNA, 19 nt, Escherichia coli CFT073
caggaaaaagaucagcggc

SEQ ID NO: 2645845 - RNA, 21 nt, Escherichia coli CFT073
caggaaaaucagcaucaaccc

SEQ ID NO: 2645846 - RNA, 17 nt, Escherichia coli CFT073
caggaaaaugagauggu

SEQ ID NO: 2645847 - RNA, 13 nt, Escherichia coli CFT073
caggaaauaaaua

SEQ ID NO: 2645848 - RNA, 15 nt, Escherichia coli CFT073
caggaaauaaauaau

SEQ ID NO: 2645849 - RNA, 15 nt, Escherichia coli CFT073
caggaaauauaacag

SEQ ID NO: 2645850 - RNA, 23 nt, Escherichia coli CFT073
caggaaaucaaugccaccagaaa

SEQ ID NO: 2645851 - RNA, 22 nt, Escherichia coli CFT073
caggaaauuauggaucaccauc

SEQ ID NO: 2645852 - RNA, 15 nt, Escherichia coli CFT073
caggaacaacgacag

SEQ ID NO: 2645853 - RNA, 15 nt, Escherichia coli CFT073
caggaaccaaaugcc

SEQ ID NO: 2645854 - RNA, 20 nt, Escherichia coli CFT073
caggaaccaaaugccggaug

SEQ ID NO: 2645855 - RNA, 20 nt, Escherichia coli CFT073
caggaaccgaucagauugag

SEQ ID NO: 2645856 - RNA, 19 nt, Escherichia coli CFT073
caggaaccugugacagcag

SEQ ID NO: 2645857 - RNA, 21 nt, Escherichia coli CFT073
caggaaccugugacagcagcg

SEQ ID NO: 2645858 - RNA, 12 nt, Escherichia coli CFT073
caggaacgccau

SEQ ID NO: 2645859 - RNA, 18 nt, Escherichia coli CFT073
caggaacgggauugccag

SEQ ID NO: 2645860 - RNA, 17 nt, Escherichia coli CFT073
caggaacuguugcaaaa

SEQ ID NO: 2645861 - RNA, 20 nt, Escherichia coli CFT073
caggaacuuaguaggccuga

SEQ ID NO: 2645862 - RNA, 15 nt, Escherichia coli CFT073
caggaagccccagcu

SEQ ID NO: 2645863 - RNA, 13 nt, Escherichia coli CFT073
caggaagcccgcc

SEQ ID NO: 2645864 - RNA, 16 nt, Escherichia coli CFT073
caggaagcccgcccag

SEQ ID NO: 2645865 - RNA, 20 nt, Escherichia coli CFT073
caggaagcccgcccagcuua

SEQ ID NO: 2645866 - RNA, 21 nt, Escherichia coli CFT073
caggaagcucuggccccaccu

SEQ ID NO: 2645867 - RNA, 18 nt, Escherichia coli CFT073
caggaaggcgacaagcga

SEQ ID NO: 2645868 - RNA, 14 nt, Escherichia coli CFT073
caggaaggcugacc

SEQ ID NO: 2645869 - RNA, 17 nt, Escherichia coli CFT073
caggaagggauuaugca

SEQ ID NO: 2645870 - RNA, 16 nt, Escherichia coli CFT073
caggaauggaaauaga

SEQ ID NO: 2645871 - RNA, 14 nt, Escherichia coli CFT073
caggacgaauacaa

SEQ ID NO: 2645872 - RNA, 14 nt, Escherichia coli CFT073
caggacgauaaacc

SEQ ID NO: 2645873 - RNA, 18 nt, Escherichia coli CFT073
caggacgauuccggcaaa

SEQ ID NO: 2645874 - RNA, 14 nt, Escherichia coli CFT073
caggacgcaauguc

SEQ ID NO: 2645875 - RNA, 14 nt, Escherichia coli CFT073
caggagacaccagc

SEQ ID NO: 2645876 - RNA, 22 nt, Escherichia coli CFT073
caggagcgauuaugaaacaaga

SEQ ID NO: 2645877 - RNA, 12 nt, Escherichia coli CFT073
caggagcgccga

SEQ ID NO: 2645878 - RNA, 13 nt, Escherichia coli CFT073
caggagcgcggca

SEQ ID NO: 2645879 - RNA, 19 nt, Escherichia coli CFT073
caggagcgguguaggccug

SEQ ID NO: 2645880 - RNA, 14 nt, Escherichia coli CFT073
caggagcugagugc

SEQ ID NO: 2645881 - RNA, 22 nt, Escherichia coli CFT073
caggaggagauauuuaacauca

SEQ ID NO: 2645882 - RNA, 16 nt, Escherichia coli CFT073
caggagguauuauuca

SEQ ID NO: 2645883 - RNA, 16 nt, Escherichia coli CFT073
caggaguagcucuggg

SEQ ID NO: 2645884 - RNA, 15 nt, Escherichia coli CFT073
caggauaaacuccug

SEQ ID NO: 2645885 - RNA, 23 nt, Escherichia coli CFT073
caggauaauaauuugcgcgguaa

SEQ ID NO: 2645886 - RNA, 18 nt, Escherichia coli CFT073
caggauauauuucaucaa

SEQ ID NO: 2645887 - RNA, 16 nt, Escherichia coli CFT073
caggauaucugaaagu

SEQ ID NO: 2645888 - RNA, 21 nt, Escherichia coli CFT073
caggaucagaccgccaaucag

SEQ ID NO: 2645889 - RNA, 23 nt, Escherichia coli CFT073
caggaucagaccgccaaucagca

SEQ ID NO: 2645890 - RNA, 15 nt, Escherichia coli CFT073
caggaucagcaaaau

SEQ ID NO: 2645891 - RNA, 13 nt, Escherichia coli CFT073
caggaucagcucc

SEQ ID NO: 2645892 - RNA, 23 nt, Escherichia coli CFT073
caggaucaucauuguugguuaaa

SEQ ID NO: 2645893 - RNA, 18 nt, Escherichia coli CFT073
caggauccgcucugcccu

SEQ ID NO: 2645894 - RNA, 23 nt, Escherichia coli CFT073
caggauccgcucugcccugccau

SEQ ID NO: 2645895 - RNA, 21 nt, Escherichia coli CFT073
caggaugagaaaagagaugaa

SEQ ID NO: 2645896 - RNA, 14 nt, Escherichia coli CFT073
caggaugagcgcga

SEQ ID NO: 2645897 - RNA, 19 nt, Escherichia coli CFT073
caggaugccguuaauaaua

SEQ ID NO: 2645898 - RNA, 13 nt, Escherichia coli CFT073
caggaugcuucaa

SEQ ID NO: 2645899 - RNA, 20 nt, Escherichia coli CFT073
caggauggcauuugcaacac

SEQ ID NO: 2645900 - RNA, 19 nt, Escherichia coli CFT073
caggaugugagcuggcgga

SEQ ID NO: 2645901 - RNA, 20 nt, Escherichia coli CFT073
caggauuacgcucaccaaaa

SEQ ID NO: 2645902 - RNA, 16 nt, Escherichia coli CFT073
caggauuuccagcuca

SEQ ID NO: 2645903 - RNA, 22 nt, Escherichia coli CFT073
caggcaaacuucacgcauuuac

SEQ ID NO: 2645904 - RNA, 16 nt, Escherichia coli CFT073
caggcaaacuucccgc

SEQ ID NO: 2645905 - RNA, 23 nt, Escherichia coli CFT073
caggcaaaucgcucccucuccac

SEQ ID NO: 2645906 - RNA, 17 nt, Escherichia coli CFT073
cagggaucauccacccg

SEQ ID NO: 2645907 - RNA, 21 nt, Escherichia coli CFT073
cagggaucauccacccgcagc

SEQ ID NO: 2645908 - RNA, 16 nt, Escherichia coli CFT073
cagggauggcuccggg

SEQ ID NO: 2645909 - RNA, 15 nt, Escherichia coli CFT073
cagggauuguuuaaa

SEQ ID NO: 2645910 - RNA, 17 nt, Escherichia coli CFT073
cagggcaaaauuucccc

SEQ ID NO: 2645911 - RNA, 12 nt, Escherichia coli CFT073
cagggcaauacg

SEQ ID NO: 2645912 - RNA, 19 nt, Escherichia coli CFT073
cagggcaauacgcuccgcc

SEQ ID NO: 2645913 - RNA, 14 nt, Escherichia coli CFT073
cagggcaaucgcgc

SEQ ID NO: 2645914 - RNA, 14 nt, Escherichia coli CFT073
cagggcagguaaca

SEQ ID NO: 2645915 - RNA, 12 nt, Escherichia coli CFT073
cagggcauugcu

SEQ ID NO: 2645916 - RNA, 23 nt, Escherichia coli CFT073
cagggccaaacagcagaucgaac

SEQ ID NO: 2645917 - RNA, 14 nt, Escherichia coli CFT073
cagggccuccugca

SEQ ID NO: 2645918 - RNA, 16 nt, Escherichia coli CFT073
cagggccuccugcagc

SEQ ID NO: 2645919 - RNA, 23 nt, Escherichia coli CFT073
cagggcgcuguugcuaucggcga

SEQ ID NO: 2645920 - RNA, 21 nt, Escherichia coli CFT073
cagggcggacugauaacuuuu

SEQ ID NO: 2645921 - RNA, 18 nt, Escherichia coli CFT073
cagggcggcuaucccaaa

SEQ ID NO: 2645922 - RNA, 22 nt, Escherichia coli CFT073
cagggcuuucgcaauaaucauc

SEQ ID NO: 2645923 - RNA, 23 nt, Escherichia coli CFT073
cagggcuuuuuuauuucaucuuu

SEQ ID NO: 2645924 - RNA, 20 nt, Escherichia coli CFT073
caggggauggaugcccccag

SEQ ID NO: 2645925 - RNA, 16 nt, Escherichia coli CFT073
caggggcaaucagcac

SEQ ID NO: 2645926 - RNA, 17 nt, Escherichia coli CFT073
caggggcaaucagcacu

SEQ ID NO: 2645927 - RNA, 22 nt, Escherichia coli CFT073
caggggcaaucagcacuacugc

SEQ ID NO: 2645928 - RNA, 23 nt, Escherichia coli CFT073
caggggcggguuuuuuuauaucu

SEQ ID NO: 2645929 - RNA, 14 nt, Escherichia coli CFT073
caggggcuggugcc

SEQ ID NO: 2645930 - RNA, 18 nt, Escherichia coli CFT073
cagggugaauaaaagaaa

SEQ ID NO: 2645931 - RNA, 22 nt, Escherichia coli CFT073
cagggugacaaauuugugcucu

SEQ ID NO: 2645932 - RNA, 22 nt, Escherichia coli CFT073
cagggugagggcaauaaucuuu

SEQ ID NO: 2645933 - RNA, 17 nt, Escherichia coli CFT073
caggguggugacaccau

SEQ ID NO: 2645934 - RNA, 15 nt, Escherichia coli CFT073
caggguguaggcaaa

SEQ ID NO: 2645935 - RNA, 19 nt, Escherichia coli CFT073
caggguguaggcaaaggga

SEQ ID NO: 2645936 - RNA, 16 nt, Escherichia coli CFT073
caggguguuaucaaua

SEQ ID NO: 2645937 - RNA, 22 nt, Escherichia coli CFT073
caggguuauuuguaacugucgg

SEQ ID NO: 2645938 - RNA, 15 nt, Escherichia coli CFT073
caggguugcagaccc

SEQ ID NO: 2645939 - RNA, 16 nt, Escherichia coli CFT073
caggguuucgacggca

SEQ ID NO: 2645940 - RNA, 21 nt, Escherichia coli CFT073
caggguuucgacggcaccaaa

SEQ ID NO: 2645941 - RNA, 15 nt, Escherichia coli CFT073
cagguaacagggaac

SEQ ID NO: 2645942 - RNA, 19 nt, Escherichia coli CFT073
cagguaagcgauaaaaaua

SEQ ID NO: 2645943 - RNA, 20 nt, Escherichia coli CFT073
cagguaauuugaucaaauac

SEQ ID NO: 2645944 - RNA, 16 nt, Escherichia coli CFT073
cagguacucaccguug

SEQ ID NO: 2645945 - RNA, 19 nt, Escherichia coli CFT073
cagguacucaugcccacgc

SEQ ID NO: 2645946 - RNA, 21 nt, Escherichia coli CFT073
cagguacugguaagcaaagca

SEQ ID NO: 2645947 - RNA, 15 nt, Escherichia coli CFT073
cagguagcagcagcg

SEQ ID NO: 2645948 - RNA, 16 nt, Escherichia coli CFT073
cagguagcagcagcgc

SEQ ID NO: 2645949 - RNA, 18 nt, Escherichia coli CFT073
cagguagcagcagcgcca

SEQ ID NO: 2645950 - RNA, 22 nt, Escherichia coli CFT073
cagguagccggaggauguuaca

SEQ ID NO: 2645951 - RNA, 19 nt, Escherichia coli CFT073
cagguagcgccuuuacuga

SEQ ID NO: 2645952 - RNA, 20 nt, Escherichia coli CFT073
cagguagcguuucaccucuu

SEQ ID NO: 2645953 - RNA, 16 nt, Escherichia coli CFT073
cagguagucaaaagca

SEQ ID NO: 2645954 - RNA, 17 nt, Escherichia coli CFT073
cagguagucaaaagcac

SEQ ID NO: 2645955 - RNA, 22 nt, Escherichia coli CFT073
cagguagucaaaagcacucaga

SEQ ID NO: 2645956 - RNA, 15 nt, Escherichia coli CFT073
cagguaguugccagc

SEQ ID NO: 2645957 - RNA, 22 nt, Escherichia coli CFT073
cagguaguugccagcagcuccc

SEQ ID NO: 2645958 - RNA, 21 nt, Escherichia coli CFT073
cagguauaccgaaaucgccau

SEQ ID NO: 2645959 - RNA, 19 nt, Escherichia coli CFT073
cagguaucguuacgccagu

SEQ ID NO: 2645960 - RNA, 18 nt, Escherichia coli CFT073
cagguauuuugucagccc

SEQ ID NO: 2645961 - RNA, 14 nt, Escherichia coli CFT073
caggucaaucccag

SEQ ID NO: 2645962 - RNA, 19 nt, Escherichia coli CFT073
caggucaaucccaggaagc

SEQ ID NO: 2645963 - RNA, 18 nt, Escherichia coli CFT073
caggucacgggcggugcg

SEQ ID NO: 2645964 - RNA, 12 nt, Escherichia coli CFT073
caggucaucacu

SEQ ID NO: 2645965 - RNA, 18 nt, Escherichia coli CFT073
cagguccacgaccagcgc

SEQ ID NO: 2645966 - RNA, 21 nt, Escherichia coli CFT073
cagguccguauagaucagcgg

SEQ ID NO: 2645967 - RNA, 17 nt, Escherichia coli CFT073
cagguccuggcuauucu

SEQ ID NO: 2645968 - RNA, 14 nt, Escherichia coli CFT073
caggucgaaguuga

SEQ ID NO: 2645969 - RNA, 23 nt, Escherichia coli CFT073
caggucgaugcacucgccaggau

SEQ ID NO: 2645970 - RNA, 17 nt, Escherichia coli CFT073
caggucgcuugccgcca

SEQ ID NO: 2645971 - RNA, 15 nt, Escherichia coli CFT073
caggucggauaagac

SEQ ID NO: 2645972 - RNA, 17 nt, Escherichia coli CFT073
caggucggauaagacgc

SEQ ID NO: 2645973 - RNA, 17 nt, Escherichia coli CFT073
caggucguuuuccugca

SEQ ID NO: 2645974 - RNA, 20 nt, Escherichia coli CFT073
caggugacaccaccgcccgg

SEQ ID NO: 2645975 - RNA, 19 nt, Escherichia coli CFT073
caggugacgcuggcagcag

SEQ ID NO: 2645976 - RNA, 18 nt, Escherichia coli CFT073
caggugaucccccugggc

SEQ ID NO: 2645977 - RNA, 14 nt, Escherichia coli CFT073
caggugauggcagc

SEQ ID NO: 2645978 - RNA, 18 nt, Escherichia coli CFT073
caggugauggcagccauu

SEQ ID NO: 2645979 - RNA, 21 nt, Escherichia coli CFT073
caggugcagcccauaagcaaa

SEQ ID NO: 2645980 - RNA, 13 nt, Escherichia coli CFT073
caggugcccgcgu

SEQ ID NO: 2645981 - RNA, 20 nt, Escherichia coli CFT073
caggugcccgcguuucgcug

SEQ ID NO: 2645982 - RNA, 16 nt, Escherichia coli CFT073
caggugccggauuuca

SEQ ID NO: 2645983 - RNA, 16 nt, Escherichia coli CFT073
caggugcuuuuguuau

SEQ ID NO: 2645984 - RNA, 19 nt, Escherichia coli CFT073
cagguggcaaacgccaccu

SEQ ID NO: 2645985 - RNA, 16 nt, Escherichia coli CFT073
cagguggcauguuacc

SEQ ID NO: 2645986 - RNA, 20 nt, Escherichia coli CFT073
cagguggucacagucugcuc

SEQ ID NO: 2645987 - RNA, 20 nt, Escherichia coli CFT073
caggugguuagccgcguaca

SEQ ID NO: 2645988 - RNA, 14 nt, Escherichia coli CFT073
cagguguaauaaag

SEQ ID NO: 2645989 - RNA, 16 nt, Escherichia coli CFT073
cagguuaacccacagc

SEQ ID NO: 2645990 - RNA, 22 nt, Escherichia coli CFT073
cagguuaacccacagcgcacca

SEQ ID NO: 2645991 - RNA, 13 nt, Escherichia coli CFT073
cagguuaacgcag

SEQ ID NO: 2645992 - RNA, 24 nt, Escherichia coli CFT073
cagguuaacggaggagagugcaau

SEQ ID NO: 2645993 - RNA, 17 nt, Escherichia coli CFT073
cagguuacgcccuuccc

SEQ ID NO: 2645994 - RNA, 18 nt, Escherichia coli CFT073
cagguuaucggauuuagu

SEQ ID NO: 2645995 - RNA, 12 nt, Escherichia coli CFT073
cagguucaacag

SEQ ID NO: 2645996 - RNA, 14 nt, Escherichia coli CFT073
cagguugcaguugg

SEQ ID NO: 2645997 - RNA, 18 nt, Escherichia coli CFT073
cagguugccguccagcgc

SEQ ID NO: 2645998 - RNA, 22 nt, Escherichia coli CFT073
cagguuggaucaacaggcacua

SEQ ID NO: 2645999 - RNA, 20 nt, Escherichia coli CFT073
cagguuggcuuuuuuauaca

SEQ ID NO: 2646000 - RNA, 20 nt, Escherichia coli CFT073
cagguuguuuucuggcugac

SEQ ID NO: 2646001 - RNA, 16 nt, Escherichia coli CFT073
cagguuuaccagcagc

SEQ ID NO: 2646002 - RNA, 17 nt, Escherichia coli CFT073
cagguuuuucagcugcc

SEQ ID NO: 2646003 - RNA, 22 nt, Escherichia coli CFT073
caguaaaacgggcgcgaugaca

SEQ ID NO: 2646004 - RNA, 19 nt, Escherichia coli CFT073
caguaaaaucgacaucugc

SEQ ID NO: 2646005 - RNA, 20 nt, Escherichia coli CFT073
caguaaaaucgacaucugca

SEQ ID NO: 2646006 - RNA, 15 nt, Escherichia coli CFT073
caguaaacacaccac

SEQ ID NO: 2646007 - RNA, 19 nt, Escherichia coli CFT073
caguaaacacaccacagca

SEQ ID NO: 2646008 - RNA, 21 nt, Escherichia coli CFT073
caguaaaccaauuucugugca

SEQ ID NO: 2646009 - RNA, 19 nt, Escherichia coli CFT073
caguaaaccacccaccagc

SEQ ID NO: 2646010 - RNA, 14 nt, Escherichia coli CFT073
caguaaacgccagg

SEQ ID NO: 2646011 - RNA, 23 nt, Escherichia coli CFT073
caguaaacugacccgcucguuuu

SEQ ID NO: 2646012 - RNA, 13 nt, Escherichia coli CFT073
caguaaacuguca

SEQ ID NO: 2646013 - RNA, 19 nt, Escherichia coli CFT073
caguccauggcagaugauc

SEQ ID NO: 2646014 - RNA, 20 nt, Escherichia coli CFT073
caguccauggcagaugauca

SEQ ID NO: 2646015 - RNA, 14 nt, Escherichia coli CFT073
cagucccaccauca

SEQ ID NO: 2646016 - RNA, 13 nt, Escherichia coli CFT073
cagucccaucuuc

SEQ ID NO: 2646017 - RNA, 16 nt, Escherichia coli CFT073
caguccccacaucaca

SEQ ID NO: 2646018 - RNA, 18 nt, Escherichia coli CFT073
caguccccucgccccucc

SEQ ID NO: 2646019 - RNA, 21 nt, Escherichia coli CFT073
caguccccucgccccuccggg

SEQ ID NO: 2646020 - RNA, 20 nt, Escherichia coli CFT073
cagucccugaaucgccacgc

SEQ ID NO: 2646021 - RNA, 19 nt, Escherichia coli CFT073
cagucccugaaugucucca

SEQ ID NO: 2646022 - RNA, 16 nt, Escherichia coli CFT073
caguccgcgguugguu

SEQ ID NO: 2646023 - RNA, 17 nt, Escherichia coli CFT073
caguccggcuuaucugc

SEQ ID NO: 2646024 - RNA, 23 nt, Escherichia coli CFT073
caguccgguggagagcauauaaa

SEQ ID NO: 2646025 - RNA, 21 nt, Escherichia coli CFT073
caguccguggcacgguaaacu

SEQ ID NO: 2646026 - RNA, 14 nt, Escherichia coli CFT073
caguccucaucauc

SEQ ID NO: 2646027 - RNA, 15 nt, Escherichia coli CFT073
caguccuguucaaac

SEQ ID NO: 2646028 - RNA, 23 nt, Escherichia coli CFT073
cagucgaccaaacuuauccgcca

SEQ ID NO: 2646029 - RNA, 17 nt, Escherichia coli CFT073
cagucgagcaccagauc

SEQ ID NO: 2646030 - RNA, 18 nt, Escherichia coli CFT073
cagucgcaaaucagcggc

SEQ ID NO: 2646031 - RNA, 15 nt, Escherichia coli CFT073
cagucgcacgccugg

SEQ ID NO: 2646032 - RNA, 19 nt, Escherichia coli CFT073
cagucgcgcuucguuuucc

SEQ ID NO: 2646033 - RNA, 13 nt, Escherichia coli CFT073
cagucgcugauca

SEQ ID NO: 2646034 - RNA, 18 nt, Escherichia coli CFT073
cagucgcuuuaccgcugc

SEQ ID NO: 2646035 - RNA, 19 nt, Escherichia coli CFT073
cagucgcuuuaccgcugcg

SEQ ID NO: 2646036 - RNA, 23 nt, Escherichia coli CFT073
cagucgcuuuaccgcugcgccau

SEQ ID NO: 2646037 - RNA, 16 nt, Escherichia coli CFT073
cagucgggugcugccg

SEQ ID NO: 2646038 - RNA, 15 nt, Escherichia coli CFT073
cagucguaaugaauc

SEQ ID NO: 2646039 - RNA, 21 nt, Escherichia coli CFT073
cagucguaaugaaucagcaga

SEQ ID NO: 2646040 - RNA, 16 nt, Escherichia coli CFT073
cagucuccuugcucca

SEQ ID NO: 2646041 - RNA, 19 nt, Escherichia coli CFT073
cagucuggcguuuucuuuu

SEQ ID NO: 2646042 - RNA, 12 nt, Escherichia coli CFT073
cagucuuaaaaa

SEQ ID NO: 2646043 - RNA, 15 nt, Escherichia coli CFT073
cagucuuaaaaagca

SEQ ID NO: 2646044 - RNA, 16 nt, Escherichia coli CFT073
cagucuuaaaaagcag

SEQ ID NO: 2646045 - RNA, 13 nt, Escherichia coli CFT073
cagucuuccugcg

SEQ ID NO: 2646046 - RNA, 22 nt, Escherichia coli CFT073
cagucuuugccguuggcggcgu

SEQ ID NO: 2646047 - RNA, 17 nt, Escherichia coli CFT073
cagugaaaauggcgcuc

SEQ ID NO: 2646048 - RNA, 20 nt, Escherichia coli CFT073
cagugaauaagcgcccagcu

SEQ ID NO: 2646049 - RNA, 19 nt, Escherichia coli CFT073
cagugaaucucaggcaaau

SEQ ID NO: 2646050 - RNA, 16 nt, Escherichia coli CFT073
cagugaauuaaaaaca

SEQ ID NO: 2646051 - RNA, 17 nt, Escherichia coli CFT073
cagugaauuaaaaacag

SEQ ID NO: 2646052 - RNA, 16 nt, Escherichia coli CFT073
cagugacauucaccuc

SEQ ID NO: 2646053 - RNA, 13 nt, Escherichia coli CFT073
cagugaccagcgg

SEQ ID NO: 2646054 - RNA, 18 nt, Escherichia coli CFT073
cagugacccgcagccagc

SEQ ID NO: 2646055 - RNA, 20 nt, Escherichia coli CFT073
cagugaccgaaccuguuuuc

SEQ ID NO: 2646056 - RNA, 13 nt, Escherichia coli CFT073
cagugaccgucau

SEQ ID NO: 2646057 - RNA, 19 nt, Escherichia coli CFT073
cagugacggcuucucggca

SEQ ID NO: 2646058 - RNA, 16 nt, Escherichia coli CFT073
cagugacugcuuuuuc

SEQ ID NO: 2646059 - RNA, 14 nt, Escherichia coli CFT073
cagugaggaugcga

SEQ ID NO: 2646060 - RNA, 17 nt, Escherichia coli CFT073
cagugaggguuucuuca

SEQ ID NO: 2646061 - RNA, 17 nt, Escherichia coli CFT073
cagugauaucgcucugg

SEQ ID NO: 2646062 - RNA, 19 nt, Escherichia coli CFT073
cagugaucgugugccacca

SEQ ID NO: 2646063 - RNA, 23 nt, Escherichia coli CFT073
cagugaucuggcuggcaacccag

SEQ ID NO: 2646064 - RNA, 16 nt, Escherichia coli CFT073
cagugauugccgcgac

SEQ ID NO: 2646065 - RNA, 20 nt, Escherichia coli CFT073
cagugauuuucccuuccgcc

SEQ ID NO: 2646066 - RNA, 17 nt, Escherichia coli CFT073
cagugauuuuugcugaa

SEQ ID NO: 2646067 - RNA, 18 nt, Escherichia coli CFT073
cagugcaaucagcggcgu

SEQ ID NO: 2646068 - RNA, 12 nt, Escherichia coli CFT073
cagugcagaugc

SEQ ID NO: 2646069 - RNA, 16 nt, Escherichia coli CFT073
cagugcagaugcacaa

SEQ ID NO: 2646070 - RNA, 23 nt, Escherichia coli CFT073
cagugcaggaugcgacauaaacg

SEQ ID NO: 2646071 - RNA, 18 nt, Escherichia coli CFT073
cagugcaggcaccagccc

SEQ ID NO: 2646072 - RNA, 22 nt, Escherichia coli CFT073
cagugcaggcaccagccccugg

SEQ ID NO: 2646073 - RNA, 16 nt, Escherichia coli CFT073
cagugcauaaauaccg

SEQ ID NO: 2646074 - RNA, 19 nt, Escherichia coli CFT073
cagugcaucgcgaccaauc

SEQ ID NO: 2646075 - RNA, 14 nt, Escherichia coli CFT073
cagugcaugggcaa

SEQ ID NO: 2646076 - RNA, 14 nt, Escherichia coli CFT073
cagugccagaacag

SEQ ID NO: 2646077 - RNA, 15 nt, Escherichia coli CFT073
cagugccagaacaga

SEQ ID NO: 2646078 - RNA, 16 nt, Escherichia coli CFT073
cagugccagcaccacu

SEQ ID NO: 2646079 - RNA, 19 nt, Escherichia coli CFT073
cagugccaucaauaaucac

SEQ ID NO: 2646080 - RNA, 13 nt, Escherichia coli CFT073
cagugccauccca

SEQ ID NO: 2646081 - RNA, 14 nt, Escherichia coli CFT073
cagugccaucccag

SEQ ID NO: 2646082 - RNA, 16 nt, Escherichia coli CFT073
cagugccccaaauguc

SEQ ID NO: 2646083 - RNA, 23 nt, Escherichia coli CFT073
cagugccccaaaugucggaugcg

SEQ ID NO: 2646084 - RNA, 18 nt, Escherichia coli CFT073
cagugcccgaccacuuca

SEQ ID NO: 2646085 - RNA, 21 nt, Escherichia coli CFT073
cagugcccgcgauuuguuuca

SEQ ID NO: 2646086 - RNA, 19 nt, Escherichia coli CFT073
cagugcccggcccggagga

SEQ ID NO: 2646087 - RNA, 15 nt, Escherichia coli CFT073
cagugccgagauauu

SEQ ID NO: 2646088 - RNA, 17 nt, Escherichia coli CFT073
cagugccgaugccgcua

SEQ ID NO: 2646089 - RNA, 13 nt, Escherichia coli CFT073
cagugccgauggu

SEQ ID NO: 2646090 - RNA, 15 nt, Escherichia coli CFT073
cagugccgccugcgc

SEQ ID NO: 2646091 - RNA, 12 nt, Escherichia coli CFT073
cagugccgcgcc

SEQ ID NO: 2646092 - RNA, 19 nt, Escherichia coli CFT073
cagugccggucagacagcg

SEQ ID NO: 2646093 - RNA, 23 nt, Escherichia coli CFT073
cagugccucguucacauauugca

SEQ ID NO: 2646094 - RNA, 16 nt, Escherichia coli CFT073
cagugccuggcauaac

SEQ ID NO: 2646095 - RNA, 18 nt, Escherichia coli CFT073
cagugccuggcgaaagga

SEQ ID NO: 2646096 - RNA, 22 nt, Escherichia coli CFT073
cagugcggcuguuggugccaga

SEQ ID NO: 2646097 - RNA, 16 nt, Escherichia coli CFT073
cagugcggugccgcga

SEQ ID NO: 2646098 - RNA, 17 nt, Escherichia coli CFT073
cagugcggugccgcgaa

SEQ ID NO: 2646099 - RNA, 14 nt, Escherichia coli CFT073
cagugcguaagcgc

SEQ ID NO: 2646100 - RNA, 15 nt, Escherichia coli CFT073
cagugcguacccagc

SEQ ID NO: 2646101 - RNA, 16 nt, Escherichia coli CFT073
cagugcguacccagcg

SEQ ID NO: 2646102 - RNA, 14 nt, Escherichia coli CFT073
cagugcguuacaca

SEQ ID NO: 2646103 - RNA, 20 nt, Escherichia coli CFT073
cagugcuccaccuugcggaa

SEQ ID NO: 2646104 - RNA, 20 nt, Escherichia coli CFT073
cagugcugcauccugcacca

SEQ ID NO: 2646105 - RNA, 14 nt, Escherichia coli CFT073
cagugcuuuaauca

SEQ ID NO: 2646106 - RNA, 22 nt, Escherichia coli CFT073
caguggaaucaaugugcuuuca

SEQ ID NO: 2646107 - RNA, 13 nt, Escherichia coli CFT073
caguggaaucauc

SEQ ID NO: 2646108 - RNA, 13 nt, Escherichia coli CFT073
caguggagccauc

SEQ ID NO: 2646109 - RNA, 15 nt, Escherichia coli CFT073
caguggaugcgccau

SEQ ID NO: 2646110 - RNA, 21 nt, Escherichia coli CFT073
caguggaugcgccauaccaug

SEQ ID NO: 2646111 - RNA, 22 nt, Escherichia coli CFT073
caguggcacuaauuaagacuga

SEQ ID NO: 2646112 - RNA, 17 nt, Escherichia coli CFT073
caguggcgcaucagcag

SEQ ID NO: 2646113 - RNA, 15 nt, Escherichia coli CFT073
cagugguaucaauau

SEQ ID NO: 2646114 - RNA, 17 nt, Escherichia coli CFT073
cagugguaucaauaucc

SEQ ID NO: 2646115 - RNA, 18 nt, Escherichia coli CFT073
cagugguaucaauaucca

SEQ ID NO: 2646116 - RNA, 21 nt, Escherichia coli CFT073
cagugguuaccgaauccagca

SEQ ID NO: 2646117 - RNA, 24 nt, Escherichia coli CFT073
cagugguuaccgaauccagcaagc

SEQ ID NO: 2646118 - RNA, 21 nt, Escherichia coli CFT073
cagugucacguuaaauaaaaa

SEQ ID NO: 2646119 - RNA, 14 nt, Escherichia coli CFT073
cagugucauuguca

SEQ ID NO: 2646120 - RNA, 14 nt, Escherichia coli CFT073
caguguccaaccga

SEQ ID NO: 2646121 - RNA, 21 nt, Escherichia coli CFT073
cauaaagcgcaauauuucucu

SEQ ID NO: 2646122 - RNA, 17 nt, Escherichia coli CFT073
cauaaagcgguuuucaa

SEQ ID NO: 2646123 - RNA, 11 nt, Escherichia coli CFT073
cauaaauaaca

SEQ ID NO: 2646124 - RNA, 16 nt, Escherichia coli CFT073
cauaaaucagaucgac

SEQ ID NO: 2646125 - RNA, 13 nt, Escherichia coli CFT073
cauaaaucagcgu

SEQ ID NO: 2646126 - RNA, 14 nt, Escherichia coli CFT073
cauaaauuugugcc

SEQ ID NO: 2646127 - RNA, 19 nt, Escherichia coli CFT073
cauaacaaauaucuuucua

SEQ ID NO: 2646128 - RNA, 21 nt, Escherichia coli CFT073
cauaacacaauaccuucugcg

SEQ ID NO: 2646129 - RNA, 17 nt, Escherichia coli CFT073
cauaacagaauaucugc

SEQ ID NO: 2646130 - RNA, 13 nt, Escherichia coli CFT073
cauaaccaacaaa

SEQ ID NO: 2646131 - RNA, 19 nt, Escherichia coli CFT073
cauaaccagguaaagacca

SEQ ID NO: 2646132 - RNA, 17 nt, Escherichia coli CFT073
cauaaccagugacggaa

SEQ ID NO: 2646133 - RNA, 22 nt, Escherichia coli CFT073
cauaaccagugacggaacucuu

SEQ ID NO: 2646134 - RNA, 12 nt, Escherichia coli CFT073
cauaaccgauac

SEQ ID NO: 2646135 - RNA, 19 nt, Escherichia coli CFT073
cauaaccgccagcacagcc

SEQ ID NO: 2646136 - RNA, 22 nt, Escherichia coli CFT073
cauaaccuguuccuuauucugu

SEQ ID NO: 2646137 - RNA, 21 nt, Escherichia coli CFT073
cauaacgccaauucauuccuu

SEQ ID NO: 2646138 - RNA, 19 nt, Escherichia coli CFT073
cauaacgcugauauuucgg

SEQ ID NO: 2646139 - RNA, 23 nt, Escherichia coli CFT073
cauaacgcugauauuucggcacu

SEQ ID NO: 2646140 - RNA, 19 nt, Escherichia coli CFT073
cauaacgcuggggaaugcc

SEQ ID NO: 2646141 - RNA, 22 nt, Escherichia coli CFT073
cauaacgcuggggaaugccaug

SEQ ID NO: 2646142 - RNA, 18 nt, Escherichia coli CFT073
cauaacggcccggcgacg

SEQ ID NO: 2646143 - RNA, 19 nt, Escherichia coli CFT073
cauaacuagcaacaaaaaa

SEQ ID NO: 2646144 - RNA, 13 nt, Escherichia coli CFT073
cauaacucaccau

SEQ ID NO: 2646145 - RNA, 17 nt, Escherichia coli CFT073
cauaacuggucaucaag

SEQ ID NO: 2646146 - RNA, 17 nt, Escherichia coli CFT073
cauaacuuugaucgcgu

SEQ ID NO: 2646147 - RNA, 21 nt, Escherichia coli CFT073
cauaagcaaauccuuccgcca

SEQ ID NO: 2646148 - RNA, 14 nt, Escherichia coli CFT073
cauaagcaccgaac

SEQ ID NO: 2646149 - RNA, 18 nt, Escherichia coli CFT073
cauaagcaccgaacaaga

SEQ ID NO: 2646150 - RNA, 23 nt, Escherichia coli CFT073
cauaagcaccgaacaagaaacag

SEQ ID NO: 2646151 - RNA, 15 nt, Escherichia coli CFT073
cauaagccgcggcgu

SEQ ID NO: 2646152 - RNA, 14 nt, Escherichia coli CFT073
cauaaggugggagg

SEQ ID NO: 2646153 - RNA, 18 nt, Escherichia coli CFT073
cauaaguaguuguucaga

SEQ ID NO: 2646154 - RNA, 23 nt, Escherichia coli CFT073
cauaauaaccucaugguuuuuau

SEQ ID NO: 2646155 - RNA, 21 nt, Escherichia coli CFT073
cauaauaaucuacuaauaaau

SEQ ID NO: 2646156 - RNA, 15 nt, Escherichia coli CFT073
cauaauacugacaaa

SEQ ID NO: 2646157 - RNA, 20 nt, Escherichia coli CFT073
cauaauacugacaaaaccga

SEQ ID NO: 2646158 - RNA, 19 nt, Escherichia coli CFT073
cauaauauagcagcgccgg

SEQ ID NO: 2646159 - RNA, 23 nt, Escherichia coli CFT073
cauaauaucuuuccuuaacaaaa

SEQ ID NO: 2646160 - RNA, 20 nt, Escherichia coli CFT073
cauaauauucauuacaccaa

SEQ ID NO: 2646161 - RNA, 23 nt, Escherichia coli CFT073
cauaauauucauuacaccaauac

SEQ ID NO: 2646162 - RNA, 16 nt, Escherichia coli CFT073
cauaauauugccggga

SEQ ID NO: 2646163 - RNA, 22 nt, Escherichia coli CFT073
cauaauauugccgggaacaccg

SEQ ID NO: 2646164 - RNA, 14 nt, Escherichia coli CFT073
cauaaucaaauaaa

SEQ ID NO: 2646165 - RNA, 18 nt, Escherichia coli CFT073
cauaaucaaugccaggac

SEQ ID NO: 2646166 - RNA, 12 nt, Escherichia coli CFT073
cauaauccacuu

SEQ ID NO: 2646167 - RNA, 22 nt, Escherichia coli CFT073
cauaauccagccuucuauaucu

SEQ ID NO: 2646168 - RNA, 16 nt, Escherichia coli CFT073
cauaauccaggcauca

SEQ ID NO: 2646169 - RNA, 13 nt, Escherichia coli CFT073
cauaauccagguu

SEQ ID NO: 2646170 - RNA, 13 nt, Escherichia coli CFT073
cauaauccgccgc

SEQ ID NO: 2646171 - RNA, 13 nt, Escherichia coli CFT073
cauaauccggguu

SEQ ID NO: 2646172 - RNA, 15 nt, Escherichia coli CFT073
cauaauccuguagau

SEQ ID NO: 2646173 - RNA, 16 nt, Escherichia coli CFT073
cauaauccuguagaua

SEQ ID NO: 2646174 - RNA, 21 nt, Escherichia coli CFT073
cauaaucgcuacgccuuccgu

SEQ ID NO: 2646175 - RNA, 18 nt, Escherichia coli CFT073
cauaaucgggaugcguaa

SEQ ID NO: 2646176 - RNA, 20 nt, Escherichia coli CFT073
cauaaucgggaugcguaaca

SEQ ID NO: 2646177 - RNA, 22 nt, Escherichia coli CFT073
cauaaugauggggucacagguu

SEQ ID NO: 2646178 - RNA, 20 nt, Escherichia coli CFT073
cauaaugauggugaaagcaa

SEQ ID NO: 2646179 - RNA, 13 nt, Escherichia coli CFT073
cauaaugccugca

SEQ ID NO: 2646180 - RNA, 19 nt, Escherichia coli CFT073
cauaaugggcgcgggcaau

SEQ ID NO: 2646181 - RNA, 16 nt, Escherichia coli CFT073
cauaauguaaacaaga

SEQ ID NO: 2646182 - RNA, 23 nt, Escherichia coli CFT073
cauaauguuaugucauugccuga

SEQ ID NO: 2646183 - RNA, 20 nt, Escherichia coli CFT073
cauaauucagaucgcuacca

SEQ ID NO: 2646184 - RNA, 17 nt, Escherichia coli CFT073
cauacaaugcaauauuu

SEQ ID NO: 2646185 - RNA, 13 nt, Escherichia coli CFT073
cauacacagauaa

SEQ ID NO: 2646186 - RNA, 13 nt, Escherichia coli CFT073
cauacacaucacg

SEQ ID NO: 2646187 - RNA, 14 nt, Escherichia coli CFT073
cauacaccaccaca

SEQ ID NO: 2646188 - RNA, 11 nt, Escherichia coli CFT073
cauacagccag

SEQ ID NO: 2646189 - RNA, 18 nt, Escherichia coli CFT073
cauacaggggaucgacgc

SEQ ID NO: 2646190 - RNA, 13 nt, Escherichia coli CFT073
cauacauaaaucg

SEQ ID NO: 2646191 - RNA, 15 nt, Escherichia coli CFT073
cauacauaacagaau

SEQ ID NO: 2646192 - RNA, 13 nt, Escherichia coli CFT073
cauacaucaacgc

SEQ ID NO: 2646193 - RNA, 14 nt, Escherichia coli CFT073
cauacaucaacgcg

SEQ ID NO: 2646194 - RNA, 19 nt, Escherichia coli CFT073
cauacauggcauccccugc

SEQ ID NO: 2646195 - RNA, 14 nt, Escherichia coli CFT073
cauaccaagcccga

SEQ ID NO: 2646196 - RNA, 22 nt, Escherichia coli CFT073
cauaccacagcaaaacgcccgc

SEQ ID NO: 2646197 - RNA, 17 nt, Escherichia coli CFT073
cauaccacauacauaau

SEQ ID NO: 2646198 - RNA, 18 nt, Escherichia coli CFT073
cauaccacuuccagcaga

SEQ ID NO: 2646199 - RNA, 19 nt, Escherichia coli CFT073
cauaccagcacauaacuca

SEQ ID NO: 2646200 - RNA, 18 nt, Escherichia coli CFT073
cauaccagcagcaucacg

SEQ ID NO: 2646201 - RNA, 13 nt, Escherichia coli CFT073
cauaccagcagga

SEQ ID NO: 2646202 - RNA, 23 nt, Escherichia coli CFT073
cauaccagcaggaaucccaucag

SEQ ID NO: 2646203 - RNA, 14 nt, Escherichia coli CFT073
cauaccauauuguu

SEQ ID NO: 2646204 - RNA, 13 nt, Escherichia coli CFT073
cauaccauugcgc

SEQ ID NO: 2646205 - RNA, 22 nt, Escherichia coli CFT073
cauacccacgaaaucuuccagu

SEQ ID NO: 2646206 - RNA, 14 nt, Escherichia coli CFT073
cauacccaguuuca

SEQ ID NO: 2646207 - RNA, 16 nt, Escherichia coli CFT073
cauacccauauugaac

SEQ ID NO: 2646208 - RNA, 14 nt, Escherichia coli CFT073
cauaccgaucgcgg

SEQ ID NO: 2646209 - RNA, 18 nt, Escherichia coli CFT073
cauaccgccgaggaacau

SEQ ID NO: 2646210 - RNA, 16 nt, Escherichia coli CFT073
cauaccgucgccagac

SEQ ID NO: 2646211 - RNA, 20 nt, Escherichia coli CFT073
cauaccuaaaagcacgccag

SEQ ID NO: 2646212 - RNA, 16 nt, Escherichia coli CFT073
cauaccuaccugcagu

SEQ ID NO: 2646213 - RNA, 16 nt, Escherichia coli CFT073
cauaccuauuuaaauc

SEQ ID NO: 2646214 - RNA, 20 nt, Escherichia coli CFT073
cauaccuggugcagcgguuc

SEQ ID NO: 2646215 - RNA, 20 nt, Escherichia coli CFT073
cauaccuucacaaaaugcca

SEQ ID NO: 2646216 - RNA, 21 nt, Escherichia coli CFT073
cauacgacuuugcgcaggcaa

SEQ ID NO: 2646217 - RNA, 20 nt, Escherichia coli CFT073
cauacggaaaaucucauuug

SEQ ID NO: 2646218 - RNA, 21 nt, Escherichia coli CFT073
cauacggcauuuucccugcgu

SEQ ID NO: 2646219 - RNA, 18 nt, Escherichia coli CFT073
cauacggcgguucuuuca

SEQ ID NO: 2646220 - RNA, 20 nt, Escherichia coli CFT073
cauacguggcagaaugguuu

SEQ ID NO: 2646221 - RNA, 14 nt, Escherichia coli CFT073
cauacuauugccau

SEQ ID NO: 2646222 - RNA, 18 nt, Escherichia coli CFT073
cauacucacaucaacaac

SEQ ID NO: 2646223 - RNA, 16 nt, Escherichia coli CFT073
cauacucagcgccugc

SEQ ID NO: 2646224 - RNA, 13 nt, Escherichia coli CFT073
cauacucaucuuc

SEQ ID NO: 2646225 - RNA, 14 nt, Escherichia coli CFT073
cauacucuccucca

SEQ ID NO: 2646226 - RNA, 19 nt, Escherichia coli CFT073
cauacucuuucccggcaau

SEQ ID NO: 2646227 - RNA, 17 nt, Escherichia coli CFT073
cauacugcaucagcgcc

SEQ ID NO: 2646228 - RNA, 19 nt, Escherichia coli CFT073
cauacugccgaccaucugu

SEQ ID NO: 2646229 - RNA, 14 nt, Escherichia coli CFT073
caucagcagcaaca

SEQ ID NO: 2646230 - RNA, 23 nt, Escherichia coli CFT073
caucagcaucggugaggaucacc

SEQ ID NO: 2646231 - RNA, 21 nt, Escherichia coli CFT073
caucagccaggguucccggcc

SEQ ID NO: 2646232 - RNA, 13 nt, Escherichia coli CFT073
caucagcgcccuc

SEQ ID NO: 2646233 - RNA, 20 nt, Escherichia coli CFT073
caucagcgggccugguugca

SEQ ID NO: 2646234 - RNA, 21 nt, Escherichia coli CFT073
caucagcggguuuucuacuuu

SEQ ID NO: 2646235 - RNA, 19 nt, Escherichia coli CFT073
caucagcuccaugggagaa

SEQ ID NO: 2646236 - RNA, 21 nt, Escherichia coli CFT073
caucagcuuacgguaggcacg

SEQ ID NO: 2646237 - RNA, 16 nt, Escherichia coli CFT073
caucaggcaaacuuca

SEQ ID NO: 2646238 - RNA, 17 nt, Escherichia coli CFT073
caucaggcaacccgcac

SEQ ID NO: 2646239 - RNA, 18 nt, Escherichia coli CFT073
caucaggcaacccgcaca

SEQ ID NO: 2646240 - RNA, 17 nt, Escherichia coli CFT073
caucaggcaaucggcgc

SEQ ID NO: 2646241 - RNA, 21 nt, Escherichia coli CFT073
caucaggcagauacaaccaau

SEQ ID NO: 2646242 - RNA, 21 nt, Escherichia coli CFT073
caucaggcaucgugcaccaau

SEQ ID NO: 2646243 - RNA, 15 nt, Escherichia coli CFT073
caucaggccgccagc

SEQ ID NO: 2646244 - RNA, 22 nt, Escherichia coli CFT073
caucaguaaaguaucaaacaga

SEQ ID NO: 2646245 - RNA, 17 nt, Escherichia coli CFT073
caucaguaacuuacuua

SEQ ID NO: 2646246 - RNA, 21 nt, Escherichia coli CFT073
caucaguagcaguaauuuaua

SEQ ID NO: 2646247 - RNA, 17 nt, Escherichia coli CFT073
caucaguagcauccccg

SEQ ID NO: 2646248 - RNA, 17 nt, Escherichia coli CFT073
caucagucagguuggca

SEQ ID NO: 2646249 - RNA, 15 nt, Escherichia coli CFT073
caucagugaacccau

SEQ ID NO: 2646250 - RNA, 20 nt, Escherichia coli CFT073
caucagugaucagccacagu

SEQ ID NO: 2646251 - RNA, 20 nt, Escherichia coli CFT073
caucaguguccagaugcugu

SEQ ID NO: 2646252 - RNA, 20 nt, Escherichia coli CFT073
caucaguuucgaucagcaau

SEQ ID NO: 2646253 - RNA, 22 nt, Escherichia coli CFT073
caucaguuucgaucagcaauuu

SEQ ID NO: 2646254 - RNA, 14 nt, Escherichia coli CFT073
caucauaauaauug

SEQ ID NO: 2646255 - RNA, 16 nt, Escherichia coli CFT073
caucauacuggcucug

SEQ ID NO: 2646256 - RNA, 20 nt, Escherichia coli CFT073
caucauaucgucauuaucgc

SEQ ID NO: 2646257 - RNA, 18 nt, Escherichia coli CFT073
caucauauggaagaaacg

SEQ ID NO: 2646258 - RNA, 22 nt, Escherichia coli CFT073
caucauauucauagcacauccu

SEQ ID NO: 2646259 - RNA, 20 nt, Escherichia coli CFT073
caucaucaagguaauuguuc

SEQ ID NO: 2646260 - RNA, 16 nt, Escherichia coli CFT073
caucaucacuuuuucc

SEQ ID NO: 2646261 - RNA, 19 nt, Escherichia coli CFT073
caucaucagaaaugccagu

SEQ ID NO: 2646262 - RNA, 14 nt, Escherichia coli CFT073
caucaucaucggca

SEQ ID NO: 2646263 - RNA, 18 nt, Escherichia coli CFT073
caucauccccaucgccgc

SEQ ID NO: 2646264 - RNA, 22 nt, Escherichia coli CFT073
caucauccccguaucuucaugc

SEQ ID NO: 2646265 - RNA, 14 nt, Escherichia coli CFT073
caucauccgcgcaa

SEQ ID NO: 2646266 - RNA, 15 nt, Escherichia coli CFT073
caucaucgcagauuu

SEQ ID NO: 2646267 - RNA, 16 nt, Escherichia coli CFT073
caucaucgccccgcuc

SEQ ID NO: 2646268 - RNA, 23 nt, Escherichia coli CFT073
caucaucgcgaucccccagaaaa

SEQ ID NO: 2646269 - RNA, 13 nt, Escherichia coli CFT073
caucaucgcuuuc

SEQ ID NO: 2646270 - RNA, 20 nt, Escherichia coli CFT073
caucaucggcaccgccagca

SEQ ID NO: 2646271 - RNA, 16 nt, Escherichia coli CFT073
caucaucgugaccaaa

SEQ ID NO: 2646272 - RNA, 23 nt, Escherichia coli CFT073
caucaugaucugugugguuuugu

SEQ ID NO: 2646273 - RNA, 16 nt, Escherichia coli CFT073
caucauggaagcaaug

SEQ ID NO: 2646274 - RNA, 20 nt, Escherichia coli CFT073
caucauuaacgccucaagua

SEQ ID NO: 2646275 - RNA, 13 nt, Escherichia coli CFT073
caucauuaacugc

SEQ ID NO: 2646276 - RNA, 16 nt, Escherichia coli CFT073
caucauucaaugcuca

SEQ ID NO: 2646277 - RNA, 21 nt, Escherichia coli CFT073
caucauucaaugcucacccgc

SEQ ID NO: 2646278 - RNA, 14 nt, Escherichia coli CFT073
caucauugacagac

SEQ ID NO: 2646279 - RNA, 16 nt, Escherichia coli CFT073
caucauugcgccgaac

SEQ ID NO: 2646280 - RNA, 23 nt, Escherichia coli CFT073
caucauugcgccgaacaacagug

SEQ ID NO: 2646281 - RNA, 21 nt, Escherichia coli CFT073
caucauugguuaacuccagcg

SEQ ID NO: 2646282 - RNA, 18 nt, Escherichia coli CFT073
caucauuucccacgcggc

SEQ ID NO: 2646283 - RNA, 12 nt, Escherichia coli CFT073
caucauuuugcu

SEQ ID NO: 2646284 - RNA, 15 nt, Escherichia coli CFT073
cauccaacaauaaaa

SEQ ID NO: 2646285 - RNA, 23 nt, Escherichia coli CFT073
cauccaagcugguggcaaucgcg

SEQ ID NO: 2646286 - RNA, 20 nt, Escherichia coli CFT073
cauccacaccaaaauaacga

SEQ ID NO: 2646287 - RNA, 16 nt, Escherichia coli CFT073
cauccacauucgcaac

SEQ ID NO: 2646288 - RNA, 15 nt, Escherichia coli CFT073
cauccaccagcccca

SEQ ID NO: 2646289 - RNA, 16 nt, Escherichia coli CFT073
cauccaccguaagauc

SEQ ID NO: 2646290 - RNA, 16 nt, Escherichia coli CFT073
cauccaccuggccccg

SEQ ID NO: 2646291 - RNA, 14 nt, Escherichia coli CFT073
cauccacgaccaga

SEQ ID NO: 2646292 - RNA, 23 nt, Escherichia coli CFT073
cauccacgccuuuuuucacgaug

SEQ ID NO: 2646293 - RNA, 22 nt, Escherichia coli CFT073
cauccacuaacccuucgccagc

SEQ ID NO: 2646294 - RNA, 21 nt, Escherichia coli CFT073
cauccacugcauacugaacca

SEQ ID NO: 2646295 - RNA, 18 nt, Escherichia coli CFT073
cauccagaaaguaacaau

SEQ ID NO: 2646296 - RNA, 13 nt, Escherichia coli CFT073
cauccagaugucu

SEQ ID NO: 2646297 - RNA, 20 nt, Escherichia coli CFT073
cauccagcaacaacagcgcg

SEQ ID NO: 2646298 - RNA, 11 nt, Escherichia coli CFT073
cauccagcagc

SEQ ID NO: 2646299 - RNA, 14 nt, Escherichia coli CFT073
cauccagcagcccu

SEQ ID NO: 2646300 - RNA, 12 nt, Escherichia coli CFT073
cauccagcagcg

SEQ ID NO: 2646301 - RNA, 19 nt, Escherichia coli CFT073
cauccagccuggaauuucu

SEQ ID NO: 2646302 - RNA, 21 nt, Escherichia coli CFT073
cauccagcggcagaguaauug

SEQ ID NO: 2646303 - RNA, 22 nt, Escherichia coli CFT073
cauccagcguucuaucagggcu

SEQ ID NO: 2646304 - RNA, 14 nt, Escherichia coli CFT073
cauccagcucaagu

SEQ ID NO: 2646305 - RNA, 16 nt, Escherichia coli CFT073
cauccagcucaagugc

SEQ ID NO: 2646306 - RNA, 16 nt, Escherichia coli CFT073
cauccagcugccaggc

SEQ ID NO: 2646307 - RNA, 14 nt, Escherichia coli CFT073
cauccaggcaaagu

SEQ ID NO: 2646308 - RNA, 21 nt, Escherichia coli CFT073
cauccaggcaaaguacacauu

SEQ ID NO: 2646309 - RNA, 12 nt, Escherichia coli CFT073
cauccaggccaa

SEQ ID NO: 2646310 - RNA, 17 nt, Escherichia coli CFT073
cauccaguacgccuuca

SEQ ID NO: 2646311 - RNA, 14 nt, Escherichia coli CFT073
cauccagugaaaug

SEQ ID NO: 2646312 - RNA, 13 nt, Escherichia coli CFT073
cauccaguugcgc

SEQ ID NO: 2646313 - RNA, 15 nt, Escherichia coli CFT073
cauccaguugcgccg

SEQ ID NO: 2646314 - RNA, 17 nt, Escherichia coli CFT073
cauccauaaucacgcug

SEQ ID NO: 2646315 - RNA, 19 nt, Escherichia coli CFT073
cauccauagcuuuggcggc

SEQ ID NO: 2646316 - RNA, 23 nt, Escherichia coli CFT073
cauccauaucgccauugcuggug

SEQ ID NO: 2646317 - RNA, 19 nt, Escherichia coli CFT073
cauccaucggcgcuucaau

SEQ ID NO: 2646318 - RNA, 15 nt, Escherichia coli CFT073
cauccaugcacugca

SEQ ID NO: 2646319 - RNA, 16 nt, Escherichia coli CFT073
cauccaugcacugcaa

SEQ ID NO: 2646320 - RNA, 14 nt, Escherichia coli CFT073
cauccaugcggcag

SEQ ID NO: 2646321 - RNA, 16 nt, Escherichia coli CFT073
cauccauuaacagcgg

SEQ ID NO: 2646322 - RNA, 16 nt, Escherichia coli CFT073
cauccauuacaucacg

SEQ ID NO: 2646323 - RNA, 20 nt, Escherichia coli CFT073
cauccauugcauaaacaccu

SEQ ID NO: 2646324 - RNA, 15 nt, Escherichia coli CFT073
caucccacacuguug

SEQ ID NO: 2646325 - RNA, 16 nt, Escherichia coli CFT073
caucccaccugaaaug

SEQ ID NO: 2646326 - RNA, 20 nt, Escherichia coli CFT073
cauccccaaaaaaucaacga

SEQ ID NO: 2646327 - RNA, 13 nt, Escherichia coli CFT073
cauccccacagaa

SEQ ID NO: 2646328 - RNA, 20 nt, Escherichia coli CFT073
cauccccggcaaccacaccc

SEQ ID NO: 2646329 - RNA, 15 nt, Escherichia coli CFT073
cauccccuccccggc

SEQ ID NO: 2646330 - RNA, 13 nt, Escherichia coli CFT073
cauccccugacug

SEQ ID NO: 2646331 - RNA, 21 nt, Escherichia coli CFT073
caucccgcacacuaccaaaac

SEQ ID NO: 2646332 - RNA, 14 nt, Escherichia coli CFT073
caucccggcaggaa

SEQ ID NO: 2646333 - RNA, 18 nt, Escherichia coli CFT073
caucccugaaaugugcgc

SEQ ID NO: 2646334 - RNA, 22 nt, Escherichia coli CFT073
caucccuucaccuacgcuggca

SEQ ID NO: 2646335 - RNA, 19 nt, Escherichia coli CFT073
caucccuucguaaacgcga

SEQ ID NO: 2646336 - RNA, 21 nt, Escherichia coli CFT073
caucccuucguaaacgcgaag

SEQ ID NO: 2646337 - RNA, 21 nt, Escherichia coli CFT073
caucgccaggaacaacgacag

SEQ ID NO: 2646338 - RNA, 20 nt, Escherichia coli CFT073
caucgccauaaacaccagca

SEQ ID NO: 2646339 - RNA, 16 nt, Escherichia coli CFT073
caucgccaugaugagc

SEQ ID NO: 2646340 - RNA, 20 nt, Escherichia coli CFT073
caucgccaugaugagcgcca

SEQ ID NO: 2646341 - RNA, 20 nt, Escherichia coli CFT073
caucgccauuaccaccaccu

SEQ ID NO: 2646342 - RNA, 12 nt, Escherichia coli CFT073
caucgccauuua

SEQ ID NO: 2646343 - RNA, 15 nt, Escherichia coli CFT073
caucgcccacaccac

SEQ ID NO: 2646344 - RNA, 19 nt, Escherichia coli CFT073
caucgcccacaccacgcca

SEQ ID NO: 2646345 - RNA, 14 nt, Escherichia coli CFT073
caucgcccagccau

SEQ ID NO: 2646346 - RNA, 22 nt, Escherichia coli CFT073
caucgcccagccaucgacacca

SEQ ID NO: 2646347 - RNA, 13 nt, Escherichia coli CFT073
caucgcccgcaac

SEQ ID NO: 2646348 - RNA, 13 nt, Escherichia coli CFT073
caucgcccgcagg

SEQ ID NO: 2646349 - RNA, 16 nt, Escherichia coli CFT073
caucgcccggcguggu

SEQ ID NO: 2646350 - RNA, 19 nt, Escherichia coli CFT073
caucgcccucuuucaccag

SEQ ID NO: 2646351 - RNA, 14 nt, Escherichia coli CFT073
caucgcccugaugg

SEQ ID NO: 2646352 - RNA, 16 nt, Escherichia coli CFT073
caucgcccugauggcg

SEQ ID NO: 2646353 - RNA, 13 nt, Escherichia coli CFT073
caucgcgacggca

SEQ ID NO: 2646354 - RNA, 12 nt, Escherichia coli CFT073
caucgcgccaac

SEQ ID NO: 2646355 - RNA, 17 nt, Escherichia coli CFT073
caucgcgcccgccgcca

SEQ ID NO: 2646356 - RNA, 23 nt, Escherichia coli CFT073
caucgcgcccgccgccauugaau

SEQ ID NO: 2646357 - RNA, 14 nt, Escherichia coli CFT073
caucgcgcuggcgc

SEQ ID NO: 2646358 - RNA, 15 nt, Escherichia coli CFT073
caucgcgcuuaucgc

SEQ ID NO: 2646359 - RNA, 18 nt, Escherichia coli CFT073
caucgcgcuuaucgccag

SEQ ID NO: 2646360 - RNA, 14 nt, Escherichia coli CFT073
caucgcggcugcgu

SEQ ID NO: 2646361 - RNA, 23 nt, Escherichia coli CFT073
caucgcggcugcguaauucgcca

SEQ ID NO: 2646362 - RNA, 21 nt, Escherichia coli CFT073
caucgcgguaauaaacgcccg

SEQ ID NO: 2646363 - RNA, 19 nt, Escherichia coli CFT073
caucgcgguuaugccgccg

SEQ ID NO: 2646364 - RNA, 21 nt, Escherichia coli CFT073
caucgcgguuaugccgccgac

SEQ ID NO: 2646365 - RNA, 15 nt, Escherichia coli CFT073
caucgcguuaauccg

SEQ ID NO: 2646366 - RNA, 14 nt, Escherichia coli CFT073
caucgcuacaccaa

SEQ ID NO: 2646367 - RNA, 20 nt, Escherichia coli CFT073
caucgcuacaccaaucguca

SEQ ID NO: 2646368 - RNA, 22 nt, Escherichia coli CFT073
caucgcuacaggcuaucggcca

SEQ ID NO: 2646369 - RNA, 18 nt, Escherichia coli CFT073
caucgcuacauaacgcag

SEQ ID NO: 2646370 - RNA, 21 nt, Escherichia coli CFT073
caucgcugaacgggccaucca

SEQ ID NO: 2646371 - RNA, 18 nt, Escherichia coli CFT073
caucgcugaauuucgccg

SEQ ID NO: 2646372 - RNA, 15 nt, Escherichia coli CFT073
caucgcuggaggcau

SEQ ID NO: 2646373 - RNA, 16 nt, Escherichia coli CFT073
caucgcuuaacccaaa

SEQ ID NO: 2646374 - RNA, 15 nt, Escherichia coli CFT073
caucggcaacgccag

SEQ ID NO: 2646375 - RNA, 16 nt, Escherichia coli CFT073
caucggcaacgccagc

SEQ ID NO: 2646376 - RNA, 15 nt, Escherichia coli CFT073
caucggcaauuuacc

SEQ ID NO: 2646377 - RNA, 19 nt, Escherichia coli CFT073
caucggcaauuuaccgccg

SEQ ID NO: 2646378 - RNA, 19 nt, Escherichia coli CFT073
caucggcaccgccagcagg

SEQ ID NO: 2646379 - RNA, 21 nt, Escherichia coli CFT073
caucggcagacagcgccaggc

SEQ ID NO: 2646380 - RNA, 14 nt, Escherichia coli CFT073
caucggcagcgcca

SEQ ID NO: 2646381 - RNA, 15 nt, Escherichia coli CFT073
caucggcagcgccaa

SEQ ID NO: 2646382 - RNA, 20 nt, Escherichia coli CFT073
caucggcagcgccaaucgcu

SEQ ID NO: 2646383 - RNA, 13 nt, Escherichia coli CFT073
caucggcaucaaa

SEQ ID NO: 2646384 - RNA, 13 nt, Escherichia coli CFT073
caucggccugcaa

SEQ ID NO: 2646385 - RNA, 19 nt, Escherichia coli CFT073
caucggccuuuaacgccac

SEQ ID NO: 2646386 - RNA, 14 nt, Escherichia coli CFT073
caucggcgcuggcg

SEQ ID NO: 2646387 - RNA, 21 nt, Escherichia coli CFT073
caucggcgucgguuucgcgca

SEQ ID NO: 2646388 - RNA, 22 nt, Escherichia coli CFT073
caucggcuuauucauaucaaac

SEQ ID NO: 2646389 - RNA, 23 nt, Escherichia coli CFT073
caucggcuugaggaagcgcgccg

SEQ ID NO: 2646390 - RNA, 18 nt, Escherichia coli CFT073
caucgggacaugauacgc

SEQ ID NO: 2646391 - RNA, 18 nt, Escherichia coli CFT073
caucgggauagucaaaua

SEQ ID NO: 2646392 - RNA, 15 nt, Escherichia coli CFT073
caucgggcaauggcu

SEQ ID NO: 2646393 - RNA, 22 nt, Escherichia coli CFT073
caucggggcugaugaaguugaa

SEQ ID NO: 2646394 - RNA, 15 nt, Escherichia coli CFT073
caucgguauaaccaa

SEQ ID NO: 2646395 - RNA, 19 nt, Escherichia coli CFT073
caucgguauaaccaaauga

SEQ ID NO: 2646396 - RNA, 21 nt, Escherichia coli CFT073
caucgguaucaucccagccaa

SEQ ID NO: 2646397 - RNA, 19 nt, Escherichia coli CFT073
caucggugaggaucaccag

SEQ ID NO: 2646398 - RNA, 15 nt, Escherichia coli CFT073
caucggugaucagcg

SEQ ID NO: 2646399 - RNA, 16 nt, Escherichia coli CFT073
caucggugaugcucuu

SEQ ID NO: 2646400 - RNA, 19 nt, Escherichia coli CFT073
caucggugcgagagcggag

SEQ ID NO: 2646401 - RNA, 14 nt, Escherichia coli CFT073
caucgguuaacccg

SEQ ID NO: 2646402 - RNA, 19 nt, Escherichia coli CFT073
caucgguucgaugauaugc

SEQ ID NO: 2646403 - RNA, 21 nt, Escherichia coli CFT073
caucguauuggugcauaacac

SEQ ID NO: 2646404 - RNA, 14 nt, Escherichia coli CFT073
caucgucgccagac

SEQ ID NO: 2646405 - RNA, 17 nt, Escherichia coli CFT073
caucgucuccagcgaau

SEQ ID NO: 2646406 - RNA, 21 nt, Escherichia coli CFT073
caucgucugcggugcgccaaa

SEQ ID NO: 2646407 - RNA, 14 nt, Escherichia coli CFT073
caucgugauuaaac

SEQ ID NO: 2646408 - RNA, 12 nt, Escherichia coli CFT073
caucgugcacca

SEQ ID NO: 2646409 - RNA, 13 nt, Escherichia coli CFT073
caucgugcaccaa

SEQ ID NO: 2646410 - RNA, 19 nt, Escherichia coli CFT073
caucgugcucgcuuuccau

SEQ ID NO: 2646411 - RNA, 20 nt, Escherichia coli CFT073
caucgugcuucacuucagcg

SEQ ID NO: 2646412 - RNA, 18 nt, Escherichia coli CFT073
caucguugaauacauuca

SEQ ID NO: 2646413 - RNA, 13 nt, Escherichia coli CFT073
caucguuucugcc

SEQ ID NO: 2646414 - RNA, 16 nt, Escherichia coli CFT073
caucuauagcacccgc

SEQ ID NO: 2646415 - RNA, 13 nt, Escherichia coli CFT073
caucucaaaacgu

SEQ ID NO: 2646416 - RNA, 14 nt, Escherichia coli CFT073
caucucaaauugcu

SEQ ID NO: 2646417 - RNA, 18 nt, Escherichia coli CFT073
caucucaucaauggauuc

SEQ ID NO: 2646418 - RNA, 15 nt, Escherichia coli CFT073
caucucauccaucaa

SEQ ID NO: 2646419 - RNA, 15 nt, Escherichia coli CFT073
caucuccagcgcauc

SEQ ID NO: 2646420 - RNA, 13 nt, Escherichia coli CFT073
caucuccagcugc

SEQ ID NO: 2646421 - RNA, 14 nt, Escherichia coli CFT073
caucuccagcugcu

SEQ ID NO: 2646422 - RNA, 11 nt, Escherichia coli CFT073
caucuccagug

SEQ ID NO: 2646423 - RNA, 19 nt, Escherichia coli CFT073
caucuccaguuucgagaaa

SEQ ID NO: 2646424 - RNA, 24 nt, Escherichia coli CFT073
caucuccauacagaacaggcgcga

SEQ ID NO: 2646425 - RNA, 12 nt, Escherichia coli CFT073
caucuccgcagg

SEQ ID NO: 2646426 - RNA, 11 nt, Escherichia coli CFT073
caucuccuggu

SEQ ID NO: 2646427 - RNA, 12 nt, Escherichia coli CFT073
caucucuccuuu

SEQ ID NO: 2646428 - RNA, 14 nt, Escherichia coli CFT073
caucucuucaauau

SEQ ID NO: 2646429 - RNA, 12 nt, Escherichia coli CFT073
caucucuuccca

SEQ ID NO: 2646430 - RNA, 13 nt, Escherichia coli CFT073
caucucuucccac

SEQ ID NO: 2646431 - RNA, 22 nt, Escherichia coli CFT073
caucucuucuucaagccaggcu

SEQ ID NO: 2646432 - RNA, 13 nt, Escherichia coli CFT073
caucucuucuucc

SEQ ID NO: 2646433 - RNA, 18 nt, Escherichia coli CFT073
caucugaagccugcuuaa

SEQ ID NO: 2646434 - RNA, 19 nt, Escherichia coli CFT073
caucugacguucagccgcu

SEQ ID NO: 2646435 - RNA, 16 nt, Escherichia coli CFT073
caucugauucuuccca

SEQ ID NO: 2646436 - RNA, 16 nt, Escherichia coli CFT073
caucugcaaugcgaau

SEQ ID NO: 2646437 - RNA, 20 nt, Escherichia coli CFT073
caucugcaaugcgaauauca

SEQ ID NO: 2646438 - RNA, 21 nt, Escherichia coli CFT073
caucugccaccguguauuucu

SEQ ID NO: 2646439 - RNA, 11 nt, Escherichia coli CFT073
caucugcccca

SEQ ID NO: 2646440 - RNA, 16 nt, Escherichia coli CFT073
caucugccugauccug

SEQ ID NO: 2646441 - RNA, 15 nt, Escherichia coli CFT073
caucugcgacagcca

SEQ ID NO: 2646442 - RNA, 15 nt, Escherichia coli CFT073
caucugcgcccuggc

SEQ ID NO: 2646443 - RNA, 19 nt, Escherichia coli CFT073
caucugcguuuugguggcg

SEQ ID NO: 2646444 - RNA, 15 nt, Escherichia coli CFT073
caucuggcauaaaca

SEQ ID NO: 2646445 - RNA, 23 nt, Escherichia coli CFT073
caucuggcaucggcgcacaaccg

SEQ ID NO: 2646446 - RNA, 18 nt, Escherichia coli CFT073
caugccggccagcgccac

SEQ ID NO: 2646447 - RNA, 23 nt, Escherichia coli CFT073
caugccgggcaaaagucaccagu

SEQ ID NO: 2646448 - RNA, 16 nt, Escherichia coli CFT073
caugccgucaauccag

SEQ ID NO: 2646449 - RNA, 18 nt, Escherichia coli CFT073
caugccgucaauccagcc

SEQ ID NO: 2646450 - RNA, 22 nt, Escherichia coli CFT073
caugccuuguuuaaucaucggg

SEQ ID NO: 2646451 - RNA, 15 nt, Escherichia coli CFT073
caugcgaagaccgca

SEQ ID NO: 2646452 - RNA, 14 nt, Escherichia coli CFT073
caugcgaaugccaa

SEQ ID NO: 2646453 - RNA, 19 nt, Escherichia coli CFT073
caugcgauuacguucgacu

SEQ ID NO: 2646454 - RNA, 23 nt, Escherichia coli CFT073
caugcgcauaagaccgugagcaa

SEQ ID NO: 2646455 - RNA, 21 nt, Escherichia coli CFT073
caugcgccagguaacgaagau

SEQ ID NO: 2646456 - RNA, 15 nt, Escherichia coli CFT073
caugcgguaacagaa

SEQ ID NO: 2646457 - RNA, 18 nt, Escherichia coli CFT073
caugcgguaaguuuucgc

SEQ ID NO: 2646458 - RNA, 20 nt, Escherichia coli CFT073
caugcgguaaguuuucgccg

SEQ ID NO: 2646459 - RNA, 20 nt, Escherichia coli CFT073
caugcggugauuuugccugu

SEQ ID NO: 2646460 - RNA, 21 nt, Escherichia coli CFT073
caugcgguucacgcgccagag

SEQ ID NO: 2646461 - RNA, 21 nt, Escherichia coli CFT073
caugcguuaucgccauccaga

SEQ ID NO: 2646462 - RNA, 22 nt, Escherichia coli CFT073
caugcuaauaaucagcacaaua

SEQ ID NO: 2646463 - RNA, 13 nt, Escherichia coli CFT073
caugcuauuccuu

SEQ ID NO: 2646464 - RNA, 14 nt, Escherichia coli CFT073
caugcucugccagc

SEQ ID NO: 2646465 - RNA, 21 nt, Escherichia coli CFT073
caugcuggaaccacagcgccg

SEQ ID NO: 2646466 - RNA, 22 nt, Escherichia coli CFT073
caugcuggaaccacagcgccgu

SEQ ID NO: 2646467 - RNA, 15 nt, Escherichia coli CFT073
caugcuggauggcgc

SEQ ID NO: 2646468 - RNA, 16 nt, Escherichia coli CFT073
caugcuggauggcgca

SEQ ID NO: 2646469 - RNA, 18 nt, Escherichia coli CFT073
caugcuuaaauauuuuuu

SEQ ID NO: 2646470 - RNA, 12 nt, Escherichia coli CFT073
caugcuuaacac

SEQ ID NO: 2646471 - RNA, 20 nt, Escherichia coli CFT073
caugcuuaccaaaaugcugc

SEQ ID NO: 2646472 - RNA, 22 nt, Escherichia coli CFT073
caugcuuaccaaaaugcugcaa

SEQ ID NO: 2646473 - RNA, 23 nt, Escherichia coli CFT073
caugcuuaccaaaaugcugcaau

SEQ ID NO: 2646474 - RNA, 13 nt, Escherichia coli CFT073
caugcuucugcac

SEQ ID NO: 2646475 - RNA, 14 nt, Escherichia coli CFT073
caugcuuuugcgcc

SEQ ID NO: 2646476 - RNA, 16 nt, Escherichia coli CFT073
cauggaauagaaucac

SEQ ID NO: 2646477 - RNA, 21 nt, Escherichia coli CFT073
cauggaaucuuuaaugacuga

SEQ ID NO: 2646478 - RNA, 14 nt, Escherichia coli CFT073
cauggagcuuuaaa

SEQ ID NO: 2646479 - RNA, 16 nt, Escherichia coli CFT073
cauggaguaaugacgu

SEQ ID NO: 2646480 - RNA, 22 nt, Escherichia coli CFT073
cauggcacuucaagauaaacga

SEQ ID NO: 2646481 - RNA, 14 nt, Escherichia coli CFT073
cauggcauccaagc

SEQ ID NO: 2646482 - RNA, 21 nt, Escherichia coli CFT073
cauggccgggguuuugcugau

SEQ ID NO: 2646483 - RNA, 22 nt, Escherichia coli CFT073
cauggcgaaaauuggcagacca

SEQ ID NO: 2646484 - RNA, 16 nt, Escherichia coli CFT073
cauggcgaauggcacg

SEQ ID NO: 2646485 - RNA, 12 nt, Escherichia coli CFT073
cauggcgcggca

SEQ ID NO: 2646486 - RNA, 17 nt, Escherichia coli CFT073
cauggcggcagcgugcc

SEQ ID NO: 2646487 - RNA, 15 nt, Escherichia coli CFT073
cauggcgugacaugg

SEQ ID NO: 2646488 - RNA, 20 nt, Escherichia coli CFT073
cauggcuugcgccauggcau

SEQ ID NO: 2646489 - RNA, 20 nt, Escherichia coli CFT073
caugggagaacgaugcugcu

SEQ ID NO: 2646490 - RNA, 16 nt, Escherichia coli CFT073
caugggcauccacagu

SEQ ID NO: 2646491 - RNA, 19 nt, Escherichia coli CFT073
caugggugccggauacaaa

SEQ ID NO: 2646492 - RNA, 14 nt, Escherichia coli CFT073
caugguauaaggag

SEQ ID NO: 2646493 - RNA, 19 nt, Escherichia coli CFT073
caugguauaaggagcaaua

SEQ ID NO: 2646494 - RNA, 20 nt, Escherichia coli CFT073
cauggucgguauuaucacua

SEQ ID NO: 2646495 - RNA, 15 nt, Escherichia coli CFT073
cauggugaugaucgc

SEQ ID NO: 2646496 - RNA, 23 nt, Escherichia coli CFT073
cauggugugcucguaaguuaacu

SEQ ID NO: 2646497 - RNA, 15 nt, Escherichia coli CFT073
caugguuacgccggu

SEQ ID NO: 2646498 - RNA, 22 nt, Escherichia coli CFT073
caugguuagccuguaaugucau

SEQ ID NO: 2646499 - RNA, 18 nt, Escherichia coli CFT073
caugguuugcauccacaa

SEQ ID NO: 2646500 - RNA, 21 nt, Escherichia coli CFT073
caugguuuggaucuguugcug

SEQ ID NO: 2646501 - RNA, 22 nt, Escherichia coli CFT073
cauguaacccuuugcggugcag

SEQ ID NO: 2646502 - RNA, 14 nt, Escherichia coli CFT073
cauguaacugccuu

SEQ ID NO: 2646503 - RNA, 20 nt, Escherichia coli CFT073
cauguaccguugcugccagu

SEQ ID NO: 2646504 - RNA, 18 nt, Escherichia coli CFT073
cauguagcaaauuucguc

SEQ ID NO: 2646505 - RNA, 18 nt, Escherichia coli CFT073
cauguagccgcuuuuucu

SEQ ID NO: 2646506 - RNA, 21 nt, Escherichia coli CFT073
caugucagagcuguagauaua

SEQ ID NO: 2646507 - RNA, 13 nt, Escherichia coli CFT073
caugucaguugca

SEQ ID NO: 2646508 - RNA, 11 nt, Escherichia coli CFT073
caugucaucaa

SEQ ID NO: 2646509 - RNA, 20 nt, Escherichia coli CFT073
cauguccgagcuuaaugaaa

SEQ ID NO: 2646510 - RNA, 21 nt, Escherichia coli CFT073
caugugaugccgcauccggcu

SEQ ID NO: 2646511 - RNA, 15 nt, Escherichia coli CFT073
caugugauuugaugu

SEQ ID NO: 2646512 - RNA, 12 nt, Escherichia coli CFT073
caugugccagcg

SEQ ID NO: 2646513 - RNA, 17 nt, Escherichia coli CFT073
caugugcccccugcaau

SEQ ID NO: 2646514 - RNA, 14 nt, Escherichia coli CFT073
cauguguucccugu

SEQ ID NO: 2646515 - RNA, 16 nt, Escherichia coli CFT073
cauguguucugcauau

SEQ ID NO: 2646516 - RNA, 15 nt, Escherichia coli CFT073
cauguuauucaugcc

SEQ ID NO: 2646517 - RNA, 15 nt, Escherichia coli CFT073
cauguuccucaucgu

SEQ ID NO: 2646518 - RNA, 23 nt, Escherichia coli CFT073
cauguugaucccugcaccaauga

SEQ ID NO: 2646519 - RNA, 20 nt, Escherichia coli CFT073
cauguugcagggcauuccau

SEQ ID NO: 2646520 - RNA, 13 nt, Escherichia coli CFT073
cauguugccuggg

SEQ ID NO: 2646521 - RNA, 18 nt, Escherichia coli CFT073
cauguugcgcuucaccag

SEQ ID NO: 2646522 - RNA, 15 nt, Escherichia coli CFT073
cauguuguuuacagc

SEQ ID NO: 2646523 - RNA, 14 nt, Escherichia coli CFT073
cauguuuuccagca

SEQ ID NO: 2646524 - RNA, 16 nt, Escherichia coli CFT073
cauguuuuccuuuucg

SEQ ID NO: 2646525 - RNA, 11 nt, Escherichia coli CFT073
cauuaaaauga

SEQ ID NO: 2646526 - RNA, 22 nt, Escherichia coli CFT073
cauuaaacgcaguaaacgccag

SEQ ID NO: 2646527 - RNA, 17 nt, Escherichia coli CFT073
cauuaaacguacuggcg

SEQ ID NO: 2646528 - RNA, 19 nt, Escherichia coli CFT073
cauuaaaugcguagguuaa

SEQ ID NO: 2646529 - RNA, 22 nt, Escherichia coli CFT073
cauuaacaacgucguuuucgcc

SEQ ID NO: 2646530 - RNA, 23 nt, Escherichia coli CFT073
cauuaacaccacgccagccgcca

SEQ ID NO: 2646531 - RNA, 22 nt, Escherichia coli CFT073
cauuaacagcggugcaccugcc

SEQ ID NO: 2646532 - RNA, 23 nt, Escherichia coli CFT073
cauuaacgaaacccgaaccacgc

SEQ ID NO: 2646533 - RNA, 12 nt, Escherichia coli CFT073
cauuaacgcgaa

SEQ ID NO: 2646534 - RNA, 18 nt, Escherichia coli CFT073
cauuaacgcgaaauaauc

SEQ ID NO: 2646535 - RNA, 16 nt, Escherichia coli CFT073
cauuaacucacuggcg

SEQ ID NO: 2646536 - RNA, 17 nt, Escherichia coli CFT073
cauuaacucacuggcgc

SEQ ID NO: 2646537 - RNA, 16 nt, Escherichia coli CFT073
cauuaacucaguugcc

SEQ ID NO: 2646538 - RNA, 22 nt, Escherichia coli CFT073
cauuaagaacuccugaaagcga

SEQ ID NO: 2646539 - RNA, 13 nt, Escherichia coli CFT073
cauuaagaaucac

SEQ ID NO: 2646540 - RNA, 14 nt, Escherichia coli CFT073
cauuaagcgccgga

SEQ ID NO: 2646541 - RNA, 17 nt, Escherichia coli CFT073
cauuaaggcauaagcgc

SEQ ID NO: 2646542 - RNA, 17 nt, Escherichia coli CFT073
cauuaaggucauaucuu

SEQ ID NO: 2646543 - RNA, 15 nt, Escherichia coli CFT073
cauuaaguaacaaua

SEQ ID NO: 2646544 - RNA, 24 nt, Escherichia coli CFT073
cauuaaguaacaauaucuaaaaug

SEQ ID NO: 2646545 - RNA, 18 nt, Escherichia coli CFT073
cauuaaguguaaucagcc

SEQ ID NO: 2646546 - RNA, 19 nt, Escherichia coli CFT073
cauuaaguguaaucagccc

SEQ ID NO: 2646547 - RNA, 15 nt, Escherichia coli CFT073
cauuaauauaaucgu

SEQ ID NO: 2646548 - RNA, 23 nt, Escherichia coli CFT073
cauuaaugccguuauacaucgcu

SEQ ID NO: 2646549 - RNA, 19 nt, Escherichia coli CFT073
cauuaaugucggaugcggc

SEQ ID NO: 2646550 - RNA, 16 nt, Escherichia coli CFT073
cauuacaaaauacaaa

SEQ ID NO: 2646551 - RNA, 18 nt, Escherichia coli CFT073
cauuacaacgcaauaucc

SEQ ID NO: 2646552 - RNA, 21 nt, Escherichia coli CFT073
cauuacaagaaucaugccaaa

SEQ ID NO: 2646553 - RNA, 14 nt, Escherichia coli CFT073
cauuacaggcaucu

SEQ ID NO: 2646554 - RNA, 19 nt, Escherichia coli CFT073
cauuaccccguaauaacca

SEQ ID NO: 2646555 - RNA, 21 nt, Escherichia coli CFT073
cauuaccccugacgcuuaucu

SEQ ID NO: 2646556 - RNA, 20 nt, Escherichia coli CFT073
cauuaccgaagggaucuucc

SEQ ID NO: 2646557 - RNA, 15 nt, Escherichia coli CFT073
cauuaccgaauccug

SEQ ID NO: 2646558 - RNA, 20 nt, Escherichia coli CFT073
cauuaccgcauuaucaaggc

SEQ ID NO: 2646559 - RNA, 22 nt, Escherichia coli CFT073
cauuacgcaucgguacaauaaa

SEQ ID NO: 2646560 - RNA, 20 nt, Escherichia coli CFT073
cauuacguccaucacaauca

SEQ ID NO: 2646561 - RNA, 16 nt, Escherichia coli CFT073
cauuacuaauuaauaa

SEQ ID NO: 2646562 - RNA, 23 nt, Escherichia coli CFT073
cauuacuaauuaauaauauaaau

SEQ ID NO: 2646563 - RNA, 14 nt, Escherichia coli CFT073
cauuacucguccuu

SEQ ID NO: 2646564 - RNA, 17 nt, Escherichia coli CFT073
cauuacugguucguuua

SEQ ID NO: 2646565 - RNA, 20 nt, Escherichia coli CFT073
cauuagcaaauuauccccca

SEQ ID NO: 2646566 - RNA, 18 nt, Escherichia coli CFT073
cauuagcaucaagaaaaa

SEQ ID NO: 2646567 - RNA, 12 nt, Escherichia coli CFT073
cauuagccaggc

SEQ ID NO: 2646568 - RNA, 13 nt, Escherichia coli CFT073
cauuagucacaaa

SEQ ID NO: 2646569 - RNA, 18 nt, Escherichia coli CFT073
cauuagucauuacucauc

SEQ ID NO: 2646570 - RNA, 22 nt, Escherichia coli CFT073
cauuagugcgcaguugccggau

SEQ ID NO: 2646571 - RNA, 14 nt, Escherichia coli CFT073
cauuaucaaagaug

SEQ ID NO: 2646572 - RNA, 21 nt, Escherichia coli CFT073
cauuaucacccugaucaauaa

SEQ ID NO: 2646573 - RNA, 21 nt, Escherichia coli CFT073
cauuauccucaaugaaucgca

SEQ ID NO: 2646574 - RNA, 17 nt, Escherichia coli CFT073
cauuauccuuuaucugc

SEQ ID NO: 2646575 - RNA, 15 nt, Escherichia coli CFT073
cauuaucucaacaca

SEQ ID NO: 2646576 - RNA, 19 nt, Escherichia coli CFT073
cauuaucuucuuucucggc

SEQ ID NO: 2646577 - RNA, 18 nt, Escherichia coli CFT073
cauuaugagugaugugcu

SEQ ID NO: 2646578 - RNA, 18 nt, Escherichia coli CFT073
cauuauggcgcaguugcc

SEQ ID NO: 2646579 - RNA, 20 nt, Escherichia coli CFT073
cauuauggcgcaguugccgg

SEQ ID NO: 2646580 - RNA, 17 nt, Escherichia coli CFT073
cauuauggugaagaagc

SEQ ID NO: 2646581 - RNA, 17 nt, Escherichia coli CFT073
cauuaugucauugaaug

SEQ ID NO: 2646582 - RNA, 17 nt, Escherichia coli CFT073
cauuauuaaacaggcag

SEQ ID NO: 2646583 - RNA, 13 nt, Escherichia coli CFT073
cauuauucaaucg

SEQ ID NO: 2646584 - RNA, 15 nt, Escherichia coli CFT073
cauuauucaggcacu

SEQ ID NO: 2646585 - RNA, 22 nt, Escherichia coli CFT073
cauuauucauuguucucccaua

SEQ ID NO: 2646586 - RNA, 21 nt, Escherichia coli CFT073
cauuauucccccggcuucaau

SEQ ID NO: 2646587 - RNA, 17 nt, Escherichia coli CFT073
cauucaacauauccagc

SEQ ID NO: 2646588 - RNA, 21 nt, Escherichia coli CFT073
cauucaacuuaagucuccauu

SEQ ID NO: 2646589 - RNA, 16 nt, Escherichia coli CFT073
cauucacaaaaacagu

SEQ ID NO: 2646590 - RNA, 15 nt, Escherichia coli CFT073
cauucacacuccagu

SEQ ID NO: 2646591 - RNA, 14 nt, Escherichia coli CFT073
cauucacauccaca

SEQ ID NO: 2646592 - RNA, 20 nt, Escherichia coli CFT073
cauucacgcugucggcacug

SEQ ID NO: 2646593 - RNA, 18 nt, Escherichia coli CFT073
cauucagacacgccgcca

SEQ ID NO: 2646594 - RNA, 14 nt, Escherichia coli CFT073
cauucagacaggcg

SEQ ID NO: 2646595 - RNA, 17 nt, Escherichia coli CFT073
cauucagauugauguua

SEQ ID NO: 2646596 - RNA, 17 nt, Escherichia coli CFT073
cauucagcauggaauag

SEQ ID NO: 2646597 - RNA, 21 nt, Escherichia coli CFT073
cauucaggccaaagccgccga

SEQ ID NO: 2646598 - RNA, 21 nt, Escherichia coli CFT073
cauucaggccgccgucaucac

SEQ ID NO: 2646599 - RNA, 16 nt, Escherichia coli CFT073
cauucagggcagugcc

SEQ ID NO: 2646600 - RNA, 13 nt, Escherichia coli CFT073
cauucaucacaaa

SEQ ID NO: 2646601 - RNA, 19 nt, Escherichia coli CFT073
cauucaucacaaaauagaa

SEQ ID NO: 2646602 - RNA, 16 nt, Escherichia coli CFT073
cauucaucgccuucuu

SEQ ID NO: 2646603 - RNA, 18 nt, Escherichia coli CFT073
cauucaugcgaauacagc

SEQ ID NO: 2646604 - RNA, 19 nt, Escherichia coli CFT073
cauucaugcgaauacagcc

SEQ ID NO: 2646605 - RNA, 12 nt, Escherichia coli CFT073
cauucauucaga

SEQ ID NO: 2646606 - RNA, 17 nt, Escherichia coli CFT073
cauuccacaaaaaccac

SEQ ID NO: 2646607 - RNA, 20 nt, Escherichia coli CFT073
cauuccacucaucgcaucgc

SEQ ID NO: 2646608 - RNA, 13 nt, Escherichia coli CFT073
cauuccagccaug

SEQ ID NO: 2646609 - RNA, 16 nt, Escherichia coli CFT073
cauucccauaccuuuc

SEQ ID NO: 2646610 - RNA, 17 nt, Escherichia coli CFT073
cauuccccggagcccua

SEQ ID NO: 2646611 - RNA, 23 nt, Escherichia coli CFT073
cauucccgcucacgguuagcaua

SEQ ID NO: 2646612 - RNA, 22 nt, Escherichia coli CFT073
cauucccggucaguagaauaau

SEQ ID NO: 2646613 - RNA, 23 nt, Escherichia coli CFT073
cauucccugcagucaccugcccu

SEQ ID NO: 2646614 - RNA, 22 nt, Escherichia coli CFT073
cauuccgcccagaccgugcgca

SEQ ID NO: 2646615 - RNA, 19 nt, Escherichia coli CFT073
cauuccguagcguuuuuuc

SEQ ID NO: 2646616 - RNA, 14 nt, Escherichia coli CFT073
cauuccuaaaccau

SEQ ID NO: 2646617 - RNA, 20 nt, Escherichia coli CFT073
cauucgcaauacauaagcac

SEQ ID NO: 2646618 - RNA, 14 nt, Escherichia coli CFT073
cauucgcagcugca

SEQ ID NO: 2646619 - RNA, 17 nt, Escherichia coli CFT073
cauucgccguuaccagc

SEQ ID NO: 2646620 - RNA, 22 nt, Escherichia coli CFT073
cauucgccugacgcaauaacac

SEQ ID NO: 2646621 - RNA, 20 nt, Escherichia coli CFT073
cauucgcgcacgaggaacag

SEQ ID NO: 2646622 - RNA, 22 nt, Escherichia coli CFT073
cauucgcuguguaaacccagcc

SEQ ID NO: 2646623 - RNA, 16 nt, Escherichia coli CFT073
cauucguacaaacgcu

SEQ ID NO: 2646624 - RNA, 18 nt, Escherichia coli CFT073
cauucucgcuacccauga

SEQ ID NO: 2646625 - RNA, 15 nt, Escherichia coli CFT073
cauucugcgcugacu

SEQ ID NO: 2646626 - RNA, 16 nt, Escherichia coli CFT073
cauucugucucauggc

SEQ ID NO: 2646627 - RNA, 19 nt, Escherichia coli CFT073
cauucuugucagaugcggc

SEQ ID NO: 2646628 - RNA, 14 nt, Escherichia coli CFT073
cauucuuucccagc

SEQ ID NO: 2646629 - RNA, 16 nt, Escherichia coli CFT073
cauugaaaauuacuca

SEQ ID NO: 2646630 - RNA, 18 nt, Escherichia coli CFT073
cauugaaaucaaaaucac

SEQ ID NO: 2646631 - RNA, 20 nt, Escherichia coli CFT073
cauugaacuuguagcuuuca

SEQ ID NO: 2646632 - RNA, 23 nt, Escherichia coli CFT073
cauugaagcgccguccaguaaug

SEQ ID NO: 2646633 - RNA, 15 nt, Escherichia coli CFT073
cauugaaguuaucgc

SEQ ID NO: 2646634 - RNA, 21 nt, Escherichia coli CFT073
cauugaauuaaaauguguacu

SEQ ID NO: 2646635 - RNA, 17 nt, Escherichia coli CFT073
cauugacgccuuuaucu

SEQ ID NO: 2646636 - RNA, 14 nt, Escherichia coli CFT073
cauugacgcuggcu

SEQ ID NO: 2646637 - RNA, 22 nt, Escherichia coli CFT073
cauugacgguuuccacuuccac

SEQ ID NO: 2646638 - RNA, 23 nt, Escherichia coli CFT073
cauugaucgauaagccagcaacc

SEQ ID NO: 2646639 - RNA, 18 nt, Escherichia coli CFT073
cauugauuuucaaaucga

SEQ ID NO: 2646640 - RNA, 14 nt, Escherichia coli CFT073
cauugcaacguggu

SEQ ID NO: 2646641 - RNA, 17 nt, Escherichia coli CFT073
cauugccagaaaccagc

SEQ ID NO: 2646642 - RNA, 16 nt, Escherichia coli CFT073
cauugccagcauuggc

SEQ ID NO: 2646643 - RNA, 22 nt, Escherichia coli CFT073
cauugccagugguacaaaagca

SEQ ID NO: 2646644 - RNA, 15 nt, Escherichia coli CFT073
cauugccauguugau

SEQ ID NO: 2646645 - RNA, 15 nt, Escherichia coli CFT073
cauugcccaauacug

SEQ ID NO: 2646646 - RNA, 14 nt, Escherichia coli CFT073
cauugccgccuggg

SEQ ID NO: 2646647 - RNA, 23 nt, Escherichia coli CFT073
cauugccggaugcgacgcuggcc

SEQ ID NO: 2646648 - RNA, 16 nt, Escherichia coli CFT073
cauugccggaugcggc

SEQ ID NO: 2646649 - RNA, 21 nt, Escherichia coli CFT073
cauugccugaucgcgcaaaca

SEQ ID NO: 2646650 - RNA, 23 nt, Escherichia coli CFT073
cauugccugaucgcgcaaacagu

SEQ ID NO: 2646651 - RNA, 21 nt, Escherichia coli CFT073
cauugcgaauaagaauaugaa

SEQ ID NO: 2646652 - RNA, 17 nt, Escherichia coli CFT073
cauugcgcauucuacuu

SEQ ID NO: 2646653 - RNA, 21 nt, Escherichia coli CFT073
cauugcgccgaacaacagugc

SEQ ID NO: 2646654 - RNA, 18 nt, Escherichia coli CFT073
cauugcggaugcgcugcu

SEQ ID NO: 2646655 - RNA, 19 nt, Escherichia coli CFT073
cauugcgggcuggaaacgc

SEQ ID NO: 2646656 - RNA, 18 nt, Escherichia coli CFT073
cauugcuaaugcagguac

SEQ ID NO: 2646657 - RNA, 19 nt, Escherichia coli CFT073
cauugcuaaugcagguacg

SEQ ID NO: 2646658 - RNA, 15 nt, Escherichia coli CFT073
cauugcuauuucccc

SEQ ID NO: 2646659 - RNA, 20 nt, Escherichia coli CFT073
cauugcuauuucccccuccc

SEQ ID NO: 2646660 - RNA, 18 nt, Escherichia coli CFT073
cauugcucauuccgccgc

SEQ ID NO: 2646661 - RNA, 22 nt, Escherichia coli CFT073
ccaaaacucgcuggcggcuggc

SEQ ID NO: 2646662 - RNA, 17 nt, Escherichia coli CFT073
ccaaaagcucggucauu

SEQ ID NO: 2646663 - RNA, 21 nt, Escherichia coli CFT073
ccaaaauuugaaaagugcugu

SEQ ID NO: 2646664 - RNA, 11 nt, Escherichia coli CFT073
ccaaacagcag

SEQ ID NO: 2646665 - RNA, 15 nt, Escherichia coli CFT073
ccaaacagcgugccg

SEQ ID NO: 2646666 - RNA, 18 nt, Escherichia coli CFT073
ccaaacagcgugccgcga

SEQ ID NO: 2646667 - RNA, 15 nt, Escherichia coli CFT073
ccaaacauuucacgu

SEQ ID NO: 2646668 - RNA, 12 nt, Escherichia coli CFT073
ccaaaccagcua

SEQ ID NO: 2646669 - RNA, 13 nt, Escherichia coli CFT073
ccaaaccauugcu

SEQ ID NO: 2646670 - RNA, 15 nt, Escherichia coli CFT073
ccaaacgcucccagc

SEQ ID NO: 2646671 - RNA, 14 nt, Escherichia coli CFT073
ccaaacucauccac

SEQ ID NO: 2646672 - RNA, 16 nt, Escherichia coli CFT073
ccaaacucauccacca

SEQ ID NO: 2646673 - RNA, 13 nt, Escherichia coli CFT073
ccaaacugcgccc

SEQ ID NO: 2646674 - RNA, 13 nt, Escherichia coli CFT073
ccaaacugcggga

SEQ ID NO: 2646675 - RNA, 19 nt, Escherichia coli CFT073
ccaaacuggaacugaaagg

SEQ ID NO: 2646676 - RNA, 19 nt, Escherichia coli CFT073
ccaaacuuaugcagcugcu

SEQ ID NO: 2646677 - RNA, 22 nt, Escherichia coli CFT073
ccaaacuuaugcagcugcucga

SEQ ID NO: 2646678 - RNA, 15 nt, Escherichia coli CFT073
ccaaagaaguucucc

SEQ ID NO: 2646679 - RNA, 22 nt, Escherichia coli CFT073
ccaaagaauuggcuuuaucugu

SEQ ID NO: 2646680 - RNA, 15 nt, Escherichia coli CFT073
ccaaagcaccacucc

SEQ ID NO: 2646681 - RNA, 19 nt, Escherichia coli CFT073
ccaaagcaccacuccucaa

SEQ ID NO: 2646682 - RNA, 22 nt, Escherichia coli CFT073
ccaaagcgacacaaucaaaucc

SEQ ID NO: 2646683 - RNA, 16 nt, Escherichia coli CFT073
ccaaagggagcagacu

SEQ ID NO: 2646684 - RNA, 19 nt, Escherichia coli CFT073
ccaaagggagcagacugua

SEQ ID NO: 2646685 - RNA, 18 nt, Escherichia coli CFT073
ccaaagggggcgacauuu

SEQ ID NO: 2646686 - RNA, 13 nt, Escherichia coli CFT073
ccaaaggugacug

SEQ ID NO: 2646687 - RNA, 23 nt, Escherichia coli CFT073
ccaaagucaucaauugcaauccg

SEQ ID NO: 2646688 - RNA, 15 nt, Escherichia coli CFT073
ccaaaguuaaucagc

SEQ ID NO: 2646689 - RNA, 18 nt, Escherichia coli CFT073
ccaaaguuugcaaaccca

SEQ ID NO: 2646690 - RNA, 12 nt, Escherichia coli CFT073
ccaaauauuucu

SEQ ID NO: 2646691 - RNA, 13 nt, Escherichia coli CFT073
ccaaaucaucagu

SEQ ID NO: 2646692 - RNA, 13 nt, Escherichia coli CFT073
ccaaauccagcgc

SEQ ID NO: 2646693 - RNA, 14 nt, Escherichia coli CFT073
ccaaauccauuuuc

SEQ ID NO: 2646694 - RNA, 23 nt, Escherichia coli CFT073
ccaaaucgccccgcagccgauuu

SEQ ID NO: 2646695 - RNA, 18 nt, Escherichia coli CFT073
ccaaaucguugcugcuca

SEQ ID NO: 2646696 - RNA, 15 nt, Escherichia coli CFT073
ccaaaugcagcaacc

SEQ ID NO: 2646697 - RNA, 19 nt, Escherichia coli CFT073
ccaaaugcagcaaccagag

SEQ ID NO: 2646698 - RNA, 16 nt, Escherichia coli CFT073
ccaaaugucaccagcc

SEQ ID NO: 2646699 - RNA, 23 nt, Escherichia coli CFT073
ccaaaugucaccagccggucauu

SEQ ID NO: 2646700 - RNA, 23 nt, Escherichia coli CFT073
ccaacaaaacauaucccaccagc

SEQ ID NO: 2646701 - RNA, 20 nt, Escherichia coli CFT073
ccaacaaauaguacacagac

SEQ ID NO: 2646702 - RNA, 14 nt, Escherichia coli CFT073
ccaacaacagcgcg

SEQ ID NO: 2646703 - RNA, 21 nt, Escherichia coli CFT073
ccaacaauaaaaagcggcagg

SEQ ID NO: 2646704 - RNA, 24 nt, Escherichia coli CFT073
ccaacaauauuggguuguugcacu

SEQ ID NO: 2646705 - RNA, 11 nt, Escherichia coli CFT073
ccaacacccac

SEQ ID NO: 2646706 - RNA, 19 nt, Escherichia coli CFT073
ccaacacuuccccggacgc

SEQ ID NO: 2646707 - RNA, 13 nt, Escherichia coli CFT073
ccaacagcagcca

SEQ ID NO: 2646708 - RNA, 15 nt, Escherichia coli CFT073
ccaacagcagccaca

SEQ ID NO: 2646709 - RNA, 12 nt, Escherichia coli CFT073
ccaacagugccg

SEQ ID NO: 2646710 - RNA, 21 nt, Escherichia coli CFT073
ccaacagugccgaugccgcua

SEQ ID NO: 2646711 - RNA, 16 nt, Escherichia coli CFT073
ccaaccaacgcgccgc

SEQ ID NO: 2646712 - RNA, 11 nt, Escherichia coli CFT073
ccaaccagcag

SEQ ID NO: 2646713 - RNA, 10 nt, Escherichia coli CFT073
ccaaccagcu

SEQ ID NO: 2646714 - RNA, 20 nt, Escherichia coli CFT073
ccaaccaucaggcagaacac

SEQ ID NO: 2646715 - RNA, 15 nt, Escherichia coli CFT073
ccaacccacaaaaac

SEQ ID NO: 2646716 - RNA, 21 nt, Escherichia coli CFT073
ccaacccacaaaaacaccgcu

SEQ ID NO: 2646717 - RNA, 18 nt, Escherichia coli CFT073
ccaaccccaauguaacca

SEQ ID NO: 2646718 - RNA, 22 nt, Escherichia coli CFT073
ccaacccuggugcaauuacgcu

SEQ ID NO: 2646719 - RNA, 16 nt, Escherichia coli CFT073
ccaaccgcugauugcu

SEQ ID NO: 2646720 - RNA, 19 nt, Escherichia coli CFT073
ccaaccgcuucccaaagac

SEQ ID NO: 2646721 - RNA, 19 nt, Escherichia coli CFT073
ccaaccgggccgcagagau

SEQ ID NO: 2646722 - RNA, 18 nt, Escherichia coli CFT073
ccaaccuuucaucuguuu

SEQ ID NO: 2646723 - RNA, 17 nt, Escherichia coli CFT073
ccaacgaucccaacuga

SEQ ID NO: 2646724 - RNA, 20 nt, Escherichia coli CFT073
ccaacgaucccaacugaucu

SEQ ID NO: 2646725 - RNA, 23 nt, Escherichia coli CFT073
ccaacgaucuggcgucagcggcu

SEQ ID NO: 2646726 - RNA, 13 nt, Escherichia coli CFT073
ccaacgcaccaaa

SEQ ID NO: 2646727 - RNA, 14 nt, Escherichia coli CFT073
ccaacgcagcaaca

SEQ ID NO: 2646728 - RNA, 15 nt, Escherichia coli CFT073
ccaacgcauuuauuu

SEQ ID NO: 2646729 - RNA, 20 nt, Escherichia coli CFT073
ccaacgccuuuaccaccagu

SEQ ID NO: 2646730 - RNA, 22 nt, Escherichia coli CFT073
ccaacgcgcaauggaccagaac

SEQ ID NO: 2646731 - RNA, 13 nt, Escherichia coli CFT073
ccaacgcgguuuc

SEQ ID NO: 2646732 - RNA, 21 nt, Escherichia coli CFT073
ccaacgcguuguaaaaacgga

SEQ ID NO: 2646733 - RNA, 18 nt, Escherichia coli CFT073
ccaacgcuagcagcagcg

SEQ ID NO: 2646734 - RNA, 23 nt, Escherichia coli CFT073
ccaacgcuggcguggagcaacac

SEQ ID NO: 2646735 - RNA, 16 nt, Escherichia coli CFT073
ccaacgggaauucaac

SEQ ID NO: 2646736 - RNA, 17 nt, Escherichia coli CFT073
ccaacggggccagcaca

SEQ ID NO: 2646737 - RNA, 22 nt, Escherichia coli CFT073
ccaacgugaccaguaccaccgc

SEQ ID NO: 2646738 - RNA, 21 nt, Escherichia coli CFT073
ccaacgugguuuaccaccagc

SEQ ID NO: 2646739 - RNA, 22 nt, Escherichia coli CFT073
ccaacgugguuuaccaccagcg

SEQ ID NO: 2646740 - RNA, 13 nt, Escherichia coli CFT073
ccaacguguugcu

SEQ ID NO: 2646741 - RNA, 19 nt, Escherichia coli CFT073
ccaacuaaacguagcggaa

SEQ ID NO: 2646742 - RNA, 21 nt, Escherichia coli CFT073
ccaacuaucaaccucuuuuuc

SEQ ID NO: 2646743 - RNA, 23 nt, Escherichia coli CFT073
ccaacucaacgccugcuuuuacc

SEQ ID NO: 2646744 - RNA, 22 nt, Escherichia coli CFT073
ccaacucuuuuaccaccgcaaa

SEQ ID NO: 2646745 - RNA, 20 nt, Escherichia coli CFT073
ccaacugcccgaacagcaac

SEQ ID NO: 2646746 - RNA, 21 nt, Escherichia coli CFT073
ccaacugugaauccugcauac

SEQ ID NO: 2646747 - RNA, 22 nt, Escherichia coli CFT073
ccaacugugccgcgaccaccuc

SEQ ID NO: 2646748 - RNA, 21 nt, Escherichia coli CFT073
ccaacugugugcugagcggcg

SEQ ID NO: 2646749 - RNA, 14 nt, Escherichia coli CFT073
ccaacuucauguau

SEQ ID NO: 2646750 - RNA, 19 nt, Escherichia coli CFT073
ccaacuuuguuguuuacca

SEQ ID NO: 2646751 - RNA, 16 nt, Escherichia coli CFT073
ccaagaaacaccagaa

SEQ ID NO: 2646752 - RNA, 13 nt, Escherichia coli CFT073
ccaagaaacuggc

SEQ ID NO: 2646753 - RNA, 23 nt, Escherichia coli CFT073
ccaagagcaaauuuuccccagau

SEQ ID NO: 2646754 - RNA, 14 nt, Escherichia coli CFT073
ccaagauagaacca

SEQ ID NO: 2646755 - RNA, 17 nt, Escherichia coli CFT073
ccaagaugggccagcac

SEQ ID NO: 2646756 - RNA, 17 nt, Escherichia coli CFT073
ccaagcaccauaaacac

SEQ ID NO: 2646757 - RNA, 14 nt, Escherichia coli CFT073
ccaagccaagccag

SEQ ID NO: 2646758 - RNA, 16 nt, Escherichia coli CFT073
ccaagccaagccagag

SEQ ID NO: 2646759 - RNA, 16 nt, Escherichia coli CFT073
ccaagccagagcagcg

SEQ ID NO: 2646760 - RNA, 21 nt, Escherichia coli CFT073
ccaaggcuaguacaggcggca

SEQ ID NO: 2646761 - RNA, 20 nt, Escherichia coli CFT073
ccaaggucggggucgcgagu

SEQ ID NO: 2646762 - RNA, 14 nt, Escherichia coli CFT073
ccaaguccugccag

SEQ ID NO: 2646763 - RNA, 17 nt, Escherichia coli CFT073
ccaagucuggcaggaaa

SEQ ID NO: 2646764 - RNA, 17 nt, Escherichia coli CFT073
ccaaguuuaugcaauag

SEQ ID NO: 2646765 - RNA, 18 nt, Escherichia coli CFT073
ccaauaaaaaucagauau

SEQ ID NO: 2646766 - RNA, 16 nt, Escherichia coli CFT073
ccaauaaacgccaggu

SEQ ID NO: 2646767 - RNA, 23 nt, Escherichia coli CFT073
ccaauaaagaaucacugguuacc

SEQ ID NO: 2646768 - RNA, 18 nt, Escherichia coli CFT073
ccaauaauccccaauacg

SEQ ID NO: 2646769 - RNA, 18 nt, Escherichia coli CFT073
ccacauggagcuuuaaac

SEQ ID NO: 2646770 - RNA, 12 nt, Escherichia coli CFT073
ccacauguugcg

SEQ ID NO: 2646771 - RNA, 15 nt, Escherichia coli CFT073
ccacauucagcagcc

SEQ ID NO: 2646772 - RNA, 21 nt, Escherichia coli CFT073
ccacauugugggauuccagcg

SEQ ID NO: 2646773 - RNA, 14 nt, Escherichia coli CFT073
ccacauuuuccauc

SEQ ID NO: 2646774 - RNA, 18 nt, Escherichia coli CFT073
ccacauuuuccaucacga

SEQ ID NO: 2646775 - RNA, 15 nt, Escherichia coli CFT073
ccaccaaacugcgcc

SEQ ID NO: 2646776 - RNA, 14 nt, Escherichia coli CFT073
ccaccaaagauguc

SEQ ID NO: 2646777 - RNA, 20 nt, Escherichia coli CFT073
ccaccaaaugcagcaaccag

SEQ ID NO: 2646778 - RNA, 21 nt, Escherichia coli CFT073
ccaccaauaaccggcacuuca

SEQ ID NO: 2646779 - RNA, 12 nt, Escherichia coli CFT073
ccaccacaaaag

SEQ ID NO: 2646780 - RNA, 21 nt, Escherichia coli CFT073
ccaccacaaaagcggugauaa

SEQ ID NO: 2646781 - RNA, 12 nt, Escherichia coli CFT073
ccaccacccugu

SEQ ID NO: 2646782 - RNA, 18 nt, Escherichia coli CFT073
ccaccaccgcaaaauagg

SEQ ID NO: 2646783 - RNA, 14 nt, Escherichia coli CFT073
ccaccaccucuucc

SEQ ID NO: 2646784 - RNA, 12 nt, Escherichia coli CFT073
ccaccaccugca

SEQ ID NO: 2646785 - RNA, 13 nt, Escherichia coli CFT073
ccaccaccuuaca

SEQ ID NO: 2646786 - RNA, 13 nt, Escherichia coli CFT073
ccaccacgccaag

SEQ ID NO: 2646787 - RNA, 14 nt, Escherichia coli CFT073
ccaccacgcccagc

SEQ ID NO: 2646788 - RNA, 16 nt, Escherichia coli CFT073
ccaccagaaccgccgc

SEQ ID NO: 2646789 - RNA, 13 nt, Escherichia coli CFT073
ccaccagaaucgc

SEQ ID NO: 2646790 - RNA, 17 nt, Escherichia coli CFT073
ccaccagaaucgccagc

SEQ ID NO: 2646791 - RNA, 13 nt, Escherichia coli CFT073
ccaccagauggcu

SEQ ID NO: 2646792 - RNA, 20 nt, Escherichia coli CFT073
ccaccagcaccgcgacaauc

SEQ ID NO: 2646793 - RNA, 12 nt, Escherichia coli CFT073
ccaccagcagcu

SEQ ID NO: 2646794 - RNA, 19 nt, Escherichia coli CFT073
ccaccagcagcugcuccca

SEQ ID NO: 2646795 - RNA, 13 nt, Escherichia coli CFT073
ccaccagcgacag

SEQ ID NO: 2646796 - RNA, 23 nt, Escherichia coli CFT073
ccaccagcgacagccagcccauc

SEQ ID NO: 2646797 - RNA, 16 nt, Escherichia coli CFT073
ccaccagcgccaccac

SEQ ID NO: 2646798 - RNA, 22 nt, Escherichia coli CFT073
ccaccagcggaauuccggcuuc

SEQ ID NO: 2646799 - RNA, 16 nt, Escherichia coli CFT073
ccaccagcgucagaaa

SEQ ID NO: 2646800 - RNA, 13 nt, Escherichia coli CFT073
ccaccaggaacgc

SEQ ID NO: 2646801 - RNA, 16 nt, Escherichia coli CFT073
ccaccaguaacgcucc

SEQ ID NO: 2646802 - RNA, 12 nt, Escherichia coli CFT073
ccaccagugaau

SEQ ID NO: 2646803 - RNA, 14 nt, Escherichia coli CFT073
ccaccagugaauaa

SEQ ID NO: 2646804 - RNA, 12 nt, Escherichia coli CFT073
ccaccagugccg

SEQ ID NO: 2646805 - RNA, 23 nt, Escherichia coli CFT073
ccaccagugguuaccgaauccag

SEQ ID NO: 2646806 - RNA, 18 nt, Escherichia coli CFT073
ccaccaucaccucucacg

SEQ ID NO: 2646807 - RNA, 17 nt, Escherichia coli CFT073
ccaccauccccaccaaa

SEQ ID NO: 2646808 - RNA, 20 nt, Escherichia coli CFT073
ccaccauccccaccaaaaca

SEQ ID NO: 2646809 - RNA, 22 nt, Escherichia coli CFT073
ccaccaugcuaauagcugcgcc

SEQ ID NO: 2646810 - RNA, 15 nt, Escherichia coli CFT073
ccaccauuuuacgcc

SEQ ID NO: 2646811 - RNA, 16 nt, Escherichia coli CFT073
ccaccauuuuacgccc

SEQ ID NO: 2646812 - RNA, 15 nt, Escherichia coli CFT073
ccacccaccgcagcc

SEQ ID NO: 2646813 - RNA, 19 nt, Escherichia coli CFT073
ccacccauuacacugaaaa

SEQ ID NO: 2646814 - RNA, 18 nt, Escherichia coli CFT073
ccaccccagacuuccccg

SEQ ID NO: 2646815 - RNA, 14 nt, Escherichia coli CFT073
ccacccgauacccu

SEQ ID NO: 2646816 - RNA, 22 nt, Escherichia coli CFT073
ccacccgcaacgcccugcaacu

SEQ ID NO: 2646817 - RNA, 14 nt, Escherichia coli CFT073
ccaccgcaaaacgc

SEQ ID NO: 2646818 - RNA, 20 nt, Escherichia coli CFT073
ccaccgcaaucgcggcagcg

SEQ ID NO: 2646819 - RNA, 21 nt, Escherichia coli CFT073
ccaccgccagauugcugcuga

SEQ ID NO: 2646820 - RNA, 13 nt, Escherichia coli CFT073
ccaccgccaggca

SEQ ID NO: 2646821 - RNA, 15 nt, Escherichia coli CFT073
ccaccgcccagagaa

SEQ ID NO: 2646822 - RNA, 12 nt, Escherichia coli CFT073
ccaccgcccguu

SEQ ID NO: 2646823 - RNA, 18 nt, Escherichia coli CFT073
ccaccgcuaacugcugcg

SEQ ID NO: 2646824 - RNA, 14 nt, Escherichia coli CFT073
ccaccguacgccag

SEQ ID NO: 2646825 - RNA, 19 nt, Escherichia coli CFT073
ccaccguacgccagcguca

SEQ ID NO: 2646826 - RNA, 15 nt, Escherichia coli CFT073
ccaccgucaaaucca

SEQ ID NO: 2646827 - RNA, 21 nt, Escherichia coli CFT073
ccaccgucgggcugacguuaa

SEQ ID NO: 2646828 - RNA, 16 nt, Escherichia coli CFT073
ccaccguguauuucug

SEQ ID NO: 2646829 - RNA, 19 nt, Escherichia coli CFT073
ccaccguguucaugaccgu

SEQ ID NO: 2646830 - RNA, 15 nt, Escherichia coli CFT073
ccaccguugugaaaa

SEQ ID NO: 2646831 - RNA, 21 nt, Escherichia coli CFT073
ccaccuccgcuaaauccgccg

SEQ ID NO: 2646832 - RNA, 21 nt, Escherichia coli CFT073
ccaccugaagaaaauccucaa

SEQ ID NO: 2646833 - RNA, 16 nt, Escherichia coli CFT073
ccaccugauugcugcu

SEQ ID NO: 2646834 - RNA, 13 nt, Escherichia coli CFT073
ccaccugcccggc

SEQ ID NO: 2646835 - RNA, 15 nt, Escherichia coli CFT073
ccaccuggccugcga

SEQ ID NO: 2646836 - RNA, 16 nt, Escherichia coli CFT073
ccaccuggcggcgugu

SEQ ID NO: 2646837 - RNA, 21 nt, Escherichia coli CFT073
ccaccuggggcgggauggucg

SEQ ID NO: 2646838 - RNA, 14 nt, Escherichia coli CFT073
ccaccuucaacguu

SEQ ID NO: 2646839 - RNA, 21 nt, Escherichia coli CFT073
ccacgaaaucuuccaguggca

SEQ ID NO: 2646840 - RNA, 14 nt, Escherichia coli CFT073
ccacgaccagcgca

SEQ ID NO: 2646841 - RNA, 20 nt, Escherichia coli CFT073
ccacgaccagcgcaaacggc

SEQ ID NO: 2646842 - RNA, 17 nt, Escherichia coli CFT073
ccacgagagaaccagcc

SEQ ID NO: 2646843 - RNA, 23 nt, Escherichia coli CFT073
ccacgaggaucgauaucaccaau

SEQ ID NO: 2646844 - RNA, 12 nt, Escherichia coli CFT073
ccacgauauccg

SEQ ID NO: 2646845 - RNA, 19 nt, Escherichia coli CFT073
ccacgauauguucaggaua

SEQ ID NO: 2646846 - RNA, 18 nt, Escherichia coli CFT073
ccacgcacagaacaaaau

SEQ ID NO: 2646847 - RNA, 13 nt, Escherichia coli CFT073
ccacgcacagccc

SEQ ID NO: 2646848 - RNA, 16 nt, Escherichia coli CFT073
ccacgcaccaccagcg

SEQ ID NO: 2646849 - RNA, 13 nt, Escherichia coli CFT073
ccacgccaagaaa

SEQ ID NO: 2646850 - RNA, 16 nt, Escherichia coli CFT073
ccacgccaagaaacac

SEQ ID NO: 2646851 - RNA, 21 nt, Escherichia coli CFT073
ccacgccaagaaacaccagaa

SEQ ID NO: 2646852 - RNA, 18 nt, Escherichia coli CFT073
ccacgccaauguguuuau

SEQ ID NO: 2646853 - RNA, 16 nt, Escherichia coli CFT073
ccacgccacaauacug

SEQ ID NO: 2646854 - RNA, 11 nt, Escherichia coli CFT073
ccacgccagug

SEQ ID NO: 2646855 - RNA, 18 nt, Escherichia coli CFT073
ccacgccauaaccggccu

SEQ ID NO: 2646856 - RNA, 12 nt, Escherichia coli CFT073
ccacgcccagcg

SEQ ID NO: 2646857 - RNA, 13 nt, Escherichia coli CFT073
ccacgcccagcga

SEQ ID NO: 2646858 - RNA, 16 nt, Escherichia coli CFT073
ccacgcccagcgacca

SEQ ID NO: 2646859 - RNA, 22 nt, Escherichia coli CFT073
ccacgccgaaccaugucaucaa

SEQ ID NO: 2646860 - RNA, 21 nt, Escherichia coli CFT073
ccacgccgauaaucaacgcgc

SEQ ID NO: 2646861 - RNA, 24 nt, Escherichia coli CFT073
ccacgccgauaaucaacgcgccgc

SEQ ID NO: 2646862 - RNA, 21 nt, Escherichia coli CFT073
ccacgccgauggcagaaauca

SEQ ID NO: 2646863 - RNA, 13 nt, Escherichia coli CFT073
ccacgccuuuuuu

SEQ ID NO: 2646864 - RNA, 10 nt, Escherichia coli CFT073
ccacgcgcgg

SEQ ID NO: 2646865 - RNA, 17 nt, Escherichia coli CFT073
ccacgcuauacagcagc

SEQ ID NO: 2646866 - RNA, 19 nt, Escherichia coli CFT073
ccacgcuaugugcuucauc

SEQ ID NO: 2646867 - RNA, 20 nt, Escherichia coli CFT073
ccacgcuaugugcuucauca

SEQ ID NO: 2646868 - RNA, 13 nt, Escherichia coli CFT073
ccacgcucagcaa

SEQ ID NO: 2646869 - RNA, 16 nt, Escherichia coli CFT073
ccacgcucagcaaucg

SEQ ID NO: 2646870 - RNA, 15 nt, Escherichia coli CFT073
ccacgcucgcuggcg

SEQ ID NO: 2646871 - RNA, 16 nt, Escherichia coli CFT073
ccacgcucgcuggcgu

SEQ ID NO: 2646872 - RNA, 17 nt, Escherichia coli CFT073
ccacgcucuggugagug

SEQ ID NO: 2646873 - RNA, 15 nt, Escherichia coli CFT073
ccacgcugccgcgca

SEQ ID NO: 2646874 - RNA, 17 nt, Escherichia coli CFT073
ccacgcugcgcugcacc

SEQ ID NO: 2646875 - RNA, 19 nt, Escherichia coli CFT073
ccacgcugcgcuugcugcc

SEQ ID NO: 2646876 - RNA, 12 nt, Escherichia coli CFT073
ccacgcuggacg

SEQ ID NO: 2646877 - RNA, 21 nt, Escherichia coli CFT073
ccacgcuuugauccgccagau

SEQ ID NO: 2646878 - RNA, 23 nt, Escherichia coli CFT073
ccagaacgacgaccgccgcucac

SEQ ID NO: 2646879 - RNA, 14 nt, Escherichia coli CFT073
ccagaacgccgaau

SEQ ID NO: 2646880 - RNA, 20 nt, Escherichia coli CFT073
ccagaacucacgcacuuccg

SEQ ID NO: 2646881 - RNA, 22 nt, Escherichia coli CFT073
ccagaacucaucuucuuuuucc

SEQ ID NO: 2646882 - RNA, 21 nt, Escherichia coli CFT073
ccagaacugcugcgccagcgg

SEQ ID NO: 2646883 - RNA, 21 nt, Escherichia coli CFT073
ccagaagacgagccgucccua

SEQ ID NO: 2646884 - RNA, 20 nt, Escherichia coli CFT073
ccagaauaacgcggcaggag

SEQ ID NO: 2646885 - RNA, 18 nt, Escherichia coli CFT073
ccagaauacccgaagcgc

SEQ ID NO: 2646886 - RNA, 12 nt, Escherichia coli CFT073
ccagaauaccuu

SEQ ID NO: 2646887 - RNA, 19 nt, Escherichia coli CFT073
ccagaauaccuugcugcuc

SEQ ID NO: 2646888 - RNA, 16 nt, Escherichia coli CFT073
ccagaauauguucgcu

SEQ ID NO: 2646889 - RNA, 21 nt, Escherichia coli CFT073
ccagaauauguucgcuuaacu

SEQ ID NO: 2646890 - RNA, 19 nt, Escherichia coli CFT073
ccagaauccggugauugcu

SEQ ID NO: 2646891 - RNA, 18 nt, Escherichia coli CFT073
ccagaaucgcaaccagcc

SEQ ID NO: 2646892 - RNA, 19 nt, Escherichia coli CFT073
ccagaaucgcaaccagcca

SEQ ID NO: 2646893 - RNA, 15 nt, Escherichia coli CFT073
ccagaaucgccagca

SEQ ID NO: 2646894 - RNA, 17 nt, Escherichia coli CFT073
ccagaaucgccagcauc

SEQ ID NO: 2646895 - RNA, 21 nt, Escherichia coli CFT073
ccagaaugcggaugagauaca

SEQ ID NO: 2646896 - RNA, 20 nt, Escherichia coli CFT073
ccagaauuccgugccagcac

SEQ ID NO: 2646897 - RNA, 22 nt, Escherichia coli CFT073
ccagaauuuccagaaagugagu

SEQ ID NO: 2646898 - RNA, 19 nt, Escherichia coli CFT073
ccagacaaaacugacgcca

SEQ ID NO: 2646899 - RNA, 20 nt, Escherichia coli CFT073
ccagacaaaugucagaaaga

SEQ ID NO: 2646900 - RNA, 15 nt, Escherichia coli CFT073
ccagacaacagucaa

SEQ ID NO: 2646901 - RNA, 17 nt, Escherichia coli CFT073
ccagacaaucauuucca

SEQ ID NO: 2646902 - RNA, 20 nt, Escherichia coli CFT073
ccagacaauccgcagcaaag

SEQ ID NO: 2646903 - RNA, 20 nt, Escherichia coli CFT073
ccagacaauugccgcuaguu

SEQ ID NO: 2646904 - RNA, 14 nt, Escherichia coli CFT073
ccagacacaacaau

SEQ ID NO: 2646905 - RNA, 20 nt, Escherichia coli CFT073
ccagacaccggcuuucaccu

SEQ ID NO: 2646906 - RNA, 17 nt, Escherichia coli CFT073
ccagacagccucaagca

SEQ ID NO: 2646907 - RNA, 17 nt, Escherichia coli CFT073
ccagacagucgccgcuu

SEQ ID NO: 2646908 - RNA, 16 nt, Escherichia coli CFT073
ccagacaucaccagua

SEQ ID NO: 2646909 - RNA, 19 nt, Escherichia coli CFT073
ccagacaucaccaguaccg

SEQ ID NO: 2646910 - RNA, 16 nt, Escherichia coli CFT073
ccagacauuacaaaau

SEQ ID NO: 2646911 - RNA, 22 nt, Escherichia coli CFT073
ccagaccaauuuuucccucuuc

SEQ ID NO: 2646912 - RNA, 18 nt, Escherichia coli CFT073
ccagaccacugcgccgcu

SEQ ID NO: 2646913 - RNA, 18 nt, Escherichia coli CFT073
ccagaccagcuaccacgc

SEQ ID NO: 2646914 - RNA, 19 nt, Escherichia coli CFT073
ccagaccauauaucagcgc

SEQ ID NO: 2646915 - RNA, 15 nt, Escherichia coli CFT073
ccagaccgccuuuga

SEQ ID NO: 2646916 - RNA, 14 nt, Escherichia coli CFT073
ccagaccggcaauc

SEQ ID NO: 2646917 - RNA, 23 nt, Escherichia coli CFT073
ccagaccggcaaucgcgccagaa

SEQ ID NO: 2646918 - RNA, 12 nt, Escherichia coli CFT073
ccagaccugaau

SEQ ID NO: 2646919 - RNA, 23 nt, Escherichia coli CFT073
ccagacgacgcgcuuguccugcc

SEQ ID NO: 2646920 - RNA, 15 nt, Escherichia coli CFT073
ccagacgacggcugc

SEQ ID NO: 2646921 - RNA, 13 nt, Escherichia coli CFT073
ccagacgauggcu

SEQ ID NO: 2646922 - RNA, 14 nt, Escherichia coli CFT073
ccagacgauuuucc

SEQ ID NO: 2646923 - RNA, 22 nt, Escherichia coli CFT073
ccagacgauuuucccugaguua

SEQ ID NO: 2646924 - RNA, 16 nt, Escherichia coli CFT073
ccagacgcaacagaaa

SEQ ID NO: 2646925 - RNA, 16 nt, Escherichia coli CFT073
ccagacgcccgcgccc

SEQ ID NO: 2646926 - RNA, 22 nt, Escherichia coli CFT073
ccagacgcccgcgcccaggcca

SEQ ID NO: 2646927 - RNA, 15 nt, Escherichia coli CFT073
ccagacgcgccgcca

SEQ ID NO: 2646928 - RNA, 19 nt, Escherichia coli CFT073
ccagacgcgcguccccugc

SEQ ID NO: 2646929 - RNA, 17 nt, Escherichia coli CFT073
ccagacgcgggcaaucg

SEQ ID NO: 2646930 - RNA, 20 nt, Escherichia coli CFT073
ccagacggguaaacggcagg

SEQ ID NO: 2646931 - RNA, 19 nt, Escherichia coli CFT073
ccagacguccaaucggcca

SEQ ID NO: 2646932 - RNA, 15 nt, Escherichia coli CFT073
ccagacguccggcgc

SEQ ID NO: 2646933 - RNA, 19 nt, Escherichia coli CFT073
ccagacguccggcgcugca

SEQ ID NO: 2646934 - RNA, 18 nt, Escherichia coli CFT073
ccagacgugcacgcagca

SEQ ID NO: 2646935 - RNA, 22 nt, Escherichia coli CFT073
ccagacgugcacgcagcaaacg

SEQ ID NO: 2646936 - RNA, 21 nt, Escherichia coli CFT073
ccagacguugauaaccacggc

SEQ ID NO: 2646937 - RNA, 14 nt, Escherichia coli CFT073
ccagacguuucgcc

SEQ ID NO: 2646938 - RNA, 14 nt, Escherichia coli CFT073
ccagacucaccagc

SEQ ID NO: 2646939 - RNA, 16 nt, Escherichia coli CFT073
ccagacucaccagcau

SEQ ID NO: 2646940 - RNA, 19 nt, Escherichia coli CFT073
ccagacuccagcagugcug

SEQ ID NO: 2646941 - RNA, 13 nt, Escherichia coli CFT073
ccagacugacaug

SEQ ID NO: 2646942 - RNA, 22 nt, Escherichia coli CFT073
ccagacuuggucgguauuuccg

SEQ ID NO: 2646943 - RNA, 22 nt, Escherichia coli CFT073
ccagagacucggugaccaucca

SEQ ID NO: 2646944 - RNA, 17 nt, Escherichia coli CFT073
ccagagagcggagcaau

SEQ ID NO: 2646945 - RNA, 14 nt, Escherichia coli CFT073
ccagagcagcaaca

SEQ ID NO: 2646946 - RNA, 20 nt, Escherichia coli CFT073
ccagagcagcaacaagccca

SEQ ID NO: 2646947 - RNA, 16 nt, Escherichia coli CFT073
ccagagcaucuacugg

SEQ ID NO: 2646948 - RNA, 11 nt, Escherichia coli CFT073
ccagagccgcg

SEQ ID NO: 2646949 - RNA, 13 nt, Escherichia coli CFT073
ccagagccgcgcc

SEQ ID NO: 2646950 - RNA, 18 nt, Escherichia coli CFT073
ccagagccgcgccgcuac

SEQ ID NO: 2646951 - RNA, 19 nt, Escherichia coli CFT073
ccagagccgcgccgcuacu

SEQ ID NO: 2646952 - RNA, 21 nt, Escherichia coli CFT073
ccagagcugcguagacuuccc

SEQ ID NO: 2646953 - RNA, 19 nt, Escherichia coli CFT073
ccagagcuuuugccaucuc

SEQ ID NO: 2646954 - RNA, 13 nt, Escherichia coli CFT073
ccagaggggcgag

SEQ ID NO: 2646955 - RNA, 11 nt, Escherichia coli CFT073
ccagagucagc

SEQ ID NO: 2646956 - RNA, 17 nt, Escherichia coli CFT073
ccagagucagcaaugcc

SEQ ID NO: 2646957 - RNA, 18 nt, Escherichia coli CFT073
ccagagucagcaaugcca

SEQ ID NO: 2646958 - RNA, 15 nt, Escherichia coli CFT073
ccagagucuuugcuu

SEQ ID NO: 2646959 - RNA, 21 nt, Escherichia coli CFT073
ccagaguggauuaucuucacc

SEQ ID NO: 2646960 - RNA, 15 nt, Escherichia coli CFT073
ccagauaaaacacau

SEQ ID NO: 2646961 - RNA, 17 nt, Escherichia coli CFT073
ccagauaaauauuauug

SEQ ID NO: 2646962 - RNA, 17 nt, Escherichia coli CFT073
ccagauaaauucgacca

SEQ ID NO: 2646963 - RNA, 21 nt, Escherichia coli CFT073
ccagauaaauucgaccauugc

SEQ ID NO: 2646964 - RNA, 13 nt, Escherichia coli CFT073
ccagauaacccag

SEQ ID NO: 2646965 - RNA, 16 nt, Escherichia coli CFT073
ccagauaagacacuga

SEQ ID NO: 2646966 - RNA, 17 nt, Escherichia coli CFT073
ccagauaaggcguucac

SEQ ID NO: 2646967 - RNA, 21 nt, Escherichia coli CFT073
ccagauacccgacagauaaau

SEQ ID NO: 2646968 - RNA, 19 nt, Escherichia coli CFT073
ccagauagagccgguuuug

SEQ ID NO: 2646969 - RNA, 15 nt, Escherichia coli CFT073
ccagauagccagguu

SEQ ID NO: 2646970 - RNA, 17 nt, Escherichia coli CFT073
ccagauagccgccagag

SEQ ID NO: 2646971 - RNA, 15 nt, Escherichia coli CFT073
ccagauauugcucua

SEQ ID NO: 2646972 - RNA, 16 nt, Escherichia coli CFT073
ccagaucaaacaaccg

SEQ ID NO: 2646973 - RNA, 14 nt, Escherichia coli CFT073
ccagaucagaccca

SEQ ID NO: 2646974 - RNA, 19 nt, Escherichia coli CFT073
ccagaucagacccagaacc

SEQ ID NO: 2646975 - RNA, 18 nt, Escherichia coli CFT073
ccagauccaauaccgcac

SEQ ID NO: 2646976 - RNA, 22 nt, Escherichia coli CFT073
ccagauccaauaccgcacuaag

SEQ ID NO: 2646977 - RNA, 12 nt, Escherichia coli CFT073
ccagauccgcca

SEQ ID NO: 2646978 - RNA, 17 nt, Escherichia coli CFT073
ccagaucggacuucaug

SEQ ID NO: 2646979 - RNA, 18 nt, Escherichia coli CFT073
ccagaucuaucuggcgcg

SEQ ID NO: 2646980 - RNA, 20 nt, Escherichia coli CFT073
ccagaucuaucuggcgcgcu

SEQ ID NO: 2646981 - RNA, 17 nt, Escherichia coli CFT073
ccagaucugacgauuau

SEQ ID NO: 2646982 - RNA, 14 nt, Escherichia coli CFT073
ccagaucugcuuca

SEQ ID NO: 2646983 - RNA, 14 nt, Escherichia coli CFT073
ccagaucuucauca

SEQ ID NO: 2646984 - RNA, 20 nt, Escherichia coli CFT073
ccagaugaguaauccgaagu

SEQ ID NO: 2646985 - RNA, 19 nt, Escherichia coli CFT073
ccagaugccuugccaggug

SEQ ID NO: 2646986 - RNA, 19 nt, Escherichia coli CFT073
ccagcaucggcaacgccag

SEQ ID NO: 2646987 - RNA, 20 nt, Escherichia coli CFT073
ccagcaugaugcucucccaa

SEQ ID NO: 2646988 - RNA, 14 nt, Escherichia coli CFT073
ccagcaugccgcca

SEQ ID NO: 2646989 - RNA, 18 nt, Escherichia coli CFT073
ccagcauggcaccugcgg

SEQ ID NO: 2646990 - RNA, 17 nt, Escherichia coli CFT073
ccagcauuacgcguccu

SEQ ID NO: 2646991 - RNA, 18 nt, Escherichia coli CFT073
ccagcauucccgccacca

SEQ ID NO: 2646992 - RNA, 11 nt, Escherichia coli CFT073
ccagcauuucc

SEQ ID NO: 2646993 - RNA, 11 nt, Escherichia coli CFT073
ccagcauuucu

SEQ ID NO: 2646994 - RNA, 14 nt, Escherichia coli CFT073
ccagcauuucuucc

SEQ ID NO: 2646995 - RNA, 22 nt, Escherichia coli CFT073
ccagccaaaacguaaaguggcg

SEQ ID NO: 2646996 - RNA, 20 nt, Escherichia coli CFT073
ccagccaacaaucgcugcgg

SEQ ID NO: 2646997 - RNA, 22 nt, Escherichia coli CFT073
ccagccaacgccuuuaccacca

SEQ ID NO: 2646998 - RNA, 13 nt, Escherichia coli CFT073
ccagccaauuucc

SEQ ID NO: 2646999 - RNA, 17 nt, Escherichia coli CFT073
ccagccacaaaccauga

SEQ ID NO: 2647000 - RNA, 10 nt, Escherichia coli CFT073
ccagccacac

SEQ ID NO: 2647001 - RNA, 12 nt, Escherichia coli CFT073
ccagccacacca

SEQ ID NO: 2647002 - RNA, 13 nt, Escherichia coli CFT073
ccagccacaccac

SEQ ID NO: 2647003 - RNA, 14 nt, Escherichia coli CFT073
ccagccacggcagc

SEQ ID NO: 2647004 - RNA, 15 nt, Escherichia coli CFT073
ccagccacugcgcca

SEQ ID NO: 2647005 - RNA, 14 nt, Escherichia coli CFT073
ccagccacugcgcg

SEQ ID NO: 2647006 - RNA, 16 nt, Escherichia coli CFT073
ccagccagaaaucacc

SEQ ID NO: 2647007 - RNA, 13 nt, Escherichia coli CFT073
ccagccagaagaa

SEQ ID NO: 2647008 - RNA, 19 nt, Escherichia coli CFT073
ccagccagacucagcaaca

SEQ ID NO: 2647009 - RNA, 15 nt, Escherichia coli CFT073
ccagccagaguugaa

SEQ ID NO: 2647010 - RNA, 13 nt, Escherichia coli CFT073
ccagccagcgccg

SEQ ID NO: 2647011 - RNA, 14 nt, Escherichia coli CFT073
ccagccagguguug

SEQ ID NO: 2647012 - RNA, 16 nt, Escherichia coli CFT073
ccagccaucgacacca

SEQ ID NO: 2647013 - RNA, 21 nt, Escherichia coli CFT073
ccagccauuaaccagccacug

SEQ ID NO: 2647014 - RNA, 13 nt, Escherichia coli CFT073
ccagcccacaugc

SEQ ID NO: 2647015 - RNA, 15 nt, Escherichia coli CFT073
ccagccccaccagca

SEQ ID NO: 2647016 - RNA, 15 nt, Escherichia coli CFT073
ccagccccgcgcggc

SEQ ID NO: 2647017 - RNA, 12 nt, Escherichia coli CFT073
ccagcccgccga

SEQ ID NO: 2647018 - RNA, 15 nt, Escherichia coli CFT073
ccagccgaucagcgg

SEQ ID NO: 2647019 - RNA, 17 nt, Escherichia coli CFT073
ccagccgcaaacgacac

SEQ ID NO: 2647020 - RNA, 18 nt, Escherichia coli CFT073
ccagccgcuaacuuccug

SEQ ID NO: 2647021 - RNA, 20 nt, Escherichia coli CFT073
ccagccgcuaacuuccugcu

SEQ ID NO: 2647022 - RNA, 16 nt, Escherichia coli CFT073
ccagccgguaaggcca

SEQ ID NO: 2647023 - RNA, 14 nt, Escherichia coli CFT073
ccagccgucgucgc

SEQ ID NO: 2647024 - RNA, 15 nt, Escherichia coli CFT073
ccagccgugaauggu

SEQ ID NO: 2647025 - RNA, 20 nt, Escherichia coli CFT073
ccagccuacagaacgcugca

SEQ ID NO: 2647026 - RNA, 18 nt, Escherichia coli CFT073
ccagccucauccaugcgg

SEQ ID NO: 2647027 - RNA, 22 nt, Escherichia coli CFT073
ccagccugaacgagaaaagcca

SEQ ID NO: 2647028 - RNA, 24 nt, Escherichia coli CFT073
ccagccugaaugccgcgccccauc

SEQ ID NO: 2647029 - RNA, 14 nt, Escherichia coli CFT073
ccagccuucuucau

SEQ ID NO: 2647030 - RNA, 15 nt, Escherichia coli CFT073
ccagccuuuccagca

SEQ ID NO: 2647031 - RNA, 21 nt, Escherichia coli CFT073
ccagcgaaaaaugguuugccc

SEQ ID NO: 2647032 - RNA, 14 nt, Escherichia coli CFT073
ccagcgaaaccuga

SEQ ID NO: 2647033 - RNA, 15 nt, Escherichia coli CFT073
ccagcgaaaccugaa

SEQ ID NO: 2647034 - RNA, 17 nt, Escherichia coli CFT073
ccagcgacacaaugggc

SEQ ID NO: 2647035 - RNA, 18 nt, Escherichia coli CFT073
ccagcgacagaaaucaga

SEQ ID NO: 2647036 - RNA, 16 nt, Escherichia coli CFT073
ccagcgacagccagcc

SEQ ID NO: 2647037 - RNA, 23 nt, Escherichia coli CFT073
ccagcgacauacucagcgccugc

SEQ ID NO: 2647038 - RNA, 21 nt, Escherichia coli CFT073
ccagcgaccgcgccauaaacc

SEQ ID NO: 2647039 - RNA, 13 nt, Escherichia coli CFT073
ccagcgacuccag

SEQ ID NO: 2647040 - RNA, 20 nt, Escherichia coli CFT073
ccagcgagaagucggcuuuu

SEQ ID NO: 2647041 - RNA, 14 nt, Escherichia coli CFT073
ccagcgagcuggcg

SEQ ID NO: 2647042 - RNA, 16 nt, Escherichia coli CFT073
ccagcgagcuggcgcu

SEQ ID NO: 2647043 - RNA, 13 nt, Escherichia coli CFT073
ccagcgauaucgc

SEQ ID NO: 2647044 - RNA, 15 nt, Escherichia coli CFT073
ccagcgauccgggua

SEQ ID NO: 2647045 - RNA, 14 nt, Escherichia coli CFT073
ccagcgcaaacggc

SEQ ID NO: 2647046 - RNA, 22 nt, Escherichia coli CFT073
ccagcgcaacuugugcucgcgu

SEQ ID NO: 2647047 - RNA, 15 nt, Escherichia coli CFT073
ccagcgcacagagca

SEQ ID NO: 2647048 - RNA, 16 nt, Escherichia coli CFT073
ccagcgcagacggcgc

SEQ ID NO: 2647049 - RNA, 17 nt, Escherichia coli CFT073
ccagcgcagcuuccggc

SEQ ID NO: 2647050 - RNA, 13 nt, Escherichia coli CFT073
ccagcgcaggcag

SEQ ID NO: 2647051 - RNA, 17 nt, Escherichia coli CFT073
ccagcgcauggcgguau

SEQ ID NO: 2647052 - RNA, 16 nt, Escherichia coli CFT073
ccagcgccaccaccag

SEQ ID NO: 2647053 - RNA, 19 nt, Escherichia coli CFT073
ccagcgccaccaccaguac

SEQ ID NO: 2647054 - RNA, 16 nt, Escherichia coli CFT073
ccagcgccaguaauuc

SEQ ID NO: 2647055 - RNA, 15 nt, Escherichia coli CFT073
ccagcgccaucucuu

SEQ ID NO: 2647056 - RNA, 23 nt, Escherichia coli CFT073
ccagcgccccuggcgcagcacga

SEQ ID NO: 2647057 - RNA, 14 nt, Escherichia coli CFT073
ccagcgcccgcuuc

SEQ ID NO: 2647058 - RNA, 12 nt, Escherichia coli CFT073
ccagcgccgcaa

SEQ ID NO: 2647059 - RNA, 18 nt, Escherichia coli CFT073
ccagcgccgccagaauca

SEQ ID NO: 2647060 - RNA, 12 nt, Escherichia coli CFT073
ccagcgccgccc

SEQ ID NO: 2647061 - RNA, 15 nt, Escherichia coli CFT073
ccagcgccgcgagca

SEQ ID NO: 2647062 - RNA, 18 nt, Escherichia coli CFT073
ccagcgccgcgagcaucg

SEQ ID NO: 2647063 - RNA, 21 nt, Escherichia coli CFT073
ccagcgcgacacaacagacca

SEQ ID NO: 2647064 - RNA, 23 nt, Escherichia coli CFT073
ccagcgcgacacaacagaccaga

SEQ ID NO: 2647065 - RNA, 14 nt, Escherichia coli CFT073
ccagcgcgaccgcc

SEQ ID NO: 2647066 - RNA, 18 nt, Escherichia coli CFT073
ccagcgcgauacaggcca

SEQ ID NO: 2647067 - RNA, 20 nt, Escherichia coli CFT073
ccagcgcgauacaggccacc

SEQ ID NO: 2647068 - RNA, 13 nt, Escherichia coli CFT073
ccagcgcgcggcu

SEQ ID NO: 2647069 - RNA, 16 nt, Escherichia coli CFT073
ccagcgcgcggcuggc

SEQ ID NO: 2647070 - RNA, 20 nt, Escherichia coli CFT073
ccagcgcggcggcaaucauc

SEQ ID NO: 2647071 - RNA, 14 nt, Escherichia coli CFT073
ccagcgcguucugu

SEQ ID NO: 2647072 - RNA, 14 nt, Escherichia coli CFT073
ccagcgcugcccac

SEQ ID NO: 2647073 - RNA, 16 nt, Escherichia coli CFT073
ccagcgcugcccacca

SEQ ID NO: 2647074 - RNA, 17 nt, Escherichia coli CFT073
ccagcgcugcccaccac

SEQ ID NO: 2647075 - RNA, 15 nt, Escherichia coli CFT073
ccagcgcugcggccu

SEQ ID NO: 2647076 - RNA, 20 nt, Escherichia coli CFT073
ccagcgcuucagcgaucgcu

SEQ ID NO: 2647077 - RNA, 17 nt, Escherichia coli CFT073
ccagcgcuuugauggca

SEQ ID NO: 2647078 - RNA, 17 nt, Escherichia coli CFT073
ccagcggaaaauaucac

SEQ ID NO: 2647079 - RNA, 19 nt, Escherichia coli CFT073
ccagcggaaauuaccgcac

SEQ ID NO: 2647080 - RNA, 18 nt, Escherichia coli CFT073
ccagcggacggcugauau

SEQ ID NO: 2647081 - RNA, 19 nt, Escherichia coli CFT073
ccagcggcaaccagcagca

SEQ ID NO: 2647082 - RNA, 16 nt, Escherichia coli CFT073
ccagcggcaccgagga

SEQ ID NO: 2647083 - RNA, 12 nt, Escherichia coli CFT073
ccagcggcagcc

SEQ ID NO: 2647084 - RNA, 13 nt, Escherichia coli CFT073
ccagcggcagcuc

SEQ ID NO: 2647085 - RNA, 20 nt, Escherichia coli CFT073
ccagcggccagacgcgccgc

SEQ ID NO: 2647086 - RNA, 12 nt, Escherichia coli CFT073
ccagcggcuuuu

SEQ ID NO: 2647087 - RNA, 16 nt, Escherichia coli CFT073
ccagcgggaucggcgu

SEQ ID NO: 2647088 - RNA, 17 nt, Escherichia coli CFT073
ccagcgguaaucauggc

SEQ ID NO: 2647089 - RNA, 17 nt, Escherichia coli CFT073
ccagcggugaaaacggc

SEQ ID NO: 2647090 - RNA, 19 nt, Escherichia coli CFT073
ccagcggugaaaacggcaa

SEQ ID NO: 2647091 - RNA, 15 nt, Escherichia coli CFT073
ccagcgguuggagca

SEQ ID NO: 2647092 - RNA, 18 nt, Escherichia coli CFT073
ccagcgguuguagccacg

SEQ ID NO: 2647093 - RNA, 21 nt, Escherichia coli CFT073
ccagcgguuguagccacgucu

SEQ ID NO: 2647094 - RNA, 23 nt, Escherichia coli CFT073
ccagcguaaauccugacgcuggg

SEQ ID NO: 2647095 - RNA, 20 nt, Escherichia coli CFT073
ccagcguacguaacuucuua

SEQ ID NO: 2647096 - RNA, 13 nt, Escherichia coli CFT073
ccagggccaguac

SEQ ID NO: 2647097 - RNA, 19 nt, Escherichia coli CFT073
ccagggccuccugcagcgu

SEQ ID NO: 2647098 - RNA, 16 nt, Escherichia coli CFT073
ccagggcgaauuuccg

SEQ ID NO: 2647099 - RNA, 23 nt, Escherichia coli CFT073
ccagggcgauaucuuucuucagc

SEQ ID NO: 2647100 - RNA, 15 nt, Escherichia coli CFT073
ccaggggcuggugcc

SEQ ID NO: 2647101 - RNA, 22 nt, Escherichia coli CFT073
ccagggguuguuauuuccggca

SEQ ID NO: 2647102 - RNA, 17 nt, Escherichia coli CFT073
ccaggguuuuauuauuc

SEQ ID NO: 2647103 - RNA, 21 nt, Escherichia coli CFT073
ccagguaaacauauacagggg

SEQ ID NO: 2647104 - RNA, 19 nt, Escherichia coli CFT073
ccagguagcaaacaaaaag

SEQ ID NO: 2647105 - RNA, 20 nt, Escherichia coli CFT073
ccagguagcguuucaccucu

SEQ ID NO: 2647106 - RNA, 20 nt, Escherichia coli CFT073
ccagguaucguuacgccagu

SEQ ID NO: 2647107 - RNA, 13 nt, Escherichia coli CFT073
ccaggucaaugca

SEQ ID NO: 2647108 - RNA, 15 nt, Escherichia coli CFT073
ccaggucaccagaca

SEQ ID NO: 2647109 - RNA, 20 nt, Escherichia coli CFT073
ccaggucagagagccagccc

SEQ ID NO: 2647110 - RNA, 22 nt, Escherichia coli CFT073
ccaggucggauaaggcguuuau

SEQ ID NO: 2647111 - RNA, 12 nt, Escherichia coli CFT073
ccaggucgugau

SEQ ID NO: 2647112 - RNA, 12 nt, Escherichia coli CFT073
ccaggugcuuuu

SEQ ID NO: 2647113 - RNA, 16 nt, Escherichia coli CFT073
ccagguuuaccagcag

SEQ ID NO: 2647114 - RNA, 17 nt, Escherichia coli CFT073
ccagguuuaccagcagc

SEQ ID NO: 2647115 - RNA, 16 nt, Escherichia coli CFT073
ccagguuuaucaugcu

SEQ ID NO: 2647116 - RNA, 14 nt, Escherichia coli CFT073
ccagguuugacccc

SEQ ID NO: 2647117 - RNA, 21 nt, Escherichia coli CFT073
ccagguuuuaguuucgccguu

SEQ ID NO: 2647118 - RNA, 22 nt, Escherichia coli CFT073
ccagguuuuaguuucgccguuu

SEQ ID NO: 2647119 - RNA, 21 nt, Escherichia coli CFT073
ccagguuuucuuucaccucuu

SEQ ID NO: 2647120 - RNA, 22 nt, Escherichia coli CFT073
ccagguuuucuuucaccucuuc

SEQ ID NO: 2647121 - RNA, 22 nt, Escherichia coli CFT073
ccagguuuuguagcuaaacuga

SEQ ID NO: 2647122 - RNA, 12 nt, Escherichia coli CFT073
ccaguaaaagga

SEQ ID NO: 2647123 - RNA, 15 nt, Escherichia coli CFT073
ccaguaaacacacca

SEQ ID NO: 2647124 - RNA, 22 nt, Escherichia coli CFT073
ccaguaaacacaccacagcacc

SEQ ID NO: 2647125 - RNA, 18 nt, Escherichia coli CFT073
ccaguaaagcagcgaagc

SEQ ID NO: 2647126 - RNA, 19 nt, Escherichia coli CFT073
ccaguaaauuguugccgga

SEQ ID NO: 2647127 - RNA, 13 nt, Escherichia coli CFT073
ccaguaaggcugc

SEQ ID NO: 2647128 - RNA, 21 nt, Escherichia coli CFT073
ccaguaagguaacgcugcccg

SEQ ID NO: 2647129 - RNA, 21 nt, Escherichia coli CFT073
ccaguaaucgggcaacugcug

SEQ ID NO: 2647130 - RNA, 23 nt, Escherichia coli CFT073
ccaguaaucgggcaacugcugcg

SEQ ID NO: 2647131 - RNA, 14 nt, Escherichia coli CFT073
ccaguaaugcgccc

SEQ ID NO: 2647132 - RNA, 17 nt, Escherichia coli CFT073
ccaguaauuccacacca

SEQ ID NO: 2647133 - RNA, 18 nt, Escherichia coli CFT073
ccaguaauuccacaccaa

SEQ ID NO: 2647134 - RNA, 18 nt, Escherichia coli CFT073
ccaguacacgcugaagau

SEQ ID NO: 2647135 - RNA, 16 nt, Escherichia coli CFT073
ccaguacagcccgccg

SEQ ID NO: 2647136 - RNA, 14 nt, Escherichia coli CFT073
ccaguaccagcagc

SEQ ID NO: 2647137 - RNA, 11 nt, Escherichia coli CFT073
ccaguaccgau

SEQ ID NO: 2647138 - RNA, 24 nt, Escherichia coli CFT073
ccaguaccgccaccaccagacgca

SEQ ID NO: 2647139 - RNA, 13 nt, Escherichia coli CFT073
ccaguaccgccag

SEQ ID NO: 2647140 - RNA, 14 nt, Escherichia coli CFT073
ccaguaccgccagu

SEQ ID NO: 2647141 - RNA, 18 nt, Escherichia coli CFT073
ccaguaccgccagugcag

SEQ ID NO: 2647142 - RNA, 15 nt, Escherichia coli CFT073
ccaguaccgccgcag

SEQ ID NO: 2647143 - RNA, 22 nt, Escherichia coli CFT073
ccaguaccgccgccauaaacag

SEQ ID NO: 2647144 - RNA, 16 nt, Escherichia coli CFT073
ccaguaccugagcgau

SEQ ID NO: 2647145 - RNA, 12 nt, Escherichia coli CFT073
ccaguaccugca

SEQ ID NO: 2647146 - RNA, 14 nt, Escherichia coli CFT073
ccaguacgcgcccg

SEQ ID NO: 2647147 - RNA, 23 nt, Escherichia coli CFT073
ccaguacggcuucgaucaggaac

SEQ ID NO: 2647148 - RNA, 23 nt, Escherichia coli CFT073
ccaguacugacuauccacuggaa

SEQ ID NO: 2647149 - RNA, 14 nt, Escherichia coli CFT073
ccaguagaacaauu

SEQ ID NO: 2647150 - RNA, 15 nt, Escherichia coli CFT073
ccaguagaacaauua

SEQ ID NO: 2647151 - RNA, 16 nt, Escherichia coli CFT073
ccaguagaacaauuaa

SEQ ID NO: 2647152 - RNA, 14 nt, Escherichia coli CFT073
ccaguagcaccucu

SEQ ID NO: 2647153 - RNA, 20 nt, Escherichia coli CFT073
ccaguagcgagccgucgcua

SEQ ID NO: 2647154 - RNA, 14 nt, Escherichia coli CFT073
ccaguagcugugug

SEQ ID NO: 2647155 - RNA, 21 nt, Escherichia coli CFT073
ccaguagugaaaaaagcaaga

SEQ ID NO: 2647156 - RNA, 19 nt, Escherichia coli CFT073
ccaguauauugcugauuuu

SEQ ID NO: 2647157 - RNA, 17 nt, Escherichia coli CFT073
ccaguauuucauagauu

SEQ ID NO: 2647158 - RNA, 24 nt, Escherichia coli CFT073
ccagucacccugcccggcaaacgu

SEQ ID NO: 2647159 - RNA, 15 nt, Escherichia coli CFT073
ccagucacugugacg

SEQ ID NO: 2647160 - RNA, 22 nt, Escherichia coli CFT073
ccagucacugugacgcggugcu

SEQ ID NO: 2647161 - RNA, 17 nt, Escherichia coli CFT073
ccagucagaaagugcca

SEQ ID NO: 2647162 - RNA, 17 nt, Escherichia coli CFT073
ccagucagaauguguua

SEQ ID NO: 2647163 - RNA, 15 nt, Escherichia coli CFT073
ccagucagcaccaga

SEQ ID NO: 2647164 - RNA, 14 nt, Escherichia coli CFT073
ccagucagcuccac

SEQ ID NO: 2647165 - RNA, 14 nt, Escherichia coli CFT073
ccagucaggcauga

SEQ ID NO: 2647166 - RNA, 14 nt, Escherichia coli CFT073
ccaguccacacuga

SEQ ID NO: 2647167 - RNA, 17 nt, Escherichia coli CFT073
ccaguccaccuggccug

SEQ ID NO: 2647168 - RNA, 17 nt, Escherichia coli CFT073
ccaguccaucggcauua

SEQ ID NO: 2647169 - RNA, 16 nt, Escherichia coli CFT073
ccagucccaguucaug

SEQ ID NO: 2647170 - RNA, 20 nt, Escherichia coli CFT073
ccaguccccucgccccuccg

SEQ ID NO: 2647171 - RNA, 21 nt, Escherichia coli CFT073
ccagucccguacccagcaaga

SEQ ID NO: 2647172 - RNA, 21 nt, Escherichia coli CFT073
ccagucccugaaugucuccau

SEQ ID NO: 2647173 - RNA, 13 nt, Escherichia coli CFT073
ccagucccuuuca

SEQ ID NO: 2647174 - RNA, 23 nt, Escherichia coli CFT073
ccaguccgucguucaacaagcca

SEQ ID NO: 2647175 - RNA, 22 nt, Escherichia coli CFT073
ccagucgauauggccuucuuca

SEQ ID NO: 2647176 - RNA, 14 nt, Escherichia coli CFT073
ccagucggucgauu

SEQ ID NO: 2647177 - RNA, 15 nt, Escherichia coli CFT073
ccagucgucauccca

SEQ ID NO: 2647178 - RNA, 18 nt, Escherichia coli CFT073
ccagucguuucgcccguu

SEQ ID NO: 2647179 - RNA, 17 nt, Escherichia coli CFT073
ccagucuuccgccggau

SEQ ID NO: 2647180 - RNA, 19 nt, Escherichia coli CFT073
ccagugaauuaaaaacagu

SEQ ID NO: 2647181 - RNA, 15 nt, Escherichia coli CFT073
ccagugacgcagcga

SEQ ID NO: 2647182 - RNA, 13 nt, Escherichia coli CFT073
ccagugauuccag

SEQ ID NO: 2647183 - RNA, 16 nt, Escherichia coli CFT073
ccagugauuccgggua

SEQ ID NO: 2647184 - RNA, 19 nt, Escherichia coli CFT073
ccagugauugcuugcgccu

SEQ ID NO: 2647185 - RNA, 18 nt, Escherichia coli CFT073
ccagugauuuuugcugaa

SEQ ID NO: 2647186 - RNA, 15 nt, Escherichia coli CFT073
ccagugcaaaaaauc

SEQ ID NO: 2647187 - RNA, 21 nt, Escherichia coli CFT073
ccagugcaaaaaaucaacagc

SEQ ID NO: 2647188 - RNA, 15 nt, Escherichia coli CFT073
ccagugcagauacca

SEQ ID NO: 2647189 - RNA, 18 nt, Escherichia coli CFT073
ccagugcagaugcacaag

SEQ ID NO: 2647190 - RNA, 15 nt, Escherichia coli CFT073
ccagugcagcgaagu

SEQ ID NO: 2647191 - RNA, 13 nt, Escherichia coli CFT073
ccagugcagcgca

SEQ ID NO: 2647192 - RNA, 13 nt, Escherichia coli CFT073
ccagugcauaucc

SEQ ID NO: 2647193 - RNA, 22 nt, Escherichia coli CFT073
ccagugcaugggcaaauuguuc

SEQ ID NO: 2647194 - RNA, 14 nt, Escherichia coli CFT073
ccagugccagaaca

SEQ ID NO: 2647195 - RNA, 15 nt, Escherichia coli CFT073
ccagugccagcacca

SEQ ID NO: 2647196 - RNA, 23 nt, Escherichia coli CFT073
ccagugcccgaccacuucaugcc

SEQ ID NO: 2647197 - RNA, 12 nt, Escherichia coli CFT073
ccagugccgccu

SEQ ID NO: 2647198 - RNA, 20 nt, Escherichia coli CFT073
ccagugcguugugcgccagu

SEQ ID NO: 2647199 - RNA, 20 nt, Escherichia coli CFT073
ccagugcuacccccagacga

SEQ ID NO: 2647200 - RNA, 19 nt, Escherichia coli CFT073
ccagugcuucgcggacauc

SEQ ID NO: 2647201 - RNA, 19 nt, Escherichia coli CFT073
ccaguggagccaucaccau

SEQ ID NO: 2647202 - RNA, 14 nt, Escherichia coli CFT073
ccaguggaugcgcc

SEQ ID NO: 2647203 - RNA, 13 nt, Escherichia coli CFT073
ccaguggcauccg

SEQ ID NO: 2647204 - RNA, 23 nt, Escherichia coli CFT073
ccaucaaguagcagguaaucugc

SEQ ID NO: 2647205 - RNA, 14 nt, Escherichia coli CFT073
ccaucaauaaucac

SEQ ID NO: 2647206 - RNA, 17 nt, Escherichia coli CFT073
ccaucaauaaucaccga

SEQ ID NO: 2647207 - RNA, 19 nt, Escherichia coli CFT073
ccaucaauagcccggcaau

SEQ ID NO: 2647208 - RNA, 14 nt, Escherichia coli CFT073
ccaucaaucccauc

SEQ ID NO: 2647209 - RNA, 15 nt, Escherichia coli CFT073
ccaucaaucuucacg

SEQ ID NO: 2647210 - RNA, 23 nt, Escherichia coli CFT073
ccaucaaugugcugagaacaaga

SEQ ID NO: 2647211 - RNA, 15 nt, Escherichia coli CFT073
ccaucacaaaguggg

SEQ ID NO: 2647212 - RNA, 13 nt, Escherichia coli CFT073
ccaucacaauuca

SEQ ID NO: 2647213 - RNA, 18 nt, Escherichia coli CFT073
ccaucacaauucaguacg

SEQ ID NO: 2647214 - RNA, 11 nt, Escherichia coli CFT073
ccaucacccaa

SEQ ID NO: 2647215 - RNA, 20 nt, Escherichia coli CFT073
ccaucaccgccacuaucgcc

SEQ ID NO: 2647216 - RNA, 13 nt, Escherichia coli CFT073
ccaucaccgccag

SEQ ID NO: 2647217 - RNA, 13 nt, Escherichia coli CFT073
ccaucaccggcau

SEQ ID NO: 2647218 - RNA, 21 nt, Escherichia coli CFT073
ccaucaccugacagcagagca

SEQ ID NO: 2647219 - RNA, 15 nt, Escherichia coli CFT073
ccaucacgccugcuu

SEQ ID NO: 2647220 - RNA, 16 nt, Escherichia coli CFT073
ccaucacuaaggguaa

SEQ ID NO: 2647221 - RNA, 13 nt, Escherichia coli CFT073
ccaucacuaccug

SEQ ID NO: 2647222 - RNA, 17 nt, Escherichia coli CFT073
ccaucacuauucagauc

SEQ ID NO: 2647223 - RNA, 14 nt, Escherichia coli CFT073
ccaucacuugcugc

SEQ ID NO: 2647224 - RNA, 14 nt, Escherichia coli CFT073
ccaucagaccagac

SEQ ID NO: 2647225 - RNA, 19 nt, Escherichia coli CFT073
ccaucagacuuugcgccau

SEQ ID NO: 2647226 - RNA, 14 nt, Escherichia coli CFT073
ccaucagcaguacg

SEQ ID NO: 2647227 - RNA, 17 nt, Escherichia coli CFT073
ccaucagccagccccau

SEQ ID NO: 2647228 - RNA, 23 nt, Escherichia coli CFT073
ccaucagccaugguuuaaucgcc

SEQ ID NO: 2647229 - RNA, 20 nt, Escherichia coli CFT073
ccaucagcgccaucgccagg

SEQ ID NO: 2647230 - RNA, 17 nt, Escherichia coli CFT073
ccaucaggaugauggcg

SEQ ID NO: 2647231 - RNA, 19 nt, Escherichia coli CFT073
ccaucaggcagaacaccgg

SEQ ID NO: 2647232 - RNA, 12 nt, Escherichia coli CFT073
ccaucaggcaua

SEQ ID NO: 2647233 - RNA, 15 nt, Escherichia coli CFT073
ccaucaggcgacacu

SEQ ID NO: 2647234 - RNA, 13 nt, Escherichia coli CFT073
ccaucaggucauc

SEQ ID NO: 2647235 - RNA, 20 nt, Escherichia coli CFT073
ccaucauacagccagcaaua

SEQ ID NO: 2647236 - RNA, 13 nt, Escherichia coli CFT073
ccaucaucaucgg

SEQ ID NO: 2647237 - RNA, 16 nt, Escherichia coli CFT073
ccaucaucgcuuucag

SEQ ID NO: 2647238 - RNA, 16 nt, Escherichia coli CFT073
ccaucaucggcaaaca

SEQ ID NO: 2647239 - RNA, 13 nt, Escherichia coli CFT073
ccaucaugcgcca

SEQ ID NO: 2647240 - RNA, 14 nt, Escherichia coli CFT073
ccaucaugcgccag

SEQ ID NO: 2647241 - RNA, 15 nt, Escherichia coli CFT073
ccaucaugcgccagg

SEQ ID NO: 2647242 - RNA, 16 nt, Escherichia coli CFT073
ccaucaugcgccaggu

SEQ ID NO: 2647243 - RNA, 19 nt, Escherichia coli CFT073
ccaucauuaugagugaugu

SEQ ID NO: 2647244 - RNA, 20 nt, Escherichia coli CFT073
ccauccacagaguguauuca

SEQ ID NO: 2647245 - RNA, 13 nt, Escherichia coli CFT073
ccauccagcaaca

SEQ ID NO: 2647246 - RNA, 12 nt, Escherichia coli CFT073
ccauccagcaga

SEQ ID NO: 2647247 - RNA, 21 nt, Escherichia coli CFT073
ccauccaggagauauugcugc

SEQ ID NO: 2647248 - RNA, 10 nt, Escherichia coli CFT073
ccauccauac

SEQ ID NO: 2647249 - RNA, 16 nt, Escherichia coli CFT073
ccauccaucaacgcca

SEQ ID NO: 2647250 - RNA, 14 nt, Escherichia coli CFT073
ccaucccacacugu

SEQ ID NO: 2647251 - RNA, 21 nt, Escherichia coli CFT073
ccauccccaaaaaaucaacga

SEQ ID NO: 2647252 - RNA, 20 nt, Escherichia coli CFT073
ccaucccuuucgccugcaaa

SEQ ID NO: 2647253 - RNA, 20 nt, Escherichia coli CFT073
ccauccgcgugacgcuggca

SEQ ID NO: 2647254 - RNA, 13 nt, Escherichia coli CFT073
ccauccggcagca

SEQ ID NO: 2647255 - RNA, 20 nt, Escherichia coli CFT073
ccauccgggaucacaucaua

SEQ ID NO: 2647256 - RNA, 18 nt, Escherichia coli CFT073
ccauccgucauucauuua

SEQ ID NO: 2647257 - RNA, 16 nt, Escherichia coli CFT073
ccauccuccgcagcca

SEQ ID NO: 2647258 - RNA, 14 nt, Escherichia coli CFT073
ccauccugaucgcc

SEQ ID NO: 2647259 - RNA, 15 nt, Escherichia coli CFT073
ccaucgacaccagcc

SEQ ID NO: 2647260 - RNA, 21 nt, Escherichia coli CFT073
ccaucgacgaaauggugugca

SEQ ID NO: 2647261 - RNA, 13 nt, Escherichia coli CFT073
ccaucgacuucuc

SEQ ID NO: 2647262 - RNA, 14 nt, Escherichia coli CFT073
ccaucgacuucucg

SEQ ID NO: 2647263 - RNA, 17 nt, Escherichia coli CFT073
ccaucgauacccagaca

SEQ ID NO: 2647264 - RNA, 13 nt, Escherichia coli CFT073
ccaucgcaucguc

SEQ ID NO: 2647265 - RNA, 13 nt, Escherichia coli CFT073
ccaucgcaugcca

SEQ ID NO: 2647266 - RNA, 19 nt, Escherichia coli CFT073
ccaucgccacaccaguaaa

SEQ ID NO: 2647267 - RNA, 20 nt, Escherichia coli CFT073
ccaucgccagcagccauucc

SEQ ID NO: 2647268 - RNA, 18 nt, Escherichia coli CFT073
ccaucgccauuuaacgca

SEQ ID NO: 2647269 - RNA, 23 nt, Escherichia coli CFT073
ccaucgccgcacuauuuaccgcc

SEQ ID NO: 2647270 - RNA, 20 nt, Escherichia coli CFT073
ccaucgccguaccuuuguaa

SEQ ID NO: 2647271 - RNA, 18 nt, Escherichia coli CFT073
ccaucgcuacauaacgca

SEQ ID NO: 2647272 - RNA, 14 nt, Escherichia coli CFT073
ccaucgcuucaugc

SEQ ID NO: 2647273 - RNA, 15 nt, Escherichia coli CFT073
ccaucggcagcgcca

SEQ ID NO: 2647274 - RNA, 19 nt, Escherichia coli CFT073
ccaucggcauuaaucugcu

SEQ ID NO: 2647275 - RNA, 16 nt, Escherichia coli CFT073
ccaucgucacaccuuc

SEQ ID NO: 2647276 - RNA, 23 nt, Escherichia coli CFT073
ccaucguccagcagcaaugcagg

SEQ ID NO: 2647277 - RNA, 22 nt, Escherichia coli CFT073
ccaucgugcuucacuucagcga

SEQ ID NO: 2647278 - RNA, 19 nt, Escherichia coli CFT073
ccaucguuaaaaaacagug

SEQ ID NO: 2647279 - RNA, 22 nt, Escherichia coli CFT073
ccaucguuaccuuugcagucaa

SEQ ID NO: 2647280 - RNA, 15 nt, Escherichia coli CFT073
ccaucguugaaaaaa

SEQ ID NO: 2647281 - RNA, 15 nt, Escherichia coli CFT073
ccaucguugagagau

SEQ ID NO: 2647282 - RNA, 16 nt, Escherichia coli CFT073
ccaucucaacuuucuu

SEQ ID NO: 2647283 - RNA, 15 nt, Escherichia coli CFT073
ccaucucagugguga

SEQ ID NO: 2647284 - RNA, 15 nt, Escherichia coli CFT073
ccaucuccagcugcu

SEQ ID NO: 2647285 - RNA, 15 nt, Escherichia coli CFT073
ccaucuccaucaucu

SEQ ID NO: 2647286 - RNA, 20 nt, Escherichia coli CFT073
ccaucugaauaaacggcuca

SEQ ID NO: 2647287 - RNA, 16 nt, Escherichia coli CFT073
ccaucugauucuuccc

SEQ ID NO: 2647288 - RNA, 16 nt, Escherichia coli CFT073
ccaucuggcuccuguu

SEQ ID NO: 2647289 - RNA, 22 nt, Escherichia coli CFT073
ccaucuucacuguccgccagac

SEQ ID NO: 2647290 - RNA, 13 nt, Escherichia coli CFT073
ccaucuuccagca

SEQ ID NO: 2647291 - RNA, 14 nt, Escherichia coli CFT073
ccaucuucuucaau

SEQ ID NO: 2647292 - RNA, 18 nt, Escherichia coli CFT073
ccaucuucuugcagcuua

SEQ ID NO: 2647293 - RNA, 13 nt, Escherichia coli CFT073
ccaucuuuuggcu

SEQ ID NO: 2647294 - RNA, 16 nt, Escherichia coli CFT073
ccaugaaaaaguuacc

SEQ ID NO: 2647295 - RNA, 15 nt, Escherichia coli CFT073
ccaugaccaccgcag

SEQ ID NO: 2647296 - RNA, 22 nt, Escherichia coli CFT073
ccaugaccgcuccgccaucuuc

SEQ ID NO: 2647297 - RNA, 20 nt, Escherichia coli CFT073
ccaugacgcaccuuguucau

SEQ ID NO: 2647298 - RNA, 23 nt, Escherichia coli CFT073
ccaugagacaaaacgaccaccuu

SEQ ID NO: 2647299 - RNA, 20 nt, Escherichia coli CFT073
ccaugaguaauuuuucuuuc

SEQ ID NO: 2647300 - RNA, 14 nt, Escherichia coli CFT073
ccaugauaaacggc

SEQ ID NO: 2647301 - RNA, 20 nt, Escherichia coli CFT073
ccaugauaagagagcaacag

SEQ ID NO: 2647302 - RNA, 14 nt, Escherichia coli CFT073
ccaugauauuggca

SEQ ID NO: 2647303 - RNA, 23 nt, Escherichia coli CFT073
ccaugaucugcaaauucaauaaa

SEQ ID NO: 2647304 - RNA, 14 nt, Escherichia coli CFT073
ccaugaugacaaca

SEQ ID NO: 2647305 - RNA, 17 nt, Escherichia coli CFT073
ccaugaugacaacauag

SEQ ID NO: 2647306 - RNA, 16 nt, Escherichia coli CFT073
ccaugauuaccagcau

SEQ ID NO: 2647307 - RNA, 22 nt, Escherichia coli CFT073
ccaugauuucguauacugcagc

SEQ ID NO: 2647308 - RNA, 23 nt, Escherichia coli CFT073
ccaugauuucguauacugcagcg

SEQ ID NO: 2647309 - RNA, 20 nt, Escherichia coli CFT073
ccaugcaauauuguagcaac

SEQ ID NO: 2647310 - RNA, 20 nt, Escherichia coli CFT073
ccaugcaaucacugccacca

SEQ ID NO: 2647311 - RNA, 21 nt, Escherichia coli CFT073
ccaugcacgauauaccgugcu

SEQ ID NO: 2647312 - RNA, 11 nt, Escherichia coli CFT073
ccaugcauauc

SEQ ID NO: 2647313 - RNA, 22 nt, Escherichia coli CFT073
cccaacugaaagaacaccagca

SEQ ID NO: 2647314 - RNA, 21 nt, Escherichia coli CFT073
cccaagaucaauacaaccuac

SEQ ID NO: 2647315 - RNA, 22 nt, Escherichia coli CFT073
cccaagaugccagaauccccac

SEQ ID NO: 2647316 - RNA, 23 nt, Escherichia coli CFT073
cccaagcgggaauagcucaguug

SEQ ID NO: 2647317 - RNA, 12 nt, Escherichia coli CFT073
cccaagcggggg

SEQ ID NO: 2647318 - RNA, 17 nt, Escherichia coli CFT073
cccaauaccuucaucga

SEQ ID NO: 2647319 - RNA, 22 nt, Escherichia coli CFT073
cccaauacgauuaacgccagac

SEQ ID NO: 2647320 - RNA, 15 nt, Escherichia coli CFT073
cccaauauacaaaua

SEQ ID NO: 2647321 - RNA, 12 nt, Escherichia coli CFT073
cccaauccacgc

SEQ ID NO: 2647322 - RNA, 20 nt, Escherichia coli CFT073
cccaauccaguacaugaagc

SEQ ID NO: 2647323 - RNA, 15 nt, Escherichia coli CFT073
cccaaucccccacuu

SEQ ID NO: 2647324 - RNA, 18 nt, Escherichia coli CFT073
cccaauguaaccacaggc

SEQ ID NO: 2647325 - RNA, 18 nt, Escherichia coli CFT073
cccaauucuuccugggua

SEQ ID NO: 2647326 - RNA, 14 nt, Escherichia coli CFT073
cccacaacauugcg

SEQ ID NO: 2647327 - RNA, 15 nt, Escherichia coli CFT073
cccacaagcccgcca

SEQ ID NO: 2647328 - RNA, 18 nt, Escherichia coli CFT073
cccacaagcccgccagac

SEQ ID NO: 2647329 - RNA, 16 nt, Escherichia coli CFT073
cccacaccacgccacu

SEQ ID NO: 2647330 - RNA, 13 nt, Escherichia coli CFT073
cccacaccgccca

SEQ ID NO: 2647331 - RNA, 19 nt, Escherichia coli CFT073
cccacaccugacaauccga

SEQ ID NO: 2647332 - RNA, 14 nt, Escherichia coli CFT073
cccacagaaacaau

SEQ ID NO: 2647333 - RNA, 12 nt, Escherichia coli CFT073
cccacagcaccg

SEQ ID NO: 2647334 - RNA, 21 nt, Escherichia coli CFT073
cccacagccauggcauccaag

SEQ ID NO: 2647335 - RNA, 17 nt, Escherichia coli CFT073
cccacagcgcaccaacg

SEQ ID NO: 2647336 - RNA, 14 nt, Escherichia coli CFT073
cccacagcgcgucu

SEQ ID NO: 2647337 - RNA, 12 nt, Escherichia coli CFT073
cccacagcucug

SEQ ID NO: 2647338 - RNA, 15 nt, Escherichia coli CFT073
cccacaucaauucag

SEQ ID NO: 2647339 - RNA, 16 nt, Escherichia coli CFT073
cccacaucacaccauc

SEQ ID NO: 2647340 - RNA, 14 nt, Escherichia coli CFT073
cccacauguugcag

SEQ ID NO: 2647341 - RNA, 15 nt, Escherichia coli CFT073
cccacauguugcgcu

SEQ ID NO: 2647342 - RNA, 16 nt, Escherichia coli CFT073
cccacauguugcgcuu

SEQ ID NO: 2647343 - RNA, 21 nt, Escherichia coli CFT073
cccacauguugcgcuucacca

SEQ ID NO: 2647344 - RNA, 18 nt, Escherichia coli CFT073
cccaccaaaacagcgaca

SEQ ID NO: 2647345 - RNA, 12 nt, Escherichia coli CFT073
cccaccaccauc

SEQ ID NO: 2647346 - RNA, 21 nt, Escherichia coli CFT073
cccaccaccgcuaacugcugc

SEQ ID NO: 2647347 - RNA, 13 nt, Escherichia coli CFT073
cccaccagcaaaa

SEQ ID NO: 2647348 - RNA, 14 nt, Escherichia coli CFT073
cccaccagcaaaua

SEQ ID NO: 2647349 - RNA, 10 nt, Escherichia coli CFT073
cccaccagcg

SEQ ID NO: 2647350 - RNA, 23 nt, Escherichia coli CFT073
cccaccauaaucagcguaugcag

SEQ ID NO: 2647351 - RNA, 15 nt, Escherichia coli CFT073
cccacccaacauggu

SEQ ID NO: 2647352 - RNA, 21 nt, Escherichia coli CFT073
cccacccggggauuugugaug

SEQ ID NO: 2647353 - RNA, 13 nt, Escherichia coli CFT073
cccaccgcagccc

SEQ ID NO: 2647354 - RNA, 15 nt, Escherichia coli CFT073
cccaccugaacuucu

SEQ ID NO: 2647355 - RNA, 17 nt, Escherichia coli CFT073
cccaccugcccggcagc

SEQ ID NO: 2647356 - RNA, 20 nt, Escherichia coli CFT073
cccaccuugcgggcaggcaa

SEQ ID NO: 2647357 - RNA, 16 nt, Escherichia coli CFT073
cccacgaaaucuucca

SEQ ID NO: 2647358 - RNA, 19 nt, Escherichia coli CFT073
cccacgcggcaacggcuuc

SEQ ID NO: 2647359 - RNA, 20 nt, Escherichia coli CFT073
cccacggauagauuuuuaau

SEQ ID NO: 2647360 - RNA, 16 nt, Escherichia coli CFT073
cccacggauugccgcu

SEQ ID NO: 2647361 - RNA, 22 nt, Escherichia coli CFT073
cccacgguuugagagucaucca

SEQ ID NO: 2647362 - RNA, 23 nt, Escherichia coli CFT073
cccacgugaguguggccaguucc

SEQ ID NO: 2647363 - RNA, 16 nt, Escherichia coli CFT073
cccacguuuaccgccc

SEQ ID NO: 2647364 - RNA, 14 nt, Escherichia coli CFT073
cccacuaccagcug

SEQ ID NO: 2647365 - RNA, 19 nt, Escherichia coli CFT073
cccacuacgcccgcaauca

SEQ ID NO: 2647366 - RNA, 16 nt, Escherichia coli CFT073
cccacucggcgaccag

SEQ ID NO: 2647367 - RNA, 15 nt, Escherichia coli CFT073
cccacugccgccuuc

SEQ ID NO: 2647368 - RNA, 19 nt, Escherichia coli CFT073
cccacugcggcgcaacacg

SEQ ID NO: 2647369 - RNA, 22 nt, Escherichia coli CFT073
cccacuucauauggcacuuuca

SEQ ID NO: 2647370 - RNA, 14 nt, Escherichia coli CFT073
cccacuucauccga

SEQ ID NO: 2647371 - RNA, 17 nt, Escherichia coli CFT073
cccacuuucugcgcaau

SEQ ID NO: 2647372 - RNA, 19 nt, Escherichia coli CFT073
cccacuuuuauuucacccc

SEQ ID NO: 2647373 - RNA, 18 nt, Escherichia coli CFT073
cccacuuuucaguuacca

SEQ ID NO: 2647374 - RNA, 18 nt, Escherichia coli CFT073
cccagaaaauacucagca

SEQ ID NO: 2647375 - RNA, 20 nt, Escherichia coli CFT073
cccagaaaauacucagcacc

SEQ ID NO: 2647376 - RNA, 22 nt, Escherichia coli CFT073
cccagaaaauacucagcacccc

SEQ ID NO: 2647377 - RNA, 15 nt, Escherichia coli CFT073
cccagaacacgccgu

SEQ ID NO: 2647378 - RNA, 15 nt, Escherichia coli CFT073
cccagaacgccgaau

SEQ ID NO: 2647379 - RNA, 20 nt, Escherichia coli CFT073
cccagaacgccgaauaacgc

SEQ ID NO: 2647380 - RNA, 17 nt, Escherichia coli CFT073
cccagaagacgagccgu

SEQ ID NO: 2647381 - RNA, 16 nt, Escherichia coli CFT073
cccagaagcuuuccau

SEQ ID NO: 2647382 - RNA, 23 nt, Escherichia coli CFT073
cccagaagggguaaugccaguca

SEQ ID NO: 2647383 - RNA, 14 nt, Escherichia coli CFT073
cccagaauccccac

SEQ ID NO: 2647384 - RNA, 14 nt, Escherichia coli CFT073
cccagaaucgccaa

SEQ ID NO: 2647385 - RNA, 19 nt, Escherichia coli CFT073
cccagaaucgccaacgccu

SEQ ID NO: 2647386 - RNA, 13 nt, Escherichia coli CFT073
cccagacccaguu

SEQ ID NO: 2647387 - RNA, 18 nt, Escherichia coli CFT073
cccagaccugcguucagc

SEQ ID NO: 2647388 - RNA, 21 nt, Escherichia coli CFT073
cccagacuccagcagugcugc

SEQ ID NO: 2647389 - RNA, 16 nt, Escherichia coli CFT073
cccagacuuuucagau

SEQ ID NO: 2647390 - RNA, 13 nt, Escherichia coli CFT073
cccagaucagacc

SEQ ID NO: 2647391 - RNA, 23 nt, Escherichia coli CFT073
cccagaugcugggcgaucggcag

SEQ ID NO: 2647392 - RNA, 14 nt, Escherichia coli CFT073
cccagcaaugccag

SEQ ID NO: 2647393 - RNA, 20 nt, Escherichia coli CFT073
cccagcaaugccaggcucca

SEQ ID NO: 2647394 - RNA, 13 nt, Escherichia coli CFT073
cccagcacuucgc

SEQ ID NO: 2647395 - RNA, 16 nt, Escherichia coli CFT073
cccagcacuucgcugg

SEQ ID NO: 2647396 - RNA, 21 nt, Escherichia coli CFT073
cccagcacuuuucgcacugca

SEQ ID NO: 2647397 - RNA, 15 nt, Escherichia coli CFT073
cccagcagagaucuu

SEQ ID NO: 2647398 - RNA, 23 nt, Escherichia coli CFT073
cccagcagagaucuuucacgccc

SEQ ID NO: 2647399 - RNA, 13 nt, Escherichia coli CFT073
cccagcagcacag

SEQ ID NO: 2647400 - RNA, 18 nt, Escherichia coli CFT073
cccagcagcgccgcgccu

SEQ ID NO: 2647401 - RNA, 17 nt, Escherichia coli CFT073
cccagcaggaucaauac

SEQ ID NO: 2647402 - RNA, 18 nt, Escherichia coli CFT073
cccagcaggaucaauacc

SEQ ID NO: 2647403 - RNA, 20 nt, Escherichia coli CFT073
cccagccaucgacaccagcc

SEQ ID NO: 2647404 - RNA, 18 nt, Escherichia coli CFT073
cccagccauuccugcacc

SEQ ID NO: 2647405 - RNA, 17 nt, Escherichia coli CFT073
cccagccccgccgguaa

SEQ ID NO: 2647406 - RNA, 16 nt, Escherichia coli CFT073
cccagccuaagccauu

SEQ ID NO: 2647407 - RNA, 21 nt, Escherichia coli CFT073
cccagccugaaugccgcgccc

SEQ ID NO: 2647408 - RNA, 14 nt, Escherichia coli CFT073
cccagccuuuccag

SEQ ID NO: 2647409 - RNA, 14 nt, Escherichia coli CFT073
cccagcgaaccguu

SEQ ID NO: 2647410 - RNA, 17 nt, Escherichia coli CFT073
cccagcgaagcaaacca

SEQ ID NO: 2647411 - RNA, 18 nt, Escherichia coli CFT073
cccagcgaagcaaaccag

SEQ ID NO: 2647412 - RNA, 17 nt, Escherichia coli CFT073
cccagcgccaugccaac

SEQ ID NO: 2647413 - RNA, 16 nt, Escherichia coli CFT073
cccagcgcgaucgcgc

SEQ ID NO: 2647414 - RNA, 18 nt, Escherichia coli CFT073
cccagcgcgaucgcgcca

SEQ ID NO: 2647415 - RNA, 21 nt, Escherichia coli CFT073
cccagcgcguuaacuggaaca

SEQ ID NO: 2647416 - RNA, 17 nt, Escherichia coli CFT073
cccagcucaucagcauu

SEQ ID NO: 2647417 - RNA, 15 nt, Escherichia coli CFT073
cccagcuuaguaagc

SEQ ID NO: 2647418 - RNA, 19 nt, Escherichia coli CFT073
cccagcuuaguaagcccag

SEQ ID NO: 2647419 - RNA, 16 nt, Escherichia coli CFT073
cccaggaagcccgccc

SEQ ID NO: 2647420 - RNA, 12 nt, Escherichia coli CFT073
cccaggcaaaau

SEQ ID NO: 2647421 - RNA, 10 nt, Escherichia coli CFT073
cccaggccau

SEQ ID NO: 2647422 - RNA, 22 nt, Escherichia coli CFT073
ccccguaaaucgucaguagcgc

SEQ ID NO: 2647423 - RNA, 21 nt, Escherichia coli CFT073
ccccgugaugaacugcgguaa

SEQ ID NO: 2647424 - RNA, 18 nt, Escherichia coli CFT073
ccccguguuuuugugcca

SEQ ID NO: 2647425 - RNA, 23 nt, Escherichia coli CFT073
ccccguguuuuugugccagagca

SEQ ID NO: 2647426 - RNA, 21 nt, Escherichia coli CFT073
ccccuaaacgcgccgcuuuuu

SEQ ID NO: 2647427 - RNA, 21 nt, Escherichia coli CFT073
ccccuagaacggggcuauacc

SEQ ID NO: 2647428 - RNA, 16 nt, Escherichia coli CFT073
ccccuauaucaacgcc

SEQ ID NO: 2647429 - RNA, 21 nt, Escherichia coli CFT073
ccccucagggcggcuauccca

SEQ ID NO: 2647430 - RNA, 12 nt, Escherichia coli CFT073
ccccuccagcga

SEQ ID NO: 2647431 - RNA, 17 nt, Escherichia coli CFT073
ccccucuuccggaacca

SEQ ID NO: 2647432 - RNA, 19 nt, Escherichia coli CFT073
ccccugaagcggcagagga

SEQ ID NO: 2647433 - RNA, 18 nt, Escherichia coli CFT073
ccccugagcauacauugc

SEQ ID NO: 2647434 - RNA, 15 nt, Escherichia coli CFT073
ccccugccccaucug

SEQ ID NO: 2647435 - RNA, 15 nt, Escherichia coli CFT073
ccccugggccaccuc

SEQ ID NO: 2647436 - RNA, 17 nt, Escherichia coli CFT073
ccccuuaccccgcccga

SEQ ID NO: 2647437 - RNA, 11 nt, Escherichia coli CFT073
ccccuucgcca

SEQ ID NO: 2647438 - RNA, 23 nt, Escherichia coli CFT073
ccccuucugccgcaauucgcccu

SEQ ID NO: 2647439 - RNA, 14 nt, Escherichia coli CFT073
cccgaacagcaacu

SEQ ID NO: 2647440 - RNA, 17 nt, Escherichia coli CFT073
cccgacacggcucgccu

SEQ ID NO: 2647441 - RNA, 17 nt, Escherichia coli CFT073
cccgaccacuucaugcc

SEQ ID NO: 2647442 - RNA, 20 nt, Escherichia coli CFT073
cccgaccgagcuggugauaa

SEQ ID NO: 2647443 - RNA, 21 nt, Escherichia coli CFT073
cccgacgacgucgcuguucau

SEQ ID NO: 2647444 - RNA, 16 nt, Escherichia coli CFT073
cccgagagaacugcug

SEQ ID NO: 2647445 - RNA, 11 nt, Escherichia coli CFT073
cccgagcgcca

SEQ ID NO: 2647446 - RNA, 14 nt, Escherichia coli CFT073
cccgauacgcuugc

SEQ ID NO: 2647447 - RNA, 15 nt, Escherichia coli CFT073
cccgauauaaccauc

SEQ ID NO: 2647448 - RNA, 13 nt, Escherichia coli CFT073
cccgaucuucuga

SEQ ID NO: 2647449 - RNA, 11 nt, Escherichia coli CFT073
cccgaugcugu

SEQ ID NO: 2647450 - RNA, 22 nt, Escherichia coli CFT073
cccgauugguucagacgccacu

SEQ ID NO: 2647451 - RNA, 14 nt, Escherichia coli CFT073
cccgcaaaccagac

SEQ ID NO: 2647452 - RNA, 20 nt, Escherichia coli CFT073
cccgcaaagagcagcaaccg

SEQ ID NO: 2647453 - RNA, 23 nt, Escherichia coli CFT073
cccgcaaggaucggugcugccag

SEQ ID NO: 2647454 - RNA, 22 nt, Escherichia coli CFT073
cccgcacaaggcuauccucuaa

SEQ ID NO: 2647455 - RNA, 17 nt, Escherichia coli CFT073
cccgcacaccucacacc

SEQ ID NO: 2647456 - RNA, 15 nt, Escherichia coli CFT073
cccgcaccaccgagu

SEQ ID NO: 2647457 - RNA, 18 nt, Escherichia coli CFT073
cccgcagccagcacugcc

SEQ ID NO: 2647458 - RNA, 15 nt, Escherichia coli CFT073
cccgcauaugcggcg

SEQ ID NO: 2647459 - RNA, 16 nt, Escherichia coli CFT073
cccgcauccgcugaug

SEQ ID NO: 2647460 - RNA, 16 nt, Escherichia coli CFT073
cccgccaaugccgcgc

SEQ ID NO: 2647461 - RNA, 13 nt, Escherichia coli CFT073
cccgccagaccag

SEQ ID NO: 2647462 - RNA, 15 nt, Escherichia coli CFT073
cccgccagcaccagc

SEQ ID NO: 2647463 - RNA, 12 nt, Escherichia coli CFT073
cccgccagcgcg

SEQ ID NO: 2647464 - RNA, 13 nt, Escherichia coli CFT073
cccgccgaccauc

SEQ ID NO: 2647465 - RNA, 15 nt, Escherichia coli CFT073
cccgccgccauccug

SEQ ID NO: 2647466 - RNA, 20 nt, Escherichia coli CFT073
cccgccgucuaugccggucu

SEQ ID NO: 2647467 - RNA, 15 nt, Escherichia coli CFT073
cccgccugauagacc

SEQ ID NO: 2647468 - RNA, 15 nt, Escherichia coli CFT073
cccgccuucacuucc

SEQ ID NO: 2647469 - RNA, 19 nt, Escherichia coli CFT073
cccgccuucacuuccggca

SEQ ID NO: 2647470 - RNA, 20 nt, Escherichia coli CFT073
cccgcgaacggggcugccag

SEQ ID NO: 2647471 - RNA, 13 nt, Escherichia coli CFT073
cccgcgauggcug

SEQ ID NO: 2647472 - RNA, 21 nt, Escherichia coli CFT073
cccgcgccaaccaugccgccc

SEQ ID NO: 2647473 - RNA, 23 nt, Escherichia coli CFT073
cccgcguaagcgggaucagguaa

SEQ ID NO: 2647474 - RNA, 14 nt, Escherichia coli CFT073
cccgcuaacugaua

SEQ ID NO: 2647475 - RNA, 22 nt, Escherichia coli CFT073
cccgcuaaugcgacccacgccc

SEQ ID NO: 2647476 - RNA, 13 nt, Escherichia coli CFT073
cccgcucacgcag

SEQ ID NO: 2647477 - RNA, 12 nt, Escherichia coli CFT073
cccgcuccagcu

SEQ ID NO: 2647478 - RNA, 13 nt, Escherichia coli CFT073
cccgcuccagcua

SEQ ID NO: 2647479 - RNA, 20 nt, Escherichia coli CFT073
cccgcucgaaguuuuccuca

SEQ ID NO: 2647480 - RNA, 20 nt, Escherichia coli CFT073
cccgcucguuuuggugcgua

SEQ ID NO: 2647481 - RNA, 15 nt, Escherichia coli CFT073
cccgcugcaacucuu

SEQ ID NO: 2647482 - RNA, 13 nt, Escherichia coli CFT073
cccgcugccagga

SEQ ID NO: 2647483 - RNA, 13 nt, Escherichia coli CFT073
cccgcuggcgacg

SEQ ID NO: 2647484 - RNA, 21 nt, Escherichia coli CFT073
cccgcuguuuguucaagcgca

SEQ ID NO: 2647485 - RNA, 12 nt, Escherichia coli CFT073
cccgcuucaucg

SEQ ID NO: 2647486 - RNA, 11 nt, Escherichia coli CFT073
cccgcuuccag

SEQ ID NO: 2647487 - RNA, 16 nt, Escherichia coli CFT073
cccgcuucgcccgcca

SEQ ID NO: 2647488 - RNA, 11 nt, Escherichia coli CFT073
cccgcuucggc

SEQ ID NO: 2647489 - RNA, 20 nt, Escherichia coli CFT073
cccgcuuuuuugucaccuuu

SEQ ID NO: 2647490 - RNA, 12 nt, Escherichia coli CFT073
cccggaagccac

SEQ ID NO: 2647491 - RNA, 16 nt, Escherichia coli CFT073
cccggaagccaccacg

SEQ ID NO: 2647492 - RNA, 18 nt, Escherichia coli CFT073
cccggacuagcgcuuuuu

SEQ ID NO: 2647493 - RNA, 16 nt, Escherichia coli CFT073
cccggagccauugccc

SEQ ID NO: 2647494 - RNA, 16 nt, Escherichia coli CFT073
cccggagcccuacaaa

SEQ ID NO: 2647495 - RNA, 12 nt, Escherichia coli CFT073
cccggaggaugc

SEQ ID NO: 2647496 - RNA, 22 nt, Escherichia coli CFT073
cccggauaccccagcuggcgcc

SEQ ID NO: 2647497 - RNA, 20 nt, Escherichia coli CFT073
cccggaugcgcguacuuacc

SEQ ID NO: 2647498 - RNA, 14 nt, Escherichia coli CFT073
cccggauggcaaca

SEQ ID NO: 2647499 - RNA, 18 nt, Escherichia coli CFT073
cccggauuuuucagcgcc

SEQ ID NO: 2647500 - RNA, 22 nt, Escherichia coli CFT073
cccggcaaaaaacacucuucaa

SEQ ID NO: 2647501 - RNA, 17 nt, Escherichia coli CFT073
cccggcaaccgcaacga

SEQ ID NO: 2647502 - RNA, 15 nt, Escherichia coli CFT073
cccggcaaucgccag

SEQ ID NO: 2647503 - RNA, 21 nt, Escherichia coli CFT073
cccggcaccaaucaccgccaa

SEQ ID NO: 2647504 - RNA, 12 nt, Escherichia coli CFT073
cccggcagagaa

SEQ ID NO: 2647505 - RNA, 20 nt, Escherichia coli CFT073
cccggcaucauuauuccccc

SEQ ID NO: 2647506 - RNA, 23 nt, Escherichia coli CFT073
cccggcaucauuauucccccggc

SEQ ID NO: 2647507 - RNA, 16 nt, Escherichia coli CFT073
cccggcauugacgaug

SEQ ID NO: 2647508 - RNA, 22 nt, Escherichia coli CFT073
cccggcauugacgaugccgucg

SEQ ID NO: 2647509 - RNA, 17 nt, Escherichia coli CFT073
cccggccacagcgccag

SEQ ID NO: 2647510 - RNA, 20 nt, Escherichia coli CFT073
cccggccaguccccucgccc

SEQ ID NO: 2647511 - RNA, 16 nt, Escherichia coli CFT073
cccggccuggcucguu

SEQ ID NO: 2647512 - RNA, 20 nt, Escherichia coli CFT073
cccggcguggugcagccgcc

SEQ ID NO: 2647513 - RNA, 21 nt, Escherichia coli CFT073
cccggcguggugcagccgcca

SEQ ID NO: 2647514 - RNA, 20 nt, Escherichia coli CFT073
cccggcguuuucagauccag

SEQ ID NO: 2647515 - RNA, 16 nt, Escherichia coli CFT073
cccggcuuccugcagc

SEQ ID NO: 2647516 - RNA, 19 nt, Escherichia coli CFT073
cccggcuuccugcagcgug

SEQ ID NO: 2647517 - RNA, 15 nt, Escherichia coli CFT073
cccggcuuugcaagc

SEQ ID NO: 2647518 - RNA, 19 nt, Escherichia coli CFT073
cccggcuuuuuuacgccug

SEQ ID NO: 2647519 - RNA, 21 nt, Escherichia coli CFT073
cccggguaaacaccaccgaaa

SEQ ID NO: 2647520 - RNA, 14 nt, Escherichia coli CFT073
cccgguaaacaaaa

SEQ ID NO: 2647521 - RNA, 23 nt, Escherichia coli CFT073
cccggucagcagcaccaccgccc

SEQ ID NO: 2647522 - RNA, 17 nt, Escherichia coli CFT073
cccggucguugucuggc

SEQ ID NO: 2647523 - RNA, 22 nt, Escherichia coli CFT073
cccggucguuuauuucgcgaau

SEQ ID NO: 2647524 - RNA, 18 nt, Escherichia coli CFT073
cccggucugauauucagg

SEQ ID NO: 2647525 - RNA, 23 nt, Escherichia coli CFT073
cccggugaauucaguaccagcac

SEQ ID NO: 2647526 - RNA, 13 nt, Escherichia coli CFT073
cccggugcgcaga

SEQ ID NO: 2647527 - RNA, 19 nt, Escherichia coli CFT073
cccgguucgagaaaaccga

SEQ ID NO: 2647528 - RNA, 15 nt, Escherichia coli CFT073
cccgguuucucuucu

SEQ ID NO: 2647529 - RNA, 17 nt, Escherichia coli CFT073
cccgguuucucuucugc

SEQ ID NO: 2647530 - RNA, 12 nt, Escherichia coli CFT073
cccguagcccau

SEQ ID NO: 2647531 - RNA, 15 nt, Escherichia coli CFT073
cccuuuuucacauca

SEQ ID NO: 2647532 - RNA, 14 nt, Escherichia coli CFT073
cccuuuuucauccc

SEQ ID NO: 2647533 - RNA, 19 nt, Escherichia coli CFT073
ccgaaacuugcgugauauu

SEQ ID NO: 2647534 - RNA, 16 nt, Escherichia coli CFT073
ccgaaacuugguuacg

SEQ ID NO: 2647535 - RNA, 22 nt, Escherichia coli CFT073
ccgaaagcacuguucgccgcag

SEQ ID NO: 2647536 - RNA, 16 nt, Escherichia coli CFT073
ccgaaaucaaggcgga

SEQ ID NO: 2647537 - RNA, 14 nt, Escherichia coli CFT073
ccgaaaucgccauu

SEQ ID NO: 2647538 - RNA, 14 nt, Escherichia coli CFT073
ccgaacaacagugc

SEQ ID NO: 2647539 - RNA, 13 nt, Escherichia coli CFT073
ccgaacagcaacu

SEQ ID NO: 2647540 - RNA, 15 nt, Escherichia coli CFT073
ccgaacagucgcuga

SEQ ID NO: 2647541 - RNA, 19 nt, Escherichia coli CFT073
ccgaacagugccagacaaa

SEQ ID NO: 2647542 - RNA, 23 nt, Escherichia coli CFT073
ccgaacagugccagacaaaccac

SEQ ID NO: 2647543 - RNA, 19 nt, Escherichia coli CFT073
ccgaaccagugcuccaccu

SEQ ID NO: 2647544 - RNA, 19 nt, Escherichia coli CFT073
ccgaacgcugacaaacugc

SEQ ID NO: 2647545 - RNA, 19 nt, Escherichia coli CFT073
ccgaacucgaccugcaacu

SEQ ID NO: 2647546 - RNA, 21 nt, Escherichia coli CFT073
ccgaacuucgccagcgugacu

SEQ ID NO: 2647547 - RNA, 14 nt, Escherichia coli CFT073
ccgaagacaaacau

SEQ ID NO: 2647548 - RNA, 16 nt, Escherichia coli CFT073
ccgaagaguaaccaaa

SEQ ID NO: 2647549 - RNA, 15 nt, Escherichia coli CFT073
ccgaagaucaccacc

SEQ ID NO: 2647550 - RNA, 20 nt, Escherichia coli CFT073
ccgaagccguuggucaucau

SEQ ID NO: 2647551 - RNA, 20 nt, Escherichia coli CFT073
ccgaagccuuuaccgcgcuc

SEQ ID NO: 2647552 - RNA, 9 nt, Escherichia coli CFT073
ccgaagcgc

SEQ ID NO: 2647553 - RNA, 12 nt, Escherichia coli CFT073
ccgaagcgccuu

SEQ ID NO: 2647554 - RNA, 22 nt, Escherichia coli CFT073
ccgaagguagccuuuuuuauuu

SEQ ID NO: 2647555 - RNA, 21 nt, Escherichia coli CFT073
ccgaagucaaacugauauugu

SEQ ID NO: 2647556 - RNA, 19 nt, Escherichia coli CFT073
ccgaagugcgcacagcuac

SEQ ID NO: 2647557 - RNA, 15 nt, Escherichia coli CFT073
ccgaauaacgcgcag

SEQ ID NO: 2647558 - RNA, 23 nt, Escherichia coli CFT073
ccgaauaaggcguuugcgucgca

SEQ ID NO: 2647559 - RNA, 18 nt, Escherichia coli CFT073
ccgaauuaaacaacgcca

SEQ ID NO: 2647560 - RNA, 22 nt, Escherichia coli CFT073
ccgaauuaaacaacgccagucc

SEQ ID NO: 2647561 - RNA, 13 nt, Escherichia coli CFT073
ccgaauucugcgg

SEQ ID NO: 2647562 - RNA, 19 nt, Escherichia coli CFT073
ccgacaauaaacgcgcagg

SEQ ID NO: 2647563 - RNA, 13 nt, Escherichia coli CFT073
ccgacaauuccgc

SEQ ID NO: 2647564 - RNA, 12 nt, Escherichia coli CFT073
ccgacacaaugu

SEQ ID NO: 2647565 - RNA, 16 nt, Escherichia coli CFT073
ccgacaccggcagaga

SEQ ID NO: 2647566 - RNA, 18 nt, Escherichia coli CFT073
ccgacaccggcagagauu

SEQ ID NO: 2647567 - RNA, 23 nt, Escherichia coli CFT073
ccgacauaggccagccgccgcuc

SEQ ID NO: 2647568 - RNA, 19 nt, Escherichia coli CFT073
ccgacaucgacauacuuga

SEQ ID NO: 2647569 - RNA, 19 nt, Escherichia coli CFT073
ccgacauuaagacgcagau

SEQ ID NO: 2647570 - RNA, 17 nt, Escherichia coli CFT073
ccgacauuaucaccgac

SEQ ID NO: 2647571 - RNA, 13 nt, Escherichia coli CFT073
ccgaccaacgcag

SEQ ID NO: 2647572 - RNA, 13 nt, Escherichia coli CFT073
ccgaccacuucca

SEQ ID NO: 2647573 - RNA, 16 nt, Escherichia coli CFT073
ccgaccagaccggcaa

SEQ ID NO: 2647574 - RNA, 18 nt, Escherichia coli CFT073
ccgaccauauagcgcaca

SEQ ID NO: 2647575 - RNA, 15 nt, Escherichia coli CFT073
ccgaccaucgccagc

SEQ ID NO: 2647576 - RNA, 16 nt, Escherichia coli CFT073
ccgaccaucgccagcu

SEQ ID NO: 2647577 - RNA, 18 nt, Escherichia coli CFT073
ccgacgaggcgcuggcgc

SEQ ID NO: 2647578 - RNA, 17 nt, Escherichia coli CFT073
ccgacgaucaacagaau

SEQ ID NO: 2647579 - RNA, 24 nt, Escherichia coli CFT073
ccgacgauguuagcggcgacaaua

SEQ ID NO: 2647580 - RNA, 18 nt, Escherichia coli CFT073
ccgacgcgaagcacacau

SEQ ID NO: 2647581 - RNA, 22 nt, Escherichia coli CFT073
ccgacgcuccugaucaagcugg

SEQ ID NO: 2647582 - RNA, 21 nt, Escherichia coli CFT073
ccgacguugcguugccgccaa

SEQ ID NO: 2647583 - RNA, 19 nt, Escherichia coli CFT073
ccgacucacuugcagucgg

SEQ ID NO: 2647584 - RNA, 20 nt, Escherichia coli CFT073
ccgacugacgcucugcuuua

SEQ ID NO: 2647585 - RNA, 12 nt, Escherichia coli CFT073
ccgacugccugc

SEQ ID NO: 2647586 - RNA, 14 nt, Escherichia coli CFT073
ccgacugcgccaau

SEQ ID NO: 2647587 - RNA, 17 nt, Escherichia coli CFT073
ccgacugcgccaauacc

SEQ ID NO: 2647588 - RNA, 19 nt, Escherichia coli CFT073
ccgacuggcaucuguuauc

SEQ ID NO: 2647589 - RNA, 17 nt, Escherichia coli CFT073
ccgacuucagccagugc

SEQ ID NO: 2647590 - RNA, 18 nt, Escherichia coli CFT073
ccgacuucaguggaauca

SEQ ID NO: 2647591 - RNA, 15 nt, Escherichia coli CFT073
ccgacuuucuuuuug

SEQ ID NO: 2647592 - RNA, 13 nt, Escherichia coli CFT073
ccgagaaugacga

SEQ ID NO: 2647593 - RNA, 19 nt, Escherichia coli CFT073
ccgagaauuuccagaugug

SEQ ID NO: 2647594 - RNA, 15 nt, Escherichia coli CFT073
ccgagagaacugcug

SEQ ID NO: 2647595 - RNA, 17 nt, Escherichia coli CFT073
ccgagaucaacagcaua

SEQ ID NO: 2647596 - RNA, 19 nt, Escherichia coli CFT073
ccgagaucuuuaauacacg

SEQ ID NO: 2647597 - RNA, 11 nt, Escherichia coli CFT073
ccgagcaaacc

SEQ ID NO: 2647598 - RNA, 11 nt, Escherichia coli CFT073
ccgagcagcca

SEQ ID NO: 2647599 - RNA, 13 nt, Escherichia coli CFT073
ccgagcagccacu

SEQ ID NO: 2647600 - RNA, 14 nt, Escherichia coli CFT073
ccgagcagccacug

SEQ ID NO: 2647601 - RNA, 13 nt, Escherichia coli CFT073
ccgagcaggaugc

SEQ ID NO: 2647602 - RNA, 16 nt, Escherichia coli CFT073
ccgagccaaacgccca

SEQ ID NO: 2647603 - RNA, 22 nt, Escherichia coli CFT073
ccgagccaaacucauccaccac

SEQ ID NO: 2647604 - RNA, 22 nt, Escherichia coli CFT073
ccgagcgaauaaaccacaccgc

SEQ ID NO: 2647605 - RNA, 15 nt, Escherichia coli CFT073
ccgagcgcuaccauc

SEQ ID NO: 2647606 - RNA, 17 nt, Escherichia coli CFT073
ccgagcggccaaaggga

SEQ ID NO: 2647607 - RNA, 20 nt, Escherichia coli CFT073
ccgagcguucaaaacggcug

SEQ ID NO: 2647608 - RNA, 18 nt, Escherichia coli CFT073
ccgaggauacagccgaag

SEQ ID NO: 2647609 - RNA, 17 nt, Escherichia coli CFT073
ccgagggaagcaauaag

SEQ ID NO: 2647610 - RNA, 17 nt, Escherichia coli CFT073
ccgagguuaauauuuuc

SEQ ID NO: 2647611 - RNA, 19 nt, Escherichia coli CFT073
ccgaguaaaaaaacaucau

SEQ ID NO: 2647612 - RNA, 16 nt, Escherichia coli CFT073
ccgaguagccagcugc

SEQ ID NO: 2647613 - RNA, 23 nt, Escherichia coli CFT073
ccgagucgccuuuuuccaucguc

SEQ ID NO: 2647614 - RNA, 14 nt, Escherichia coli CFT073
ccgauaaccgcaaa

SEQ ID NO: 2647615 - RNA, 17 nt, Escherichia coli CFT073
ccgauaaccgcaaaacc

SEQ ID NO: 2647616 - RNA, 17 nt, Escherichia coli CFT073
ccgauaauuccucccgu

SEQ ID NO: 2647617 - RNA, 14 nt, Escherichia coli CFT073
ccgauacgaucauc

SEQ ID NO: 2647618 - RNA, 19 nt, Escherichia coli CFT073
ccgauacgaucaucuggcg

SEQ ID NO: 2647619 - RNA, 16 nt, Escherichia coli CFT073
ccgauacgcauaaaca

SEQ ID NO: 2647620 - RNA, 18 nt, Escherichia coli CFT073
ccgauauagaccaucggc

SEQ ID NO: 2647621 - RNA, 20 nt, Escherichia coli CFT073
ccgauaucuuuccggcagaa

SEQ ID NO: 2647622 - RNA, 16 nt, Escherichia coli CFT073
ccgauauuugccgcga

SEQ ID NO: 2647623 - RNA, 13 nt, Escherichia coli CFT073
ccgaucaccacaa

SEQ ID NO: 2647624 - RNA, 15 nt, Escherichia coli CFT073
ccgaucaguaccagc

SEQ ID NO: 2647625 - RNA, 20 nt, Escherichia coli CFT073
ccgaucaucaaaaaacacga

SEQ ID NO: 2647626 - RNA, 14 nt, Escherichia coli CFT073
ccgaucaucaucca

SEQ ID NO: 2647627 - RNA, 16 nt, Escherichia coli CFT073
ccgauccacugaaaca

SEQ ID NO: 2647628 - RNA, 20 nt, Escherichia coli CFT073
ccgauccccggauucauacu

SEQ ID NO: 2647629 - RNA, 15 nt, Escherichia coli CFT073
ccgaucccugcaaca

SEQ ID NO: 2647630 - RNA, 13 nt, Escherichia coli CFT073
ccgauccggcacc

SEQ ID NO: 2647631 - RNA, 15 nt, Escherichia coli CFT073
ccgauccuggacgca

SEQ ID NO: 2647632 - RNA, 18 nt, Escherichia coli CFT073
ccgauccuggacgcagaa

SEQ ID NO: 2647633 - RNA, 13 nt, Escherichia coli CFT073
ccgaucgccagca

SEQ ID NO: 2647634 - RNA, 20 nt, Escherichia coli CFT073
ccgaucgccagcagggcaaa

SEQ ID NO: 2647635 - RNA, 18 nt, Escherichia coli CFT073
ccgaugacagaaucagca

SEQ ID NO: 2647636 - RNA, 14 nt, Escherichia coli CFT073
ccgaugaucaaaaa

SEQ ID NO: 2647637 - RNA, 18 nt, Escherichia coli CFT073
ccgaugaucgccaucagc

SEQ ID NO: 2647638 - RNA, 14 nt, Escherichia coli CFT073
ccgaugauucccag

SEQ ID NO: 2647639 - RNA, 16 nt, Escherichia coli CFT073
ccgaugcaaaaaauga

SEQ ID NO: 2647640 - RNA, 13 nt, Escherichia coli CFT073
ccgccagauaguu

SEQ ID NO: 2647641 - RNA, 16 nt, Escherichia coli CFT073
ccgccagaugcggcgu

SEQ ID NO: 2647642 - RNA, 13 nt, Escherichia coli CFT073
ccgccagauugcu

SEQ ID NO: 2647643 - RNA, 13 nt, Escherichia coli CFT073
ccgccagcacagc

SEQ ID NO: 2647644 - RNA, 23 nt, Escherichia coli CFT073
ccgccagcacagccagccuccaa

SEQ ID NO: 2647645 - RNA, 16 nt, Escherichia coli CFT073
ccgccagcaggaacga

SEQ ID NO: 2647646 - RNA, 15 nt, Escherichia coli CFT073
ccgccagcauuguca

SEQ ID NO: 2647647 - RNA, 13 nt, Escherichia coli CFT073
ccgccagccacag

SEQ ID NO: 2647648 - RNA, 14 nt, Escherichia coli CFT073
ccgccagcgccaaa

SEQ ID NO: 2647649 - RNA, 18 nt, Escherichia coli CFT073
ccgccagcgccaaagcca

SEQ ID NO: 2647650 - RNA, 22 nt, Escherichia coli CFT073
ccgccagcgccaucgguagcac

SEQ ID NO: 2647651 - RNA, 15 nt, Escherichia coli CFT073
ccgccagcgccaucu

SEQ ID NO: 2647652 - RNA, 14 nt, Escherichia coli CFT073
ccgccagcgcggag

SEQ ID NO: 2647653 - RNA, 19 nt, Escherichia coli CFT073
ccgccagcuucgcuuccca

SEQ ID NO: 2647654 - RNA, 19 nt, Escherichia coli CFT073
ccgccaggcaaauucuguu

SEQ ID NO: 2647655 - RNA, 13 nt, Escherichia coli CFT073
ccgccagugcaua

SEQ ID NO: 2647656 - RNA, 22 nt, Escherichia coli CFT073
ccgccagugccaccaguaacgc

SEQ ID NO: 2647657 - RNA, 23 nt, Escherichia coli CFT073
ccgccagugugaauaauugugca

SEQ ID NO: 2647658 - RNA, 18 nt, Escherichia coli CFT073
ccgccaguuccaggcaaa

SEQ ID NO: 2647659 - RNA, 19 nt, Escherichia coli CFT073
ccgccaguucccccugcca

SEQ ID NO: 2647660 - RNA, 22 nt, Escherichia coli CFT073
ccgccaguucccccugccagac

SEQ ID NO: 2647661 - RNA, 11 nt, Escherichia coli CFT073
ccgccaucauc

SEQ ID NO: 2647662 - RNA, 12 nt, Escherichia coli CFT073
ccgccaucaucg

SEQ ID NO: 2647663 - RNA, 12 nt, Escherichia coli CFT073
ccgccauccagg

SEQ ID NO: 2647664 - RNA, 13 nt, Escherichia coli CFT073
ccgccaucgccca

SEQ ID NO: 2647665 - RNA, 13 nt, Escherichia coli CFT073
ccgccaucgcguu

SEQ ID NO: 2647666 - RNA, 22 nt, Escherichia coli CFT073
ccgccaucguugagcaucugca

SEQ ID NO: 2647667 - RNA, 15 nt, Escherichia coli CFT073
ccgccaugccgacgg

SEQ ID NO: 2647668 - RNA, 21 nt, Escherichia coli CFT073
ccgccaugccgacggguucuu

SEQ ID NO: 2647669 - RNA, 20 nt, Escherichia coli CFT073
ccgccauuaaacgcaguaaa

SEQ ID NO: 2647670 - RNA, 18 nt, Escherichia coli CFT073
ccgccauuccagccagaa

SEQ ID NO: 2647671 - RNA, 20 nt, Escherichia coli CFT073
ccgcccagaccgugcgcagc

SEQ ID NO: 2647672 - RNA, 22 nt, Escherichia coli CFT073
ccgcccagucccguacccagca

SEQ ID NO: 2647673 - RNA, 12 nt, Escherichia coli CFT073
ccgcccagugcc

SEQ ID NO: 2647674 - RNA, 13 nt, Escherichia coli CFT073
ccgcccaucgcga

SEQ ID NO: 2647675 - RNA, 17 nt, Escherichia coli CFT073
ccgccccaaagggcggc

SEQ ID NO: 2647676 - RNA, 15 nt, Escherichia coli CFT073
ccgcccccgccagcg

SEQ ID NO: 2647677 - RNA, 21 nt, Escherichia coli CFT073
ccgccccgcguuucaccacca

SEQ ID NO: 2647678 - RNA, 13 nt, Escherichia coli CFT073
ccgccccggcaau

SEQ ID NO: 2647679 - RNA, 18 nt, Escherichia coli CFT073
ccgccccggguuuccugg

SEQ ID NO: 2647680 - RNA, 13 nt, Escherichia coli CFT073
ccgcccugcugua

SEQ ID NO: 2647681 - RNA, 20 nt, Escherichia coli CFT073
ccgccgaagucccuacugcu

SEQ ID NO: 2647682 - RNA, 16 nt, Escherichia coli CFT073
ccgccgacaucugcca

SEQ ID NO: 2647683 - RNA, 14 nt, Escherichia coli CFT073
ccgccgacgcgaag

SEQ ID NO: 2647684 - RNA, 22 nt, Escherichia coli CFT073
ccgccgagaaauaucagcagca

SEQ ID NO: 2647685 - RNA, 23 nt, Escherichia coli CFT073
ccgccgagaaauaucagcagcac

SEQ ID NO: 2647686 - RNA, 18 nt, Escherichia coli CFT073
ccgccgauggugcagcag

SEQ ID NO: 2647687 - RNA, 13 nt, Escherichia coli CFT073
ccgccgcaaccgu

SEQ ID NO: 2647688 - RNA, 20 nt, Escherichia coli CFT073
ccgccgcacaauacauagaa

SEQ ID NO: 2647689 - RNA, 18 nt, Escherichia coli CFT073
ccgccgccaaucgcccgg

SEQ ID NO: 2647690 - RNA, 12 nt, Escherichia coli CFT073
ccgccgccagau

SEQ ID NO: 2647691 - RNA, 13 nt, Escherichia coli CFT073
ccgccgccagggu

SEQ ID NO: 2647692 - RNA, 13 nt, Escherichia coli CFT073
ccgccgccauccu

SEQ ID NO: 2647693 - RNA, 20 nt, Escherichia coli CFT073
ccgccgccauuugggcggcu

SEQ ID NO: 2647694 - RNA, 19 nt, Escherichia coli CFT073
ccgccgcucucuucguggc

SEQ ID NO: 2647695 - RNA, 19 nt, Escherichia coli CFT073
ccgccggaaagcaguaccg

SEQ ID NO: 2647696 - RNA, 19 nt, Escherichia coli CFT073
ccgccggaaucaacggcaa

SEQ ID NO: 2647697 - RNA, 22 nt, Escherichia coli CFT073
ccgccggaucgaauaacuccgc

SEQ ID NO: 2647698 - RNA, 23 nt, Escherichia coli CFT073
ccgccggaugcggcgugaacgcc

SEQ ID NO: 2647699 - RNA, 19 nt, Escherichia coli CFT073
ccgccggggucaaaccugg

SEQ ID NO: 2647700 - RNA, 14 nt, Escherichia coli CFT073
ccgccggugcagua

SEQ ID NO: 2647701 - RNA, 16 nt, Escherichia coli CFT073
ccgccuaccgccagua

SEQ ID NO: 2647702 - RNA, 15 nt, Escherichia coli CFT073
ccgccucacgccagc

SEQ ID NO: 2647703 - RNA, 15 nt, Escherichia coli CFT073
ccgccucagccagaa

SEQ ID NO: 2647704 - RNA, 20 nt, Escherichia coli CFT073
ccgccucugccgcaauggcc

SEQ ID NO: 2647705 - RNA, 21 nt, Escherichia coli CFT073
ccgccugacggaaaucaucca

SEQ ID NO: 2647706 - RNA, 18 nt, Escherichia coli CFT073
ccgccugcauaaaggcaa

SEQ ID NO: 2647707 - RNA, 23 nt, Escherichia coli CFT073
ccgccugcauaaaggcaaaacag

SEQ ID NO: 2647708 - RNA, 12 nt, Escherichia coli CFT073
ccgccugcgcca

SEQ ID NO: 2647709 - RNA, 12 nt, Escherichia coli CFT073
ccgccugcugau

SEQ ID NO: 2647710 - RNA, 17 nt, Escherichia coli CFT073
ccgccuggugcaggcgu

SEQ ID NO: 2647711 - RNA, 13 nt, Escherichia coli CFT073
ccgccuguugccc

SEQ ID NO: 2647712 - RNA, 15 nt, Escherichia coli CFT073
ccgccuguugcccuu

SEQ ID NO: 2647713 - RNA, 16 nt, Escherichia coli CFT073
ccgccuuucacgccgg

SEQ ID NO: 2647714 - RNA, 22 nt, Escherichia coli CFT073
ccgccuuuugccuuacgcaccg

SEQ ID NO: 2647715 - RNA, 18 nt, Escherichia coli CFT073
ccgcgaaacugcguggcg

SEQ ID NO: 2647716 - RNA, 13 nt, Escherichia coli CFT073
ccgcgaaccagac

SEQ ID NO: 2647717 - RNA, 15 nt, Escherichia coli CFT073
ccgcgaccugaucca

SEQ ID NO: 2647718 - RNA, 20 nt, Escherichia coli CFT073
ccgcgacgacgacaggcaag

SEQ ID NO: 2647719 - RNA, 16 nt, Escherichia coli CFT073
ccgcgacggaagcuua

SEQ ID NO: 2647720 - RNA, 14 nt, Escherichia coli CFT073
ccgcgacugcggua

SEQ ID NO: 2647721 - RNA, 23 nt, Escherichia coli CFT073
ccgcgagaacugaaccaauauuc

SEQ ID NO: 2647722 - RNA, 14 nt, Escherichia coli CFT073
ccgcgagugcgggc

SEQ ID NO: 2647723 - RNA, 18 nt, Escherichia coli CFT073
ccgcgauaaaaauccugu

SEQ ID NO: 2647724 - RNA, 16 nt, Escherichia coli CFT073
ccgcgauaacgcccca

SEQ ID NO: 2647725 - RNA, 21 nt, Escherichia coli CFT073
ccgcgauagagagcagucagg

SEQ ID NO: 2647726 - RNA, 20 nt, Escherichia coli CFT073
ccgcgauccagcgcaauacc

SEQ ID NO: 2647727 - RNA, 17 nt, Escherichia coli CFT073
ccgcgaugaccaaaaac

SEQ ID NO: 2647728 - RNA, 16 nt, Escherichia coli CFT073
ccgcgauuuguuucaa

SEQ ID NO: 2647729 - RNA, 12 nt, Escherichia coli CFT073
ccgcgcaaaucc

SEQ ID NO: 2647730 - RNA, 21 nt, Escherichia coli CFT073
ccgcgcagcgaaacucgcuga

SEQ ID NO: 2647731 - RNA, 21 nt, Escherichia coli CFT073
ccgcgcaguaccacuucaucc

SEQ ID NO: 2647732 - RNA, 13 nt, Escherichia coli CFT073
ccgcgcccgcuaa

SEQ ID NO: 2647733 - RNA, 15 nt, Escherichia coli CFT073
ccgcgccgcagccgg

SEQ ID NO: 2647734 - RNA, 16 nt, Escherichia coli CFT073
ccgcgccgcgcggagc

SEQ ID NO: 2647735 - RNA, 16 nt, Escherichia coli CFT073
ccgcgccgcugagaaa

SEQ ID NO: 2647736 - RNA, 22 nt, Escherichia coli CFT073
ccgcgccggaaaccagcggcac

SEQ ID NO: 2647737 - RNA, 20 nt, Escherichia coli CFT073
ccgcgcgcaccguccagcgu

SEQ ID NO: 2647738 - RNA, 15 nt, Escherichia coli CFT073
ccgcgcggguaaaac

SEQ ID NO: 2647739 - RNA, 23 nt, Escherichia coli CFT073
ccgcgcggguggugcgcaccagg

SEQ ID NO: 2647740 - RNA, 19 nt, Escherichia coli CFT073
ccgcgcgugccggaacgcc

SEQ ID NO: 2647741 - RNA, 16 nt, Escherichia coli CFT073
ccgcgcuauuuuccug

SEQ ID NO: 2647742 - RNA, 15 nt, Escherichia coli CFT073
ccgcgcuccaucaug

SEQ ID NO: 2647743 - RNA, 19 nt, Escherichia coli CFT073
ccgcgcuuucuggcgcaga

SEQ ID NO: 2647744 - RNA, 16 nt, Escherichia coli CFT073
ccgcgcuuucuucuuc

SEQ ID NO: 2647745 - RNA, 15 nt, Escherichia coli CFT073
ccgcggaugauuccg

SEQ ID NO: 2647746 - RNA, 14 nt, Escherichia coli CFT073
ccgcgguaucgccg

SEQ ID NO: 2647747 - RNA, 15 nt, Escherichia coli CFT073
ccgcgguucccagcg

SEQ ID NO: 2647748 - RNA, 21 nt, Escherichia coli CFT073
ccgcguaaacgugcggcugug

SEQ ID NO: 2647749 - RNA, 15 nt, Escherichia coli CFT073
ccggaugccucuccu

SEQ ID NO: 2647750 - RNA, 20 nt, Escherichia coli CFT073
ccggaugcgaacauccggca

SEQ ID NO: 2647751 - RNA, 16 nt, Escherichia coli CFT073
ccggaugcgacgcaaa

SEQ ID NO: 2647752 - RNA, 15 nt, Escherichia coli CFT073
ccggaugcgacgcac

SEQ ID NO: 2647753 - RNA, 22 nt, Escherichia coli CFT073
ccggaugcgacgcuggccgcgu

SEQ ID NO: 2647754 - RNA, 21 nt, Escherichia coli CFT073
ccggaugcgaugcugacacau

SEQ ID NO: 2647755 - RNA, 19 nt, Escherichia coli CFT073
ccggaugcgaugcuggcgc

SEQ ID NO: 2647756 - RNA, 17 nt, Escherichia coli CFT073
ccggaugcgcuucuuua

SEQ ID NO: 2647757 - RNA, 17 nt, Escherichia coli CFT073
ccggaugcggcaggcgu

SEQ ID NO: 2647758 - RNA, 23 nt, Escherichia coli CFT073
ccggaugcggcauaaacgccuua

SEQ ID NO: 2647759 - RNA, 22 nt, Escherichia coli CFT073
ccggaugcggcgcaccagcauc

SEQ ID NO: 2647760 - RNA, 14 nt, Escherichia coli CFT073
ccggaugcggcgcg

SEQ ID NO: 2647761 - RNA, 23 nt, Escherichia coli CFT073
ccggaugcggcguaaacgccuua

SEQ ID NO: 2647762 - RNA, 18 nt, Escherichia coli CFT073
ccggaugcggcgugaacg

SEQ ID NO: 2647763 - RNA, 23 nt, Escherichia coli CFT073
ccggaugcggcgugaacgccuua

SEQ ID NO: 2647764 - RNA, 22 nt, Escherichia coli CFT073
ccggaugcggcguuaacgccuu

SEQ ID NO: 2647765 - RNA, 23 nt, Escherichia coli CFT073
ccggaugcggcguuaacgccuua

SEQ ID NO: 2647766 - RNA, 19 nt, Escherichia coli CFT073
ccggauggcacaugacuuc

SEQ ID NO: 2647767 - RNA, 17 nt, Escherichia coli CFT073
ccggauuacgcaucagu

SEQ ID NO: 2647768 - RNA, 16 nt, Escherichia coli CFT073
ccggauuauccagcca

SEQ ID NO: 2647769 - RNA, 18 nt, Escherichia coli CFT073
ccggauucacgccaacca

SEQ ID NO: 2647770 - RNA, 17 nt, Escherichia coli CFT073
ccggauuguauugagau

SEQ ID NO: 2647771 - RNA, 15 nt, Escherichia coli CFT073
ccggauuucauaucc

SEQ ID NO: 2647772 - RNA, 19 nt, Escherichia coli CFT073
ccggauuuuucagcgccau

SEQ ID NO: 2647773 - RNA, 14 nt, Escherichia coli CFT073
ccggcaaacucuac

SEQ ID NO: 2647774 - RNA, 14 nt, Escherichia coli CFT073
ccggcaaauaacag

SEQ ID NO: 2647775 - RNA, 18 nt, Escherichia coli CFT073
ccggcaacaacagggcaa

SEQ ID NO: 2647776 - RNA, 14 nt, Escherichia coli CFT073
ccggcaaccacacc

SEQ ID NO: 2647777 - RNA, 22 nt, Escherichia coli CFT073
ccggcaaccggaucgucaauaa

SEQ ID NO: 2647778 - RNA, 21 nt, Escherichia coli CFT073
ccggcaacgaccgcgagcaaa

SEQ ID NO: 2647779 - RNA, 19 nt, Escherichia coli CFT073
ccggcaacguugccaguac

SEQ ID NO: 2647780 - RNA, 23 nt, Escherichia coli CFT073
ccggcaacguugccaguaccauc

SEQ ID NO: 2647781 - RNA, 15 nt, Escherichia coli CFT073
ccggcaauaaaacag

SEQ ID NO: 2647782 - RNA, 16 nt, Escherichia coli CFT073
ccggcaauaaaacagg

SEQ ID NO: 2647783 - RNA, 19 nt, Escherichia coli CFT073
ccggcaauaaaacagggcg

SEQ ID NO: 2647784 - RNA, 14 nt, Escherichia coli CFT073
ccggcaauaaacag

SEQ ID NO: 2647785 - RNA, 17 nt, Escherichia coli CFT073
ccggcaaucaacagaua

SEQ ID NO: 2647786 - RNA, 20 nt, Escherichia coli CFT073
ccggcaaucaacagauaaau

SEQ ID NO: 2647787 - RNA, 20 nt, Escherichia coli CFT073
ccggcaaucugcuggcaaac

SEQ ID NO: 2647788 - RNA, 16 nt, Escherichia coli CFT073
ccggcaaugagcgccg

SEQ ID NO: 2647789 - RNA, 15 nt, Escherichia coli CFT073
ccggcaaugcgcacg

SEQ ID NO: 2647790 - RNA, 16 nt, Escherichia coli CFT073
ccggcaaugcgccgaa

SEQ ID NO: 2647791 - RNA, 14 nt, Escherichia coli CFT073
ccggcaaugggcaa

SEQ ID NO: 2647792 - RNA, 11 nt, Escherichia coli CFT073
ccggcaauggu

SEQ ID NO: 2647793 - RNA, 19 nt, Escherichia coli CFT073
ccggcaauggugugauauu

SEQ ID NO: 2647794 - RNA, 13 nt, Escherichia coli CFT073
ccggcacauuuca

SEQ ID NO: 2647795 - RNA, 21 nt, Escherichia coli CFT073
ccggcaccagcgcugcggccu

SEQ ID NO: 2647796 - RNA, 15 nt, Escherichia coli CFT073
ccggcaccauuggaa

SEQ ID NO: 2647797 - RNA, 24 nt, Escherichia coli CFT073
ccggcacgaauugcuuccaguaac

SEQ ID NO: 2647798 - RNA, 16 nt, Escherichia coli CFT073
ccggcacgucgcguua

SEQ ID NO: 2647799 - RNA, 18 nt, Escherichia coli CFT073
ccggcacguuuugcggau

SEQ ID NO: 2647800 - RNA, 15 nt, Escherichia coli CFT073
ccggcacuggaaaac

SEQ ID NO: 2647801 - RNA, 15 nt, Escherichia coli CFT073
ccggcacuuuuucau

SEQ ID NO: 2647802 - RNA, 14 nt, Escherichia coli CFT073
ccggcagaaaccag

SEQ ID NO: 2647803 - RNA, 20 nt, Escherichia coli CFT073
ccggcagaagcagucguccc

SEQ ID NO: 2647804 - RNA, 11 nt, Escherichia coli CFT073
ccggcagagaa

SEQ ID NO: 2647805 - RNA, 21 nt, Escherichia coli CFT073
ccggcagagaggacucugccg

SEQ ID NO: 2647806 - RNA, 22 nt, Escherichia coli CFT073
ccggcagcaaauucaccgccug

SEQ ID NO: 2647807 - RNA, 21 nt, Escherichia coli CFT073
ccggcagcgaaccgucgagau

SEQ ID NO: 2647808 - RNA, 23 nt, Escherichia coli CFT073
ccggcaggaauaucgaucgccgc

SEQ ID NO: 2647809 - RNA, 23 nt, Escherichia coli CFT073
ccggcagguuuaaccaucaggca

SEQ ID NO: 2647810 - RNA, 18 nt, Escherichia coli CFT073
ccggcaguauuaccagac

SEQ ID NO: 2647811 - RNA, 23 nt, Escherichia coli CFT073
ccggcauaaacaaagcgcacuau

SEQ ID NO: 2647812 - RNA, 23 nt, Escherichia coli CFT073
ccggcauaauaagcccggccugg

SEQ ID NO: 2647813 - RNA, 15 nt, Escherichia coli CFT073
ccggcauacuuugau

SEQ ID NO: 2647814 - RNA, 15 nt, Escherichia coli CFT073
ccggcauauuaacca

SEQ ID NO: 2647815 - RNA, 22 nt, Escherichia coli CFT073
ccggcaucauuauucccccggc

SEQ ID NO: 2647816 - RNA, 16 nt, Escherichia coli CFT073
ccggcauccagccaaa

SEQ ID NO: 2647817 - RNA, 19 nt, Escherichia coli CFT073
ccggcauccagccaaacau

SEQ ID NO: 2647818 - RNA, 15 nt, Escherichia coli CFT073
ccggcaucgccagcg

SEQ ID NO: 2647819 - RNA, 15 nt, Escherichia coli CFT073
ccggcaucuuguuca

SEQ ID NO: 2647820 - RNA, 15 nt, Escherichia coli CFT073
ccggcaugaacaaaa

SEQ ID NO: 2647821 - RNA, 17 nt, Escherichia coli CFT073
ccggcauuguuggaccg

SEQ ID NO: 2647822 - RNA, 20 nt, Escherichia coli CFT073
ccggcauuucuugugcaaug

SEQ ID NO: 2647823 - RNA, 18 nt, Escherichia coli CFT073
ccggcauuugagcaggau

SEQ ID NO: 2647824 - RNA, 11 nt, Escherichia coli CFT073
ccggccacagc

SEQ ID NO: 2647825 - RNA, 16 nt, Escherichia coli CFT073
ccggccagcgccacca

SEQ ID NO: 2647826 - RNA, 22 nt, Escherichia coli CFT073
ccggccauacccgccagugccg

SEQ ID NO: 2647827 - RNA, 12 nt, Escherichia coli CFT073
ccggccaucagu

SEQ ID NO: 2647828 - RNA, 16 nt, Escherichia coli CFT073
ccggccauuuucauuu

SEQ ID NO: 2647829 - RNA, 23 nt, Escherichia coli CFT073
ccggccugauauaucaccuucca

SEQ ID NO: 2647830 - RNA, 23 nt, Escherichia coli CFT073
ccggcgacaggaaccaaaugccg

SEQ ID NO: 2647831 - RNA, 18 nt, Escherichia coli CFT073
ccggcgauaucccaggca

SEQ ID NO: 2647832 - RNA, 22 nt, Escherichia coli CFT073
ccggcgcaaaaaacuaucccau

SEQ ID NO: 2647833 - RNA, 16 nt, Escherichia coli CFT073
ccggcgcacuggcgcu

SEQ ID NO: 2647834 - RNA, 16 nt, Escherichia coli CFT073
ccggcgcagcgcgcga

SEQ ID NO: 2647835 - RNA, 14 nt, Escherichia coli CFT073
ccggcggcacagcc

SEQ ID NO: 2647836 - RNA, 12 nt, Escherichia coli CFT073
ccggcggcagca

SEQ ID NO: 2647837 - RNA, 18 nt, Escherichia coli CFT073
ccggcggcuugcaccagc

SEQ ID NO: 2647838 - RNA, 19 nt, Escherichia coli CFT073
ccggcggcuugcaccagca

SEQ ID NO: 2647839 - RNA, 14 nt, Escherichia coli CFT073
ccggcgggcaaacg

SEQ ID NO: 2647840 - RNA, 21 nt, Escherichia coli CFT073
ccggcgggguuuuuugucucu

SEQ ID NO: 2647841 - RNA, 22 nt, Escherichia coli CFT073
ccggcguccaccugcgucgcgc

SEQ ID NO: 2647842 - RNA, 22 nt, Escherichia coli CFT073
ccggcgucguucgccagucucc

SEQ ID NO: 2647843 - RNA, 19 nt, Escherichia coli CFT073
ccggcgugauauccauaaa

SEQ ID NO: 2647844 - RNA, 21 nt, Escherichia coli CFT073
ccggcgugcguugacucggua

SEQ ID NO: 2647845 - RNA, 18 nt, Escherichia coli CFT073
ccggcguggcguugcggc

SEQ ID NO: 2647846 - RNA, 21 nt, Escherichia coli CFT073
ccggcguggugcagccgccau

SEQ ID NO: 2647847 - RNA, 14 nt, Escherichia coli CFT073
ccggcuauauugca

SEQ ID NO: 2647848 - RNA, 16 nt, Escherichia coli CFT073
ccggcucauaucuucu

SEQ ID NO: 2647849 - RNA, 13 nt, Escherichia coli CFT073
ccggcucccgcag

SEQ ID NO: 2647850 - RNA, 19 nt, Escherichia coli CFT073
ccggcugaauacgcagcgu

SEQ ID NO: 2647851 - RNA, 20 nt, Escherichia coli CFT073
ccggcugcaaacccugagcg

SEQ ID NO: 2647852 - RNA, 21 nt, Escherichia coli CFT073
ccggcuguugaccccacagcg

SEQ ID NO: 2647853 - RNA, 19 nt, Escherichia coli CFT073
ccggcuuacaucuuuacau

SEQ ID NO: 2647854 - RNA, 19 nt, Escherichia coli CFT073
ccggcuucaaggugauauc

SEQ ID NO: 2647855 - RNA, 15 nt, Escherichia coli CFT073
ccggcuuccugcagc

SEQ ID NO: 2647856 - RNA, 18 nt, Escherichia coli CFT073
ccguaagcaaacagagca

SEQ ID NO: 2647857 - RNA, 21 nt, Escherichia coli CFT073
ccguaagguggauuacucuac

SEQ ID NO: 2647858 - RNA, 16 nt, Escherichia coli CFT073
ccguaauaucuuccug

SEQ ID NO: 2647859 - RNA, 15 nt, Escherichia coli CFT073
ccguaaucgccucca

SEQ ID NO: 2647860 - RNA, 18 nt, Escherichia coli CFT073
ccguaauguugcgccagu

SEQ ID NO: 2647861 - RNA, 15 nt, Escherichia coli CFT073
ccguaauuaacaccu

SEQ ID NO: 2647862 - RNA, 19 nt, Escherichia coli CFT073
ccguacaaagugccgccag

SEQ ID NO: 2647863 - RNA, 21 nt, Escherichia coli CFT073
ccguacagaguauuacccggc

SEQ ID NO: 2647864 - RNA, 15 nt, Escherichia coli CFT073
ccguacagcccagga

SEQ ID NO: 2647865 - RNA, 20 nt, Escherichia coli CFT073
ccguacagucgagcaccaga

SEQ ID NO: 2647866 - RNA, 13 nt, Escherichia coli CFT073
ccguacccagcaa

SEQ ID NO: 2647867 - RNA, 22 nt, Escherichia coli CFT073
ccguacccagcggucaaacucg

SEQ ID NO: 2647868 - RNA, 20 nt, Escherichia coli CFT073
ccguacgcuaugcgccaguu

SEQ ID NO: 2647869 - RNA, 21 nt, Escherichia coli CFT073
ccguacugacggcguucuuua

SEQ ID NO: 2647870 - RNA, 18 nt, Escherichia coli CFT073
ccguagaaggcgacaaag

SEQ ID NO: 2647871 - RNA, 15 nt, Escherichia coli CFT073
ccguagcccaucagc

SEQ ID NO: 2647872 - RNA, 18 nt, Escherichia coli CFT073
ccguagcccaucagcugg

SEQ ID NO: 2647873 - RNA, 19 nt, Escherichia coli CFT073
ccguagcggcuuaagaaga

SEQ ID NO: 2647874 - RNA, 13 nt, Escherichia coli CFT073
ccguaggccagcg

SEQ ID NO: 2647875 - RNA, 14 nt, Escherichia coli CFT073
ccguaguuccacau

SEQ ID NO: 2647876 - RNA, 12 nt, Escherichia coli CFT073
ccguaugacaaa

SEQ ID NO: 2647877 - RNA, 15 nt, Escherichia coli CFT073
ccguaugauguauau

SEQ ID NO: 2647878 - RNA, 15 nt, Escherichia coli CFT073
ccguaugcgguacug

SEQ ID NO: 2647879 - RNA, 12 nt, Escherichia coli CFT073
ccguauugucag

SEQ ID NO: 2647880 - RNA, 17 nt, Escherichia coli CFT073
ccgucaaaaggcgugau

SEQ ID NO: 2647881 - RNA, 22 nt, Escherichia coli CFT073
ccgucaaagcgccagcgcgccu

SEQ ID NO: 2647882 - RNA, 16 nt, Escherichia coli CFT073
ccgucaacaauccauu

SEQ ID NO: 2647883 - RNA, 11 nt, Escherichia coli CFT073
ccgucaacagg

SEQ ID NO: 2647884 - RNA, 19 nt, Escherichia coli CFT073
ccgucaauccagccgccca

SEQ ID NO: 2647885 - RNA, 23 nt, Escherichia coli CFT073
ccgucaauccagccgcccagcga

SEQ ID NO: 2647886 - RNA, 19 nt, Escherichia coli CFT073
ccgucacaggcacaccgcc

SEQ ID NO: 2647887 - RNA, 21 nt, Escherichia coli CFT073
ccgucaccagcaucaacaaca

SEQ ID NO: 2647888 - RNA, 14 nt, Escherichia coli CFT073
ccgucaccaguccc

SEQ ID NO: 2647889 - RNA, 14 nt, Escherichia coli CFT073
ccgucacgacccau

SEQ ID NO: 2647890 - RNA, 18 nt, Escherichia coli CFT073
ccgucacguuuugcgccg

SEQ ID NO: 2647891 - RNA, 14 nt, Escherichia coli CFT073
ccgucagcaaaaua

SEQ ID NO: 2647892 - RNA, 19 nt, Escherichia coli CFT073
ccgucagcaaaguaccauc

SEQ ID NO: 2647893 - RNA, 15 nt, Escherichia coli CFT073
ccgucagcagaucca

SEQ ID NO: 2647894 - RNA, 15 nt, Escherichia coli CFT073
ccgucagccgcccgc

SEQ ID NO: 2647895 - RNA, 14 nt, Escherichia coli CFT073
ccgucaguugugcc

SEQ ID NO: 2647896 - RNA, 17 nt, Escherichia coli CFT073
ccgucaguugugccagu

SEQ ID NO: 2647897 - RNA, 23 nt, Escherichia coli CFT073
ccgucaucaucggcugcgcuucu

SEQ ID NO: 2647898 - RNA, 22 nt, Escherichia coli CFT073
ccgucaucauugauggcaaaau

SEQ ID NO: 2647899 - RNA, 15 nt, Escherichia coli CFT073
ccgucaugccgguaa

SEQ ID NO: 2647900 - RNA, 21 nt, Escherichia coli CFT073
ccgucauguagcaaauuucgu

SEQ ID NO: 2647901 - RNA, 20 nt, Escherichia coli CFT073
ccgucaugucucucagagaa

SEQ ID NO: 2647902 - RNA, 12 nt, Escherichia coli CFT073
ccguccaccaga

SEQ ID NO: 2647903 - RNA, 19 nt, Escherichia coli CFT073
ccgucccuaacaugccacu

SEQ ID NO: 2647904 - RNA, 22 nt, Escherichia coli CFT073
ccgucccuaacaugccacuggc

SEQ ID NO: 2647905 - RNA, 16 nt, Escherichia coli CFT073
ccgucccuacugguaa

SEQ ID NO: 2647906 - RNA, 17 nt, Escherichia coli CFT073
ccguccggcaucgcaaa

SEQ ID NO: 2647907 - RNA, 23 nt, Escherichia coli CFT073
ccguccucacuuaaagcaacacc

SEQ ID NO: 2647908 - RNA, 12 nt, Escherichia coli CFT073
ccgucgaccagc

SEQ ID NO: 2647909 - RNA, 22 nt, Escherichia coli CFT073
ccgucgcaccgguaucugccag

SEQ ID NO: 2647910 - RNA, 12 nt, Escherichia coli CFT073
ccgucgcauggg

SEQ ID NO: 2647911 - RNA, 19 nt, Escherichia coli CFT073
ccgucgccaguaccagcag

SEQ ID NO: 2647912 - RNA, 15 nt, Escherichia coli CFT073
ccgucgcgccaggcg

SEQ ID NO: 2647913 - RNA, 22 nt, Escherichia coli CFT073
ccgucgcggcaaauuacuggcg

SEQ ID NO: 2647914 - RNA, 14 nt, Escherichia coli CFT073
ccgucgcguagcac

SEQ ID NO: 2647915 - RNA, 22 nt, Escherichia coli CFT073
ccgucggcuucacgcccagcac

SEQ ID NO: 2647916 - RNA, 17 nt, Escherichia coli CFT073
ccgucguagccaccauc

SEQ ID NO: 2647917 - RNA, 14 nt, Escherichia coli CFT073
ccgucgugaaugcc

SEQ ID NO: 2647918 - RNA, 21 nt, Escherichia coli CFT073
ccgucguggucgugaucgugg

SEQ ID NO: 2647919 - RNA, 15 nt, Escherichia coli CFT073
ccgucguuaaucugc

SEQ ID NO: 2647920 - RNA, 18 nt, Escherichia coli CFT073
ccgucguuaaucugcccg

SEQ ID NO: 2647921 - RNA, 15 nt, Escherichia coli CFT073
ccgucuaugccgguc

SEQ ID NO: 2647922 - RNA, 20 nt, Escherichia coli CFT073
ccgucugaagggaugcugug

SEQ ID NO: 2647923 - RNA, 18 nt, Escherichia coli CFT073
ccgucugcaccgagagaa

SEQ ID NO: 2647924 - RNA, 13 nt, Escherichia coli CFT073
ccgucugcgccug

SEQ ID NO: 2647925 - RNA, 12 nt, Escherichia coli CFT073
ccgucugcugcu

SEQ ID NO: 2647926 - RNA, 15 nt, Escherichia coli CFT073
ccgucugcugcugcg

SEQ ID NO: 2647927 - RNA, 16 nt, Escherichia coli CFT073
ccgucuggccaguucg

SEQ ID NO: 2647928 - RNA, 17 nt, Escherichia coli CFT073
ccgucugggcaaaauca

SEQ ID NO: 2647929 - RNA, 24 nt, Escherichia coli CFT073
ccgucugggcaaaaucaucacucc

SEQ ID NO: 2647930 - RNA, 16 nt, Escherichia coli CFT073
ccgucuucccgcagcc

SEQ ID NO: 2647931 - RNA, 20 nt, Escherichia coli CFT073
ccgucuuccgucacaggcac

SEQ ID NO: 2647932 - RNA, 18 nt, Escherichia coli CFT073
ccgucuucgucuggcugu

SEQ ID NO: 2647933 - RNA, 19 nt, Escherichia coli CFT073
ccgucuucuucccagaccc

SEQ ID NO: 2647934 - RNA, 20 nt, Escherichia coli CFT073
ccgugaaaacagcaaccucc

SEQ ID NO: 2647935 - RNA, 18 nt, Escherichia coli CFT073
ccgugaaucggacgugau

SEQ ID NO: 2647936 - RNA, 14 nt, Escherichia coli CFT073
ccgugagcaaugca

SEQ ID NO: 2647937 - RNA, 18 nt, Escherichia coli CFT073
ccgugaugcggucgcugc

SEQ ID NO: 2647938 - RNA, 21 nt, Escherichia coli CFT073
ccgugaugcggucgcugccgc

SEQ ID NO: 2647939 - RNA, 14 nt, Escherichia coli CFT073
ccgugcagcgcaau

SEQ ID NO: 2647940 - RNA, 12 nt, Escherichia coli CFT073
ccgugccagcac

SEQ ID NO: 2647941 - RNA, 16 nt, Escherichia coli CFT073
ccgugccccauauggc

SEQ ID NO: 2647942 - RNA, 16 nt, Escherichia coli CFT073
ccgugcgauggcaggc

SEQ ID NO: 2647943 - RNA, 15 nt, Escherichia coli CFT073
ccgugcuguacagca

SEQ ID NO: 2647944 - RNA, 15 nt, Escherichia coli CFT073
ccguggcaaaaucca

SEQ ID NO: 2647945 - RNA, 18 nt, Escherichia coli CFT073
ccguggcaaauugcccaa

SEQ ID NO: 2647946 - RNA, 17 nt, Escherichia coli CFT073
ccguggccugcaucgcu

SEQ ID NO: 2647947 - RNA, 19 nt, Escherichia coli CFT073
ccguggucggcaaaauaca

SEQ ID NO: 2647948 - RNA, 19 nt, Escherichia coli CFT073
ccgugguggcagccagcca

SEQ ID NO: 2647949 - RNA, 17 nt, Escherichia coli CFT073
ccguguacgaacggucc

SEQ ID NO: 2647950 - RNA, 15 nt, Escherichia coli CFT073
ccgugucccagguug

SEQ ID NO: 2647951 - RNA, 21 nt, Escherichia coli CFT073
ccgugugugagauauaucgcg

SEQ ID NO: 2647952 - RNA, 20 nt, Escherichia coli CFT073
ccguguuuuugugccagagc

SEQ ID NO: 2647953 - RNA, 21 nt, Escherichia coli CFT073
ccguguuuuugugccagagca

SEQ ID NO: 2647954 - RNA, 21 nt, Escherichia coli CFT073
ccguuaacacggugccaguac

SEQ ID NO: 2647955 - RNA, 14 nt, Escherichia coli CFT073
ccguuaaccaugca

SEQ ID NO: 2647956 - RNA, 13 nt, Escherichia coli CFT073
ccguuaagcugga

SEQ ID NO: 2647957 - RNA, 21 nt, Escherichia coli CFT073
ccguuaaggccaaacaccagg

SEQ ID NO: 2647958 - RNA, 21 nt, Escherichia coli CFT073
ccguuaauucuuaacaccggc

SEQ ID NO: 2647959 - RNA, 17 nt, Escherichia coli CFT073
ccguuagcgaguugauc

SEQ ID NO: 2647960 - RNA, 20 nt, Escherichia coli CFT073
ccguuaugaucagcaacgcc

SEQ ID NO: 2647961 - RNA, 17 nt, Escherichia coli CFT073
ccguuauguuucaucca

SEQ ID NO: 2647962 - RNA, 19 nt, Escherichia coli CFT073
ccguuauguuucauccagg

SEQ ID NO: 2647963 - RNA, 13 nt, Escherichia coli CFT073
ccguucauccgcu

SEQ ID NO: 2647964 - RNA, 21 nt, Escherichia coli CFT073
ccucauuucauuguccgucug

SEQ ID NO: 2647965 - RNA, 22 nt, Escherichia coli CFT073
ccuccaacaacccugcaucaga

SEQ ID NO: 2647966 - RNA, 12 nt, Escherichia coli CFT073
ccuccaacccac

SEQ ID NO: 2647967 - RNA, 21 nt, Escherichia coli CFT073
ccuccaacccacaaaaacacc

SEQ ID NO: 2647968 - RNA, 14 nt, Escherichia coli CFT073
ccuccagcaucaga

SEQ ID NO: 2647969 - RNA, 20 nt, Escherichia coli CFT073
ccuccauaagaguagcccga

SEQ ID NO: 2647970 - RNA, 18 nt, Escherichia coli CFT073
ccucccauucaucgccac

SEQ ID NO: 2647971 - RNA, 17 nt, Escherichia coli CFT073
ccuccccaucgucagcc

SEQ ID NO: 2647972 - RNA, 23 nt, Escherichia coli CFT073
ccucccgcuguuuguucaagcgc

SEQ ID NO: 2647973 - RNA, 23 nt, Escherichia coli CFT073
ccucccggugaauucaguaccag

SEQ ID NO: 2647974 - RNA, 23 nt, Escherichia coli CFT073
ccucccguaacgacgcagaaaug

SEQ ID NO: 2647975 - RNA, 22 nt, Escherichia coli CFT073
ccucccguuuuuagauuguuuu

SEQ ID NO: 2647976 - RNA, 19 nt, Escherichia coli CFT073
ccuccgcuaaauccgccgc

SEQ ID NO: 2647977 - RNA, 22 nt, Escherichia coli CFT073
ccuccgcuaaauccgccgccac

SEQ ID NO: 2647978 - RNA, 10 nt, Escherichia coli CFT073
ccuccggcgu

SEQ ID NO: 2647979 - RNA, 14 nt, Escherichia coli CFT073
ccuccggcguacag

SEQ ID NO: 2647980 - RNA, 19 nt, Escherichia coli CFT073
ccuccguuuuucuguugau

SEQ ID NO: 2647981 - RNA, 15 nt, Escherichia coli CFT073
ccuccuccggcaucu

SEQ ID NO: 2647982 - RNA, 13 nt, Escherichia coli CFT073
ccuccugcagcgu

SEQ ID NO: 2647983 - RNA, 13 nt, Escherichia coli CFT073
ccuccugcggcuu

SEQ ID NO: 2647984 - RNA, 14 nt, Escherichia coli CFT073
ccuccugcggcuuc

SEQ ID NO: 2647985 - RNA, 17 nt, Escherichia coli CFT073
ccuccugcggcuucaac

SEQ ID NO: 2647986 - RNA, 22 nt, Escherichia coli CFT073
ccuccugucuaaccgccugccu

SEQ ID NO: 2647987 - RNA, 23 nt, Escherichia coli CFT073
ccuccugucuaaccgccugccuu

SEQ ID NO: 2647988 - RNA, 17 nt, Escherichia coli CFT073
ccucgaccaucuccuua

SEQ ID NO: 2647989 - RNA, 13 nt, Escherichia coli CFT073
ccucgcagcggca

SEQ ID NO: 2647990 - RNA, 15 nt, Escherichia coli CFT073
ccucgccccuccggg

SEQ ID NO: 2647991 - RNA, 17 nt, Escherichia coli CFT073
ccucgccccuccgggga

SEQ ID NO: 2647992 - RNA, 20 nt, Escherichia coli CFT073
ccucgccgagcagcuguuuc

SEQ ID NO: 2647993 - RNA, 22 nt, Escherichia coli CFT073
ccucgcgcguccacggugcgac

SEQ ID NO: 2647994 - RNA, 17 nt, Escherichia coli CFT073
ccucgcucucgccgcgc

SEQ ID NO: 2647995 - RNA, 18 nt, Escherichia coli CFT073
ccucgcucucgccgcgcu

SEQ ID NO: 2647996 - RNA, 18 nt, Escherichia coli CFT073
ccucgcugcucacaccau

SEQ ID NO: 2647997 - RNA, 20 nt, Escherichia coli CFT073
ccucgcuuuuaugccuggcg

SEQ ID NO: 2647998 - RNA, 21 nt, Escherichia coli CFT073
ccucguauuccaucucgccau

SEQ ID NO: 2647999 - RNA, 14 nt, Escherichia coli CFT073
ccucgugcaccgcc

SEQ ID NO: 2648000 - RNA, 16 nt, Escherichia coli CFT073
ccucgugcaccgccug

SEQ ID NO: 2648001 - RNA, 22 nt, Escherichia coli CFT073
ccucguucugaauacccgccag

SEQ ID NO: 2648002 - RNA, 16 nt, Escherichia coli CFT073
ccucguugauguucgg

SEQ ID NO: 2648003 - RNA, 16 nt, Escherichia coli CFT073
ccucuaaaauaacgaa

SEQ ID NO: 2648004 - RNA, 19 nt, Escherichia coli CFT073
ccucuaaaccccaaccacu

SEQ ID NO: 2648005 - RNA, 23 nt, Escherichia coli CFT073
ccucucacgacgcugguuacauc

SEQ ID NO: 2648006 - RNA, 15 nt, Escherichia coli CFT073
ccucuccccagcgga

SEQ ID NO: 2648007 - RNA, 23 nt, Escherichia coli CFT073
ccucuccgggggcgauuucagau

SEQ ID NO: 2648008 - RNA, 13 nt, Escherichia coli CFT073
ccucugccagcug

SEQ ID NO: 2648009 - RNA, 22 nt, Escherichia coli CFT073
ccucugccccgccaacagugcc

SEQ ID NO: 2648010 - RNA, 15 nt, Escherichia coli CFT073
ccucugcgcccagca

SEQ ID NO: 2648011 - RNA, 17 nt, Escherichia coli CFT073
ccucuguucagguggcc

SEQ ID NO: 2648012 - RNA, 19 nt, Escherichia coli CFT073
ccucuguucagugauggca

SEQ ID NO: 2648013 - RNA, 18 nt, Escherichia coli CFT073
ccucuuaaugcaggcagc

SEQ ID NO: 2648014 - RNA, 21 nt, Escherichia coli CFT073
ccucuucaccguccauccaca

SEQ ID NO: 2648015 - RNA, 22 nt, Escherichia coli CFT073
ccucuucaggaggagauauuua

SEQ ID NO: 2648016 - RNA, 20 nt, Escherichia coli CFT073
ccucuuccagagagguuuuc

SEQ ID NO: 2648017 - RNA, 15 nt, Escherichia coli CFT073
ccucuuccagcgaua

SEQ ID NO: 2648018 - RNA, 21 nt, Escherichia coli CFT073
ccucuuccauuucaucgccag

SEQ ID NO: 2648019 - RNA, 19 nt, Escherichia coli CFT073
ccucuuccggaaccaccag

SEQ ID NO: 2648020 - RNA, 12 nt, Escherichia coli CFT073
ccucuuccugag

SEQ ID NO: 2648021 - RNA, 14 nt, Escherichia coli CFT073
ccucuucuuuaaaa

SEQ ID NO: 2648022 - RNA, 11 nt, Escherichia coli CFT073
ccucuucuuuu

SEQ ID NO: 2648023 - RNA, 16 nt, Escherichia coli CFT073
ccucuucuuuuagcuc

SEQ ID NO: 2648024 - RNA, 15 nt, Escherichia coli CFT073
ccucuuuauuuccug

SEQ ID NO: 2648025 - RNA, 15 nt, Escherichia coli CFT073
ccucuuucaccagau

SEQ ID NO: 2648026 - RNA, 19 nt, Escherichia coli CFT073
ccucuuugcugccuucgca

SEQ ID NO: 2648027 - RNA, 23 nt, Escherichia coli CFT073
ccucuuuguaccaguuaaagcuc

SEQ ID NO: 2648028 - RNA, 13 nt, Escherichia coli CFT073
ccucuuugugaca

SEQ ID NO: 2648029 - RNA, 19 nt, Escherichia coli CFT073
ccugaaaauucaguucguc

SEQ ID NO: 2648030 - RNA, 20 nt, Escherichia coli CFT073
ccugaaacgcggcguaacca

SEQ ID NO: 2648031 - RNA, 15 nt, Escherichia coli CFT073
ccugaaagcgacagc

SEQ ID NO: 2648032 - RNA, 18 nt, Escherichia coli CFT073
ccugaaagcgugucaugu

SEQ ID NO: 2648033 - RNA, 17 nt, Escherichia coli CFT073
ccugaaagcugagaaaa

SEQ ID NO: 2648034 - RNA, 16 nt, Escherichia coli CFT073
ccugaaauuuaucuac

SEQ ID NO: 2648035 - RNA, 22 nt, Escherichia coli CFT073
ccugaacccggaaucgcgucgu

SEQ ID NO: 2648036 - RNA, 13 nt, Escherichia coli CFT073
ccugaacuuguuu

SEQ ID NO: 2648037 - RNA, 22 nt, Escherichia coli CFT073
ccugaacuuguuuacaaauaau

SEQ ID NO: 2648038 - RNA, 13 nt, Escherichia coli CFT073
ccugaagaucaac

SEQ ID NO: 2648039 - RNA, 15 nt, Escherichia coli CFT073
ccugaagcaguuuca

SEQ ID NO: 2648040 - RNA, 12 nt, Escherichia coli CFT073
ccugaauaaacg

SEQ ID NO: 2648041 - RNA, 13 nt, Escherichia coli CFT073
ccugaauaaacgc

SEQ ID NO: 2648042 - RNA, 16 nt, Escherichia coli CFT073
ccugaauaaacgccau

SEQ ID NO: 2648043 - RNA, 11 nt, Escherichia coli CFT073
ccugaauaauc

SEQ ID NO: 2648044 - RNA, 13 nt, Escherichia coli CFT073
ccugaauaaucag

SEQ ID NO: 2648045 - RNA, 17 nt, Escherichia coli CFT073
ccugaauaaucagauac

SEQ ID NO: 2648046 - RNA, 22 nt, Escherichia coli CFT073
ccugaauaaucguaaucagcau

SEQ ID NO: 2648047 - RNA, 17 nt, Escherichia coli CFT073
ccugaauacacugcuga

SEQ ID NO: 2648048 - RNA, 23 nt, Escherichia coli CFT073
ccugaaucagccaguaaaccaau

SEQ ID NO: 2648049 - RNA, 22 nt, Escherichia coli CFT073
ccugaauccgcgauuaucccau

SEQ ID NO: 2648050 - RNA, 23 nt, Escherichia coli CFT073
ccugaauccgcgauuaucccaua

SEQ ID NO: 2648051 - RNA, 13 nt, Escherichia coli CFT073
ccugaaucgccga

SEQ ID NO: 2648052 - RNA, 16 nt, Escherichia coli CFT073
ccugaaugccgcgccc

SEQ ID NO: 2648053 - RNA, 21 nt, Escherichia coli CFT073
ccugaauggugaccugcaaug

SEQ ID NO: 2648054 - RNA, 21 nt, Escherichia coli CFT073
ccugaauugacuacaaaaaaa

SEQ ID NO: 2648055 - RNA, 16 nt, Escherichia coli CFT073
ccugaauuugcuccag

SEQ ID NO: 2648056 - RNA, 19 nt, Escherichia coli CFT073
ccugaauuugcuccagaaa

SEQ ID NO: 2648057 - RNA, 21 nt, Escherichia coli CFT073
ccugacaaggugcgaaaaaaa

SEQ ID NO: 2648058 - RNA, 14 nt, Escherichia coli CFT073
ccugacaggcggga

SEQ ID NO: 2648059 - RNA, 22 nt, Escherichia coli CFT073
ccugacaggcgggaagaacggc

SEQ ID NO: 2648060 - RNA, 14 nt, Escherichia coli CFT073
ccugaccacccgcu

SEQ ID NO: 2648061 - RNA, 19 nt, Escherichia coli CFT073
ccugaccauuaucaaacag

SEQ ID NO: 2648062 - RNA, 21 nt, Escherichia coli CFT073
ccugacccagaccgauacaca

SEQ ID NO: 2648063 - RNA, 15 nt, Escherichia coli CFT073
ccugacccagcacca

SEQ ID NO: 2648064 - RNA, 19 nt, Escherichia coli CFT073
ccugaccgucuuuuuuuac

SEQ ID NO: 2648065 - RNA, 17 nt, Escherichia coli CFT073
ccugaccguuguugaac

SEQ ID NO: 2648066 - RNA, 17 nt, Escherichia coli CFT073
ccugaccuuaauaaacu

SEQ ID NO: 2648067 - RNA, 15 nt, Escherichia coli CFT073
ccugacgaucaagcg

SEQ ID NO: 2648068 - RNA, 16 nt, Escherichia coli CFT073
ccugacgcaauaacac

SEQ ID NO: 2648069 - RNA, 16 nt, Escherichia coli CFT073
ccugacgcuuaucuuc

SEQ ID NO: 2648070 - RNA, 19 nt, Escherichia coli CFT073
ccugacguaaggcaucgcu

SEQ ID NO: 2648071 - RNA, 12 nt, Escherichia coli CFT073
ccugacugguua

SEQ ID NO: 2648072 - RNA, 15 nt, Escherichia coli CFT073
ccugcccgcuccagc

SEQ ID NO: 2648073 - RNA, 12 nt, Escherichia coli CFT073
ccugccgccauc

SEQ ID NO: 2648074 - RNA, 20 nt, Escherichia coli CFT073
ccugccggaacgugcauauu

SEQ ID NO: 2648075 - RNA, 17 nt, Escherichia coli CFT073
ccugccgggaauacugc

SEQ ID NO: 2648076 - RNA, 22 nt, Escherichia coli CFT073
ccugccgggcugauaccgcguu

SEQ ID NO: 2648077 - RNA, 23 nt, Escherichia coli CFT073
ccugccgucugggcaaaaucauc

SEQ ID NO: 2648078 - RNA, 17 nt, Escherichia coli CFT073
ccugccugcagcugcuc

SEQ ID NO: 2648079 - RNA, 17 nt, Escherichia coli CFT073
ccugcgaacuguaauga

SEQ ID NO: 2648080 - RNA, 15 nt, Escherichia coli CFT073
ccugcgagccgccgc

SEQ ID NO: 2648081 - RNA, 14 nt, Escherichia coli CFT073
ccugcgauugugac

SEQ ID NO: 2648082 - RNA, 13 nt, Escherichia coli CFT073
ccugcgcaauaac

SEQ ID NO: 2648083 - RNA, 23 nt, Escherichia coli CFT073
ccugcgcacgcguaauauccagc

SEQ ID NO: 2648084 - RNA, 13 nt, Escherichia coli CFT073
ccugcgccaccac

SEQ ID NO: 2648085 - RNA, 18 nt, Escherichia coli CFT073
ccugcgccaccacaacau

SEQ ID NO: 2648086 - RNA, 14 nt, Escherichia coli CFT073
ccugcgccaccguu

SEQ ID NO: 2648087 - RNA, 15 nt, Escherichia coli CFT073
ccugcgccagccagc

SEQ ID NO: 2648088 - RNA, 14 nt, Escherichia coli CFT073
ccugcgccagcguu

SEQ ID NO: 2648089 - RNA, 16 nt, Escherichia coli CFT073
ccugcgcgcuggcgcg

SEQ ID NO: 2648090 - RNA, 18 nt, Escherichia coli CFT073
ccugcgcggcaaugcgcc

SEQ ID NO: 2648091 - RNA, 14 nt, Escherichia coli CFT073
ccugcgcuggcagg

SEQ ID NO: 2648092 - RNA, 23 nt, Escherichia coli CFT073
ccugcgcuggcaggccugcuuug

SEQ ID NO: 2648093 - RNA, 18 nt, Escherichia coli CFT073
ccugcgcuuccaguucca

SEQ ID NO: 2648094 - RNA, 18 nt, Escherichia coli CFT073
ccugcgcuuucugcuucg

SEQ ID NO: 2648095 - RNA, 15 nt, Escherichia coli CFT073
ccugcggacagucac

SEQ ID NO: 2648096 - RNA, 19 nt, Escherichia coli CFT073
ccugcggagaucaccacau

SEQ ID NO: 2648097 - RNA, 11 nt, Escherichia coli CFT073
ccugcggcagc

SEQ ID NO: 2648098 - RNA, 15 nt, Escherichia coli CFT073
ccugcggccagcagc

SEQ ID NO: 2648099 - RNA, 18 nt, Escherichia coli CFT073
ccugcgggagcgcuuuuu

SEQ ID NO: 2648100 - RNA, 20 nt, Escherichia coli CFT073
ccugcgggagcgcuuuuucc

SEQ ID NO: 2648101 - RNA, 19 nt, Escherichia coli CFT073
ccugcggggagaaugccag

SEQ ID NO: 2648102 - RNA, 20 nt, Escherichia coli CFT073
ccugcggggagaaugccagc

SEQ ID NO: 2648103 - RNA, 14 nt, Escherichia coli CFT073
ccugcgucgccauc

SEQ ID NO: 2648104 - RNA, 17 nt, Escherichia coli CFT073
ccugcguuuguccgcca

SEQ ID NO: 2648105 - RNA, 17 nt, Escherichia coli CFT073
ccugcuacaccauugcg

SEQ ID NO: 2648106 - RNA, 23 nt, Escherichia coli CFT073
ccugcucacgcaucaacgcggca

SEQ ID NO: 2648107 - RNA, 17 nt, Escherichia coli CFT073
ccugcucaggcagaaga

SEQ ID NO: 2648108 - RNA, 13 nt, Escherichia coli CFT073
ccugcucaucagc

SEQ ID NO: 2648109 - RNA, 18 nt, Escherichia coli CFT073
ccugcuccagcagcucaa

SEQ ID NO: 2648110 - RNA, 16 nt, Escherichia coli CFT073
ccugcucgucauccgc

SEQ ID NO: 2648111 - RNA, 17 nt, Escherichia coli CFT073
ccugcucgucauccgcu

SEQ ID NO: 2648112 - RNA, 16 nt, Escherichia coli CFT073
ccugcucuuucagcac

SEQ ID NO: 2648113 - RNA, 21 nt, Escherichia coli CFT073
ccugcugaauuuccugcgcuu

SEQ ID NO: 2648114 - RNA, 23 nt, Escherichia coli CFT073
ccugcugagaacauaaacaccca

SEQ ID NO: 2648115 - RNA, 19 nt, Escherichia coli CFT073
ccugcugugccagcuccac

SEQ ID NO: 2648116 - RNA, 20 nt, Escherichia coli CFT073
ccugcuguguaauuugcguu

SEQ ID NO: 2648117 - RNA, 15 nt, Escherichia coli CFT073
ccugcugugucucuu

SEQ ID NO: 2648118 - RNA, 17 nt, Escherichia coli CFT073
ccugcugugucucuucu

SEQ ID NO: 2648119 - RNA, 16 nt, Escherichia coli CFT073
ccugcuugaacgcacc

SEQ ID NO: 2648120 - RNA, 17 nt, Escherichia coli CFT073
ccugcuuugacacuuca

SEQ ID NO: 2648121 - RNA, 18 nt, Escherichia coli CFT073
ccugcuuugacacuucau

SEQ ID NO: 2648122 - RNA, 21 nt, Escherichia coli CFT073
ccuggaauuucuucggcgggc

SEQ ID NO: 2648123 - RNA, 12 nt, Escherichia coli CFT073
ccuggagagugu

SEQ ID NO: 2648124 - RNA, 23 nt, Escherichia coli CFT073
ccuggauaaggccaccagcggca

SEQ ID NO: 2648125 - RNA, 19 nt, Escherichia coli CFT073
ccuggcaauagcgcacgcc

SEQ ID NO: 2648126 - RNA, 13 nt, Escherichia coli CFT073
ccuggcacagcag

SEQ ID NO: 2648127 - RNA, 13 nt, Escherichia coli CFT073
ccuggcaccauca

SEQ ID NO: 2648128 - RNA, 19 nt, Escherichia coli CFT073
ccuggcacuguucauugau

SEQ ID NO: 2648129 - RNA, 21 nt, Escherichia coli CFT073
ccuggccauaccaugacgaug

SEQ ID NO: 2648130 - RNA, 15 nt, Escherichia coli CFT073
ccuggccccuggcug

SEQ ID NO: 2648131 - RNA, 23 nt, Escherichia coli CFT073
ccuggcgaauuuguuccccaugc

SEQ ID NO: 2648132 - RNA, 15 nt, Escherichia coli CFT073
ccuggcgcugcucag

SEQ ID NO: 2648133 - RNA, 16 nt, Escherichia coli CFT073
ccuggcgggaauaaaa

SEQ ID NO: 2648134 - RNA, 23 nt, Escherichia coli CFT073
ccuggcgggaauaaaagccagga

SEQ ID NO: 2648135 - RNA, 20 nt, Escherichia coli CFT073
ccuggcuggcgcuacugaag

SEQ ID NO: 2648136 - RNA, 16 nt, Escherichia coli CFT073
ccuggcuggucagcaa

SEQ ID NO: 2648137 - RNA, 13 nt, Escherichia coli CFT073
ccugggcaauggu

SEQ ID NO: 2648138 - RNA, 15 nt, Escherichia coli CFT073
ccugggccagcacca

SEQ ID NO: 2648139 - RNA, 17 nt, Escherichia coli CFT073
ccugggucagcgccgua

SEQ ID NO: 2648140 - RNA, 18 nt, Escherichia coli CFT073
ccugggugaugguccagu

SEQ ID NO: 2648141 - RNA, 18 nt, Escherichia coli CFT073
ccuggguuagccagaaca

SEQ ID NO: 2648142 - RNA, 21 nt, Escherichia coli CFT073
ccugguacauugcgaacaggu

SEQ ID NO: 2648143 - RNA, 17 nt, Escherichia coli CFT073
ccugguacucgacugug

SEQ ID NO: 2648144 - RNA, 13 nt, Escherichia coli CFT073
ccuggucaaagac

SEQ ID NO: 2648145 - RNA, 12 nt, Escherichia coli CFT073
ccuggucgcugg

SEQ ID NO: 2648146 - RNA, 22 nt, Escherichia coli CFT073
ccuggugguaucaaggcugaug

SEQ ID NO: 2648147 - RNA, 23 nt, Escherichia coli CFT073
ccugguggucgaaaaucugcccg

SEQ ID NO: 2648148 - RNA, 19 nt, Escherichia coli CFT073
ccugguuauuucacuucaa

SEQ ID NO: 2648149 - RNA, 23 nt, Escherichia coli CFT073
ccugguuguauggccuggugagu

SEQ ID NO: 2648150 - RNA, 19 nt, Escherichia coli CFT073
ccugguuucucuccguguc

SEQ ID NO: 2648151 - RNA, 20 nt, Escherichia coli CFT073
ccugguuuugccaugcaaua

SEQ ID NO: 2648152 - RNA, 20 nt, Escherichia coli CFT073
ccuguaaaaaaggcagccau

SEQ ID NO: 2648153 - RNA, 22 nt, Escherichia coli CFT073
ccuguaaacggaugacuucgcu

SEQ ID NO: 2648154 - RNA, 21 nt, Escherichia coli CFT073
ccuguaaagagugugaauauu

SEQ ID NO: 2648155 - RNA, 19 nt, Escherichia coli CFT073
ccuguaagaccugucucuu

SEQ ID NO: 2648156 - RNA, 21 nt, Escherichia coli CFT073
ccuguaagcgguauugagcuu

SEQ ID NO: 2648157 - RNA, 19 nt, Escherichia coli CFT073
ccuguaaugucaucucugg

SEQ ID NO: 2648158 - RNA, 21 nt, Escherichia coli CFT073
ccuguaaugucaucucuggca

SEQ ID NO: 2648159 - RNA, 20 nt, Escherichia coli CFT073
ccuguaccagcggcuuccag

SEQ ID NO: 2648160 - RNA, 15 nt, Escherichia coli CFT073
ccuguacgucgagaa

SEQ ID NO: 2648161 - RNA, 20 nt, Escherichia coli CFT073
ccuguacgucgagaauaucg

SEQ ID NO: 2648162 - RNA, 16 nt, Escherichia coli CFT073
ccuguaggccugauaa

SEQ ID NO: 2648163 - RNA, 20 nt, Escherichia coli CFT073
ccugucaccgggcaaacgcu

SEQ ID NO: 2648164 - RNA, 23 nt, Escherichia coli CFT073
ccugucgcuuuugcaucuucagu

SEQ ID NO: 2648165 - RNA, 17 nt, Escherichia coli CFT073
ccugucuaaccgccugc

SEQ ID NO: 2648166 - RNA, 22 nt, Escherichia coli CFT073
ccugucuggauuuacugcaugg

SEQ ID NO: 2648167 - RNA, 15 nt, Escherichia coli CFT073
ccugucuucccugcu

SEQ ID NO: 2648168 - RNA, 15 nt, Escherichia coli CFT073
ccugugacagcagcg

SEQ ID NO: 2648169 - RNA, 19 nt, Escherichia coli CFT073
ccugugcaaccuuuuccau

SEQ ID NO: 2648170 - RNA, 18 nt, Escherichia coli CFT073
ccugugccgccgcccggc

SEQ ID NO: 2648171 - RNA, 18 nt, Escherichia coli CFT073
ccugugccugagccggag

SEQ ID NO: 2648172 - RNA, 15 nt, Escherichia coli CFT073
ccugugcgauuuccu

SEQ ID NO: 2648173 - RNA, 16 nt, Escherichia coli CFT073
ccugugcgauuuccuu

SEQ ID NO: 2648174 - RNA, 13 nt, Escherichia coli CFT073
ccugugcgcccug

SEQ ID NO: 2648175 - RNA, 18 nt, Escherichia coli CFT073
ccugugcgcccuguucug

SEQ ID NO: 2648176 - RNA, 18 nt, Escherichia coli CFT073
ccuguggacgcagcucau

SEQ ID NO: 2648177 - RNA, 21 nt, Escherichia coli CFT073
ccuguggcgcgaccagacgca

SEQ ID NO: 2648178 - RNA, 13 nt, Escherichia coli CFT073
ccuguggcuuuuu

SEQ ID NO: 2648179 - RNA, 18 nt, Escherichia coli CFT073
ccugugggccgauggcua

SEQ ID NO: 2648180 - RNA, 15 nt, Escherichia coli CFT073
cgaacauauucgaca

SEQ ID NO: 2648181 - RNA, 16 nt, Escherichia coli CFT073
cgaacaugccgccaac

SEQ ID NO: 2648182 - RNA, 23 nt, Escherichia coli CFT073
cgaacauucccgguuucaggaug

SEQ ID NO: 2648183 - RNA, 17 nt, Escherichia coli CFT073
cgaaccaaacagcgcca

SEQ ID NO: 2648184 - RNA, 20 nt, Escherichia coli CFT073
cgaaccagaccagcaauaaa

SEQ ID NO: 2648185 - RNA, 21 nt, Escherichia coli CFT073
cgaaccagaccagcaauaaaa

SEQ ID NO: 2648186 - RNA, 13 nt, Escherichia coli CFT073
cgaaccagugcuc

SEQ ID NO: 2648187 - RNA, 23 nt, Escherichia coli CFT073
cgaaccaugucaucaauugcgca

SEQ ID NO: 2648188 - RNA, 23 nt, Escherichia coli CFT073
cgaaccgccuggcgcugcucagg

SEQ ID NO: 2648189 - RNA, 16 nt, Escherichia coli CFT073
cgaaccucggaaugcc

SEQ ID NO: 2648190 - RNA, 12 nt, Escherichia coli CFT073
cgaacgccacga

SEQ ID NO: 2648191 - RNA, 18 nt, Escherichia coli CFT073
cgaacgcugacaaacugc

SEQ ID NO: 2648192 - RNA, 22 nt, Escherichia coli CFT073
cgaacgggauaaacgaaaugcg

SEQ ID NO: 2648193 - RNA, 21 nt, Escherichia coli CFT073
cgaacguacaucccgcgcacg

SEQ ID NO: 2648194 - RNA, 23 nt, Escherichia coli CFT073
cgaacgugaucgccccggaagcc

SEQ ID NO: 2648195 - RNA, 15 nt, Escherichia coli CFT073
cgaacuaaccgcacu

SEQ ID NO: 2648196 - RNA, 22 nt, Escherichia coli CFT073
cgaacucauugcgggccaggaa

SEQ ID NO: 2648197 - RNA, 16 nt, Escherichia coli CFT073
cgaacucugacgauuc

SEQ ID NO: 2648198 - RNA, 15 nt, Escherichia coli CFT073
cgaacucuucgccca

SEQ ID NO: 2648199 - RNA, 16 nt, Escherichia coli CFT073
cgaacugguaaggaac

SEQ ID NO: 2648200 - RNA, 21 nt, Escherichia coli CFT073
cgaacugucgauuuguacucu

SEQ ID NO: 2648201 - RNA, 15 nt, Escherichia coli CFT073
cgaacuuuacugccu

SEQ ID NO: 2648202 - RNA, 13 nt, Escherichia coli CFT073
cgaagaaccagua

SEQ ID NO: 2648203 - RNA, 18 nt, Escherichia coli CFT073
cgaagaauacgccccaga

SEQ ID NO: 2648204 - RNA, 20 nt, Escherichia coli CFT073
cgaagaauacgccccagaau

SEQ ID NO: 2648205 - RNA, 13 nt, Escherichia coli CFT073
cgaagacaaaacc

SEQ ID NO: 2648206 - RNA, 17 nt, Escherichia coli CFT073
cgaagacaaaaccaacg

SEQ ID NO: 2648207 - RNA, 22 nt, Escherichia coli CFT073
cgaagacaucgcagggaucauc

SEQ ID NO: 2648208 - RNA, 20 nt, Escherichia coli CFT073
cgaagaguaaccaaacgugg

SEQ ID NO: 2648209 - RNA, 16 nt, Escherichia coli CFT073
cgaagaguuccagcgc

SEQ ID NO: 2648210 - RNA, 16 nt, Escherichia coli CFT073
cgaagauauucaucag

SEQ ID NO: 2648211 - RNA, 13 nt, Escherichia coli CFT073
cgaagauguaguc

SEQ ID NO: 2648212 - RNA, 17 nt, Escherichia coli CFT073
cgaagauguagucugug

SEQ ID NO: 2648213 - RNA, 15 nt, Escherichia coli CFT073
cgaagcccacaccgc

SEQ ID NO: 2648214 - RNA, 20 nt, Escherichia coli CFT073
cgaagcccacaccgcccagc

SEQ ID NO: 2648215 - RNA, 20 nt, Escherichia coli CFT073
cgaagccugcgacgucugau

SEQ ID NO: 2648216 - RNA, 20 nt, Escherichia coli CFT073
cgaagcggcacugcucuuua

SEQ ID NO: 2648217 - RNA, 11 nt, Escherichia coli CFT073
cgaagcggcug

SEQ ID NO: 2648218 - RNA, 15 nt, Escherichia coli CFT073
cgaagcggucgagaa

SEQ ID NO: 2648219 - RNA, 22 nt, Escherichia coli CFT073
cgaagcugguguaacugcgcca

SEQ ID NO: 2648220 - RNA, 16 nt, Escherichia coli CFT073
cgaagcuugcgacaua

SEQ ID NO: 2648221 - RNA, 15 nt, Escherichia coli CFT073
cgaaggccagcacca

SEQ ID NO: 2648222 - RNA, 19 nt, Escherichia coli CFT073
cgaaggugaacgccaccaa

SEQ ID NO: 2648223 - RNA, 13 nt, Escherichia coli CFT073
cgaaggugcauug

SEQ ID NO: 2648224 - RNA, 20 nt, Escherichia coli CFT073
cgaaggugccugcccagccg

SEQ ID NO: 2648225 - RNA, 20 nt, Escherichia coli CFT073
cgaagguuccugcaaagcgu

SEQ ID NO: 2648226 - RNA, 23 nt, Escherichia coli CFT073
cgaagguucgaauccuuccccca

SEQ ID NO: 2648227 - RNA, 20 nt, Escherichia coli CFT073
cgaagugaaucggaucaauc

SEQ ID NO: 2648228 - RNA, 16 nt, Escherichia coli CFT073
cgaagugagggccagc

SEQ ID NO: 2648229 - RNA, 21 nt, Escherichia coli CFT073
cgaaguggacgaacagcucaa

SEQ ID NO: 2648230 - RNA, 17 nt, Escherichia coli CFT073
cgaagugguuccacgcc

SEQ ID NO: 2648231 - RNA, 19 nt, Escherichia coli CFT073
cgaagugguuccacgcccg

SEQ ID NO: 2648232 - RNA, 17 nt, Escherichia coli CFT073
cgaaguucauccauacc

SEQ ID NO: 2648233 - RNA, 22 nt, Escherichia coli CFT073
cgaaguucauccauaccacagg

SEQ ID NO: 2648234 - RNA, 22 nt, Escherichia coli CFT073
cgaaguucuuccggcagccagg

SEQ ID NO: 2648235 - RNA, 21 nt, Escherichia coli CFT073
cgaaguugauugccagcaggg

SEQ ID NO: 2648236 - RNA, 21 nt, Escherichia coli CFT073
cgaauaaacgauauccccgga

SEQ ID NO: 2648237 - RNA, 16 nt, Escherichia coli CFT073
cgaauaaauuccgcuc

SEQ ID NO: 2648238 - RNA, 16 nt, Escherichia coli CFT073
cgaauaacgcgcagcg

SEQ ID NO: 2648239 - RNA, 13 nt, Escherichia coli CFT073
cgaauaauccagc

SEQ ID NO: 2648240 - RNA, 14 nt, Escherichia coli CFT073
cgaauaaucccggc

SEQ ID NO: 2648241 - RNA, 12 nt, Escherichia coli CFT073
cgaauaccccag

SEQ ID NO: 2648242 - RNA, 15 nt, Escherichia coli CFT073
cgaauaccguaacga

SEQ ID NO: 2648243 - RNA, 13 nt, Escherichia coli CFT073
cgaauaccuucuu

SEQ ID NO: 2648244 - RNA, 16 nt, Escherichia coli CFT073
cgaauaccuucuuccu

SEQ ID NO: 2648245 - RNA, 14 nt, Escherichia coli CFT073
cgaauacggcggau

SEQ ID NO: 2648246 - RNA, 15 nt, Escherichia coli CFT073
cgaauacguaauguc

SEQ ID NO: 2648247 - RNA, 16 nt, Escherichia coli CFT073
cgaauagaacauaaug

SEQ ID NO: 2648248 - RNA, 21 nt, Escherichia coli CFT073
cgaauagagccuggcugcgug

SEQ ID NO: 2648249 - RNA, 13 nt, Escherichia coli CFT073
cgaauauaacuaa

SEQ ID NO: 2648250 - RNA, 13 nt, Escherichia coli CFT073
cgaauaucaacaa

SEQ ID NO: 2648251 - RNA, 15 nt, Escherichia coli CFT073
cgaauauguuuuuga

SEQ ID NO: 2648252 - RNA, 20 nt, Escherichia coli CFT073
cgaauauuggagagcgauaa

SEQ ID NO: 2648253 - RNA, 14 nt, Escherichia coli CFT073
cgaaucaaacaugg

SEQ ID NO: 2648254 - RNA, 18 nt, Escherichia coli CFT073
cgaaucaggcggcucacc

SEQ ID NO: 2648255 - RNA, 20 nt, Escherichia coli CFT073
cgaaucaggcggcucaccug

SEQ ID NO: 2648256 - RNA, 14 nt, Escherichia coli CFT073
cgaaucauuaccug

SEQ ID NO: 2648257 - RNA, 14 nt, Escherichia coli CFT073
cgaauccaauaaaa

SEQ ID NO: 2648258 - RNA, 11 nt, Escherichia coli CFT073
cgaauccagca

SEQ ID NO: 2648259 - RNA, 14 nt, Escherichia coli CFT073
cgaauccggcagcg

SEQ ID NO: 2648260 - RNA, 22 nt, Escherichia coli CFT073
cgaauccggcagcgaaccgucg

SEQ ID NO: 2648261 - RNA, 16 nt, Escherichia coli CFT073
cgaauccuuauauaaa

SEQ ID NO: 2648262 - RNA, 13 nt, Escherichia coli CFT073
cgaauccuucccc

SEQ ID NO: 2648263 - RNA, 21 nt, Escherichia coli CFT073
cgaauccuucccccaccacca

SEQ ID NO: 2648264 - RNA, 16 nt, Escherichia coli CFT073
cgaaucuucauagucu

SEQ ID NO: 2648265 - RNA, 13 nt, Escherichia coli CFT073
cgaaugacaugcc

SEQ ID NO: 2648266 - RNA, 15 nt, Escherichia coli CFT073
cgaaugcaggcgcgc

SEQ ID NO: 2648267 - RNA, 19 nt, Escherichia coli CFT073
cgaaugccgcagcacccug

SEQ ID NO: 2648268 - RNA, 22 nt, Escherichia coli CFT073
cgaaugggugaacccggcgauu

SEQ ID NO: 2648269 - RNA, 18 nt, Escherichia coli CFT073
cgaauguacgucaggcca

SEQ ID NO: 2648270 - RNA, 19 nt, Escherichia coli CFT073
cgaauuaacaccaccagcg

SEQ ID NO: 2648271 - RNA, 14 nt, Escherichia coli CFT073
cgaauuauucagag

SEQ ID NO: 2648272 - RNA, 11 nt, Escherichia coli CFT073
cgaauuccuga

SEQ ID NO: 2648273 - RNA, 19 nt, Escherichia coli CFT073
cgaauuccugacuuacuuc

SEQ ID NO: 2648274 - RNA, 19 nt, Escherichia coli CFT073
cgaauugagaugacgccac

SEQ ID NO: 2648275 - RNA, 15 nt, Escherichia coli CFT073
cgaauugcagaacgc

SEQ ID NO: 2648276 - RNA, 22 nt, Escherichia coli CFT073
cgaauugcaucuacgcucucuu

SEQ ID NO: 2648277 - RNA, 13 nt, Escherichia coli CFT073
cgaauuuccugcc

SEQ ID NO: 2648278 - RNA, 14 nt, Escherichia coli CFT073
cgacaaaaacccug

SEQ ID NO: 2648279 - RNA, 18 nt, Escherichia coli CFT073
cgacaaaaacccugccgu

SEQ ID NO: 2648280 - RNA, 20 nt, Escherichia coli CFT073
cgacaaaaauaccaccaaug

SEQ ID NO: 2648281 - RNA, 15 nt, Escherichia coli CFT073
cgacaaaauccccuu

SEQ ID NO: 2648282 - RNA, 15 nt, Escherichia coli CFT073
cgacaaacaccgaac

SEQ ID NO: 2648283 - RNA, 19 nt, Escherichia coli CFT073
cgacaaacgccggauggca

SEQ ID NO: 2648284 - RNA, 20 nt, Escherichia coli CFT073
cgacaaacgcuguaauuacc

SEQ ID NO: 2648285 - RNA, 23 nt, Escherichia coli CFT073
cgacaaacgcuguaauuaccagc

SEQ ID NO: 2648286 - RNA, 21 nt, Escherichia coli CFT073
cgacaaagccucuauggaagu

SEQ ID NO: 2648287 - RNA, 12 nt, Escherichia coli CFT073
cgacaaaguuga

SEQ ID NO: 2648288 - RNA, 21 nt, Escherichia coli CFT073
cgacgaggcgcuggcgcaugu

SEQ ID NO: 2648289 - RNA, 18 nt, Escherichia coli CFT073
cgacgauaccgccgcaca

SEQ ID NO: 2648290 - RNA, 16 nt, Escherichia coli CFT073
cgacgauacgcccgga

SEQ ID NO: 2648291 - RNA, 14 nt, Escherichia coli CFT073
cgacgcagcagacg

SEQ ID NO: 2648292 - RNA, 19 nt, Escherichia coli CFT073
cgacgcagguuucgauuaa

SEQ ID NO: 2648293 - RNA, 17 nt, Escherichia coli CFT073
cgacgcaguucaccugg

SEQ ID NO: 2648294 - RNA, 18 nt, Escherichia coli CFT073
cgacgccagcguucaaac

SEQ ID NO: 2648295 - RNA, 15 nt, Escherichia coli CFT073
cgacgcgacauccag

SEQ ID NO: 2648296 - RNA, 16 nt, Escherichia coli CFT073
cgacgcgccagcagcg

SEQ ID NO: 2648297 - RNA, 13 nt, Escherichia coli CFT073
cgacgcgcuggca

SEQ ID NO: 2648298 - RNA, 13 nt, Escherichia coli CFT073
cgacgcggcagcg

SEQ ID NO: 2648299 - RNA, 20 nt, Escherichia coli CFT073
cgacgcuccugaucaagcug

SEQ ID NO: 2648300 - RNA, 23 nt, Escherichia coli CFT073
cgacgcuccugaucaagcuggcg

SEQ ID NO: 2648301 - RNA, 21 nt, Escherichia coli CFT073
cgacgcugaagucagcacauc

SEQ ID NO: 2648302 - RNA, 15 nt, Escherichia coli CFT073
cgacgcugauagcgu

SEQ ID NO: 2648303 - RNA, 14 nt, Escherichia coli CFT073
cgacgcuggcgcgu

SEQ ID NO: 2648304 - RNA, 23 nt, Escherichia coli CFT073
cgacgcugguugcgucuuaucag

SEQ ID NO: 2648305 - RNA, 14 nt, Escherichia coli CFT073
cgacgcugucgcgu

SEQ ID NO: 2648306 - RNA, 15 nt, Escherichia coli CFT073
cgacgcuugaugcgu

SEQ ID NO: 2648307 - RNA, 18 nt, Escherichia coli CFT073
cgacgcuugccgcgucuu

SEQ ID NO: 2648308 - RNA, 23 nt, Escherichia coli CFT073
cgacgcuugccgcgucuuaucag

SEQ ID NO: 2648309 - RNA, 17 nt, Escherichia coli CFT073
cgacggacgcccgccga

SEQ ID NO: 2648310 - RNA, 12 nt, Escherichia coli CFT073
cgacggcauaag

SEQ ID NO: 2648311 - RNA, 20 nt, Escherichia coli CFT073
cgacggcauaagaaacacac

SEQ ID NO: 2648312 - RNA, 18 nt, Escherichia coli CFT073
cgacggcgcacaggcaau

SEQ ID NO: 2648313 - RNA, 11 nt, Escherichia coli CFT073
cgacgggcgac

SEQ ID NO: 2648314 - RNA, 12 nt, Escherichia coli CFT073
cgacgggcuaau

SEQ ID NO: 2648315 - RNA, 17 nt, Escherichia coli CFT073
cgacgguaaaccacgcc

SEQ ID NO: 2648316 - RNA, 18 nt, Escherichia coli CFT073
cgacgguaaaccacgcca

SEQ ID NO: 2648317 - RNA, 15 nt, Escherichia coli CFT073
cgacgguauuaacuc

SEQ ID NO: 2648318 - RNA, 13 nt, Escherichia coli CFT073
cgacgguuaaauu

SEQ ID NO: 2648319 - RNA, 14 nt, Escherichia coli CFT073
cgacgucagcagau

SEQ ID NO: 2648320 - RNA, 20 nt, Escherichia coli CFT073
cgacgucgauuucuggaugg

SEQ ID NO: 2648321 - RNA, 18 nt, Escherichia coli CFT073
cgacgucgguuuccagca

SEQ ID NO: 2648322 - RNA, 15 nt, Escherichia coli CFT073
cgacguuacgcgcca

SEQ ID NO: 2648323 - RNA, 14 nt, Escherichia coli CFT073
cgacguugcuucuc

SEQ ID NO: 2648324 - RNA, 16 nt, Escherichia coli CFT073
cgacguuuuacagcaa

SEQ ID NO: 2648325 - RNA, 21 nt, Escherichia coli CFT073
cgacguuuuccaucgaccagc

SEQ ID NO: 2648326 - RNA, 18 nt, Escherichia coli CFT073
cgacucaaaucacgcagu

SEQ ID NO: 2648327 - RNA, 18 nt, Escherichia coli CFT073
cgacucaagcguugcgga

SEQ ID NO: 2648328 - RNA, 17 nt, Escherichia coli CFT073
cgacuccagcgcuucgc

SEQ ID NO: 2648329 - RNA, 17 nt, Escherichia coli CFT073
cgacucgcgaaucgccg

SEQ ID NO: 2648330 - RNA, 19 nt, Escherichia coli CFT073
cgacucggugcgcccgcca

SEQ ID NO: 2648331 - RNA, 15 nt, Escherichia coli CFT073
cgacucguuguguga

SEQ ID NO: 2648332 - RNA, 21 nt, Escherichia coli CFT073
cgacugaaaggucaucaucac

SEQ ID NO: 2648333 - RNA, 16 nt, Escherichia coli CFT073
cgacugaaccagcgcc

SEQ ID NO: 2648334 - RNA, 17 nt, Escherichia coli CFT073
cgacugauaucugcccg

SEQ ID NO: 2648335 - RNA, 12 nt, Escherichia coli CFT073
cgacugaugaag

SEQ ID NO: 2648336 - RNA, 23 nt, Escherichia coli CFT073
cgacugcaagccaugacgcacuu

SEQ ID NO: 2648337 - RNA, 15 nt, Escherichia coli CFT073
cgacugcgccuucca

SEQ ID NO: 2648338 - RNA, 14 nt, Escherichia coli CFT073
cgacuggcgcggca

SEQ ID NO: 2648339 - RNA, 17 nt, Escherichia coli CFT073
cgacuggggcuggaaga

SEQ ID NO: 2648340 - RNA, 15 nt, Escherichia coli CFT073
cgacugucuuccugc

SEQ ID NO: 2648341 - RNA, 19 nt, Escherichia coli CFT073
cgacuguucgccaaaaggc

SEQ ID NO: 2648342 - RNA, 22 nt, Escherichia coli CFT073
cgacuguuuauuguugauucga

SEQ ID NO: 2648343 - RNA, 18 nt, Escherichia coli CFT073
cgacuuauucuucaacaa

SEQ ID NO: 2648344 - RNA, 15 nt, Escherichia coli CFT073
cgacuuccaccagcg

SEQ ID NO: 2648345 - RNA, 16 nt, Escherichia coli CFT073
cgacuuccaccagcgg

SEQ ID NO: 2648346 - RNA, 21 nt, Escherichia coli CFT073
cgacuuccugcaaucuuuccu

SEQ ID NO: 2648347 - RNA, 18 nt, Escherichia coli CFT073
cgacuucgauguccgcuc

SEQ ID NO: 2648348 - RNA, 13 nt, Escherichia coli CFT073
cgacuucucgcaa

SEQ ID NO: 2648349 - RNA, 14 nt, Escherichia coli CFT073
cgacuuugccuggc

SEQ ID NO: 2648350 - RNA, 17 nt, Escherichia coli CFT073
cgagaaaagccaaccug

SEQ ID NO: 2648351 - RNA, 21 nt, Escherichia coli CFT073
cgagaaaagccaaccugcagg

SEQ ID NO: 2648352 - RNA, 17 nt, Escherichia coli CFT073
cgagaaauugagauaag

SEQ ID NO: 2648353 - RNA, 23 nt, Escherichia coli CFT073
cgagaagccgaccagcaccgcca

SEQ ID NO: 2648354 - RNA, 20 nt, Escherichia coli CFT073
cgagaaguuuuucgucaccu

SEQ ID NO: 2648355 - RNA, 18 nt, Escherichia coli CFT073
cgagaauaaaacaagcag

SEQ ID NO: 2648356 - RNA, 20 nt, Escherichia coli CFT073
cgagaauaucuucgaccguc

SEQ ID NO: 2648357 - RNA, 19 nt, Escherichia coli CFT073
cgagaaucugccgcaguac

SEQ ID NO: 2648358 - RNA, 14 nt, Escherichia coli CFT073
cgagaauuuccaga

SEQ ID NO: 2648359 - RNA, 17 nt, Escherichia coli CFT073
cgagagaauuaaccaga

SEQ ID NO: 2648360 - RNA, 20 nt, Escherichia coli CFT073
cgagagacgcuugucaccgu

SEQ ID NO: 2648361 - RNA, 16 nt, Escherichia coli CFT073
cgagagccuucggcaa

SEQ ID NO: 2648362 - RNA, 19 nt, Escherichia coli CFT073
cgagagcgggaaaacauac

SEQ ID NO: 2648363 - RNA, 14 nt, Escherichia coli CFT073
cgagaggaauuuau

SEQ ID NO: 2648364 - RNA, 14 nt, Escherichia coli CFT073
cgagauaaaugcca

SEQ ID NO: 2648365 - RNA, 15 nt, Escherichia coli CFT073
cgagauaaugcgcca

SEQ ID NO: 2648366 - RNA, 18 nt, Escherichia coli CFT073
cgagauacagguugccga

SEQ ID NO: 2648367 - RNA, 14 nt, Escherichia coli CFT073
cgagauacucaagc

SEQ ID NO: 2648368 - RNA, 21 nt, Escherichia coli CFT073
cgagauauuucaccagcgcac

SEQ ID NO: 2648369 - RNA, 22 nt, Escherichia coli CFT073
cgagaucuucgccaucccggca

SEQ ID NO: 2648370 - RNA, 20 nt, Escherichia coli CFT073
cgagauuacuaacaaagugc

SEQ ID NO: 2648371 - RNA, 20 nt, Escherichia coli CFT073
cgagauuagacggcgcaaca

SEQ ID NO: 2648372 - RNA, 19 nt, Escherichia coli CFT073
cgagauucauccaguucca

SEQ ID NO: 2648373 - RNA, 12 nt, Escherichia coli CFT073
cgagauugugaa

SEQ ID NO: 2648374 - RNA, 18 nt, Escherichia coli CFT073
cgagcaauaaacacugcu

SEQ ID NO: 2648375 - RNA, 20 nt, Escherichia coli CFT073
cgagcagaaucgguccgcca

SEQ ID NO: 2648376 - RNA, 21 nt, Escherichia coli CFT073
cgagcagaaucgguccgccac

SEQ ID NO: 2648377 - RNA, 15 nt, Escherichia coli CFT073
cgagcagagaaacgc

SEQ ID NO: 2648378 - RNA, 23 nt, Escherichia coli CFT073
cgagcagagaaacgccagcagca

SEQ ID NO: 2648379 - RNA, 13 nt, Escherichia coli CFT073
cgagcagcaauau

SEQ ID NO: 2648380 - RNA, 19 nt, Escherichia coli CFT073
cgagcagcaauauagcgca

SEQ ID NO: 2648381 - RNA, 19 nt, Escherichia coli CFT073
cgagcagccacugcggcau

SEQ ID NO: 2648382 - RNA, 15 nt, Escherichia coli CFT073
cgagcagcuccugcu

SEQ ID NO: 2648383 - RNA, 23 nt, Escherichia coli CFT073
cgagcaguaauccagcaaacugg

SEQ ID NO: 2648384 - RNA, 19 nt, Escherichia coli CFT073
cgagcauccgauccuggac

SEQ ID NO: 2648385 - RNA, 12 nt, Escherichia coli CFT073
cgagcaucgcga

SEQ ID NO: 2648386 - RNA, 22 nt, Escherichia coli CFT073
cgagcauuucggcuuuauuuuc

SEQ ID NO: 2648387 - RNA, 18 nt, Escherichia coli CFT073
cgagcauuuucagcguuu

SEQ ID NO: 2648388 - RNA, 17 nt, Escherichia coli CFT073
cgagccaaacgcccagc

SEQ ID NO: 2648389 - RNA, 12 nt, Escherichia coli CFT073
cgagccagcgca

SEQ ID NO: 2648390 - RNA, 15 nt, Escherichia coli CFT073
cgagccauaaaauca

SEQ ID NO: 2648391 - RNA, 15 nt, Escherichia coli CFT073
cgagccauaaaccga

SEQ ID NO: 2648392 - RNA, 16 nt, Escherichia coli CFT073
cgagccgguugccuga

SEQ ID NO: 2648393 - RNA, 22 nt, Escherichia coli CFT073
cgagccgucccuaacaugccac

SEQ ID NO: 2648394 - RNA, 18 nt, Escherichia coli CFT073
cgagccgucgcuaucgau

SEQ ID NO: 2648395 - RNA, 14 nt, Escherichia coli CFT073
cgagcgaauaaacc

SEQ ID NO: 2648396 - RNA, 23 nt, Escherichia coli CFT073
cgauauggcugcgcuugaggaug

SEQ ID NO: 2648397 - RNA, 15 nt, Escherichia coli CFT073
cgauauguucaggau

SEQ ID NO: 2648398 - RNA, 19 nt, Escherichia coli CFT073
cgauauuaguggcaaccgc

SEQ ID NO: 2648399 - RNA, 22 nt, Escherichia coli CFT073
cgauauuaguggcaaccgcaac

SEQ ID NO: 2648400 - RNA, 19 nt, Escherichia coli CFT073
cgauauucauuuugcugga

SEQ ID NO: 2648401 - RNA, 14 nt, Escherichia coli CFT073
cgaucaacagaaug

SEQ ID NO: 2648402 - RNA, 19 nt, Escherichia coli CFT073
cgaucaagagauccgcacu

SEQ ID NO: 2648403 - RNA, 13 nt, Escherichia coli CFT073
cgaucaccacaau

SEQ ID NO: 2648404 - RNA, 15 nt, Escherichia coli CFT073
cgaucaccgcaauga

SEQ ID NO: 2648405 - RNA, 15 nt, Escherichia coli CFT073
cgaucagacgaucgc

SEQ ID NO: 2648406 - RNA, 14 nt, Escherichia coli CFT073
cgaucagccauacc

SEQ ID NO: 2648407 - RNA, 21 nt, Escherichia coli CFT073
cgaucaggaacuguugcaaaa

SEQ ID NO: 2648408 - RNA, 15 nt, Escherichia coli CFT073
cgaucaguaccagcc

SEQ ID NO: 2648409 - RNA, 19 nt, Escherichia coli CFT073
cgaucaguaccagcccgcc

SEQ ID NO: 2648410 - RNA, 14 nt, Escherichia coli CFT073
cgaucaucaccugc

SEQ ID NO: 2648411 - RNA, 19 nt, Escherichia coli CFT073
cgaucaucgacaguaccag

SEQ ID NO: 2648412 - RNA, 17 nt, Escherichia coli CFT073
cgaucaugauaaauaau

SEQ ID NO: 2648413 - RNA, 13 nt, Escherichia coli CFT073
cgaucauuaacac

SEQ ID NO: 2648414 - RNA, 17 nt, Escherichia coli CFT073
cgauccaccaccgcaaa

SEQ ID NO: 2648415 - RNA, 14 nt, Escherichia coli CFT073
cgauccagcgcaau

SEQ ID NO: 2648416 - RNA, 15 nt, Escherichia coli CFT073
cgauccagugauucc

SEQ ID NO: 2648417 - RNA, 22 nt, Escherichia coli CFT073
cgaucccaacugaucugccagc

SEQ ID NO: 2648418 - RNA, 15 nt, Escherichia coli CFT073
cgaucccaugccgaa

SEQ ID NO: 2648419 - RNA, 19 nt, Escherichia coli CFT073
cgauccccaaagagagcac

SEQ ID NO: 2648420 - RNA, 18 nt, Escherichia coli CFT073
cgaucccgguuaacugca

SEQ ID NO: 2648421 - RNA, 21 nt, Escherichia coli CFT073
cgaucccgguuaacugcaugu

SEQ ID NO: 2648422 - RNA, 16 nt, Escherichia coli CFT073
cgauccgacaucccgc

SEQ ID NO: 2648423 - RNA, 13 nt, Escherichia coli CFT073
cgauccggcacca

SEQ ID NO: 2648424 - RNA, 11 nt, Escherichia coli CFT073
cgauccgggua

SEQ ID NO: 2648425 - RNA, 23 nt, Escherichia coli CFT073
cgauccugauacagaccgcgcag

SEQ ID NO: 2648426 - RNA, 22 nt, Escherichia coli CFT073
cgauccuggacgcagaauggcg

SEQ ID NO: 2648427 - RNA, 14 nt, Escherichia coli CFT073
cgauccuggucagg

SEQ ID NO: 2648428 - RNA, 20 nt, Escherichia coli CFT073
cgaucgcccggcaccagcac

SEQ ID NO: 2648429 - RNA, 19 nt, Escherichia coli CFT073
cgaucgccgcacccgccag

SEQ ID NO: 2648430 - RNA, 19 nt, Escherichia coli CFT073
cgaucgccguuaaccauaa

SEQ ID NO: 2648431 - RNA, 15 nt, Escherichia coli CFT073
cgaucgccugcugga

SEQ ID NO: 2648432 - RNA, 18 nt, Escherichia coli CFT073
cgaucgcgccaaucagcg

SEQ ID NO: 2648433 - RNA, 20 nt, Escherichia coli CFT073
cgaucgcgccaaucagcgca

SEQ ID NO: 2648434 - RNA, 14 nt, Escherichia coli CFT073
cgaucgcugaugaa

SEQ ID NO: 2648435 - RNA, 14 nt, Escherichia coli CFT073
cgaucggcaggaaa

SEQ ID NO: 2648436 - RNA, 17 nt, Escherichia coli CFT073
cgaucggcaucgggcca

SEQ ID NO: 2648437 - RNA, 20 nt, Escherichia coli CFT073
cgaucggcguguuucaucuc

SEQ ID NO: 2648438 - RNA, 16 nt, Escherichia coli CFT073
cgaucgggaacaggcu

SEQ ID NO: 2648439 - RNA, 14 nt, Escherichia coli CFT073
cgaucguccagcug

SEQ ID NO: 2648440 - RNA, 22 nt, Escherichia coli CFT073
cgaucgucgcucacuucacgcu

SEQ ID NO: 2648441 - RNA, 23 nt, Escherichia coli CFT073
cgaucgugauacaacugccgcgc

SEQ ID NO: 2648442 - RNA, 16 nt, Escherichia coli CFT073
cgaucgugauagcgca

SEQ ID NO: 2648443 - RNA, 23 nt, Escherichia coli CFT073
cgaucucccgcuuuggcaucuuc

SEQ ID NO: 2648444 - RNA, 15 nt, Escherichia coli CFT073
cgaucucggucacca

SEQ ID NO: 2648445 - RNA, 16 nt, Escherichia coli CFT073
cgaucucggucaccag

SEQ ID NO: 2648446 - RNA, 17 nt, Escherichia coli CFT073
cgaucucuuuauuugau

SEQ ID NO: 2648447 - RNA, 23 nt, Escherichia coli CFT073
cgaucuuccgaccgcccuuuuuc

SEQ ID NO: 2648448 - RNA, 15 nt, Escherichia coli CFT073
cgaucuuuugucgcu

SEQ ID NO: 2648449 - RNA, 21 nt, Escherichia coli CFT073
cgaugaaaaaccuuaaagcga

SEQ ID NO: 2648450 - RNA, 18 nt, Escherichia coli CFT073
cgaugaagucgaucagac

SEQ ID NO: 2648451 - RNA, 18 nt, Escherichia coli CFT073
cgaugacagaaucagcag

SEQ ID NO: 2648452 - RNA, 20 nt, Escherichia coli CFT073
cgaugacagaaucagcagcg

SEQ ID NO: 2648453 - RNA, 22 nt, Escherichia coli CFT073
cgaugaccaaaaacguugccgu

SEQ ID NO: 2648454 - RNA, 13 nt, Escherichia coli CFT073
cgaugaccgccac

SEQ ID NO: 2648455 - RNA, 15 nt, Escherichia coli CFT073
cgaugaccgccacgg

SEQ ID NO: 2648456 - RNA, 21 nt, Escherichia coli CFT073
cgaugagcugcaacuggcggc

SEQ ID NO: 2648457 - RNA, 15 nt, Escherichia coli CFT073
cgaugaucaaaaaaa

SEQ ID NO: 2648458 - RNA, 24 nt, Escherichia coli CFT073
cgaugaucgccgccagugccacca

SEQ ID NO: 2648459 - RNA, 21 nt, Escherichia coli CFT073
cgaugaugaucggcguaccca

SEQ ID NO: 2648460 - RNA, 13 nt, Escherichia coli CFT073
cgaugauuguccc

SEQ ID NO: 2648461 - RNA, 16 nt, Escherichia coli CFT073
cgaugauuuccgccag

SEQ ID NO: 2648462 - RNA, 16 nt, Escherichia coli CFT073
cgaugcaaauuuuuaa

SEQ ID NO: 2648463 - RNA, 19 nt, Escherichia coli CFT073
cgaugcacagcucugaaua

SEQ ID NO: 2648464 - RNA, 22 nt, Escherichia coli CFT073
cgaugcacucgccaggaugggc

SEQ ID NO: 2648465 - RNA, 12 nt, Escherichia coli CFT073
cgaugcagcgca

SEQ ID NO: 2648466 - RNA, 21 nt, Escherichia coli CFT073
cgaugcauaauccgccgcugu

SEQ ID NO: 2648467 - RNA, 16 nt, Escherichia coli CFT073
cgaugccaauauccug

SEQ ID NO: 2648468 - RNA, 14 nt, Escherichia coli CFT073
cgaugccagcgcug

SEQ ID NO: 2648469 - RNA, 17 nt, Escherichia coli CFT073
cgaugccagcgcuguua

SEQ ID NO: 2648470 - RNA, 22 nt, Escherichia coli CFT073
cgaugcccccaggagcgcggca

SEQ ID NO: 2648471 - RNA, 17 nt, Escherichia coli CFT073
cgaugccucaucacaaa

SEQ ID NO: 2648472 - RNA, 15 nt, Escherichia coli CFT073
cgaugcgaccgccgc

SEQ ID NO: 2648473 - RNA, 17 nt, Escherichia coli CFT073
cgaugcgcuggcgcaac

SEQ ID NO: 2648474 - RNA, 23 nt, Escherichia coli CFT073
cgaugcucuguguaggccggaua

SEQ ID NO: 2648475 - RNA, 15 nt, Escherichia coli CFT073
cgaugcuguuauaca

SEQ ID NO: 2648476 - RNA, 23 nt, Escherichia coli CFT073
cgaugcuuuacguauccguucca

SEQ ID NO: 2648477 - RNA, 19 nt, Escherichia coli CFT073
cgaugcuuugaccucccgc

SEQ ID NO: 2648478 - RNA, 17 nt, Escherichia coli CFT073
cgauggaaaacaacacc

SEQ ID NO: 2648479 - RNA, 21 nt, Escherichia coli CFT073
cgauggauggggcgucaacgc

SEQ ID NO: 2648480 - RNA, 20 nt, Escherichia coli CFT073
cgauggcagaaaucaacggc

SEQ ID NO: 2648481 - RNA, 19 nt, Escherichia coli CFT073
cgauggcccgcuugccaga

SEQ ID NO: 2648482 - RNA, 16 nt, Escherichia coli CFT073
cgauggcgauucagca

SEQ ID NO: 2648483 - RNA, 16 nt, Escherichia coli CFT073
cgauggcgggccugga

SEQ ID NO: 2648484 - RNA, 18 nt, Escherichia coli CFT073
cgauggcgggccuggaag

SEQ ID NO: 2648485 - RNA, 14 nt, Escherichia coli CFT073
cgauggcuccggaa

SEQ ID NO: 2648486 - RNA, 12 nt, Escherichia coli CFT073
cgauggcugggg

SEQ ID NO: 2648487 - RNA, 17 nt, Escherichia coli CFT073
cgauggcuucuggcugc

SEQ ID NO: 2648488 - RNA, 20 nt, Escherichia coli CFT073
cgaugggugaucaagcguag

SEQ ID NO: 2648489 - RNA, 15 nt, Escherichia coli CFT073
cgauggguuugaaaa

SEQ ID NO: 2648490 - RNA, 18 nt, Escherichia coli CFT073
cgauggucauauccagca

SEQ ID NO: 2648491 - RNA, 17 nt, Escherichia coli CFT073
cgauggugaugagcuga

SEQ ID NO: 2648492 - RNA, 23 nt, Escherichia coli CFT073
cgaugguucaagacgaauaccuu

SEQ ID NO: 2648493 - RNA, 20 nt, Escherichia coli CFT073
cgaugguugcugucaacuga

SEQ ID NO: 2648494 - RNA, 14 nt, Escherichia coli CFT073
cgauguaauucagc

SEQ ID NO: 2648495 - RNA, 18 nt, Escherichia coli CFT073
cgauguaauucagccauu

SEQ ID NO: 2648496 - RNA, 18 nt, Escherichia coli CFT073
cgauguagcgauuuacua

SEQ ID NO: 2648497 - RNA, 18 nt, Escherichia coli CFT073
cgauguggcucagccaga

SEQ ID NO: 2648498 - RNA, 13 nt, Escherichia coli CFT073
cgauguuaccguu

SEQ ID NO: 2648499 - RNA, 12 nt, Escherichia coli CFT073
cgauguucaaua

SEQ ID NO: 2648500 - RNA, 13 nt, Escherichia coli CFT073
cgauguuugcugc

SEQ ID NO: 2648501 - RNA, 16 nt, Escherichia coli CFT073
cgauguuuucugccuc

SEQ ID NO: 2648502 - RNA, 21 nt, Escherichia coli CFT073
cgauuaagaaugcgaaaacga

SEQ ID NO: 2648503 - RNA, 16 nt, Escherichia coli CFT073
cgauuaaucaccggag

SEQ ID NO: 2648504 - RNA, 13 nt, Escherichia coli CFT073
cgcacaagcguca

SEQ ID NO: 2648505 - RNA, 22 nt, Escherichia coli CFT073
cgcacaaugccguaaccagcgc

SEQ ID NO: 2648506 - RNA, 15 nt, Escherichia coli CFT073
cgcacacgcgcugag

SEQ ID NO: 2648507 - RNA, 16 nt, Escherichia coli CFT073
cgcacagcaguugcag

SEQ ID NO: 2648508 - RNA, 19 nt, Escherichia coli CFT073
cgcacagcccgccgccauc

SEQ ID NO: 2648509 - RNA, 14 nt, Escherichia coli CFT073
cgcacauugugcgc

SEQ ID NO: 2648510 - RNA, 16 nt, Escherichia coli CFT073
cgcaccaaccacugcu

SEQ ID NO: 2648511 - RNA, 16 nt, Escherichia coli CFT073
cgcaccaaccaucagg

SEQ ID NO: 2648512 - RNA, 20 nt, Escherichia coli CFT073
cgcaccaacuccacuucacc

SEQ ID NO: 2648513 - RNA, 22 nt, Escherichia coli CFT073
cgcaccaacuccucuuugcugc

SEQ ID NO: 2648514 - RNA, 12 nt, Escherichia coli CFT073
cgcaccagcagg

SEQ ID NO: 2648515 - RNA, 16 nt, Escherichia coli CFT073
cgcaccagcaggccgu

SEQ ID NO: 2648516 - RNA, 13 nt, Escherichia coli CFT073
cgcaccagcuuuc

SEQ ID NO: 2648517 - RNA, 23 nt, Escherichia coli CFT073
cgcaccaggcgaaaacgcugacc

SEQ ID NO: 2648518 - RNA, 18 nt, Escherichia coli CFT073
cgcaccgaagucuuaagu

SEQ ID NO: 2648519 - RNA, 16 nt, Escherichia coli CFT073
cgcaccgaccaucggc

SEQ ID NO: 2648520 - RNA, 19 nt, Escherichia coli CFT073
cgcaccgagugguucauca

SEQ ID NO: 2648521 - RNA, 19 nt, Escherichia coli CFT073
cgcaccgguaucugccagc

SEQ ID NO: 2648522 - RNA, 16 nt, Escherichia coli CFT073
cgcaccugccagcgcc

SEQ ID NO: 2648523 - RNA, 22 nt, Escherichia coli CFT073
cgcaccuugccaaauuuacugu

SEQ ID NO: 2648524 - RNA, 15 nt, Escherichia coli CFT073
cgcacgaacuaccgu

SEQ ID NO: 2648525 - RNA, 20 nt, Escherichia coli CFT073
cgcacgaggaacagcgcgcu

SEQ ID NO: 2648526 - RNA, 16 nt, Escherichia coli CFT073
cgcacgcaacccgcuc

SEQ ID NO: 2648527 - RNA, 17 nt, Escherichia coli CFT073
cgcacgcguaauaucca

SEQ ID NO: 2648528 - RNA, 16 nt, Escherichia coli CFT073
cgcacgcugucgccag

SEQ ID NO: 2648529 - RNA, 21 nt, Escherichia coli CFT073
cgcacggcacacuuucaucaa

SEQ ID NO: 2648530 - RNA, 15 nt, Escherichia coli CFT073
cgcacgggcaguuaa

SEQ ID NO: 2648531 - RNA, 21 nt, Escherichia coli CFT073
cgcacguucugucgcucugcu

SEQ ID NO: 2648532 - RNA, 14 nt, Escherichia coli CFT073
cgcacguugccagc

SEQ ID NO: 2648533 - RNA, 18 nt, Escherichia coli CFT073
cgcacguugccagcaacu

SEQ ID NO: 2648534 - RNA, 20 nt, Escherichia coli CFT073
cgcacguuguuaacaaucuu

SEQ ID NO: 2648535 - RNA, 12 nt, Escherichia coli CFT073
cgcacuacgccg

SEQ ID NO: 2648536 - RNA, 16 nt, Escherichia coli CFT073
cgcacuauacaaccag

SEQ ID NO: 2648537 - RNA, 15 nt, Escherichia coli CFT073
cgcacuauuuaccgc

SEQ ID NO: 2648538 - RNA, 18 nt, Escherichia coli CFT073
cgcacucuacucccugcu

SEQ ID NO: 2648539 - RNA, 13 nt, Escherichia coli CFT073
cgcacugcaauau

SEQ ID NO: 2648540 - RNA, 13 nt, Escherichia coli CFT073
cgcacugccgcca

SEQ ID NO: 2648541 - RNA, 17 nt, Escherichia coli CFT073
cgcacugccgccaugcg

SEQ ID NO: 2648542 - RNA, 15 nt, Escherichia coli CFT073
cgcacuggcgcgccu

SEQ ID NO: 2648543 - RNA, 19 nt, Escherichia coli CFT073
cgcacuggguggcccggag

SEQ ID NO: 2648544 - RNA, 13 nt, Escherichia coli CFT073
cgcacugucgcca

SEQ ID NO: 2648545 - RNA, 18 nt, Escherichia coli CFT073
cgcacuuaaaaugcgcuc

SEQ ID NO: 2648546 - RNA, 15 nt, Escherichia coli CFT073
cgcacuuacagcaac

SEQ ID NO: 2648547 - RNA, 16 nt, Escherichia coli CFT073
cgcacuucuuccgggc

SEQ ID NO: 2648548 - RNA, 21 nt, Escherichia coli CFT073
cgcacuucuucguuuucugcg

SEQ ID NO: 2648549 - RNA, 19 nt, Escherichia coli CFT073
cgcacuuucuccggcagcu

SEQ ID NO: 2648550 - RNA, 23 nt, Escherichia coli CFT073
cgcacuuuucccacuaacugcgc

SEQ ID NO: 2648551 - RNA, 22 nt, Escherichia coli CFT073
cgcagaaauucguaauccauag

SEQ ID NO: 2648552 - RNA, 22 nt, Escherichia coli CFT073
cgcagaagcauaccgaucgcgg

SEQ ID NO: 2648553 - RNA, 15 nt, Escherichia coli CFT073
cgcagaaucucugcg

SEQ ID NO: 2648554 - RNA, 20 nt, Escherichia coli CFT073
cgcagaauggcgaacgcuaa

SEQ ID NO: 2648555 - RNA, 13 nt, Escherichia coli CFT073
cgcagacaaggcg

SEQ ID NO: 2648556 - RNA, 13 nt, Escherichia coli CFT073
cgcagacaccaga

SEQ ID NO: 2648557 - RNA, 16 nt, Escherichia coli CFT073
cgcagacaccagaaua

SEQ ID NO: 2648558 - RNA, 18 nt, Escherichia coli CFT073
cgcagaccaaccgucaga

SEQ ID NO: 2648559 - RNA, 19 nt, Escherichia coli CFT073
cgcagagccugaauaaacg

SEQ ID NO: 2648560 - RNA, 15 nt, Escherichia coli CFT073
cgcagaucauccggc

SEQ ID NO: 2648561 - RNA, 20 nt, Escherichia coli CFT073
cgcagaucauccggcacgcu

SEQ ID NO: 2648562 - RNA, 15 nt, Escherichia coli CFT073
cgcagauccagugcu

SEQ ID NO: 2648563 - RNA, 17 nt, Escherichia coli CFT073
cgcagaucccacucauc

SEQ ID NO: 2648564 - RNA, 17 nt, Escherichia coli CFT073
cgcagcaacaucacgcu

SEQ ID NO: 2648565 - RNA, 18 nt, Escherichia coli CFT073
cgcagcaacaucacgcug

SEQ ID NO: 2648566 - RNA, 19 nt, Escherichia coli CFT073
cgcagcaaguucagcguca

SEQ ID NO: 2648567 - RNA, 20 nt, Escherichia coli CFT073
cgcagcagauaaaagaccac

SEQ ID NO: 2648568 - RNA, 19 nt, Escherichia coli CFT073
cgcagcaucagcgccuggg

SEQ ID NO: 2648569 - RNA, 15 nt, Escherichia coli CFT073
cgcagcaucgccauc

SEQ ID NO: 2648570 - RNA, 16 nt, Escherichia coli CFT073
cgcagcauuuccucaa

SEQ ID NO: 2648571 - RNA, 20 nt, Escherichia coli CFT073
cgcagcauuuccucaacauc

SEQ ID NO: 2648572 - RNA, 21 nt, Escherichia coli CFT073
cgcagccagcacugccgcauc

SEQ ID NO: 2648573 - RNA, 13 nt, Escherichia coli CFT073
cgcagccagcgca

SEQ ID NO: 2648574 - RNA, 14 nt, Escherichia coli CFT073
cgcagccagcgcac

SEQ ID NO: 2648575 - RNA, 15 nt, Escherichia coli CFT073
cgcagccagcgcacc

SEQ ID NO: 2648576 - RNA, 16 nt, Escherichia coli CFT073
cgcagccagcgcaccu

SEQ ID NO: 2648577 - RNA, 15 nt, Escherichia coli CFT073
cgcagccaguuaacc

SEQ ID NO: 2648578 - RNA, 12 nt, Escherichia coli CFT073
cgcagccccagc

SEQ ID NO: 2648579 - RNA, 12 nt, Escherichia coli CFT073
cgcagccgccac

SEQ ID NO: 2648580 - RNA, 13 nt, Escherichia coli CFT073
cgcagccgccaca

SEQ ID NO: 2648581 - RNA, 18 nt, Escherichia coli CFT073
cgcagccgccacaauaaa

SEQ ID NO: 2648582 - RNA, 12 nt, Escherichia coli CFT073
cgcagcgcagcg

SEQ ID NO: 2648583 - RNA, 15 nt, Escherichia coli CFT073
cgcagcgcagcgcca

SEQ ID NO: 2648584 - RNA, 16 nt, Escherichia coli CFT073
cgcagcgcagcgccaa

SEQ ID NO: 2648585 - RNA, 22 nt, Escherichia coli CFT073
cgcagcgccaacgcaacgcgcu

SEQ ID NO: 2648586 - RNA, 21 nt, Escherichia coli CFT073
cgcagcgcguuacgcccaagc

SEQ ID NO: 2648587 - RNA, 15 nt, Escherichia coli CFT073
cgcagcggaccgcuu

SEQ ID NO: 2648588 - RNA, 15 nt, Escherichia coli CFT073
cgcagcguccagcgc

SEQ ID NO: 2648589 - RNA, 14 nt, Escherichia coli CFT073
cgcagcuaucagcg

SEQ ID NO: 2648590 - RNA, 21 nt, Escherichia coli CFT073
cgcagcuauccugccggugau

SEQ ID NO: 2648591 - RNA, 19 nt, Escherichia coli CFT073
cgcagcucacuucgaucca

SEQ ID NO: 2648592 - RNA, 17 nt, Escherichia coli CFT073
cgcagcucauaaccguc

SEQ ID NO: 2648593 - RNA, 23 nt, Escherichia coli CFT073
cgcagcucuuuauccagcagcca

SEQ ID NO: 2648594 - RNA, 14 nt, Escherichia coli CFT073
cgcagcuuugugcu

SEQ ID NO: 2648595 - RNA, 19 nt, Escherichia coli CFT073
cgcagcuuugugcuucagu

SEQ ID NO: 2648596 - RNA, 22 nt, Escherichia coli CFT073
cgcagcuuugugcuucaguucc

SEQ ID NO: 2648597 - RNA, 12 nt, Escherichia coli CFT073
cgcaggagauug

SEQ ID NO: 2648598 - RNA, 15 nt, Escherichia coli CFT073
cgcaggagcggcgga

SEQ ID NO: 2648599 - RNA, 21 nt, Escherichia coli CFT073
cgcaggcaagccuugcagcca

SEQ ID NO: 2648600 - RNA, 14 nt, Escherichia coli CFT073
cgcaggcgcugaaa

SEQ ID NO: 2648601 - RNA, 21 nt, Escherichia coli CFT073
cgcaggcggcuggcaucggca

SEQ ID NO: 2648602 - RNA, 14 nt, Escherichia coli CFT073
cgcaggcugauaac

SEQ ID NO: 2648603 - RNA, 21 nt, Escherichia coli CFT073
cgcaggcuguuaccccugcgg

SEQ ID NO: 2648604 - RNA, 23 nt, Escherichia coli CFT073
cgcaggcuguuaccccugcggcc

SEQ ID NO: 2648605 - RNA, 15 nt, Escherichia coli CFT073
cgcagggauauuuca

SEQ ID NO: 2648606 - RNA, 23 nt, Escherichia coli CFT073
cgcagggaucauccacccgcagc

SEQ ID NO: 2648607 - RNA, 18 nt, Escherichia coli CFT073
cgcagggcgaauuccuga

SEQ ID NO: 2648608 - RNA, 19 nt, Escherichia coli CFT073
cgcagggcgaauuccugac

SEQ ID NO: 2648609 - RNA, 23 nt, Escherichia coli CFT073
cgcaggggauggaugcccccaga

SEQ ID NO: 2648610 - RNA, 17 nt, Escherichia coli CFT073
cgcagguaaucaaugcg

SEQ ID NO: 2648611 - RNA, 16 nt, Escherichia coli CFT073
cgcagguagcagcagc

SEQ ID NO: 2648612 - RNA, 20 nt, Escherichia coli CFT073
cgcagguagcagcagcgcca

SEQ ID NO: 2648613 - RNA, 13 nt, Escherichia coli CFT073
cgccaaagccagu

SEQ ID NO: 2648614 - RNA, 22 nt, Escherichia coli CFT073
cgccaaagccaguucggcagcc

SEQ ID NO: 2648615 - RNA, 15 nt, Escherichia coli CFT073
cgccaaaucguugcu

SEQ ID NO: 2648616 - RNA, 20 nt, Escherichia coli CFT073
cgccaaauggauaagaaaga

SEQ ID NO: 2648617 - RNA, 18 nt, Escherichia coli CFT073
cgccaaaugucaccagcc

SEQ ID NO: 2648618 - RNA, 20 nt, Escherichia coli CFT073
cgccaacaugcgcagaagca

SEQ ID NO: 2648619 - RNA, 20 nt, Escherichia coli CFT073
cgccaaccaggaugauauuc

SEQ ID NO: 2648620 - RNA, 23 nt, Escherichia coli CFT073
cgccaaccaugccgcccagcagc

SEQ ID NO: 2648621 - RNA, 20 nt, Escherichia coli CFT073
cgccaaccgcugauugcugg

SEQ ID NO: 2648622 - RNA, 19 nt, Escherichia coli CFT073
cgccaacgccugcggcuga

SEQ ID NO: 2648623 - RNA, 21 nt, Escherichia coli CFT073
cgccaacgccugcggcugaua

SEQ ID NO: 2648624 - RNA, 21 nt, Escherichia coli CFT073
cgccaacggugaaaaaccaau

SEQ ID NO: 2648625 - RNA, 21 nt, Escherichia coli CFT073
cgccaacguguugcugcaugu

SEQ ID NO: 2648626 - RNA, 23 nt, Escherichia coli CFT073
cgccaacuucaugaccuuccagc

SEQ ID NO: 2648627 - RNA, 15 nt, Escherichia coli CFT073
cgccaagcaucggca

SEQ ID NO: 2648628 - RNA, 21 nt, Escherichia coli CFT073
cgccaaguucgaacgccgcca

SEQ ID NO: 2648629 - RNA, 22 nt, Escherichia coli CFT073
cgccaaguucgaacgccgccag

SEQ ID NO: 2648630 - RNA, 19 nt, Escherichia coli CFT073
cgccaaguuucaauauccg

SEQ ID NO: 2648631 - RNA, 21 nt, Escherichia coli CFT073
cgccaauaaucugcccggcau

SEQ ID NO: 2648632 - RNA, 18 nt, Escherichia coli CFT073
cgccaauacgugaucgca

SEQ ID NO: 2648633 - RNA, 20 nt, Escherichia coli CFT073
cgccaauagccgcaccgagc

SEQ ID NO: 2648634 - RNA, 21 nt, Escherichia coli CFT073
cgccaauagccgcaccgagcg

SEQ ID NO: 2648635 - RNA, 14 nt, Escherichia coli CFT073
cgccaaucagcaua

SEQ ID NO: 2648636 - RNA, 13 nt, Escherichia coli CFT073
cgccaaucagcgc

SEQ ID NO: 2648637 - RNA, 20 nt, Escherichia coli CFT073
cgccaaucagcgcagcaccc

SEQ ID NO: 2648638 - RNA, 15 nt, Escherichia coli CFT073
cgccaaucgccacgc

SEQ ID NO: 2648639 - RNA, 13 nt, Escherichia coli CFT073
cgccaaucugcaa

SEQ ID NO: 2648640 - RNA, 24 nt, Escherichia coli CFT073
cgccaaugaucccgccaucgcggc

SEQ ID NO: 2648641 - RNA, 15 nt, Escherichia coli CFT073
cgccaaugcgcaaua

SEQ ID NO: 2648642 - RNA, 18 nt, Escherichia coli CFT073
cgccaauggcugccgcca

SEQ ID NO: 2648643 - RNA, 20 nt, Escherichia coli CFT073
cgccaauggcugccgccagg

SEQ ID NO: 2648644 - RNA, 21 nt, Escherichia coli CFT073
cgccaauggcugccgccaggu

SEQ ID NO: 2648645 - RNA, 20 nt, Escherichia coli CFT073
cgccaauguacggaauaagu

SEQ ID NO: 2648646 - RNA, 23 nt, Escherichia coli CFT073
cgccaauuucaucgcugaauuuc

SEQ ID NO: 2648647 - RNA, 23 nt, Escherichia coli CFT073
cgccacaacgauaauccagcaga

SEQ ID NO: 2648648 - RNA, 22 nt, Escherichia coli CFT073
cgccacacucucgcgcagcggu

SEQ ID NO: 2648649 - RNA, 13 nt, Escherichia coli CFT073
cgccacagcagcc

SEQ ID NO: 2648650 - RNA, 15 nt, Escherichia coli CFT073
cgccacauugcugca

SEQ ID NO: 2648651 - RNA, 13 nt, Escherichia coli CFT073
cgccaccacaaaa

SEQ ID NO: 2648652 - RNA, 13 nt, Escherichia coli CFT073
cgccaccacaaca

SEQ ID NO: 2648653 - RNA, 15 nt, Escherichia coli CFT073
cgccaccaccagacg

SEQ ID NO: 2648654 - RNA, 14 nt, Escherichia coli CFT073
cgccaccacgccca

SEQ ID NO: 2648655 - RNA, 13 nt, Escherichia coli CFT073
cgccaccagcgcc

SEQ ID NO: 2648656 - RNA, 14 nt, Escherichia coli CFT073
cgccaccagcgcca

SEQ ID NO: 2648657 - RNA, 13 nt, Escherichia coli CFT073
cgccaccccacac

SEQ ID NO: 2648658 - RNA, 14 nt, Escherichia coli CFT073
cgccaccccacacc

SEQ ID NO: 2648659 - RNA, 12 nt, Escherichia coli CFT073
cgccacccgaua

SEQ ID NO: 2648660 - RNA, 21 nt, Escherichia coli CFT073
cgccaccgaccaggcaaacca

SEQ ID NO: 2648661 - RNA, 22 nt, Escherichia coli CFT073
cgccaccgcgggcaaucgccag

SEQ ID NO: 2648662 - RNA, 18 nt, Escherichia coli CFT073
cgccaccgcuuccggcgu

SEQ ID NO: 2648663 - RNA, 20 nt, Escherichia coli CFT073
cgccaccucuuucaccaacg

SEQ ID NO: 2648664 - RNA, 22 nt, Escherichia coli CFT073
cgccacgacucaaaucacgcag

SEQ ID NO: 2648665 - RNA, 13 nt, Escherichia coli CFT073
cgccacgaucggu

SEQ ID NO: 2648666 - RNA, 14 nt, Escherichia coli CFT073
cgccacgccaagaa

SEQ ID NO: 2648667 - RNA, 15 nt, Escherichia coli CFT073
cgccacgccaccagc

SEQ ID NO: 2648668 - RNA, 16 nt, Escherichia coli CFT073
cgccacgccuuccuga

SEQ ID NO: 2648669 - RNA, 16 nt, Escherichia coli CFT073
cgccacgcugccgcgc

SEQ ID NO: 2648670 - RNA, 18 nt, Escherichia coli CFT073
cgccacggaaacauucaa

SEQ ID NO: 2648671 - RNA, 21 nt, Escherichia coli CFT073
cgccacggacauaaagcccgc

SEQ ID NO: 2648672 - RNA, 23 nt, Escherichia coli CFT073
cgccacgguaucaagcccgccgg

SEQ ID NO: 2648673 - RNA, 19 nt, Escherichia coli CFT073
cgccacgucaucagcaauu

SEQ ID NO: 2648674 - RNA, 14 nt, Escherichia coli CFT073
cgccacucacugau

SEQ ID NO: 2648675 - RNA, 21 nt, Escherichia coli CFT073
cgccacugcaaaucaccacau

SEQ ID NO: 2648676 - RNA, 16 nt, Escherichia coli CFT073
cgccacugcgccacgg

SEQ ID NO: 2648677 - RNA, 11 nt, Escherichia coli CFT073
cgccacuggca

SEQ ID NO: 2648678 - RNA, 19 nt, Escherichia coli CFT073
cgccacuucuggcggcggc

SEQ ID NO: 2648679 - RNA, 19 nt, Escherichia coli CFT073
cgccacuuuaugauccagc

SEQ ID NO: 2648680 - RNA, 15 nt, Escherichia coli CFT073
cgccagaaaaccugg

SEQ ID NO: 2648681 - RNA, 15 nt, Escherichia coli CFT073
cgccagaaacgggug

SEQ ID NO: 2648682 - RNA, 21 nt, Escherichia coli CFT073
cgccagaaaggguguccacgc

SEQ ID NO: 2648683 - RNA, 17 nt, Escherichia coli CFT073
cgccagaaaguggcaca

SEQ ID NO: 2648684 - RNA, 19 nt, Escherichia coli CFT073
cgccagaacacgcucccag

SEQ ID NO: 2648685 - RNA, 23 nt, Escherichia coli CFT073
cgccagaacacgcucccagcagu

SEQ ID NO: 2648686 - RNA, 18 nt, Escherichia coli CFT073
cgccagaacuacccgguu

SEQ ID NO: 2648687 - RNA, 19 nt, Escherichia coli CFT073
cgccagaagaaccgccacc

SEQ ID NO: 2648688 - RNA, 23 nt, Escherichia coli CFT073
cgccagaauaacgugaucgaaca

SEQ ID NO: 2648689 - RNA, 18 nt, Escherichia coli CFT073
cgccagaauagcgccgcc

SEQ ID NO: 2648690 - RNA, 14 nt, Escherichia coli CFT073
cgccagaaucaccg

SEQ ID NO: 2648691 - RNA, 16 nt, Escherichia coli CFT073
cgccagaaucaccgga

SEQ ID NO: 2648692 - RNA, 17 nt, Escherichia coli CFT073
cgccagaauccccggca

SEQ ID NO: 2648693 - RNA, 14 nt, Escherichia coli CFT073
cgccagaaugcgga

SEQ ID NO: 2648694 - RNA, 17 nt, Escherichia coli CFT073
cgccagaccaauagaaa

SEQ ID NO: 2648695 - RNA, 16 nt, Escherichia coli CFT073
cgccagaccugcgcau

SEQ ID NO: 2648696 - RNA, 19 nt, Escherichia coli CFT073
cgccagacgugcacgcagc

SEQ ID NO: 2648697 - RNA, 22 nt, Escherichia coli CFT073
cgccagacgugcacgcagcaaa

SEQ ID NO: 2648698 - RNA, 19 nt, Escherichia coli CFT073
cgccagacucaccagcauc

SEQ ID NO: 2648699 - RNA, 18 nt, Escherichia coli CFT073
cgccagacucucgccaga

SEQ ID NO: 2648700 - RNA, 14 nt, Escherichia coli CFT073
cgccagacugauca

SEQ ID NO: 2648701 - RNA, 20 nt, Escherichia coli CFT073
cgccagagaaagcccgcgua

SEQ ID NO: 2648702 - RNA, 17 nt, Escherichia coli CFT073
cgccagagagaacugug

SEQ ID NO: 2648703 - RNA, 21 nt, Escherichia coli CFT073
cgccagagagcggagcaauga

SEQ ID NO: 2648704 - RNA, 13 nt, Escherichia coli CFT073
cgccagagcuggc

SEQ ID NO: 2648705 - RNA, 17 nt, Escherichia coli CFT073
cgccagaggcgacaaac

SEQ ID NO: 2648706 - RNA, 20 nt, Escherichia coli CFT073
cgccagauagccgccagaga

SEQ ID NO: 2648707 - RNA, 11 nt, Escherichia coli CFT073
cgccagaucag

SEQ ID NO: 2648708 - RNA, 19 nt, Escherichia coli CFT073
cgccagauccgcuucgcca

SEQ ID NO: 2648709 - RNA, 12 nt, Escherichia coli CFT073
cgccagauccug

SEQ ID NO: 2648710 - RNA, 12 nt, Escherichia coli CFT073
cgccagaugcgg

SEQ ID NO: 2648711 - RNA, 15 nt, Escherichia coli CFT073
cgccagaugcggcgu

SEQ ID NO: 2648712 - RNA, 22 nt, Escherichia coli CFT073
cgccagaugcggcgugaacgcc

SEQ ID NO: 2648713 - RNA, 14 nt, Escherichia coli CFT073
cgccagauguuccg

SEQ ID NO: 2648714 - RNA, 16 nt, Escherichia coli CFT073
cgccagauugcugcug

SEQ ID NO: 2648715 - RNA, 17 nt, Escherichia coli CFT073
cgccagauuguuaucca

SEQ ID NO: 2648716 - RNA, 19 nt, Escherichia coli CFT073
cgccagauuguuauccagc

SEQ ID NO: 2648717 - RNA, 17 nt, Escherichia coli CFT073
cgccagcaaaucagcca

SEQ ID NO: 2648718 - RNA, 21 nt, Escherichia coli CFT073
cgccagcaagagcaaauaaaa

SEQ ID NO: 2648719 - RNA, 13 nt, Escherichia coli CFT073
cgccagcacagcc

SEQ ID NO: 2648720 - RNA, 20 nt, Escherichia coli CFT073
cgccagcacagccagccucc

SEQ ID NO: 2648721 - RNA, 14 nt, Escherichia coli CFT073
cgccaucgccagga

SEQ ID NO: 2648722 - RNA, 13 nt, Escherichia coli CFT073
cgccaucgcggcu

SEQ ID NO: 2648723 - RNA, 14 nt, Escherichia coli CFT073
cgccaucuaccacc

SEQ ID NO: 2648724 - RNA, 14 nt, Escherichia coli CFT073
cgccaucuguuucu

SEQ ID NO: 2648725 - RNA, 19 nt, Escherichia coli CFT073
cgccaugaugauccacacc

SEQ ID NO: 2648726 - RNA, 16 nt, Escherichia coli CFT073
cgccaugccaaagaag

SEQ ID NO: 2648727 - RNA, 19 nt, Escherichia coli CFT073
cgccaugccaacgcggccc

SEQ ID NO: 2648728 - RNA, 14 nt, Escherichia coli CFT073
cgccaugcugguua

SEQ ID NO: 2648729 - RNA, 20 nt, Escherichia coli CFT073
cgccaugugcgacgggccaa

SEQ ID NO: 2648730 - RNA, 21 nt, Escherichia coli CFT073
cgccauuaaacaacccaagcg

SEQ ID NO: 2648731 - RNA, 16 nt, Escherichia coli CFT073
cgccauuaacaguccg

SEQ ID NO: 2648732 - RNA, 16 nt, Escherichia coli CFT073
cgccauucagauugau

SEQ ID NO: 2648733 - RNA, 17 nt, Escherichia coli CFT073
cgccauugaaaccgcug

SEQ ID NO: 2648734 - RNA, 19 nt, Escherichia coli CFT073
cgccauuggccccauaauc

SEQ ID NO: 2648735 - RNA, 16 nt, Escherichia coli CFT073
cgccauuggccugaau

SEQ ID NO: 2648736 - RNA, 18 nt, Escherichia coli CFT073
cgccauuuagcagggcag

SEQ ID NO: 2648737 - RNA, 12 nt, Escherichia coli CFT073
cgccauuuccag

SEQ ID NO: 2648738 - RNA, 16 nt, Escherichia coli CFT073
cgccauuuccagcguc

SEQ ID NO: 2648739 - RNA, 14 nt, Escherichia coli CFT073
cgccauuuucugcc

SEQ ID NO: 2648740 - RNA, 20 nt, Escherichia coli CFT073
cgccauuuuuuugccugcua

SEQ ID NO: 2648741 - RNA, 12 nt, Escherichia coli CFT073
cgcccaacacuu

SEQ ID NO: 2648742 - RNA, 13 nt, Escherichia coli CFT073
cgcccaacacuuc

SEQ ID NO: 2648743 - RNA, 16 nt, Escherichia coli CFT073
cgcccaaccagcaggu

SEQ ID NO: 2648744 - RNA, 13 nt, Escherichia coli CFT073
cgcccaagcacaa

SEQ ID NO: 2648745 - RNA, 14 nt, Escherichia coli CFT073
cgcccacaccacgc

SEQ ID NO: 2648746 - RNA, 15 nt, Escherichia coli CFT073
cgcccaccgccaggc

SEQ ID NO: 2648747 - RNA, 20 nt, Escherichia coli CFT073
cgcccacgcaccaccagcgc

SEQ ID NO: 2648748 - RNA, 16 nt, Escherichia coli CFT073
cgcccacgccagagau

SEQ ID NO: 2648749 - RNA, 19 nt, Escherichia coli CFT073
cgcccagaccgugcgcagc

SEQ ID NO: 2648750 - RNA, 20 nt, Escherichia coli CFT073
cgcccagaccgugcgcagca

SEQ ID NO: 2648751 - RNA, 15 nt, Escherichia coli CFT073
cgcccagcagcacag

SEQ ID NO: 2648752 - RNA, 20 nt, Escherichia coli CFT073
cgcccagcguacguaacuuc

SEQ ID NO: 2648753 - RNA, 21 nt, Escherichia coli CFT073
cgcccagcguacguaacuucu

SEQ ID NO: 2648754 - RNA, 15 nt, Escherichia coli CFT073
cgcccagcucuuuac

SEQ ID NO: 2648755 - RNA, 21 nt, Escherichia coli CFT073
cgcccagcuuaguaagcccag

SEQ ID NO: 2648756 - RNA, 23 nt, Escherichia coli CFT073
cgcccaggcaaguagcgccagac

SEQ ID NO: 2648757 - RNA, 12 nt, Escherichia coli CFT073
cgcccagucacg

SEQ ID NO: 2648758 - RNA, 21 nt, Escherichia coli CFT073
cgcccagucccguacccagca

SEQ ID NO: 2648759 - RNA, 18 nt, Escherichia coli CFT073
cgcccaguggaugcgcca

SEQ ID NO: 2648760 - RNA, 20 nt, Escherichia coli CFT073
cgcccauacucaucuuccau

SEQ ID NO: 2648761 - RNA, 12 nt, Escherichia coli CFT073
cgcccaucauug

SEQ ID NO: 2648762 - RNA, 16 nt, Escherichia coli CFT073
cgcccaucgcgcccgc

SEQ ID NO: 2648763 - RNA, 13 nt, Escherichia coli CFT073
cgcccauugagcc

SEQ ID NO: 2648764 - RNA, 13 nt, Escherichia coli CFT073
cgccccaauccac

SEQ ID NO: 2648765 - RNA, 23 nt, Escherichia coli CFT073
cgccccacaagcccgccagacca

SEQ ID NO: 2648766 - RNA, 20 nt, Escherichia coli CFT073
cgccccagaauccccacaaa

SEQ ID NO: 2648767 - RNA, 11 nt, Escherichia coli CFT073
cgccccagauu

SEQ ID NO: 2648768 - RNA, 13 nt, Escherichia coli CFT073
cgcccccagacug

SEQ ID NO: 2648769 - RNA, 14 nt, Escherichia coli CFT073
cgcccccaucaccg

SEQ ID NO: 2648770 - RNA, 17 nt, Escherichia coli CFT073
cgccccgcucacgcagc

SEQ ID NO: 2648771 - RNA, 15 nt, Escherichia coli CFT073
cgccccgugaugaac

SEQ ID NO: 2648772 - RNA, 11 nt, Escherichia coli CFT073
cgccccugaca

SEQ ID NO: 2648773 - RNA, 23 nt, Escherichia coli CFT073
cgccccuggcgaugcccccagga

SEQ ID NO: 2648774 - RNA, 17 nt, Escherichia coli CFT073
cgccccuucugccgcaa

SEQ ID NO: 2648775 - RNA, 19 nt, Escherichia coli CFT073
cgcccgacaauaugcagca

SEQ ID NO: 2648776 - RNA, 22 nt, Escherichia coli CFT073
cgcccgacaauaugcagcaguc

SEQ ID NO: 2648777 - RNA, 22 nt, Escherichia coli CFT073
cgcccgaugcauaauccgccgc

SEQ ID NO: 2648778 - RNA, 21 nt, Escherichia coli CFT073
cgcccgcaaucaacauaaugc

SEQ ID NO: 2648779 - RNA, 22 nt, Escherichia coli CFT073
cgcccgcagcggaauaaaaagc

SEQ ID NO: 2648780 - RNA, 12 nt, Escherichia coli CFT073
cgcccgccgaga

SEQ ID NO: 2648781 - RNA, 13 nt, Escherichia coli CFT073
cgcccgccgagaa

SEQ ID NO: 2648782 - RNA, 15 nt, Escherichia coli CFT073
cgcccgcgcccaggc

SEQ ID NO: 2648783 - RNA, 18 nt, Escherichia coli CFT073
cgcccgcuguaagccaag

SEQ ID NO: 2648784 - RNA, 16 nt, Escherichia coli CFT073
cgcccgcuucaucgug

SEQ ID NO: 2648785 - RNA, 14 nt, Escherichia coli CFT073
cgcccgcuuuuugg

SEQ ID NO: 2648786 - RNA, 17 nt, Escherichia coli CFT073
cgcccggcaccagcacc

SEQ ID NO: 2648787 - RNA, 19 nt, Escherichia coli CFT073
cgcccgguggcgguuuugu

SEQ ID NO: 2648788 - RNA, 22 nt, Escherichia coli CFT073
cgcccgucacguuuugcgccgu

SEQ ID NO: 2648789 - RNA, 17 nt, Escherichia coli CFT073
cgcccgucauaccgucg

SEQ ID NO: 2648790 - RNA, 21 nt, Escherichia coli CFT073
cgcccgugacgggugacgcca

SEQ ID NO: 2648791 - RNA, 20 nt, Escherichia coli CFT073
cgcccguucauccgcuucag

SEQ ID NO: 2648792 - RNA, 14 nt, Escherichia coli CFT073
cgcccguucuuccu

SEQ ID NO: 2648793 - RNA, 20 nt, Escherichia coli CFT073
cgcccguuuucuccagcgcc

SEQ ID NO: 2648794 - RNA, 21 nt, Escherichia coli CFT073
cgcccguuuucuccagcgccg

SEQ ID NO: 2648795 - RNA, 17 nt, Escherichia coli CFT073
cgcccucuaaaauaacg

SEQ ID NO: 2648796 - RNA, 17 nt, Escherichia coli CFT073
cgcccugcccggagcca

SEQ ID NO: 2648797 - RNA, 13 nt, Escherichia coli CFT073
cgcccugcuccag

SEQ ID NO: 2648798 - RNA, 21 nt, Escherichia coli CFT073
cgcccuggcccauugccagcg

SEQ ID NO: 2648799 - RNA, 16 nt, Escherichia coli CFT073
cgcccuguaauucgua

SEQ ID NO: 2648800 - RNA, 17 nt, Escherichia coli CFT073
cgcccuuaccauuccca

SEQ ID NO: 2648801 - RNA, 12 nt, Escherichia coli CFT073
cgcccuuccccc

SEQ ID NO: 2648802 - RNA, 18 nt, Escherichia coli CFT073
cgccgaaauuucgccgcg

SEQ ID NO: 2648803 - RNA, 17 nt, Escherichia coli CFT073
cgccgaacgccacgacg

SEQ ID NO: 2648804 - RNA, 17 nt, Escherichia coli CFT073
cgccgaagcagcugcug

SEQ ID NO: 2648805 - RNA, 17 nt, Escherichia coli CFT073
cgccgaauaacgcgcag

SEQ ID NO: 2648806 - RNA, 18 nt, Escherichia coli CFT073
cgccgaauaacgcgcagc

SEQ ID NO: 2648807 - RNA, 20 nt, Escherichia coli CFT073
cgccgaccauauagcgcaca

SEQ ID NO: 2648808 - RNA, 21 nt, Escherichia coli CFT073
cgccgaccguagcguaaauca

SEQ ID NO: 2648809 - RNA, 14 nt, Escherichia coli CFT073
cgccgacgcccugc

SEQ ID NO: 2648810 - RNA, 20 nt, Escherichia coli CFT073
cgccgagauuugccagauua

SEQ ID NO: 2648811 - RNA, 16 nt, Escherichia coli CFT073
cgccgagcaaaccaca

SEQ ID NO: 2648812 - RNA, 16 nt, Escherichia coli CFT073
cgccgagcaaugagcu

SEQ ID NO: 2648813 - RNA, 17 nt, Escherichia coli CFT073
cgccgaggaaacauuug

SEQ ID NO: 2648814 - RNA, 14 nt, Escherichia coli CFT073
cgccgauaaucaac

SEQ ID NO: 2648815 - RNA, 22 nt, Escherichia coli CFT073
cgccgauaaucaacgcgccgcc

SEQ ID NO: 2648816 - RNA, 23 nt, Escherichia coli CFT073
cgccgauaaucaacgcgccgcca

SEQ ID NO: 2648817 - RNA, 19 nt, Escherichia coli CFT073
cgccgauacgcauaaacau

SEQ ID NO: 2648818 - RNA, 15 nt, Escherichia coli CFT073
cgccgauugccugau

SEQ ID NO: 2648819 - RNA, 17 nt, Escherichia coli CFT073
cgccgauuggcaccgac

SEQ ID NO: 2648820 - RNA, 17 nt, Escherichia coli CFT073
cgccgauuucucaucaa

SEQ ID NO: 2648821 - RNA, 13 nt, Escherichia coli CFT073
cgccgcaacaaua

SEQ ID NO: 2648822 - RNA, 19 nt, Escherichia coli CFT073
cgccgcaauauuccggcau

SEQ ID NO: 2648823 - RNA, 14 nt, Escherichia coli CFT073
cgccgcaaucagcg

SEQ ID NO: 2648824 - RNA, 22 nt, Escherichia coli CFT073
cgccgcaaucagcguuucgcca

SEQ ID NO: 2648825 - RNA, 22 nt, Escherichia coli CFT073
cgccgcacaagucagcaacgau

SEQ ID NO: 2648826 - RNA, 13 nt, Escherichia coli CFT073
cgccgcacccggc

SEQ ID NO: 2648827 - RNA, 17 nt, Escherichia coli CFT073
cgccgcauaauaucuuu

SEQ ID NO: 2648828 - RNA, 16 nt, Escherichia coli CFT073
cgccgcauaucaucaa

SEQ ID NO: 2648829 - RNA, 22 nt, Escherichia coli CFT073
cgccgcauccggcgacaggaac

SEQ ID NO: 2648830 - RNA, 16 nt, Escherichia coli CFT073
cgccuuauccggccug

SEQ ID NO: 2648831 - RNA, 16 nt, Escherichia coli CFT073
cgccuucacgguuauu

SEQ ID NO: 2648832 - RNA, 16 nt, Escherichia coli CFT073
cgccuucacuuccggc

SEQ ID NO: 2648833 - RNA, 18 nt, Escherichia coli CFT073
cgccuucagguuuuucag

SEQ ID NO: 2648834 - RNA, 18 nt, Escherichia coli CFT073
cgccuucauucaccaguu

SEQ ID NO: 2648835 - RNA, 21 nt, Escherichia coli CFT073
cgccuucuuccagcgcaagga

SEQ ID NO: 2648836 - RNA, 19 nt, Escherichia coli CFT073
cgccuugaguaccgagaaa

SEQ ID NO: 2648837 - RNA, 23 nt, Escherichia coli CFT073
cgccuugcgugacgccugcucca

SEQ ID NO: 2648838 - RNA, 17 nt, Escherichia coli CFT073
cgccuuucacgccggga

SEQ ID NO: 2648839 - RNA, 17 nt, Escherichia coli CFT073
cgccuuugagcaguuuc

SEQ ID NO: 2648840 - RNA, 15 nt, Escherichia coli CFT073
cgccuuuuacgcauu

SEQ ID NO: 2648841 - RNA, 15 nt, Escherichia coli CFT073
cgccuuuucgcccgu

SEQ ID NO: 2648842 - RNA, 20 nt, Escherichia coli CFT073
cgccuuuuuaauuugccaga

SEQ ID NO: 2648843 - RNA, 18 nt, Escherichia coli CFT073
cgccuuuuucuccgagca

SEQ ID NO: 2648844 - RNA, 23 nt, Escherichia coli CFT073
cgccuuuuugcgcgaagaaacga

SEQ ID NO: 2648845 - RNA, 19 nt, Escherichia coli CFT073
cgccuuuuuucgccgcagc

SEQ ID NO: 2648846 - RNA, 14 nt, Escherichia coli CFT073
cgcgaaaccuuacg

SEQ ID NO: 2648847 - RNA, 15 nt, Escherichia coli CFT073
cgcgaaacugcgugg

SEQ ID NO: 2648848 - RNA, 21 nt, Escherichia coli CFT073
cgcgaaaugucaaacaguuca

SEQ ID NO: 2648849 - RNA, 21 nt, Escherichia coli CFT073
cgcgaaauuauccauauucag

SEQ ID NO: 2648850 - RNA, 16 nt, Escherichia coli CFT073
cgcgaaccagaccagc

SEQ ID NO: 2648851 - RNA, 17 nt, Escherichia coli CFT073
cgcgaaccagaccagca

SEQ ID NO: 2648852 - RNA, 12 nt, Escherichia coli CFT073
cgcgaaccgccu

SEQ ID NO: 2648853 - RNA, 12 nt, Escherichia coli CFT073
cgcgaacgugug

SEQ ID NO: 2648854 - RNA, 20 nt, Escherichia coli CFT073
cgcgaacuaaacaacgccgc

SEQ ID NO: 2648855 - RNA, 22 nt, Escherichia coli CFT073
cgcgaagcugguguaacugcgc

SEQ ID NO: 2648856 - RNA, 16 nt, Escherichia coli CFT073
cgcgaaggacugccgc

SEQ ID NO: 2648857 - RNA, 14 nt, Escherichia coli CFT073
cgcgaaggccagca

SEQ ID NO: 2648858 - RNA, 21 nt, Escherichia coli CFT073
cgcgaauauggcggcggcuuu

SEQ ID NO: 2648859 - RNA, 14 nt, Escherichia coli CFT073
cgcgaaugggugaa

SEQ ID NO: 2648860 - RNA, 21 nt, Escherichia coli CFT073
cgcgaauucauguucgguaaa

SEQ ID NO: 2648861 - RNA, 20 nt, Escherichia coli CFT073
cgcgacacaauccaugccaa

SEQ ID NO: 2648862 - RNA, 15 nt, Escherichia coli CFT073
cgcgacauaucgcca

SEQ ID NO: 2648863 - RNA, 13 nt, Escherichia coli CFT073
cgcgaccaauacg

SEQ ID NO: 2648864 - RNA, 15 nt, Escherichia coli CFT073
cgcgaccacacucaa

SEQ ID NO: 2648865 - RNA, 18 nt, Escherichia coli CFT073
cgcgaccacuggguuaac

SEQ ID NO: 2648866 - RNA, 20 nt, Escherichia coli CFT073
cgcgaccaucggaucggcca

SEQ ID NO: 2648867 - RNA, 14 nt, Escherichia coli CFT073
cgcgaccgccauga

SEQ ID NO: 2648868 - RNA, 15 nt, Escherichia coli CFT073
cgcgaccgucuuuau

SEQ ID NO: 2648869 - RNA, 13 nt, Escherichia coli CFT073
cgcgacgaccacc

SEQ ID NO: 2648870 - RNA, 21 nt, Escherichia coli CFT073
cgcgacgguagagcugaaaau

SEQ ID NO: 2648871 - RNA, 15 nt, Escherichia coli CFT073
cgcgacggugcggcu

SEQ ID NO: 2648872 - RNA, 16 nt, Escherichia coli CFT073
cgcgacucccugacug

SEQ ID NO: 2648873 - RNA, 14 nt, Escherichia coli CFT073
cgcgagaacugaac

SEQ ID NO: 2648874 - RNA, 15 nt, Escherichia coli CFT073
cgcgagcaaaaucgu

SEQ ID NO: 2648875 - RNA, 14 nt, Escherichia coli CFT073
cgcgagccuuuacg

SEQ ID NO: 2648876 - RNA, 21 nt, Escherichia coli CFT073
cgcgagcgccuuauccggccu

SEQ ID NO: 2648877 - RNA, 18 nt, Escherichia coli CFT073
cgcgagcuuaacugccau

SEQ ID NO: 2648878 - RNA, 17 nt, Escherichia coli CFT073
cgcgauaaaaucccaua

SEQ ID NO: 2648879 - RNA, 15 nt, Escherichia coli CFT073
cgcgauaacgcccca

SEQ ID NO: 2648880 - RNA, 17 nt, Escherichia coli CFT073
cgcgauaaucccaacgc

SEQ ID NO: 2648881 - RNA, 14 nt, Escherichia coli CFT073
cgcgauacgcagua

SEQ ID NO: 2648882 - RNA, 14 nt, Escherichia coli CFT073
cgcgauacgcuuca

SEQ ID NO: 2648883 - RNA, 13 nt, Escherichia coli CFT073
cgcgauaggccuu

SEQ ID NO: 2648884 - RNA, 22 nt, Escherichia coli CFT073
cgcgauaucgcgguacuucuca

SEQ ID NO: 2648885 - RNA, 23 nt, Escherichia coli CFT073
cgcgauauuccgcaacgccgcca

SEQ ID NO: 2648886 - RNA, 22 nt, Escherichia coli CFT073
cgcgaucauuaacaccacgcca

SEQ ID NO: 2648887 - RNA, 18 nt, Escherichia coli CFT073
cgcgauccacgcucgcug

SEQ ID NO: 2648888 - RNA, 15 nt, Escherichia coli CFT073
cgcgauccagcgcaa

SEQ ID NO: 2648889 - RNA, 17 nt, Escherichia coli CFT073
cgcgaucccagaccaga

SEQ ID NO: 2648890 - RNA, 14 nt, Escherichia coli CFT073
cgcgaucccccaga

SEQ ID NO: 2648891 - RNA, 18 nt, Escherichia coli CFT073
cgcgaucgcgccaccguu

SEQ ID NO: 2648892 - RNA, 16 nt, Escherichia coli CFT073
cgcgaucucgucagca

SEQ ID NO: 2648893 - RNA, 14 nt, Escherichia coli CFT073
cgcgaugaccaaaa

SEQ ID NO: 2648894 - RNA, 19 nt, Escherichia coli CFT073
cgcgaugaugcgacgcgau

SEQ ID NO: 2648895 - RNA, 21 nt, Escherichia coli CFT073
cgcgaugcuacuaugauuuuc

SEQ ID NO: 2648896 - RNA, 17 nt, Escherichia coli CFT073
cgcgauggaaaacaaca

SEQ ID NO: 2648897 - RNA, 20 nt, Escherichia coli CFT073
cgcgauggcuuuccaccugc

SEQ ID NO: 2648898 - RNA, 17 nt, Escherichia coli CFT073
cgcgauguuuggcggau

SEQ ID NO: 2648899 - RNA, 14 nt, Escherichia coli CFT073
cgcgcaaacaguga

SEQ ID NO: 2648900 - RNA, 15 nt, Escherichia coli CFT073
cgcgcaaacccucua

SEQ ID NO: 2648901 - RNA, 15 nt, Escherichia coli CFT073
cgcgcaaauccacgu

SEQ ID NO: 2648902 - RNA, 22 nt, Escherichia coli CFT073
cgcgcaacgucgcgccugucac

SEQ ID NO: 2648903 - RNA, 16 nt, Escherichia coli CFT073
cgcgcacaucaggacg

SEQ ID NO: 2648904 - RNA, 19 nt, Escherichia coli CFT073
cgcgcaccaaugacggcca

SEQ ID NO: 2648905 - RNA, 20 nt, Escherichia coli CFT073
cgcgcaccggaacaacccag

SEQ ID NO: 2648906 - RNA, 16 nt, Escherichia coli CFT073
cgcgcaccguccagcg

SEQ ID NO: 2648907 - RNA, 15 nt, Escherichia coli CFT073
cgcgcaccuacagcc

SEQ ID NO: 2648908 - RNA, 19 nt, Escherichia coli CFT073
cgcgcacgcccaucagcgg

SEQ ID NO: 2648909 - RNA, 20 nt, Escherichia coli CFT073
cgcgcagcucuuuauccagc

SEQ ID NO: 2648910 - RNA, 22 nt, Escherichia coli CFT073
cgcgcagggugcagaaucaauc

SEQ ID NO: 2648911 - RNA, 19 nt, Escherichia coli CFT073
cgcgcaguaaauccgccac

SEQ ID NO: 2648912 - RNA, 22 nt, Escherichia coli CFT073
cgcgcaguaccacuucauccgg

SEQ ID NO: 2648913 - RNA, 13 nt, Escherichia coli CFT073
cgcgcaguuucuu

SEQ ID NO: 2648914 - RNA, 18 nt, Escherichia coli CFT073
cgcgcaguuucuuaccua

SEQ ID NO: 2648915 - RNA, 17 nt, Escherichia coli CFT073
cgcgcauaguuuuuugg

SEQ ID NO: 2648916 - RNA, 18 nt, Escherichia coli CFT073
cgcgcaucauuaccggca

SEQ ID NO: 2648917 - RNA, 23 nt, Escherichia coli CFT073
cgcgcauuaccucaauaauuucu

SEQ ID NO: 2648918 - RNA, 14 nt, Escherichia coli CFT073
cgcgccaaccagga

SEQ ID NO: 2648919 - RNA, 14 nt, Escherichia coli CFT073
cgcgccaaucagcg

SEQ ID NO: 2648920 - RNA, 18 nt, Escherichia coli CFT073
cgcgccaaucagcgcagc

SEQ ID NO: 2648921 - RNA, 21 nt, Escherichia coli CFT073
cgcgccaaucagcgcagcacc

SEQ ID NO: 2648922 - RNA, 22 nt, Escherichia coli CFT073
cgcgccacuggcggaugcggcg

SEQ ID NO: 2648923 - RNA, 12 nt, Escherichia coli CFT073
cgcgccagcagc

SEQ ID NO: 2648924 - RNA, 15 nt, Escherichia coli CFT073
cgcgccagcgucgca

SEQ ID NO: 2648925 - RNA, 20 nt, Escherichia coli CFT073
cgcgccagcuaccagaauug

SEQ ID NO: 2648926 - RNA, 18 nt, Escherichia coli CFT073
cgcgccagcuucacgcgc

SEQ ID NO: 2648927 - RNA, 17 nt, Escherichia coli CFT073
cgcgccaguaaucagcg

SEQ ID NO: 2648928 - RNA, 22 nt, Escherichia coli CFT073
cgcgccaguaccgccgcaguca

SEQ ID NO: 2648929 - RNA, 22 nt, Escherichia coli CFT073
cgcgccauccauaaucacgcug

SEQ ID NO: 2648930 - RNA, 14 nt, Escherichia coli CFT073
cgcgcccaaacgua

SEQ ID NO: 2648931 - RNA, 17 nt, Escherichia coli CFT073
cgcgcccaacaguagac

SEQ ID NO: 2648932 - RNA, 13 nt, Escherichia coli CFT073
cgcgcccaaccag

SEQ ID NO: 2648933 - RNA, 14 nt, Escherichia coli CFT073
cgcgcccaaccagc

SEQ ID NO: 2648934 - RNA, 16 nt, Escherichia coli CFT073
cgcgcccaaccagcag

SEQ ID NO: 2648935 - RNA, 17 nt, Escherichia coli CFT073
cgcgcccaaccagcagg

SEQ ID NO: 2648936 - RNA, 22 nt, Escherichia coli CFT073
cgcgcccagccugaaugccgcg

SEQ ID NO: 2648937 - RNA, 22 nt, Escherichia coli CFT073
cgcgccccacggaaguuuaauc

SEQ ID NO: 2648938 - RNA, 15 nt, Escherichia coli CFT073
cgcguuggcgcagca

SEQ ID NO: 2648939 - RNA, 18 nt, Escherichia coli CFT073
cgcguuguugcaggaaca

SEQ ID NO: 2648940 - RNA, 14 nt, Escherichia coli CFT073
cgcguuuacagagc

SEQ ID NO: 2648941 - RNA, 21 nt, Escherichia coli CFT073
cgcguuuaucgacagacgcca

SEQ ID NO: 2648942 - RNA, 23 nt, Escherichia coli CFT073
cgcguuucaccaccacuucuuuc

SEQ ID NO: 2648943 - RNA, 23 nt, Escherichia coli CFT073
cgcguuucgaugccaaaaaugga

SEQ ID NO: 2648944 - RNA, 17 nt, Escherichia coli CFT073
cgcguuugcccgcaacg

SEQ ID NO: 2648945 - RNA, 21 nt, Escherichia coli CFT073
cgcguuugcguuccggcggca

SEQ ID NO: 2648946 - RNA, 14 nt, Escherichia coli CFT073
cgcguuugucagca

SEQ ID NO: 2648947 - RNA, 23 nt, Escherichia coli CFT073
cgcguuuuggcgaaauagccgaa

SEQ ID NO: 2648948 - RNA, 23 nt, Escherichia coli CFT073
cgcuaaagacuuugcugccuuuc

SEQ ID NO: 2648949 - RNA, 12 nt, Escherichia coli CFT073
cgcuaaagcauu

SEQ ID NO: 2648950 - RNA, 17 nt, Escherichia coli CFT073
cgcuaaauccgccgcca

SEQ ID NO: 2648951 - RNA, 14 nt, Escherichia coli CFT073
cgcuaacagcagca

SEQ ID NO: 2648952 - RNA, 15 nt, Escherichia coli CFT073
cgcuaacaugguuaa

SEQ ID NO: 2648953 - RNA, 15 nt, Escherichia coli CFT073
cgcuaaccuguuuuc

SEQ ID NO: 2648954 - RNA, 17 nt, Escherichia coli CFT073
cgcuaacgucugguaaa

SEQ ID NO: 2648955 - RNA, 14 nt, Escherichia coli CFT073
cgcuaacuuccugc

SEQ ID NO: 2648956 - RNA, 17 nt, Escherichia coli CFT073
cgcuaaugcgacccacg

SEQ ID NO: 2648957 - RNA, 16 nt, Escherichia coli CFT073
cgcuaccacuucccaa

SEQ ID NO: 2648958 - RNA, 18 nt, Escherichia coli CFT073
cgcuaccagaaagcgacc

SEQ ID NO: 2648959 - RNA, 17 nt, Escherichia coli CFT073
cgcuaccagagccgcgc

SEQ ID NO: 2648960 - RNA, 21 nt, Escherichia coli CFT073
cgcuacccgaacaccaaucuu

SEQ ID NO: 2648961 - RNA, 18 nt, Escherichia coli CFT073
cgcuaccggcgacuuccu

SEQ ID NO: 2648962 - RNA, 23 nt, Escherichia coli CFT073
cgcuaccggcgacuuccugagcu

SEQ ID NO: 2648963 - RNA, 16 nt, Escherichia coli CFT073
cgcuaccugccgccac

SEQ ID NO: 2648964 - RNA, 13 nt, Escherichia coli CFT073
cgcuacgacguuc

SEQ ID NO: 2648965 - RNA, 18 nt, Escherichia coli CFT073
cgcuacgccuuccgucag

SEQ ID NO: 2648966 - RNA, 16 nt, Escherichia coli CFT073
cgcuacgcuuaucagg

SEQ ID NO: 2648967 - RNA, 21 nt, Escherichia coli CFT073
cgcuacuggcaauccugcuuu

SEQ ID NO: 2648968 - RNA, 13 nt, Escherichia coli CFT073
cgcuagcagcagc

SEQ ID NO: 2648969 - RNA, 19 nt, Escherichia coli CFT073
cgcuaguucucgggcggca

SEQ ID NO: 2648970 - RNA, 14 nt, Escherichia coli CFT073
cgcuaguuucgugc

SEQ ID NO: 2648971 - RNA, 15 nt, Escherichia coli CFT073
cgcuauacagcagcc

SEQ ID NO: 2648972 - RNA, 21 nt, Escherichia coli CFT073
cgcuauaucgcugauaucaaa

SEQ ID NO: 2648973 - RNA, 14 nt, Escherichia coli CFT073
cgcuaucagcgcca

SEQ ID NO: 2648974 - RNA, 14 nt, Escherichia coli CFT073
cgcuauccugguua

SEQ ID NO: 2648975 - RNA, 20 nt, Escherichia coli CFT073
cgcuaucgccugcgaaucua

SEQ ID NO: 2648976 - RNA, 12 nt, Escherichia coli CFT073
cgcuaucggcau

SEQ ID NO: 2648977 - RNA, 19 nt, Escherichia coli CFT073
cgcuaugcaacaacuggcg

SEQ ID NO: 2648978 - RNA, 15 nt, Escherichia coli CFT073
cgcuaugugccauug

SEQ ID NO: 2648979 - RNA, 22 nt, Escherichia coli CFT073
cgcuauuacgaugaacaugcag

SEQ ID NO: 2648980 - RNA, 14 nt, Escherichia coli CFT073
cgcuauuugcugaa

SEQ ID NO: 2648981 - RNA, 16 nt, Escherichia coli CFT073
cgcucaagaacggcaa

SEQ ID NO: 2648982 - RNA, 18 nt, Escherichia coli CFT073
cgcucaagaacggcaaua

SEQ ID NO: 2648983 - RNA, 18 nt, Escherichia coli CFT073
cgcucaauaaucaaucuu

SEQ ID NO: 2648984 - RNA, 16 nt, Escherichia coli CFT073
cgcucaauauauucuu

SEQ ID NO: 2648985 - RNA, 13 nt, Escherichia coli CFT073
cgcucacccauca

SEQ ID NO: 2648986 - RNA, 17 nt, Escherichia coli CFT073
cgcucacgauucgguuc

SEQ ID NO: 2648987 - RNA, 12 nt, Escherichia coli CFT073
cgcucacgcagc

SEQ ID NO: 2648988 - RNA, 18 nt, Escherichia coli CFT073
cgcucacgcagcggcggc

SEQ ID NO: 2648989 - RNA, 17 nt, Escherichia coli CFT073
cgcucaggugacggaaa

SEQ ID NO: 2648990 - RNA, 22 nt, Escherichia coli CFT073
cgcucaguagauccuugcggau

SEQ ID NO: 2648991 - RNA, 23 nt, Escherichia coli CFT073
cgcucauauuuaagccugcauca

SEQ ID NO: 2648992 - RNA, 12 nt, Escherichia coli CFT073
cgcucaucaccg

SEQ ID NO: 2648993 - RNA, 20 nt, Escherichia coli CFT073
cgcucaucacgcaguuguuu

SEQ ID NO: 2648994 - RNA, 20 nt, Escherichia coli CFT073
cgcucaucagcggguuuucu

SEQ ID NO: 2648995 - RNA, 14 nt, Escherichia coli CFT073
cgcucaucaggcca

SEQ ID NO: 2648996 - RNA, 13 nt, Escherichia coli CFT073
cgcucauuuucuu

SEQ ID NO: 2648997 - RNA, 22 nt, Escherichia coli CFT073
cgcuccaaggucuccgcccagc

SEQ ID NO: 2648998 - RNA, 13 nt, Escherichia coli CFT073
cgcuccaguaccu

SEQ ID NO: 2648999 - RNA, 21 nt, Escherichia coli CFT073
cgcuccaucagauucagcagc

SEQ ID NO: 2649000 - RNA, 13 nt, Escherichia coli CFT073
cgcuccauugccc

SEQ ID NO: 2649001 - RNA, 19 nt, Escherichia coli CFT073
cgcuccauugcccgcccga

SEQ ID NO: 2649002 - RNA, 14 nt, Escherichia coli CFT073
cgcucccagcccgg

SEQ ID NO: 2649003 - RNA, 18 nt, Escherichia coli CFT073
cgcucccgcaggagcgcc

SEQ ID NO: 2649004 - RNA, 19 nt, Escherichia coli CFT073
cgcucccggauaccccagc

SEQ ID NO: 2649005 - RNA, 13 nt, Escherichia coli CFT073
cgcucccggcaua

SEQ ID NO: 2649006 - RNA, 12 nt, Escherichia coli CFT073
cgcuccggcacu

SEQ ID NO: 2649007 - RNA, 13 nt, Escherichia coli CFT073
cgcuccggcagca

SEQ ID NO: 2649008 - RNA, 16 nt, Escherichia coli CFT073
cgcuccggcagcagca

SEQ ID NO: 2649009 - RNA, 21 nt, Escherichia coli CFT073
cgcuccugaucaagcuggcgc

SEQ ID NO: 2649010 - RNA, 19 nt, Escherichia coli CFT073
cgcucgaaguuuuccucag

SEQ ID NO: 2649011 - RNA, 19 nt, Escherichia coli CFT073
cgcucgagagagaaaauaa

SEQ ID NO: 2649012 - RNA, 16 nt, Escherichia coli CFT073
cgcucgagccgcaucc

SEQ ID NO: 2649013 - RNA, 18 nt, Escherichia coli CFT073
cgcucgagccgcauccga

SEQ ID NO: 2649014 - RNA, 18 nt, Escherichia coli CFT073
cgcucgcgcagcucauca

SEQ ID NO: 2649015 - RNA, 16 nt, Escherichia coli CFT073
cgcucgcgccgcaucc

SEQ ID NO: 2649016 - RNA, 20 nt, Escherichia coli CFT073
cgcucgcgguuggcaaucag

SEQ ID NO: 2649017 - RNA, 23 nt, Escherichia coli CFT073
cgcucgcuggcguuguccgccag

SEQ ID NO: 2649018 - RNA, 14 nt, Escherichia coli CFT073
cgcucggcaacacc

SEQ ID NO: 2649019 - RNA, 19 nt, Escherichia coli CFT073
cgcucggcgcaaucgccag

SEQ ID NO: 2649020 - RNA, 22 nt, Escherichia coli CFT073
cgcucggucacugacaccagca

SEQ ID NO: 2649021 - RNA, 14 nt, Escherichia coli CFT073
cgcucguccgcgag

SEQ ID NO: 2649022 - RNA, 15 nt, Escherichia coli CFT073
cgcucucagcuggcg

SEQ ID NO: 2649023 - RNA, 14 nt, Escherichia coli CFT073
cgcucucgccgcgc

SEQ ID NO: 2649024 - RNA, 19 nt, Escherichia coli CFT073
cgcucucgccgcgcuccau

SEQ ID NO: 2649025 - RNA, 19 nt, Escherichia coli CFT073
cgcucugacgacauaauaa

SEQ ID NO: 2649026 - RNA, 21 nt, Escherichia coli CFT073
cgcucugcuagauaagcaagg

SEQ ID NO: 2649027 - RNA, 15 nt, Escherichia coli CFT073
cgcucuggauaauca

SEQ ID NO: 2649028 - RNA, 21 nt, Escherichia coli CFT073
cgcucugguuuguaggucagg

SEQ ID NO: 2649029 - RNA, 15 nt, Escherichia coli CFT073
cgcucuucaucuucc

SEQ ID NO: 2649030 - RNA, 21 nt, Escherichia coli CFT073
cgcucuucgaggccgcggcuc

SEQ ID NO: 2649031 - RNA, 20 nt, Escherichia coli CFT073
cgcucuugcuuacgcagaca

SEQ ID NO: 2649032 - RNA, 15 nt, Escherichia coli CFT073
cgcucuuuaaaggcc

SEQ ID NO: 2649033 - RNA, 15 nt, Escherichia coli CFT073
cgcucuuuuauuagc

SEQ ID NO: 2649034 - RNA, 14 nt, Escherichia coli CFT073
cgcugaaaaacgaa

SEQ ID NO: 2649035 - RNA, 17 nt, Escherichia coli CFT073
cgcugaaacuucaccaa

SEQ ID NO: 2649036 - RNA, 17 nt, Escherichia coli CFT073
cgcugaacgcaccuucc

SEQ ID NO: 2649037 - RNA, 16 nt, Escherichia coli CFT073
cgcugaacgggccauc

SEQ ID NO: 2649038 - RNA, 16 nt, Escherichia coli CFT073
cgcugaauaaucccca

SEQ ID NO: 2649039 - RNA, 18 nt, Escherichia coli CFT073
cgcugaauaauggugaau

SEQ ID NO: 2649040 - RNA, 16 nt, Escherichia coli CFT073
cgcugaauaucuuucu

SEQ ID NO: 2649041 - RNA, 17 nt, Escherichia coli CFT073
cgcugacaaacugcgug

SEQ ID NO: 2649042 - RNA, 21 nt, Escherichia coli CFT073
cgcugaccgcuuuguccgucg

SEQ ID NO: 2649043 - RNA, 23 nt, Escherichia coli CFT073
cgcugaccgcuuuguccgucgac

SEQ ID NO: 2649044 - RNA, 19 nt, Escherichia coli CFT073
cgcugaccguugcucauua

SEQ ID NO: 2649045 - RNA, 21 nt, Escherichia coli CFT073
cgcugaccuucuucagcaaua

SEQ ID NO: 2649046 - RNA, 17 nt, Escherichia coli CFT073
cgcuucggcggguuuuu

SEQ ID NO: 2649047 - RNA, 16 nt, Escherichia coli CFT073
cgcuucugucgcuuca

SEQ ID NO: 2649048 - RNA, 20 nt, Escherichia coli CFT073
cgcuucugucgcuucacgca

SEQ ID NO: 2649049 - RNA, 12 nt, Escherichia coli CFT073
cgcuucuucagc

SEQ ID NO: 2649050 - RNA, 20 nt, Escherichia coli CFT073
cgcuucuucagccugcacga

SEQ ID NO: 2649051 - RNA, 16 nt, Escherichia coli CFT073
cgcuucuuucucaauc

SEQ ID NO: 2649052 - RNA, 14 nt, Escherichia coli CFT073
cgcuugacaaaaag

SEQ ID NO: 2649053 - RNA, 13 nt, Escherichia coli CFT073
cgcuugaucuucc

SEQ ID NO: 2649054 - RNA, 17 nt, Escherichia coli CFT073
cgcuugaucuuccugau

SEQ ID NO: 2649055 - RNA, 19 nt, Escherichia coli CFT073
cgcuugauucuguucagua

SEQ ID NO: 2649056 - RNA, 23 nt, Escherichia coli CFT073
cgcuugcaggaucagcuccggca

SEQ ID NO: 2649057 - RNA, 20 nt, Escherichia coli CFT073
cgcuugcauccggcaugaua

SEQ ID NO: 2649058 - RNA, 14 nt, Escherichia coli CFT073
cgcuugccgcgucu

SEQ ID NO: 2649059 - RNA, 19 nt, Escherichia coli CFT073
cgcuugccugugccacggc

SEQ ID NO: 2649060 - RNA, 17 nt, Escherichia coli CFT073
cgcuugcggccagcaca

SEQ ID NO: 2649061 - RNA, 15 nt, Escherichia coli CFT073
cgcuugcguaucggg

SEQ ID NO: 2649062 - RNA, 18 nt, Escherichia coli CFT073
cgcuugcguaucgggcgc

SEQ ID NO: 2649063 - RNA, 15 nt, Escherichia coli CFT073
cgcuugcucgcgcac

SEQ ID NO: 2649064 - RNA, 23 nt, Escherichia coli CFT073
cgcuugcugccaguuaccaccgc

SEQ ID NO: 2649065 - RNA, 14 nt, Escherichia coli CFT073
cgcuugcugcgauc

SEQ ID NO: 2649066 - RNA, 15 nt, Escherichia coli CFT073
cgcuugcugcgaucc

SEQ ID NO: 2649067 - RNA, 16 nt, Escherichia coli CFT073
cgcuugucaggccugu

SEQ ID NO: 2649068 - RNA, 23 nt, Escherichia coli CFT073
cgcuuguugauucugauaugcag

SEQ ID NO: 2649069 - RNA, 20 nt, Escherichia coli CFT073
cgcuuuaaacggcugggaaa

SEQ ID NO: 2649070 - RNA, 14 nt, Escherichia coli CFT073
cgcuuuaacgcccu

SEQ ID NO: 2649071 - RNA, 19 nt, Escherichia coli CFT073
cgcuuuacuguacaauccu

SEQ ID NO: 2649072 - RNA, 22 nt, Escherichia coli CFT073
cgcuuuauagguggcaaagaaa

SEQ ID NO: 2649073 - RNA, 14 nt, Escherichia coli CFT073
cgcuuuaugugcuu

SEQ ID NO: 2649074 - RNA, 19 nt, Escherichia coli CFT073
cgcuuucaaaagccccuga

SEQ ID NO: 2649075 - RNA, 22 nt, Escherichia coli CFT073
cgcuuucaagcuugcagaauug

SEQ ID NO: 2649076 - RNA, 23 nt, Escherichia coli CFT073
cgcuuucagcacuucggcaucaa

SEQ ID NO: 2649077 - RNA, 13 nt, Escherichia coli CFT073
cgcuuucgcgaau

SEQ ID NO: 2649078 - RNA, 17 nt, Escherichia coli CFT073
cgcuuucgcuuucucuu

SEQ ID NO: 2649079 - RNA, 18 nt, Escherichia coli CFT073
cgcuuucucaccaugacc

SEQ ID NO: 2649080 - RNA, 21 nt, Escherichia coli CFT073
cgcuuucucuucggcuucuac

SEQ ID NO: 2649081 - RNA, 13 nt, Escherichia coli CFT073
cgcuuucuucuuc

SEQ ID NO: 2649082 - RNA, 15 nt, Escherichia coli CFT073
cgcuuugauccgcca

SEQ ID NO: 2649083 - RNA, 16 nt, Escherichia coli CFT073
cgcuuugauccgccag

SEQ ID NO: 2649084 - RNA, 17 nt, Escherichia coli CFT073
cgcuuugauccgccaga

SEQ ID NO: 2649085 - RNA, 18 nt, Escherichia coli CFT073
cgcuuugauccgccagau

SEQ ID NO: 2649086 - RNA, 18 nt, Escherichia coli CFT073
cgcuuugaugcguucuuc

SEQ ID NO: 2649087 - RNA, 12 nt, Escherichia coli CFT073
cgcuuugcugau

SEQ ID NO: 2649088 - RNA, 22 nt, Escherichia coli CFT073
cgcuuugcugccuuccuccggc

SEQ ID NO: 2649089 - RNA, 11 nt, Escherichia coli CFT073
cgcuuuuaacc

SEQ ID NO: 2649090 - RNA, 16 nt, Escherichia coli CFT073
cgcuuuuacugcacuc

SEQ ID NO: 2649091 - RNA, 16 nt, Escherichia coli CFT073
cgcuuuucaccgccuu

SEQ ID NO: 2649092 - RNA, 21 nt, Escherichia coli CFT073
cgcuuuuccacucacacagcu

SEQ ID NO: 2649093 - RNA, 20 nt, Escherichia coli CFT073
cgcuuuugggaucgccauca

SEQ ID NO: 2649094 - RNA, 17 nt, Escherichia coli CFT073
cgcuuuugguuuuucaa

SEQ ID NO: 2649095 - RNA, 20 nt, Escherichia coli CFT073
cgcuuuugguuuuucaacca

SEQ ID NO: 2649096 - RNA, 20 nt, Escherichia coli CFT073
cgcuuuuuaggggcgcaucu

SEQ ID NO: 2649097 - RNA, 15 nt, Escherichia coli CFT073
cgcuuuuuccugccg

SEQ ID NO: 2649098 - RNA, 16 nt, Escherichia coli CFT073
cgcuuuuugauaagua

SEQ ID NO: 2649099 - RNA, 19 nt, Escherichia coli CFT073
cgcuuuuuuagguacaaag

SEQ ID NO: 2649100 - RNA, 23 nt, Escherichia coli CFT073
cgcuuuuuuugucugagauuaca

SEQ ID NO: 2649101 - RNA, 15 nt, Escherichia coli CFT073
cggaaaaaucaaaaa

SEQ ID NO: 2649102 - RNA, 16 nt, Escherichia coli CFT073
cggaaaacaacaccgg

SEQ ID NO: 2649103 - RNA, 18 nt, Escherichia coli CFT073
cggaaaacaaccgccaug

SEQ ID NO: 2649104 - RNA, 13 nt, Escherichia coli CFT073
cggaaaagcaaca

SEQ ID NO: 2649105 - RNA, 14 nt, Escherichia coli CFT073
cggaaaagcaacaa

SEQ ID NO: 2649106 - RNA, 16 nt, Escherichia coli CFT073
cggaaaagcaacaacc

SEQ ID NO: 2649107 - RNA, 23 nt, Escherichia coli CFT073
cggaaaagguuaaaccgccaguc

SEQ ID NO: 2649108 - RNA, 14 nt, Escherichia coli CFT073
cggaaacuggaugg

SEQ ID NO: 2649109 - RNA, 20 nt, Escherichia coli CFT073
cggaaagcagauaacccagc

SEQ ID NO: 2649110 - RNA, 15 nt, Escherichia coli CFT073
cggaaagccccgccu

SEQ ID NO: 2649111 - RNA, 22 nt, Escherichia coli CFT073
cggaaaguuuacgucgccaguu

SEQ ID NO: 2649112 - RNA, 16 nt, Escherichia coli CFT073
cggaaauaacgcugau

SEQ ID NO: 2649113 - RNA, 12 nt, Escherichia coli CFT073
cggaaauauauu

SEQ ID NO: 2649114 - RNA, 15 nt, Escherichia coli CFT073
cggaaaucaugcucc

SEQ ID NO: 2649115 - RNA, 15 nt, Escherichia coli CFT073
cggaaaucuccagau

SEQ ID NO: 2649116 - RNA, 20 nt, Escherichia coli CFT073
cggaaauuaccgcaccacca

SEQ ID NO: 2649117 - RNA, 15 nt, Escherichia coli CFT073
cggaacaacggcaaa

SEQ ID NO: 2649118 - RNA, 15 nt, Escherichia coli CFT073
cggaacaucugcccc

SEQ ID NO: 2649119 - RNA, 23 nt, Escherichia coli CFT073
cggaacaucugccccauugcuga

SEQ ID NO: 2649120 - RNA, 14 nt, Escherichia coli CFT073
cggaacccagcgcg

SEQ ID NO: 2649121 - RNA, 21 nt, Escherichia coli CFT073
cggaaccgcaggcugauaacc

SEQ ID NO: 2649122 - RNA, 20 nt, Escherichia coli CFT073
cggaaccuggucagaaacgu

SEQ ID NO: 2649123 - RNA, 13 nt, Escherichia coli CFT073
cggaacgccgcug

SEQ ID NO: 2649124 - RNA, 16 nt, Escherichia coli CFT073
cggaacgggagaaacc

SEQ ID NO: 2649125 - RNA, 17 nt, Escherichia coli CFT073
cggaacucgcugcgcgg

SEQ ID NO: 2649126 - RNA, 13 nt, Escherichia coli CFT073
cggaacuuuuuuc

SEQ ID NO: 2649127 - RNA, 17 nt, Escherichia coli CFT073
cggaagagacuauuucu

SEQ ID NO: 2649128 - RNA, 22 nt, Escherichia coli CFT073
cggaagcaaaauaaccggcaag

SEQ ID NO: 2649129 - RNA, 12 nt, Escherichia coli CFT073
cggaagccacca

SEQ ID NO: 2649130 - RNA, 13 nt, Escherichia coli CFT073
cggaagccaccac

SEQ ID NO: 2649131 - RNA, 15 nt, Escherichia coli CFT073
cggaagccaccacgc

SEQ ID NO: 2649132 - RNA, 16 nt, Escherichia coli CFT073
cggaagcgccaccagc

SEQ ID NO: 2649133 - RNA, 23 nt, Escherichia coli CFT073
cggaagggaacagagagcgccuc

SEQ ID NO: 2649134 - RNA, 19 nt, Escherichia coli CFT073
cggaaggguaaacacccag

SEQ ID NO: 2649135 - RNA, 23 nt, Escherichia coli CFT073
cggaaggguaaacacccaggcca

SEQ ID NO: 2649136 - RNA, 17 nt, Escherichia coli CFT073
cggaaguguguaucuuc

SEQ ID NO: 2649137 - RNA, 15 nt, Escherichia coli CFT073
cggaaguuuaauccg

SEQ ID NO: 2649138 - RNA, 18 nt, Escherichia coli CFT073
cggaauaaaaagcgauau

SEQ ID NO: 2649139 - RNA, 15 nt, Escherichia coli CFT073
cggaauaagggauca

SEQ ID NO: 2649140 - RNA, 13 nt, Escherichia coli CFT073
cggaauaauaaug

SEQ ID NO: 2649141 - RNA, 15 nt, Escherichia coli CFT073
cggaauaaucagaug

SEQ ID NO: 2649142 - RNA, 23 nt, Escherichia coli CFT073
cggaauaaucuguaccuucugca

SEQ ID NO: 2649143 - RNA, 23 nt, Escherichia coli CFT073
cggaauagaaccuaagaaccaga

SEQ ID NO: 2649144 - RNA, 15 nt, Escherichia coli CFT073
cggaauaucagaggc

SEQ ID NO: 2649145 - RNA, 15 nt, Escherichia coli CFT073
cggaauaucgcuggc

SEQ ID NO: 2649146 - RNA, 23 nt, Escherichia coli CFT073
cggaaucaacggcaacaauuucc

SEQ ID NO: 2649147 - RNA, 16 nt, Escherichia coli CFT073
cggaaucaccggcaaa

SEQ ID NO: 2649148 - RNA, 23 nt, Escherichia coli CFT073
cggaauccaacaacugcgcacga

SEQ ID NO: 2649149 - RNA, 15 nt, Escherichia coli CFT073
cggaauccacuugcg

SEQ ID NO: 2649150 - RNA, 15 nt, Escherichia coli CFT073
cggaaucccuuccgc

SEQ ID NO: 2649151 - RNA, 18 nt, Escherichia coli CFT073
cggaaugcagucacgcca

SEQ ID NO: 2649152 - RNA, 21 nt, Escherichia coli CFT073
cggaaugcagucacgccagua

SEQ ID NO: 2649153 - RNA, 19 nt, Escherichia coli CFT073
cggaauggacuguucacca

SEQ ID NO: 2649154 - RNA, 19 nt, Escherichia coli CFT073
cggaauggucaccacaaau

SEQ ID NO: 2649155 - RNA, 23 nt, Escherichia coli CFT073
cggaauuucuuucagcaguucag

SEQ ID NO: 2649156 - RNA, 20 nt, Escherichia coli CFT073
cggacaaauaacccgccaug

SEQ ID NO: 2649157 - RNA, 11 nt, Escherichia coli CFT073
cggacaaaucg

SEQ ID NO: 2649158 - RNA, 15 nt, Escherichia coli CFT073
cggacacuuuccugc

SEQ ID NO: 2649159 - RNA, 17 nt, Escherichia coli CFT073
cggacagucacguagcg

SEQ ID NO: 2649160 - RNA, 13 nt, Escherichia coli CFT073
cggacauguugcu

SEQ ID NO: 2649161 - RNA, 17 nt, Escherichia coli CFT073
cggacauguuuuccagc

SEQ ID NO: 2649162 - RNA, 20 nt, Escherichia coli CFT073
cggaccaauaaacgccaggu

SEQ ID NO: 2649163 - RNA, 15 nt, Escherichia coli CFT073
cggaccacgcacagc

SEQ ID NO: 2649164 - RNA, 22 nt, Escherichia coli CFT073
cggaccaucuuccagcugcacg

SEQ ID NO: 2649165 - RNA, 20 nt, Escherichia coli CFT073
cggaccccgcgcucgcgcag

SEQ ID NO: 2649166 - RNA, 14 nt, Escherichia coli CFT073
cggaccgcauucac

SEQ ID NO: 2649167 - RNA, 13 nt, Escherichia coli CFT073
cggaccuuuugcc

SEQ ID NO: 2649168 - RNA, 24 nt, Escherichia coli CFT073
cggacgaccgugcgccagcaaauc

SEQ ID NO: 2649169 - RNA, 18 nt, Escherichia coli CFT073
cggacgcaccuugccaaa

SEQ ID NO: 2649170 - RNA, 17 nt, Escherichia coli CFT073
cggacgcccgccgacca

SEQ ID NO: 2649171 - RNA, 14 nt, Escherichia coli CFT073
cggacgcgcaggag

SEQ ID NO: 2649172 - RNA, 16 nt, Escherichia coli CFT073
cggacgcgcaggagcg

SEQ ID NO: 2649173 - RNA, 23 nt, Escherichia coli CFT073
cggacguugaguuuacgcagcag

SEQ ID NO: 2649174 - RNA, 15 nt, Escherichia coli CFT073
cggacguuugccaug

SEQ ID NO: 2649175 - RNA, 23 nt, Escherichia coli CFT073
cggacguuugccaugcauaucca

SEQ ID NO: 2649176 - RNA, 18 nt, Escherichia coli CFT073
cggacuucuuugucguac

SEQ ID NO: 2649177 - RNA, 20 nt, Escherichia coli CFT073
cggacuucuuugucguacca

SEQ ID NO: 2649178 - RNA, 15 nt, Escherichia coli CFT073
cggacuuuuuauuua

SEQ ID NO: 2649179 - RNA, 15 nt, Escherichia coli CFT073
cggagaauagcgcca

SEQ ID NO: 2649180 - RNA, 16 nt, Escherichia coli CFT073
cggagaauagcgccau

SEQ ID NO: 2649181 - RNA, 16 nt, Escherichia coli CFT073
cggagaauccagcccc

SEQ ID NO: 2649182 - RNA, 19 nt, Escherichia coli CFT073
cggagacagcuuagacaac

SEQ ID NO: 2649183 - RNA, 11 nt, Escherichia coli CFT073
cggagaggggg

SEQ ID NO: 2649184 - RNA, 17 nt, Escherichia coli CFT073
cggagaguaaacgguga

SEQ ID NO: 2649185 - RNA, 18 nt, Escherichia coli CFT073
cggagaucaccacauacu

SEQ ID NO: 2649186 - RNA, 17 nt, Escherichia coli CFT073
cggagcaugcuccggcc

SEQ ID NO: 2649187 - RNA, 19 nt, Escherichia coli CFT073
cggaggaaacuugccuccg

SEQ ID NO: 2649188 - RNA, 22 nt, Escherichia coli CFT073
cggaggaaacuugccuccggca

SEQ ID NO: 2649189 - RNA, 15 nt, Escherichia coli CFT073
cggaggagugcgcca

SEQ ID NO: 2649190 - RNA, 18 nt, Escherichia coli CFT073
cggaggccugauaaaacg

SEQ ID NO: 2649191 - RNA, 20 nt, Escherichia coli CFT073
cggaggccugauaaaacgcg

SEQ ID NO: 2649192 - RNA, 15 nt, Escherichia coli CFT073
cggaggcgauaauga

SEQ ID NO: 2649193 - RNA, 15 nt, Escherichia coli CFT073
cggagguuuuuuccu

SEQ ID NO: 2649194 - RNA, 15 nt, Escherichia coli CFT073
cggaguaagaauaaa

SEQ ID NO: 2649195 - RNA, 16 nt, Escherichia coli CFT073
cggaguugcagauuug

SEQ ID NO: 2649196 - RNA, 20 nt, Escherichia coli CFT073
cggauaaaugacucacguua

SEQ ID NO: 2649197 - RNA, 22 nt, Escherichia coli CFT073
cggauaaaugacucacguuacu

SEQ ID NO: 2649198 - RNA, 23 nt, Escherichia coli CFT073
cggauaacgcguucacccgcauc

SEQ ID NO: 2649199 - RNA, 21 nt, Escherichia coli CFT073
cggauaagacgcgccagcgcc

SEQ ID NO: 2649200 - RNA, 22 nt, Escherichia coli CFT073
cggauaagacgcgucagcgccg

SEQ ID NO: 2649201 - RNA, 19 nt, Escherichia coli CFT073
cggauaagaggcgccagca

SEQ ID NO: 2649202 - RNA, 16 nt, Escherichia coli CFT073
cggauaagaugcgcca

SEQ ID NO: 2649203 - RNA, 17 nt, Escherichia coli CFT073
cggauaaggcguucacg

SEQ ID NO: 2649204 - RNA, 23 nt, Escherichia coli CFT073
cggauaaggcguucacgccgcau

SEQ ID NO: 2649205 - RNA, 23 nt, Escherichia coli CFT073
cggauaaggcguuuacgccgcau

SEQ ID NO: 2649206 - RNA, 16 nt, Escherichia coli CFT073
cggauaaucggcaaua

SEQ ID NO: 2649207 - RNA, 21 nt, Escherichia coli CFT073
cggauaauggagccagaucug

SEQ ID NO: 2649208 - RNA, 14 nt, Escherichia coli CFT073
cggauagagcgcug

SEQ ID NO: 2649209 - RNA, 22 nt, Escherichia coli CFT073
cggauagccagcaucgcaucga

SEQ ID NO: 2649210 - RNA, 16 nt, Escherichia coli CFT073
cggauagccauccccg

SEQ ID NO: 2649211 - RNA, 19 nt, Escherichia coli CFT073
cggauagccgccccagacu

SEQ ID NO: 2649212 - RNA, 21 nt, Escherichia coli CFT073
cggauaggcaccgccaaagau

SEQ ID NO: 2649213 - RNA, 16 nt, Escherichia coli CFT073
cggauaggccauaauc

SEQ ID NO: 2649214 - RNA, 22 nt, Escherichia coli CFT073
cggauaucccccuuucugcaug

SEQ ID NO: 2649215 - RNA, 14 nt, Escherichia coli CFT073
cggauaucgaggau

SEQ ID NO: 2649216 - RNA, 16 nt, Escherichia coli CFT073
cggauaucgaggauca

SEQ ID NO: 2649217 - RNA, 15 nt, Escherichia coli CFT073
cggauaucggcagcg

SEQ ID NO: 2649218 - RNA, 18 nt, Escherichia coli CFT073
cggauauuuuccagcaac

SEQ ID NO: 2649219 - RNA, 15 nt, Escherichia coli CFT073
cggaucaauccccag

SEQ ID NO: 2649220 - RNA, 12 nt, Escherichia coli CFT073
cggaucaggcag

SEQ ID NO: 2649221 - RNA, 18 nt, Escherichia coli CFT073
cggaucaguuuauccaua

SEQ ID NO: 2649222 - RNA, 13 nt, Escherichia coli CFT073
cggauccagcggu

SEQ ID NO: 2649223 - RNA, 21 nt, Escherichia coli CFT073
cggauccagcgguuggagcac

SEQ ID NO: 2649224 - RNA, 18 nt, Escherichia coli CFT073
cggaucgaagacaucauc

SEQ ID NO: 2649225 - RNA, 15 nt, Escherichia coli CFT073
cggaucgaugccaaa

SEQ ID NO: 2649226 - RNA, 14 nt, Escherichia coli CFT073
cggaucgccgccgg

SEQ ID NO: 2649227 - RNA, 15 nt, Escherichia coli CFT073
cggaucgccgccgga

SEQ ID NO: 2649228 - RNA, 17 nt, Escherichia coli CFT073
cggaucgcgugcggcau

SEQ ID NO: 2649229 - RNA, 13 nt, Escherichia coli CFT073
cggaucggcuggc

SEQ ID NO: 2649230 - RNA, 16 nt, Escherichia coli CFT073
cggaucggcuggcggc

SEQ ID NO: 2649231 - RNA, 13 nt, Escherichia coli CFT073
cggaucguucacg

SEQ ID NO: 2649232 - RNA, 11 nt, Escherichia coli CFT073
cggaucuccgg

SEQ ID NO: 2649233 - RNA, 18 nt, Escherichia coli CFT073
cggaucugaucagcacga

SEQ ID NO: 2649234 - RNA, 14 nt, Escherichia coli CFT073
cggaucuuccagcg

SEQ ID NO: 2649235 - RNA, 16 nt, Escherichia coli CFT073
cggaucuuccagcgca

SEQ ID NO: 2649236 - RNA, 23 nt, Escherichia coli CFT073
cggaucuuucaggaacagcgaca

SEQ ID NO: 2649237 - RNA, 17 nt, Escherichia coli CFT073
cggaugacccagcgcca

SEQ ID NO: 2649238 - RNA, 16 nt, Escherichia coli CFT073
cggaugacccagcgcg

SEQ ID NO: 2649239 - RNA, 17 nt, Escherichia coli CFT073
cggaugacccagcgcga

SEQ ID NO: 2649240 - RNA, 20 nt, Escherichia coli CFT073
cggaugacuucgcuacccug

SEQ ID NO: 2649241 - RNA, 22 nt, Escherichia coli CFT073
cggaugaggcguuaacagcgca

SEQ ID NO: 2649242 - RNA, 15 nt, Escherichia coli CFT073
cggaugaguacagcg

SEQ ID NO: 2649243 - RNA, 16 nt, Escherichia coli CFT073
cggaugaucauccggc

SEQ ID NO: 2649244 - RNA, 16 nt, Escherichia coli CFT073
cggaugauuaccggag

SEQ ID NO: 2649245 - RNA, 14 nt, Escherichia coli CFT073
cggaugauuauguc

SEQ ID NO: 2649246 - RNA, 14 nt, Escherichia coli CFT073
cggaugauucacau

SEQ ID NO: 2649247 - RNA, 13 nt, Escherichia coli CFT073
cggaugauuccgc

SEQ ID NO: 2649248 - RNA, 24 nt, Escherichia coli CFT073
cggaugcagcaucaugucgcccac

SEQ ID NO: 2649249 - RNA, 16 nt, Escherichia coli CFT073
cggaugcgacgcuggc

SEQ ID NO: 2649250 - RNA, 16 nt, Escherichia coli CFT073
cggaugcgaugcuggc

SEQ ID NO: 2649251 - RNA, 15 nt, Escherichia coli CFT073
cggaugcgccgucag

SEQ ID NO: 2649252 - RNA, 13 nt, Escherichia coli CFT073
cggaugcgcuucu

SEQ ID NO: 2649253 - RNA, 17 nt, Escherichia coli CFT073
cggaugcggcauaaacg

SEQ ID NO: 2649254 - RNA, 14 nt, Escherichia coli CFT073
cggaugcggcgauu

SEQ ID NO: 2649255 - RNA, 13 nt, Escherichia coli CFT073
cggaugcggcgcg

SEQ ID NO: 2649256 - RNA, 16 nt, Escherichia coli CFT073
cggaugcggcgcgagc

SEQ ID NO: 2649257 - RNA, 19 nt, Escherichia coli CFT073
cggaugcguuguaccagcu

SEQ ID NO: 2649258 - RNA, 19 nt, Escherichia coli CFT073
cggauggauccccgcagca

SEQ ID NO: 2649259 - RNA, 20 nt, Escherichia coli CFT073
cggauggcagaguaucgcca

SEQ ID NO: 2649260 - RNA, 14 nt, Escherichia coli CFT073
cggaugggcugaug

SEQ ID NO: 2649261 - RNA, 22 nt, Escherichia coli CFT073
cggaugugaugcauccggcaca

SEQ ID NO: 2649262 - RNA, 20 nt, Escherichia coli CFT073
cggcagccugcgucgccauc

SEQ ID NO: 2649263 - RNA, 13 nt, Escherichia coli CFT073
cggcagcgcgcuc

SEQ ID NO: 2649264 - RNA, 22 nt, Escherichia coli CFT073
cggcagcgucgcauccaacaau

SEQ ID NO: 2649265 - RNA, 21 nt, Escherichia coli CFT073
cggcagcgugccaggcgcgcu

SEQ ID NO: 2649266 - RNA, 15 nt, Escherichia coli CFT073
cggcagcucuuucuc

SEQ ID NO: 2649267 - RNA, 21 nt, Escherichia coli CFT073
cggcagcucuuucucgcucag

SEQ ID NO: 2649268 - RNA, 18 nt, Escherichia coli CFT073
cggcagcuuuaccggcuu

SEQ ID NO: 2649269 - RNA, 14 nt, Escherichia coli CFT073
cggcaggaaaauag

SEQ ID NO: 2649270 - RNA, 14 nt, Escherichia coli CFT073
cggcaggaacagau

SEQ ID NO: 2649271 - RNA, 23 nt, Escherichia coli CFT073
cggcaggauaaucagguuggcgc

SEQ ID NO: 2649272 - RNA, 17 nt, Escherichia coli CFT073
cggcaggccuaacacau

SEQ ID NO: 2649273 - RNA, 22 nt, Escherichia coli CFT073
cggcaggccuaacacaugcaag

SEQ ID NO: 2649274 - RNA, 17 nt, Escherichia coli CFT073
cggcaggguuugcgccc

SEQ ID NO: 2649275 - RNA, 19 nt, Escherichia coli CFT073
cggcaggugauggcggcuu

SEQ ID NO: 2649276 - RNA, 17 nt, Escherichia coli CFT073
cggcagguugaugauga

SEQ ID NO: 2649277 - RNA, 17 nt, Escherichia coli CFT073
cggcaguauagcggcau

SEQ ID NO: 2649278 - RNA, 19 nt, Escherichia coli CFT073
cggcaguauuaccagaccu

SEQ ID NO: 2649279 - RNA, 15 nt, Escherichia coli CFT073
cggcagugacagccc

SEQ ID NO: 2649280 - RNA, 18 nt, Escherichia coli CFT073
cggcaguggcuaagcagg

SEQ ID NO: 2649281 - RNA, 21 nt, Escherichia coli CFT073
cggcaguggcuaagcaggcug

SEQ ID NO: 2649282 - RNA, 16 nt, Escherichia coli CFT073
cggcaguuugagauug

SEQ ID NO: 2649283 - RNA, 17 nt, Escherichia coli CFT073
cggcaguuuuaccgccg

SEQ ID NO: 2649284 - RNA, 22 nt, Escherichia coli CFT073
cggcauacuuugauuaaccguu

SEQ ID NO: 2649285 - RNA, 23 nt, Escherichia coli CFT073
cggcauagccaccuggcugcguu

SEQ ID NO: 2649286 - RNA, 13 nt, Escherichia coli CFT073
cggcaucaaccag

SEQ ID NO: 2649287 - RNA, 15 nt, Escherichia coli CFT073
cggcaucaaccgccg

SEQ ID NO: 2649288 - RNA, 16 nt, Escherichia coli CFT073
cggcaucaguaacuua

SEQ ID NO: 2649289 - RNA, 20 nt, Escherichia coli CFT073
cggcaucauacacgccgccu

SEQ ID NO: 2649290 - RNA, 21 nt, Escherichia coli CFT073
cggcaucauacacgccgccua

SEQ ID NO: 2649291 - RNA, 20 nt, Escherichia coli CFT073
cggcauccagaccgcuguaa

SEQ ID NO: 2649292 - RNA, 15 nt, Escherichia coli CFT073
cggcaucgcaaacca

SEQ ID NO: 2649293 - RNA, 22 nt, Escherichia coli CFT073
cggcaucgccagcgcggcggca

SEQ ID NO: 2649294 - RNA, 21 nt, Escherichia coli CFT073
cggcaucgcgguugcugucgg

SEQ ID NO: 2649295 - RNA, 22 nt, Escherichia coli CFT073
cggcaucgcgguugcugucggc

SEQ ID NO: 2649296 - RNA, 18 nt, Escherichia coli CFT073
cggcaucuucuccacgcc

SEQ ID NO: 2649297 - RNA, 16 nt, Escherichia coli CFT073
cggcauggaucgccgc

SEQ ID NO: 2649298 - RNA, 17 nt, Escherichia coli CFT073
cggcauggaucgccgcg

SEQ ID NO: 2649299 - RNA, 18 nt, Escherichia coli CFT073
cggcauggaucgccgcgg

SEQ ID NO: 2649300 - RNA, 17 nt, Escherichia coli CFT073
cggcauggggucaggug

SEQ ID NO: 2649301 - RNA, 15 nt, Escherichia coli CFT073
cggcauuagcaucaa

SEQ ID NO: 2649302 - RNA, 15 nt, Escherichia coli CFT073
cggcauugccgucgg

SEQ ID NO: 2649303 - RNA, 20 nt, Escherichia coli CFT073
cggcauugccgucgggauuc

SEQ ID NO: 2649304 - RNA, 16 nt, Escherichia coli CFT073
cggcauuguucauuug

SEQ ID NO: 2649305 - RNA, 16 nt, Escherichia coli CFT073
cggcauuguucugcaa

SEQ ID NO: 2649306 - RNA, 17 nt, Escherichia coli CFT073
cggcauuuauuccgcac

SEQ ID NO: 2649307 - RNA, 14 nt, Escherichia coli CFT073
cggcauuuccgcca

SEQ ID NO: 2649308 - RNA, 15 nt, Escherichia coli CFT073
cggcauuuugcugau

SEQ ID NO: 2649309 - RNA, 23 nt, Escherichia coli CFT073
cggcauuuuuuaucacuucuucu

SEQ ID NO: 2649310 - RNA, 23 nt, Escherichia coli CFT073
cggcauuuuuuauggagaaaaca

SEQ ID NO: 2649311 - RNA, 14 nt, Escherichia coli CFT073
cggccaaaagcaca

SEQ ID NO: 2649312 - RNA, 17 nt, Escherichia coli CFT073
cggccaaaagcacaauc

SEQ ID NO: 2649313 - RNA, 21 nt, Escherichia coli CFT073
cggccaaaagcacaauccgcc

SEQ ID NO: 2649314 - RNA, 15 nt, Escherichia coli CFT073
cggccaaauauccgc

SEQ ID NO: 2649315 - RNA, 13 nt, Escherichia coli CFT073
cggccacagcgcc

SEQ ID NO: 2649316 - RNA, 14 nt, Escherichia coli CFT073
cggccacagcgcca

SEQ ID NO: 2649317 - RNA, 16 nt, Escherichia coli CFT073
cggccacagcgccaga

SEQ ID NO: 2649318 - RNA, 15 nt, Escherichia coli CFT073
cggccacgaucccgg

SEQ ID NO: 2649319 - RNA, 23 nt, Escherichia coli CFT073
cggccagacaccggcuuucaccu

SEQ ID NO: 2649320 - RNA, 14 nt, Escherichia coli CFT073
cggccagcgcaccu

SEQ ID NO: 2649321 - RNA, 14 nt, Escherichia coli CFT073
cggccagcgccacc

SEQ ID NO: 2649322 - RNA, 20 nt, Escherichia coli CFT073
cggccagcgccaccaccagu

SEQ ID NO: 2649323 - RNA, 14 nt, Escherichia coli CFT073
cggccagcgggcgu

SEQ ID NO: 2649324 - RNA, 22 nt, Escherichia coli CFT073
cggccagcgggcgucaaaauca

SEQ ID NO: 2649325 - RNA, 20 nt, Escherichia coli CFT073
cggccaguagcuugaaauca

SEQ ID NO: 2649326 - RNA, 22 nt, Escherichia coli CFT073
cggccaguguuuaucaucucgg

SEQ ID NO: 2649327 - RNA, 17 nt, Escherichia coli CFT073
cggccaguugcgcaacg

SEQ ID NO: 2649328 - RNA, 18 nt, Escherichia coli CFT073
cggccaguugcgcaacgu

SEQ ID NO: 2649329 - RNA, 15 nt, Escherichia coli CFT073
cggccaguuucggac

SEQ ID NO: 2649330 - RNA, 22 nt, Escherichia coli CFT073
cggccaguuucggacgcggcac

SEQ ID NO: 2649331 - RNA, 12 nt, Escherichia coli CFT073
cggccaucccag

SEQ ID NO: 2649332 - RNA, 20 nt, Escherichia coli CFT073
cggccaugaccgcuccgcca

SEQ ID NO: 2649333 - RNA, 20 nt, Escherichia coli CFT073
cggccaugauaaacggcacu

SEQ ID NO: 2649334 - RNA, 15 nt, Escherichia coli CFT073
cggccauugaauauu

SEQ ID NO: 2649335 - RNA, 17 nt, Escherichia coli CFT073
cggccauugcccgagga

SEQ ID NO: 2649336 - RNA, 18 nt, Escherichia coli CFT073
cggccauugcccgaggau

SEQ ID NO: 2649337 - RNA, 17 nt, Escherichia coli CFT073
cggccauuuucauuuaa

SEQ ID NO: 2649338 - RNA, 23 nt, Escherichia coli CFT073
cggcccauaacccacaccauaau

SEQ ID NO: 2649339 - RNA, 17 nt, Escherichia coli CFT073
cggccccauuuauuucu

SEQ ID NO: 2649340 - RNA, 20 nt, Escherichia coli CFT073
cggccccgucgcccgaugcc

SEQ ID NO: 2649341 - RNA, 15 nt, Escherichia coli CFT073
cggccccuauaucaa

SEQ ID NO: 2649342 - RNA, 15 nt, Escherichia coli CFT073
cggcccggaggaugc

SEQ ID NO: 2649343 - RNA, 19 nt, Escherichia coli CFT073
cggcccguacugaacccgg

SEQ ID NO: 2649344 - RNA, 17 nt, Escherichia coli CFT073
cggccguaagaaaguca

SEQ ID NO: 2649345 - RNA, 22 nt, Escherichia coli CFT073
cggccuacaaaagcaauaauuu

SEQ ID NO: 2649346 - RNA, 14 nt, Escherichia coli CFT073
cggccuaccgcauc

SEQ ID NO: 2649347 - RNA, 15 nt, Escherichia coli CFT073
cggccuaccugacug

SEQ ID NO: 2649348 - RNA, 20 nt, Escherichia coli CFT073
cggccugauauaucaccuuc

SEQ ID NO: 2649349 - RNA, 12 nt, Escherichia coli CFT073
cggccuggcacg

SEQ ID NO: 2649350 - RNA, 19 nt, Escherichia coli CFT073
cggccuggggaaugagcga

SEQ ID NO: 2649351 - RNA, 20 nt, Escherichia coli CFT073
cggccuugauuauuucccuc

SEQ ID NO: 2649352 - RNA, 18 nt, Escherichia coli CFT073
cggccuuuaacgccacga

SEQ ID NO: 2649353 - RNA, 22 nt, Escherichia coli CFT073
cggccuuuuuauuuagauaaac

SEQ ID NO: 2649354 - RNA, 21 nt, Escherichia coli CFT073
cggcgaaaauuacuuuccgcc

SEQ ID NO: 2649355 - RNA, 23 nt, Escherichia coli CFT073
cggcgaaacuggguuaccgccuu

SEQ ID NO: 2649356 - RNA, 15 nt, Escherichia coli CFT073
cggcgaaagcgucag

SEQ ID NO: 2649357 - RNA, 19 nt, Escherichia coli CFT073
cggcgaacauucccgguuu

SEQ ID NO: 2649358 - RNA, 17 nt, Escherichia coli CFT073
cggcgaagagagcgcca

SEQ ID NO: 2649359 - RNA, 18 nt, Escherichia coli CFT073
cggcgaagagagcgccag

SEQ ID NO: 2649360 - RNA, 19 nt, Escherichia coli CFT073
cggcgaagagagcgccagu

SEQ ID NO: 2649361 - RNA, 20 nt, Escherichia coli CFT073
cggcgaagagagcgccagua

SEQ ID NO: 2649362 - RNA, 17 nt, Escherichia coli CFT073
cggcgaaggcaucggca

SEQ ID NO: 2649363 - RNA, 14 nt, Escherichia coli CFT073
cggcgacaggaacc

SEQ ID NO: 2649364 - RNA, 14 nt, Escherichia coli CFT073
cggcgacuggcuga

SEQ ID NO: 2649365 - RNA, 15 nt, Escherichia coli CFT073
cggcgagaacgccuu

SEQ ID NO: 2649366 - RNA, 17 nt, Escherichia coli CFT073
cggcgagaucuucgcca

SEQ ID NO: 2649367 - RNA, 18 nt, Escherichia coli CFT073
cggcgaggaaucguucau

SEQ ID NO: 2649368 - RNA, 15 nt, Escherichia coli CFT073
cggcgagugugugga

SEQ ID NO: 2649369 - RNA, 15 nt, Escherichia coli CFT073
cggcgauaccaguaa

SEQ ID NO: 2649370 - RNA, 19 nt, Escherichia coli CFT073
cggcuggguagcuuccugc

SEQ ID NO: 2649371 - RNA, 21 nt, Escherichia coli CFT073
cggcuggguagcuuccugcug

SEQ ID NO: 2649372 - RNA, 14 nt, Escherichia coli CFT073
cggcuguccggcac

SEQ ID NO: 2649373 - RNA, 15 nt, Escherichia coli CFT073
cggcuguuccggcac

SEQ ID NO: 2649374 - RNA, 19 nt, Escherichia coli CFT073
cggcuguuccggcacaccu

SEQ ID NO: 2649375 - RNA, 22 nt, Escherichia coli CFT073
cggcuguuccggcacaccuuca

SEQ ID NO: 2649376 - RNA, 22 nt, Escherichia coli CFT073
cggcuguugauguccaguuccc

SEQ ID NO: 2649377 - RNA, 22 nt, Escherichia coli CFT073
cggcuuauucauaucaaacgcc

SEQ ID NO: 2649378 - RNA, 23 nt, Escherichia coli CFT073
cggcuuauugcuucaagaugcca

SEQ ID NO: 2649379 - RNA, 20 nt, Escherichia coli CFT073
cggcuucaaaacagaaaccc

SEQ ID NO: 2649380 - RNA, 22 nt, Escherichia coli CFT073
cggcuucaaggugauauccacc

SEQ ID NO: 2649381 - RNA, 22 nt, Escherichia coli CFT073
cggcuucaaucaacauauuucu

SEQ ID NO: 2649382 - RNA, 22 nt, Escherichia coli CFT073
cggcuucagacaccguuuccau

SEQ ID NO: 2649383 - RNA, 13 nt, Escherichia coli CFT073
cggcuucaucuuu

SEQ ID NO: 2649384 - RNA, 17 nt, Escherichia coli CFT073
cggcuuccccaacacag

SEQ ID NO: 2649385 - RNA, 19 nt, Escherichia coli CFT073
cggcuuccuuaagccgcug

SEQ ID NO: 2649386 - RNA, 20 nt, Escherichia coli CFT073
cggcuucgcaucccgguauc

SEQ ID NO: 2649387 - RNA, 19 nt, Escherichia coli CFT073
cggcuugaggaagcgcgcc

SEQ ID NO: 2649388 - RNA, 21 nt, Escherichia coli CFT073
cggcuugaggaagcgcgccgu

SEQ ID NO: 2649389 - RNA, 15 nt, Escherichia coli CFT073
cggcuugcaccagca

SEQ ID NO: 2649390 - RNA, 22 nt, Escherichia coli CFT073
cggcuuuaccaccgucaauaaa

SEQ ID NO: 2649391 - RNA, 20 nt, Escherichia coli CFT073
cggcuuucugcaaccagaaa

SEQ ID NO: 2649392 - RNA, 16 nt, Escherichia coli CFT073
cggcuuugaucagcgu

SEQ ID NO: 2649393 - RNA, 17 nt, Escherichia coli CFT073
cggcuuuuuuacgccug

SEQ ID NO: 2649394 - RNA, 18 nt, Escherichia coli CFT073
cggcuuuuuuacgccugu

SEQ ID NO: 2649395 - RNA, 21 nt, Escherichia coli CFT073
cggcuuuuuuauugcugcacc

SEQ ID NO: 2649396 - RNA, 13 nt, Escherichia coli CFT073
cggcuuuuuucuc

SEQ ID NO: 2649397 - RNA, 19 nt, Escherichia coli CFT073
cgggaaaaauugccugaug

SEQ ID NO: 2649398 - RNA, 20 nt, Escherichia coli CFT073
cgggaaaacauacacauuuu

SEQ ID NO: 2649399 - RNA, 14 nt, Escherichia coli CFT073
cgggaaaagaaaua

SEQ ID NO: 2649400 - RNA, 14 nt, Escherichia coli CFT073
cgggaaauagcuua

SEQ ID NO: 2649401 - RNA, 13 nt, Escherichia coli CFT073
cgggaacagccac

SEQ ID NO: 2649402 - RNA, 22 nt, Escherichia coli CFT073
cgggaacagccacaguuugcug

SEQ ID NO: 2649403 - RNA, 21 nt, Escherichia coli CFT073
cgggaacagugcucuuuguag

SEQ ID NO: 2649404 - RNA, 18 nt, Escherichia coli CFT073
cgggaacagugcuuuuug

SEQ ID NO: 2649405 - RNA, 15 nt, Escherichia coli CFT073
cgggaagugcgccca

SEQ ID NO: 2649406 - RNA, 15 nt, Escherichia coli CFT073
cgggaauaaaagcca

SEQ ID NO: 2649407 - RNA, 18 nt, Escherichia coli CFT073
cgggaauaaaagccagga

SEQ ID NO: 2649408 - RNA, 17 nt, Escherichia coli CFT073
cgggaauauuuaccgga

SEQ ID NO: 2649409 - RNA, 19 nt, Escherichia coli CFT073
cgggaauucaacuaacuga

SEQ ID NO: 2649410 - RNA, 17 nt, Escherichia coli CFT073
cgggacaacaaacgcaa

SEQ ID NO: 2649411 - RNA, 21 nt, Escherichia coli CFT073
cgggagaaacccggccacagc

SEQ ID NO: 2649412 - RNA, 19 nt, Escherichia coli CFT073
cgggagaauugccaaccga

SEQ ID NO: 2649413 - RNA, 17 nt, Escherichia coli CFT073
cgggagagccccagccg

SEQ ID NO: 2649414 - RNA, 14 nt, Escherichia coli CFT073
cgggagaguaucca

SEQ ID NO: 2649415 - RNA, 22 nt, Escherichia coli CFT073
cgggagaucgcguucccgacca

SEQ ID NO: 2649416 - RNA, 14 nt, Escherichia coli CFT073
cgggagcgcuuuuu

SEQ ID NO: 2649417 - RNA, 21 nt, Escherichia coli CFT073
cgggaguuucagcggcguguu

SEQ ID NO: 2649418 - RNA, 11 nt, Escherichia coli CFT073
cgggauaaacg

SEQ ID NO: 2649419 - RNA, 19 nt, Escherichia coli CFT073
cgggauagcguagugaugg

SEQ ID NO: 2649420 - RNA, 14 nt, Escherichia coli CFT073
cgggaucagguaag

SEQ ID NO: 2649421 - RNA, 23 nt, Escherichia coli CFT073
cgggauccaguuauugucgaggu

SEQ ID NO: 2649422 - RNA, 13 nt, Escherichia coli CFT073
cgggaucgccgga

SEQ ID NO: 2649423 - RNA, 14 nt, Escherichia coli CFT073
cgggaucuccucca

SEQ ID NO: 2649424 - RNA, 19 nt, Escherichia coli CFT073
cgggaucuuauccugcguu

SEQ ID NO: 2649425 - RNA, 22 nt, Escherichia coli CFT073
cgggauguacguucgcgggcgu

SEQ ID NO: 2649426 - RNA, 23 nt, Escherichia coli CFT073
cgggauguugcugcgagcuguau

SEQ ID NO: 2649427 - RNA, 13 nt, Escherichia coli CFT073
cgggauuccugcg

SEQ ID NO: 2649428 - RNA, 18 nt, Escherichia coli CFT073
cgggauucuccugagaau

SEQ ID NO: 2649429 - RNA, 22 nt, Escherichia coli CFT073
cgggauugagauuucaccaauu

SEQ ID NO: 2649430 - RNA, 13 nt, Escherichia coli CFT073
cgggauugccagc

SEQ ID NO: 2649431 - RNA, 18 nt, Escherichia coli CFT073
cgggauuuuacuucccag

SEQ ID NO: 2649432 - RNA, 19 nt, Escherichia coli CFT073
cgggcaaagucaauaaaaa

SEQ ID NO: 2649433 - RNA, 17 nt, Escherichia coli CFT073
cgggcaacguuccagca

SEQ ID NO: 2649434 - RNA, 21 nt, Escherichia coli CFT073
cgggcaaggcugucgcaaauu

SEQ ID NO: 2649435 - RNA, 23 nt, Escherichia coli CFT073
cgggcaauaaucucaauauccgg

SEQ ID NO: 2649436 - RNA, 14 nt, Escherichia coli CFT073
cgggcaaucggcug

SEQ ID NO: 2649437 - RNA, 21 nt, Escherichia coli CFT073
cgggcaaucuccugcgcacgu

SEQ ID NO: 2649438 - RNA, 19 nt, Escherichia coli CFT073
cgggcaggcuucaacacag

SEQ ID NO: 2649439 - RNA, 16 nt, Escherichia coli CFT073
cgggcaggguagcgca

SEQ ID NO: 2649440 - RNA, 17 nt, Escherichia coli CFT073
cgggcaggguagcgcag

SEQ ID NO: 2649441 - RNA, 13 nt, Escherichia coli CFT073
cgggcauauuucc

SEQ ID NO: 2649442 - RNA, 22 nt, Escherichia coli CFT073
cgggcaugaacaaaucgcacgu

SEQ ID NO: 2649443 - RNA, 14 nt, Escherichia coli CFT073
cgggcauugaugaa

SEQ ID NO: 2649444 - RNA, 20 nt, Escherichia coli CFT073
cgggccaaaaaccggcacgc

SEQ ID NO: 2649445 - RNA, 14 nt, Escherichia coli CFT073
cgggccacauacug

SEQ ID NO: 2649446 - RNA, 18 nt, Escherichia coli CFT073
cgggccaccaugcccagu

SEQ ID NO: 2649447 - RNA, 23 nt, Escherichia coli CFT073
cgggccacgcugcgcuugcugcc

SEQ ID NO: 2649448 - RNA, 16 nt, Escherichia coli CFT073
cgggccauccaucaac

SEQ ID NO: 2649449 - RNA, 15 nt, Escherichia coli CFT073
cgggccgcaaaccag

SEQ ID NO: 2649450 - RNA, 21 nt, Escherichia coli CFT073
cgggccgcaaaccagcgcaug

SEQ ID NO: 2649451 - RNA, 13 nt, Escherichia coli CFT073
cgggccgcagaga

SEQ ID NO: 2649452 - RNA, 15 nt, Escherichia coli CFT073
cgggccguugucgac

SEQ ID NO: 2649453 - RNA, 17 nt, Escherichia coli CFT073
cgggccucgcagcggca

SEQ ID NO: 2649454 - RNA, 18 nt, Escherichia coli CFT073
cgggcgauacaccuucac

SEQ ID NO: 2649455 - RNA, 13 nt, Escherichia coli CFT073
cgggcgcugaggu

SEQ ID NO: 2649456 - RNA, 20 nt, Escherichia coli CFT073
cgggcgcuuccagccaugcc

SEQ ID NO: 2649457 - RNA, 23 nt, Escherichia coli CFT073
cgggcgucgaaaauaucgagcag

SEQ ID NO: 2649458 - RNA, 14 nt, Escherichia coli CFT073
cgggcgugcugccu

SEQ ID NO: 2649459 - RNA, 16 nt, Escherichia coli CFT073
cgggcgugcugccuuu

SEQ ID NO: 2649460 - RNA, 18 nt, Escherichia coli CFT073
cgggcgugcugccuuuuu

SEQ ID NO: 2649461 - RNA, 23 nt, Escherichia coli CFT073
cgggcuaacacccgucguugcaa

SEQ ID NO: 2649462 - RNA, 22 nt, Escherichia coli CFT073
cgggcuaacuucuuuuucgaca

SEQ ID NO: 2649463 - RNA, 23 nt, Escherichia coli CFT073
cgggcuaaucgucaucagcgcca

SEQ ID NO: 2649464 - RNA, 18 nt, Escherichia coli CFT073
cgggcuaucaugcccgga

SEQ ID NO: 2649465 - RNA, 19 nt, Escherichia coli CFT073
cgggcuccauggaaucacc

SEQ ID NO: 2649466 - RNA, 17 nt, Escherichia coli CFT073
cgggcugagucccccaa

SEQ ID NO: 2649467 - RNA, 16 nt, Escherichia coli CFT073
cgggcugcuguaccca

SEQ ID NO: 2649468 - RNA, 14 nt, Escherichia coli CFT073
cgggcuggcggggc

SEQ ID NO: 2649469 - RNA, 20 nt, Escherichia coli CFT073
cgggcuguuuuccagcacca

SEQ ID NO: 2649470 - RNA, 15 nt, Escherichia coli CFT073
cgggcuuccggcaau

SEQ ID NO: 2649471 - RNA, 15 nt, Escherichia coli CFT073
cgggcuuuaaucacc

SEQ ID NO: 2649472 - RNA, 18 nt, Escherichia coli CFT073
cggggagaaugccagcag

SEQ ID NO: 2649473 - RNA, 21 nt, Escherichia coli CFT073
cggggagagucauuaugcugg

SEQ ID NO: 2649474 - RNA, 19 nt, Escherichia coli CFT073
cggggagauauuccccaga

SEQ ID NO: 2649475 - RNA, 13 nt, Escherichia coli CFT073
cggggccagcgca

SEQ ID NO: 2649476 - RNA, 14 nt, Escherichia coli CFT073
cggggccagcgcau

SEQ ID NO: 2649477 - RNA, 16 nt, Escherichia coli CFT073
cggucaugauggcgau

SEQ ID NO: 2649478 - RNA, 15 nt, Escherichia coli CFT073
cgguccaauggucau

SEQ ID NO: 2649479 - RNA, 15 nt, Escherichia coli CFT073
cgguccacuuccugc

SEQ ID NO: 2649480 - RNA, 15 nt, Escherichia coli CFT073
cgguccaugcgaaga

SEQ ID NO: 2649481 - RNA, 11 nt, Escherichia coli CFT073
cggucccuucu

SEQ ID NO: 2649482 - RNA, 13 nt, Escherichia coli CFT073
cggucccuucugc

SEQ ID NO: 2649483 - RNA, 21 nt, Escherichia coli CFT073
cgguccgccacauaccacggc

SEQ ID NO: 2649484 - RNA, 15 nt, Escherichia coli CFT073
cgguccuucaucuuc

SEQ ID NO: 2649485 - RNA, 19 nt, Escherichia coli CFT073
cggucgaggcaaccagcac

SEQ ID NO: 2649486 - RNA, 20 nt, Escherichia coli CFT073
cggucgccgcgcaaauccac

SEQ ID NO: 2649487 - RNA, 13 nt, Escherichia coli CFT073
cggucgcuucgcg

SEQ ID NO: 2649488 - RNA, 18 nt, Escherichia coli CFT073
cggucgguaaacccggcc

SEQ ID NO: 2649489 - RNA, 20 nt, Escherichia coli CFT073
cggucuaccgauccggcacc

SEQ ID NO: 2649490 - RNA, 21 nt, Escherichia coli CFT073
cggucuaccgauccggcacca

SEQ ID NO: 2649491 - RNA, 18 nt, Escherichia coli CFT073
cggucugauacaugcugu

SEQ ID NO: 2649492 - RNA, 13 nt, Escherichia coli CFT073
cggucuggcagcu

SEQ ID NO: 2649493 - RNA, 24 nt, Escherichia coli CFT073
cggugaaaaaccaaucucccagcc

SEQ ID NO: 2649494 - RNA, 20 nt, Escherichia coli CFT073
cggugaagccaccagcgcca

SEQ ID NO: 2649495 - RNA, 21 nt, Escherichia coli CFT073
cggugaauucaguaccagcac

SEQ ID NO: 2649496 - RNA, 14 nt, Escherichia coli CFT073
cggugacacuuugu

SEQ ID NO: 2649497 - RNA, 15 nt, Escherichia coli CFT073
cggugacacuuugug

SEQ ID NO: 2649498 - RNA, 24 nt, Escherichia coli CFT073
cggugacacuuugugccaucgcca

SEQ ID NO: 2649499 - RNA, 23 nt, Escherichia coli CFT073
cggugacaucaauacgguugacg

SEQ ID NO: 2649500 - RNA, 18 nt, Escherichia coli CFT073
cggugaccgagcgcccgc

SEQ ID NO: 2649501 - RNA, 20 nt, Escherichia coli CFT073
cggugaccgagcgcccgcca

SEQ ID NO: 2649502 - RNA, 13 nt, Escherichia coli CFT073
cggugacuagcag

SEQ ID NO: 2649503 - RNA, 14 nt, Escherichia coli CFT073
cggugacuagcagc

SEQ ID NO: 2649504 - RNA, 11 nt, Escherichia coli CFT073
cggugacuuca

SEQ ID NO: 2649505 - RNA, 18 nt, Escherichia coli CFT073
cggugagacgccagaacc

SEQ ID NO: 2649506 - RNA, 20 nt, Escherichia coli CFT073
cggugagcacaucagcgccc

SEQ ID NO: 2649507 - RNA, 14 nt, Escherichia coli CFT073
cggugauacagcaa

SEQ ID NO: 2649508 - RNA, 23 nt, Escherichia coli CFT073
cggugauauacgccacuucaucg

SEQ ID NO: 2649509 - RNA, 16 nt, Escherichia coli CFT073
cggugauauccagguu

SEQ ID NO: 2649510 - RNA, 13 nt, Escherichia coli CFT073
cggugaugaugcu

SEQ ID NO: 2649511 - RNA, 18 nt, Escherichia coli CFT073
cggugauggccgcgccga

SEQ ID NO: 2649512 - RNA, 22 nt, Escherichia coli CFT073
cggugauucagcguaacgccca

SEQ ID NO: 2649513 - RNA, 15 nt, Escherichia coli CFT073
cggugauuuccgccg

SEQ ID NO: 2649514 - RNA, 22 nt, Escherichia coli CFT073
cggugauuuccgccgccagcag

SEQ ID NO: 2649515 - RNA, 23 nt, Escherichia coli CFT073
cggugauuuccgccgccagcaga

SEQ ID NO: 2649516 - RNA, 17 nt, Escherichia coli CFT073
cggugcaccugccagca

SEQ ID NO: 2649517 - RNA, 21 nt, Escherichia coli CFT073
cggugcaccuuguuucagcac

SEQ ID NO: 2649518 - RNA, 16 nt, Escherichia coli CFT073
cggugcagcagcuucg

SEQ ID NO: 2649519 - RNA, 23 nt, Escherichia coli CFT073
cggugcauccacuuugguuacac

SEQ ID NO: 2649520 - RNA, 16 nt, Escherichia coli CFT073
cggugcaucuucacac

SEQ ID NO: 2649521 - RNA, 13 nt, Escherichia coli CFT073
cggugccaucucc

SEQ ID NO: 2649522 - RNA, 17 nt, Escherichia coli CFT073
cggugccauuucgcugg

SEQ ID NO: 2649523 - RNA, 21 nt, Escherichia coli CFT073
cggugccgcgauaccacccgc

SEQ ID NO: 2649524 - RNA, 23 nt, Escherichia coli CFT073
cggugccgcgauaccacccgcag

SEQ ID NO: 2649525 - RNA, 13 nt, Escherichia coli CFT073
cggugccggagcg

SEQ ID NO: 2649526 - RNA, 15 nt, Escherichia coli CFT073
cggugccggagcgcg

SEQ ID NO: 2649527 - RNA, 14 nt, Escherichia coli CFT073
cggugccgguuuca

SEQ ID NO: 2649528 - RNA, 19 nt, Escherichia coli CFT073
cggugcgccaaacugccgu

SEQ ID NO: 2649529 - RNA, 16 nt, Escherichia coli CFT073
cggugcgcgcuggcau

SEQ ID NO: 2649530 - RNA, 21 nt, Escherichia coli CFT073
cggugcgggaguugaucgcca

SEQ ID NO: 2649531 - RNA, 17 nt, Escherichia coli CFT073
cggugcgguaagcugcg

SEQ ID NO: 2649532 - RNA, 15 nt, Escherichia coli CFT073
cggugcguugucauc

SEQ ID NO: 2649533 - RNA, 21 nt, Escherichia coli CFT073
cggugcucauuagcccggcaa

SEQ ID NO: 2649534 - RNA, 13 nt, Escherichia coli CFT073
cggugcuccagug

SEQ ID NO: 2649535 - RNA, 15 nt, Escherichia coli CFT073
cggugcuccagugcg

SEQ ID NO: 2649536 - RNA, 13 nt, Escherichia coli CFT073
cgguggaccacgg

SEQ ID NO: 2649537 - RNA, 18 nt, Escherichia coli CFT073
cgguggagagcauauaaa

SEQ ID NO: 2649538 - RNA, 13 nt, Escherichia coli CFT073
cgguggcaagcag

SEQ ID NO: 2649539 - RNA, 23 nt, Escherichia coli CFT073
cgguggcacauaauugagcagca

SEQ ID NO: 2649540 - RNA, 23 nt, Escherichia coli CFT073
cgguggcaguagcgccucuucca

SEQ ID NO: 2649541 - RNA, 22 nt, Escherichia coli CFT073
cgguggcggcgucagcggcugu

SEQ ID NO: 2649542 - RNA, 19 nt, Escherichia coli CFT073
cgguggcuggcgcggcgca

SEQ ID NO: 2649543 - RNA, 13 nt, Escherichia coli CFT073
cggugggcugaca

SEQ ID NO: 2649544 - RNA, 15 nt, Escherichia coli CFT073
cgguggugaaaagag

SEQ ID NO: 2649545 - RNA, 22 nt, Escherichia coli CFT073
cgguguaaccaccgcaggcagu

SEQ ID NO: 2649546 - RNA, 15 nt, Escherichia coli CFT073
cgguguaaccgcaac

SEQ ID NO: 2649547 - RNA, 18 nt, Escherichia coli CFT073
cgguguaggcauacacau

SEQ ID NO: 2649548 - RNA, 17 nt, Escherichia coli CFT073
cgguguauuaccuccgc

SEQ ID NO: 2649549 - RNA, 20 nt, Escherichia coli CFT073
cggugucaucgacaucaacg

SEQ ID NO: 2649550 - RNA, 16 nt, Escherichia coli CFT073
cgguguccacuuccgc

SEQ ID NO: 2649551 - RNA, 18 nt, Escherichia coli CFT073
cggugucgccgaagcagc

SEQ ID NO: 2649552 - RNA, 20 nt, Escherichia coli CFT073
cggugucuuuuugcuccgaa

SEQ ID NO: 2649553 - RNA, 17 nt, Escherichia coli CFT073
cggugugcggguuuucu

SEQ ID NO: 2649554 - RNA, 16 nt, Escherichia coli CFT073
cgguguggccugcuuu

SEQ ID NO: 2649555 - RNA, 16 nt, Escherichia coli CFT073
cgguguuucgggcagc

SEQ ID NO: 2649556 - RNA, 18 nt, Escherichia coli CFT073
cgguuaaaaacagccagc

SEQ ID NO: 2649557 - RNA, 21 nt, Escherichia coli CFT073
cgguuaaaaacagccagcagc

SEQ ID NO: 2649558 - RNA, 15 nt, Escherichia coli CFT073
cgguuaacagcgcac

SEQ ID NO: 2649559 - RNA, 17 nt, Escherichia coli CFT073
cgguuaacgccagccac

SEQ ID NO: 2649560 - RNA, 18 nt, Escherichia coli CFT073
cgguuaacgccagccaca

SEQ ID NO: 2649561 - RNA, 18 nt, Escherichia coli CFT073
cgguuaacugcaugucag

SEQ ID NO: 2649562 - RNA, 14 nt, Escherichia coli CFT073
cgguuaaucagaua

SEQ ID NO: 2649563 - RNA, 16 nt, Escherichia coli CFT073
cgguuagcucaacgca

SEQ ID NO: 2649564 - RNA, 23 nt, Escherichia coli CFT073
cgguuaucacccugugucgccga

SEQ ID NO: 2649565 - RNA, 14 nt, Escherichia coli CFT073
cgguuauccugcaa

SEQ ID NO: 2649566 - RNA, 16 nt, Escherichia coli CFT073
cgguuauccugcaaau

SEQ ID NO: 2649567 - RNA, 21 nt, Escherichia coli CFT073
cgguuaugaauaacuccgccg

SEQ ID NO: 2649568 - RNA, 17 nt, Escherichia coli CFT073
cgguucaauaucuuccu

SEQ ID NO: 2649569 - RNA, 14 nt, Escherichia coli CFT073
cgguucaucacgaa

SEQ ID NO: 2649570 - RNA, 22 nt, Escherichia coli CFT073
cgguucgagguaguagccgucu

SEQ ID NO: 2649571 - RNA, 15 nt, Escherichia coli CFT073
cgguucggacauguu

SEQ ID NO: 2649572 - RNA, 15 nt, Escherichia coli CFT073
cgguucggcgucgcc

SEQ ID NO: 2649573 - RNA, 20 nt, Escherichia coli CFT073
cgguucggcucaaugauaac

SEQ ID NO: 2649574 - RNA, 22 nt, Escherichia coli CFT073
cgguucuucaucuucaucaucu

SEQ ID NO: 2649575 - RNA, 22 nt, Escherichia coli CFT073
cgguugaacgccaaauucuuua

SEQ ID NO: 2649576 - RNA, 16 nt, Escherichia coli CFT073
cgguugagagcaaaca

SEQ ID NO: 2649577 - RNA, 19 nt, Escherichia coli CFT073
cgguugaucucaucuucca

SEQ ID NO: 2649578 - RNA, 14 nt, Escherichia coli CFT073
cgguugaucuccgc

SEQ ID NO: 2649579 - RNA, 22 nt, Escherichia coli CFT073
cgguugaugccguuccacccag

SEQ ID NO: 2649580 - RNA, 16 nt, Escherichia coli CFT073
cgguugcaaugcauca

SEQ ID NO: 2649581 - RNA, 22 nt, Escherichia coli CFT073
cgguugccccgcacgcuucauc

SEQ ID NO: 2649582 - RNA, 19 nt, Escherichia coli CFT073
cgguugcggaacccagcgc

SEQ ID NO: 2649583 - RNA, 12 nt, Escherichia coli CFT073
cgguugcuuuuc

SEQ ID NO: 2649584 - RNA, 14 nt, Escherichia coli CFT073
cgguuggccugaua

SEQ ID NO: 2649585 - RNA, 13 nt, Escherichia coli CFT073
cguacucuucaau

SEQ ID NO: 2649586 - RNA, 15 nt, Escherichia coli CFT073
cguacugaccguaag

SEQ ID NO: 2649587 - RNA, 12 nt, Escherichia coli CFT073
cguacugcaacg

SEQ ID NO: 2649588 - RNA, 12 nt, Escherichia coli CFT073
cguacugcugaa

SEQ ID NO: 2649589 - RNA, 15 nt, Escherichia coli CFT073
cguacugcugaauga

SEQ ID NO: 2649590 - RNA, 22 nt, Escherichia coli CFT073
cguacuggcaaucgccagcggc

SEQ ID NO: 2649591 - RNA, 15 nt, Escherichia coli CFT073
cguacuucacauacu

SEQ ID NO: 2649592 - RNA, 14 nt, Escherichia coli CFT073
cguagacauaaccg

SEQ ID NO: 2649593 - RNA, 15 nt, Escherichia coli CFT073
cguagaggugauaug

SEQ ID NO: 2649594 - RNA, 13 nt, Escherichia coli CFT073
cguagcaggaaau

SEQ ID NO: 2649595 - RNA, 15 nt, Escherichia coli CFT073
cguagccagauuguu

SEQ ID NO: 2649596 - RNA, 15 nt, Escherichia coli CFT073
cguagccaggcuuug

SEQ ID NO: 2649597 - RNA, 19 nt, Escherichia coli CFT073
cguagcccaucagcuggca

SEQ ID NO: 2649598 - RNA, 15 nt, Escherichia coli CFT073
cguagccccagucuu

SEQ ID NO: 2649599 - RNA, 19 nt, Escherichia coli CFT073
cguagccccagucuuccug

SEQ ID NO: 2649600 - RNA, 12 nt, Escherichia coli CFT073
cguagcgcagca

SEQ ID NO: 2649601 - RNA, 13 nt, Escherichia coli CFT073
cguagcgcaucag

SEQ ID NO: 2649602 - RNA, 20 nt, Escherichia coli CFT073
cguagcguaagaaagucgcg

SEQ ID NO: 2649603 - RNA, 16 nt, Escherichia coli CFT073
cguagcguuuuuucau

SEQ ID NO: 2649604 - RNA, 17 nt, Escherichia coli CFT073
cguagcucaucuucaua

SEQ ID NO: 2649605 - RNA, 14 nt, Escherichia coli CFT073
cguagcugcugcuc

SEQ ID NO: 2649606 - RNA, 23 nt, Escherichia coli CFT073
cguagcuguuguucgaucaguug

SEQ ID NO: 2649607 - RNA, 20 nt, Escherichia coli CFT073
cguaggccagauaaggcguu

SEQ ID NO: 2649608 - RNA, 15 nt, Escherichia coli CFT073
cguaggcccagccgu

SEQ ID NO: 2649609 - RNA, 12 nt, Escherichia coli CFT073
cguaggccggau

SEQ ID NO: 2649610 - RNA, 13 nt, Escherichia coli CFT073
cguaggccggaua

SEQ ID NO: 2649611 - RNA, 20 nt, Escherichia coli CFT073
cguaggccugauaagacgca

SEQ ID NO: 2649612 - RNA, 23 nt, Escherichia coli CFT073
cguaggcuucauuacgcgcuggg

SEQ ID NO: 2649613 - RNA, 18 nt, Escherichia coli CFT073
cguaggucggauaagacg

SEQ ID NO: 2649614 - RNA, 20 nt, Escherichia coli CFT073
cguaggucggauaagacgcg

SEQ ID NO: 2649615 - RNA, 18 nt, Escherichia coli CFT073
cguaguacccucugcacc

SEQ ID NO: 2649616 - RNA, 14 nt, Escherichia coli CFT073
cguaguaguucauc

SEQ ID NO: 2649617 - RNA, 18 nt, Escherichia coli CFT073
cguaguguaaaugcaaau

SEQ ID NO: 2649618 - RNA, 18 nt, Escherichia coli CFT073
cguaguuuuugcccauca

SEQ ID NO: 2649619 - RNA, 13 nt, Escherichia coli CFT073
cguauacgcuucg

SEQ ID NO: 2649620 - RNA, 13 nt, Escherichia coli CFT073
cguauagaucagc

SEQ ID NO: 2649621 - RNA, 20 nt, Escherichia coli CFT073
cguauccagcauaccuucca

SEQ ID NO: 2649622 - RNA, 19 nt, Escherichia coli CFT073
cguauccauuaccgccauc

SEQ ID NO: 2649623 - RNA, 21 nt, Escherichia coli CFT073
cguauccgacguuacgcgcca

SEQ ID NO: 2649624 - RNA, 16 nt, Escherichia coli CFT073
cguauccgguuuucca

SEQ ID NO: 2649625 - RNA, 13 nt, Escherichia coli CFT073
cguauccugcaug

SEQ ID NO: 2649626 - RNA, 19 nt, Escherichia coli CFT073
cguaucgaccagaauaagu

SEQ ID NO: 2649627 - RNA, 20 nt, Escherichia coli CFT073
cguaucguucgccagcucca

SEQ ID NO: 2649628 - RNA, 14 nt, Escherichia coli CFT073
cguaucuccaguaa

SEQ ID NO: 2649629 - RNA, 19 nt, Escherichia coli CFT073
cguaugauguauauuucug

SEQ ID NO: 2649630 - RNA, 14 nt, Escherichia coli CFT073
cguaugcagccagg

SEQ ID NO: 2649631 - RNA, 14 nt, Escherichia coli CFT073
cguaugcccagcgc

SEQ ID NO: 2649632 - RNA, 13 nt, Escherichia coli CFT073
cguaugcgaagcu

SEQ ID NO: 2649633 - RNA, 14 nt, Escherichia coli CFT073
cguauuacugagau

SEQ ID NO: 2649634 - RNA, 14 nt, Escherichia coli CFT073
cguauuaugcacac

SEQ ID NO: 2649635 - RNA, 18 nt, Escherichia coli CFT073
cguauuggugcauaacac

SEQ ID NO: 2649636 - RNA, 22 nt, Escherichia coli CFT073
cguauuggugcauaacacaaua

SEQ ID NO: 2649637 - RNA, 18 nt, Escherichia coli CFT073
cguauuucagccccagca

SEQ ID NO: 2649638 - RNA, 14 nt, Escherichia coli CFT073
cguauuuuuggcuc

SEQ ID NO: 2649639 - RNA, 23 nt, Escherichia coli CFT073
cguauuuuuggcucauaaaauca

SEQ ID NO: 2649640 - RNA, 20 nt, Escherichia coli CFT073
cgucaaaauucauaaagcua

SEQ ID NO: 2649641 - RNA, 18 nt, Escherichia coli CFT073
cgucaaacucauaaacca

SEQ ID NO: 2649642 - RNA, 13 nt, Escherichia coli CFT073
cgucaaauccaga

SEQ ID NO: 2649643 - RNA, 22 nt, Escherichia coli CFT073
cgucaacaacacucucugcagu

SEQ ID NO: 2649644 - RNA, 12 nt, Escherichia coli CFT073
cgucaaccugac

SEQ ID NO: 2649645 - RNA, 17 nt, Escherichia coli CFT073
cgucaacuguacgccga

SEQ ID NO: 2649646 - RNA, 22 nt, Escherichia coli CFT073
cgucaagcgguaaccauccaua

SEQ ID NO: 2649647 - RNA, 13 nt, Escherichia coli CFT073
cgucaauaaaaac

SEQ ID NO: 2649648 - RNA, 15 nt, Escherichia coli CFT073
cgucaauaaucaugc

SEQ ID NO: 2649649 - RNA, 13 nt, Escherichia coli CFT073
cgucaauccagcc

SEQ ID NO: 2649650 - RNA, 13 nt, Escherichia coli CFT073
cgucaaucugccc

SEQ ID NO: 2649651 - RNA, 20 nt, Escherichia coli CFT073
cgucaaucugcccgaccaga

SEQ ID NO: 2649652 - RNA, 20 nt, Escherichia coli CFT073
cgucaauuugcuccgccagu

SEQ ID NO: 2649653 - RNA, 23 nt, Escherichia coli CFT073
cgucacaaauaccccugccgccg

SEQ ID NO: 2649654 - RNA, 13 nt, Escherichia coli CFT073
cgucacaccuuca

SEQ ID NO: 2649655 - RNA, 18 nt, Escherichia coli CFT073
cgucacaggccucaagcu

SEQ ID NO: 2649656 - RNA, 11 nt, Escherichia coli CFT073
cgucaccaccu

SEQ ID NO: 2649657 - RNA, 17 nt, Escherichia coli CFT073
cgucaccaccucacccg

SEQ ID NO: 2649658 - RNA, 12 nt, Escherichia coli CFT073
cgucaccagcau

SEQ ID NO: 2649659 - RNA, 11 nt, Escherichia coli CFT073
cgucaccgauu

SEQ ID NO: 2649660 - RNA, 14 nt, Escherichia coli CFT073
cgucaccugcccgg

SEQ ID NO: 2649661 - RNA, 15 nt, Escherichia coli CFT073
cgucacgcaccaacu

SEQ ID NO: 2649662 - RNA, 20 nt, Escherichia coli CFT073
cgucacgcaccaacuccucu

SEQ ID NO: 2649663 - RNA, 16 nt, Escherichia coli CFT073
cgucacggacucggcg

SEQ ID NO: 2649664 - RNA, 19 nt, Escherichia coli CFT073
cgucacgguuucaaagaaa

SEQ ID NO: 2649665 - RNA, 17 nt, Escherichia coli CFT073
cgucacguaggcuucau

SEQ ID NO: 2649666 - RNA, 21 nt, Escherichia coli CFT073
cgucacguaggcuucauuacg

SEQ ID NO: 2649667 - RNA, 22 nt, Escherichia coli CFT073
cgucacguugcgacaaaccagg

SEQ ID NO: 2649668 - RNA, 14 nt, Escherichia coli CFT073
cgucacucacgcug

SEQ ID NO: 2649669 - RNA, 20 nt, Escherichia coli CFT073
cgucacucacgcugcguaca

SEQ ID NO: 2649670 - RNA, 16 nt, Escherichia coli CFT073
cgucacuuugcugucg

SEQ ID NO: 2649671 - RNA, 11 nt, Escherichia coli CFT073
cgucacuuuuc

SEQ ID NO: 2649672 - RNA, 16 nt, Escherichia coli CFT073
cgucagauccgccagu

SEQ ID NO: 2649673 - RNA, 22 nt, Escherichia coli CFT073
cgucagauuauucaaaaacaga

SEQ ID NO: 2649674 - RNA, 20 nt, Escherichia coli CFT073
cgucagcaaaguaccaucgu

SEQ ID NO: 2649675 - RNA, 17 nt, Escherichia coli CFT073
cgucagcacuucauagu

SEQ ID NO: 2649676 - RNA, 23 nt, Escherichia coli CFT073
cgucagccaaaucgccccgcagc

SEQ ID NO: 2649677 - RNA, 11 nt, Escherichia coli CFT073
cgucagccaca

SEQ ID NO: 2649678 - RNA, 16 nt, Escherichia coli CFT073
cgucagccacaacaaa

SEQ ID NO: 2649679 - RNA, 19 nt, Escherichia coli CFT073
cgucagccacaacaaacga

SEQ ID NO: 2649680 - RNA, 14 nt, Escherichia coli CFT073
cgucagccgcccgc

SEQ ID NO: 2649681 - RNA, 12 nt, Escherichia coli CFT073
cgucagcgccgc

SEQ ID NO: 2649682 - RNA, 12 nt, Escherichia coli CFT073
cgucagcgccuc

SEQ ID NO: 2649683 - RNA, 21 nt, Escherichia coli CFT073
cgucagcggcuggcacucuuc

SEQ ID NO: 2649684 - RNA, 22 nt, Escherichia coli CFT073
cgucagcggcuggcacucuucc

SEQ ID NO: 2649685 - RNA, 20 nt, Escherichia coli CFT073
cgucagcgucgcaucuggca

SEQ ID NO: 2649686 - RNA, 14 nt, Escherichia coli CFT073
cgucagcuccggac

SEQ ID NO: 2649687 - RNA, 14 nt, Escherichia coli CFT073
cgucagcuucagau

SEQ ID NO: 2649688 - RNA, 13 nt, Escherichia coli CFT073
cgucagcuuucag

SEQ ID NO: 2649689 - RNA, 16 nt, Escherichia coli CFT073
cgucaggaagaagccc

SEQ ID NO: 2649690 - RNA, 20 nt, Escherichia coli CFT073
cgucaggaagaagcccauca

SEQ ID NO: 2649691 - RNA, 14 nt, Escherichia coli CFT073
cgucaggauaaacu

SEQ ID NO: 2649692 - RNA, 23 nt, Escherichia coli CFT073
cgucaggccaacauccaucagcg

SEQ ID NO: 2649693 - RNA, 14 nt, Escherichia coli CFT073
cgucaggccgccac

SEQ ID NO: 2649694 - RNA, 17 nt, Escherichia coli CFT073
cgucagggccugcgugu

SEQ ID NO: 2649695 - RNA, 16 nt, Escherichia coli CFT073
cgucugccccgccgcc

SEQ ID NO: 2649696 - RNA, 23 nt, Escherichia coli CFT073
cgucugccucccauucaucgcca

SEQ ID NO: 2649697 - RNA, 20 nt, Escherichia coli CFT073
cgucugcgcagguuuaccug

SEQ ID NO: 2649698 - RNA, 23 nt, Escherichia coli CFT073
cgucugcggugcgccaaacugcc

SEQ ID NO: 2649699 - RNA, 16 nt, Escherichia coli CFT073
cgucugcugaagcaua

SEQ ID NO: 2649700 - RNA, 21 nt, Escherichia coli CFT073
cgucuggcauuuugcugcuuc

SEQ ID NO: 2649701 - RNA, 14 nt, Escherichia coli CFT073
cgucuguguaccug

SEQ ID NO: 2649702 - RNA, 16 nt, Escherichia coli CFT073
cgucuuacggauuagu

SEQ ID NO: 2649703 - RNA, 20 nt, Escherichia coli CFT073
cgucuuaucaggccuacaag

SEQ ID NO: 2649704 - RNA, 16 nt, Escherichia coli CFT073
cgucuuaucaggccuu

SEQ ID NO: 2649705 - RNA, 12 nt, Escherichia coli CFT073
cgucuuauccga

SEQ ID NO: 2649706 - RNA, 20 nt, Escherichia coli CFT073
cgucuuauccgaccuacagg

SEQ ID NO: 2649707 - RNA, 16 nt, Escherichia coli CFT073
cgucuuauccggcaua

SEQ ID NO: 2649708 - RNA, 12 nt, Escherichia coli CFT073
cgucuuaucugg

SEQ ID NO: 2649709 - RNA, 20 nt, Escherichia coli CFT073
cgucuuaucuggccuacaaa

SEQ ID NO: 2649710 - RNA, 15 nt, Escherichia coli CFT073
cgucuucaaccgcag

SEQ ID NO: 2649711 - RNA, 15 nt, Escherichia coli CFT073
cgucuucccgcagcc

SEQ ID NO: 2649712 - RNA, 16 nt, Escherichia coli CFT073
cgucuucugcagucac

SEQ ID NO: 2649713 - RNA, 17 nt, Escherichia coli CFT073
cgucuucuucaaaacca

SEQ ID NO: 2649714 - RNA, 16 nt, Escherichia coli CFT073
cgucuuugcgcuccau

SEQ ID NO: 2649715 - RNA, 18 nt, Escherichia coli CFT073
cgucuuuggcccauugca

SEQ ID NO: 2649716 - RNA, 20 nt, Escherichia coli CFT073
cgucuuuggguucaccgcga

SEQ ID NO: 2649717 - RNA, 19 nt, Escherichia coli CFT073
cgugaaacgcguuuuguag

SEQ ID NO: 2649718 - RNA, 15 nt, Escherichia coli CFT073
cgugaaagaaaauga

SEQ ID NO: 2649719 - RNA, 20 nt, Escherichia coli CFT073
cgugaacaauuucagcaaua

SEQ ID NO: 2649720 - RNA, 21 nt, Escherichia coli CFT073
cgugaacgccuuauccgaccu

SEQ ID NO: 2649721 - RNA, 14 nt, Escherichia coli CFT073
cgugaacgugacca

SEQ ID NO: 2649722 - RNA, 16 nt, Escherichia coli CFT073
cgugaacgugcaaaau

SEQ ID NO: 2649723 - RNA, 18 nt, Escherichia coli CFT073
cgugaaguuugccugaug

SEQ ID NO: 2649724 - RNA, 19 nt, Escherichia coli CFT073
cgugaaugguuucgcccac

SEQ ID NO: 2649725 - RNA, 20 nt, Escherichia coli CFT073
cgugaauuuuaggaugcugc

SEQ ID NO: 2649726 - RNA, 21 nt, Escherichia coli CFT073
cgugacagcauaccuucacaa

SEQ ID NO: 2649727 - RNA, 22 nt, Escherichia coli CFT073
cgugacauccauauccagugca

SEQ ID NO: 2649728 - RNA, 23 nt, Escherichia coli CFT073
cgugaccaugagccaguucuucu

SEQ ID NO: 2649729 - RNA, 20 nt, Escherichia coli CFT073
cgugaccguaaacuuuagca

SEQ ID NO: 2649730 - RNA, 19 nt, Escherichia coli CFT073
cgugacgccagaaaaccug

SEQ ID NO: 2649731 - RNA, 18 nt, Escherichia coli CFT073
cgugacgcuggcagaaag

SEQ ID NO: 2649732 - RNA, 16 nt, Escherichia coli CFT073
cgugacggcuuuuuug

SEQ ID NO: 2649733 - RNA, 18 nt, Escherichia coli CFT073
cgugacgggugacgccaa

SEQ ID NO: 2649734 - RNA, 23 nt, Escherichia coli CFT073
cgugacgucucaaucaccaccag

SEQ ID NO: 2649735 - RNA, 20 nt, Escherichia coli CFT073
cgugacguuucaucgcagac

SEQ ID NO: 2649736 - RNA, 19 nt, Escherichia coli CFT073
cgugacugccgccagcauu

SEQ ID NO: 2649737 - RNA, 20 nt, Escherichia coli CFT073
cgugacuuuaucuucugcug

SEQ ID NO: 2649738 - RNA, 20 nt, Escherichia coli CFT073
cgugagcagggugaauaaaa

SEQ ID NO: 2649739 - RNA, 21 nt, Escherichia coli CFT073
cgugaggguuucuggcuacac

SEQ ID NO: 2649740 - RNA, 17 nt, Escherichia coli CFT073
cgugagguaugaaaauc

SEQ ID NO: 2649741 - RNA, 17 nt, Escherichia coli CFT073
cgugagguuaucgcccu

SEQ ID NO: 2649742 - RNA, 18 nt, Escherichia coli CFT073
cgugagguuaucgcccug

SEQ ID NO: 2649743 - RNA, 13 nt, Escherichia coli CFT073
cgugaguguggcc

SEQ ID NO: 2649744 - RNA, 17 nt, Escherichia coli CFT073
cgugauacaacugccgc

SEQ ID NO: 2649745 - RNA, 23 nt, Escherichia coli CFT073
cgugauauuacauaccagcagca

SEQ ID NO: 2649746 - RNA, 18 nt, Escherichia coli CFT073
cgugaucgucuucaaccg

SEQ ID NO: 2649747 - RNA, 22 nt, Escherichia coli CFT073
cgugaucgucuucaaccgcagu

SEQ ID NO: 2649748 - RNA, 23 nt, Escherichia coli CFT073
cgugaucgucuucaaccgcagug

SEQ ID NO: 2649749 - RNA, 20 nt, Escherichia coli CFT073
cgugauuaaacuucaccagc

SEQ ID NO: 2649750 - RNA, 14 nt, Escherichia coli CFT073
cgugauuuuuguag

SEQ ID NO: 2649751 - RNA, 18 nt, Escherichia coli CFT073
cgugcaaaaucaaacaga

SEQ ID NO: 2649752 - RNA, 12 nt, Escherichia coli CFT073
cgugcaccaauu

SEQ ID NO: 2649753 - RNA, 17 nt, Escherichia coli CFT073
cgugcacuacaacggcg

SEQ ID NO: 2649754 - RNA, 16 nt, Escherichia coli CFT073
cgugcacuucugcggu

SEQ ID NO: 2649755 - RNA, 18 nt, Escherichia coli CFT073
cgugcagcaccgccgcca

SEQ ID NO: 2649756 - RNA, 19 nt, Escherichia coli CFT073
cgugcagcaccgccgccag

SEQ ID NO: 2649757 - RNA, 17 nt, Escherichia coli CFT073
cgugcagcgcaaucgcc

SEQ ID NO: 2649758 - RNA, 22 nt, Escherichia coli CFT073
cgugcagguucuuuuaaaccuu

SEQ ID NO: 2649759 - RNA, 20 nt, Escherichia coli CFT073
cgugcauagcagcacaccac

SEQ ID NO: 2649760 - RNA, 12 nt, Escherichia coli CFT073
cgugcaucggca

SEQ ID NO: 2649761 - RNA, 16 nt, Escherichia coli CFT073
cgugcaucucuucaaa

SEQ ID NO: 2649762 - RNA, 16 nt, Escherichia coli CFT073
cgugcauuccagcauu

SEQ ID NO: 2649763 - RNA, 19 nt, Escherichia coli CFT073
cgugcauuuuucgcuuuuc

SEQ ID NO: 2649764 - RNA, 16 nt, Escherichia coli CFT073
cgugccaaauauucag

SEQ ID NO: 2649765 - RNA, 12 nt, Escherichia coli CFT073
cgugccagaacu

SEQ ID NO: 2649766 - RNA, 12 nt, Escherichia coli CFT073
cgugccagagca

SEQ ID NO: 2649767 - RNA, 13 nt, Escherichia coli CFT073
cgugccagauguu

SEQ ID NO: 2649768 - RNA, 23 nt, Escherichia coli CFT073
cgugccagauguuuaaacugggc

SEQ ID NO: 2649769 - RNA, 17 nt, Escherichia coli CFT073
cgugccccugaauaauc

SEQ ID NO: 2649770 - RNA, 19 nt, Escherichia coli CFT073
cgugcccgggucagcgcca

SEQ ID NO: 2649771 - RNA, 13 nt, Escherichia coli CFT073
cgugccgcauuuc

SEQ ID NO: 2649772 - RNA, 16 nt, Escherichia coli CFT073
cgugccgccgugacga

SEQ ID NO: 2649773 - RNA, 22 nt, Escherichia coli CFT073
cgugccgggcaaauucagacua

SEQ ID NO: 2649774 - RNA, 18 nt, Escherichia coli CFT073
cgugccuucacgggcaac

SEQ ID NO: 2649775 - RNA, 14 nt, Escherichia coli CFT073
cgugcgcaucgcca

SEQ ID NO: 2649776 - RNA, 14 nt, Escherichia coli CFT073
cgugcgcgccguga

SEQ ID NO: 2649777 - RNA, 17 nt, Escherichia coli CFT073
cgugcggcggcugacau

SEQ ID NO: 2649778 - RNA, 18 nt, Escherichia coli CFT073
cgugcgguaucaccaccc

SEQ ID NO: 2649779 - RNA, 18 nt, Escherichia coli CFT073
cgugcgguuucagcucac

SEQ ID NO: 2649780 - RNA, 14 nt, Escherichia coli CFT073
cgugcuaaauguca

SEQ ID NO: 2649781 - RNA, 16 nt, Escherichia coli CFT073
cgugcucgaacauccc

SEQ ID NO: 2649782 - RNA, 23 nt, Escherichia coli CFT073
cgugcucucaaauaucugccgga

SEQ ID NO: 2649783 - RNA, 17 nt, Escherichia coli CFT073
cgugcugcgauucaggg

SEQ ID NO: 2649784 - RNA, 22 nt, Escherichia coli CFT073
cgugcugcuuuuaaugcugucu

SEQ ID NO: 2649785 - RNA, 22 nt, Escherichia coli CFT073
cgugcugguggucagcagcuuu

SEQ ID NO: 2649786 - RNA, 14 nt, Escherichia coli CFT073
cgugcuguacagca

SEQ ID NO: 2649787 - RNA, 14 nt, Escherichia coli CFT073
cgugcuucauucac

SEQ ID NO: 2649788 - RNA, 14 nt, Escherichia coli CFT073
cgugcuucgcgcug

SEQ ID NO: 2649789 - RNA, 17 nt, Escherichia coli CFT073
cguggacauguuccggc

SEQ ID NO: 2649790 - RNA, 21 nt, Escherichia coli CFT073
cguggacauguuccggcgaca

SEQ ID NO: 2649791 - RNA, 23 nt, Escherichia coli CFT073
cguggaugcgauguucccccagc

SEQ ID NO: 2649792 - RNA, 18 nt, Escherichia coli CFT073
cguggcagaaugguuuca

SEQ ID NO: 2649793 - RNA, 13 nt, Escherichia coli CFT073
cguggcagcagga

SEQ ID NO: 2649794 - RNA, 12 nt, Escherichia coli CFT073
cguggcgucgca

SEQ ID NO: 2649795 - RNA, 15 nt, Escherichia coli CFT073
cguggcuggcugacc

SEQ ID NO: 2649796 - RNA, 17 nt, Escherichia coli CFT073
cgugggcaucgcgacag

SEQ ID NO: 2649797 - RNA, 17 nt, Escherichia coli CFT073
cgugggcuaacacugcc

SEQ ID NO: 2649798 - RNA, 16 nt, Escherichia coli CFT073
cgugguaagaagagcg

SEQ ID NO: 2649799 - RNA, 14 nt, Escherichia coli CFT073
cguggucgccagca

SEQ ID NO: 2649800 - RNA, 20 nt, Escherichia coli CFT073
cguggucggcaaaauacaug

SEQ ID NO: 2649801 - RNA, 17 nt, Escherichia coli CFT073
cgugguggcuacuucuu

SEQ ID NO: 2649802 - RNA, 18 nt, Escherichia coli CFT073
cgugguguaacgagacaa

SEQ ID NO: 2649803 - RNA, 21 nt, Escherichia coli CFT073
cguugagauuguuggucacaa

SEQ ID NO: 2649804 - RNA, 15 nt, Escherichia coli CFT073
cguugagguugaucu

SEQ ID NO: 2649805 - RNA, 14 nt, Escherichia coli CFT073
cguugaguuuacgc

SEQ ID NO: 2649806 - RNA, 20 nt, Escherichia coli CFT073
cguugauaccgugcagcacg

SEQ ID NO: 2649807 - RNA, 16 nt, Escherichia coli CFT073
cguugauccagcgcga

SEQ ID NO: 2649808 - RNA, 18 nt, Escherichia coli CFT073
cguugaucuucucuuaua

SEQ ID NO: 2649809 - RNA, 18 nt, Escherichia coli CFT073
cguugaugcaggcaguaa

SEQ ID NO: 2649810 - RNA, 16 nt, Escherichia coli CFT073
cguugauuguugcaga

SEQ ID NO: 2649811 - RNA, 16 nt, Escherichia coli CFT073
cguugauuucaccauc

SEQ ID NO: 2649812 - RNA, 16 nt, Escherichia coli CFT073
cguugcagcaaauaaa

SEQ ID NO: 2649813 - RNA, 19 nt, Escherichia coli CFT073
cguugccaucgugggauaa

SEQ ID NO: 2649814 - RNA, 20 nt, Escherichia coli CFT073
cguugcccgcagauccagug

SEQ ID NO: 2649815 - RNA, 16 nt, Escherichia coli CFT073
cguugccgcucccggc

SEQ ID NO: 2649816 - RNA, 22 nt, Escherichia coli CFT073
cguugccgcucccggcauaaca

SEQ ID NO: 2649817 - RNA, 17 nt, Escherichia coli CFT073
cguugccgcucuuuuau

SEQ ID NO: 2649818 - RNA, 20 nt, Escherichia coli CFT073
cguugccguaagcaacgcca

SEQ ID NO: 2649819 - RNA, 16 nt, Escherichia coli CFT073
cguugcgacaaaccag

SEQ ID NO: 2649820 - RNA, 17 nt, Escherichia coli CFT073
cguugcgacaaaccagg

SEQ ID NO: 2649821 - RNA, 13 nt, Escherichia coli CFT073
cguugcgcgguga

SEQ ID NO: 2649822 - RNA, 23 nt, Escherichia coli CFT073
cguugcucaaggguuucgcgguu

SEQ ID NO: 2649823 - RNA, 20 nt, Escherichia coli CFT073
cguugcucagaaucacgcca

SEQ ID NO: 2649824 - RNA, 16 nt, Escherichia coli CFT073
cguugcucaugcaaca

SEQ ID NO: 2649825 - RNA, 13 nt, Escherichia coli CFT073
cguugcugcggcg

SEQ ID NO: 2649826 - RNA, 17 nt, Escherichia coli CFT073
cguugcugucgcgcagc

SEQ ID NO: 2649827 - RNA, 22 nt, Escherichia coli CFT073
cguugcugucgcgcagcacuug

SEQ ID NO: 2649828 - RNA, 17 nt, Escherichia coli CFT073
cguugcuuauugccgga

SEQ ID NO: 2649829 - RNA, 21 nt, Escherichia coli CFT073
cguugcuuauugccggaugcg

SEQ ID NO: 2649830 - RNA, 16 nt, Escherichia coli CFT073
cguuggcaaauugcgg

SEQ ID NO: 2649831 - RNA, 19 nt, Escherichia coli CFT073
cguuggcgcguguuccaga

SEQ ID NO: 2649832 - RNA, 18 nt, Escherichia coli CFT073
cguugguacgaucagagu

SEQ ID NO: 2649833 - RNA, 11 nt, Escherichia coli CFT073
cguuguaaaug

SEQ ID NO: 2649834 - RNA, 14 nt, Escherichia coli CFT073
cguugucagcaauc

SEQ ID NO: 2649835 - RNA, 12 nt, Escherichia coli CFT073
cguugucuguaa

SEQ ID NO: 2649836 - RNA, 21 nt, Escherichia coli CFT073
cguugugauuucugacuuccc

SEQ ID NO: 2649837 - RNA, 23 nt, Escherichia coli CFT073
cguugugcaucaggcaaacuuca

SEQ ID NO: 2649838 - RNA, 14 nt, Escherichia coli CFT073
cguugugcgaucca

SEQ ID NO: 2649839 - RNA, 17 nt, Escherichia coli CFT073
cguugugcgauccacgc

SEQ ID NO: 2649840 - RNA, 21 nt, Escherichia coli CFT073
cguugugcuuugugaccacgg

SEQ ID NO: 2649841 - RNA, 18 nt, Escherichia coli CFT073
cguuguuaaauccagauc

SEQ ID NO: 2649842 - RNA, 14 nt, Escherichia coli CFT073
cguuguuuacagca

SEQ ID NO: 2649843 - RNA, 16 nt, Escherichia coli CFT073
cguuguuuacgccgga

SEQ ID NO: 2649844 - RNA, 19 nt, Escherichia coli CFT073
cguuuaaucgccuuccggc

SEQ ID NO: 2649845 - RNA, 16 nt, Escherichia coli CFT073
cguuuaauugccucuu

SEQ ID NO: 2649846 - RNA, 22 nt, Escherichia coli CFT073
cguuuacaauaaccauuccacg

SEQ ID NO: 2649847 - RNA, 13 nt, Escherichia coli CFT073
cguuuaccuaucu

SEQ ID NO: 2649848 - RNA, 22 nt, Escherichia coli CFT073
cguuuacgccgcauccggcaac

SEQ ID NO: 2649849 - RNA, 22 nt, Escherichia coli CFT073
cguuuacgccgcauccggcaau

SEQ ID NO: 2649850 - RNA, 15 nt, Escherichia coli CFT073
cguuuagacgcugcg

SEQ ID NO: 2649851 - RNA, 15 nt, Escherichia coli CFT073
cguuuaucaauaucc

SEQ ID NO: 2649852 - RNA, 16 nt, Escherichia coli CFT073
cguuuaucaauaucca

SEQ ID NO: 2649853 - RNA, 22 nt, Escherichia coli CFT073
cguuuaugucgcauccugcacu

SEQ ID NO: 2649854 - RNA, 22 nt, Escherichia coli CFT073
cguuucaacuucugcugugacu

SEQ ID NO: 2649855 - RNA, 23 nt, Escherichia coli CFT073
cguuucacuucugaguucggcau

SEQ ID NO: 2649856 - RNA, 19 nt, Escherichia coli CFT073
cguuucauguaacgcugca

SEQ ID NO: 2649857 - RNA, 17 nt, Escherichia coli CFT073
cguuuccagcaccaguu

SEQ ID NO: 2649858 - RNA, 14 nt, Escherichia coli CFT073
cguuuccauaaccg

SEQ ID NO: 2649859 - RNA, 15 nt, Escherichia coli CFT073
cguuuccuuccagaa

SEQ ID NO: 2649860 - RNA, 19 nt, Escherichia coli CFT073
cguuucgccauaaaacagc

SEQ ID NO: 2649861 - RNA, 19 nt, Escherichia coli CFT073
cguuucgcccguucuuccu

SEQ ID NO: 2649862 - RNA, 22 nt, Escherichia coli CFT073
cguuucguggaaaacaccgaua

SEQ ID NO: 2649863 - RNA, 16 nt, Escherichia coli CFT073
cguuucuccacuggca

SEQ ID NO: 2649864 - RNA, 13 nt, Escherichia coli CFT073
cguuucugccggu

SEQ ID NO: 2649865 - RNA, 15 nt, Escherichia coli CFT073
cguuucuggcaauuc

SEQ ID NO: 2649866 - RNA, 23 nt, Escherichia coli CFT073
cguuucuuccacaccacuucauu

SEQ ID NO: 2649867 - RNA, 18 nt, Escherichia coli CFT073
cguuucuuucgauugcac

SEQ ID NO: 2649868 - RNA, 23 nt, Escherichia coli CFT073
cguuugaccgacaccggcagaga

SEQ ID NO: 2649869 - RNA, 15 nt, Escherichia coli CFT073
cguuugaugcgcgag

SEQ ID NO: 2649870 - RNA, 23 nt, Escherichia coli CFT073
cguuugaugcgcgagguaacaau

SEQ ID NO: 2649871 - RNA, 18 nt, Escherichia coli CFT073
cguuugauuaacgccaga

SEQ ID NO: 2649872 - RNA, 20 nt, Escherichia coli CFT073
cguuugcagcuuacgcgcca

SEQ ID NO: 2649873 - RNA, 23 nt, Escherichia coli CFT073
cguuugccagaacugcugcgcca

SEQ ID NO: 2649874 - RNA, 18 nt, Escherichia coli CFT073
cguuugccccaaccguuc

SEQ ID NO: 2649875 - RNA, 24 nt, Escherichia coli CFT073
cguuugcccuaaagcgcgaucgcu

SEQ ID NO: 2649876 - RNA, 22 nt, Escherichia coli CFT073
cguuugcgcgacguugcuucuc

SEQ ID NO: 2649877 - RNA, 13 nt, Escherichia coli CFT073
cguuugcggcugu

SEQ ID NO: 2649878 - RNA, 15 nt, Escherichia coli CFT073
cguuugcguuccggc

SEQ ID NO: 2649879 - RNA, 16 nt, Escherichia coli CFT073
cguuugcguuccggcg

SEQ ID NO: 2649880 - RNA, 14 nt, Escherichia coli CFT073
cguuuggcaucagc

SEQ ID NO: 2649881 - RNA, 15 nt, Escherichia coli CFT073
cguuuggcaucaguc

SEQ ID NO: 2649882 - RNA, 20 nt, Escherichia coli CFT073
cguuuguaggccugauaaga

SEQ ID NO: 2649883 - RNA, 13 nt, Escherichia coli CFT073
cguuugucagcaa

SEQ ID NO: 2649884 - RNA, 18 nt, Escherichia coli CFT073
cguuuguccgccagaaau

SEQ ID NO: 2649885 - RNA, 17 nt, Escherichia coli CFT073
cguuuguucugcauccu

SEQ ID NO: 2649886 - RNA, 21 nt, Escherichia coli CFT073
cguuuuaaaucgccgcaucau

SEQ ID NO: 2649887 - RNA, 13 nt, Escherichia coli CFT073
cguuuuaaugauu

SEQ ID NO: 2649888 - RNA, 17 nt, Escherichia coli CFT073
cguuuuaaugcgauccu

SEQ ID NO: 2649889 - RNA, 20 nt, Escherichia coli CFT073
cguuuuacaauauccagcgc

SEQ ID NO: 2649890 - RNA, 14 nt, Escherichia coli CFT073
cguuuuacagcaac

SEQ ID NO: 2649891 - RNA, 15 nt, Escherichia coli CFT073
cguuuuaguaacaac

SEQ ID NO: 2649892 - RNA, 18 nt, Escherichia coli CFT073
cguuuucaaccguuugau

SEQ ID NO: 2649893 - RNA, 14 nt, Escherichia coli CFT073
cguuuucaccacuu

SEQ ID NO: 2649894 - RNA, 17 nt, Escherichia coli CFT073
cguuuucuccagcgccg

SEQ ID NO: 2649895 - RNA, 12 nt, Escherichia coli CFT073
cguuuucugcca

SEQ ID NO: 2649896 - RNA, 16 nt, Escherichia coli CFT073
cguuuugccgccauca

SEQ ID NO: 2649897 - RNA, 19 nt, Escherichia coli CFT073
cguuuugccgccaucaucg

SEQ ID NO: 2649898 - RNA, 18 nt, Escherichia coli CFT073
cguuuugcuguuccagca

SEQ ID NO: 2649899 - RNA, 21 nt, Escherichia coli CFT073
cguuuuuaacguccgcucaau

SEQ ID NO: 2649900 - RNA, 18 nt, Escherichia coli CFT073
cguuuuucauccagcggc

SEQ ID NO: 2649901 - RNA, 19 nt, Escherichia coli CFT073
cguuuuuucaucacugcgc

SEQ ID NO: 2649902 - RNA, 16 nt, Escherichia coli CFT073
cguuuuuugaaacagg

SEQ ID NO: 2649903 - RNA, 17 nt, Escherichia coli CFT073
cguuuuuugaucaguaa

SEQ ID NO: 2649904 - RNA, 13 nt, Escherichia coli CFT073
cguuuuuuguccg

SEQ ID NO: 2649905 - RNA, 9 nt, Escherichia coli CFT073
cuaaaaaca

SEQ ID NO: 2649906 - RNA, 20 nt, Escherichia coli CFT073
cuaaaacugauaaugcagau

SEQ ID NO: 2649907 - RNA, 15 nt, Escherichia coli CFT073
cuaaaacuucauuug

SEQ ID NO: 2649908 - RNA, 16 nt, Escherichia coli CFT073
cuaaaagcaaacugug

SEQ ID NO: 2649909 - RNA, 22 nt, Escherichia coli CFT073
cuaaaagcacgccagacaucac

SEQ ID NO: 2649910 - RNA, 19 nt, Escherichia coli CFT073
cuaaaaucgccaaacuuaa

SEQ ID NO: 2649911 - RNA, 19 nt, Escherichia coli CFT073
cuaccauuuguucuuuuuu

SEQ ID NO: 2649912 - RNA, 21 nt, Escherichia coli CFT073
cuacccaugaagaaaauucca

SEQ ID NO: 2649913 - RNA, 22 nt, Escherichia coli CFT073
cuacccgaacaccaaucuucaa

SEQ ID NO: 2649914 - RNA, 16 nt, Escherichia coli CFT073
cuacccgcgccaauaa

SEQ ID NO: 2649915 - RNA, 13 nt, Escherichia coli CFT073
cuacccuggcgag

SEQ ID NO: 2649916 - RNA, 19 nt, Escherichia coli CFT073
cuaccgauccggcaccaau

SEQ ID NO: 2649917 - RNA, 12 nt, Escherichia coli CFT073
cuaccgccagac

SEQ ID NO: 2649918 - RNA, 12 nt, Escherichia coli CFT073
cuaccggaacca

SEQ ID NO: 2649919 - RNA, 16 nt, Escherichia coli CFT073
cuaccggaaucgcgcg

SEQ ID NO: 2649920 - RNA, 15 nt, Escherichia coli CFT073
cuaccguguucagcg

SEQ ID NO: 2649921 - RNA, 19 nt, Escherichia coli CFT073
cuaccguuucaacuucugc

SEQ ID NO: 2649922 - RNA, 19 nt, Escherichia coli CFT073
cuaccugacugaauacgau

SEQ ID NO: 2649923 - RNA, 17 nt, Escherichia coli CFT073
cuaccugauucgcacca

SEQ ID NO: 2649924 - RNA, 20 nt, Escherichia coli CFT073
cuaccuuaacgguaucuuuc

SEQ ID NO: 2649925 - RNA, 22 nt, Escherichia coli CFT073
cuaccuuaacgguaucuuucca

SEQ ID NO: 2649926 - RNA, 19 nt, Escherichia coli CFT073
cuacgcagggauauuucac

SEQ ID NO: 2649927 - RNA, 16 nt, Escherichia coli CFT073
cuacgcagguuaacgc

SEQ ID NO: 2649928 - RNA, 12 nt, Escherichia coli CFT073
cuacgcaucaau

SEQ ID NO: 2649929 - RNA, 21 nt, Escherichia coli CFT073
cuacgcccgccagugcauauc

SEQ ID NO: 2649930 - RNA, 21 nt, Escherichia coli CFT073
cuacgccuuccgucagcaaag

SEQ ID NO: 2649931 - RNA, 15 nt, Escherichia coli CFT073
cuacgcgccgccagc

SEQ ID NO: 2649932 - RNA, 20 nt, Escherichia coli CFT073
cuacgcgccgccagccacag

SEQ ID NO: 2649933 - RNA, 20 nt, Escherichia coli CFT073
cuacgcuaacuucgccauca

SEQ ID NO: 2649934 - RNA, 20 nt, Escherichia coli CFT073
cuacgcucgcgguagcccag

SEQ ID NO: 2649935 - RNA, 13 nt, Escherichia coli CFT073
cuacgcuuaucag

SEQ ID NO: 2649936 - RNA, 19 nt, Escherichia coli CFT073
cuacgcuuaucaggccuac

SEQ ID NO: 2649937 - RNA, 22 nt, Escherichia coli CFT073
cuacgcuucucucuguagaaca

SEQ ID NO: 2649938 - RNA, 14 nt, Escherichia coli CFT073
cuacgcuugcugcg

SEQ ID NO: 2649939 - RNA, 16 nt, Escherichia coli CFT073
cuacguagcucaucuu

SEQ ID NO: 2649940 - RNA, 14 nt, Escherichia coli CFT073
cuacguaggccgga

SEQ ID NO: 2649941 - RNA, 20 nt, Escherichia coli CFT073
cuacgucgcgguugcaaucu

SEQ ID NO: 2649942 - RNA, 19 nt, Escherichia coli CFT073
cuacgugauuccugcaauu

SEQ ID NO: 2649943 - RNA, 18 nt, Escherichia coli CFT073
cuacguuaaaacacacua

SEQ ID NO: 2649944 - RNA, 15 nt, Escherichia coli CFT073
cuacguucgcgagga

SEQ ID NO: 2649945 - RNA, 14 nt, Escherichia coli CFT073
cuacguucucacuu

SEQ ID NO: 2649946 - RNA, 22 nt, Escherichia coli CFT073
cuacugaagcgaccaccacccu

SEQ ID NO: 2649947 - RNA, 14 nt, Escherichia coli CFT073
cuacugccagauuc

SEQ ID NO: 2649948 - RNA, 14 nt, Escherichia coli CFT073
cuacugcuugccac

SEQ ID NO: 2649949 - RNA, 16 nt, Escherichia coli CFT073
cuacuggcaauccugc

SEQ ID NO: 2649950 - RNA, 14 nt, Escherichia coli CFT073
cuacuuucaugcuc

SEQ ID NO: 2649951 - RNA, 15 nt, Escherichia coli CFT073
cuagaaacuguuaag

SEQ ID NO: 2649952 - RNA, 12 nt, Escherichia coli CFT073
cuagcaacaaaa

SEQ ID NO: 2649953 - RNA, 15 nt, Escherichia coli CFT073
cuagcaacaaaaaaa

SEQ ID NO: 2649954 - RNA, 18 nt, Escherichia coli CFT073
cuagcaacaaaaaaacca

SEQ ID NO: 2649955 - RNA, 17 nt, Escherichia coli CFT073
cuagcagcagcguaccu

SEQ ID NO: 2649956 - RNA, 17 nt, Escherichia coli CFT073
cuagccucccugccucc

SEQ ID NO: 2649957 - RNA, 15 nt, Escherichia coli CFT073
cuagcuuuucgccca

SEQ ID NO: 2649958 - RNA, 15 nt, Escherichia coli CFT073
cuagugcuacccacu

SEQ ID NO: 2649959 - RNA, 23 nt, Escherichia coli CFT073
cuauaaauauacauacuguaaau

SEQ ID NO: 2649960 - RNA, 13 nt, Escherichia coli CFT073
cuauacagcagcc

SEQ ID NO: 2649961 - RNA, 14 nt, Escherichia coli CFT073
cuauaccccacccc

SEQ ID NO: 2649962 - RNA, 14 nt, Escherichia coli CFT073
cuauaccgccaggc

SEQ ID NO: 2649963 - RNA, 17 nt, Escherichia coli CFT073
cuauacuccugauggcc

SEQ ID NO: 2649964 - RNA, 22 nt, Escherichia coli CFT073
cuauagacaccuugcaacuccg

SEQ ID NO: 2649965 - RNA, 20 nt, Escherichia coli CFT073
cuauauauuuaguucauaua

SEQ ID NO: 2649966 - RNA, 13 nt, Escherichia coli CFT073
cuauaucaacgcc

SEQ ID NO: 2649967 - RNA, 19 nt, Escherichia coli CFT073
cuauaucgcugauaucaaa

SEQ ID NO: 2649968 - RNA, 15 nt, Escherichia coli CFT073
cuauaucucaaucaa

SEQ ID NO: 2649969 - RNA, 22 nt, Escherichia coli CFT073
cuauaugacucauaaaaauaua

SEQ ID NO: 2649970 - RNA, 23 nt, Escherichia coli CFT073
cuauauuaaagcuuuaauuucag

SEQ ID NO: 2649971 - RNA, 18 nt, Escherichia coli CFT073
cuaucaacaauaaacugc

SEQ ID NO: 2649972 - RNA, 19 nt, Escherichia coli CFT073
cuaucaaccucuuuuucug

SEQ ID NO: 2649973 - RNA, 18 nt, Escherichia coli CFT073
cuaucaauacuuuccagc

SEQ ID NO: 2649974 - RNA, 21 nt, Escherichia coli CFT073
cuaucaggccaccucgcaaca

SEQ ID NO: 2649975 - RNA, 14 nt, Escherichia coli CFT073
cuauccacauuagu

SEQ ID NO: 2649976 - RNA, 15 nt, Escherichia coli CFT073
cuauccgcuuucaca

SEQ ID NO: 2649977 - RNA, 20 nt, Escherichia coli CFT073
cuauccugguuauuucacuu

SEQ ID NO: 2649978 - RNA, 13 nt, Escherichia coli CFT073
cuaucgaaaucaa

SEQ ID NO: 2649979 - RNA, 22 nt, Escherichia coli CFT073
cuaucgcauuauccuuuaucug

SEQ ID NO: 2649980 - RNA, 23 nt, Escherichia coli CFT073
cuaucgcauuauccuuuaucugc

SEQ ID NO: 2649981 - RNA, 22 nt, Escherichia coli CFT073
cuaucgccgagauacucaagca

SEQ ID NO: 2649982 - RNA, 20 nt, Escherichia coli CFT073
cuaucggcaaaaauaaucuc

SEQ ID NO: 2649983 - RNA, 21 nt, Escherichia coli CFT073
cuaucggcagaguugagcagu

SEQ ID NO: 2649984 - RNA, 20 nt, Escherichia coli CFT073
cuaucggcauaaccaauugc

SEQ ID NO: 2649985 - RNA, 21 nt, Escherichia coli CFT073
cuaucggcgauguagcgcugu

SEQ ID NO: 2649986 - RNA, 20 nt, Escherichia coli CFT073
cuaucucugguaggccugau

SEQ ID NO: 2649987 - RNA, 13 nt, Escherichia coli CFT073
cuaucugucagac

SEQ ID NO: 2649988 - RNA, 18 nt, Escherichia coli CFT073
cuaucuuauuuccagaua

SEQ ID NO: 2649989 - RNA, 18 nt, Escherichia coli CFT073
cuaucuucgauaaacuca

SEQ ID NO: 2649990 - RNA, 22 nt, Escherichia coli CFT073
cuaugcauaauccugccgagau

SEQ ID NO: 2649991 - RNA, 13 nt, Escherichia coli CFT073
cuaugcauacaca

SEQ ID NO: 2649992 - RNA, 14 nt, Escherichia coli CFT073
cuaugcgcaucaag

SEQ ID NO: 2649993 - RNA, 16 nt, Escherichia coli CFT073
cuaugcugccacacug

SEQ ID NO: 2649994 - RNA, 22 nt, Escherichia coli CFT073
cuauggaaguuccggcaccguu

SEQ ID NO: 2649995 - RNA, 17 nt, Escherichia coli CFT073
cuaugggauauuuuuuu

SEQ ID NO: 2649996 - RNA, 18 nt, Escherichia coli CFT073
cuauggucggcauugccg

SEQ ID NO: 2649997 - RNA, 16 nt, Escherichia coli CFT073
cuaugguguaacgauu

SEQ ID NO: 2649998 - RNA, 19 nt, Escherichia coli CFT073
cuauuaccuuuaugacuau

SEQ ID NO: 2649999 - RNA, 17 nt, Escherichia coli CFT073
cuauuauuauuuuugug

SEQ ID NO: 2650000 - RNA, 21 nt, Escherichia coli CFT073
cuauucaccacuuuaucggca

SEQ ID NO: 2650001 - RNA, 16 nt, Escherichia coli CFT073
cuauucauuguaaaua

SEQ ID NO: 2650002 - RNA, 20 nt, Escherichia coli CFT073
cuauugcaggggcuuauaua

SEQ ID NO: 2650003 - RNA, 17 nt, Escherichia coli CFT073
cuauugccguaaucgcc

SEQ ID NO: 2650004 - RNA, 18 nt, Escherichia coli CFT073
cuauugcuuuagacagcu

SEQ ID NO: 2650005 - RNA, 19 nt, Escherichia coli CFT073
cuauuuaacaauucuccaa

SEQ ID NO: 2650006 - RNA, 13 nt, Escherichia coli CFT073
cuauuuacagauu

SEQ ID NO: 2650007 - RNA, 18 nt, Escherichia coli CFT073
cuauuuacagauuuccca

SEQ ID NO: 2650008 - RNA, 20 nt, Escherichia coli CFT073
cuauuuaccagcacaucuua

SEQ ID NO: 2650009 - RNA, 13 nt, Escherichia coli CFT073
cuauuuuccuguu

SEQ ID NO: 2650010 - RNA, 15 nt, Escherichia coli CFT073
cuauuuuuugcaggc

SEQ ID NO: 2650011 - RNA, 12 nt, Escherichia coli CFT073
cucaaaaagaaa

SEQ ID NO: 2650012 - RNA, 19 nt, Escherichia coli CFT073
cucaaaagcguaccgccaa

SEQ ID NO: 2650013 - RNA, 14 nt, Escherichia coli CFT073
cucaaaauacugcc

SEQ ID NO: 2650014 - RNA, 20 nt, Escherichia coli CFT073
cucaaacagcguaaugccaa

SEQ ID NO: 2650015 - RNA, 13 nt, Escherichia coli CFT073
cucaaacgccagc

SEQ ID NO: 2650016 - RNA, 17 nt, Escherichia coli CFT073
cucaaacgccagcaugu

SEQ ID NO: 2650017 - RNA, 21 nt, Escherichia coli CFT073
cucaaacgccagcauguuguc

SEQ ID NO: 2650018 - RNA, 17 nt, Escherichia coli CFT073
cucaaagcaguauuucu

SEQ ID NO: 2650019 - RNA, 23 nt, Escherichia coli CFT073
cucaggcgguggaacaagucagc

SEQ ID NO: 2650020 - RNA, 14 nt, Escherichia coli CFT073
cucaggcucucauu

SEQ ID NO: 2650021 - RNA, 23 nt, Escherichia coli CFT073
cucaguugccauauccaccggaa

SEQ ID NO: 2650022 - RNA, 17 nt, Escherichia coli CFT073
cucaguugguagagcac

SEQ ID NO: 2650023 - RNA, 22 nt, Escherichia coli CFT073
cucaguugguagagcacgaccu

SEQ ID NO: 2650024 - RNA, 19 nt, Escherichia coli CFT073
cucaguugguuagagcaca

SEQ ID NO: 2650025 - RNA, 17 nt, Escherichia coli CFT073
  misc_feature (5)..(5): n is a, c, g or u
cucangagugaacacgu

SEQ ID NO: 2650026 - RNA, 18 nt, Escherichia coli CFT073
cucauaaaccagcggcac

SEQ ID NO: 2650027 - RNA, 16 nt, Escherichia coli CFT073
cucauaacguaaacca

SEQ ID NO: 2650028 - RNA, 19 nt, Escherichia coli CFT073
cucauaccuuccacuuuca

SEQ ID NO: 2650029 - RNA, 14 nt, Escherichia coli CFT073
cucauagaccauug

SEQ ID NO: 2650030 - RNA, 19 nt, Escherichia coli CFT073
cucauauuccugcauugcu

SEQ ID NO: 2650031 - RNA, 14 nt, Escherichia coli CFT073
cucaucaaaaaaac

SEQ ID NO: 2650032 - RNA, 22 nt, Escherichia coli CFT073
cucaucaauggauucaugauac

SEQ ID NO: 2650033 - RNA, 21 nt, Escherichia coli CFT073
cucaucaauuaaugccuucaa

SEQ ID NO: 2650034 - RNA, 21 nt, Escherichia coli CFT073
cucaucaccacagacaaacag

SEQ ID NO: 2650035 - RNA, 19 nt, Escherichia coli CFT073
cucaucagcgguaaaacgc

SEQ ID NO: 2650036 - RNA, 13 nt, Escherichia coli CFT073
cucaucagcuuac

SEQ ID NO: 2650037 - RNA, 14 nt, Escherichia coli CFT073
cucaucaggccugc

SEQ ID NO: 2650038 - RNA, 21 nt, Escherichia coli CFT073
cucauccaccacaaaagcaaa

SEQ ID NO: 2650039 - RNA, 12 nt, Escherichia coli CFT073
cucauccaucaa

SEQ ID NO: 2650040 - RNA, 18 nt, Escherichia coli CFT073
cucauccaucucgguuuu

SEQ ID NO: 2650041 - RNA, 16 nt, Escherichia coli CFT073
cucauccccugacugu

SEQ ID NO: 2650042 - RNA, 16 nt, Escherichia coli CFT073
cucauccgccaaaaca

SEQ ID NO: 2650043 - RNA, 17 nt, Escherichia coli CFT073
cucauccuucagugccu

SEQ ID NO: 2650044 - RNA, 13 nt, Escherichia coli CFT073
cucaucgccgcca

SEQ ID NO: 2650045 - RNA, 14 nt, Escherichia coli CFT073
cucaucggcauaca

SEQ ID NO: 2650046 - RNA, 21 nt, Escherichia coli CFT073
cucaucgucaaaauucauaaa

SEQ ID NO: 2650047 - RNA, 21 nt, Escherichia coli CFT073
cucaucugacguucagccgcu

SEQ ID NO: 2650048 - RNA, 13 nt, Escherichia coli CFT073
cucaucuucauaa

SEQ ID NO: 2650049 - RNA, 20 nt, Escherichia coli CFT073
cucaucuucuuuuuccgggc

SEQ ID NO: 2650050 - RNA, 17 nt, Escherichia coli CFT073
cucaugcccacgcaaac

SEQ ID NO: 2650051 - RNA, 19 nt, Escherichia coli CFT073
cucauggaaucuuuaauga

SEQ ID NO: 2650052 - RNA, 17 nt, Escherichia coli CFT073
cucaugggucugcggau

SEQ ID NO: 2650053 - RNA, 16 nt, Escherichia coli CFT073
cucauguagccgcuuu

SEQ ID NO: 2650054 - RNA, 21 nt, Escherichia coli CFT073
cucauguagccgcuuuuucug

SEQ ID NO: 2650055 - RNA, 17 nt, Escherichia coli CFT073
cucauuaauguaugugc

SEQ ID NO: 2650056 - RNA, 15 nt, Escherichia coli CFT073
cucauuauucaaucg

SEQ ID NO: 2650057 - RNA, 17 nt, Escherichia coli CFT073
cucauuauuugccgcca

SEQ ID NO: 2650058 - RNA, 17 nt, Escherichia coli CFT073
cucauuguuaucagcaa

SEQ ID NO: 2650059 - RNA, 15 nt, Escherichia coli CFT073
cucauuuucucuuuu

SEQ ID NO: 2650060 - RNA, 20 nt, Escherichia coli CFT073
cucauuuugauuaauauuga

SEQ ID NO: 2650061 - RNA, 17 nt, Escherichia coli CFT073
cuccaacaacccugcau

SEQ ID NO: 2650062 - RNA, 14 nt, Escherichia coli CFT073
cuccaaccagcugu

SEQ ID NO: 2650063 - RNA, 20 nt, Escherichia coli CFT073
cuccaacccacaaaaacacc

SEQ ID NO: 2650064 - RNA, 22 nt, Escherichia coli CFT073
cuccaacccacaaaaacaccgc

SEQ ID NO: 2650065 - RNA, 23 nt, Escherichia coli CFT073
cuccaacccacaaaaacaccgcu

SEQ ID NO: 2650066 - RNA, 16 nt, Escherichia coli CFT073
cuccaaucguucaacc

SEQ ID NO: 2650067 - RNA, 16 nt, Escherichia coli CFT073
cuccaccagcaccagc

SEQ ID NO: 2650068 - RNA, 22 nt, Escherichia coli CFT073
cuccaccagcaccagcaacaac

SEQ ID NO: 2650069 - RNA, 21 nt, Escherichia coli CFT073
cuccacccgcaaauaauugcc

SEQ ID NO: 2650070 - RNA, 14 nt, Escherichia coli CFT073
cuccacgcaggcgu

SEQ ID NO: 2650071 - RNA, 11 nt, Escherichia coli CFT073
cuccacgccca

SEQ ID NO: 2650072 - RNA, 17 nt, Escherichia coli CFT073
cuccacgcccagcgcag

SEQ ID NO: 2650073 - RNA, 20 nt, Escherichia coli CFT073
cuccacgcccagcgcaggaa

SEQ ID NO: 2650074 - RNA, 14 nt, Escherichia coli CFT073
cuccacgcucagac

SEQ ID NO: 2650075 - RNA, 16 nt, Escherichia coli CFT073
cuccacucugccaggc

SEQ ID NO: 2650076 - RNA, 23 nt, Escherichia coli CFT073
cuccacucugccaggcagcgauu

SEQ ID NO: 2650077 - RNA, 23 nt, Escherichia coli CFT073
cuccacugggaguuuuucuacua

SEQ ID NO: 2650078 - RNA, 17 nt, Escherichia coli CFT073
cuccacuucaccgcgaa

SEQ ID NO: 2650079 - RNA, 13 nt, Escherichia coli CFT073
cuccacuuccugc

SEQ ID NO: 2650080 - RNA, 17 nt, Escherichia coli CFT073
cuccacuuccugccagu

SEQ ID NO: 2650081 - RNA, 14 nt, Escherichia coli CFT073
cuccagacaccgcu

SEQ ID NO: 2650082 - RNA, 18 nt, Escherichia coli CFT073
cuccagacgcccgcgccc

SEQ ID NO: 2650083 - RNA, 14 nt, Escherichia coli CFT073
cuccagauaacaau

SEQ ID NO: 2650084 - RNA, 14 nt, Escherichia coli CFT073
cuccagauauugcu

SEQ ID NO: 2650085 - RNA, 15 nt, Escherichia coli CFT073
cuccagauauugcuc

SEQ ID NO: 2650086 - RNA, 18 nt, Escherichia coli CFT073
cuccagauauugcucuac

SEQ ID NO: 2650087 - RNA, 14 nt, Escherichia coli CFT073
cuccagaugacugg

SEQ ID NO: 2650088 - RNA, 16 nt, Escherichia coli CFT073
cuccagcaguccccag

SEQ ID NO: 2650089 - RNA, 14 nt, Escherichia coli CFT073
cuccagcaucuccu

SEQ ID NO: 2650090 - RNA, 13 nt, Escherichia coli CFT073
cuccagcccuuuc

SEQ ID NO: 2650091 - RNA, 14 nt, Escherichia coli CFT073
cuccagcccuuucg

SEQ ID NO: 2650092 - RNA, 21 nt, Escherichia coli CFT073
cuccagccugcgucagcuauu

SEQ ID NO: 2650093 - RNA, 11 nt, Escherichia coli CFT073
cuccagcgcca

SEQ ID NO: 2650094 - RNA, 13 nt, Escherichia coli CFT073
cuccagcgccgcc

SEQ ID NO: 2650095 - RNA, 21 nt, Escherichia coli CFT073
cuccagcgggcgaaucaacuc

SEQ ID NO: 2650096 - RNA, 17 nt, Escherichia coli CFT073
cuccagcuuaacauccc

SEQ ID NO: 2650097 - RNA, 15 nt, Escherichia coli CFT073
cuccaggcagaaaca

SEQ ID NO: 2650098 - RNA, 19 nt, Escherichia coli CFT073
cuccaggcagaaacaucau

SEQ ID NO: 2650099 - RNA, 14 nt, Escherichia coli CFT073
cuccaggccggaug

SEQ ID NO: 2650100 - RNA, 15 nt, Escherichia coli CFT073
cuccagguuaacgga

SEQ ID NO: 2650101 - RNA, 16 nt, Escherichia coli CFT073
cuccaguaccugcaaa

SEQ ID NO: 2650102 - RNA, 22 nt, Escherichia coli CFT073
cuccagucccauaacauauuca

SEQ ID NO: 2650103 - RNA, 22 nt, Escherichia coli CFT073
cuccagugcgcuuuauucagau

SEQ ID NO: 2650104 - RNA, 16 nt, Escherichia coli CFT073
cuccaguuaacgccgc

SEQ ID NO: 2650105 - RNA, 14 nt, Escherichia coli CFT073
cuccauagggcagg

SEQ ID NO: 2650106 - RNA, 17 nt, Escherichia coli CFT073
cuccauccccagcucuu

SEQ ID NO: 2650107 - RNA, 17 nt, Escherichia coli CFT073
cuccauccgggaucaca

SEQ ID NO: 2650108 - RNA, 13 nt, Escherichia coli CFT073
cuccaugaugacc

SEQ ID NO: 2650109 - RNA, 19 nt, Escherichia coli CFT073
cuccaugggagaacgaugc

SEQ ID NO: 2650110 - RNA, 23 nt, Escherichia coli CFT073
cuccauguaauucggcaaucgcu

SEQ ID NO: 2650111 - RNA, 19 nt, Escherichia coli CFT073
cuccauugcccgcccgaca

SEQ ID NO: 2650112 - RNA, 18 nt, Escherichia coli CFT073
cucccacaguuucagccc

SEQ ID NO: 2650113 - RNA, 20 nt, Escherichia coli CFT073
cuccccgguagccauuuuuu

SEQ ID NO: 2650114 - RNA, 16 nt, Escherichia coli CFT073
cuccccugcgagccgc

SEQ ID NO: 2650115 - RNA, 18 nt, Escherichia coli CFT073
cuccccuuucuuauuuuu

SEQ ID NO: 2650116 - RNA, 16 nt, Escherichia coli CFT073
cucccgcagccacucc

SEQ ID NO: 2650117 - RNA, 17 nt, Escherichia coli CFT073
cucccgcaggagcgccg

SEQ ID NO: 2650118 - RNA, 12 nt, Escherichia coli CFT073
cucccgcaguaa

SEQ ID NO: 2650119 - RNA, 19 nt, Escherichia coli CFT073
cucccgcaguaagcuguac

SEQ ID NO: 2650120 - RNA, 11 nt, Escherichia coli CFT073
cucccgccccc

SEQ ID NO: 2650121 - RNA, 21 nt, Escherichia coli CFT073
cucccgcccccgccagcgcca

SEQ ID NO: 2650122 - RNA, 20 nt, Escherichia coli CFT073
cucccgcgccgcagccggaa

SEQ ID NO: 2650123 - RNA, 12 nt, Escherichia coli CFT073
cucccgcuggcg

SEQ ID NO: 2650124 - RNA, 15 nt, Escherichia coli CFT073
cucccgucgcccaca

SEQ ID NO: 2650125 - RNA, 15 nt, Escherichia coli CFT073
cucccucuccacgca

SEQ ID NO: 2650126 - RNA, 18 nt, Escherichia coli CFT073
cucccugaugugaugccc

SEQ ID NO: 2650127 - RNA, 14 nt, Escherichia coli CFT073
cucccuugccugca

SEQ ID NO: 2650128 - RNA, 13 nt, Escherichia coli CFT073
cucggcugcugcc

SEQ ID NO: 2650129 - RNA, 17 nt, Escherichia coli CFT073
cucggcugcugccagca

SEQ ID NO: 2650130 - RNA, 14 nt, Escherichia coli CFT073
cucgggcggcaggu

SEQ ID NO: 2650131 - RNA, 20 nt, Escherichia coli CFT073
cucgguaaaaucaacgccgc

SEQ ID NO: 2650132 - RNA, 13 nt, Escherichia coli CFT073
cucggucacugac

SEQ ID NO: 2650133 - RNA, 19 nt, Escherichia coli CFT073
cucggucacugacaccagc

SEQ ID NO: 2650134 - RNA, 13 nt, Escherichia coli CFT073
cucgguuuucagg

SEQ ID NO: 2650135 - RNA, 18 nt, Escherichia coli CFT073
cucgucacaucaccaaca

SEQ ID NO: 2650136 - RNA, 15 nt, Escherichia coli CFT073
cucguccauaguaac

SEQ ID NO: 2650137 - RNA, 19 nt, Escherichia coli CFT073
cucgucgagaauauacagc

SEQ ID NO: 2650138 - RNA, 20 nt, Escherichia coli CFT073
cucgucgcgacgaccaccca

SEQ ID NO: 2650139 - RNA, 21 nt, Escherichia coli CFT073
cucgucgcgacgaccacccac

SEQ ID NO: 2650140 - RNA, 18 nt, Escherichia coli CFT073
cucgucgcugauauugcu

SEQ ID NO: 2650141 - RNA, 13 nt, Escherichia coli CFT073
cucgugccacagu

SEQ ID NO: 2650142 - RNA, 15 nt, Escherichia coli CFT073
cucgugccacaguuu

SEQ ID NO: 2650143 - RNA, 17 nt, Escherichia coli CFT073
cucguuaacuucauccc

SEQ ID NO: 2650144 - RNA, 14 nt, Escherichia coli CFT073
cucguucacauauu

SEQ ID NO: 2650145 - RNA, 22 nt, Escherichia coli CFT073
cucguucugaauacccgccaga

SEQ ID NO: 2650146 - RNA, 18 nt, Escherichia coli CFT073
cucguugauguucggcaa

SEQ ID NO: 2650147 - RNA, 13 nt, Escherichia coli CFT073
cucuaaaaucauc

SEQ ID NO: 2650148 - RNA, 15 nt, Escherichia coli CFT073
cucuaacccuuccag

SEQ ID NO: 2650149 - RNA, 20 nt, Escherichia coli CFT073
cucuaacccuuccagauuca

SEQ ID NO: 2650150 - RNA, 17 nt, Escherichia coli CFT073
cucuacaauauccucaa

SEQ ID NO: 2650151 - RNA, 21 nt, Escherichia coli CFT073
cucuacaauauccucaagcgu

SEQ ID NO: 2650152 - RNA, 16 nt, Escherichia coli CFT073
cucuaccuggucaccg

SEQ ID NO: 2650153 - RNA, 17 nt, Escherichia coli CFT073
cucuacgcgcugaccuu

SEQ ID NO: 2650154 - RNA, 21 nt, Escherichia coli CFT073
cucuacgcgcugaccuucagc

SEQ ID NO: 2650155 - RNA, 14 nt, Escherichia coli CFT073
cucuacucccugcu

SEQ ID NO: 2650156 - RNA, 21 nt, Escherichia coli CFT073
cucuauacugcgcgccgaagc

SEQ ID NO: 2650157 - RNA, 14 nt, Escherichia coli CFT073
cucuauccagccuu

SEQ ID NO: 2650158 - RNA, 16 nt, Escherichia coli CFT073
cucuaucuuauuuucc

SEQ ID NO: 2650159 - RNA, 22 nt, Escherichia coli CFT073
cucucacgguuaauggccggaa

SEQ ID NO: 2650160 - RNA, 15 nt, Escherichia coli CFT073
cucucagagaaucau

SEQ ID NO: 2650161 - RNA, 13 nt, Escherichia coli CFT073
cucucauccgcca

SEQ ID NO: 2650162 - RNA, 14 nt, Escherichia coli CFT073
cucucauccgccaa

SEQ ID NO: 2650163 - RNA, 15 nt, Escherichia coli CFT073
cucuccgggcggcgu

SEQ ID NO: 2650164 - RNA, 23 nt, Escherichia coli CFT073
cucuccgugggcuaacacugcca

SEQ ID NO: 2650165 - RNA, 23 nt, Escherichia coli CFT073
cucuccuguuuaauaugcaauuc

SEQ ID NO: 2650166 - RNA, 23 nt, Escherichia coli CFT073
cucucgccagagaucgcacaugu

SEQ ID NO: 2650167 - RNA, 14 nt, Escherichia coli CFT073
cucucgggcaguaa

SEQ ID NO: 2650168 - RNA, 17 nt, Escherichia coli CFT073
cucucgggcaguaaauc

SEQ ID NO: 2650169 - RNA, 21 nt, Escherichia coli CFT073
cucucugcaguagccagugcu

SEQ ID NO: 2650170 - RNA, 14 nt, Escherichia coli CFT073
cucucuggcggcca

SEQ ID NO: 2650171 - RNA, 18 nt, Escherichia coli CFT073
cucucuucaaacgcuucu

SEQ ID NO: 2650172 - RNA, 11 nt, Escherichia coli CFT073
cucucuucauc

SEQ ID NO: 2650173 - RNA, 12 nt, Escherichia coli CFT073
cucucuucaucg

SEQ ID NO: 2650174 - RNA, 18 nt, Escherichia coli CFT073
cucucuucguggcccgcc

SEQ ID NO: 2650175 - RNA, 14 nt, Escherichia coli CFT073
cucugaaugccagu

SEQ ID NO: 2650176 - RNA, 19 nt, Escherichia coli CFT073
cucugaaugccaguuuauu

SEQ ID NO: 2650177 - RNA, 15 nt, Escherichia coli CFT073
cucugacauaaaaaa

SEQ ID NO: 2650178 - RNA, 20 nt, Escherichia coli CFT073
cucugacgcgcauacucucc

SEQ ID NO: 2650179 - RNA, 21 nt, Escherichia coli CFT073
cucugacgcgcauacucuccu

SEQ ID NO: 2650180 - RNA, 18 nt, Escherichia coli CFT073
cucugaugacgcgucugg

SEQ ID NO: 2650181 - RNA, 15 nt, Escherichia coli CFT073
cucugaugacugaug

SEQ ID NO: 2650182 - RNA, 21 nt, Escherichia coli CFT073
cucugcaacucggcuauacga

SEQ ID NO: 2650183 - RNA, 17 nt, Escherichia coli CFT073
cucugcaagucuugcug

SEQ ID NO: 2650184 - RNA, 22 nt, Escherichia coli CFT073
cucugcaagucuugcugcgcuu

SEQ ID NO: 2650185 - RNA, 24 nt, Escherichia coli CFT073
cucugcaccagaacucccuguucc

SEQ ID NO: 2650186 - RNA, 19 nt, Escherichia coli CFT073
cucugcauguagcaacaaa

SEQ ID NO: 2650187 - RNA, 15 nt, Escherichia coli CFT073
cucugccacuggcuu

SEQ ID NO: 2650188 - RNA, 23 nt, Escherichia coli CFT073
cucugccagcgacagugaugacg

SEQ ID NO: 2650189 - RNA, 13 nt, Escherichia coli CFT073
cucugccagcgua

SEQ ID NO: 2650190 - RNA, 12 nt, Escherichia coli CFT073
cucugccaggca

SEQ ID NO: 2650191 - RNA, 13 nt, Escherichia coli CFT073
cucugcgccgccu

SEQ ID NO: 2650192 - RNA, 23 nt, Escherichia coli CFT073
cucugcgccuuugaugccaccag

SEQ ID NO: 2650193 - RNA, 13 nt, Escherichia coli CFT073
cucugcggaggcc

SEQ ID NO: 2650194 - RNA, 19 nt, Escherichia coli CFT073
cucugcggcaagaucgcga

SEQ ID NO: 2650195 - RNA, 15 nt, Escherichia coli CFT073
cucugcggcaucaua

SEQ ID NO: 2650196 - RNA, 18 nt, Escherichia coli CFT073
cucugcguuauuuucagg

SEQ ID NO: 2650197 - RNA, 13 nt, Escherichia coli CFT073
cucugcugccaca

SEQ ID NO: 2650198 - RNA, 20 nt, Escherichia coli CFT073
cucugcuggcggaacaucgc

SEQ ID NO: 2650199 - RNA, 14 nt, Escherichia coli CFT073
cucugcuugaauuc

SEQ ID NO: 2650200 - RNA, 12 nt, Escherichia coli CFT073
cucuggagaaau

SEQ ID NO: 2650201 - RNA, 15 nt, Escherichia coli CFT073
cucuggagaaauaua

SEQ ID NO: 2650202 - RNA, 12 nt, Escherichia coli CFT073
cucuggaugaaa

SEQ ID NO: 2650203 - RNA, 14 nt, Escherichia coli CFT073
cucuggcagcacca

SEQ ID NO: 2650204 - RNA, 13 nt, Escherichia coli CFT073
cucuggcaggcuu

SEQ ID NO: 2650205 - RNA, 22 nt, Escherichia coli CFT073
cucuggcauuuuugucgcgcug

SEQ ID NO: 2650206 - RNA, 21 nt, Escherichia coli CFT073
cucuggccccaccugcucgaa

SEQ ID NO: 2650207 - RNA, 20 nt, Escherichia coli CFT073
cucugguguggagugcagca

SEQ ID NO: 2650208 - RNA, 17 nt, Escherichia coli CFT073
cucuguaaacuccuuuc

SEQ ID NO: 2650209 - RNA, 19 nt, Escherichia coli CFT073
cucuguaaacuccuuucug

SEQ ID NO: 2650210 - RNA, 21 nt, Escherichia coli CFT073
cucuguagaacaccugucuuc

SEQ ID NO: 2650211 - RNA, 18 nt, Escherichia coli CFT073
cucugugcgucugcuuuu

SEQ ID NO: 2650212 - RNA, 20 nt, Escherichia coli CFT073
cucuguggaaagagcaaugu

SEQ ID NO: 2650213 - RNA, 23 nt, Escherichia coli CFT073
cucuguuaugguacuuucugauu

SEQ ID NO: 2650214 - RNA, 20 nt, Escherichia coli CFT073
cucuguucagugauggcaca

SEQ ID NO: 2650215 - RNA, 12 nt, Escherichia coli CFT073
cucuguucugcg

SEQ ID NO: 2650216 - RNA, 22 nt, Escherichia coli CFT073
cucuguuggcgauaaaacccag

SEQ ID NO: 2650217 - RNA, 13 nt, Escherichia coli CFT073
cucuuaaagcuac

SEQ ID NO: 2650218 - RNA, 21 nt, Escherichia coli CFT073
cucuuaaaugcacaauaauau

SEQ ID NO: 2650219 - RNA, 20 nt, Escherichia coli CFT073
cucuuaagguucacuuaauc

SEQ ID NO: 2650220 - RNA, 19 nt, Escherichia coli CFT073
cucuuauacacaagucccc

SEQ ID NO: 2650221 - RNA, 18 nt, Escherichia coli CFT073
cucuucaaacgcuucugg

SEQ ID NO: 2650222 - RNA, 16 nt, Escherichia coli CFT073
cucuucaacuucagca

SEQ ID NO: 2650223 - RNA, 18 nt, Escherichia coli CFT073
cucuucaacuucagcagc

SEQ ID NO: 2650224 - RNA, 16 nt, Escherichia coli CFT073
cucuucaagcugcuga

SEQ ID NO: 2650225 - RNA, 15 nt, Escherichia coli CFT073
cucuucaauccgcga

SEQ ID NO: 2650226 - RNA, 20 nt, Escherichia coli CFT073
cucuucaauggcaucacgca

SEQ ID NO: 2650227 - RNA, 23 nt, Escherichia coli CFT073
cucuucaauuaacaacacccggu

SEQ ID NO: 2650228 - RNA, 17 nt, Escherichia coli CFT073
cucuucaccgguacgga

SEQ ID NO: 2650229 - RNA, 17 nt, Escherichia coli CFT073
cucuucaccugccugca

SEQ ID NO: 2650230 - RNA, 22 nt, Escherichia coli CFT073
cucuucagccaacgcauuagca

SEQ ID NO: 2650231 - RNA, 19 nt, Escherichia coli CFT073
cucuucauacaucugcaaa

SEQ ID NO: 2650232 - RNA, 14 nt, Escherichia coli CFT073
cucuucaucuucca

SEQ ID NO: 2650233 - RNA, 14 nt, Escherichia coli CFT073
cucuucauuaccuu

SEQ ID NO: 2650234 - RNA, 19 nt, Escherichia coli CFT073
cucuuccagcagcggcaga

SEQ ID NO: 2650235 - RNA, 23 nt, Escherichia coli CFT073
cucuuccagcgacaccuuccgcg

SEQ ID NO: 2650236 - RNA, 15 nt, Escherichia coli CFT073
cugaauugugauggu

SEQ ID NO: 2650237 - RNA, 23 nt, Escherichia coli CFT073
cugaauuuccugcgcuuucugcu

SEQ ID NO: 2650238 - RNA, 16 nt, Escherichia coli CFT073
cugaauuugcuccaga

SEQ ID NO: 2650239 - RNA, 17 nt, Escherichia coli CFT073
cugaauuugcuccagaa

SEQ ID NO: 2650240 - RNA, 12 nt, Escherichia coli CFT073
cugacaaaauca

SEQ ID NO: 2650241 - RNA, 12 nt, Escherichia coli CFT073
cugacaaacugc

SEQ ID NO: 2650242 - RNA, 20 nt, Escherichia coli CFT073
cugacaacgcugaauggcga

SEQ ID NO: 2650243 - RNA, 18 nt, Escherichia coli CFT073
cugacacaggcagcaauc

SEQ ID NO: 2650244 - RNA, 13 nt, Escherichia coli CFT073
cugacaccagcau

SEQ ID NO: 2650245 - RNA, 20 nt, Escherichia coli CFT073
cugacacugccacuuuuucc

SEQ ID NO: 2650246 - RNA, 21 nt, Escherichia coli CFT073
cugacacugccacuuuuuccc

SEQ ID NO: 2650247 - RNA, 17 nt, Escherichia coli CFT073
cugacagaccacucucu

SEQ ID NO: 2650248 - RNA, 23 nt, Escherichia coli CFT073
cugacagaccacucucuggcaac

SEQ ID NO: 2650249 - RNA, 14 nt, Escherichia coli CFT073
cugacagacugcuu

SEQ ID NO: 2650250 - RNA, 21 nt, Escherichia coli CFT073
cugacauacggcgguucuuuc

SEQ ID NO: 2650251 - RNA, 20 nt, Escherichia coli CFT073
cugacauagacgccacccga

SEQ ID NO: 2650252 - RNA, 17 nt, Escherichia coli CFT073
cugacaucacgccacuc

SEQ ID NO: 2650253 - RNA, 13 nt, Escherichia coli CFT073
cugacaugcacgc

SEQ ID NO: 2650254 - RNA, 20 nt, Escherichia coli CFT073
cugacauggcaauagcuucu

SEQ ID NO: 2650255 - RNA, 17 nt, Escherichia coli CFT073
cugacauuaaauugcga

SEQ ID NO: 2650256 - RNA, 16 nt, Escherichia coli CFT073
cugacauuaccuucua

SEQ ID NO: 2650257 - RNA, 17 nt, Escherichia coli CFT073
cugaccaaauacacgca

SEQ ID NO: 2650258 - RNA, 14 nt, Escherichia coli CFT073
cugaccaccagcac

SEQ ID NO: 2650259 - RNA, 15 nt, Escherichia coli CFT073
cugaccaccagcacg

SEQ ID NO: 2650260 - RNA, 13 nt, Escherichia coli CFT073
cugaccacgacuc

SEQ ID NO: 2650261 - RNA, 14 nt, Escherichia coli CFT073
cugaccacggccau

SEQ ID NO: 2650262 - RNA, 13 nt, Escherichia coli CFT073
cugaccagccagc

SEQ ID NO: 2650263 - RNA, 16 nt, Escherichia coli CFT073
cugaccaucagcagcg

SEQ ID NO: 2650264 - RNA, 23 nt, Escherichia coli CFT073
cugaccauuacuguauacgggcu

SEQ ID NO: 2650265 - RNA, 14 nt, Escherichia coli CFT073
cugacccagaagac

SEQ ID NO: 2650266 - RNA, 13 nt, Escherichia coli CFT073
cugacccagcacc

SEQ ID NO: 2650267 - RNA, 19 nt, Escherichia coli CFT073
cugaccggaauuuacccgc

SEQ ID NO: 2650268 - RNA, 15 nt, Escherichia coli CFT073
cugaccgguugcugg

SEQ ID NO: 2650269 - RNA, 16 nt, Escherichia coli CFT073
cugaccgguugcugga

SEQ ID NO: 2650270 - RNA, 19 nt, Escherichia coli CFT073
cugaccgucgcagccagcg

SEQ ID NO: 2650271 - RNA, 15 nt, Escherichia coli CFT073
cugaccgucuuuuuu

SEQ ID NO: 2650272 - RNA, 21 nt, Escherichia coli CFT073
cugaccguucgccccauacag

SEQ ID NO: 2650273 - RNA, 14 nt, Escherichia coli CFT073
cugaccguugcuca

SEQ ID NO: 2650274 - RNA, 22 nt, Escherichia coli CFT073
cugaccugaauuaaugccucuc

SEQ ID NO: 2650275 - RNA, 19 nt, Escherichia coli CFT073
cugaccuggaaguguccag

SEQ ID NO: 2650276 - RNA, 22 nt, Escherichia coli CFT073
cugaccuuaauaaacucacuua

SEQ ID NO: 2650277 - RNA, 14 nt, Escherichia coli CFT073
cugaccuucuucag

SEQ ID NO: 2650278 - RNA, 21 nt, Escherichia coli CFT073
cugacgaaugguuucacgcug

SEQ ID NO: 2650279 - RNA, 13 nt, Escherichia coli CFT073
cugacgaucaagc

SEQ ID NO: 2650280 - RNA, 12 nt, Escherichia coli CFT073
cugacgcaucuu

SEQ ID NO: 2650281 - RNA, 16 nt, Escherichia coli CFT073
cugacgcaucuuaucc

SEQ ID NO: 2650282 - RNA, 12 nt, Escherichia coli CFT073
cugacgccacca

SEQ ID NO: 2650283 - RNA, 20 nt, Escherichia coli CFT073
cugacgccauucucaccuac

SEQ ID NO: 2650284 - RNA, 22 nt, Escherichia coli CFT073
cugacgcccaguuucgacauca

SEQ ID NO: 2650285 - RNA, 17 nt, Escherichia coli CFT073
cugacgcggguauuuaa

SEQ ID NO: 2650286 - RNA, 22 nt, Escherichia coli CFT073
cugacgcgugguuacgccgggc

SEQ ID NO: 2650287 - RNA, 21 nt, Escherichia coli CFT073
cugacgcucucaacgcccugu

SEQ ID NO: 2650288 - RNA, 23 nt, Escherichia coli CFT073
cugacgcuggguuucgccugcca

SEQ ID NO: 2650289 - RNA, 20 nt, Escherichia coli CFT073
cugacgcuuaucuuccguau

SEQ ID NO: 2650290 - RNA, 20 nt, Escherichia coli CFT073
cugacggaucggcucaacau

SEQ ID NO: 2650291 - RNA, 21 nt, Escherichia coli CFT073
cugacggugauaaucauccca

SEQ ID NO: 2650292 - RNA, 22 nt, Escherichia coli CFT073
cugacguaaacccguugcuuca

SEQ ID NO: 2650293 - RNA, 13 nt, Escherichia coli CFT073
cugacguagcagc

SEQ ID NO: 2650294 - RNA, 23 nt, Escherichia coli CFT073
cugacgugcacaaacuucuucag

SEQ ID NO: 2650295 - RNA, 14 nt, Escherichia coli CFT073
cugacguucagccg

SEQ ID NO: 2650296 - RNA, 18 nt, Escherichia coli CFT073
cugacguugcggauuaaa

SEQ ID NO: 2650297 - RNA, 23 nt, Escherichia coli CFT073
cugacguugcggauuaaauacau

SEQ ID NO: 2650298 - RNA, 13 nt, Escherichia coli CFT073
cugacguugggua

SEQ ID NO: 2650299 - RNA, 15 nt, Escherichia coli CFT073
cugacuaagcgggau

SEQ ID NO: 2650300 - RNA, 17 nt, Escherichia coli CFT073
cugacuacuuucaugcu

SEQ ID NO: 2650301 - RNA, 13 nt, Escherichia coli CFT073
cugacuccaggug

SEQ ID NO: 2650302 - RNA, 16 nt, Escherichia coli CFT073
cugacugacgugauga

SEQ ID NO: 2650303 - RNA, 23 nt, Escherichia coli CFT073
cugacugacgugaugauaaguga

SEQ ID NO: 2650304 - RNA, 13 nt, Escherichia coli CFT073
cugacugacuuca

SEQ ID NO: 2650305 - RNA, 15 nt, Escherichia coli CFT073
cugacugaugacaaa

SEQ ID NO: 2650306 - RNA, 17 nt, Escherichia coli CFT073
cugacuggcucuuuuuc

SEQ ID NO: 2650307 - RNA, 19 nt, Escherichia coli CFT073
cugacuguuuuuccagcuu

SEQ ID NO: 2650308 - RNA, 23 nt, Escherichia coli CFT073
cugacuuacuuccugucuucccu

SEQ ID NO: 2650309 - RNA, 12 nt, Escherichia coli CFT073
cugacuuccacu

SEQ ID NO: 2650310 - RNA, 16 nt, Escherichia coli CFT073
cugacuuccacuuccu

SEQ ID NO: 2650311 - RNA, 17 nt, Escherichia coli CFT073
cugacuuccugccucuu

SEQ ID NO: 2650312 - RNA, 13 nt, Escherichia coli CFT073
cugacuugccagg

SEQ ID NO: 2650313 - RNA, 22 nt, Escherichia coli CFT073
cugacuuucuuuucccuguggg

SEQ ID NO: 2650314 - RNA, 18 nt, Escherichia coli CFT073
cugacuuuguaccagcgg

SEQ ID NO: 2650315 - RNA, 19 nt, Escherichia coli CFT073
cugacuuuguaccagcggg

SEQ ID NO: 2650316 - RNA, 23 nt, Escherichia coli CFT073
cugagaaauuagcgucaccaucc

SEQ ID NO: 2650317 - RNA, 20 nt, Escherichia coli CFT073
cugagaacuucggcagagaa

SEQ ID NO: 2650318 - RNA, 22 nt, Escherichia coli CFT073
cugagaauuccggcagagaaag

SEQ ID NO: 2650319 - RNA, 19 nt, Escherichia coli CFT073
cugagacaaacagucucaa

SEQ ID NO: 2650320 - RNA, 18 nt, Escherichia coli CFT073
cugagacagacagccuca

SEQ ID NO: 2650321 - RNA, 15 nt, Escherichia coli CFT073
cugagacccggccau

SEQ ID NO: 2650322 - RNA, 21 nt, Escherichia coli CFT073
cugagaucggaaagccccgcc

SEQ ID NO: 2650323 - RNA, 14 nt, Escherichia coli CFT073
cugagaucugccuu

SEQ ID NO: 2650324 - RNA, 14 nt, Escherichia coli CFT073
cugagauggcuuca

SEQ ID NO: 2650325 - RNA, 21 nt, Escherichia coli CFT073
cugagauuacauugggaagau

SEQ ID NO: 2650326 - RNA, 21 nt, Escherichia coli CFT073
cugagcaaacaguucugcagc

SEQ ID NO: 2650327 - RNA, 20 nt, Escherichia coli CFT073
cugagcaccacacgacgcgc

SEQ ID NO: 2650328 - RNA, 22 nt, Escherichia coli CFT073
cugagcauuuaugccauguuca

SEQ ID NO: 2650329 - RNA, 17 nt, Escherichia coli CFT073
cugagccaguuuuucuu

SEQ ID NO: 2650330 - RNA, 13 nt, Escherichia coli CFT073
cugagcccgcuuc

SEQ ID NO: 2650331 - RNA, 16 nt, Escherichia coli CFT073
cugagccgacgccagc

SEQ ID NO: 2650332 - RNA, 13 nt, Escherichia coli CFT073
cugagccugugca

SEQ ID NO: 2650333 - RNA, 23 nt, Escherichia coli CFT073
cugagccugugcauguuuaacca

SEQ ID NO: 2650334 - RNA, 19 nt, Escherichia coli CFT073
cugagcgaagcgcaugccu

SEQ ID NO: 2650335 - RNA, 19 nt, Escherichia coli CFT073
cugagcguaggucaugccu

SEQ ID NO: 2650336 - RNA, 22 nt, Escherichia coli CFT073
cugagcgugagugcgaaacaga

SEQ ID NO: 2650337 - RNA, 22 nt, Escherichia coli CFT073
cugagcgugccccugaauaauc

SEQ ID NO: 2650338 - RNA, 15 nt, Escherichia coli CFT073
cugagcucaugccgu

SEQ ID NO: 2650339 - RNA, 13 nt, Escherichia coli CFT073
cugagcuucuuca

SEQ ID NO: 2650340 - RNA, 17 nt, Escherichia coli CFT073
cugagcuucuucaaaaa

SEQ ID NO: 2650341 - RNA, 22 nt, Escherichia coli CFT073
cugagcuucuucaaaaaaguca

SEQ ID NO: 2650342 - RNA, 20 nt, Escherichia coli CFT073
cugaggggcaaaaucggcgu

SEQ ID NO: 2650343 - RNA, 21 nt, Escherichia coli CFT073
cugaguaucgaaaacaucaaa

SEQ ID NO: 2650344 - RNA, 18 nt, Escherichia coli CFT073
cugauuccgggccaccau

SEQ ID NO: 2650345 - RNA, 13 nt, Escherichia coli CFT073
cugauugcauaau

SEQ ID NO: 2650346 - RNA, 12 nt, Escherichia coli CFT073
cugauugcuggc

SEQ ID NO: 2650347 - RNA, 16 nt, Escherichia coli CFT073
cugauugcuggcgggc

SEQ ID NO: 2650348 - RNA, 21 nt, Escherichia coli CFT073
cugauugucagguagguuggu

SEQ ID NO: 2650349 - RNA, 15 nt, Escherichia coli CFT073
cugauuguucagucg

SEQ ID NO: 2650350 - RNA, 17 nt, Escherichia coli CFT073
cugauuguucagucgau

SEQ ID NO: 2650351 - RNA, 18 nt, Escherichia coli CFT073
cugauuuccccccggcag

SEQ ID NO: 2650352 - RNA, 20 nt, Escherichia coli CFT073
cugauuuccccccggcagcu

SEQ ID NO: 2650353 - RNA, 23 nt, Escherichia coli CFT073
cugauuugcccgaugcgcaagcu

SEQ ID NO: 2650354 - RNA, 17 nt, Escherichia coli CFT073
cugauuuuauuucacau

SEQ ID NO: 2650355 - RNA, 22 nt, Escherichia coli CFT073
cugauuuucaucuucuucuggc

SEQ ID NO: 2650356 - RNA, 14 nt, Escherichia coli CFT073
cugauuuucuucca

SEQ ID NO: 2650357 - RNA, 16 nt, Escherichia coli CFT073
cugcaaaaaacagccg

SEQ ID NO: 2650358 - RNA, 16 nt, Escherichia coli CFT073
cugcaaaaguaccauu

SEQ ID NO: 2650359 - RNA, 16 nt, Escherichia coli CFT073
cugcaaaauaccaaua

SEQ ID NO: 2650360 - RNA, 22 nt, Escherichia coli CFT073
cugcaaaauaccaauaaucaau

SEQ ID NO: 2650361 - RNA, 15 nt, Escherichia coli CFT073
cugcaaaaucuguug

SEQ ID NO: 2650362 - RNA, 20 nt, Escherichia coli CFT073
cugcaaagcugaugguugaa

SEQ ID NO: 2650363 - RNA, 13 nt, Escherichia coli CFT073
cugcaaauaaaua

SEQ ID NO: 2650364 - RNA, 15 nt, Escherichia coli CFT073
cugcaaauauugccc

SEQ ID NO: 2650365 - RNA, 14 nt, Escherichia coli CFT073
cugcaaauauuguc

SEQ ID NO: 2650366 - RNA, 21 nt, Escherichia coli CFT073
cugcaacaacaccagcaggug

SEQ ID NO: 2650367 - RNA, 18 nt, Escherichia coli CFT073
cugcaacacccgguaccu

SEQ ID NO: 2650368 - RNA, 19 nt, Escherichia coli CFT073
cugcaacacuuccgcuucc

SEQ ID NO: 2650369 - RNA, 21 nt, Escherichia coli CFT073
cugcaacacuuccgcuuccag

SEQ ID NO: 2650370 - RNA, 11 nt, Escherichia coli CFT073
cugcaaccaga

SEQ ID NO: 2650371 - RNA, 17 nt, Escherichia coli CFT073
cugcaacguuuuaagca

SEQ ID NO: 2650372 - RNA, 22 nt, Escherichia coli CFT073
cugcaacguuuuaagcaaauaa

SEQ ID NO: 2650373 - RNA, 14 nt, Escherichia coli CFT073
cugcaacugaugac

SEQ ID NO: 2650374 - RNA, 14 nt, Escherichia coli CFT073
cugcaacugcugca

SEQ ID NO: 2650375 - RNA, 14 nt, Escherichia coli CFT073
cugcaacuggcggc

SEQ ID NO: 2650376 - RNA, 21 nt, Escherichia coli CFT073
cugcaacugugcggcaauuag

SEQ ID NO: 2650377 - RNA, 20 nt, Escherichia coli CFT073
cugcaagagggacuccggau

SEQ ID NO: 2650378 - RNA, 20 nt, Escherichia coli CFT073
cugcaaggccaucggcagcg

SEQ ID NO: 2650379 - RNA, 20 nt, Escherichia coli CFT073
cugcaauaacaucggcuguu

SEQ ID NO: 2650380 - RNA, 18 nt, Escherichia coli CFT073
cugcaaucgucugcugaa

SEQ ID NO: 2650381 - RNA, 17 nt, Escherichia coli CFT073
cugcaaugccauucaca

SEQ ID NO: 2650382 - RNA, 23 nt, Escherichia coli CFT073
cugcaauugcggcaggucaucgu

SEQ ID NO: 2650383 - RNA, 12 nt, Escherichia coli CFT073
cugcaauuucau

SEQ ID NO: 2650384 - RNA, 14 nt, Escherichia coli CFT073
cugcaauuucauuu

SEQ ID NO: 2650385 - RNA, 15 nt, Escherichia coli CFT073
cugcaauuugugcgu

SEQ ID NO: 2650386 - RNA, 19 nt, Escherichia coli CFT073
cugcacaccaaccgcuucc

SEQ ID NO: 2650387 - RNA, 14 nt, Escherichia coli CFT073
cugcacacggauaa

SEQ ID NO: 2650388 - RNA, 22 nt, Escherichia coli CFT073
cugcacagcauucagcuuccag

SEQ ID NO: 2650389 - RNA, 19 nt, Escherichia coli CFT073
cugcacaguguuuguugaa

SEQ ID NO: 2650390 - RNA, 17 nt, Escherichia coli CFT073
cugcacauuaucaaacg

SEQ ID NO: 2650391 - RNA, 18 nt, Escherichia coli CFT073
cugcaccagaacucccug

SEQ ID NO: 2650392 - RNA, 13 nt, Escherichia coli CFT073
cugcaccagcagc

SEQ ID NO: 2650393 - RNA, 18 nt, Escherichia coli CFT073
cugcaccagcagcgucag

SEQ ID NO: 2650394 - RNA, 13 nt, Escherichia coli CFT073
cugcaccccacaa

SEQ ID NO: 2650395 - RNA, 17 nt, Escherichia coli CFT073
cugcaccccacaaacag

SEQ ID NO: 2650396 - RNA, 15 nt, Escherichia coli CFT073
cugcacccuuuuuua

SEQ ID NO: 2650397 - RNA, 20 nt, Escherichia coli CFT073
cugcaccgccuccagcgaca

SEQ ID NO: 2650398 - RNA, 13 nt, Escherichia coli CFT073
cugcacgcccuga

SEQ ID NO: 2650399 - RNA, 14 nt, Escherichia coli CFT073
cugcacgcccugau

SEQ ID NO: 2650400 - RNA, 21 nt, Escherichia coli CFT073
cugcacgcgauggcuuuccac

SEQ ID NO: 2650401 - RNA, 23 nt, Escherichia coli CFT073
cugcacgcgauggcuuuccaccu

SEQ ID NO: 2650402 - RNA, 13 nt, Escherichia coli CFT073
cugcacgguuuuu

SEQ ID NO: 2650403 - RNA, 19 nt, Escherichia coli CFT073
cugcacguuggcgcauaac

SEQ ID NO: 2650404 - RNA, 17 nt, Escherichia coli CFT073
cugcacguuuugcuggu

SEQ ID NO: 2650405 - RNA, 11 nt, Escherichia coli CFT073
cugcacucagg

SEQ ID NO: 2650406 - RNA, 13 nt, Escherichia coli CFT073
cugcacucaggua

SEQ ID NO: 2650407 - RNA, 16 nt, Escherichia coli CFT073
cugcacugacaggccg

SEQ ID NO: 2650408 - RNA, 21 nt, Escherichia coli CFT073
cugcacugacaggccgugcag

SEQ ID NO: 2650409 - RNA, 22 nt, Escherichia coli CFT073
cugcacugaguuacguccaugu

SEQ ID NO: 2650410 - RNA, 23 nt, Escherichia coli CFT073
cugcacugguggcaccucgugcg

SEQ ID NO: 2650411 - RNA, 13 nt, Escherichia coli CFT073
cugcacuguccca

SEQ ID NO: 2650412 - RNA, 15 nt, Escherichia coli CFT073
cugcagaauauccgc

SEQ ID NO: 2650413 - RNA, 14 nt, Escherichia coli CFT073
cugcagacugaagc

SEQ ID NO: 2650414 - RNA, 16 nt, Escherichia coli CFT073
cugcagcaggcgagcu

SEQ ID NO: 2650415 - RNA, 19 nt, Escherichia coli CFT073
cugcagcagguugucgagu

SEQ ID NO: 2650416 - RNA, 17 nt, Escherichia coli CFT073
cugcagccaguugcucu

SEQ ID NO: 2650417 - RNA, 18 nt, Escherichia coli CFT073
cugcagccaguugcucuu

SEQ ID NO: 2650418 - RNA, 19 nt, Escherichia coli CFT073
cugcagccaucgucgccac

SEQ ID NO: 2650419 - RNA, 21 nt, Escherichia coli CFT073
cugcaggaaagcaagaccaac

SEQ ID NO: 2650420 - RNA, 19 nt, Escherichia coli CFT073
cugcaggaaaucaaugcca

SEQ ID NO: 2650421 - RNA, 23 nt, Escherichia coli CFT073
cugcaggaaaucaaugccaccag

SEQ ID NO: 2650422 - RNA, 23 nt, Escherichia coli CFT073
cugcaggcaacgaccagaaaugc

SEQ ID NO: 2650423 - RNA, 15 nt, Escherichia coli CFT073
cugcagggauggcuc

SEQ ID NO: 2650424 - RNA, 15 nt, Escherichia coli CFT073
cugcagggcuuuuua

SEQ ID NO: 2650425 - RNA, 14 nt, Escherichia coli CFT073
cugcagguuggcuu

SEQ ID NO: 2650426 - RNA, 12 nt, Escherichia coli CFT073
cugcaguaccag

SEQ ID NO: 2650427 - RNA, 16 nt, Escherichia coli CFT073
cugcagucaccugccc

SEQ ID NO: 2650428 - RNA, 15 nt, Escherichia coli CFT073
cugcagugguaaaca

SEQ ID NO: 2650429 - RNA, 23 nt, Escherichia coli CFT073
cugcauaaugucgcuggccggac

SEQ ID NO: 2650430 - RNA, 15 nt, Escherichia coli CFT073
cugcauaccauugcg

SEQ ID NO: 2650431 - RNA, 22 nt, Escherichia coli CFT073
cugcauacugaguaauuuucaa

SEQ ID NO: 2650432 - RNA, 13 nt, Escherichia coli CFT073
cugcaucaaccag

SEQ ID NO: 2650433 - RNA, 16 nt, Escherichia coli CFT073
cugcaucaaccagcac

SEQ ID NO: 2650434 - RNA, 21 nt, Escherichia coli CFT073
cugcaucaaccagcaccuuuu

SEQ ID NO: 2650435 - RNA, 14 nt, Escherichia coli CFT073
cugcaucagcgccu

SEQ ID NO: 2650436 - RNA, 19 nt, Escherichia coli CFT073
cugcaucagcgccuuacca

SEQ ID NO: 2650437 - RNA, 12 nt, Escherichia coli CFT073
cugcauccagaa

SEQ ID NO: 2650438 - RNA, 18 nt, Escherichia coli CFT073
cugcaucccggcaggaau

SEQ ID NO: 2650439 - RNA, 16 nt, Escherichia coli CFT073
cugcauccgcgcuuuc

SEQ ID NO: 2650440 - RNA, 17 nt, Escherichia coli CFT073
cugcaucgccugauuca

SEQ ID NO: 2650441 - RNA, 19 nt, Escherichia coli CFT073
cugcaugaaauagcccacu

SEQ ID NO: 2650442 - RNA, 16 nt, Escherichia coli CFT073
cugcaugacagcgccc

SEQ ID NO: 2650443 - RNA, 21 nt, Escherichia coli CFT073
cugcaugaugucgaauuucuc

SEQ ID NO: 2650444 - RNA, 22 nt, Escherichia coli CFT073
cugcaugaugucgaauuucucg

SEQ ID NO: 2650445 - RNA, 22 nt, Escherichia coli CFT073
cugcaugccuaaagugcugggc

SEQ ID NO: 2650446 - RNA, 17 nt, Escherichia coli CFT073
cugcauggcaacuuuaa

SEQ ID NO: 2650447 - RNA, 20 nt, Escherichia coli CFT073
cugcauuagccaggcaccaa

SEQ ID NO: 2650448 - RNA, 18 nt, Escherichia coli CFT073
cugcauucggcgaccagc

SEQ ID NO: 2650449 - RNA, 15 nt, Escherichia coli CFT073
cugcauugcgcugaa

SEQ ID NO: 2650450 - RNA, 13 nt, Escherichia coli CFT073
cugcauugucgga

SEQ ID NO: 2650451 - RNA, 18 nt, Escherichia coli CFT073
cugcauuucuggaaugcg

SEQ ID NO: 2650452 - RNA, 19 nt, Escherichia coli CFT073
cugcgaauuuccugccaga

SEQ ID NO: 2650453 - RNA, 13 nt, Escherichia coli CFT073
cugcgacaccagc

SEQ ID NO: 2650454 - RNA, 21 nt, Escherichia coli CFT073
cugcgacaccagcauguucca

SEQ ID NO: 2650455 - RNA, 13 nt, Escherichia coli CFT073
cugcgacacugug

SEQ ID NO: 2650456 - RNA, 21 nt, Escherichia coli CFT073
cugcgaccggcguaacggcca

SEQ ID NO: 2650457 - RNA, 14 nt, Escherichia coli CFT073
cugcgacgucugau

SEQ ID NO: 2650458 - RNA, 19 nt, Escherichia coli CFT073
cugcgacgucugaucggca

SEQ ID NO: 2650459 - RNA, 20 nt, Escherichia coli CFT073
cugcgagaugaccgacaggu

SEQ ID NO: 2650460 - RNA, 15 nt, Escherichia coli CFT073
cugcgauucaggguu

SEQ ID NO: 2650461 - RNA, 12 nt, Escherichia coli CFT073
cugcgcaaugcg

SEQ ID NO: 2650462 - RNA, 16 nt, Escherichia coli CFT073
cugcgcacgaguuucu

SEQ ID NO: 2650463 - RNA, 13 nt, Escherichia coli CFT073
cugcgcagcggug

SEQ ID NO: 2650464 - RNA, 22 nt, Escherichia coli CFT073
cugcgcagguuuaccuguuucg

SEQ ID NO: 2650465 - RNA, 16 nt, Escherichia coli CFT073
cugcgcauggaagcgc

SEQ ID NO: 2650466 - RNA, 20 nt, Escherichia coli CFT073
cugcgcauuucccagcaaga

SEQ ID NO: 2650467 - RNA, 21 nt, Escherichia coli CFT073
cugcgcauuucccagcaagaa

SEQ ID NO: 2650468 - RNA, 22 nt, Escherichia coli CFT073
cugcgcauuucccagcaagaac

SEQ ID NO: 2650469 - RNA, 15 nt, Escherichia coli CFT073
cugcgcauuucgcuc

SEQ ID NO: 2650470 - RNA, 22 nt, Escherichia coli CFT073
cugcgcauuucgcucuucacau

SEQ ID NO: 2650471 - RNA, 16 nt, Escherichia coli CFT073
cugcgccaccacaaca

SEQ ID NO: 2650472 - RNA, 15 nt, Escherichia coli CFT073
cugcgccacgaaaac

SEQ ID NO: 2650473 - RNA, 17 nt, Escherichia coli CFT073
cugcgccagcgaaccac

SEQ ID NO: 2650474 - RNA, 13 nt, Escherichia coli CFT073
cugcgccagugcc

SEQ ID NO: 2650475 - RNA, 14 nt, Escherichia coli CFT073
cugcgccagugccg

SEQ ID NO: 2650476 - RNA, 15 nt, Escherichia coli CFT073
cugcgccauaaccgc

SEQ ID NO: 2650477 - RNA, 14 nt, Escherichia coli CFT073
cugcgccaucccca

SEQ ID NO: 2650478 - RNA, 14 nt, Escherichia coli CFT073
cugcgcccgcccgc

SEQ ID NO: 2650479 - RNA, 16 nt, Escherichia coli CFT073
cugcgccgcucggugc

SEQ ID NO: 2650480 - RNA, 24 nt, Escherichia coli CFT073
cugcgccuaacaacugcuggacga

SEQ ID NO: 2650481 - RNA, 13 nt, Escherichia coli CFT073
cugcgccuuccag

SEQ ID NO: 2650482 - RNA, 14 nt, Escherichia coli CFT073
cugcgccuuccagc

SEQ ID NO: 2650483 - RNA, 19 nt, Escherichia coli CFT073
cugcgccuuuuuucgccgc

SEQ ID NO: 2650484 - RNA, 22 nt, Escherichia coli CFT073
cugcgccuuuuuucgccgcagc

SEQ ID NO: 2650485 - RNA, 17 nt, Escherichia coli CFT073
cugcgcggaccccgcgc

SEQ ID NO: 2650486 - RNA, 18 nt, Escherichia coli CFT073
cugcgcggaccccgcgcu

SEQ ID NO: 2650487 - RNA, 19 nt, Escherichia coli CFT073
cugcgcggcaaaggcuucg

SEQ ID NO: 2650488 - RNA, 17 nt, Escherichia coli CFT073
cugcgcgggugaaaacg

SEQ ID NO: 2650489 - RNA, 15 nt, Escherichia coli CFT073
cugcgcggugacauc

SEQ ID NO: 2650490 - RNA, 19 nt, Escherichia coli CFT073
cugcgcgugaagcacguaa

SEQ ID NO: 2650491 - RNA, 16 nt, Escherichia coli CFT073
cugcgcguuacuggca

SEQ ID NO: 2650492 - RNA, 17 nt, Escherichia coli CFT073
cugcgcuaaaauuucuu

SEQ ID NO: 2650493 - RNA, 15 nt, Escherichia coli CFT073
cugcgcucuucuggc

SEQ ID NO: 2650494 - RNA, 14 nt, Escherichia coli CFT073
cugcgcugacucua

SEQ ID NO: 2650495 - RNA, 17 nt, Escherichia coli CFT073
cugcgcuggcaggccug

SEQ ID NO: 2650496 - RNA, 18 nt, Escherichia coli CFT073
cugcgcuggcaggccugc

SEQ ID NO: 2650497 - RNA, 20 nt, Escherichia coli CFT073
cugcgcuuaucaggccuaaa

SEQ ID NO: 2650498 - RNA, 12 nt, Escherichia coli CFT073
cugcgcuuccag

SEQ ID NO: 2650499 - RNA, 16 nt, Escherichia coli CFT073
cugcgcuucugccacg

SEQ ID NO: 2650500 - RNA, 15 nt, Escherichia coli CFT073
cugcgcuucuuccag

SEQ ID NO: 2650501 - RNA, 17 nt, Escherichia coli CFT073
cugcgcuugcggccagc

SEQ ID NO: 2650502 - RNA, 14 nt, Escherichia coli CFT073
cugcgcuugcugcc

SEQ ID NO: 2650503 - RNA, 15 nt, Escherichia coli CFT073
cugcgcuuucugcuu

SEQ ID NO: 2650504 - RNA, 22 nt, Escherichia coli CFT073
cugcgcuuucugcuucgccauc

SEQ ID NO: 2650505 - RNA, 21 nt, Escherichia coli CFT073
cugcggaauagcggguacagc

SEQ ID NO: 2650506 - RNA, 13 nt, Escherichia coli CFT073
cugcggcaaugcg

SEQ ID NO: 2650507 - RNA, 11 nt, Escherichia coli CFT073
cugcggcagcu

SEQ ID NO: 2650508 - RNA, 19 nt, Escherichia coli CFT073
cugcggccugcugcacaga

SEQ ID NO: 2650509 - RNA, 22 nt, Escherichia coli CFT073
cugcggcgaugaccgccacggu

SEQ ID NO: 2650510 - RNA, 21 nt, Escherichia coli CFT073
cugcggcuguccggcaccauu

SEQ ID NO: 2650511 - RNA, 15 nt, Escherichia coli CFT073
cugcggcuugucgua

SEQ ID NO: 2650512 - RNA, 19 nt, Escherichia coli CFT073
cugcgggaacauaugcaca

SEQ ID NO: 2650513 - RNA, 17 nt, Escherichia coli CFT073
cugcgggagaauugcca

SEQ ID NO: 2650514 - RNA, 20 nt, Escherichia coli CFT073
cugcggggaugaauauguag

SEQ ID NO: 2650515 - RNA, 20 nt, Escherichia coli CFT073
cugcggguugcucucgccag

SEQ ID NO: 2650516 - RNA, 22 nt, Escherichia coli CFT073
cugcgguacggauagccgcccc

SEQ ID NO: 2650517 - RNA, 14 nt, Escherichia coli CFT073
cugcggucacgcug

SEQ ID NO: 2650518 - RNA, 18 nt, Escherichia coli CFT073
cugcggugacguagcucg

SEQ ID NO: 2650519 - RNA, 16 nt, Escherichia coli CFT073
cugcgguguaaaccag

SEQ ID NO: 2650520 - RNA, 17 nt, Escherichia coli CFT073
cugcgguugaaacacag

SEQ ID NO: 2650521 - RNA, 19 nt, Escherichia coli CFT073
cugcgguuugucaucauug

SEQ ID NO: 2650522 - RNA, 18 nt, Escherichia coli CFT073
cugcguaauucgccaccg

SEQ ID NO: 2650523 - RNA, 18 nt, Escherichia coli CFT073
cugcguagaguccagcgc

SEQ ID NO: 2650524 - RNA, 16 nt, Escherichia coli CFT073
cugcguaucgcccugc

SEQ ID NO: 2650525 - RNA, 16 nt, Escherichia coli CFT073
cugcgucaucggcguu

SEQ ID NO: 2650526 - RNA, 17 nt, Escherichia coli CFT073
cugcgucgcaucuggca

SEQ ID NO: 2650527 - RNA, 22 nt, Escherichia coli CFT073
cugcgucgcggccuguuccaau

SEQ ID NO: 2650528 - RNA, 13 nt, Escherichia coli CFT073
cugcgucuuccac

SEQ ID NO: 2650529 - RNA, 18 nt, Escherichia coli CFT073
cugcgucuuccacuucau

SEQ ID NO: 2650530 - RNA, 19 nt, Escherichia coli CFT073
cugcguuagaaaacgccug

SEQ ID NO: 2650531 - RNA, 22 nt, Escherichia coli CFT073
cugcguuagaaaacgccugcuc

SEQ ID NO: 2650532 - RNA, 15 nt, Escherichia coli CFT073
cugcguuccggcaug

SEQ ID NO: 2650533 - RNA, 16 nt, Escherichia coli CFT073
cugcguugagaaacgc

SEQ ID NO: 2650534 - RNA, 16 nt, Escherichia coli CFT073
cugcguugcucaugca

SEQ ID NO: 2650535 - RNA, 22 nt, Escherichia coli CFT073
cugcguuucauguaacgcugca

SEQ ID NO: 2650536 - RNA, 14 nt, Escherichia coli CFT073
cugcguuuucacag

SEQ ID NO: 2650537 - RNA, 17 nt, Escherichia coli CFT073
cugcguuuugguggcga

SEQ ID NO: 2650538 - RNA, 21 nt, Escherichia coli CFT073
cugcuaacaguuugccaaacc

SEQ ID NO: 2650539 - RNA, 12 nt, Escherichia coli CFT073
cugcuaauuuau

SEQ ID NO: 2650540 - RNA, 12 nt, Escherichia coli CFT073
cugcuacaccau

SEQ ID NO: 2650541 - RNA, 21 nt, Escherichia coli CFT073
cugcuauggcgcguccggcgu

SEQ ID NO: 2650542 - RNA, 20 nt, Escherichia coli CFT073
cugcuauucccgcaaaaucu

SEQ ID NO: 2650543 - RNA, 21 nt, Escherichia coli CFT073
cugcucaaccgccaguucccc

SEQ ID NO: 2650544 - RNA, 16 nt, Escherichia coli CFT073
cugcucaaguaauaaa

SEQ ID NO: 2650545 - RNA, 21 nt, Escherichia coli CFT073
cugcucaaucgaacgcagcaa

SEQ ID NO: 2650546 - RNA, 13 nt, Escherichia coli CFT073
cugcucacaccau

SEQ ID NO: 2650547 - RNA, 14 nt, Escherichia coli CFT073
cugcucaucagcgg

SEQ ID NO: 2650548 - RNA, 16 nt, Escherichia coli CFT073
cugcuccagaaaauaa

SEQ ID NO: 2650549 - RNA, 16 nt, Escherichia coli CFT073
cugcuccagcagcuca

SEQ ID NO: 2650550 - RNA, 22 nt, Escherichia coli CFT073
cugcuccagcguaccugccgcg

SEQ ID NO: 2650551 - RNA, 19 nt, Escherichia coli CFT073
cugcuccaucgcaugccag

SEQ ID NO: 2650552 - RNA, 17 nt, Escherichia coli CFT073
cugcuccuguugaugug

SEQ ID NO: 2650553 - RNA, 19 nt, Escherichia coli CFT073
cugcucgcagaaauacccc

SEQ ID NO: 2650554 - RNA, 14 nt, Escherichia coli CFT073
cugcucguaaagca

SEQ ID NO: 2650555 - RNA, 19 nt, Escherichia coli CFT073
cugcucguaaagcaucaga

SEQ ID NO: 2650556 - RNA, 22 nt, Escherichia coli CFT073
cugcucuauacgcucauuuucu

SEQ ID NO: 2650557 - RNA, 14 nt, Escherichia coli CFT073
cugcucuauugccg

SEQ ID NO: 2650558 - RNA, 10 nt, Escherichia coli CFT073
cugcucuccc

SEQ ID NO: 2650559 - RNA, 20 nt, Escherichia coli CFT073
cugcucuggcagcaccacgc

SEQ ID NO: 2650560 - RNA, 15 nt, Escherichia coli CFT073
cugcucuuccggcgu

SEQ ID NO: 2650561 - RNA, 22 nt, Escherichia coli CFT073
cuggcagggaaagaaacgccau

SEQ ID NO: 2650562 - RNA, 19 nt, Escherichia coli CFT073
cuggcaguggaauauaauu

SEQ ID NO: 2650563 - RNA, 16 nt, Escherichia coli CFT073
cuggcaguggugcggc

SEQ ID NO: 2650564 - RNA, 16 nt, Escherichia coli CFT073
cuggcaucaaucgcuc

SEQ ID NO: 2650565 - RNA, 22 nt, Escherichia coli CFT073
cuggcaucaaucgcucccagcc

SEQ ID NO: 2650566 - RNA, 23 nt, Escherichia coli CFT073
cuggcaucaaucgcucccagccc

SEQ ID NO: 2650567 - RNA, 20 nt, Escherichia coli CFT073
cuggcauuuuugucgcgcug

SEQ ID NO: 2650568 - RNA, 19 nt, Escherichia coli CFT073
cuggccauggauucaagca

SEQ ID NO: 2650569 - RNA, 21 nt, Escherichia coli CFT073
cuggccauugaauuaaaaugu

SEQ ID NO: 2650570 - RNA, 14 nt, Escherichia coli CFT073
cuggcccaugccag

SEQ ID NO: 2650571 - RNA, 18 nt, Escherichia coli CFT073
cuggcccauugccagcgc

SEQ ID NO: 2650572 - RNA, 19 nt, Escherichia coli CFT073
cuggccccuggcuggucag

SEQ ID NO: 2650573 - RNA, 16 nt, Escherichia coli CFT073
cuggccugcgaccagu

SEQ ID NO: 2650574 - RNA, 17 nt, Escherichia coli CFT073
cuggccuuuauuuucca

SEQ ID NO: 2650575 - RNA, 21 nt, Escherichia coli CFT073
cuggcgaaaggaggcauugaa

SEQ ID NO: 2650576 - RNA, 15 nt, Escherichia coli CFT073
cuggcgaacucugac

SEQ ID NO: 2650577 - RNA, 14 nt, Escherichia coli CFT073
cuggcgaauuuaua

SEQ ID NO: 2650578 - RNA, 13 nt, Escherichia coli CFT073
cuggcgacgccgg

SEQ ID NO: 2650579 - RNA, 15 nt, Escherichia coli CFT073
cuggcgacggcuacg

SEQ ID NO: 2650580 - RNA, 16 nt, Escherichia coli CFT073
cuggcgacugccagcc

SEQ ID NO: 2650581 - RNA, 15 nt, Escherichia coli CFT073
cuggcgagaacaccg

SEQ ID NO: 2650582 - RNA, 14 nt, Escherichia coli CFT073
cuggcgagcgccag

SEQ ID NO: 2650583 - RNA, 13 nt, Escherichia coli CFT073
cuggcgaugcccc

SEQ ID NO: 2650584 - RNA, 21 nt, Escherichia coli CFT073
cuggcgauugucauucgccug

SEQ ID NO: 2650585 - RNA, 16 nt, Escherichia coli CFT073
cuggcgcaacugcgcc

SEQ ID NO: 2650586 - RNA, 22 nt, Escherichia coli CFT073
cuggcgcaauauucaagauaac

SEQ ID NO: 2650587 - RNA, 14 nt, Escherichia coli CFT073
cuggcgcagcacga

SEQ ID NO: 2650588 - RNA, 12 nt, Escherichia coli CFT073
cuggcgcagcag

SEQ ID NO: 2650589 - RNA, 12 nt, Escherichia coli CFT073
cuggcgcagcau

SEQ ID NO: 2650590 - RNA, 14 nt, Escherichia coli CFT073
cuggcgcaggagcc

SEQ ID NO: 2650591 - RNA, 18 nt, Escherichia coli CFT073
cuggcgcaggagccgcau

SEQ ID NO: 2650592 - RNA, 20 nt, Escherichia coli CFT073
cuggcgcgcuauuaccaggc

SEQ ID NO: 2650593 - RNA, 15 nt, Escherichia coli CFT073
cuggcgcuaucaaua

SEQ ID NO: 2650594 - RNA, 14 nt, Escherichia coli CFT073
cuggcgcugcucag

SEQ ID NO: 2650595 - RNA, 14 nt, Escherichia coli CFT073
cuggcgcuggcaug

SEQ ID NO: 2650596 - RNA, 12 nt, Escherichia coli CFT073
cuggcgcuuuga

SEQ ID NO: 2650597 - RNA, 22 nt, Escherichia coli CFT073
cuggcggcaaaccuuucgccac

SEQ ID NO: 2650598 - RNA, 20 nt, Escherichia coli CFT073
cuggcggcaaugaaagcgag

SEQ ID NO: 2650599 - RNA, 14 nt, Escherichia coli CFT073
cuggcggcagcagg

SEQ ID NO: 2650600 - RNA, 12 nt, Escherichia coli CFT073
cuggcggcggcg

SEQ ID NO: 2650601 - RNA, 17 nt, Escherichia coli CFT073
cuggcggcgugaugccg

SEQ ID NO: 2650602 - RNA, 20 nt, Escherichia coli CFT073
cuggcggcguguuauccggc

SEQ ID NO: 2650603 - RNA, 21 nt, Escherichia coli CFT073
cuggcggcguuuugcuuuuua

SEQ ID NO: 2650604 - RNA, 16 nt, Escherichia coli CFT073
cuggcgguugauaaug

SEQ ID NO: 2650605 - RNA, 19 nt, Escherichia coli CFT073
cuggcgguugauaaugauu

SEQ ID NO: 2650606 - RNA, 22 nt, Escherichia coli CFT073
cuggcgguuugccauuuucuga

SEQ ID NO: 2650607 - RNA, 16 nt, Escherichia coli CFT073
cuggcguacccaucaa

SEQ ID NO: 2650608 - RNA, 13 nt, Escherichia coli CFT073
cuggcguagagau

SEQ ID NO: 2650609 - RNA, 14 nt, Escherichia coli CFT073
cuggcguagagauc

SEQ ID NO: 2650610 - RNA, 23 nt, Escherichia coli CFT073
cuggcguagagaucccccgcaca

SEQ ID NO: 2650611 - RNA, 21 nt, Escherichia coli CFT073
cuggcgucacgccgaccagac

SEQ ID NO: 2650612 - RNA, 16 nt, Escherichia coli CFT073
cuggcgucauggcgcu

SEQ ID NO: 2650613 - RNA, 15 nt, Escherichia coli CFT073
cuggcgugaaauuca

SEQ ID NO: 2650614 - RNA, 22 nt, Escherichia coli CFT073
cuggcguuacccuuguggauaa

SEQ ID NO: 2650615 - RNA, 14 nt, Escherichia coli CFT073
cuggcguuggcgua

SEQ ID NO: 2650616 - RNA, 17 nt, Escherichia coli CFT073
cuggcuaagcaucgcaa

SEQ ID NO: 2650617 - RNA, 20 nt, Escherichia coli CFT073
cuggcuaagcaucgcaauac

SEQ ID NO: 2650618 - RNA, 20 nt, Escherichia coli CFT073
cuggcucaucgccuuccagu

SEQ ID NO: 2650619 - RNA, 18 nt, Escherichia coli CFT073
cuggcuccuguuugcauu

SEQ ID NO: 2650620 - RNA, 18 nt, Escherichia coli CFT073
cuggcucguuauagguau

SEQ ID NO: 2650621 - RNA, 20 nt, Escherichia coli CFT073
cuggcugaacgccugcacca

SEQ ID NO: 2650622 - RNA, 14 nt, Escherichia coli CFT073
cuggcugaaucccu

SEQ ID NO: 2650623 - RNA, 22 nt, Escherichia coli CFT073
cuggcugacauaaacaccagca

SEQ ID NO: 2650624 - RNA, 23 nt, Escherichia coli CFT073
cuggcugacauaaacaccagcaa

SEQ ID NO: 2650625 - RNA, 13 nt, Escherichia coli CFT073
cuggcugaccuga

SEQ ID NO: 2650626 - RNA, 21 nt, Escherichia coli CFT073
cuggcugagcaaacaguucug

SEQ ID NO: 2650627 - RNA, 23 nt, Escherichia coli CFT073
cuggcugagcaaacaguucugca

SEQ ID NO: 2650628 - RNA, 22 nt, Escherichia coli CFT073
cuggcugauggaagugacaccg

SEQ ID NO: 2650629 - RNA, 22 nt, Escherichia coli CFT073
cuggcugauuaacguuuccauu

SEQ ID NO: 2650630 - RNA, 17 nt, Escherichia coli CFT073
cuggcugccagcccgcu

SEQ ID NO: 2650631 - RNA, 22 nt, Escherichia coli CFT073
cuggcugcccaugccuuguuua

SEQ ID NO: 2650632 - RNA, 16 nt, Escherichia coli CFT073
cuggcugccuuagucu

SEQ ID NO: 2650633 - RNA, 14 nt, Escherichia coli CFT073
cuggcugcuccaga

SEQ ID NO: 2650634 - RNA, 16 nt, Escherichia coli CFT073
cuggcuggcaacccag

SEQ ID NO: 2650635 - RNA, 20 nt, Escherichia coli CFT073
cuggcuggcgcuacugaagc

SEQ ID NO: 2650636 - RNA, 14 nt, Escherichia coli CFT073
cuggcugguggaac

SEQ ID NO: 2650637 - RNA, 15 nt, Escherichia coli CFT073
cuggcuuaauaauuc

SEQ ID NO: 2650638 - RNA, 23 nt, Escherichia coli CFT073
cuggcuucgagaaugaagucacc

SEQ ID NO: 2650639 - RNA, 16 nt, Escherichia coli CFT073
cuggcuugccagccac

SEQ ID NO: 2650640 - RNA, 22 nt, Escherichia coli CFT073
cuggcuuuacuuaacuccaucc

SEQ ID NO: 2650641 - RNA, 19 nt, Escherichia coli CFT073
cuggcuuuuggaccgccaa

SEQ ID NO: 2650642 - RNA, 23 nt, Escherichia coli CFT073
cuggcuuuuggaccgccaauuaa

SEQ ID NO: 2650643 - RNA, 15 nt, Escherichia coli CFT073
cugggaaaucaccac

SEQ ID NO: 2650644 - RNA, 18 nt, Escherichia coli CFT073
cugggaaaucaccaccag

SEQ ID NO: 2650645 - RNA, 15 nt, Escherichia coli CFT073
cugggaugccccggg

SEQ ID NO: 2650646 - RNA, 19 nt, Escherichia coli CFT073
cugggauuuggcagcaccc

SEQ ID NO: 2650647 - RNA, 17 nt, Escherichia coli CFT073
cugggcaaaaucaucac

SEQ ID NO: 2650648 - RNA, 14 nt, Escherichia coli CFT073
cugggcaaugcugu

SEQ ID NO: 2650649 - RNA, 23 nt, Escherichia coli CFT073
cugggcacucuuggcaccgccuu

SEQ ID NO: 2650650 - RNA, 13 nt, Escherichia coli CFT073
cugggccagcacc

SEQ ID NO: 2650651 - RNA, 14 nt, Escherichia coli CFT073
cugggccagcacca

SEQ ID NO: 2650652 - RNA, 13 nt, Escherichia coli CFT073
cugggccaucagg

SEQ ID NO: 2650653 - RNA, 17 nt, Escherichia coli CFT073
cugggccugcauaucgg

SEQ ID NO: 2650654 - RNA, 18 nt, Escherichia coli CFT073
cugggcgaucggcaggaa

SEQ ID NO: 2650655 - RNA, 14 nt, Escherichia coli CFT073
cuggggcuggaaga

SEQ ID NO: 2650656 - RNA, 14 nt, Escherichia coli CFT073
cugggguaccugga

SEQ ID NO: 2650657 - RNA, 15 nt, Escherichia coli CFT073
cugggguaccuggau

SEQ ID NO: 2650658 - RNA, 12 nt, Escherichia coli CFT073
cuggguaacacc

SEQ ID NO: 2650659 - RNA, 22 nt, Escherichia coli CFT073
cuggguauaccggcguuucugg

SEQ ID NO: 2650660 - RNA, 14 nt, Escherichia coli CFT073
cuggguuccuucca

SEQ ID NO: 2650661 - RNA, 16 nt, Escherichia coli CFT073
cuggguuuucacagaa

SEQ ID NO: 2650662 - RNA, 14 nt, Escherichia coli CFT073
cugguaaacgaccc

SEQ ID NO: 2650663 - RNA, 20 nt, Escherichia coli CFT073
cugguaaacgacccugccac

SEQ ID NO: 2650664 - RNA, 20 nt, Escherichia coli CFT073
cugguaaagcagacggcugu

SEQ ID NO: 2650665 - RNA, 14 nt, Escherichia coli CFT073
cugguaacgaucgu

SEQ ID NO: 2650666 - RNA, 16 nt, Escherichia coli CFT073
cugguaaucaccaccc

SEQ ID NO: 2650667 - RNA, 13 nt, Escherichia coli CFT073
cugguaaucgcaa

SEQ ID NO: 2650668 - RNA, 22 nt, Escherichia coli CFT073
cugguaaucgcggguugccauu

SEQ ID NO: 2650669 - RNA, 22 nt, Escherichia coli CFT073
cugucagugaccagcggcagaa

SEQ ID NO: 2650670 - RNA, 18 nt, Escherichia coli CFT073
cugucaucgacaaaaacc

SEQ ID NO: 2650671 - RNA, 23 nt, Escherichia coli CFT073
cugucaucgacaaaaacccugcc

SEQ ID NO: 2650672 - RNA, 16 nt, Escherichia coli CFT073
cugucauucauucaga

SEQ ID NO: 2650673 - RNA, 19 nt, Escherichia coli CFT073
cuguccacauccagauguc

SEQ ID NO: 2650674 - RNA, 15 nt, Escherichia coli CFT073
cuguccacgacagaa

SEQ ID NO: 2650675 - RNA, 18 nt, Escherichia coli CFT073
cuguccacgacagaaccc

SEQ ID NO: 2650676 - RNA, 20 nt, Escherichia coli CFT073
cuguccacgacagaacccgg

SEQ ID NO: 2650677 - RNA, 19 nt, Escherichia coli CFT073
cugucccaaaaugucggau

SEQ ID NO: 2650678 - RNA, 22 nt, Escherichia coli CFT073
cugucccaaaaugucggaugcg

SEQ ID NO: 2650679 - RNA, 16 nt, Escherichia coli CFT073
cuguccgauuuguucu

SEQ ID NO: 2650680 - RNA, 14 nt, Escherichia coli CFT073
cuguccugaaaauu

SEQ ID NO: 2650681 - RNA, 13 nt, Escherichia coli CFT073
cuguccugcggcg

SEQ ID NO: 2650682 - RNA, 13 nt, Escherichia coli CFT073
cugucgaggccaa

SEQ ID NO: 2650683 - RNA, 20 nt, Escherichia coli CFT073
cugucgauuuguacucuucc

SEQ ID NO: 2650684 - RNA, 14 nt, Escherichia coli CFT073
cugucgccagugag

SEQ ID NO: 2650685 - RNA, 15 nt, Escherichia coli CFT073
cugucgcgcagcacu

SEQ ID NO: 2650686 - RNA, 15 nt, Escherichia coli CFT073
cugucgcuucacgca

SEQ ID NO: 2650687 - RNA, 16 nt, Escherichia coli CFT073
cugucgcuucacgcag

SEQ ID NO: 2650688 - RNA, 17 nt, Escherichia coli CFT073
cugucggagcucccccu

SEQ ID NO: 2650689 - RNA, 20 nt, Escherichia coli CFT073
cugucggcaaaucaauagug

SEQ ID NO: 2650690 - RNA, 23 nt, Escherichia coli CFT073
cugucggcaagauacugcauaau

SEQ ID NO: 2650691 - RNA, 20 nt, Escherichia coli CFT073
cugucggcacugaccaccac

SEQ ID NO: 2650692 - RNA, 15 nt, Escherichia coli CFT073
cugucggcggcgaua

SEQ ID NO: 2650693 - RNA, 17 nt, Escherichia coli CFT073
cugucggguaagcgcca

SEQ ID NO: 2650694 - RNA, 18 nt, Escherichia coli CFT073
cugucggguaagcgccac

SEQ ID NO: 2650695 - RNA, 18 nt, Escherichia coli CFT073
cugucuaaccgccugccu

SEQ ID NO: 2650696 - RNA, 19 nt, Escherichia coli CFT073
cugucuaaugauucauaaa

SEQ ID NO: 2650697 - RNA, 22 nt, Escherichia coli CFT073
cugucuaaugauucauaaacaa

SEQ ID NO: 2650698 - RNA, 12 nt, Escherichia coli CFT073
cugucuaccagc

SEQ ID NO: 2650699 - RNA, 21 nt, Escherichia coli CFT073
cugucucauuguguacauccu

SEQ ID NO: 2650700 - RNA, 15 nt, Escherichia coli CFT073
cugucugauaaaaaa

SEQ ID NO: 2650701 - RNA, 16 nt, Escherichia coli CFT073
cugucugcugugugau

SEQ ID NO: 2650702 - RNA, 13 nt, Escherichia coli CFT073
cugucuuccugcg

SEQ ID NO: 2650703 - RNA, 15 nt, Escherichia coli CFT073
cugugaaacaccugc

SEQ ID NO: 2650704 - RNA, 18 nt, Escherichia coli CFT073
cugugaacucaggcugcc

SEQ ID NO: 2650705 - RNA, 13 nt, Escherichia coli CFT073
cugugaagcaccu

SEQ ID NO: 2650706 - RNA, 18 nt, Escherichia coli CFT073
cugugaaguauuaauguc

SEQ ID NO: 2650707 - RNA, 19 nt, Escherichia coli CFT073
cugugaagucgggaacugg

SEQ ID NO: 2650708 - RNA, 18 nt, Escherichia coli CFT073
cugugaagugcugcaacc

SEQ ID NO: 2650709 - RNA, 21 nt, Escherichia coli CFT073
cugugaauccugcauaccauu

SEQ ID NO: 2650710 - RNA, 17 nt, Escherichia coli CFT073
cugugaauuacugcugc

SEQ ID NO: 2650711 - RNA, 18 nt, Escherichia coli CFT073
cugugaauuacugcugcg

SEQ ID NO: 2650712 - RNA, 24 nt, Escherichia coli CFT073
cugugauuucuuuauugauaaaca

SEQ ID NO: 2650713 - RNA, 19 nt, Escherichia coli CFT073
cugugcaaccuuuuccauu

SEQ ID NO: 2650714 - RNA, 14 nt, Escherichia coli CFT073
cugugcaaugaaaa

SEQ ID NO: 2650715 - RNA, 22 nt, Escherichia coli CFT073
cugugcaccgcccugcaucaug

SEQ ID NO: 2650716 - RNA, 22 nt, Escherichia coli CFT073
cugugcagcaagccacucagcc

SEQ ID NO: 2650717 - RNA, 18 nt, Escherichia coli CFT073
cugugcagccaaaaauga

SEQ ID NO: 2650718 - RNA, 23 nt, Escherichia coli CFT073
cugugccagcucgugcagaacau

SEQ ID NO: 2650719 - RNA, 21 nt, Escherichia coli CFT073
cugugccaggacuucaucacg

SEQ ID NO: 2650720 - RNA, 22 nt, Escherichia coli CFT073
cugugccguggcgcucgcagga

SEQ ID NO: 2650721 - RNA, 19 nt, Escherichia coli CFT073
cugugccugagccggaguu

SEQ ID NO: 2650722 - RNA, 14 nt, Escherichia coli CFT073
cugugcgauagcaa

SEQ ID NO: 2650723 - RNA, 20 nt, Escherichia coli CFT073
cugugcgcguuauuuguugc

SEQ ID NO: 2650724 - RNA, 17 nt, Escherichia coli CFT073
cugugcggggguaaaac

SEQ ID NO: 2650725 - RNA, 14 nt, Escherichia coli CFT073
cugugcgucugcuu

SEQ ID NO: 2650726 - RNA, 22 nt, Escherichia coli CFT073
cugugcguuacccacaguuuca

SEQ ID NO: 2650727 - RNA, 17 nt, Escherichia coli CFT073
cugugcuugcagauaau

SEQ ID NO: 2650728 - RNA, 21 nt, Escherichia coli CFT073
cugugcuuguaaaacagccaa

SEQ ID NO: 2650729 - RNA, 19 nt, Escherichia coli CFT073
cuguggaaagagcaaugug

SEQ ID NO: 2650730 - RNA, 20 nt, Escherichia coli CFT073
cuguggaauaugcgccacuc

SEQ ID NO: 2650731 - RNA, 14 nt, Escherichia coli CFT073
cuguggaucuuccc

SEQ ID NO: 2650732 - RNA, 18 nt, Escherichia coli CFT073
cuguggcagucacuuccu

SEQ ID NO: 2650733 - RNA, 16 nt, Escherichia coli CFT073
cuguggcgcgaccaga

SEQ ID NO: 2650734 - RNA, 16 nt, Escherichia coli CFT073
cugugguacugccgac

SEQ ID NO: 2650735 - RNA, 21 nt, Escherichia coli CFT073
cugugguauaugcguugcggu

SEQ ID NO: 2650736 - RNA, 20 nt, Escherichia coli CFT073
cuguguaaacccagccgcgu

SEQ ID NO: 2650737 - RNA, 22 nt, Escherichia coli CFT073
cuguguaaacccagccgcgucu

SEQ ID NO: 2650738 - RNA, 21 nt, Escherichia coli CFT073
cuguguaaugaauggaguugu

SEQ ID NO: 2650739 - RNA, 15 nt, Escherichia coli CFT073
cugugucgccgagcc

SEQ ID NO: 2650740 - RNA, 21 nt, Escherichia coli CFT073
cugugucgguuaccaguacac

SEQ ID NO: 2650741 - RNA, 16 nt, Escherichia coli CFT073
cugugucucuucuuug

SEQ ID NO: 2650742 - RNA, 19 nt, Escherichia coli CFT073
cugugugauccacugcaga

SEQ ID NO: 2650743 - RNA, 17 nt, Escherichia coli CFT073
cugugugguuuuguagu

SEQ ID NO: 2650744 - RNA, 13 nt, Escherichia coli CFT073
cuguguguaggcc

SEQ ID NO: 2650745 - RNA, 13 nt, Escherichia coli CFT073
cuguguuguucug

SEQ ID NO: 2650746 - RNA, 17 nt, Escherichia coli CFT073
cuguguuuaugccggau

SEQ ID NO: 2650747 - RNA, 23 nt, Escherichia coli CFT073
cuguuaaugcgaaugaaagauga

SEQ ID NO: 2650748 - RNA, 20 nt, Escherichia coli CFT073
cuguuaccuacgcuugcugc

SEQ ID NO: 2650749 - RNA, 13 nt, Escherichia coli CFT073
cuguuacuacaga

SEQ ID NO: 2650750 - RNA, 15 nt, Escherichia coli CFT073
cuguuacucaacuga

SEQ ID NO: 2650751 - RNA, 19 nt, Escherichia coli CFT073
cuguucaaaugcgcucaga

SEQ ID NO: 2650752 - RNA, 16 nt, Escherichia coli CFT073
cuguucagugauggca

SEQ ID NO: 2650753 - RNA, 20 nt, Escherichia coli CFT073
cuguucagugauggcacacc

SEQ ID NO: 2650754 - RNA, 16 nt, Escherichia coli CFT073
cuguucauuuuguagg

SEQ ID NO: 2650755 - RNA, 16 nt, Escherichia coli CFT073
cuguuccagguuuugu

SEQ ID NO: 2650756 - RNA, 16 nt, Escherichia coli CFT073
cuguuccggcagaaac

SEQ ID NO: 2650757 - RNA, 16 nt, Escherichia coli CFT073
cuguuccggcggcagg

SEQ ID NO: 2650758 - RNA, 12 nt, Escherichia coli CFT073
cuguuccucccg

SEQ ID NO: 2650759 - RNA, 22 nt, Escherichia coli CFT073
cuguuccuuauucugugaacuu

SEQ ID NO: 2650760 - RNA, 18 nt, Escherichia coli CFT073
cuguucgccagugcauua

SEQ ID NO: 2650761 - RNA, 14 nt, Escherichia coli CFT073
cuguucgccgcagc

SEQ ID NO: 2650762 - RNA, 14 nt, Escherichia coli CFT073
cuguucgccgccgc

SEQ ID NO: 2650763 - RNA, 15 nt, Escherichia coli CFT073
cuguucgccgccgcu

SEQ ID NO: 2650764 - RNA, 15 nt, Escherichia coli CFT073
cuguugaaauuauug

SEQ ID NO: 2650765 - RNA, 21 nt, Escherichia coli CFT073
cuguugacguccagcccuucu

SEQ ID NO: 2650766 - RNA, 20 nt, Escherichia coli CFT073
cuguugauugcguucaaucu

SEQ ID NO: 2650767 - RNA, 15 nt, Escherichia coli CFT073
cuguugccagcagca

SEQ ID NO: 2650768 - RNA, 17 nt, Escherichia coli CFT073
cuguugccagcaguuca

SEQ ID NO: 2650769 - RNA, 20 nt, Escherichia coli CFT073
cuguugcccaugcuucugca

SEQ ID NO: 2650770 - RNA, 22 nt, Escherichia coli CFT073
cuguuggaaucacucaucaugc

SEQ ID NO: 2650771 - RNA, 15 nt, Escherichia coli CFT073
cuguuggcaacgcaa

SEQ ID NO: 2650772 - RNA, 19 nt, Escherichia coli CFT073
cuguuggcaacgcaaacug

SEQ ID NO: 2650773 - RNA, 13 nt, Escherichia coli CFT073
cuguugugaugca

SEQ ID NO: 2650774 - RNA, 17 nt, Escherichia coli CFT073
cuguuguuccagcuucc

SEQ ID NO: 2650775 - RNA, 21 nt, Escherichia coli CFT073
cuguuuaagcgaaagcgugag

SEQ ID NO: 2650776 - RNA, 20 nt, Escherichia coli CFT073
cuguuuaccggugccagcaa

SEQ ID NO: 2650777 - RNA, 17 nt, Escherichia coli CFT073
cuuauggcguacugaag

SEQ ID NO: 2650778 - RNA, 19 nt, Escherichia coli CFT073
cuuauuaacagucagucac

SEQ ID NO: 2650779 - RNA, 12 nt, Escherichia coli CFT073
cuuauucaccac

SEQ ID NO: 2650780 - RNA, 18 nt, Escherichia coli CFT073
cuuauucaccaccaucaa

SEQ ID NO: 2650781 - RNA, 14 nt, Escherichia coli CFT073
cuuauucacgccaa

SEQ ID NO: 2650782 - RNA, 22 nt, Escherichia coli CFT073
cuuauucauaucuucaggccaa

SEQ ID NO: 2650783 - RNA, 16 nt, Escherichia coli CFT073
cuuauucccacuuuuc

SEQ ID NO: 2650784 - RNA, 17 nt, Escherichia coli CFT073
cuuauucggccuaccau

SEQ ID NO: 2650785 - RNA, 18 nt, Escherichia coli CFT073
cuuauucugugaacuuca

SEQ ID NO: 2650786 - RNA, 19 nt, Escherichia coli CFT073
cuuauucuucaacaauuga

SEQ ID NO: 2650787 - RNA, 14 nt, Escherichia coli CFT073
cuuauugccggaug

SEQ ID NO: 2650788 - RNA, 17 nt, Escherichia coli CFT073
cuuauugcuucaagaug

SEQ ID NO: 2650789 - RNA, 21 nt, Escherichia coli CFT073
cuuauugcuucaagaugccau

SEQ ID NO: 2650790 - RNA, 14 nt, Escherichia coli CFT073
cuucaaaaaaguca

SEQ ID NO: 2650791 - RNA, 20 nt, Escherichia coli CFT073
cuucaaaaauaaguugccac

SEQ ID NO: 2650792 - RNA, 13 nt, Escherichia coli CFT073
cuucaaacgcuga

SEQ ID NO: 2650793 - RNA, 15 nt, Escherichia coli CFT073
cuucaaacugcagca

SEQ ID NO: 2650794 - RNA, 14 nt, Escherichia coli CFT073
cuucaaauaaacgu

SEQ ID NO: 2650795 - RNA, 17 nt, Escherichia coli CFT073
cuucaacacaggccggc

SEQ ID NO: 2650796 - RNA, 14 nt, Escherichia coli CFT073
cuucaaccacauuc

SEQ ID NO: 2650797 - RNA, 16 nt, Escherichia coli CFT073
cuucaaccacauucag

SEQ ID NO: 2650798 - RNA, 20 nt, Escherichia coli CFT073
cuucaaccagcggcgcaucc

SEQ ID NO: 2650799 - RNA, 22 nt, Escherichia coli CFT073
cuucaaccaguuucuccaguga

SEQ ID NO: 2650800 - RNA, 18 nt, Escherichia coli CFT073
cuucaacgaaagcgccuc

SEQ ID NO: 2650801 - RNA, 19 nt, Escherichia coli CFT073
cuucaacgcugcggcgugc

SEQ ID NO: 2650802 - RNA, 19 nt, Escherichia coli CFT073
cuucaacguuaggcggaaa

SEQ ID NO: 2650803 - RNA, 18 nt, Escherichia coli CFT073
cuucaagaauccuuauuu

SEQ ID NO: 2650804 - RNA, 22 nt, Escherichia coli CFT073
cuucaagaaucgagcaauaaac

SEQ ID NO: 2650805 - RNA, 17 nt, Escherichia coli CFT073
cuucaagaauuaaaaua

SEQ ID NO: 2650806 - RNA, 18 nt, Escherichia coli CFT073
cuucaagccaggcuuuaa

SEQ ID NO: 2650807 - RNA, 19 nt, Escherichia coli CFT073
cuucaagccgggagcggcg

SEQ ID NO: 2650808 - RNA, 19 nt, Escherichia coli CFT073
cuucaaguguggccgccag

SEQ ID NO: 2650809 - RNA, 18 nt, Escherichia coli CFT073
cuucaauaucaucauccg

SEQ ID NO: 2650810 - RNA, 22 nt, Escherichia coli CFT073
cuucaauaucaucauccgcaau

SEQ ID NO: 2650811 - RNA, 13 nt, Escherichia coli CFT073
cuucaaucaauaa

SEQ ID NO: 2650812 - RNA, 20 nt, Escherichia coli CFT073
cuucaaucaauaacagcgca

SEQ ID NO: 2650813 - RNA, 11 nt, Escherichia coli CFT073
cuucaaucgcc

SEQ ID NO: 2650814 - RNA, 17 nt, Escherichia coli CFT073
cuucaaucgccaccacg

SEQ ID NO: 2650815 - RNA, 15 nt, Escherichia coli CFT073
cuucaaucugagcga

SEQ ID NO: 2650816 - RNA, 21 nt, Escherichia coli CFT073
cuucaauggcugaaagcgccg

SEQ ID NO: 2650817 - RNA, 22 nt, Escherichia coli CFT073
cuucaauuuuuuccggcgaacc

SEQ ID NO: 2650818 - RNA, 14 nt, Escherichia coli CFT073
cuucacaaaggcuu

SEQ ID NO: 2650819 - RNA, 13 nt, Escherichia coli CFT073
cuucacacugacg

SEQ ID NO: 2650820 - RNA, 12 nt, Escherichia coli CFT073
cuucacacugau

SEQ ID NO: 2650821 - RNA, 19 nt, Escherichia coli CFT073
cuucacacugaugacaggc

SEQ ID NO: 2650822 - RNA, 12 nt, Escherichia coli CFT073
cuucacaggccg

SEQ ID NO: 2650823 - RNA, 18 nt, Escherichia coli CFT073
cuucacauuguuaaagcc

SEQ ID NO: 2650824 - RNA, 18 nt, Escherichia coli CFT073
cuucaccauaaaacgcgc

SEQ ID NO: 2650825 - RNA, 13 nt, Escherichia coli CFT073
cuucacccgcagc

SEQ ID NO: 2650826 - RNA, 16 nt, Escherichia coli CFT073
cuucacccgcagcacg

SEQ ID NO: 2650827 - RNA, 17 nt, Escherichia coli CFT073
cuucacccgcagcacgg

SEQ ID NO: 2650828 - RNA, 22 nt, Escherichia coli CFT073
cuucacccucacgcauucucuu

SEQ ID NO: 2650829 - RNA, 17 nt, Escherichia coli CFT073
cuucaccgacaucuuuc

SEQ ID NO: 2650830 - RNA, 19 nt, Escherichia coli CFT073
cuucaccgguucaucacga

SEQ ID NO: 2650831 - RNA, 21 nt, Escherichia coli CFT073
cuucaccguggucuuuugccu

SEQ ID NO: 2650832 - RNA, 15 nt, Escherichia coli CFT073
cuucaccucauguaa

SEQ ID NO: 2650833 - RNA, 16 nt, Escherichia coli CFT073
cuucaccugccugcag

SEQ ID NO: 2650834 - RNA, 18 nt, Escherichia coli CFT073
cuucaccugccugcagcu

SEQ ID NO: 2650835 - RNA, 22 nt, Escherichia coli CFT073
cuucaccuucggugaauuucac

SEQ ID NO: 2650836 - RNA, 17 nt, Escherichia coli CFT073
cuucacgcccgccccag

SEQ ID NO: 2650837 - RNA, 16 nt, Escherichia coli CFT073
cuucacggaucgcuuu

SEQ ID NO: 2650838 - RNA, 16 nt, Escherichia coli CFT073
cuucacggcugcuaau

SEQ ID NO: 2650839 - RNA, 23 nt, Escherichia coli CFT073
cuucacggcugcuaauauuuucg

SEQ ID NO: 2650840 - RNA, 13 nt, Escherichia coli CFT073
cuucacggcuuug

SEQ ID NO: 2650841 - RNA, 23 nt, Escherichia coli CFT073
cuucacggguugcgccuguguuu

SEQ ID NO: 2650842 - RNA, 14 nt, Escherichia coli CFT073
cuucacucucuuuu

SEQ ID NO: 2650843 - RNA, 13 nt, Escherichia coli CFT073
cuucacugaaaau

SEQ ID NO: 2650844 - RNA, 13 nt, Escherichia coli CFT073
cuucacugaaaca

SEQ ID NO: 2650845 - RNA, 11 nt, Escherichia coli CFT073
cuucacugaau

SEQ ID NO: 2650846 - RNA, 14 nt, Escherichia coli CFT073
cuucacugccggac

SEQ ID NO: 2650847 - RNA, 14 nt, Escherichia coli CFT073
cuucacuggcgaca

SEQ ID NO: 2650848 - RNA, 14 nt, Escherichia coli CFT073
cuucacuucagcga

SEQ ID NO: 2650849 - RNA, 20 nt, Escherichia coli CFT073
cuucagacaccguuuccaua

SEQ ID NO: 2650850 - RNA, 23 nt, Escherichia coli CFT073
cuucagacgguccgcgagauaac

SEQ ID NO: 2650851 - RNA, 21 nt, Escherichia coli CFT073
cuucagauuagccgcagguaa

SEQ ID NO: 2650852 - RNA, 15 nt, Escherichia coli CFT073
cuucagauugcacca

SEQ ID NO: 2650853 - RNA, 14 nt, Escherichia coli CFT073
cuucagcaacgugc

SEQ ID NO: 2650854 - RNA, 13 nt, Escherichia coli CFT073
cuucagcaagagu

SEQ ID NO: 2650855 - RNA, 13 nt, Escherichia coli CFT073
cuucagcaaucuc

SEQ ID NO: 2650856 - RNA, 21 nt, Escherichia coli CFT073
cuucagcaaucucuucaagcu

SEQ ID NO: 2650857 - RNA, 14 nt, Escherichia coli CFT073
cuucagcaguucag

SEQ ID NO: 2650858 - RNA, 12 nt, Escherichia coli CFT073
cuucagcaucaa

SEQ ID NO: 2650859 - RNA, 19 nt, Escherichia coli CFT073
cuucagcaucgacauucaa

SEQ ID NO: 2650860 - RNA, 14 nt, Escherichia coli CFT073
cuucagccagugcu

SEQ ID NO: 2650861 - RNA, 23 nt, Escherichia coli CFT073
cuucagccaguuuuucagcgcca

SEQ ID NO: 2650862 - RNA, 20 nt, Escherichia coli CFT073
cuucagcgaaaucacgcacu

SEQ ID NO: 2650863 - RNA, 17 nt, Escherichia coli CFT073
cuucagcgaagcccaca

SEQ ID NO: 2650864 - RNA, 20 nt, Escherichia coli CFT073
cuucagcgaagcccacaccg

SEQ ID NO: 2650865 - RNA, 22 nt, Escherichia coli CFT073
cuucagcguauccagcauaccu

SEQ ID NO: 2650866 - RNA, 15 nt, Escherichia coli CFT073
cuucaggauugguaa

SEQ ID NO: 2650867 - RNA, 21 nt, Escherichia coli CFT073
cuucagggcgcacgcacggcg

SEQ ID NO: 2650868 - RNA, 22 nt, Escherichia coli CFT073
cuucagguaauauugcguaccu

SEQ ID NO: 2650869 - RNA, 19 nt, Escherichia coli CFT073
cuucaguaaauacugcgca

SEQ ID NO: 2650870 - RNA, 16 nt, Escherichia coli CFT073
cuucaguggaaucauc

SEQ ID NO: 2650871 - RNA, 21 nt, Escherichia coli CFT073
cuucaguuucuucaacaggcg

SEQ ID NO: 2650872 - RNA, 16 nt, Escherichia coli CFT073
cuucaguuuugcccgc

SEQ ID NO: 2650873 - RNA, 21 nt, Escherichia coli CFT073
cuucauaacuuugaucgcguu

SEQ ID NO: 2650874 - RNA, 22 nt, Escherichia coli CFT073
cuucauaacuuugaucgcguuu

SEQ ID NO: 2650875 - RNA, 12 nt, Escherichia coli CFT073
cuucauacugcg

SEQ ID NO: 2650876 - RNA, 18 nt, Escherichia coli CFT073
cuucauagauagccagca

SEQ ID NO: 2650877 - RNA, 12 nt, Escherichia coli CFT073
cuucauaggcuu

SEQ ID NO: 2650878 - RNA, 13 nt, Escherichia coli CFT073
cuucauagguaaa

SEQ ID NO: 2650879 - RNA, 15 nt, Escherichia coli CFT073
cuucauagguaaaca

SEQ ID NO: 2650880 - RNA, 18 nt, Escherichia coli CFT073
cuucauagucucgcccac

SEQ ID NO: 2650881 - RNA, 19 nt, Escherichia coli CFT073
cuucauagucucgcccacg

SEQ ID NO: 2650882 - RNA, 16 nt, Escherichia coli CFT073
cuucaucacgcagugu

SEQ ID NO: 2650883 - RNA, 14 nt, Escherichia coli CFT073
cuucauccagcagc

SEQ ID NO: 2650884 - RNA, 18 nt, Escherichia coli CFT073
cuucauccagggugagga

SEQ ID NO: 2650885 - RNA, 22 nt, Escherichia coli CFT073
cuucauccaucggcgcuucaau

SEQ ID NO: 2650886 - RNA, 22 nt, Escherichia coli CFT073
cuuccugacggugauacagcaa

SEQ ID NO: 2650887 - RNA, 21 nt, Escherichia coli CFT073
cuuccugacucacacgcacga

SEQ ID NO: 2650888 - RNA, 20 nt, Escherichia coli CFT073
cuuccugauaaccuuccagc

SEQ ID NO: 2650889 - RNA, 18 nt, Escherichia coli CFT073
cuuccugcaaucuuuccu

SEQ ID NO: 2650890 - RNA, 23 nt, Escherichia coli CFT073
cuuccugcagcgugauccacccu

SEQ ID NO: 2650891 - RNA, 19 nt, Escherichia coli CFT073
cuuccugccagauccagug

SEQ ID NO: 2650892 - RNA, 20 nt, Escherichia coli CFT073
cuuccugccgcaaucuuucc

SEQ ID NO: 2650893 - RNA, 19 nt, Escherichia coli CFT073
cuuccuggggaagugguga

SEQ ID NO: 2650894 - RNA, 14 nt, Escherichia coli CFT073
cuuccugucuuccc

SEQ ID NO: 2650895 - RNA, 15 nt, Escherichia coli CFT073
cuuccugucuucccu

SEQ ID NO: 2650896 - RNA, 16 nt, Escherichia coli CFT073
cuuccuuaagccgcug

SEQ ID NO: 2650897 - RNA, 16 nt, Escherichia coli CFT073
cuuccuucacauccau

SEQ ID NO: 2650898 - RNA, 18 nt, Escherichia coli CFT073
cuuccuucacauccaucg

SEQ ID NO: 2650899 - RNA, 13 nt, Escherichia coli CFT073
cuuccuugcugau

SEQ ID NO: 2650900 - RNA, 22 nt, Escherichia coli CFT073
cuuccuuuagaagcacuaccuu

SEQ ID NO: 2650901 - RNA, 13 nt, Escherichia coli CFT073
cuucgaagaaaaa

SEQ ID NO: 2650902 - RNA, 15 nt, Escherichia coli CFT073
cuucgaaugccgcag

SEQ ID NO: 2650903 - RNA, 21 nt, Escherichia coli CFT073
cuucgacguucuuuaccggau

SEQ ID NO: 2650904 - RNA, 19 nt, Escherichia coli CFT073
cuucgaguacauccacugc

SEQ ID NO: 2650905 - RNA, 19 nt, Escherichia coli CFT073
cuucgauauugacgaucuc

SEQ ID NO: 2650906 - RNA, 14 nt, Escherichia coli CFT073
cuucgauggcuggg

SEQ ID NO: 2650907 - RNA, 16 nt, Escherichia coli CFT073
cuucgaugguuggaau

SEQ ID NO: 2650908 - RNA, 20 nt, Escherichia coli CFT073
cuucgaugguuggaauugaa

SEQ ID NO: 2650909 - RNA, 14 nt, Escherichia coli CFT073
cuucgauucccagc

SEQ ID NO: 2650910 - RNA, 19 nt, Escherichia coli CFT073
cuucgcaaaaaaccauccc

SEQ ID NO: 2650911 - RNA, 14 nt, Escherichia coli CFT073
cuucgcaucccggu

SEQ ID NO: 2650912 - RNA, 17 nt, Escherichia coli CFT073
cuucgcauuuugcagcu

SEQ ID NO: 2650913 - RNA, 22 nt, Escherichia coli CFT073
cuucgccaaauggcaggcacag

SEQ ID NO: 2650914 - RNA, 14 nt, Escherichia coli CFT073
cuucgccaaugacc

SEQ ID NO: 2650915 - RNA, 19 nt, Escherichia coli CFT073
cuucgccaauggcugccgc

SEQ ID NO: 2650916 - RNA, 21 nt, Escherichia coli CFT073
cuucgccaauggcugccgcca

SEQ ID NO: 2650917 - RNA, 12 nt, Escherichia coli CFT073
cuucgccacagc

SEQ ID NO: 2650918 - RNA, 15 nt, Escherichia coli CFT073
cuucgccacagcggc

SEQ ID NO: 2650919 - RNA, 22 nt, Escherichia coli CFT073
cuucgccagacguugauaacca

SEQ ID NO: 2650920 - RNA, 22 nt, Escherichia coli CFT073
cuucgccagcgcgcggcuggca

SEQ ID NO: 2650921 - RNA, 23 nt, Escherichia coli CFT073
cuucgccaggauagaaaacgaca

SEQ ID NO: 2650922 - RNA, 21 nt, Escherichia coli CFT073
cuucgccagguuuuggaauac

SEQ ID NO: 2650923 - RNA, 17 nt, Escherichia coli CFT073
cuucgccauaacaaaua

SEQ ID NO: 2650924 - RNA, 17 nt, Escherichia coli CFT073
cuucgccauuucgucgu

SEQ ID NO: 2650925 - RNA, 20 nt, Escherichia coli CFT073
cuucgcccugcgucgcacuc

SEQ ID NO: 2650926 - RNA, 13 nt, Escherichia coli CFT073
cuucgccgccgcu

SEQ ID NO: 2650927 - RNA, 17 nt, Escherichia coli CFT073
cuucgccggaauuucuu

SEQ ID NO: 2650928 - RNA, 14 nt, Escherichia coli CFT073
cuucgcgcaccaau

SEQ ID NO: 2650929 - RNA, 18 nt, Escherichia coli CFT073
cuucgcggaauuucagaa

SEQ ID NO: 2650930 - RNA, 22 nt, Escherichia coli CFT073
cuucgcggcaaaacagccugcg

SEQ ID NO: 2650931 - RNA, 16 nt, Escherichia coli CFT073
cuucgcuaucaaacug

SEQ ID NO: 2650932 - RNA, 21 nt, Escherichia coli CFT073
cuucgcucucuuucaccagcg

SEQ ID NO: 2650933 - RNA, 19 nt, Escherichia coli CFT073
cuucgcugacgccugccag

SEQ ID NO: 2650934 - RNA, 21 nt, Escherichia coli CFT073
cuucgcugacgccugccagcu

SEQ ID NO: 2650935 - RNA, 15 nt, Escherichia coli CFT073
cuucgcuuaaccggc

SEQ ID NO: 2650936 - RNA, 19 nt, Escherichia coli CFT073
cuucgcuuaaccggcuucg

SEQ ID NO: 2650937 - RNA, 18 nt, Escherichia coli CFT073
cuucgcuuaucaggcauu

SEQ ID NO: 2650938 - RNA, 15 nt, Escherichia coli CFT073
cuucgcuuucaagcu

SEQ ID NO: 2650939 - RNA, 20 nt, Escherichia coli CFT073
cuucggaauaguucuggucu

SEQ ID NO: 2650940 - RNA, 21 nt, Escherichia coli CFT073
cuucggcaauuucagugcuga

SEQ ID NO: 2650941 - RNA, 15 nt, Escherichia coli CFT073
cuucggcgaaaauca

SEQ ID NO: 2650942 - RNA, 22 nt, Escherichia coli CFT073
cuucggcgaaaaucauuuaucu

SEQ ID NO: 2650943 - RNA, 11 nt, Escherichia coli CFT073
cuucgguaaau

SEQ ID NO: 2650944 - RNA, 12 nt, Escherichia coli CFT073
cuucggucagaa

SEQ ID NO: 2650945 - RNA, 19 nt, Escherichia coli CFT073
cuucggugaauuucacuuu

SEQ ID NO: 2650946 - RNA, 14 nt, Escherichia coli CFT073
cuucgucaaagaua

SEQ ID NO: 2650947 - RNA, 13 nt, Escherichia coli CFT073
cuucgucccaguc

SEQ ID NO: 2650948 - RNA, 22 nt, Escherichia coli CFT073
cuucgucccagucgucauccca

SEQ ID NO: 2650949 - RNA, 15 nt, Escherichia coli CFT073
cuucgucgccagcuc

SEQ ID NO: 2650950 - RNA, 14 nt, Escherichia coli CFT073
cuucgucgucuucg

SEQ ID NO: 2650951 - RNA, 16 nt, Escherichia coli CFT073
cuucgucgucuucguc

SEQ ID NO: 2650952 - RNA, 18 nt, Escherichia coli CFT073
cuucgugcggcugcaucu

SEQ ID NO: 2650953 - RNA, 13 nt, Escherichia coli CFT073
cuucguguaauuc

SEQ ID NO: 2650954 - RNA, 22 nt, Escherichia coli CFT073
cuucguuaacgugucauaacug

SEQ ID NO: 2650955 - RNA, 15 nt, Escherichia coli CFT073
cuucguucagccaac

SEQ ID NO: 2650956 - RNA, 16 nt, Escherichia coli CFT073
cuucguuuucugcgcu

SEQ ID NO: 2650957 - RNA, 12 nt, Escherichia coli CFT073
cuucuaaaucgu

SEQ ID NO: 2650958 - RNA, 21 nt, Escherichia coli CFT073
cuucuaauucgacacaacgag

SEQ ID NO: 2650959 - RNA, 21 nt, Escherichia coli CFT073
cuucuaccugaugcuuuuuuc

SEQ ID NO: 2650960 - RNA, 17 nt, Escherichia coli CFT073
cuucuaccuuauccagc

SEQ ID NO: 2650961 - RNA, 16 nt, Escherichia coli CFT073
cuucuacuucacggcu

SEQ ID NO: 2650962 - RNA, 17 nt, Escherichia coli CFT073
cuucuagcaugaugaua

SEQ ID NO: 2650963 - RNA, 22 nt, Escherichia coli CFT073
cuucuaggcuguguucaccaag

SEQ ID NO: 2650964 - RNA, 19 nt, Escherichia coli CFT073
cuucuagugccugcacaac

SEQ ID NO: 2650965 - RNA, 13 nt, Escherichia coli CFT073
cuucucaaucccu

SEQ ID NO: 2650966 - RNA, 15 nt, Escherichia coli CFT073
cuucucaccaucaaa

SEQ ID NO: 2650967 - RNA, 15 nt, Escherichia coli CFT073
cuucucacggaucca

SEQ ID NO: 2650968 - RNA, 19 nt, Escherichia coli CFT073
cuucucacugcccugcaac

SEQ ID NO: 2650969 - RNA, 15 nt, Escherichia coli CFT073
cuucucagauauaaa

SEQ ID NO: 2650970 - RNA, 12 nt, Escherichia coli CFT073
cuucucaucuuu

SEQ ID NO: 2650971 - RNA, 17 nt, Escherichia coli CFT073
cuucuccggccuacaaa

SEQ ID NO: 2650972 - RNA, 14 nt, Escherichia coli CFT073
cuucucgcacuucu

SEQ ID NO: 2650973 - RNA, 22 nt, Escherichia coli CFT073
cuucucgcacuucugaugcagg

SEQ ID NO: 2650974 - RNA, 20 nt, Escherichia coli CFT073
cuucucgucaaucugcucca

SEQ ID NO: 2650975 - RNA, 15 nt, Escherichia coli CFT073
cuucucgugaaauuc

SEQ ID NO: 2650976 - RNA, 18 nt, Escherichia coli CFT073
cuucucuacgcaaagaga

SEQ ID NO: 2650977 - RNA, 16 nt, Escherichia coli CFT073
cuucucugaaaauuaa

SEQ ID NO: 2650978 - RNA, 16 nt, Escherichia coli CFT073
cuucucuuauauuuca

SEQ ID NO: 2650979 - RNA, 14 nt, Escherichia coli CFT073
cuucucuuccccgg

SEQ ID NO: 2650980 - RNA, 15 nt, Escherichia coli CFT073
cuucucuuucccgcg

SEQ ID NO: 2650981 - RNA, 16 nt, Escherichia coli CFT073
cuucugaaucagauca

SEQ ID NO: 2650982 - RNA, 16 nt, Escherichia coli CFT073
cuucugacauagccac

SEQ ID NO: 2650983 - RNA, 15 nt, Escherichia coli CFT073
cuucugaccgggauu

SEQ ID NO: 2650984 - RNA, 16 nt, Escherichia coli CFT073
cuucugaccgggauuu

SEQ ID NO: 2650985 - RNA, 23 nt, Escherichia coli CFT073
cuucugauaaccggauggcgcga

SEQ ID NO: 2650986 - RNA, 17 nt, Escherichia coli CFT073
cuucugccaauuuuucg

SEQ ID NO: 2650987 - RNA, 20 nt, Escherichia coli CFT073
cuucugccacgguaugaccc

SEQ ID NO: 2650988 - RNA, 20 nt, Escherichia coli CFT073
cuucugccgcaauucgcccu

SEQ ID NO: 2650989 - RNA, 16 nt, Escherichia coli CFT073
cuucugcgcuggcaag

SEQ ID NO: 2650990 - RNA, 22 nt, Escherichia coli CFT073
cuucugcuuuacccacgcuuuu

SEQ ID NO: 2650991 - RNA, 19 nt, Escherichia coli CFT073
cuucuggaucaaagucauc

SEQ ID NO: 2650992 - RNA, 15 nt, Escherichia coli CFT073
cuucuggccauugaa

SEQ ID NO: 2650993 - RNA, 16 nt, Escherichia coli CFT073
cuucuggccauugaau

SEQ ID NO: 2650994 - RNA, 14 nt, Escherichia coli CFT073
cuugugcaaugugg

SEQ ID NO: 2650995 - RNA, 16 nt, Escherichia coli CFT073
cuugugcgcuuguuca

SEQ ID NO: 2650996 - RNA, 20 nt, Escherichia coli CFT073
cuuguggcgcaggggcagaa

SEQ ID NO: 2650997 - RNA, 15 nt, Escherichia coli CFT073
cuuguggcucgccau

SEQ ID NO: 2650998 - RNA, 22 nt, Escherichia coli CFT073
cuuguggcucgccauccaguga

SEQ ID NO: 2650999 - RNA, 13 nt, Escherichia coli CFT073
cuuguugaacaga

SEQ ID NO: 2651000 - RNA, 14 nt, Escherichia coli CFT073
cuuguugaacagac

SEQ ID NO: 2651001 - RNA, 14 nt, Escherichia coli CFT073
cuuguuuaaggaaa

SEQ ID NO: 2651002 - RNA, 13 nt, Escherichia coli CFT073
cuuguuucagcac

SEQ ID NO: 2651003 - RNA, 18 nt, Escherichia coli CFT073
cuuguuugaagucaacgc

SEQ ID NO: 2651004 - RNA, 15 nt, Escherichia coli CFT073
cuuguuugcccagaa

SEQ ID NO: 2651005 - RNA, 21 nt, Escherichia coli CFT073
cuuguuugcccagaaucgcca

SEQ ID NO: 2651006 - RNA, 13 nt, Escherichia coli CFT073
cuuguuuuuuucg

SEQ ID NO: 2651007 - RNA, 14 nt, Escherichia coli CFT073
cuuuaaacacgauu

SEQ ID NO: 2651008 - RNA, 11 nt, Escherichia coli CFT073
cuuuaaacaga

SEQ ID NO: 2651009 - RNA, 20 nt, Escherichia coli CFT073
cuuuaaagcguuccagcagc

SEQ ID NO: 2651010 - RNA, 13 nt, Escherichia coli CFT073
cuuuaaaggccag

SEQ ID NO: 2651011 - RNA, 17 nt, Escherichia coli CFT073
cuuuaaauugcguaaag

SEQ ID NO: 2651012 - RNA, 20 nt, Escherichia coli CFT073
cuuuaaccccagaggcgaua

SEQ ID NO: 2651013 - RNA, 16 nt, Escherichia coli CFT073
cuuuaacggccugacc

SEQ ID NO: 2651014 - RNA, 22 nt, Escherichia coli CFT073
cuuuaacugccgcacauuuccc

SEQ ID NO: 2651015 - RNA, 19 nt, Escherichia coli CFT073
cuuuaagaauagccugguu

SEQ ID NO: 2651016 - RNA, 23 nt, Escherichia coli CFT073
cuuuaaguucagccaguugaucu

SEQ ID NO: 2651017 - RNA, 18 nt, Escherichia coli CFT073
cuuuaauagauaauuuug

SEQ ID NO: 2651018 - RNA, 20 nt, Escherichia coli CFT073
cuuuaaucuuagacaucaaa

SEQ ID NO: 2651019 - RNA, 22 nt, Escherichia coli CFT073
cuuuaaugacugaacgugaaau

SEQ ID NO: 2651020 - RNA, 21 nt, Escherichia coli CFT073
cuuuaauuaaucaucaugcuu

SEQ ID NO: 2651021 - RNA, 12 nt, Escherichia coli CFT073
cuuuaauuucau

SEQ ID NO: 2651022 - RNA, 19 nt, Escherichia coli CFT073
cuuuaauuuugugcagcac

SEQ ID NO: 2651023 - RNA, 20 nt, Escherichia coli CFT073
cuuuaauuuugugcagcaca

SEQ ID NO: 2651024 - RNA, 15 nt, Escherichia coli CFT073
cuuuacaggcgugau

SEQ ID NO: 2651025 - RNA, 23 nt, Escherichia coli CFT073
cuuuaccaccgucaauaaaaacg

SEQ ID NO: 2651026 - RNA, 13 nt, Escherichia coli CFT073
cuuuaccagacgg

SEQ ID NO: 2651027 - RNA, 19 nt, Escherichia coli CFT073
cuuuacccacgcuuuucau

SEQ ID NO: 2651028 - RNA, 14 nt, Escherichia coli CFT073
cuuuacccagcgga

SEQ ID NO: 2651029 - RNA, 17 nt, Escherichia coli CFT073
cuuuacccagcggaugu

SEQ ID NO: 2651030 - RNA, 19 nt, Escherichia coli CFT073
cuuuacccggccacagaau

SEQ ID NO: 2651031 - RNA, 17 nt, Escherichia coli CFT073
cuuuacgcgucuuauca

SEQ ID NO: 2651032 - RNA, 16 nt, Escherichia coli CFT073
cuuuacuaaaaaguga

SEQ ID NO: 2651033 - RNA, 22 nt, Escherichia coli CFT073
cuuuacuaauagcaaaauauaa

SEQ ID NO: 2651034 - RNA, 13 nt, Escherichia coli CFT073
cuuuacucauccc

SEQ ID NO: 2651035 - RNA, 22 nt, Escherichia coli CFT073
cuuuacuccuaauggagaaacg

SEQ ID NO: 2651036 - RNA, 23 nt, Escherichia coli CFT073
cuuuacuguuccgauaaguucag

SEQ ID NO: 2651037 - RNA, 14 nt, Escherichia coli CFT073
cuuuagcaguucuu

SEQ ID NO: 2651038 - RNA, 17 nt, Escherichia coli CFT073
cuuuagucguugccgga

SEQ ID NO: 2651039 - RNA, 20 nt, Escherichia coli CFT073
cuuuauaaauugcaauuuuu

SEQ ID NO: 2651040 - RNA, 15 nt, Escherichia coli CFT073
cuuuauaacugucuu

SEQ ID NO: 2651041 - RNA, 20 nt, Escherichia coli CFT073
cuuuauagugugcaaucacu

SEQ ID NO: 2651042 - RNA, 13 nt, Escherichia coli CFT073
cuuuaucaagcac

SEQ ID NO: 2651043 - RNA, 15 nt, Escherichia coli CFT073
cuuuaucaagcacca

SEQ ID NO: 2651044 - RNA, 17 nt, Escherichia coli CFT073
cuuuaucaagcaccaac

SEQ ID NO: 2651045 - RNA, 15 nt, Escherichia coli CFT073
cuuuaucaaucagcc

SEQ ID NO: 2651046 - RNA, 18 nt, Escherichia coli CFT073
cuuuauccagcagccaga

SEQ ID NO: 2651047 - RNA, 19 nt, Escherichia coli CFT073
cuuuaucgacauaaaucau

SEQ ID NO: 2651048 - RNA, 19 nt, Escherichia coli CFT073
cuuuaucggcacccaucgc

SEQ ID NO: 2651049 - RNA, 23 nt, Escherichia coli CFT073
cuuuaucggcacccaucgccagc

SEQ ID NO: 2651050 - RNA, 18 nt, Escherichia coli CFT073
cuuuaucgucgcuggaaa

SEQ ID NO: 2651051 - RNA, 18 nt, Escherichia coli CFT073
cuuuaucugccagccagu

SEQ ID NO: 2651052 - RNA, 13 nt, Escherichia coli CFT073
cuuuaucugcccu

SEQ ID NO: 2651053 - RNA, 14 nt, Escherichia coli CFT073
cuuuaucuuucagu

SEQ ID NO: 2651054 - RNA, 15 nt, Escherichia coli CFT073
cuuuaugcgaugaaa

SEQ ID NO: 2651055 - RNA, 16 nt, Escherichia coli CFT073
cuuuauguaauccugu

SEQ ID NO: 2651056 - RNA, 16 nt, Escherichia coli CFT073
cuuuauuaacaagcga

SEQ ID NO: 2651057 - RNA, 15 nt, Escherichia coli CFT073
cuuuauucaccagua

SEQ ID NO: 2651058 - RNA, 16 nt, Escherichia coli CFT073
cuuuauucauaaucaa

SEQ ID NO: 2651059 - RNA, 18 nt, Escherichia coli CFT073
cuuuauuggguugcagua

SEQ ID NO: 2651060 - RNA, 19 nt, Escherichia coli CFT073
cuuuauuugauucgcccgc

SEQ ID NO: 2651061 - RNA, 18 nt, Escherichia coli CFT073
cuuuauuuuccagauucu

SEQ ID NO: 2651062 - RNA, 20 nt, Escherichia coli CFT073
cuuucaaagagagcagucca

SEQ ID NO: 2651063 - RNA, 13 nt, Escherichia coli CFT073
cuuucaacaaccu

SEQ ID NO: 2651064 - RNA, 15 nt, Escherichia coli CFT073
cuuucaaugccugau

SEQ ID NO: 2651065 - RNA, 21 nt, Escherichia coli CFT073
cuuucaaugcuuuuugcauuu

SEQ ID NO: 2651066 - RNA, 16 nt, Escherichia coli CFT073
cuuucaauuccuggaa

SEQ ID NO: 2651067 - RNA, 22 nt, Escherichia coli CFT073
cuuucacaucagaacagcccca

SEQ ID NO: 2651068 - RNA, 20 nt, Escherichia coli CFT073
cuuucacauugaugaaguca

SEQ ID NO: 2651069 - RNA, 22 nt, Escherichia coli CFT073
cuuucaccagaauagcggcuuc

SEQ ID NO: 2651070 - RNA, 23 nt, Escherichia coli CFT073
cuuucaccagaauagcggcuuca

SEQ ID NO: 2651071 - RNA, 23 nt, Escherichia coli CFT073
cuuucaccagcgccugcgcggca

SEQ ID NO: 2651072 - RNA, 22 nt, Escherichia coli CFT073
cuuucacccggaucaauuaauc

SEQ ID NO: 2651073 - RNA, 16 nt, Escherichia coli CFT073
cuuucaccucuucauu

SEQ ID NO: 2651074 - RNA, 17 nt, Escherichia coli CFT073
cuuucacgcccaguccg

SEQ ID NO: 2651075 - RNA, 15 nt, Escherichia coli CFT073
cuuucacgccgccaa

SEQ ID NO: 2651076 - RNA, 20 nt, Escherichia coli CFT073
cuuucacgccgggaaauuuu

SEQ ID NO: 2651077 - RNA, 16 nt, Escherichia coli CFT073
cuuucacgcgcugacc

SEQ ID NO: 2651078 - RNA, 18 nt, Escherichia coli CFT073
cuuucacucaguguugga

SEQ ID NO: 2651079 - RNA, 22 nt, Escherichia coli CFT073
cuuucacuccauugucuuuucg

SEQ ID NO: 2651080 - RNA, 21 nt, Escherichia coli CFT073
cuuucacuuuugccagacgaa

SEQ ID NO: 2651081 - RNA, 20 nt, Escherichia coli CFT073
cuuucagaguuguaccaccc

SEQ ID NO: 2651082 - RNA, 21 nt, Escherichia coli CFT073
cuuucagaguuguaccacccu

SEQ ID NO: 2651083 - RNA, 20 nt, Escherichia coli CFT073
cuuucagaugcaccugcguu

SEQ ID NO: 2651084 - RNA, 15 nt, Escherichia coli CFT073
cuuucagcaaaccac

SEQ ID NO: 2651085 - RNA, 22 nt, Escherichia coli CFT073
cuuucagcaccagcccgacgau

SEQ ID NO: 2651086 - RNA, 21 nt, Escherichia coli CFT073
cuuucagcaguucagucagca

SEQ ID NO: 2651087 - RNA, 17 nt, Escherichia coli CFT073
cuuucagccacuucauu

SEQ ID NO: 2651088 - RNA, 19 nt, Escherichia coli CFT073
cuuucagccacuucauuua

SEQ ID NO: 2651089 - RNA, 23 nt, Escherichia coli CFT073
cuuucagcccaccuugcgggcag

SEQ ID NO: 2651090 - RNA, 19 nt, Escherichia coli CFT073
cuuucagcgccagaaaggu

SEQ ID NO: 2651091 - RNA, 17 nt, Escherichia coli CFT073
cuuucagcgucugcgcu

SEQ ID NO: 2651092 - RNA, 21 nt, Escherichia coli CFT073
cuuucaggaacagcgacagau

SEQ ID NO: 2651093 - RNA, 14 nt, Escherichia coli CFT073
cuuucaggcgugaa

SEQ ID NO: 2651094 - RNA, 22 nt, Escherichia coli CFT073
cuuucaguggcuuaucuuccug

SEQ ID NO: 2651095 - RNA, 16 nt, Escherichia coli CFT073
cuuucaguucaacggu

SEQ ID NO: 2651096 - RNA, 14 nt, Escherichia coli CFT073
cuuucauacugccg

SEQ ID NO: 2651097 - RNA, 19 nt, Escherichia coli CFT073
cuuucauuucgucgaacuc

SEQ ID NO: 2651098 - RNA, 17 nt, Escherichia coli CFT073
cuuucauuuucggcagu

SEQ ID NO: 2651099 - RNA, 17 nt, Escherichia coli CFT073
cuuuccaccugcaacgu

SEQ ID NO: 2651100 - RNA, 21 nt, Escherichia coli CFT073
cuuuccagagagacauuggca

SEQ ID NO: 2651101 - RNA, 15 nt, Escherichia coli CFT073
cuuuccagccacagu

SEQ ID NO: 2651102 - RNA, 13 nt, Escherichia coli CFT073
cuuuucaccagcg

SEQ ID NO: 2651103 - RNA, 13 nt, Escherichia coli CFT073
cuuuucaccuuca

SEQ ID NO: 2651104 - RNA, 17 nt, Escherichia coli CFT073
cuuuuccacucacacag

SEQ ID NO: 2651105 - RNA, 13 nt, Escherichia coli CFT073
cuuuuccauauca

SEQ ID NO: 2651106 - RNA, 18 nt, Escherichia coli CFT073
cuuuucccgauauaacca

SEQ ID NO: 2651107 - RNA, 15 nt, Escherichia coli CFT073
cuuuuccucauuuaa

SEQ ID NO: 2651108 - RNA, 20 nt, Escherichia coli CFT073
cuuuucgcauguaacugccu

SEQ ID NO: 2651109 - RNA, 21 nt, Escherichia coli CFT073
cuuuucgcauguaacugccuu

SEQ ID NO: 2651110 - RNA, 17 nt, Escherichia coli CFT073
cuuuucgcgucaaucac

SEQ ID NO: 2651111 - RNA, 15 nt, Escherichia coli CFT073
cuuuucgcuuccggu

SEQ ID NO: 2651112 - RNA, 23 nt, Escherichia coli CFT073
cuuuucggcaugaaucauggcgu

SEQ ID NO: 2651113 - RNA, 18 nt, Escherichia coli CFT073
cuuuugaaggaauuaauc

SEQ ID NO: 2651114 - RNA, 21 nt, Escherichia coli CFT073
cuuuugccagcaguugcugac

SEQ ID NO: 2651115 - RNA, 15 nt, Escherichia coli CFT073
cuuuugccuguugca

SEQ ID NO: 2651116 - RNA, 20 nt, Escherichia coli CFT073
cuuuugcuaaggucaccagu

SEQ ID NO: 2651117 - RNA, 23 nt, Escherichia coli CFT073
cuuuuggcgcguucccuuguugu

SEQ ID NO: 2651118 - RNA, 22 nt, Escherichia coli CFT073
cuuuugucgcuuuaacgcccug

SEQ ID NO: 2651119 - RNA, 16 nt, Escherichia coli CFT073
cuuuuuaauuugccag

SEQ ID NO: 2651120 - RNA, 16 nt, Escherichia coli CFT073
cuuuuuaccguaacag

SEQ ID NO: 2651121 - RNA, 13 nt, Escherichia coli CFT073
cuuuuuacugccg

SEQ ID NO: 2651122 - RNA, 13 nt, Escherichia coli CFT073
cuuuuucaaucca

SEQ ID NO: 2651123 - RNA, 18 nt, Escherichia coli CFT073
cuuuuucaguuugcugac

SEQ ID NO: 2651124 - RNA, 22 nt, Escherichia coli CFT073
cuuuuucaucagguuggaucaa

SEQ ID NO: 2651125 - RNA, 13 nt, Escherichia coli CFT073
cuuuuucaugcua

SEQ ID NO: 2651126 - RNA, 21 nt, Escherichia coli CFT073
cuuuuucaugcuauuccuuga

SEQ ID NO: 2651127 - RNA, 19 nt, Escherichia coli CFT073
cuuuuuccgggccaaaaac

SEQ ID NO: 2651128 - RNA, 12 nt, Escherichia coli CFT073
cuuuuuccugcc

SEQ ID NO: 2651129 - RNA, 20 nt, Escherichia coli CFT073
cuuuuucgacuuccaccagc

SEQ ID NO: 2651130 - RNA, 15 nt, Escherichia coli CFT073
cuuuuucggaaagcc

SEQ ID NO: 2651131 - RNA, 21 nt, Escherichia coli CFT073
cuuuuucggaaagcccacccc

SEQ ID NO: 2651132 - RNA, 14 nt, Escherichia coli CFT073
cuuuuucucugauc

SEQ ID NO: 2651133 - RNA, 15 nt, Escherichia coli CFT073
cuuuuucugaagacg

SEQ ID NO: 2651134 - RNA, 21 nt, Escherichia coli CFT073
cuuuuucugccugaucuuucu

SEQ ID NO: 2651135 - RNA, 16 nt, Escherichia coli CFT073
cuuuuucuucacccgu

SEQ ID NO: 2651136 - RNA, 20 nt, Escherichia coli CFT073
cuuuuugaacgaguugcggu

SEQ ID NO: 2651137 - RNA, 21 nt, Escherichia coli CFT073
cuuuuugauaaguacauuaaa

SEQ ID NO: 2651138 - RNA, 13 nt, Escherichia coli CFT073
cuuuuugcauaau

SEQ ID NO: 2651139 - RNA, 12 nt, Escherichia coli CFT073
cuuuuugcucuc

SEQ ID NO: 2651140 - RNA, 19 nt, Escherichia coli CFT073
cuuuuugugggccugauaa

SEQ ID NO: 2651141 - RNA, 21 nt, Escherichia coli CFT073
cuuuuugugggccugauaaga

SEQ ID NO: 2651142 - RNA, 17 nt, Escherichia coli CFT073
cuuuuuuaagauccagu

SEQ ID NO: 2651143 - RNA, 18 nt, Escherichia coli CFT073
cuuuuuuaauauuucauu

SEQ ID NO: 2651144 - RNA, 20 nt, Escherichia coli CFT073
cuuuuuuacgccugcaauuu

SEQ ID NO: 2651145 - RNA, 15 nt, Escherichia coli CFT073
cuuuuuuauuucauc

SEQ ID NO: 2651146 - RNA, 19 nt, Escherichia coli CFT073
cuuuuuucagccguaucca

SEQ ID NO: 2651147 - RNA, 14 nt, Escherichia coli CFT073
cuuuuuucauuucc

SEQ ID NO: 2651148 - RNA, 16 nt, Escherichia coli CFT073
cuuuuuucccaauaau

SEQ ID NO: 2651149 - RNA, 20 nt, Escherichia coli CFT073
cuuuuuuguucuguaaucca

SEQ ID NO: 2651150 - RNA, 21 nt, Escherichia coli CFT073
cuuuuuuuacggguaaugacg

SEQ ID NO: 2651151 - RNA, 15 nt, Escherichia coli CFT073
cuuuuuuucauugga

SEQ ID NO: 2651152 - RNA, 13 nt, Escherichia coli CFT073
gaaaaaacacaaa

SEQ ID NO: 2651153 - RNA, 13 nt, Escherichia coli CFT073
gaaaaaaccagaa

SEQ ID NO: 2651154 - RNA, 21 nt, Escherichia coli CFT073
gaaaaaagcaagauuaaaaua

SEQ ID NO: 2651155 - RNA, 16 nt, Escherichia coli CFT073
gaaaaaauuuuaucca

SEQ ID NO: 2651156 - RNA, 18 nt, Escherichia coli CFT073
gaaaaaccaaucucccag

SEQ ID NO: 2651157 - RNA, 15 nt, Escherichia coli CFT073
gaaaaaccugacgcu

SEQ ID NO: 2651158 - RNA, 20 nt, Escherichia coli CFT073
gaaaaaccugacgcugcuca

SEQ ID NO: 2651159 - RNA, 14 nt, Escherichia coli CFT073
gaaaaacggaauga

SEQ ID NO: 2651160 - RNA, 18 nt, Escherichia coli CFT073
gaaaaacgggucgccaga

SEQ ID NO: 2651161 - RNA, 21 nt, Escherichia coli CFT073
gaaaaacguuucaaacaggcu

SEQ ID NO: 2651162 - RNA, 22 nt, Escherichia coli CFT073
gaaaaauaaaagcgugaaacaa

SEQ ID NO: 2651163 - RNA, 14 nt, Escherichia coli CFT073
gaaaaaucaaaaac

SEQ ID NO: 2651164 - RNA, 15 nt, Escherichia coli CFT073
gaaaaaucuccagcg

SEQ ID NO: 2651165 - RNA, 20 nt, Escherichia coli CFT073
gaaaaaugguuugcccugcc

SEQ ID NO: 2651166 - RNA, 20 nt, Escherichia coli CFT073
gaaaacaauuacgccgagcg

SEQ ID NO: 2651167 - RNA, 15 nt, Escherichia coli CFT073
gaaaacaucaaaagg

SEQ ID NO: 2651168 - RNA, 16 nt, Escherichia coli CFT073
gaaaacaucaugguuu

SEQ ID NO: 2651169 - RNA, 20 nt, Escherichia coli CFT073
gaaaaccauaaugaugccga

SEQ ID NO: 2651170 - RNA, 16 nt, Escherichia coli CFT073
gaaaaccuggcgcagu

SEQ ID NO: 2651171 - RNA, 14 nt, Escherichia coli CFT073
gaaaacgaauugca

SEQ ID NO: 2651172 - RNA, 16 nt, Escherichia coli CFT073
gaaaacgccuuucagc

SEQ ID NO: 2651173 - RNA, 13 nt, Escherichia coli CFT073
gaaaacgcuauuu

SEQ ID NO: 2651174 - RNA, 11 nt, Escherichia coli CFT073
gaaaacgcugu

SEQ ID NO: 2651175 - RNA, 21 nt, Escherichia coli CFT073
gaaaacgucgguuacaccgcg

SEQ ID NO: 2651176 - RNA, 20 nt, Escherichia coli CFT073
gaaaacguugggcgaauucc

SEQ ID NO: 2651177 - RNA, 20 nt, Escherichia coli CFT073
gaaaacuaucugaaaaugaa

SEQ ID NO: 2651178 - RNA, 13 nt, Escherichia coli CFT073
gaaaagaaauauc

SEQ ID NO: 2651179 - RNA, 14 nt, Escherichia coli CFT073
gaaaagaccagcca

SEQ ID NO: 2651180 - RNA, 14 nt, Escherichia coli CFT073
gaaaagaguucauc

SEQ ID NO: 2651181 - RNA, 14 nt, Escherichia coli CFT073
gaaaagcaacaacc

SEQ ID NO: 2651182 - RNA, 18 nt, Escherichia coli CFT073
gaaaagcaguggcacuaa

SEQ ID NO: 2651183 - RNA, 19 nt, Escherichia coli CFT073
gaaaagcgagaguuacagc

SEQ ID NO: 2651184 - RNA, 16 nt, Escherichia coli CFT073
gaaaagcuucuuccuc

SEQ ID NO: 2651185 - RNA, 21 nt, Escherichia coli CFT073
gaaaagguuaaaccgccaguc

SEQ ID NO: 2651186 - RNA, 18 nt, Escherichia coli CFT073
gaaaagugcuguaaagca

SEQ ID NO: 2651187 - RNA, 17 nt, Escherichia coli CFT073
gaaaauaaaucaaaguc

SEQ ID NO: 2651188 - RNA, 20 nt, Escherichia coli CFT073
gaaaauaacguaguguaaau

SEQ ID NO: 2651189 - RNA, 18 nt, Escherichia coli CFT073
gaaaauaauccgcuguaa

SEQ ID NO: 2651190 - RNA, 12 nt, Escherichia coli CFT073
gaaaauaauccu

SEQ ID NO: 2651191 - RNA, 16 nt, Escherichia coli CFT073
gaaaauacacgcugca

SEQ ID NO: 2651192 - RNA, 19 nt, Escherichia coli CFT073
gaaaauacagcaauggaaa

SEQ ID NO: 2651193 - RNA, 17 nt, Escherichia coli CFT073
gaaaauacucagcaccc

SEQ ID NO: 2651194 - RNA, 12 nt, Escherichia coli CFT073
gaaaauaucggu

SEQ ID NO: 2651195 - RNA, 15 nt, Escherichia coli CFT073
gaaaaucauuuaucu

SEQ ID NO: 2651196 - RNA, 22 nt, Escherichia coli CFT073
gaaaauccaucccaaugcggcg

SEQ ID NO: 2651197 - RNA, 20 nt, Escherichia coli CFT073
gaaaaucgccggaugcggca

SEQ ID NO: 2651198 - RNA, 17 nt, Escherichia coli CFT073
gaaaaucgggcgacagc

SEQ ID NO: 2651199 - RNA, 21 nt, Escherichia coli CFT073
gaaaaucgggcgacagcugcg

SEQ ID NO: 2651200 - RNA, 21 nt, Escherichia coli CFT073
gaaaaucucaauguauucccg

SEQ ID NO: 2651201 - RNA, 18 nt, Escherichia coli CFT073
gaaaaucuggcgcgcgga

SEQ ID NO: 2651202 - RNA, 15 nt, Escherichia coli CFT073
gaaaaugagcguaua

SEQ ID NO: 2651203 - RNA, 15 nt, Escherichia coli CFT073
gaaaaugcauucuua

SEQ ID NO: 2651204 - RNA, 17 nt, Escherichia coli CFT073
gaaaaugccacugcgcc

SEQ ID NO: 2651205 - RNA, 21 nt, Escherichia coli CFT073
gaaaaugccucuugucucguu

SEQ ID NO: 2651206 - RNA, 15 nt, Escherichia coli CFT073
gaaaaugcuuuccag

SEQ ID NO: 2651207 - RNA, 18 nt, Escherichia coli CFT073
gaaaaugcuuuccagaga

SEQ ID NO: 2651208 - RNA, 22 nt, Escherichia coli CFT073
gaaaaugcuuuccagagagaca

SEQ ID NO: 2651209 - RNA, 18 nt, Escherichia coli CFT073
gaaaaugguuugccagca

SEQ ID NO: 2651210 - RNA, 18 nt, Escherichia coli CFT073
gaaauacaaguccccgcu

SEQ ID NO: 2651211 - RNA, 17 nt, Escherichia coli CFT073
gaaauaccacucagcuu

SEQ ID NO: 2651212 - RNA, 21 nt, Escherichia coli CFT073
gaaauaccacucagcuuaaga

SEQ ID NO: 2651213 - RNA, 15 nt, Escherichia coli CFT073
gaaauaccccgccag

SEQ ID NO: 2651214 - RNA, 17 nt, Escherichia coli CFT073
gaaauaccccgccagca

SEQ ID NO: 2651215 - RNA, 16 nt, Escherichia coli CFT073
gaaauacuaaauauga

SEQ ID NO: 2651216 - RNA, 18 nt, Escherichia coli CFT073
gaaauacuaaauaugaaa

SEQ ID NO: 2651217 - RNA, 20 nt, Escherichia coli CFT073
gaaauacuguuuaccggugc

SEQ ID NO: 2651218 - RNA, 14 nt, Escherichia coli CFT073
gaaauagcccacua

SEQ ID NO: 2651219 - RNA, 14 nt, Escherichia coli CFT073
gaaauagccgaaaa

SEQ ID NO: 2651220 - RNA, 18 nt, Escherichia coli CFT073
gaaauagccgaaaacgcu

SEQ ID NO: 2651221 - RNA, 15 nt, Escherichia coli CFT073
gaaauagcggguuug

SEQ ID NO: 2651222 - RNA, 15 nt, Escherichia coli CFT073
gaaauaucagcagca

SEQ ID NO: 2651223 - RNA, 22 nt, Escherichia coli CFT073
gaaauaucgccuggggcuuuug

SEQ ID NO: 2651224 - RNA, 20 nt, Escherichia coli CFT073
gaaauaucggcgucguugua

SEQ ID NO: 2651225 - RNA, 15 nt, Escherichia coli CFT073
gaaauauuaucuaac

SEQ ID NO: 2651226 - RNA, 11 nt, Escherichia coli CFT073
gaaauauugcu

SEQ ID NO: 2651227 - RNA, 16 nt, Escherichia coli CFT073
gaaauauuuuaaaauu

SEQ ID NO: 2651228 - RNA, 22 nt, Escherichia coli CFT073
gaaaucaacauguuccugccag

SEQ ID NO: 2651229 - RNA, 13 nt, Escherichia coli CFT073
gaaaucaacggcg

SEQ ID NO: 2651230 - RNA, 19 nt, Escherichia coli CFT073
gaaaucaacggcgucagcc

SEQ ID NO: 2651231 - RNA, 13 nt, Escherichia coli CFT073
gaaaucaaugcca

SEQ ID NO: 2651232 - RNA, 11 nt, Escherichia coli CFT073
gaaaucaccac

SEQ ID NO: 2651233 - RNA, 12 nt, Escherichia coli CFT073
gaaaucaccacc

SEQ ID NO: 2651234 - RNA, 16 nt, Escherichia coli CFT073
gaaaucaccaccagca

SEQ ID NO: 2651235 - RNA, 21 nt, Escherichia coli CFT073
gaaaucaccaccagcaccgcg

SEQ ID NO: 2651236 - RNA, 16 nt, Escherichia coli CFT073
gaaaucaccaccgcaa

SEQ ID NO: 2651237 - RNA, 22 nt, Escherichia coli CFT073
gaaaucagagauuugcuccagc

SEQ ID NO: 2651238 - RNA, 13 nt, Escherichia coli CFT073
gaaaucagcagcu

SEQ ID NO: 2651239 - RNA, 20 nt, Escherichia coli CFT073
gaaaucagccguuucaccac

SEQ ID NO: 2651240 - RNA, 17 nt, Escherichia coli CFT073
gaaaucagcgagauaau

SEQ ID NO: 2651241 - RNA, 19 nt, Escherichia coli CFT073
gaaaucauucgcagcugca

SEQ ID NO: 2651242 - RNA, 21 nt, Escherichia coli CFT073
gaaaucauucgcagcugcagu

SEQ ID NO: 2651243 - RNA, 22 nt, Escherichia coli CFT073
gaaauccggcaccugucagacu

SEQ ID NO: 2651244 - RNA, 17 nt, Escherichia coli CFT073
gaaauccucaaccggug

SEQ ID NO: 2651245 - RNA, 19 nt, Escherichia coli CFT073
gaaaucgacauugaugaaa

SEQ ID NO: 2651246 - RNA, 21 nt, Escherichia coli CFT073
gaaaucggggucaucuuuaac

SEQ ID NO: 2651247 - RNA, 14 nt, Escherichia coli CFT073
gaaaucuccagaua

SEQ ID NO: 2651248 - RNA, 20 nt, Escherichia coli CFT073
gaaaucucuuccagcgacac

SEQ ID NO: 2651249 - RNA, 13 nt, Escherichia coli CFT073
gaaaucuuccagu

SEQ ID NO: 2651250 - RNA, 14 nt, Escherichia coli CFT073
gaaaucuuccagug

SEQ ID NO: 2651251 - RNA, 19 nt, Escherichia coli CFT073
gaaaucuuccaguggcauu

SEQ ID NO: 2651252 - RNA, 23 nt, Escherichia coli CFT073
gaaaucuuccaguggcauuuucu

SEQ ID NO: 2651253 - RNA, 21 nt, Escherichia coli CFT073
gaaaucuuguuuuuuucgagu

SEQ ID NO: 2651254 - RNA, 22 nt, Escherichia coli CFT073
gaaaugaauaaucugaaaacca

SEQ ID NO: 2651255 - RNA, 19 nt, Escherichia coli CFT073
gaaaugacgcuuuauucau

SEQ ID NO: 2651256 - RNA, 18 nt, Escherichia coli CFT073
gaaaugauguuugcgaca

SEQ ID NO: 2651257 - RNA, 15 nt, Escherichia coli CFT073
gaaaugccaguaacu

SEQ ID NO: 2651258 - RNA, 10 nt, Escherichia coli CFT073
gaaauggcug

SEQ ID NO: 2651259 - RNA, 19 nt, Escherichia coli CFT073
gaaauggcuggcagcagac

SEQ ID NO: 2651260 - RNA, 13 nt, Escherichia coli CFT073
gaaauggcugguc

SEQ ID NO: 2651261 - RNA, 15 nt, Escherichia coli CFT073
gaaauggcuggucag

SEQ ID NO: 2651262 - RNA, 17 nt, Escherichia coli CFT073
gaaauguaaaaguugca

SEQ ID NO: 2651263 - RNA, 15 nt, Escherichia coli CFT073
gaaauguaggguuac

SEQ ID NO: 2651264 - RNA, 19 nt, Escherichia coli CFT073
gaaaugucaaacaguucac

SEQ ID NO: 2651265 - RNA, 23 nt, Escherichia coli CFT073
gaaaugucauuacgaucaagaau

SEQ ID NO: 2651266 - RNA, 20 nt, Escherichia coli CFT073
gaaauguugguuucgugcau

SEQ ID NO: 2651267 - RNA, 21 nt, Escherichia coli CFT073
gaaauuaccgcaccaccagca

SEQ ID NO: 2651268 - RNA, 20 nt, Escherichia coli CFT073
gaaauuacgauguguggcau

SEQ ID NO: 2651269 - RNA, 16 nt, Escherichia coli CFT073
gaaauuagcgucacca

SEQ ID NO: 2651270 - RNA, 15 nt, Escherichia coli CFT073
gaaauuccagcggca

SEQ ID NO: 2651271 - RNA, 18 nt, Escherichia coli CFT073
gaaauuccagcggcagga

SEQ ID NO: 2651272 - RNA, 16 nt, Escherichia coli CFT073
gaaauuguaggccuga

SEQ ID NO: 2651273 - RNA, 18 nt, Escherichia coli CFT073
gaaauugugauaaaaauc

SEQ ID NO: 2651274 - RNA, 16 nt, Escherichia coli CFT073
gaaauuuaguauuuua

SEQ ID NO: 2651275 - RNA, 23 nt, Escherichia coli CFT073
gaaauuuaucuacuacccagcaa

SEQ ID NO: 2651276 - RNA, 15 nt, Escherichia coli CFT073
gaaauuucccaccga

SEQ ID NO: 2651277 - RNA, 18 nt, Escherichia coli CFT073
gaaauuugcauaaaaauu

SEQ ID NO: 2651278 - RNA, 19 nt, Escherichia coli CFT073
gaacaaaacauacuuucuc

SEQ ID NO: 2651279 - RNA, 19 nt, Escherichia coli CFT073
gaacaaaugaaagcagcag

SEQ ID NO: 2651280 - RNA, 19 nt, Escherichia coli CFT073
gaacaaccaagacuauuaa

SEQ ID NO: 2651281 - RNA, 13 nt, Escherichia coli CFT073
gaacaagcaagag

SEQ ID NO: 2651282 - RNA, 18 nt, Escherichia coli CFT073
gaacaaucugguuuuugg

SEQ ID NO: 2651283 - RNA, 21 nt, Escherichia coli CFT073
gaacaaucuugcaaaggcugu

SEQ ID NO: 2651284 - RNA, 13 nt, Escherichia coli CFT073
gaacaauuaauac

SEQ ID NO: 2651285 - RNA, 14 nt, Escherichia coli CFT073
gaacaauuucagca

SEQ ID NO: 2651286 - RNA, 22 nt, Escherichia coli CFT073
gaacacaacguacaccgcagcc

SEQ ID NO: 2651287 - RNA, 19 nt, Escherichia coli CFT073
gaacacauaccuggucuga

SEQ ID NO: 2651288 - RNA, 17 nt, Escherichia coli CFT073
gaacacauuugucggau

SEQ ID NO: 2651289 - RNA, 20 nt, Escherichia coli CFT073
gaacacauuugucggaugcg

SEQ ID NO: 2651290 - RNA, 23 nt, Escherichia coli CFT073
gaacacauuugucggaugcggcg

SEQ ID NO: 2651291 - RNA, 19 nt, Escherichia coli CFT073
gaacaccagaaccagcaac

SEQ ID NO: 2651292 - RNA, 12 nt, Escherichia coli CFT073
gaacaccagcag

SEQ ID NO: 2651293 - RNA, 16 nt, Escherichia coli CFT073
gaacaccagcaguaaa

SEQ ID NO: 2651294 - RNA, 13 nt, Escherichia coli CFT073
gaacaccauaaug

SEQ ID NO: 2651295 - RNA, 13 nt, Escherichia coli CFT073
gaacacccagaau

SEQ ID NO: 2651296 - RNA, 15 nt, Escherichia coli CFT073
gaacaccggcagcgg

SEQ ID NO: 2651297 - RNA, 19 nt, Escherichia coli CFT073
gaacaccgguauucuccug

SEQ ID NO: 2651298 - RNA, 17 nt, Escherichia coli CFT073
gaacaccuuauccggcc

SEQ ID NO: 2651299 - RNA, 14 nt, Escherichia coli CFT073
gaacacgaccugcc

SEQ ID NO: 2651300 - RNA, 17 nt, Escherichia coli CFT073
gaacacgaccugccaga

SEQ ID NO: 2651301 - RNA, 20 nt, Escherichia coli CFT073
gaacacgcaacaccagcagu

SEQ ID NO: 2651302 - RNA, 23 nt, Escherichia coli CFT073
gaacacgguaguuaaacuuucau

SEQ ID NO: 2651303 - RNA, 20 nt, Escherichia coli CFT073
gaacacguuaugcuuacuga

SEQ ID NO: 2651304 - RNA, 23 nt, Escherichia coli CFT073
gaacacuucuucuguuucugucg

SEQ ID NO: 2651305 - RNA, 16 nt, Escherichia coli CFT073
gaacacuuugccgucu

SEQ ID NO: 2651306 - RNA, 23 nt, Escherichia coli CFT073
gaacagaaauggcuggcagcaga

SEQ ID NO: 2651307 - RNA, 19 nt, Escherichia coli CFT073
gaacagaucccacauaugu

SEQ ID NO: 2651308 - RNA, 13 nt, Escherichia coli CFT073
gaacagcccgcca

SEQ ID NO: 2651309 - RNA, 20 nt, Escherichia coli CFT073
gaacagccugugccugagcc

SEQ ID NO: 2651310 - RNA, 16 nt, Escherichia coli CFT073
gaacagcgaccgcaga

SEQ ID NO: 2651311 - RNA, 18 nt, Escherichia coli CFT073
gaacagcgucgcaucagg

SEQ ID NO: 2651312 - RNA, 14 nt, Escherichia coli CFT073
gaacaggcuggccg

SEQ ID NO: 2651313 - RNA, 16 nt, Escherichia coli CFT073
gaacaggucgaugcac

SEQ ID NO: 2651314 - RNA, 14 nt, Escherichia coli CFT073
gaacagugccagac

SEQ ID NO: 2651315 - RNA, 16 nt, Escherichia coli CFT073
gaacaguuuucgcacc

SEQ ID NO: 2651316 - RNA, 16 nt, Escherichia coli CFT073
gaacauaaacacccac

SEQ ID NO: 2651317 - RNA, 16 nt, Escherichia coli CFT073
gaacauaucagcgcaa

SEQ ID NO: 2651318 - RNA, 12 nt, Escherichia coli CFT073
gaagacaaaacc

SEQ ID NO: 2651319 - RNA, 23 nt, Escherichia coli CFT073
gaagacaauccccgccagcguug

SEQ ID NO: 2651320 - RNA, 16 nt, Escherichia coli CFT073
gaagacaucaucguga

SEQ ID NO: 2651321 - RNA, 21 nt, Escherichia coli CFT073
gaagacaucgcagggaucauc

SEQ ID NO: 2651322 - RNA, 20 nt, Escherichia coli CFT073
gaagaccagauuaaucagca

SEQ ID NO: 2651323 - RNA, 21 nt, Escherichia coli CFT073
gaagaccagcgaaaccugaau

SEQ ID NO: 2651324 - RNA, 17 nt, Escherichia coli CFT073
gaagacgaguagaagcg

SEQ ID NO: 2651325 - RNA, 18 nt, Escherichia coli CFT073
gaagacggccaucccagu

SEQ ID NO: 2651326 - RNA, 15 nt, Escherichia coli CFT073
gaagacguagcaagc

SEQ ID NO: 2651327 - RNA, 22 nt, Escherichia coli CFT073
gaagagaauuugcucuucuuuc

SEQ ID NO: 2651328 - RNA, 15 nt, Escherichia coli CFT073
gaagagcggcucugg

SEQ ID NO: 2651329 - RNA, 12 nt, Escherichia coli CFT073
gaagaggagagu

SEQ ID NO: 2651330 - RNA, 23 nt, Escherichia coli CFT073
gaagaggccgccguaggagugcc

SEQ ID NO: 2651331 - RNA, 14 nt, Escherichia coli CFT073
gaagaguuccagcg

SEQ ID NO: 2651332 - RNA, 13 nt, Escherichia coli CFT073
gaagaucaccaca

SEQ ID NO: 2651333 - RNA, 22 nt, Escherichia coli CFT073
gaagaucaccacauucagcagc

SEQ ID NO: 2651334 - RNA, 13 nt, Escherichia coli CFT073
gaagaucaccacc

SEQ ID NO: 2651335 - RNA, 18 nt, Escherichia coli CFT073
gaagaucaucaccaggcc

SEQ ID NO: 2651336 - RNA, 13 nt, Escherichia coli CFT073
gaagauccagauu

SEQ ID NO: 2651337 - RNA, 17 nt, Escherichia coli CFT073
gaagauccaugaagcaa

SEQ ID NO: 2651338 - RNA, 16 nt, Escherichia coli CFT073
gaagaucuucagucuu

SEQ ID NO: 2651339 - RNA, 17 nt, Escherichia coli CFT073
gaagaucuucagucuug

SEQ ID NO: 2651340 - RNA, 14 nt, Escherichia coli CFT073
gaagaugaaaaacg

SEQ ID NO: 2651341 - RNA, 22 nt, Escherichia coli CFT073
gaagauucguauuuaaaaccgg

SEQ ID NO: 2651342 - RNA, 15 nt, Escherichia coli CFT073
gaagauuugcagauc

SEQ ID NO: 2651343 - RNA, 18 nt, Escherichia coli CFT073
gaagauuuuaccgucacc

SEQ ID NO: 2651344 - RNA, 17 nt, Escherichia coli CFT073
gaagauuuuuugccagc

SEQ ID NO: 2651345 - RNA, 15 nt, Escherichia coli CFT073
gaagcaaaccaggcc

SEQ ID NO: 2651346 - RNA, 18 nt, Escherichia coli CFT073
gaagcaaaccaggccggu

SEQ ID NO: 2651347 - RNA, 13 nt, Escherichia coli CFT073
gaagcaauaagca

SEQ ID NO: 2651348 - RNA, 22 nt, Escherichia coli CFT073
gaagcaauguauuuguccacgc

SEQ ID NO: 2651349 - RNA, 12 nt, Escherichia coli CFT073
gaagcaccugcg

SEQ ID NO: 2651350 - RNA, 23 nt, Escherichia coli CFT073
gaagcacguacgcuguucgccag

SEQ ID NO: 2651351 - RNA, 15 nt, Escherichia coli CFT073
gaagcacuaccuugc

SEQ ID NO: 2651352 - RNA, 21 nt, Escherichia coli CFT073
gaagcacuaccuugcuucuua

SEQ ID NO: 2651353 - RNA, 22 nt, Escherichia coli CFT073
gaagcagaaugaaugauacaga

SEQ ID NO: 2651354 - RNA, 23 nt, Escherichia coli CFT073
gaagcagcaucagcaaauagaua

SEQ ID NO: 2651355 - RNA, 15 nt, Escherichia coli CFT073
gaagcagcgcuggag

SEQ ID NO: 2651356 - RNA, 21 nt, Escherichia coli CFT073
gaagcagcgcuggagagcgcc

SEQ ID NO: 2651357 - RNA, 14 nt, Escherichia coli CFT073
gaagcauaccgauc

SEQ ID NO: 2651358 - RNA, 22 nt, Escherichia coli CFT073
gaagccaaccgggccgcagaga

SEQ ID NO: 2651359 - RNA, 18 nt, Escherichia coli CFT073
gaagccaccacgccaaga

SEQ ID NO: 2651360 - RNA, 15 nt, Escherichia coli CFT073
gaagccaccuggggc

SEQ ID NO: 2651361 - RNA, 17 nt, Escherichia coli CFT073
gaagccagacaaauguc

SEQ ID NO: 2651362 - RNA, 22 nt, Escherichia coli CFT073
gaagccauuaccgauaucaaua

SEQ ID NO: 2651363 - RNA, 19 nt, Escherichia coli CFT073
gaagcccacaccgcccagc

SEQ ID NO: 2651364 - RNA, 18 nt, Escherichia coli CFT073
gaagcccaguaccgccag

SEQ ID NO: 2651365 - RNA, 22 nt, Escherichia coli CFT073
gaagcccaguaccgccagugca

SEQ ID NO: 2651366 - RNA, 14 nt, Escherichia coli CFT073
gaagcccgcccagc

SEQ ID NO: 2651367 - RNA, 20 nt, Escherichia coli CFT073
gaagccgaacagucgcugau

SEQ ID NO: 2651368 - RNA, 20 nt, Escherichia coli CFT073
gaagccgcuccggcagcagc

SEQ ID NO: 2651369 - RNA, 22 nt, Escherichia coli CFT073
gaagccggaauauucuuccggc

SEQ ID NO: 2651370 - RNA, 20 nt, Escherichia coli CFT073
gaagccguuggucaucauca

SEQ ID NO: 2651371 - RNA, 22 nt, Escherichia coli CFT073
gaagcgagugcgaaacuucuua

SEQ ID NO: 2651372 - RNA, 20 nt, Escherichia coli CFT073
gaagcgaguuaccacgccuu

SEQ ID NO: 2651373 - RNA, 13 nt, Escherichia coli CFT073
gaagcgccaauac

SEQ ID NO: 2651374 - RNA, 17 nt, Escherichia coli CFT073
gaagcgccaccagcgcc

SEQ ID NO: 2651375 - RNA, 23 nt, Escherichia coli CFT073
gaagcgcgaucaguugcucggca

SEQ ID NO: 2651376 - RNA, 17 nt, Escherichia coli CFT073
gaagcggcacugcucuu

SEQ ID NO: 2651377 - RNA, 20 nt, Escherichia coli CFT073
gaagcggccgucagaucgcc

SEQ ID NO: 2651378 - RNA, 23 nt, Escherichia coli CFT073
gaagcggcggucuucucaccgcc

SEQ ID NO: 2651379 - RNA, 15 nt, Escherichia coli CFT073
gaagcgggugcgcag

SEQ ID NO: 2651380 - RNA, 21 nt, Escherichia coli CFT073
gaagcggguuucgagagcauc

SEQ ID NO: 2651381 - RNA, 16 nt, Escherichia coli CFT073
gaagcguugauccagc

SEQ ID NO: 2651382 - RNA, 22 nt, Escherichia coli CFT073
gaagcucguuguuuacgccgga

SEQ ID NO: 2651383 - RNA, 16 nt, Escherichia coli CFT073
gaagcucucuuccagu

SEQ ID NO: 2651384 - RNA, 20 nt, Escherichia coli CFT073
gaagcugaacagucgcugau

SEQ ID NO: 2651385 - RNA, 18 nt, Escherichia coli CFT073
gaagcuggucagcaucgu

SEQ ID NO: 2651386 - RNA, 22 nt, Escherichia coli CFT073
gaagcuuaucacagaggaagag

SEQ ID NO: 2651387 - RNA, 16 nt, Escherichia coli CFT073
gaagcuugcuucuuug

SEQ ID NO: 2651388 - RNA, 19 nt, Escherichia coli CFT073
gaagcuuuucgggaacacg

SEQ ID NO: 2651389 - RNA, 21 nt, Escherichia coli CFT073
gaaggaagacguagcaagcau

SEQ ID NO: 2651390 - RNA, 20 nt, Escherichia coli CFT073
gaaggaaggcaugagccgcu

SEQ ID NO: 2651391 - RNA, 14 nt, Escherichia coli CFT073
gaaggacugccgca

SEQ ID NO: 2651392 - RNA, 16 nt, Escherichia coli CFT073
gaaggauauaaaaaua

SEQ ID NO: 2651393 - RNA, 17 nt, Escherichia coli CFT073
gaaggauauaaaaauaa

SEQ ID NO: 2651394 - RNA, 15 nt, Escherichia coli CFT073
gaagggaauauacca

SEQ ID NO: 2651395 - RNA, 22 nt, Escherichia coli CFT073
gaagggcuggccaauuggcugg

SEQ ID NO: 2651396 - RNA, 23 nt, Escherichia coli CFT073
gaaggguaaacacccaggccauc

SEQ ID NO: 2651397 - RNA, 14 nt, Escherichia coli CFT073
gaagguaacaccag

SEQ ID NO: 2651398 - RNA, 21 nt, Escherichia coli CFT073
gaagguaacaccaguuuccag

SEQ ID NO: 2651399 - RNA, 20 nt, Escherichia coli CFT073
gaagguaagcaacagaugga

SEQ ID NO: 2651400 - RNA, 19 nt, Escherichia coli CFT073
gaagguaaguuguugauaa

SEQ ID NO: 2651401 - RNA, 19 nt, Escherichia coli CFT073
gaagguauacugcaaauau

SEQ ID NO: 2651402 - RNA, 14 nt, Escherichia coli CFT073
gaaggucagguuug

SEQ ID NO: 2651403 - RNA, 16 nt, Escherichia coli CFT073
gaaggugagggggcga

SEQ ID NO: 2651404 - RNA, 17 nt, Escherichia coli CFT073
gaaggugauucccagca

SEQ ID NO: 2651405 - RNA, 13 nt, Escherichia coli CFT073
gaaggugccguuc

SEQ ID NO: 2651406 - RNA, 13 nt, Escherichia coli CFT073
gaaggugccugcc

SEQ ID NO: 2651407 - RNA, 12 nt, Escherichia coli CFT073
gaaggugccuuu

SEQ ID NO: 2651408 - RNA, 17 nt, Escherichia coli CFT073
gaaggugguuaccgcca

SEQ ID NO: 2651409 - RNA, 20 nt, Escherichia coli CFT073
gaaggugguuaccgccagca

SEQ ID NO: 2651410 - RNA, 24 nt, Escherichia coli CFT073
gaagguguugaaaugagaaaacua

SEQ ID NO: 2651411 - RNA, 22 nt, Escherichia coli CFT073
gaagguugccauaucuucccgg

SEQ ID NO: 2651412 - RNA, 17 nt, Escherichia coli CFT073
gaagguuuuuucuguau

SEQ ID NO: 2651413 - RNA, 15 nt, Escherichia coli CFT073
gaaguaagaggagga

SEQ ID NO: 2651414 - RNA, 21 nt, Escherichia coli CFT073
gaaguaagaggaggacagcca

SEQ ID NO: 2651415 - RNA, 20 nt, Escherichia coli CFT073
gaaguacgcaguaaauaaaa

SEQ ID NO: 2651416 - RNA, 21 nt, Escherichia coli CFT073
gaaguacgcaguaaauaaaaa

SEQ ID NO: 2651417 - RNA, 23 nt, Escherichia coli CFT073
gaaguagaucguacucaaucccu

SEQ ID NO: 2651418 - RNA, 19 nt, Escherichia coli CFT073
gaaguaugacgaguauauu

SEQ ID NO: 2651419 - RNA, 20 nt, Escherichia coli CFT073
gaagucaacgcucaggccga

SEQ ID NO: 2651420 - RNA, 18 nt, Escherichia coli CFT073
gaagucaccuuucagcca

SEQ ID NO: 2651421 - RNA, 21 nt, Escherichia coli CFT073
gaagucgcagaccaaacucuu

SEQ ID NO: 2651422 - RNA, 14 nt, Escherichia coli CFT073
gaagucguuaguaa

SEQ ID NO: 2651423 - RNA, 22 nt, Escherichia coli CFT073
gaagucguuaguaaccacugug

SEQ ID NO: 2651424 - RNA, 23 nt, Escherichia coli CFT073
gaagugauccgccgugcgguggg

SEQ ID NO: 2651425 - RNA, 21 nt, Escherichia coli CFT073
gaaucucugcgcuauccagcg

SEQ ID NO: 2651426 - RNA, 20 nt, Escherichia coli CFT073
gaaucucuucuucgcucaug

SEQ ID NO: 2651427 - RNA, 22 nt, Escherichia coli CFT073
gaaucuggcuucaucugcgcga

SEQ ID NO: 2651428 - RNA, 19 nt, Escherichia coli CFT073
gaaucuucauagucucgcc

SEQ ID NO: 2651429 - RNA, 16 nt, Escherichia coli CFT073
gaaugaaauauuaucu

SEQ ID NO: 2651430 - RNA, 13 nt, Escherichia coli CFT073
gaaugaagcagaa

SEQ ID NO: 2651431 - RNA, 16 nt, Escherichia coli CFT073
gaaugaagcagaagcc

SEQ ID NO: 2651432 - RNA, 17 nt, Escherichia coli CFT073
gaaugacacuuucagcg

SEQ ID NO: 2651433 - RNA, 15 nt, Escherichia coli CFT073
gaaugacgaucaacc

SEQ ID NO: 2651434 - RNA, 19 nt, Escherichia coli CFT073
gaaugacguuuacuucgcu

SEQ ID NO: 2651435 - RNA, 19 nt, Escherichia coli CFT073
gaaugaggcacgacacaau

SEQ ID NO: 2651436 - RNA, 20 nt, Escherichia coli CFT073
gaaugaucacuuguucagcg

SEQ ID NO: 2651437 - RNA, 21 nt, Escherichia coli CFT073
gaaugaugcggcgcuuucagc

SEQ ID NO: 2651438 - RNA, 13 nt, Escherichia coli CFT073
gaaugcagcagca

SEQ ID NO: 2651439 - RNA, 14 nt, Escherichia coli CFT073
gaaugcaggcgcgc

SEQ ID NO: 2651440 - RNA, 16 nt, Escherichia coli CFT073
gaaugcaggcgcgccu

SEQ ID NO: 2651441 - RNA, 19 nt, Escherichia coli CFT073
gaaugcagucacgccagua

SEQ ID NO: 2651442 - RNA, 16 nt, Escherichia coli CFT073
gaaugccaauuucccg

SEQ ID NO: 2651443 - RNA, 17 nt, Escherichia coli CFT073
gaaugccucaaucagcg

SEQ ID NO: 2651444 - RNA, 12 nt, Escherichia coli CFT073
gaaugcgaaaac

SEQ ID NO: 2651445 - RNA, 15 nt, Escherichia coli CFT073
gaaugcucgcuggca

SEQ ID NO: 2651446 - RNA, 17 nt, Escherichia coli CFT073
gaaugcucgcuggcagg

SEQ ID NO: 2651447 - RNA, 20 nt, Escherichia coli CFT073
gaauggaaacagcaccaucc

SEQ ID NO: 2651448 - RNA, 22 nt, Escherichia coli CFT073
gaauggcgacguaccagcgucg

SEQ ID NO: 2651449 - RNA, 19 nt, Escherichia coli CFT073
gaauggcugcacuuucagu

SEQ ID NO: 2651450 - RNA, 11 nt, Escherichia coli CFT073
gaauggcuggg

SEQ ID NO: 2651451 - RNA, 23 nt, Escherichia coli CFT073
gaaugguaaucagcgacugcucc

SEQ ID NO: 2651452 - RNA, 14 nt, Escherichia coli CFT073
gaauggucaccaca

SEQ ID NO: 2651453 - RNA, 23 nt, Escherichia coli CFT073
gaauggucaccacaaaugcgcca

SEQ ID NO: 2651454 - RNA, 11 nt, Escherichia coli CFT073
gaauggucagu

SEQ ID NO: 2651455 - RNA, 15 nt, Escherichia coli CFT073
gaauggucaguuucg

SEQ ID NO: 2651456 - RNA, 23 nt, Escherichia coli CFT073
gaauggugaaguuauuaaugaca

SEQ ID NO: 2651457 - RNA, 15 nt, Escherichia coli CFT073
gaauggugaccugca

SEQ ID NO: 2651458 - RNA, 16 nt, Escherichia coli CFT073
gaaugguuucacgcug

SEQ ID NO: 2651459 - RNA, 11 nt, Escherichia coli CFT073
gaauguuccau

SEQ ID NO: 2651460 - RNA, 16 nt, Escherichia coli CFT073
gaauuaaaaacgauau

SEQ ID NO: 2651461 - RNA, 12 nt, Escherichia coli CFT073
gaauuaaaauau

SEQ ID NO: 2651462 - RNA, 22 nt, Escherichia coli CFT073
gaauuaaaauaucaggcugaac

SEQ ID NO: 2651463 - RNA, 17 nt, Escherichia coli CFT073
gaauuaaacaacgccag

SEQ ID NO: 2651464 - RNA, 13 nt, Escherichia coli CFT073
gaauuaaccagaa

SEQ ID NO: 2651465 - RNA, 20 nt, Escherichia coli CFT073
gaauuaaucccuuaaaaccg

SEQ ID NO: 2651466 - RNA, 23 nt, Escherichia coli CFT073
gaauuaucggcgucgcaucaggu

SEQ ID NO: 2651467 - RNA, 16 nt, Escherichia coli CFT073
gaauuaucuauauuua

SEQ ID NO: 2651468 - RNA, 21 nt, Escherichia coli CFT073
gaauuaugcagccuucauuca

SEQ ID NO: 2651469 - RNA, 18 nt, Escherichia coli CFT073
gaauuaugcccaaugagc

SEQ ID NO: 2651470 - RNA, 22 nt, Escherichia coli CFT073
gaauuaugcccaaugagcugaa

SEQ ID NO: 2651471 - RNA, 12 nt, Escherichia coli CFT073
gaauuauucaga

SEQ ID NO: 2651472 - RNA, 23 nt, Escherichia coli CFT073
gaauuauucagaguauauauucg

SEQ ID NO: 2651473 - RNA, 16 nt, Escherichia coli CFT073
gaauucaacuaacuga

SEQ ID NO: 2651474 - RNA, 16 nt, Escherichia coli CFT073
gaauuccggcagagaa

SEQ ID NO: 2651475 - RNA, 18 nt, Escherichia coli CFT073
gaauuccggcagagaaag

SEQ ID NO: 2651476 - RNA, 17 nt, Escherichia coli CFT073
gaauuccgugccagcac

SEQ ID NO: 2651477 - RNA, 15 nt, Escherichia coli CFT073
gaauuccugacuuac

SEQ ID NO: 2651478 - RNA, 15 nt, Escherichia coli CFT073
gaauucgacuuucuc

SEQ ID NO: 2651479 - RNA, 17 nt, Escherichia coli CFT073
gaauucgacuuucucug

SEQ ID NO: 2651480 - RNA, 16 nt, Escherichia coli CFT073
gaauucugcagacugu

SEQ ID NO: 2651481 - RNA, 15 nt, Escherichia coli CFT073
gaauugaccaguaau

SEQ ID NO: 2651482 - RNA, 21 nt, Escherichia coli CFT073
gaauugacuagcuuuucgccc

SEQ ID NO: 2651483 - RNA, 22 nt, Escherichia coli CFT073
gaauugcaucuacgcucucuuc

SEQ ID NO: 2651484 - RNA, 15 nt, Escherichia coli CFT073
gaauugcccacugcg

SEQ ID NO: 2651485 - RNA, 18 nt, Escherichia coli CFT073
gaauugccuguucaaccu

SEQ ID NO: 2651486 - RNA, 16 nt, Escherichia coli CFT073
gaauugcuuccaguaa

SEQ ID NO: 2651487 - RNA, 19 nt, Escherichia coli CFT073
gaauuggcaucaggcuggu

SEQ ID NO: 2651488 - RNA, 15 nt, Escherichia coli CFT073
gaauuggcgucagua

SEQ ID NO: 2651489 - RNA, 16 nt, Escherichia coli CFT073
gaauuuaaaugacaau

SEQ ID NO: 2651490 - RNA, 17 nt, Escherichia coli CFT073
gaauuuaucuucaccaa

SEQ ID NO: 2651491 - RNA, 15 nt, Escherichia coli CFT073
gaauuuaucuuucag

SEQ ID NO: 2651492 - RNA, 15 nt, Escherichia coli CFT073
gaauuucagaaaacg

SEQ ID NO: 2651493 - RNA, 16 nt, Escherichia coli CFT073
gaauuucauccuguau

SEQ ID NO: 2651494 - RNA, 13 nt, Escherichia coli CFT073
gaauuuccagaaa

SEQ ID NO: 2651495 - RNA, 15 nt, Escherichia coli CFT073
gaauuuccagaaagu

SEQ ID NO: 2651496 - RNA, 23 nt, Escherichia coli CFT073
gaauuuccugcgcuuucugcuuc

SEQ ID NO: 2651497 - RNA, 20 nt, Escherichia coli CFT073
gaauuuccuucgcuuccugu

SEQ ID NO: 2651498 - RNA, 14 nt, Escherichia coli CFT073
gaauuucuuucagc

SEQ ID NO: 2651499 - RNA, 16 nt, Escherichia coli CFT073
gaauuugcuccagaaa

SEQ ID NO: 2651500 - RNA, 15 nt, Escherichia coli CFT073
gaauuugcuccgcca

SEQ ID NO: 2651501 - RNA, 15 nt, Escherichia coli CFT073
gaauuuguaggccgg

SEQ ID NO: 2651502 - RNA, 16 nt, Escherichia coli CFT073
gaauuuguaggccgga

SEQ ID NO: 2651503 - RNA, 18 nt, Escherichia coli CFT073
gaauuuguaggccugaua

SEQ ID NO: 2651504 - RNA, 19 nt, Escherichia coli CFT073
gaauuuugaaggaaaaauc

SEQ ID NO: 2651505 - RNA, 13 nt, Escherichia coli CFT073
gaauuuugcuggc

SEQ ID NO: 2651506 - RNA, 15 nt, Escherichia coli CFT073
gaauuuuuaaccguc

SEQ ID NO: 2651507 - RNA, 15 nt, Escherichia coli CFT073
gacaaaaagaguucc

SEQ ID NO: 2651508 - RNA, 14 nt, Escherichia coli CFT073
gacaaaaauaccac

SEQ ID NO: 2651509 - RNA, 15 nt, Escherichia coli CFT073
gacaaaaauaccacc

SEQ ID NO: 2651510 - RNA, 19 nt, Escherichia coli CFT073
gacaaaacuuuuaucaauu

SEQ ID NO: 2651511 - RNA, 17 nt, Escherichia coli CFT073
gacaaaaucagaaacaa

SEQ ID NO: 2651512 - RNA, 14 nt, Escherichia coli CFT073
gacaaaauccccuu

SEQ ID NO: 2651513 - RNA, 17 nt, Escherichia coli CFT073
gacaaacagcgagaaca

SEQ ID NO: 2651514 - RNA, 18 nt, Escherichia coli CFT073
gacaaaccagguaucguu

SEQ ID NO: 2651515 - RNA, 21 nt, Escherichia coli CFT073
gacaaaccggcuggcuaacau

SEQ ID NO: 2651516 - RNA, 20 nt, Escherichia coli CFT073
gacaaacgcaaaacugccug

SEQ ID NO: 2651517 - RNA, 23 nt, Escherichia coli CFT073
gacaaacgcaaaauugccugaug

SEQ ID NO: 2651518 - RNA, 18 nt, Escherichia coli CFT073
gacaaacgccggauggca

SEQ ID NO: 2651519 - RNA, 23 nt, Escherichia coli CFT073
gacaaacguauaauugccugaug

SEQ ID NO: 2651520 - RNA, 19 nt, Escherichia coli CFT073
gacaaacuuccagaauaug

SEQ ID NO: 2651521 - RNA, 19 nt, Escherichia coli CFT073
gacaaaguggcggcagcgg

SEQ ID NO: 2651522 - RNA, 13 nt, Escherichia coli CFT073
gacaaaugucaga

SEQ ID NO: 2651523 - RNA, 20 nt, Escherichia coli CFT073
gacaaaugucagaaagaaau

SEQ ID NO: 2651524 - RNA, 21 nt, Escherichia coli CFT073
gacaaauguguucagcgacag

SEQ ID NO: 2651525 - RNA, 20 nt, Escherichia coli CFT073
gacaacaaacgcaaacacca

SEQ ID NO: 2651526 - RNA, 22 nt, Escherichia coli CFT073
gacaacaaacgcaaacaccagc

SEQ ID NO: 2651527 - RNA, 13 nt, Escherichia coli CFT073
gacaacaacauca

SEQ ID NO: 2651528 - RNA, 20 nt, Escherichia coli CFT073
gacaacaacaucacaccugc

SEQ ID NO: 2651529 - RNA, 11 nt, Escherichia coli CFT073
gacaacaguca

SEQ ID NO: 2651530 - RNA, 17 nt, Escherichia coli CFT073
gacaacagucaaccgcc

SEQ ID NO: 2651531 - RNA, 21 nt, Escherichia coli CFT073
gacaaccugaccuuuuuucag

SEQ ID NO: 2651532 - RNA, 18 nt, Escherichia coli CFT073
gacaacgaucgacaaaac

SEQ ID NO: 2651533 - RNA, 22 nt, Escherichia coli CFT073
gacauacucagcgccugcugca

SEQ ID NO: 2651534 - RNA, 16 nt, Escherichia coli CFT073
gacauauaaccggcaa

SEQ ID NO: 2651535 - RNA, 12 nt, Escherichia coli CFT073
gacauauuuuug

SEQ ID NO: 2651536 - RNA, 21 nt, Escherichia coli CFT073
gacaucaaaauuaccuuuaca

SEQ ID NO: 2651537 - RNA, 13 nt, Escherichia coli CFT073
gacaucaaacagg

SEQ ID NO: 2651538 - RNA, 13 nt, Escherichia coli CFT073
gacaucaaagaaa

SEQ ID NO: 2651539 - RNA, 15 nt, Escherichia coli CFT073
gacaucaaagaaaag

SEQ ID NO: 2651540 - RNA, 14 nt, Escherichia coli CFT073
gacaucaacagaag

SEQ ID NO: 2651541 - RNA, 19 nt, Escherichia coli CFT073
gacaucaacgaugccuuau

SEQ ID NO: 2651542 - RNA, 14 nt, Escherichia coli CFT073
gacaucaacgccug

SEQ ID NO: 2651543 - RNA, 17 nt, Escherichia coli CFT073
gacaucaacgccugaug

SEQ ID NO: 2651544 - RNA, 13 nt, Escherichia coli CFT073
gacaucaagaaau

SEQ ID NO: 2651545 - RNA, 21 nt, Escherichia coli CFT073
gacaucaagaaaugcauguuc

SEQ ID NO: 2651546 - RNA, 12 nt, Escherichia coli CFT073
gacaucaucgcc

SEQ ID NO: 2651547 - RNA, 18 nt, Escherichia coli CFT073
gacaucaucgccccgcuc

SEQ ID NO: 2651548 - RNA, 21 nt, Escherichia coli CFT073
gacaucaucgugaccaaagca

SEQ ID NO: 2651549 - RNA, 24 nt, Escherichia coli CFT073
gacauccagaucacgcagcaagcc

SEQ ID NO: 2651550 - RNA, 20 nt, Escherichia coli CFT073
gacauccauauccagugcac

SEQ ID NO: 2651551 - RNA, 16 nt, Escherichia coli CFT073
gacaucccggcagaga

SEQ ID NO: 2651552 - RNA, 23 nt, Escherichia coli CFT073
gacauccgccagcgccucuucua

SEQ ID NO: 2651553 - RNA, 14 nt, Escherichia coli CFT073
gacaucuccagcgc

SEQ ID NO: 2651554 - RNA, 13 nt, Escherichia coli CFT073
gacaucucuucuu

SEQ ID NO: 2651555 - RNA, 20 nt, Escherichia coli CFT073
gacaucuucucuacccgcuc

SEQ ID NO: 2651556 - RNA, 20 nt, Escherichia coli CFT073
gacaugaccacaaagcagac

SEQ ID NO: 2651557 - RNA, 13 nt, Escherichia coli CFT073
gacaugacccggc

SEQ ID NO: 2651558 - RNA, 22 nt, Escherichia coli CFT073
gacaugcgguucacgcgccaga

SEQ ID NO: 2651559 - RNA, 14 nt, Escherichia coli CFT073
gacauguugcuuaa

SEQ ID NO: 2651560 - RNA, 21 nt, Escherichia coli CFT073
gacauguugcuuaaugcggga

SEQ ID NO: 2651561 - RNA, 14 nt, Escherichia coli CFT073
gacauguuuuccag

SEQ ID NO: 2651562 - RNA, 18 nt, Escherichia coli CFT073
gacauguuuuuauuaaag

SEQ ID NO: 2651563 - RNA, 14 nt, Escherichia coli CFT073
gacauuaaagcuuu

SEQ ID NO: 2651564 - RNA, 18 nt, Escherichia coli CFT073
gacauuaucaccgacaaa

SEQ ID NO: 2651565 - RNA, 23 nt, Escherichia coli CFT073
gacauuaucaccgacaaacagcg

SEQ ID NO: 2651566 - RNA, 19 nt, Escherichia coli CFT073
gacauucaacauauccagc

SEQ ID NO: 2651567 - RNA, 19 nt, Escherichia coli CFT073
gacauucgcgcacggugca

SEQ ID NO: 2651568 - RNA, 15 nt, Escherichia coli CFT073
gacauugccaguuuu

SEQ ID NO: 2651569 - RNA, 16 nt, Escherichia coli CFT073
gacauuggcaaaacca

SEQ ID NO: 2651570 - RNA, 15 nt, Escherichia coli CFT073
gacauuucccccuuc

SEQ ID NO: 2651571 - RNA, 15 nt, Escherichia coli CFT073
gacauuucugcugcc

SEQ ID NO: 2651572 - RNA, 21 nt, Escherichia coli CFT073
gacauuuggggcacuguagcu

SEQ ID NO: 2651573 - RNA, 23 nt, Escherichia coli CFT073
gaccaaaacucgcuggcggcugg

SEQ ID NO: 2651574 - RNA, 23 nt, Escherichia coli CFT073
gaccaaacauacgacuuugcgca

SEQ ID NO: 2651575 - RNA, 15 nt, Escherichia coli CFT073
gaccaaacugaacgu

SEQ ID NO: 2651576 - RNA, 13 nt, Escherichia coli CFT073
gaccaaacugcuc

SEQ ID NO: 2651577 - RNA, 19 nt, Escherichia coli CFT073
gaccaacacccacagccau

SEQ ID NO: 2651578 - RNA, 14 nt, Escherichia coli CFT073
gaccaacaguugcc

SEQ ID NO: 2651579 - RNA, 15 nt, Escherichia coli CFT073
gaccaaccaucaucc

SEQ ID NO: 2651580 - RNA, 18 nt, Escherichia coli CFT073
gaccaauaaacgccaggu

SEQ ID NO: 2651581 - RNA, 15 nt, Escherichia coli CFT073
gaccaauaacccguu

SEQ ID NO: 2651582 - RNA, 16 nt, Escherichia coli CFT073
gaccaauaacccguug

SEQ ID NO: 2651583 - RNA, 13 nt, Escherichia coli CFT073
gaccaauagaaag

SEQ ID NO: 2651584 - RNA, 18 nt, Escherichia coli CFT073
gaccaaucacacaaccau

SEQ ID NO: 2651585 - RNA, 16 nt, Escherichia coli CFT073
gaccaaucccgccaua

SEQ ID NO: 2651586 - RNA, 22 nt, Escherichia coli CFT073
gaccaaucccgccauaacggcu

SEQ ID NO: 2651587 - RNA, 15 nt, Escherichia coli CFT073
gaccaauccgccagc

SEQ ID NO: 2651588 - RNA, 13 nt, Escherichia coli CFT073
gaccaauggcuuu

SEQ ID NO: 2651589 - RNA, 20 nt, Escherichia coli CFT073
gaccaauuacacacaacaca

SEQ ID NO: 2651590 - RNA, 13 nt, Escherichia coli CFT073
gaccacaaucaac

SEQ ID NO: 2651591 - RNA, 15 nt, Escherichia coli CFT073
gaccacaaucaacgc

SEQ ID NO: 2651592 - RNA, 20 nt, Escherichia coli CFT073
gaccacaaucaacgccacca

SEQ ID NO: 2651593 - RNA, 16 nt, Escherichia coli CFT073
gaccacacaaagugcg

SEQ ID NO: 2651594 - RNA, 17 nt, Escherichia coli CFT073
gaccaccacccuguggg

SEQ ID NO: 2651595 - RNA, 13 nt, Escherichia coli CFT073
gaccaccagcacg

SEQ ID NO: 2651596 - RNA, 17 nt, Escherichia coli CFT073
gaccaccgaaugcgccu

SEQ ID NO: 2651597 - RNA, 12 nt, Escherichia coli CFT073
gaccaccgcagc

SEQ ID NO: 2651598 - RNA, 14 nt, Escherichia coli CFT073
gaccaccgcagcaa

SEQ ID NO: 2651599 - RNA, 13 nt, Escherichia coli CFT073
gaccaccgcgcua

SEQ ID NO: 2651600 - RNA, 22 nt, Escherichia coli CFT073
gaccaccucggcacugacgcgc

SEQ ID NO: 2651601 - RNA, 20 nt, Escherichia coli CFT073
gaccacgcacagcccgccgc

SEQ ID NO: 2651602 - RNA, 24 nt, Escherichia coli CFT073
gaccacgcacagcccgccgccauc

SEQ ID NO: 2651603 - RNA, 20 nt, Escherichia coli CFT073
gaccacgcugcgcugcacca

SEQ ID NO: 2651604 - RNA, 22 nt, Escherichia coli CFT073
gaccacgcugcgcugcaccagu

SEQ ID NO: 2651605 - RNA, 22 nt, Escherichia coli CFT073
gaccacggacaugaaccguguc

SEQ ID NO: 2651606 - RNA, 20 nt, Escherichia coli CFT073
gaccacggccauauccagcc

SEQ ID NO: 2651607 - RNA, 13 nt, Escherichia coli CFT073
gaccagaccggca

SEQ ID NO: 2651608 - RNA, 20 nt, Escherichia coli CFT073
gaccagaccggcaaucgcgc

SEQ ID NO: 2651609 - RNA, 22 nt, Escherichia coli CFT073
gaccagaccggcaaucgcgcca

SEQ ID NO: 2651610 - RNA, 17 nt, Escherichia coli CFT073
gaccagagcugauacgg

SEQ ID NO: 2651611 - RNA, 15 nt, Escherichia coli CFT073
gaccagauugaacuc

SEQ ID NO: 2651612 - RNA, 23 nt, Escherichia coli CFT073
gaccagcaauaacuaagauaauc

SEQ ID NO: 2651613 - RNA, 19 nt, Escherichia coli CFT073
gaccagcacgguggcuggc

SEQ ID NO: 2651614 - RNA, 14 nt, Escherichia coli CFT073
gaccagccagcaau

SEQ ID NO: 2651615 - RNA, 15 nt, Escherichia coli CFT073
gaccagccagcaaug

SEQ ID NO: 2651616 - RNA, 16 nt, Escherichia coli CFT073
gaccagccaggccgcc

SEQ ID NO: 2651617 - RNA, 18 nt, Escherichia coli CFT073
gaccagccuugugccuca

SEQ ID NO: 2651618 - RNA, 16 nt, Escherichia coli CFT073
gaccagcggcaacauc

SEQ ID NO: 2651619 - RNA, 23 nt, Escherichia coli CFT073
gaccagcggcaacaucaucacgc

SEQ ID NO: 2651620 - RNA, 12 nt, Escherichia coli CFT073
gaccagcgggcg

SEQ ID NO: 2651621 - RNA, 19 nt, Escherichia coli CFT073
gaccagcgucguauccagc

SEQ ID NO: 2651622 - RNA, 22 nt, Escherichia coli CFT073
gaccagcuaccacgccgauaau

SEQ ID NO: 2651623 - RNA, 16 nt, Escherichia coli CFT073
gaccagcuccagcagu

SEQ ID NO: 2651624 - RNA, 18 nt, Escherichia coli CFT073
gaccagcuccagcagucc

SEQ ID NO: 2651625 - RNA, 15 nt, Escherichia coli CFT073
gaccaggaugcuuca

SEQ ID NO: 2651626 - RNA, 20 nt, Escherichia coli CFT073
gaccaggauuugauggucuc

SEQ ID NO: 2651627 - RNA, 16 nt, Escherichia coli CFT073
gaccaggcaaaccagu

SEQ ID NO: 2651628 - RNA, 15 nt, Escherichia coli CFT073
gaccaggccaucagc

SEQ ID NO: 2651629 - RNA, 16 nt, Escherichia coli CFT073
gaccaggccaucagca

SEQ ID NO: 2651630 - RNA, 19 nt, Escherichia coli CFT073
gaccaggccaucagcagcg

SEQ ID NO: 2651631 - RNA, 13 nt, Escherichia coli CFT073
gaccaguaccacc

SEQ ID NO: 2651632 - RNA, 21 nt, Escherichia coli CFT073
gaccagugcagacucaccuga

SEQ ID NO: 2651633 - RNA, 18 nt, Escherichia coli CFT073
gaccagugcagauaccac

SEQ ID NO: 2651634 - RNA, 18 nt, Escherichia coli CFT073
gaccaguggcgggacaga

SEQ ID NO: 2651635 - RNA, 23 nt, Escherichia coli CFT073
gaccaguggcgggacagaaagug

SEQ ID NO: 2651636 - RNA, 21 nt, Escherichia coli CFT073
gaccaguuguaaucugcacca

SEQ ID NO: 2651637 - RNA, 12 nt, Escherichia coli CFT073
gaccauaaaagg

SEQ ID NO: 2651638 - RNA, 13 nt, Escherichia coli CFT073
gaccauaacccgc

SEQ ID NO: 2651639 - RNA, 13 nt, Escherichia coli CFT073
gaccauaaugaug

SEQ ID NO: 2651640 - RNA, 20 nt, Escherichia coli CFT073
gaccauauuaacgcagcaaa

SEQ ID NO: 2651641 - RNA, 20 nt, Escherichia coli CFT073
gacgcgccagcaucgcauca

SEQ ID NO: 2651642 - RNA, 23 nt, Escherichia coli CFT073
gacgcgccagcaucgcaucaggc

SEQ ID NO: 2651643 - RNA, 15 nt, Escherichia coli CFT073
gacgcgccagcgucg

SEQ ID NO: 2651644 - RNA, 12 nt, Escherichia coli CFT073
gacgcgccaggu

SEQ ID NO: 2651645 - RNA, 18 nt, Escherichia coli CFT073
gacgcgccgccaccgcca

SEQ ID NO: 2651646 - RNA, 20 nt, Escherichia coli CFT073
gacgcgccgccaccgccaga

SEQ ID NO: 2651647 - RNA, 22 nt, Escherichia coli CFT073
gacgcgcguccccugcccgcga

SEQ ID NO: 2651648 - RNA, 15 nt, Escherichia coli CFT073
gacgcgggccacaua

SEQ ID NO: 2651649 - RNA, 17 nt, Escherichia coli CFT073
gacgcgguaaaagccca

SEQ ID NO: 2651650 - RNA, 15 nt, Escherichia coli CFT073
gacgcguaaauccag

SEQ ID NO: 2651651 - RNA, 16 nt, Escherichia coli CFT073
gacgcguaaauccagc

SEQ ID NO: 2651652 - RNA, 23 nt, Escherichia coli CFT073
gacgcguaaauccagcaccgcuu

SEQ ID NO: 2651653 - RNA, 16 nt, Escherichia coli CFT073
gacgcguagugucgca

SEQ ID NO: 2651654 - RNA, 21 nt, Escherichia coli CFT073
gacgcgucagcgucgcaucug

SEQ ID NO: 2651655 - RNA, 20 nt, Escherichia coli CFT073
gacgcguggcgucgcaucug

SEQ ID NO: 2651656 - RNA, 19 nt, Escherichia coli CFT073
gacgcguuaagcgucgcau

SEQ ID NO: 2651657 - RNA, 14 nt, Escherichia coli CFT073
gacgcuaaaccgcu

SEQ ID NO: 2651658 - RNA, 19 nt, Escherichia coli CFT073
gacgcuccauugcccgccc

SEQ ID NO: 2651659 - RNA, 14 nt, Escherichia coli CFT073
gacgcuccgcacuu

SEQ ID NO: 2651660 - RNA, 22 nt, Escherichia coli CFT073
gacgcuccugaucaagcuggcg

SEQ ID NO: 2651661 - RNA, 14 nt, Escherichia coli CFT073
gacgcugaauaauc

SEQ ID NO: 2651662 - RNA, 14 nt, Escherichia coli CFT073
gacgcugaccgcuu

SEQ ID NO: 2651663 - RNA, 16 nt, Escherichia coli CFT073
gacgcugagcacgcuu

SEQ ID NO: 2651664 - RNA, 16 nt, Escherichia coli CFT073
gacgcugcauaucucc

SEQ ID NO: 2651665 - RNA, 15 nt, Escherichia coli CFT073
gacgcugcucaggcg

SEQ ID NO: 2651666 - RNA, 16 nt, Escherichia coli CFT073
gacgcuggcagaaagu

SEQ ID NO: 2651667 - RNA, 23 nt, Escherichia coli CFT073
gacgcuggcagaaaguucgcgaa

SEQ ID NO: 2651668 - RNA, 20 nt, Escherichia coli CFT073
gacggaacgaucgcuuucaa

SEQ ID NO: 2651669 - RNA, 22 nt, Escherichia coli CFT073
gacggaagcuuaucacagagga

SEQ ID NO: 2651670 - RNA, 15 nt, Escherichia coli CFT073
gacggacgcccgccg

SEQ ID NO: 2651671 - RNA, 15 nt, Escherichia coli CFT073
gacggacgcgcggcg

SEQ ID NO: 2651672 - RNA, 19 nt, Escherichia coli CFT073
gacggacuucuuugucgua

SEQ ID NO: 2651673 - RNA, 16 nt, Escherichia coli CFT073
gacggaucuuccagcg

SEQ ID NO: 2651674 - RNA, 18 nt, Escherichia coli CFT073
gacggaucuuccagcgca

SEQ ID NO: 2651675 - RNA, 22 nt, Escherichia coli CFT073
gacggaucuuccagcgcaucgc

SEQ ID NO: 2651676 - RNA, 15 nt, Escherichia coli CFT073
gacggcaccaaaaau

SEQ ID NO: 2651677 - RNA, 21 nt, Escherichia coli CFT073
gacggccucugcggaggccgu

SEQ ID NO: 2651678 - RNA, 16 nt, Escherichia coli CFT073
gacggcgaccagaacu

SEQ ID NO: 2651679 - RNA, 15 nt, Escherichia coli CFT073
gacggcgagcguucg

SEQ ID NO: 2651680 - RNA, 23 nt, Escherichia coli CFT073
gacggcgcucuugcggcauuucg

SEQ ID NO: 2651681 - RNA, 15 nt, Escherichia coli CFT073
gacggcguucuuuac

SEQ ID NO: 2651682 - RNA, 19 nt, Escherichia coli CFT073
gacggcugucauccagcag

SEQ ID NO: 2651683 - RNA, 21 nt, Escherichia coli CFT073
gacgggcauuucgucuugcag

SEQ ID NO: 2651684 - RNA, 21 nt, Escherichia coli CFT073
gacgggcuaaucgucaucagc

SEQ ID NO: 2651685 - RNA, 19 nt, Escherichia coli CFT073
gacggggauucccacuuca

SEQ ID NO: 2651686 - RNA, 19 nt, Escherichia coli CFT073
gacggugauaaucauccca

SEQ ID NO: 2651687 - RNA, 16 nt, Escherichia coli CFT073
gacggugccagguaau

SEQ ID NO: 2651688 - RNA, 21 nt, Escherichia coli CFT073
gacgguugaucucaucuucca

SEQ ID NO: 2651689 - RNA, 16 nt, Escherichia coli CFT073
gacgguuuccaggcag

SEQ ID NO: 2651690 - RNA, 17 nt, Escherichia coli CFT073
gacgguuuccaggcagc

SEQ ID NO: 2651691 - RNA, 15 nt, Escherichia coli CFT073
gacguaaucaugaac

SEQ ID NO: 2651692 - RNA, 18 nt, Escherichia coli CFT073
gacguacaccauuuaaug

SEQ ID NO: 2651693 - RNA, 23 nt, Escherichia coli CFT073
gacguacaccauuuaaugacaaa

SEQ ID NO: 2651694 - RNA, 18 nt, Escherichia coli CFT073
gacguacaucagcggcaa

SEQ ID NO: 2651695 - RNA, 23 nt, Escherichia coli CFT073
gacguagaaaaucaccccgagcg

SEQ ID NO: 2651696 - RNA, 19 nt, Escherichia coli CFT073
gacgucagcagauggcaga

SEQ ID NO: 2651697 - RNA, 17 nt, Escherichia coli CFT073
gacgucaggccgccacu

SEQ ID NO: 2651698 - RNA, 15 nt, Escherichia coli CFT073
gacguccaaucagca

SEQ ID NO: 2651699 - RNA, 16 nt, Escherichia coli CFT073
gacguccaaucagcac

SEQ ID NO: 2651700 - RNA, 23 nt, Escherichia coli CFT073
gacguccagcccuucucgcuccu

SEQ ID NO: 2651701 - RNA, 15 nt, Escherichia coli CFT073
gacguccggcgcugc

SEQ ID NO: 2651702 - RNA, 19 nt, Escherichia coli CFT073
gacgucgguuuccagcauc

SEQ ID NO: 2651703 - RNA, 17 nt, Escherichia coli CFT073
gacgugauuccagacgg

SEQ ID NO: 2651704 - RNA, 21 nt, Escherichia coli CFT073
gacgugcacaaacuucuucag

SEQ ID NO: 2651705 - RNA, 20 nt, Escherichia coli CFT073
gacgugcaccgucacuucuu

SEQ ID NO: 2651706 - RNA, 15 nt, Escherichia coli CFT073
gacgugcagcaucga

SEQ ID NO: 2651707 - RNA, 18 nt, Escherichia coli CFT073
gacgugcaguagcagcag

SEQ ID NO: 2651708 - RNA, 23 nt, Escherichia coli CFT073
gacgugcaguagcagcaggaaua

SEQ ID NO: 2651709 - RNA, 18 nt, Escherichia coli CFT073
gacgugcucgaacauccc

SEQ ID NO: 2651710 - RNA, 14 nt, Escherichia coli CFT073
gacgugugauaaug

SEQ ID NO: 2651711 - RNA, 17 nt, Escherichia coli CFT073
gacguguugucagcuca

SEQ ID NO: 2651712 - RNA, 19 nt, Escherichia coli CFT073
gacguguugucagcucauc

SEQ ID NO: 2651713 - RNA, 16 nt, Escherichia coli CFT073
gacguuaagaucaaac

SEQ ID NO: 2651714 - RNA, 23 nt, Escherichia coli CFT073
gacguuacaaccacauauuacgg

SEQ ID NO: 2651715 - RNA, 14 nt, Escherichia coli CFT073
gacguuacgcgcca

SEQ ID NO: 2651716 - RNA, 15 nt, Escherichia coli CFT073
gacguuauugguggu

SEQ ID NO: 2651717 - RNA, 12 nt, Escherichia coli CFT073
gacguucagcca

SEQ ID NO: 2651718 - RNA, 14 nt, Escherichia coli CFT073
gacguucagccaua

SEQ ID NO: 2651719 - RNA, 13 nt, Escherichia coli CFT073
gacguucaguuca

SEQ ID NO: 2651720 - RNA, 13 nt, Escherichia coli CFT073
gacguucugccaa

SEQ ID NO: 2651721 - RNA, 14 nt, Escherichia coli CFT073
gacguucuuccugu

SEQ ID NO: 2651722 - RNA, 15 nt, Escherichia coli CFT073
gacguugauaaccac

SEQ ID NO: 2651723 - RNA, 15 nt, Escherichia coli CFT073
gacguuguccagcuu

SEQ ID NO: 2651724 - RNA, 15 nt, Escherichia coli CFT073
gacguuguugaauag

SEQ ID NO: 2651725 - RNA, 17 nt, Escherichia coli CFT073
gacguuucaucgcagac

SEQ ID NO: 2651726 - RNA, 22 nt, Escherichia coli CFT073
gacguuuuagccauaaacgggc

SEQ ID NO: 2651727 - RNA, 12 nt, Escherichia coli CFT073
gacuaacauccg

SEQ ID NO: 2651728 - RNA, 18 nt, Escherichia coli CFT073
gacuaagcgaucgcuaaa

SEQ ID NO: 2651729 - RNA, 20 nt, Escherichia coli CFT073
gacuagcagcauuucaaaac

SEQ ID NO: 2651730 - RNA, 11 nt, Escherichia coli CFT073
gacuaucacuc

SEQ ID NO: 2651731 - RNA, 14 nt, Escherichia coli CFT073
gacuauccgccaua

SEQ ID NO: 2651732 - RNA, 12 nt, Escherichia coli CFT073
gacuauuaauau

SEQ ID NO: 2651733 - RNA, 17 nt, Escherichia coli CFT073
gacuauuaauauauauu

SEQ ID NO: 2651734 - RNA, 13 nt, Escherichia coli CFT073
gacuauuucuuca

SEQ ID NO: 2651735 - RNA, 19 nt, Escherichia coli CFT073
gacucaaacggucagucgc

SEQ ID NO: 2651736 - RNA, 14 nt, Escherichia coli CFT073
gacucaccagcauc

SEQ ID NO: 2651737 - RNA, 21 nt, Escherichia coli CFT073
gacucacguuacuuaacaccc

SEQ ID NO: 2651738 - RNA, 18 nt, Escherichia coli CFT073
gacucauaaaaauauauu

SEQ ID NO: 2651739 - RNA, 18 nt, Escherichia coli CFT073
gacucccgcgccgcagcc

SEQ ID NO: 2651740 - RNA, 15 nt, Escherichia coli CFT073
gacuccgccgccauu

SEQ ID NO: 2651741 - RNA, 19 nt, Escherichia coli CFT073
gacucucgccagagaucgc

SEQ ID NO: 2651742 - RNA, 18 nt, Escherichia coli CFT073
gacucuguagcgggaaag

SEQ ID NO: 2651743 - RNA, 18 nt, Escherichia coli CFT073
gacucuguggcgggaaag

SEQ ID NO: 2651744 - RNA, 21 nt, Escherichia coli CFT073
gacucuguuaugguacuuucu

SEQ ID NO: 2651745 - RNA, 13 nt, Escherichia coli CFT073
gacugaaccagcg

SEQ ID NO: 2651746 - RNA, 18 nt, Escherichia coli CFT073
gacugaaccagcgccggu

SEQ ID NO: 2651747 - RNA, 12 nt, Escherichia coli CFT073
gacugacagacu

SEQ ID NO: 2651748 - RNA, 15 nt, Escherichia coli CFT073
gacugacagagaaca

SEQ ID NO: 2651749 - RNA, 19 nt, Escherichia coli CFT073
gagagacauuggcaaaacc

SEQ ID NO: 2651750 - RNA, 13 nt, Escherichia coli CFT073
gagagagaaaaua

SEQ ID NO: 2651751 - RNA, 21 nt, Escherichia coli CFT073
gagagauccugagaaauuagc

SEQ ID NO: 2651752 - RNA, 18 nt, Escherichia coli CFT073
gagagcaaccagcaaugc

SEQ ID NO: 2651753 - RNA, 19 nt, Escherichia coli CFT073
gagagcaaccagcaaugcc

SEQ ID NO: 2651754 - RNA, 15 nt, Escherichia coli CFT073
gagagccagccccac

SEQ ID NO: 2651755 - RNA, 15 nt, Escherichia coli CFT073
gagagccccagccgc

SEQ ID NO: 2651756 - RNA, 14 nt, Escherichia coli CFT073
gagagcgccgggca

SEQ ID NO: 2651757 - RNA, 21 nt, Escherichia coli CFT073
gagagcgccucauaugcggca

SEQ ID NO: 2651758 - RNA, 20 nt, Escherichia coli CFT073
gagagcuuauccagcaaagc

SEQ ID NO: 2651759 - RNA, 18 nt, Escherichia coli CFT073
gagaggccuucgacugau

SEQ ID NO: 2651760 - RNA, 17 nt, Escherichia coli CFT073
gagaggguuagggugag

SEQ ID NO: 2651761 - RNA, 19 nt, Escherichia coli CFT073
gagaggguuagggugaggg

SEQ ID NO: 2651762 - RNA, 16 nt, Escherichia coli CFT073
gagagucacgcagcau

SEQ ID NO: 2651763 - RNA, 17 nt, Escherichia coli CFT073
gagagucauuaugcugg

SEQ ID NO: 2651764 - RNA, 13 nt, Escherichia coli CFT073
gagaguuaccguu

SEQ ID NO: 2651765 - RNA, 19 nt, Escherichia coli CFT073
gagaguugcaccagcaaua

SEQ ID NO: 2651766 - RNA, 20 nt, Escherichia coli CFT073
gagaguuuguuucccccacu

SEQ ID NO: 2651767 - RNA, 16 nt, Escherichia coli CFT073
gagauaaaaucgagcg

SEQ ID NO: 2651768 - RNA, 19 nt, Escherichia coli CFT073
gagauaaacucacucugca

SEQ ID NO: 2651769 - RNA, 16 nt, Escherichia coli CFT073
gagauaacguuuagcg

SEQ ID NO: 2651770 - RNA, 20 nt, Escherichia coli CFT073
gagauaacuggcaaaaacaa

SEQ ID NO: 2651771 - RNA, 14 nt, Escherichia coli CFT073
gagauaaugcgcca

SEQ ID NO: 2651772 - RNA, 17 nt, Escherichia coli CFT073
gagauaauggcaauggu

SEQ ID NO: 2651773 - RNA, 21 nt, Escherichia coli CFT073
gagauaaugguuuccagcauc

SEQ ID NO: 2651774 - RNA, 18 nt, Escherichia coli CFT073
gagauaauucagcagagc

SEQ ID NO: 2651775 - RNA, 14 nt, Escherichia coli CFT073
gagauacaggccac

SEQ ID NO: 2651776 - RNA, 14 nt, Escherichia coli CFT073
gagauacucaagca

SEQ ID NO: 2651777 - RNA, 22 nt, Escherichia coli CFT073
gagauacucaagcaaccagguu

SEQ ID NO: 2651778 - RNA, 12 nt, Escherichia coli CFT073
gagauauucccc

SEQ ID NO: 2651779 - RNA, 24 nt, Escherichia coli CFT073
gagauauuucaccagcgcacguaa

SEQ ID NO: 2651780 - RNA, 18 nt, Escherichia coli CFT073
gagauauuuccuuguuaa

SEQ ID NO: 2651781 - RNA, 15 nt, Escherichia coli CFT073
gagaucaaugcgcca

SEQ ID NO: 2651782 - RNA, 16 nt, Escherichia coli CFT073
gagaucagauaauauu

SEQ ID NO: 2651783 - RNA, 19 nt, Escherichia coli CFT073
gagauccagcuucgccagc

SEQ ID NO: 2651784 - RNA, 14 nt, Escherichia coli CFT073
gagauccgcacuca

SEQ ID NO: 2651785 - RNA, 16 nt, Escherichia coli CFT073
gagauccgcacucaac

SEQ ID NO: 2651786 - RNA, 18 nt, Escherichia coli CFT073
gagaucggggucaacuuc

SEQ ID NO: 2651787 - RNA, 22 nt, Escherichia coli CFT073
gagaucguuaugcaaaugagaa

SEQ ID NO: 2651788 - RNA, 15 nt, Escherichia coli CFT073
gagaucuucgccauc

SEQ ID NO: 2651789 - RNA, 22 nt, Escherichia coli CFT073
gagaucuuucacgcccaguccg

SEQ ID NO: 2651790 - RNA, 20 nt, Escherichia coli CFT073
gagaugaaauacuaaauaug

SEQ ID NO: 2651791 - RNA, 18 nt, Escherichia coli CFT073
gagauguaauaacgcuua

SEQ ID NO: 2651792 - RNA, 18 nt, Escherichia coli CFT073
gagauucauccaguucca

SEQ ID NO: 2651793 - RNA, 16 nt, Escherichia coli CFT073
gagauuguaucccuuu

SEQ ID NO: 2651794 - RNA, 19 nt, Escherichia coli CFT073
gagauuuucuccugcgccu

SEQ ID NO: 2651795 - RNA, 20 nt, Escherichia coli CFT073
gagcaaaaucguaagcagga

SEQ ID NO: 2651796 - RNA, 19 nt, Escherichia coli CFT073
gagcaaacaguucugcagc

SEQ ID NO: 2651797 - RNA, 16 nt, Escherichia coli CFT073
gagcaaaccacaggcc

SEQ ID NO: 2651798 - RNA, 17 nt, Escherichia coli CFT073
gagcaaaccacaggccg

SEQ ID NO: 2651799 - RNA, 12 nt, Escherichia coli CFT073
gagcaaauaaaa

SEQ ID NO: 2651800 - RNA, 20 nt, Escherichia coli CFT073
gagcaaccagcaaugccagc

SEQ ID NO: 2651801 - RNA, 16 nt, Escherichia coli CFT073
gagcaaggcauaggcu

SEQ ID NO: 2651802 - RNA, 17 nt, Escherichia coli CFT073
gagcaaggcauaggcuu

SEQ ID NO: 2651803 - RNA, 17 nt, Escherichia coli CFT073
gagcaaggccaaauagg

SEQ ID NO: 2651804 - RNA, 10 nt, Escherichia coli CFT073
gagcaaugau

SEQ ID NO: 2651805 - RNA, 22 nt, Escherichia coli CFT073
gagcaauuuuuugcgccagcgc

SEQ ID NO: 2651806 - RNA, 22 nt, Escherichia coli CFT073
gagcacaaagccgugccagaug

SEQ ID NO: 2651807 - RNA, 22 nt, Escherichia coli CFT073
gagcacauauucuuugccgucu

SEQ ID NO: 2651808 - RNA, 18 nt, Escherichia coli CFT073
gagcacgaccuugccaag

SEQ ID NO: 2651809 - RNA, 17 nt, Escherichia coli CFT073
gagcacugcgcccgcca

SEQ ID NO: 2651810 - RNA, 20 nt, Escherichia coli CFT073
gagcacugcgcccgccagca

SEQ ID NO: 2651811 - RNA, 14 nt, Escherichia coli CFT073
gagcagcaaaaugg

SEQ ID NO: 2651812 - RNA, 19 nt, Escherichia coli CFT073
gagcagcaaccacuugcag

SEQ ID NO: 2651813 - RNA, 21 nt, Escherichia coli CFT073
gagcagggugaauaaaagaaa

SEQ ID NO: 2651814 - RNA, 17 nt, Escherichia coli CFT073
gagcaguaauccagcaa

SEQ ID NO: 2651815 - RNA, 23 nt, Escherichia coli CFT073
gagcaguaauccagcaaacuggc

SEQ ID NO: 2651816 - RNA, 21 nt, Escherichia coli CFT073
gagcaguagcgucgccagcag

SEQ ID NO: 2651817 - RNA, 18 nt, Escherichia coli CFT073
gagcaucgcccaggcgac

SEQ ID NO: 2651818 - RNA, 21 nt, Escherichia coli CFT073
gagcaucgguaucaucccagc

SEQ ID NO: 2651819 - RNA, 22 nt, Escherichia coli CFT073
gagcaucgugccggaaggaaga

SEQ ID NO: 2651820 - RNA, 17 nt, Escherichia coli CFT073
gagcaugcuccggccuu

SEQ ID NO: 2651821 - RNA, 20 nt, Escherichia coli CFT073
gagcaugguaacgccccaca

SEQ ID NO: 2651822 - RNA, 22 nt, Escherichia coli CFT073
gagcauuacuuucggugacuuc

SEQ ID NO: 2651823 - RNA, 17 nt, Escherichia coli CFT073
gagccaaacgcccagcu

SEQ ID NO: 2651824 - RNA, 19 nt, Escherichia coli CFT073
gagccaaacucauccacca

SEQ ID NO: 2651825 - RNA, 20 nt, Escherichia coli CFT073
gagccaaacucauccaccac

SEQ ID NO: 2651826 - RNA, 20 nt, Escherichia coli CFT073
gagccagcaccgcuggcuca

SEQ ID NO: 2651827 - RNA, 16 nt, Escherichia coli CFT073
gagccagccccacagc

SEQ ID NO: 2651828 - RNA, 21 nt, Escherichia coli CFT073
gagccaguacagcccgccgga

SEQ ID NO: 2651829 - RNA, 22 nt, Escherichia coli CFT073
gagccaguuggcguaccauuaa

SEQ ID NO: 2651830 - RNA, 13 nt, Escherichia coli CFT073
gagccaucaccau

SEQ ID NO: 2651831 - RNA, 15 nt, Escherichia coli CFT073
gagccaucccugcag

SEQ ID NO: 2651832 - RNA, 21 nt, Escherichia coli CFT073
gagccauugcccgaugcgcaa

SEQ ID NO: 2651833 - RNA, 18 nt, Escherichia coli CFT073
gagcccgcuucgccugcc

SEQ ID NO: 2651834 - RNA, 19 nt, Escherichia coli CFT073
gagcccucaagccacuucc

SEQ ID NO: 2651835 - RNA, 15 nt, Escherichia coli CFT073
gagccgauauccgga

SEQ ID NO: 2651836 - RNA, 21 nt, Escherichia coli CFT073
gagccgccgcauuauggugaa

SEQ ID NO: 2651837 - RNA, 22 nt, Escherichia coli CFT073
gagccgguuuugguuuucuguc

SEQ ID NO: 2651838 - RNA, 17 nt, Escherichia coli CFT073
gagccgucgcuaucgau

SEQ ID NO: 2651839 - RNA, 17 nt, Escherichia coli CFT073
gagccuucggggcucgu

SEQ ID NO: 2651840 - RNA, 23 nt, Escherichia coli CFT073
gagccuucggggcucguuuuugu

SEQ ID NO: 2651841 - RNA, 16 nt, Escherichia coli CFT073
gagcgaauaucauugc

SEQ ID NO: 2651842 - RNA, 14 nt, Escherichia coli CFT073
gagcgacaaacucc

SEQ ID NO: 2651843 - RNA, 22 nt, Escherichia coli CFT073
gagcgauggcgggaucgccgga

SEQ ID NO: 2651844 - RNA, 16 nt, Escherichia coli CFT073
gagcgcaaauugcugg

SEQ ID NO: 2651845 - RNA, 13 nt, Escherichia coli CFT073
gagcgcaagccac

SEQ ID NO: 2651846 - RNA, 17 nt, Escherichia coli CFT073
gagcgcaagccacgggc

SEQ ID NO: 2651847 - RNA, 13 nt, Escherichia coli CFT073
gagcgccauaucg

SEQ ID NO: 2651848 - RNA, 16 nt, Escherichia coli CFT073
gagcgccauaucggca

SEQ ID NO: 2651849 - RNA, 17 nt, Escherichia coli CFT073
gagcgccccagaccuga

SEQ ID NO: 2651850 - RNA, 22 nt, Escherichia coli CFT073
gagcgccgauuucucaucaauu

SEQ ID NO: 2651851 - RNA, 20 nt, Escherichia coli CFT073
gagcgccugucugcaaaaau

SEQ ID NO: 2651852 - RNA, 19 nt, Escherichia coli CFT073
gagcgccuuauccggccua

SEQ ID NO: 2651853 - RNA, 14 nt, Escherichia coli CFT073
gagcgcgaaaccuu

SEQ ID NO: 2651854 - RNA, 14 nt, Escherichia coli CFT073
gagcgcgaggugga

SEQ ID NO: 2651855 - RNA, 16 nt, Escherichia coli CFT073
gagcgcguaguucagg

SEQ ID NO: 2651856 - RNA, 17 nt, Escherichia coli CFT073
gagcgcuuuuuccugcc

SEQ ID NO: 2651857 - RNA, 23 nt, Escherichia coli CFT073
gauaaucagaucguugaccugga

SEQ ID NO: 2651858 - RNA, 16 nt, Escherichia coli CFT073
gauaaucagcgccagc

SEQ ID NO: 2651859 - RNA, 23 nt, Escherichia coli CFT073
gauaaucaucccacaugaauucg

SEQ ID NO: 2651860 - RNA, 21 nt, Escherichia coli CFT073
gauaauccagcagaugcugug

SEQ ID NO: 2651861 - RNA, 13 nt, Escherichia coli CFT073
gauaauccaggac

SEQ ID NO: 2651862 - RNA, 16 nt, Escherichia coli CFT073
gauaaucggugcggca

SEQ ID NO: 2651863 - RNA, 17 nt, Escherichia coli CFT073
gauaaucguuugcaucc

SEQ ID NO: 2651864 - RNA, 15 nt, Escherichia coli CFT073
gauaaucuucaaaua

SEQ ID NO: 2651865 - RNA, 18 nt, Escherichia coli CFT073
gauaaugaaccaaucagc

SEQ ID NO: 2651866 - RNA, 19 nt, Escherichia coli CFT073
gauaaugaaugaugcggcg

SEQ ID NO: 2651867 - RNA, 24 nt, Escherichia coli CFT073
gauaaugcgccagacgugcacgca

SEQ ID NO: 2651868 - RNA, 22 nt, Escherichia coli CFT073
gauaauggagccagaucugcuu

SEQ ID NO: 2651869 - RNA, 14 nt, Escherichia coli CFT073
gauaauggcaaugg

SEQ ID NO: 2651870 - RNA, 12 nt, Escherichia coli CFT073
gauaauggcugu

SEQ ID NO: 2651871 - RNA, 17 nt, Escherichia coli CFT073
gauaaugggaauuggcg

SEQ ID NO: 2651872 - RNA, 21 nt, Escherichia coli CFT073
gauaaugggcgguuggccuga

SEQ ID NO: 2651873 - RNA, 20 nt, Escherichia coli CFT073
gauaaugguuuccagcaucg

SEQ ID NO: 2651874 - RNA, 16 nt, Escherichia coli CFT073
gauaauguuaaccugc

SEQ ID NO: 2651875 - RNA, 20 nt, Escherichia coli CFT073
gauaauguuaaccugcagga

SEQ ID NO: 2651876 - RNA, 18 nt, Escherichia coli CFT073
gauaauuaauccuucucc

SEQ ID NO: 2651877 - RNA, 20 nt, Escherichia coli CFT073
gauaauuagugcugcuggaa

SEQ ID NO: 2651878 - RNA, 16 nt, Escherichia coli CFT073
gauaauucaacagauu

SEQ ID NO: 2651879 - RNA, 14 nt, Escherichia coli CFT073
gauaauucagcaga

SEQ ID NO: 2651880 - RNA, 23 nt, Escherichia coli CFT073
gauaauuuauaacuuuaguauca

SEQ ID NO: 2651881 - RNA, 15 nt, Escherichia coli CFT073
gauaauuuugaaaua

SEQ ID NO: 2651882 - RNA, 23 nt, Escherichia coli CFT073
gauacaacugccgcgccugaauc

SEQ ID NO: 2651883 - RNA, 18 nt, Escherichia coli CFT073
gauacaagccacaucgcc

SEQ ID NO: 2651884 - RNA, 20 nt, Escherichia coli CFT073
gauacacaccgagcguggcg

SEQ ID NO: 2651885 - RNA, 23 nt, Escherichia coli CFT073
gauacacagcccaguuuuucagg

SEQ ID NO: 2651886 - RNA, 19 nt, Escherichia coli CFT073
gauacaccgcgaagcagcu

SEQ ID NO: 2651887 - RNA, 23 nt, Escherichia coli CFT073
gauacaccuucaucguuucugcc

SEQ ID NO: 2651888 - RNA, 16 nt, Escherichia coli CFT073
gauacacggugcgaug

SEQ ID NO: 2651889 - RNA, 12 nt, Escherichia coli CFT073
gauacagaaagu

SEQ ID NO: 2651890 - RNA, 15 nt, Escherichia coli CFT073
gauacagccaaauca

SEQ ID NO: 2651891 - RNA, 12 nt, Escherichia coli CFT073
gauacagccgac

SEQ ID NO: 2651892 - RNA, 22 nt, Escherichia coli CFT073
gauacagccgacaauaccacaa

SEQ ID NO: 2651893 - RNA, 20 nt, Escherichia coli CFT073
gauacaggccaccaggccac

SEQ ID NO: 2651894 - RNA, 12 nt, Escherichia coli CFT073
gauacauuucag

SEQ ID NO: 2651895 - RNA, 16 nt, Escherichia coli CFT073
gauaccaacccuggug

SEQ ID NO: 2651896 - RNA, 15 nt, Escherichia coli CFT073
gauaccaccagcgcc

SEQ ID NO: 2651897 - RNA, 17 nt, Escherichia coli CFT073
gauaccagauuaauuau

SEQ ID NO: 2651898 - RNA, 13 nt, Escherichia coli CFT073
gauaccaguaaaa

SEQ ID NO: 2651899 - RNA, 21 nt, Escherichia coli CFT073
gauacccgacagauaaaucau

SEQ ID NO: 2651900 - RNA, 16 nt, Escherichia coli CFT073
gauaccgugcagcacg

SEQ ID NO: 2651901 - RNA, 17 nt, Escherichia coli CFT073
gauacgaucaucuggcg

SEQ ID NO: 2651902 - RNA, 18 nt, Escherichia coli CFT073
gauacgcgccaaucggca

SEQ ID NO: 2651903 - RNA, 17 nt, Escherichia coli CFT073
gauacgcgucccggaau

SEQ ID NO: 2651904 - RNA, 17 nt, Escherichia coli CFT073
gauacgcuucaaccagu

SEQ ID NO: 2651905 - RNA, 18 nt, Escherichia coli CFT073
gauacgcuucaaccaguu

SEQ ID NO: 2651906 - RNA, 21 nt, Escherichia coli CFT073
gauacgcuucaaccaguuucu

SEQ ID NO: 2651907 - RNA, 19 nt, Escherichia coli CFT073
gauacggaaauccucuuuu

SEQ ID NO: 2651908 - RNA, 23 nt, Escherichia coli CFT073
gauacggaauaucgcuggccucc

SEQ ID NO: 2651909 - RNA, 20 nt, Escherichia coli CFT073
gauacggaucgacagcaacu

SEQ ID NO: 2651910 - RNA, 17 nt, Escherichia coli CFT073
gauacggucaggauaau

SEQ ID NO: 2651911 - RNA, 20 nt, Escherichia coli CFT073
gauacggucaguuuucgccc

SEQ ID NO: 2651912 - RNA, 22 nt, Escherichia coli CFT073
gauacggugcacaaugccugau

SEQ ID NO: 2651913 - RNA, 20 nt, Escherichia coli CFT073
gauacgguuuuuugaacaga

SEQ ID NO: 2651914 - RNA, 21 nt, Escherichia coli CFT073
gauacgguuuuuugaacagac

SEQ ID NO: 2651915 - RNA, 22 nt, Escherichia coli CFT073
gauacgguuuuuugaacagacc

SEQ ID NO: 2651916 - RNA, 20 nt, Escherichia coli CFT073
gauacguagcgcaacaggca

SEQ ID NO: 2651917 - RNA, 15 nt, Escherichia coli CFT073
gauacguugccguau

SEQ ID NO: 2651918 - RNA, 21 nt, Escherichia coli CFT073
gauacguuuuaaugauuucca

SEQ ID NO: 2651919 - RNA, 16 nt, Escherichia coli CFT073
gauacucaagcaacca

SEQ ID NO: 2651920 - RNA, 13 nt, Escherichia coli CFT073
gauacucaguccg

SEQ ID NO: 2651921 - RNA, 13 nt, Escherichia coli CFT073
gauacucugccau

SEQ ID NO: 2651922 - RNA, 12 nt, Escherichia coli CFT073
gauacugccuuu

SEQ ID NO: 2651923 - RNA, 18 nt, Escherichia coli CFT073
gauacuggaaaaucuggc

SEQ ID NO: 2651924 - RNA, 19 nt, Escherichia coli CFT073
gauacuggaaaaucuggcg

SEQ ID NO: 2651925 - RNA, 21 nt, Escherichia coli CFT073
gauacuggaaaaucuggcgcg

SEQ ID NO: 2651926 - RNA, 15 nt, Escherichia coli CFT073
gauagaacugcggca

SEQ ID NO: 2651927 - RNA, 20 nt, Escherichia coli CFT073
gauagagagcagucagguuc

SEQ ID NO: 2651928 - RNA, 14 nt, Escherichia coli CFT073
gauagauuucucua

SEQ ID NO: 2651929 - RNA, 15 nt, Escherichia coli CFT073
gauagauuucucuaa

SEQ ID NO: 2651930 - RNA, 16 nt, Escherichia coli CFT073
gauagauuucucuaaa

SEQ ID NO: 2651931 - RNA, 11 nt, Escherichia coli CFT073
gauagcaaugc

SEQ ID NO: 2651932 - RNA, 12 nt, Escherichia coli CFT073
gauagccaggcg

SEQ ID NO: 2651933 - RNA, 22 nt, Escherichia coli CFT073
gauagccagguuuaccagcagc

SEQ ID NO: 2651934 - RNA, 20 nt, Escherichia coli CFT073
gauagcccaacgaucccaac

SEQ ID NO: 2651935 - RNA, 19 nt, Escherichia coli CFT073
gauagccgaccgcaaggaa

SEQ ID NO: 2651936 - RNA, 15 nt, Escherichia coli CFT073
gauagccgccccaga

SEQ ID NO: 2651937 - RNA, 15 nt, Escherichia coli CFT073
gauagcgaaccgcag

SEQ ID NO: 2651938 - RNA, 21 nt, Escherichia coli CFT073
gauagcgaccaguuugccuuu

SEQ ID NO: 2651939 - RNA, 20 nt, Escherichia coli CFT073
gauagcguucuuuaacugcc

SEQ ID NO: 2651940 - RNA, 16 nt, Escherichia coli CFT073
gauagcuaaucaucug

SEQ ID NO: 2651941 - RNA, 14 nt, Escherichia coli CFT073
gauagcuguaccug

SEQ ID NO: 2651942 - RNA, 20 nt, Escherichia coli CFT073
gauagcugucccagucuuuc

SEQ ID NO: 2651943 - RNA, 19 nt, Escherichia coli CFT073
gauagcuuacggcgcugug

SEQ ID NO: 2651944 - RNA, 20 nt, Escherichia coli CFT073
gauagggcuguuuagcugaa

SEQ ID NO: 2651945 - RNA, 14 nt, Escherichia coli CFT073
gauaggucauauca

SEQ ID NO: 2651946 - RNA, 13 nt, Escherichia coli CFT073
gauagguuucacg

SEQ ID NO: 2651947 - RNA, 15 nt, Escherichia coli CFT073
gauagucgaaucagu

SEQ ID NO: 2651948 - RNA, 18 nt, Escherichia coli CFT073
gauaguggaacaaagaaa

SEQ ID NO: 2651949 - RNA, 14 nt, Escherichia coli CFT073
gauaguggcucagg

SEQ ID NO: 2651950 - RNA, 22 nt, Escherichia coli CFT073
gauaguggcucaggcucucauu

SEQ ID NO: 2651951 - RNA, 22 nt, Escherichia coli CFT073
gauagugugcgaucgagauuca

SEQ ID NO: 2651952 - RNA, 15 nt, Escherichia coli CFT073
gauauaaaaauaaca

SEQ ID NO: 2651953 - RNA, 22 nt, Escherichia coli CFT073
gauauaaccauccgagcagcaa

SEQ ID NO: 2651954 - RNA, 17 nt, Escherichia coli CFT073
gauauacaccggcauca

SEQ ID NO: 2651955 - RNA, 15 nt, Escherichia coli CFT073
gauauacguguacgu

SEQ ID NO: 2651956 - RNA, 22 nt, Escherichia coli CFT073
gauauacguguacguugaugga

SEQ ID NO: 2651957 - RNA, 16 nt, Escherichia coli CFT073
gauauacguucgccca

SEQ ID NO: 2651958 - RNA, 19 nt, Escherichia coli CFT073
gauauagccuaacacagca

SEQ ID NO: 2651959 - RNA, 19 nt, Escherichia coli CFT073
gauauagcguaaagccagc

SEQ ID NO: 2651960 - RNA, 15 nt, Escherichia coli CFT073
gauauaugucaccag

SEQ ID NO: 2651961 - RNA, 15 nt, Escherichia coli CFT073
gauaucaccaauuuu

SEQ ID NO: 2651962 - RNA, 19 nt, Escherichia coli CFT073
gauaucaggcaaacagaau

SEQ ID NO: 2651963 - RNA, 20 nt, Escherichia coli CFT073
gauaucccgccagcaccagc

SEQ ID NO: 2651964 - RNA, 14 nt, Escherichia coli CFT073
gauauccugauauu

SEQ ID NO: 2651965 - RNA, 19 nt, Escherichia coli CFT073
gaucaugaugaugccaaaa

SEQ ID NO: 2651966 - RNA, 23 nt, Escherichia coli CFT073
gaucaugaugaugccaaaaugca

SEQ ID NO: 2651967 - RNA, 15 nt, Escherichia coli CFT073
gaucaugccgacaaa

SEQ ID NO: 2651968 - RNA, 14 nt, Escherichia coli CFT073
gaucauggcuggca

SEQ ID NO: 2651969 - RNA, 15 nt, Escherichia coli CFT073
gaucauggcuggcau

SEQ ID NO: 2651970 - RNA, 21 nt, Escherichia coli CFT073
gaucauggucugcgccgcauu

SEQ ID NO: 2651971 - RNA, 14 nt, Escherichia coli CFT073
gaucauuaaccagu

SEQ ID NO: 2651972 - RNA, 13 nt, Escherichia coli CFT073
gaucauucaccag

SEQ ID NO: 2651973 - RNA, 15 nt, Escherichia coli CFT073
gaucauucaccagcc

SEQ ID NO: 2651974 - RNA, 15 nt, Escherichia coli CFT073
gauccaccaccgcaa

SEQ ID NO: 2651975 - RNA, 16 nt, Escherichia coli CFT073
gauccacgccaucccc

SEQ ID NO: 2651976 - RNA, 20 nt, Escherichia coli CFT073
gauccagaacugcgagauga

SEQ ID NO: 2651977 - RNA, 16 nt, Escherichia coli CFT073
gauccagcgcaauacc

SEQ ID NO: 2651978 - RNA, 11 nt, Escherichia coli CFT073
gauccagcgcg

SEQ ID NO: 2651979 - RNA, 15 nt, Escherichia coli CFT073
gauccagcucuuccu

SEQ ID NO: 2651980 - RNA, 22 nt, Escherichia coli CFT073
gauccagcuugucagacggugc

SEQ ID NO: 2651981 - RNA, 14 nt, Escherichia coli CFT073
gauccagugcguau

SEQ ID NO: 2651982 - RNA, 21 nt, Escherichia coli CFT073
gauccauacucuuucccggca

SEQ ID NO: 2651983 - RNA, 14 nt, Escherichia coli CFT073
gauccaugccgcca

SEQ ID NO: 2651984 - RNA, 16 nt, Escherichia coli CFT073
gaucccagagcgggca

SEQ ID NO: 2651985 - RNA, 19 nt, Escherichia coli CFT073
gaucccaugccgaaugccg

SEQ ID NO: 2651986 - RNA, 14 nt, Escherichia coli CFT073
gauccccgcagcaa

SEQ ID NO: 2651987 - RNA, 17 nt, Escherichia coli CFT073
gauccccgcagcaaaca

SEQ ID NO: 2651988 - RNA, 22 nt, Escherichia coli CFT073
gauccccggccaguccagagcc

SEQ ID NO: 2651989 - RNA, 19 nt, Escherichia coli CFT073
gauccccugcccgauaaaa

SEQ ID NO: 2651990 - RNA, 14 nt, Escherichia coli CFT073
gaucccgacgugau

SEQ ID NO: 2651991 - RNA, 16 nt, Escherichia coli CFT073
gaucccgauaccagua

SEQ ID NO: 2651992 - RNA, 21 nt, Escherichia coli CFT073
gaucccggagaagagauaaac

SEQ ID NO: 2651993 - RNA, 16 nt, Escherichia coli CFT073
gaucccugcaacaccc

SEQ ID NO: 2651994 - RNA, 17 nt, Escherichia coli CFT073
gauccggcagagguaca

SEQ ID NO: 2651995 - RNA, 18 nt, Escherichia coli CFT073
gauccguccgacggcauu

SEQ ID NO: 2651996 - RNA, 16 nt, Escherichia coli CFT073
gauccugagcaaacag

SEQ ID NO: 2651997 - RNA, 17 nt, Escherichia coli CFT073
gauccugagccaguuuu

SEQ ID NO: 2651998 - RNA, 17 nt, Escherichia coli CFT073
gauccugcaacaacacc

SEQ ID NO: 2651999 - RNA, 14 nt, Escherichia coli CFT073
gauccuggauuucu

SEQ ID NO: 2652000 - RNA, 15 nt, Escherichia coli CFT073
gauccuggcuguauu

SEQ ID NO: 2652001 - RNA, 23 nt, Escherichia coli CFT073
gauccuggcuguauuuuuccagc

SEQ ID NO: 2652002 - RNA, 17 nt, Escherichia coli CFT073
gauccuggucaaagugg

SEQ ID NO: 2652003 - RNA, 14 nt, Escherichia coli CFT073
gauccuugcggauc

SEQ ID NO: 2652004 - RNA, 23 nt, Escherichia coli CFT073
gaucgaacauuugcguggcgcgc

SEQ ID NO: 2652005 - RNA, 14 nt, Escherichia coli CFT073
gaucgacaguugcu

SEQ ID NO: 2652006 - RNA, 18 nt, Escherichia coli CFT073
gaucgacaguugcugcgu

SEQ ID NO: 2652007 - RNA, 22 nt, Escherichia coli CFT073
gaucgacgugggcgugggaaua

SEQ ID NO: 2652008 - RNA, 20 nt, Escherichia coli CFT073
gaucgagaauauucacgaca

SEQ ID NO: 2652009 - RNA, 14 nt, Escherichia coli CFT073
gaucgcacuuaauc

SEQ ID NO: 2652010 - RNA, 22 nt, Escherichia coli CFT073
gaucgccacuuucacgccgcca

SEQ ID NO: 2652011 - RNA, 11 nt, Escherichia coli CFT073
gaucgccagag

SEQ ID NO: 2652012 - RNA, 23 nt, Escherichia coli CFT073
gaucgccagcccuuucagcccac

SEQ ID NO: 2652013 - RNA, 14 nt, Escherichia coli CFT073
gaucgccaucagcg

SEQ ID NO: 2652014 - RNA, 22 nt, Escherichia coli CFT073
gaucgccccggaagcaucaaac

SEQ ID NO: 2652015 - RNA, 19 nt, Escherichia coli CFT073
gaucgccguuaaccaugca

SEQ ID NO: 2652016 - RNA, 22 nt, Escherichia coli CFT073
gaucgcgcaguaaauccgccac

SEQ ID NO: 2652017 - RNA, 21 nt, Escherichia coli CFT073
gaucgcggcuauucaccacuu

SEQ ID NO: 2652018 - RNA, 17 nt, Escherichia coli CFT073
gaucgcgguaacagaug

SEQ ID NO: 2652019 - RNA, 20 nt, Escherichia coli CFT073
gaucgcguaaggcuucaauc

SEQ ID NO: 2652020 - RNA, 20 nt, Escherichia coli CFT073
gaucgcugaacgcaccuucc

SEQ ID NO: 2652021 - RNA, 13 nt, Escherichia coli CFT073
gaucgcuggcagc

SEQ ID NO: 2652022 - RNA, 21 nt, Escherichia coli CFT073
gaucgcuuucaacguagccug

SEQ ID NO: 2652023 - RNA, 21 nt, Escherichia coli CFT073
gaucggacuucaugcgcagca

SEQ ID NO: 2652024 - RNA, 15 nt, Escherichia coli CFT073
gaucgguagaccgga

SEQ ID NO: 2652025 - RNA, 15 nt, Escherichia coli CFT073
gaucgucagcacuca

SEQ ID NO: 2652026 - RNA, 15 nt, Escherichia coli CFT073
gaucgugugccacca

SEQ ID NO: 2652027 - RNA, 22 nt, Escherichia coli CFT073
gaucguguggauaauccauccc

SEQ ID NO: 2652028 - RNA, 16 nt, Escherichia coli CFT073
gaucuaucuggcgcgc

SEQ ID NO: 2652029 - RNA, 17 nt, Escherichia coli CFT073
gaucuccacccgcaaau

SEQ ID NO: 2652030 - RNA, 23 nt, Escherichia coli CFT073
gaucuccuccagcgcuuccagaa

SEQ ID NO: 2652031 - RNA, 19 nt, Escherichia coli CFT073
gaucucgccagagagcgga

SEQ ID NO: 2652032 - RNA, 17 nt, Escherichia coli CFT073
gaucucuuuauuugauu

SEQ ID NO: 2652033 - RNA, 19 nt, Escherichia coli CFT073
gaucugacauuugcaucca

SEQ ID NO: 2652034 - RNA, 18 nt, Escherichia coli CFT073
gaucugacgugcacaaac

SEQ ID NO: 2652035 - RNA, 19 nt, Escherichia coli CFT073
gaucugacgugcacaaacu

SEQ ID NO: 2652036 - RNA, 14 nt, Escherichia coli CFT073
gaucugauuuucuu

SEQ ID NO: 2652037 - RNA, 15 nt, Escherichia coli CFT073
gaucugauuuucuuc

SEQ ID NO: 2652038 - RNA, 18 nt, Escherichia coli CFT073
gaucugcgucgcuuucca

SEQ ID NO: 2652039 - RNA, 11 nt, Escherichia coli CFT073
gaucugcugcc

SEQ ID NO: 2652040 - RNA, 18 nt, Escherichia coli CFT073
gaucuggaauggaaacag

SEQ ID NO: 2652041 - RNA, 20 nt, Escherichia coli CFT073
gaucuggaauggaaacagca

SEQ ID NO: 2652042 - RNA, 21 nt, Escherichia coli CFT073
gaucuggaauggaaacagcac

SEQ ID NO: 2652043 - RNA, 20 nt, Escherichia coli CFT073
gaucuguuuaucgcgcaacc

SEQ ID NO: 2652044 - RNA, 12 nt, Escherichia coli CFT073
gaucuuccagcg

SEQ ID NO: 2652045 - RNA, 14 nt, Escherichia coli CFT073
gaucuuccaguucu

SEQ ID NO: 2652046 - RNA, 14 nt, Escherichia coli CFT073
gaucuuccgaccgc

SEQ ID NO: 2652047 - RNA, 11 nt, Escherichia coli CFT073
gaucuucucuu

SEQ ID NO: 2652048 - RNA, 17 nt, Escherichia coli CFT073
gaucuuugacugaaauu

SEQ ID NO: 2652049 - RNA, 19 nt, Escherichia coli CFT073
gaucuuugacugaaauuua

SEQ ID NO: 2652050 - RNA, 23 nt, Escherichia coli CFT073
gaugaaaaaaccagaaagggaag

SEQ ID NO: 2652051 - RNA, 19 nt, Escherichia coli CFT073
gaugaaaagauuaacguga

SEQ ID NO: 2652052 - RNA, 22 nt, Escherichia coli CFT073
gaugaaauacuaaauaugaaaa

SEQ ID NO: 2652053 - RNA, 16 nt, Escherichia coli CFT073
gaugaaauaguugcau

SEQ ID NO: 2652054 - RNA, 18 nt, Escherichia coli CFT073
gaugaacgcgcagaucau

SEQ ID NO: 2652055 - RNA, 18 nt, Escherichia coli CFT073
gaugaacggugcgcaggc

SEQ ID NO: 2652056 - RNA, 23 nt, Escherichia coli CFT073
gaugaauaacccuaaagcaccca

SEQ ID NO: 2652057 - RNA, 16 nt, Escherichia coli CFT073
gaugacaacaccaucg

SEQ ID NO: 2652058 - RNA, 17 nt, Escherichia coli CFT073
gaugacagaaucagcag

SEQ ID NO: 2652059 - RNA, 19 nt, Escherichia coli CFT073
gaugacagaaucagcagcg

SEQ ID NO: 2652060 - RNA, 17 nt, Escherichia coli CFT073
gaugacccagcgccagc

SEQ ID NO: 2652061 - RNA, 13 nt, Escherichia coli CFT073
gaugaccgguucu

SEQ ID NO: 2652062 - RNA, 21 nt, Escherichia coli CFT073
gaugagaaauauuuucagggg

SEQ ID NO: 2652063 - RNA, 13 nt, Escherichia coli CFT073
gaugagaacacca

SEQ ID NO: 2652064 - RNA, 18 nt, Escherichia coli CFT073
gaugagaucccgauacca

SEQ ID NO: 2652065 - RNA, 14 nt, Escherichia coli CFT073
gaugagcgccauau

SEQ ID NO: 2652066 - RNA, 17 nt, Escherichia coli CFT073
gaugaguaucuuauuga

SEQ ID NO: 2652067 - RNA, 22 nt, Escherichia coli CFT073
gaugaguaucuuauugaaagau

SEQ ID NO: 2652068 - RNA, 15 nt, Escherichia coli CFT073
gaugauacuugcacc

SEQ ID NO: 2652069 - RNA, 19 nt, Escherichia coli CFT073
gaugaucaaaaaaaucuuc

SEQ ID NO: 2652070 - RNA, 17 nt, Escherichia coli CFT073
gaugaucaucaucgcga

SEQ ID NO: 2652071 - RNA, 18 nt, Escherichia coli CFT073
gaugaucaucaucgcgau

SEQ ID NO: 2652072 - RNA, 18 nt, Escherichia coli CFT073
gaugaucauccacgacca

SEQ ID NO: 2652073 - RNA, 15 nt, Escherichia coli CFT073
gaugguuuuauagcg

SEQ ID NO: 2652074 - RNA, 17 nt, Escherichia coli CFT073
gauguaauuaagcgcaa

SEQ ID NO: 2652075 - RNA, 15 nt, Escherichia coli CFT073
gauguaauucagcca

SEQ ID NO: 2652076 - RNA, 16 nt, Escherichia coli CFT073
gauguagcgauuuacu

SEQ ID NO: 2652077 - RNA, 19 nt, Escherichia coli CFT073
gauguagcgugauuuugua

SEQ ID NO: 2652078 - RNA, 20 nt, Escherichia coli CFT073
gaugucauaaaucagcguga

SEQ ID NO: 2652079 - RNA, 16 nt, Escherichia coli CFT073
gauguccugcggacag

SEQ ID NO: 2652080 - RNA, 22 nt, Escherichia coli CFT073
gaugucgagguaugcuccggca

SEQ ID NO: 2652081 - RNA, 19 nt, Escherichia coli CFT073
gaugucgauaucaggcaaa

SEQ ID NO: 2652082 - RNA, 17 nt, Escherichia coli CFT073
gaugucgcgcacugggu

SEQ ID NO: 2652083 - RNA, 15 nt, Escherichia coli CFT073
gaugugaacugacuc

SEQ ID NO: 2652084 - RNA, 18 nt, Escherichia coli CFT073
gaugugaggcugauuugc

SEQ ID NO: 2652085 - RNA, 14 nt, Escherichia coli CFT073
gaugugcuccauca

SEQ ID NO: 2652086 - RNA, 14 nt, Escherichia coli CFT073
gaugugcuucagcu

SEQ ID NO: 2652087 - RNA, 18 nt, Escherichia coli CFT073
gauguggcucagccagac

SEQ ID NO: 2652088 - RNA, 15 nt, Escherichia coli CFT073
gauuaaaccaaccac

SEQ ID NO: 2652089 - RNA, 19 nt, Escherichia coli CFT073
gauuaaacgggucaucaaa

SEQ ID NO: 2652090 - RNA, 16 nt, Escherichia coli CFT073
gauuaaacuggcacgc

SEQ ID NO: 2652091 - RNA, 17 nt, Escherichia coli CFT073
gauuaaacuucaccagc

SEQ ID NO: 2652092 - RNA, 22 nt, Escherichia coli CFT073
gauuaacagcccaugacaggca

SEQ ID NO: 2652093 - RNA, 16 nt, Escherichia coli CFT073
gauuaacgugaccgcu

SEQ ID NO: 2652094 - RNA, 22 nt, Escherichia coli CFT073
gauuaagaucgugcagcaccgc

SEQ ID NO: 2652095 - RNA, 17 nt, Escherichia coli CFT073
gauuaagugaaccuuaa

SEQ ID NO: 2652096 - RNA, 22 nt, Escherichia coli CFT073
gauuaauaaggaugcaacacau

SEQ ID NO: 2652097 - RNA, 17 nt, Escherichia coli CFT073
gauuaccagagaaaaga

SEQ ID NO: 2652098 - RNA, 14 nt, Escherichia coli CFT073
gauuaccauuucac

SEQ ID NO: 2652099 - RNA, 21 nt, Escherichia coli CFT073
gauuaccgcaaacucaucgcc

SEQ ID NO: 2652100 - RNA, 16 nt, Escherichia coli CFT073
gauuaccgccuucacc

SEQ ID NO: 2652101 - RNA, 23 nt, Escherichia coli CFT073
gauuaccgugaaucggacgugau

SEQ ID NO: 2652102 - RNA, 16 nt, Escherichia coli CFT073
gauuaccuaccaacgc

SEQ ID NO: 2652103 - RNA, 22 nt, Escherichia coli CFT073
gauuaccugucgcgucaaucac

SEQ ID NO: 2652104 - RNA, 21 nt, Escherichia coli CFT073
gauuaccuuccugccagaucc

SEQ ID NO: 2652105 - RNA, 17 nt, Escherichia coli CFT073
gauuacgcaucaccccu

SEQ ID NO: 2652106 - RNA, 16 nt, Escherichia coli CFT073
gauuacguaccagaua

SEQ ID NO: 2652107 - RNA, 15 nt, Escherichia coli CFT073
gauuacguacugcaa

SEQ ID NO: 2652108 - RNA, 19 nt, Escherichia coli CFT073
gauuacucccuugccugca

SEQ ID NO: 2652109 - RNA, 22 nt, Escherichia coli CFT073
gauuacucccuugccugcagga

SEQ ID NO: 2652110 - RNA, 21 nt, Escherichia coli CFT073
gauuacuuaacuuccaucccu

SEQ ID NO: 2652111 - RNA, 19 nt, Escherichia coli CFT073
gauuagacggcgcaacauc

SEQ ID NO: 2652112 - RNA, 15 nt, Escherichia coli CFT073
gauuagccauucuuu

SEQ ID NO: 2652113 - RNA, 21 nt, Escherichia coli CFT073
gauuagucugguugagcagua

SEQ ID NO: 2652114 - RNA, 12 nt, Escherichia coli CFT073
gauuaucaugcc

SEQ ID NO: 2652115 - RNA, 17 nt, Escherichia coli CFT073
gauuaucaugcccuuuu

SEQ ID NO: 2652116 - RNA, 15 nt, Escherichia coli CFT073
gauuauccaugccac

SEQ ID NO: 2652117 - RNA, 21 nt, Escherichia coli CFT073
gauuaucccauauaccuacuc

SEQ ID NO: 2652118 - RNA, 12 nt, Escherichia coli CFT073
gauuaucccccg

SEQ ID NO: 2652119 - RNA, 15 nt, Escherichia coli CFT073
gauuaucuucgcacu

SEQ ID NO: 2652120 - RNA, 14 nt, Escherichia coli CFT073
gauuauuacucaac

SEQ ID NO: 2652121 - RNA, 18 nt, Escherichia coli CFT073
gauuauucaaaaacagau

SEQ ID NO: 2652122 - RNA, 22 nt, Escherichia coli CFT073
gauuauugcuugaucaggaaau

SEQ ID NO: 2652123 - RNA, 14 nt, Escherichia coli CFT073
gauuauuuauuccc

SEQ ID NO: 2652124 - RNA, 14 nt, Escherichia coli CFT073
gauuauuucgcugc

SEQ ID NO: 2652125 - RNA, 23 nt, Escherichia coli CFT073
gauuauuucgcugcggauuguca

SEQ ID NO: 2652126 - RNA, 14 nt, Escherichia coli CFT073
gauucaaauccagu

SEQ ID NO: 2652127 - RNA, 20 nt, Escherichia coli CFT073
gauucaaauccagucuuucg

SEQ ID NO: 2652128 - RNA, 14 nt, Escherichia coli CFT073
gauucaaugcaauu

SEQ ID NO: 2652129 - RNA, 13 nt, Escherichia coli CFT073
gauucaccaccgu

SEQ ID NO: 2652130 - RNA, 17 nt, Escherichia coli CFT073
gauucacgccaaccagc

SEQ ID NO: 2652131 - RNA, 18 nt, Escherichia coli CFT073
gauucacgccaaccagcu

SEQ ID NO: 2652132 - RNA, 21 nt, Escherichia coli CFT073
gauucacuucgcucuuaucac

SEQ ID NO: 2652133 - RNA, 16 nt, Escherichia coli CFT073
gauucagcaacaucac

SEQ ID NO: 2652134 - RNA, 22 nt, Escherichia coli CFT073
gauucagcccgagguuauuuug

SEQ ID NO: 2652135 - RNA, 20 nt, Escherichia coli CFT073
gauucagucuuaaaaagcag

SEQ ID NO: 2652136 - RNA, 18 nt, Escherichia coli CFT073
gauucaucaccacugacg

SEQ ID NO: 2652137 - RNA, 16 nt, Escherichia coli CFT073
gauucaucucuucuuc

SEQ ID NO: 2652138 - RNA, 21 nt, Escherichia coli CFT073
gauucauuuggcguaguugcu

SEQ ID NO: 2652139 - RNA, 18 nt, Escherichia coli CFT073
gauuccaacgaaaaugau

SEQ ID NO: 2652140 - RNA, 13 nt, Escherichia coli CFT073
gauuccacucauu

SEQ ID NO: 2652141 - RNA, 19 nt, Escherichia coli CFT073
gauuccaggucaaucccag

SEQ ID NO: 2652142 - RNA, 20 nt, Escherichia coli CFT073
gauuccaggucaaucccagg

SEQ ID NO: 2652143 - RNA, 14 nt, Escherichia coli CFT073
gauuccccagccac

SEQ ID NO: 2652144 - RNA, 14 nt, Escherichia coli CFT073
gauucccugccuga

SEQ ID NO: 2652145 - RNA, 22 nt, Escherichia coli CFT073
gauuccgccgauggugcagcag

SEQ ID NO: 2652146 - RNA, 20 nt, Escherichia coli CFT073
gauuccugcgcuuccaguuc

SEQ ID NO: 2652147 - RNA, 23 nt, Escherichia coli CFT073
gauucgaaccucggaaugccgga

SEQ ID NO: 2652148 - RNA, 15 nt, Escherichia coli CFT073
gauucgaugcccagc

SEQ ID NO: 2652149 - RNA, 16 nt, Escherichia coli CFT073
gauucgccgaugcaua

SEQ ID NO: 2652150 - RNA, 16 nt, Escherichia coli CFT073
gauucggauccagcac

SEQ ID NO: 2652151 - RNA, 16 nt, Escherichia coli CFT073
gauucggcaaucacaa

SEQ ID NO: 2652152 - RNA, 21 nt, Escherichia coli CFT073
gauucggcgcaaugauaucgc

SEQ ID NO: 2652153 - RNA, 12 nt, Escherichia coli CFT073
gauucuccagca

SEQ ID NO: 2652154 - RNA, 17 nt, Escherichia coli CFT073
gauucuggugagagcaa

SEQ ID NO: 2652155 - RNA, 16 nt, Escherichia coli CFT073
gauucuucgaugaugc

SEQ ID NO: 2652156 - RNA, 13 nt, Escherichia coli CFT073
gauugaagaaauc

SEQ ID NO: 2652157 - RNA, 21 nt, Escherichia coli CFT073
gauugaccauauuaacgcagc

SEQ ID NO: 2652158 - RNA, 22 nt, Escherichia coli CFT073
gauugagaauaaugccuuuaau

SEQ ID NO: 2652159 - RNA, 20 nt, Escherichia coli CFT073
gauugauagcgacgcgcugg

SEQ ID NO: 2652160 - RNA, 22 nt, Escherichia coli CFT073
gauugauagcgacgcgcuggca

SEQ ID NO: 2652161 - RNA, 13 nt, Escherichia coli CFT073
gauugaugugcuu

SEQ ID NO: 2652162 - RNA, 23 nt, Escherichia coli CFT073
gauugcauccgauuguuccugcu

SEQ ID NO: 2652163 - RNA, 12 nt, Escherichia coli CFT073
gauugccagcau

SEQ ID NO: 2652164 - RNA, 18 nt, Escherichia coli CFT073
gauugccauguuuuccuu

SEQ ID NO: 2652165 - RNA, 17 nt, Escherichia coli CFT073
gauugccggaugcggcg

SEQ ID NO: 2652166 - RNA, 15 nt, Escherichia coli CFT073
gauugccugaugcgc

SEQ ID NO: 2652167 - RNA, 21 nt, Escherichia coli CFT073
gauugcggucagcgcagcaag

SEQ ID NO: 2652168 - RNA, 14 nt, Escherichia coli CFT073
gauuggcaccgaca

SEQ ID NO: 2652169 - RNA, 13 nt, Escherichia coli CFT073
gauuggcaggugg

SEQ ID NO: 2652170 - RNA, 15 nt, Escherichia coli CFT073
gauuguacuuuaaaa

SEQ ID NO: 2652171 - RNA, 16 nt, Escherichia coli CFT073
gauuguagaaaaucuc

SEQ ID NO: 2652172 - RNA, 18 nt, Escherichia coli CFT073
gauugugauuaccgcaaa

SEQ ID NO: 2652173 - RNA, 20 nt, Escherichia coli CFT073
gauuguucaacgaaaauaug

SEQ ID NO: 2652174 - RNA, 15 nt, Escherichia coli CFT073
gauuguuuaaaaaua

SEQ ID NO: 2652175 - RNA, 14 nt, Escherichia coli CFT073
gauuuaacagcaaa

SEQ ID NO: 2652176 - RNA, 13 nt, Escherichia coli CFT073
gauuuaaugccaa

SEQ ID NO: 2652177 - RNA, 22 nt, Escherichia coli CFT073
gauuuaccguuaagcuggaaau

SEQ ID NO: 2652178 - RNA, 13 nt, Escherichia coli CFT073
gauuuacuaaaac

SEQ ID NO: 2652179 - RNA, 15 nt, Escherichia coli CFT073
gauuuacuaaaacuu

SEQ ID NO: 2652180 - RNA, 20 nt, Escherichia coli CFT073
gauuuacuaaaacuucauuu

SEQ ID NO: 2652181 - RNA, 20 nt, Escherichia coli CFT073
gcaaagcccaucaccgccag

SEQ ID NO: 2652182 - RNA, 23 nt, Escherichia coli CFT073
gcaaagcccaucaccgccaggcc

SEQ ID NO: 2652183 - RNA, 19 nt, Escherichia coli CFT073
gcaaagcccgggcacauca

SEQ ID NO: 2652184 - RNA, 22 nt, Escherichia coli CFT073
gcaaagcccgggcacaucaccu

SEQ ID NO: 2652185 - RNA, 10 nt, Escherichia coli CFT073
gcaaagcgac

SEQ ID NO: 2652186 - RNA, 18 nt, Escherichia coli CFT073
gcaaagcgcugaauaucu

SEQ ID NO: 2652187 - RNA, 16 nt, Escherichia coli CFT073
gcaaagcugucaccaa

SEQ ID NO: 2652188 - RNA, 21 nt, Escherichia coli CFT073
gcaaagcugucaccaaucagg

SEQ ID NO: 2652189 - RNA, 23 nt, Escherichia coli CFT073
gcaaagcuguuaucgauauacaa

SEQ ID NO: 2652190 - RNA, 14 nt, Escherichia coli CFT073
gcaaaggccagcca

SEQ ID NO: 2652191 - RNA, 21 nt, Escherichia coli CFT073
gcaaaguaaagcgcgucacca

SEQ ID NO: 2652192 - RNA, 17 nt, Escherichia coli CFT073
gcaaaguagagcgaaac

SEQ ID NO: 2652193 - RNA, 21 nt, Escherichia coli CFT073
gcaaaguagcugaaaaucaga

SEQ ID NO: 2652194 - RNA, 22 nt, Escherichia coli CFT073
gcaaaguaggccguacagccca

SEQ ID NO: 2652195 - RNA, 20 nt, Escherichia coli CFT073
gcaaagucacccgauaaaua

SEQ ID NO: 2652196 - RNA, 19 nt, Escherichia coli CFT073
gcaaagucuucacgggaaa

SEQ ID NO: 2652197 - RNA, 12 nt, Escherichia coli CFT073
gcaaauaacgcc

SEQ ID NO: 2652198 - RNA, 21 nt, Escherichia coli CFT073
gcaaauaacgcuucagcuguu

SEQ ID NO: 2652199 - RNA, 12 nt, Escherichia coli CFT073
gcaaauaauucc

SEQ ID NO: 2652200 - RNA, 19 nt, Escherichia coli CFT073
gcaaauaauuccccaccug

SEQ ID NO: 2652201 - RNA, 17 nt, Escherichia coli CFT073
gcaaauacccaaaaaau

SEQ ID NO: 2652202 - RNA, 18 nt, Escherichia coli CFT073
gcaaauacccaaaaaaua

SEQ ID NO: 2652203 - RNA, 20 nt, Escherichia coli CFT073
gcaaauauugccccagcguu

SEQ ID NO: 2652204 - RNA, 21 nt, Escherichia coli CFT073
gcaaaucaauagugaacugac

SEQ ID NO: 2652205 - RNA, 20 nt, Escherichia coli CFT073
gcaaaucaaucugaugacug

SEQ ID NO: 2652206 - RNA, 12 nt, Escherichia coli CFT073
gcaaaucaccac

SEQ ID NO: 2652207 - RNA, 23 nt, Escherichia coli CFT073
gcaaaucgccgagaucaacagca

SEQ ID NO: 2652208 - RNA, 12 nt, Escherichia coli CFT073
gcaaaucgcggc

SEQ ID NO: 2652209 - RNA, 15 nt, Escherichia coli CFT073
gcaaaugaugcacca

SEQ ID NO: 2652210 - RNA, 16 nt, Escherichia coli CFT073
gcaaaugaugcaccac

SEQ ID NO: 2652211 - RNA, 22 nt, Escherichia coli CFT073
gcaaaugaugcaccaccugauu

SEQ ID NO: 2652212 - RNA, 17 nt, Escherichia coli CFT073
gcaaauuuuccccagau

SEQ ID NO: 2652213 - RNA, 21 nt, Escherichia coli CFT073
gcaacaaaaaacccaucaacc

SEQ ID NO: 2652214 - RNA, 22 nt, Escherichia coli CFT073
gcaacaacacgaucagacgcag

SEQ ID NO: 2652215 - RNA, 12 nt, Escherichia coli CFT073
gcaacaacagcg

SEQ ID NO: 2652216 - RNA, 13 nt, Escherichia coli CFT073
gcaacaacagcgc

SEQ ID NO: 2652217 - RNA, 14 nt, Escherichia coli CFT073
gcaacaacagcgcg

SEQ ID NO: 2652218 - RNA, 19 nt, Escherichia coli CFT073
gcaacaaccaccacaccug

SEQ ID NO: 2652219 - RNA, 12 nt, Escherichia coli CFT073
gcaacaacuuca

SEQ ID NO: 2652220 - RNA, 17 nt, Escherichia coli CFT073
gcaacaagauuagccau

SEQ ID NO: 2652221 - RNA, 19 nt, Escherichia coli CFT073
gcaacaagccgcuugcgau

SEQ ID NO: 2652222 - RNA, 14 nt, Escherichia coli CFT073
gcaacaauuuccgc

SEQ ID NO: 2652223 - RNA, 14 nt, Escherichia coli CFT073
gcaacaauuugcgg

SEQ ID NO: 2652224 - RNA, 13 nt, Escherichia coli CFT073
gcaacacaagcca

SEQ ID NO: 2652225 - RNA, 23 nt, Escherichia coli CFT073
gcaacaccgcuuuaaucacccga

SEQ ID NO: 2652226 - RNA, 15 nt, Escherichia coli CFT073
gcaacacgccagcgu

SEQ ID NO: 2652227 - RNA, 21 nt, Escherichia coli CFT073
gcaacacguugccaucguggg

SEQ ID NO: 2652228 - RNA, 12 nt, Escherichia coli CFT073
gcaacacuacac

SEQ ID NO: 2652229 - RNA, 15 nt, Escherichia coli CFT073
gcaacacucguuuca

SEQ ID NO: 2652230 - RNA, 17 nt, Escherichia coli CFT073
gcaacagcaauacguuu

SEQ ID NO: 2652231 - RNA, 19 nt, Escherichia coli CFT073
gcaacagcagauccgguuc

SEQ ID NO: 2652232 - RNA, 16 nt, Escherichia coli CFT073
gcaacagcgcgcccgg

SEQ ID NO: 2652233 - RNA, 15 nt, Escherichia coli CFT073
gcaacagcgcgucag

SEQ ID NO: 2652234 - RNA, 17 nt, Escherichia coli CFT073
gcaacagcgcgucagca

SEQ ID NO: 2652235 - RNA, 12 nt, Escherichia coli CFT073
gcaacagguuac

SEQ ID NO: 2652236 - RNA, 16 nt, Escherichia coli CFT073
gcaacaguaauaaugc

SEQ ID NO: 2652237 - RNA, 20 nt, Escherichia coli CFT073
gcaacaguaauaaugcccau

SEQ ID NO: 2652238 - RNA, 22 nt, Escherichia coli CFT073
gcaacaguauccgggcauccag

SEQ ID NO: 2652239 - RNA, 14 nt, Escherichia coli CFT073
gcaacauaucuuuu

SEQ ID NO: 2652240 - RNA, 22 nt, Escherichia coli CFT073
gcaacaucaaauacagcuuaau

SEQ ID NO: 2652241 - RNA, 16 nt, Escherichia coli CFT073
gcaacaucaauaaagc

SEQ ID NO: 2652242 - RNA, 22 nt, Escherichia coli CFT073
gcaacauggcgcggcacaccag

SEQ ID NO: 2652243 - RNA, 21 nt, Escherichia coli CFT073
gcaaccaacgcuagcagcagc

SEQ ID NO: 2652244 - RNA, 22 nt, Escherichia coli CFT073
gcaaccaacgcuagcagcagcg

SEQ ID NO: 2652245 - RNA, 18 nt, Escherichia coli CFT073
gcaaccaaugccgccagg

SEQ ID NO: 2652246 - RNA, 13 nt, Escherichia coli CFT073
gcaaccacaacgc

SEQ ID NO: 2652247 - RNA, 14 nt, Escherichia coli CFT073
gcaaccacaacgca

SEQ ID NO: 2652248 - RNA, 14 nt, Escherichia coli CFT073
gcaaccacacccac

SEQ ID NO: 2652249 - RNA, 16 nt, Escherichia coli CFT073
gcaaccagcaaugcca

SEQ ID NO: 2652250 - RNA, 13 nt, Escherichia coli CFT073
gcaaccagcaccg

SEQ ID NO: 2652251 - RNA, 17 nt, Escherichia coli CFT073
gcaaccagcagcaucac

SEQ ID NO: 2652252 - RNA, 15 nt, Escherichia coli CFT073
gcaaccagcaggugu

SEQ ID NO: 2652253 - RNA, 15 nt, Escherichia coli CFT073
gcaaccagcgucgca

SEQ ID NO: 2652254 - RNA, 21 nt, Escherichia coli CFT073
gcaaccagcgucgcaucaggc

SEQ ID NO: 2652255 - RNA, 21 nt, Escherichia coli CFT073
gcaaccaguagcaaaacucac

SEQ ID NO: 2652256 - RNA, 22 nt, Escherichia coli CFT073
gcaacccuugacccguuuuaaa

SEQ ID NO: 2652257 - RNA, 21 nt, Escherichia coli CFT073
gcaaccgcauccagauucuca

SEQ ID NO: 2652258 - RNA, 16 nt, Escherichia coli CFT073
gcaaccgccaacagca

SEQ ID NO: 2652259 - RNA, 22 nt, Escherichia coli CFT073
gcaaccgccgcugcuuucgccg

SEQ ID NO: 2652260 - RNA, 21 nt, Escherichia coli CFT073
gcaaccggauuuuuaugacgc

SEQ ID NO: 2652261 - RNA, 15 nt, Escherichia coli CFT073
gcaaccgggcuauuu

SEQ ID NO: 2652262 - RNA, 22 nt, Escherichia coli CFT073
gcaaccguucgggaaaauauau

SEQ ID NO: 2652263 - RNA, 14 nt, Escherichia coli CFT073
gcaaccuaaccaaa

SEQ ID NO: 2652264 - RNA, 15 nt, Escherichia coli CFT073
gcaaccuguaggccg

SEQ ID NO: 2652265 - RNA, 16 nt, Escherichia coli CFT073
gcaaccuguaggccga

SEQ ID NO: 2652266 - RNA, 15 nt, Escherichia coli CFT073
gcaaccuucgccaga

SEQ ID NO: 2652267 - RNA, 13 nt, Escherichia coli CFT073
gcaacgaccagaa

SEQ ID NO: 2652268 - RNA, 15 nt, Escherichia coli CFT073
gcaacgaccgcgagc

SEQ ID NO: 2652269 - RNA, 19 nt, Escherichia coli CFT073
gcaacgagacucaauggca

SEQ ID NO: 2652270 - RNA, 15 nt, Escherichia coli CFT073
gcaacgauaacaauc

SEQ ID NO: 2652271 - RNA, 19 nt, Escherichia coli CFT073
gcaacgcagccccagcgca

SEQ ID NO: 2652272 - RNA, 20 nt, Escherichia coli CFT073
gcaacgccccuucugccgca

SEQ ID NO: 2652273 - RNA, 15 nt, Escherichia coli CFT073
gcaacgcccugcaac

SEQ ID NO: 2652274 - RNA, 21 nt, Escherichia coli CFT073
gcaacgccuuccagacucauc

SEQ ID NO: 2652275 - RNA, 22 nt, Escherichia coli CFT073
gcaacgccuuugucgggcaggc

SEQ ID NO: 2652276 - RNA, 22 nt, Escherichia coli CFT073
gcaacgcgcuuugaugcguucu

SEQ ID NO: 2652277 - RNA, 20 nt, Escherichia coli CFT073
gcaacgcuucaaccagugca

SEQ ID NO: 2652278 - RNA, 21 nt, Escherichia coli CFT073
gcaacgcuucguagaagccau

SEQ ID NO: 2652279 - RNA, 20 nt, Escherichia coli CFT073
gcaacggcacauauugcacc

SEQ ID NO: 2652280 - RNA, 16 nt, Escherichia coli CFT073
gcaacggcaucgccaa

SEQ ID NO: 2652281 - RNA, 17 nt, Escherichia coli CFT073
gcaacggcgacaagaau

SEQ ID NO: 2652282 - RNA, 23 nt, Escherichia coli CFT073
gcaacgguagaugacuuuguacc

SEQ ID NO: 2652283 - RNA, 19 nt, Escherichia coli CFT073
gcaacgucagucccaacug

SEQ ID NO: 2652284 - RNA, 18 nt, Escherichia coli CFT073
gcaacguuuuaagcaaau

SEQ ID NO: 2652285 - RNA, 14 nt, Escherichia coli CFT073
gcaacuaccagcag

SEQ ID NO: 2652286 - RNA, 15 nt, Escherichia coli CFT073
gcaacuaccagcagu

SEQ ID NO: 2652287 - RNA, 17 nt, Escherichia coli CFT073
gcaacuccaucaagcua

SEQ ID NO: 2652288 - RNA, 14 nt, Escherichia coli CFT073
gcaacugauauuua

SEQ ID NO: 2652289 - RNA, 23 nt, Escherichia coli CFT073
gcaacugcccaggcaaaaaggcc

SEQ ID NO: 2652290 - RNA, 21 nt, Escherichia coli CFT073
gcaacugcgccgcgagcauuu

SEQ ID NO: 2652291 - RNA, 22 nt, Escherichia coli CFT073
gcaacugcgccgcgagcauuuc

SEQ ID NO: 2652292 - RNA, 20 nt, Escherichia coli CFT073
gcaacuggcuugccagcagg

SEQ ID NO: 2652293 - RNA, 22 nt, Escherichia coli CFT073
gcaacuguaacgcagaagguua

SEQ ID NO: 2652294 - RNA, 16 nt, Escherichia coli CFT073
gcaacuguuuuaccaa

SEQ ID NO: 2652295 - RNA, 15 nt, Escherichia coli CFT073
gcaacuuaaucauca

SEQ ID NO: 2652296 - RNA, 18 nt, Escherichia coli CFT073
gcaacuuaaucaucaaug

SEQ ID NO: 2652297 - RNA, 13 nt, Escherichia coli CFT073
gcaacuugaagua

SEQ ID NO: 2652298 - RNA, 15 nt, Escherichia coli CFT073
gcaacuuuacucauc

SEQ ID NO: 2652299 - RNA, 18 nt, Escherichia coli CFT073
gcaacuuucaauaaccgc

SEQ ID NO: 2652300 - RNA, 20 nt, Escherichia coli CFT073
gcaacuuucaauaaccgcug

SEQ ID NO: 2652301 - RNA, 18 nt, Escherichia coli CFT073
gcaagaaacugaucauua

SEQ ID NO: 2652302 - RNA, 21 nt, Escherichia coli CFT073
gcaagacgaaaaaugaauacc

SEQ ID NO: 2652303 - RNA, 20 nt, Escherichia coli CFT073
gcaagacgcauaauccaggc

SEQ ID NO: 2652304 - RNA, 19 nt, Escherichia coli CFT073
gcaagacuuuguaggccgg

SEQ ID NO: 2652305 - RNA, 20 nt, Escherichia coli CFT073
gcaagacuuuguaggccgga

SEQ ID NO: 2652306 - RNA, 14 nt, Escherichia coli CFT073
gcaagagcaaauaa

SEQ ID NO: 2652307 - RNA, 15 nt, Escherichia coli CFT073
gcaagagcaaauaaa

SEQ ID NO: 2652308 - RNA, 16 nt, Escherichia coli CFT073
gcaagagcaaauaaaa

SEQ ID NO: 2652309 - RNA, 19 nt, Escherichia coli CFT073
gcaagaguaaacaucuucu

SEQ ID NO: 2652310 - RNA, 14 nt, Escherichia coli CFT073
gcaagaguuuuaaa

SEQ ID NO: 2652311 - RNA, 16 nt, Escherichia coli CFT073
gcaagauaaaucgcac

SEQ ID NO: 2652312 - RNA, 15 nt, Escherichia coli CFT073
gcaagaucgcgauga

SEQ ID NO: 2652313 - RNA, 22 nt, Escherichia coli CFT073
gcaagaucggagccaaaaucaa

SEQ ID NO: 2652314 - RNA, 16 nt, Escherichia coli CFT073
gcaagcaaauacucgu

SEQ ID NO: 2652315 - RNA, 16 nt, Escherichia coli CFT073
gcaagcaucccgccgu

SEQ ID NO: 2652316 - RNA, 19 nt, Escherichia coli CFT073
gcaagccagguaaaucaga

SEQ ID NO: 2652317 - RNA, 19 nt, Escherichia coli CFT073
gcaagccgcuaacagcagc

SEQ ID NO: 2652318 - RNA, 21 nt, Escherichia coli CFT073
gcaagccuuacuucacaucau

SEQ ID NO: 2652319 - RNA, 15 nt, Escherichia coli CFT073
gcaagccuugcagcc

SEQ ID NO: 2652320 - RNA, 19 nt, Escherichia coli CFT073
gcaagcgcaccgauugcag

SEQ ID NO: 2652321 - RNA, 16 nt, Escherichia coli CFT073
gcaagcgucgcaucag

SEQ ID NO: 2652322 - RNA, 14 nt, Escherichia coli CFT073
gcaaggaugcguuu

SEQ ID NO: 2652323 - RNA, 18 nt, Escherichia coli CFT073
gcaaggcgcgacaucucu

SEQ ID NO: 2652324 - RNA, 13 nt, Escherichia coli CFT073
gcaaggcgcgggu

SEQ ID NO: 2652325 - RNA, 19 nt, Escherichia coli CFT073
gcaaggcuauucagcaguu

SEQ ID NO: 2652326 - RNA, 21 nt, Escherichia coli CFT073
gcaaggugagcguggcuggcu

SEQ ID NO: 2652327 - RNA, 24 nt, Escherichia coli CFT073
gcaagguggucagacggaacaucu

SEQ ID NO: 2652328 - RNA, 19 nt, Escherichia coli CFT073
gcaaguagcgccagacuga

SEQ ID NO: 2652329 - RNA, 16 nt, Escherichia coli CFT073
gcaaguaguccgcaau

SEQ ID NO: 2652330 - RNA, 16 nt, Escherichia coli CFT073
gcaaguucccggaaaa

SEQ ID NO: 2652331 - RNA, 14 nt, Escherichia coli CFT073
gcaauaaaacaggg

SEQ ID NO: 2652332 - RNA, 20 nt, Escherichia coli CFT073
gcaauaaacauccuuuucac

SEQ ID NO: 2652333 - RNA, 13 nt, Escherichia coli CFT073
gcaauaacacgcg

SEQ ID NO: 2652334 - RNA, 15 nt, Escherichia coli CFT073
gcaauaaccaucagc

SEQ ID NO: 2652335 - RNA, 19 nt, Escherichia coli CFT073
gcaauaaccguaacgcauu

SEQ ID NO: 2652336 - RNA, 19 nt, Escherichia coli CFT073
gcaauaacucccaggcuac

SEQ ID NO: 2652337 - RNA, 20 nt, Escherichia coli CFT073
gcaauaacuccccuucuggc

SEQ ID NO: 2652338 - RNA, 18 nt, Escherichia coli CFT073
gcaauaagcacucuggcg

SEQ ID NO: 2652339 - RNA, 15 nt, Escherichia coli CFT073
gcaauaauaauaagu

SEQ ID NO: 2652340 - RNA, 19 nt, Escherichia coli CFT073
gcaauaaucagauggcggc

SEQ ID NO: 2652341 - RNA, 23 nt, Escherichia coli CFT073
gcaauaaucagugccgcgccgcg

SEQ ID NO: 2652342 - RNA, 19 nt, Escherichia coli CFT073
gcaauaaucucaauauccg

SEQ ID NO: 2652343 - RNA, 14 nt, Escherichia coli CFT073
gcaauaaugccagu

SEQ ID NO: 2652344 - RNA, 15 nt, Escherichia coli CFT073
gcaauaaugccaguc

SEQ ID NO: 2652345 - RNA, 15 nt, Escherichia coli CFT073
gcaauacagccagcc

SEQ ID NO: 2652346 - RNA, 14 nt, Escherichia coli CFT073
gcaauacauaagca

SEQ ID NO: 2652347 - RNA, 16 nt, Escherichia coli CFT073
gcaauaccugacgcaa

SEQ ID NO: 2652348 - RNA, 22 nt, Escherichia coli CFT073
gcaauacgauccugagcagcaa

SEQ ID NO: 2652349 - RNA, 14 nt, Escherichia coli CFT073
gcaauagccugaug

SEQ ID NO: 2652350 - RNA, 22 nt, Escherichia coli CFT073
gcaauagcuucuuccacauugu

SEQ ID NO: 2652351 - RNA, 20 nt, Escherichia coli CFT073
gcaauagugauguucuggcg

SEQ ID NO: 2652352 - RNA, 17 nt, Escherichia coli CFT073
gcaauauaggccgccga

SEQ ID NO: 2652353 - RNA, 19 nt, Escherichia coli CFT073
gcaauauauugaauuugca

SEQ ID NO: 2652354 - RNA, 20 nt, Escherichia coli CFT073
gcaauauccauuaaaacuga

SEQ ID NO: 2652355 - RNA, 14 nt, Escherichia coli CFT073
gcaauauuacuuca

SEQ ID NO: 2652356 - RNA, 17 nt, Escherichia coli CFT073
gcaauauuauggugaca

SEQ ID NO: 2652357 - RNA, 15 nt, Escherichia coli CFT073
gcaauauucuuuugc

SEQ ID NO: 2652358 - RNA, 19 nt, Escherichia coli CFT073
gcaauauuguagcaacucc

SEQ ID NO: 2652359 - RNA, 13 nt, Escherichia coli CFT073
gcaaucaaaugac

SEQ ID NO: 2652360 - RNA, 15 nt, Escherichia coli CFT073
gcaaucaaauuugcc

SEQ ID NO: 2652361 - RNA, 15 nt, Escherichia coli CFT073
gcaaucaacagauaa

SEQ ID NO: 2652362 - RNA, 17 nt, Escherichia coli CFT073
gcaaucaacgccugaug

SEQ ID NO: 2652363 - RNA, 15 nt, Escherichia coli CFT073
gcaaucacaucacca

SEQ ID NO: 2652364 - RNA, 18 nt, Escherichia coli CFT073
gcaaucacaucguagaca

SEQ ID NO: 2652365 - RNA, 15 nt, Escherichia coli CFT073
gcaaucaccgccagc

SEQ ID NO: 2652366 - RNA, 20 nt, Escherichia coli CFT073
gcaaucacgcccgccagaua

SEQ ID NO: 2652367 - RNA, 19 nt, Escherichia coli CFT073
gcaaucacugccaccagga

SEQ ID NO: 2652368 - RNA, 14 nt, Escherichia coli CFT073
gcaaucacuuccuc

SEQ ID NO: 2652369 - RNA, 15 nt, Escherichia coli CFT073
gcaaucacuuccuca

SEQ ID NO: 2652370 - RNA, 20 nt, Escherichia coli CFT073
gcaaucacuuccucaagcgu

SEQ ID NO: 2652371 - RNA, 22 nt, Escherichia coli CFT073
gcaaucacuuccucaagcguuu

SEQ ID NO: 2652372 - RNA, 19 nt, Escherichia coli CFT073
gcaaucagcggugccgcga

SEQ ID NO: 2652373 - RNA, 19 nt, Escherichia coli CFT073
gcaaucagcguaaaggccg

SEQ ID NO: 2652374 - RNA, 18 nt, Escherichia coli CFT073
gcaaucagcguuucgcca

SEQ ID NO: 2652375 - RNA, 23 nt, Escherichia coli CFT073
gcaaucaguuuguuauauucacu

SEQ ID NO: 2652376 - RNA, 20 nt, Escherichia coli CFT073
gcaaucaguuuuuguugaua

SEQ ID NO: 2652377 - RNA, 13 nt, Escherichia coli CFT073
gcaaucaucaucg

SEQ ID NO: 2652378 - RNA, 12 nt, Escherichia coli CFT073
gcaaucaucgca

SEQ ID NO: 2652379 - RNA, 14 nt, Escherichia coli CFT073
gcaaucaucgcagc

SEQ ID NO: 2652380 - RNA, 13 nt, Escherichia coli CFT073
gcaaucaugcgca

SEQ ID NO: 2652381 - RNA, 17 nt, Escherichia coli CFT073
gcaaucauucccagacc

SEQ ID NO: 2652382 - RNA, 18 nt, Escherichia coli CFT073
gcaaucauucccagaccu

SEQ ID NO: 2652383 - RNA, 18 nt, Escherichia coli CFT073
gcaauccagcuaaccauc

SEQ ID NO: 2652384 - RNA, 23 nt, Escherichia coli CFT073
gcaauccaguccaccuggccugc

SEQ ID NO: 2652385 - RNA, 14 nt, Escherichia coli CFT073
gcaauccccgccag

SEQ ID NO: 2652386 - RNA, 23 nt, Escherichia coli CFT073
gcaaucccguugccacucaggca

SEQ ID NO: 2652387 - RNA, 15 nt, Escherichia coli CFT073
gcaauccggaaacca

SEQ ID NO: 2652388 - RNA, 20 nt, Escherichia coli CFT073
gcaauccugcuuuuuuccag

SEQ ID NO: 2652389 - RNA, 14 nt, Escherichia coli CFT073
gcaaucgaccaggc

SEQ ID NO: 2652390 - RNA, 22 nt, Escherichia coli CFT073
gcaaucgacucugaaugccagu

SEQ ID NO: 2652391 - RNA, 14 nt, Escherichia coli CFT073
gcaaucgauuugaa

SEQ ID NO: 2652392 - RNA, 21 nt, Escherichia coli CFT073
gcaaucgcauauuucaacgac

SEQ ID NO: 2652393 - RNA, 19 nt, Escherichia coli CFT073
gcaaucgccagacucacca

SEQ ID NO: 2652394 - RNA, 14 nt, Escherichia coli CFT073
gcaaucgcggcagc

SEQ ID NO: 2652395 - RNA, 22 nt, Escherichia coli CFT073
gcaaucgcugggcgauaaaauc

SEQ ID NO: 2652396 - RNA, 22 nt, Escherichia coli CFT073
gcaaucgcuuugacuaaagaaa

SEQ ID NO: 2652397 - RNA, 22 nt, Escherichia coli CFT073
gcacagccagugauuccggugc

SEQ ID NO: 2652398 - RNA, 19 nt, Escherichia coli CFT073
gcacagcccgccgccaucc

SEQ ID NO: 2652399 - RNA, 15 nt, Escherichia coli CFT073
gcacagcgacaagcu

SEQ ID NO: 2652400 - RNA, 16 nt, Escherichia coli CFT073
gcacaggcggcccagu

SEQ ID NO: 2652401 - RNA, 14 nt, Escherichia coli CFT073
gcacaggcggguga

SEQ ID NO: 2652402 - RNA, 15 nt, Escherichia coli CFT073
gcacaggcgggugau

SEQ ID NO: 2652403 - RNA, 19 nt, Escherichia coli CFT073
gcacagggggauucaccau

SEQ ID NO: 2652404 - RNA, 15 nt, Escherichia coli CFT073
gcacaguacgcgccc

SEQ ID NO: 2652405 - RNA, 20 nt, Escherichia coli CFT073
gcacaguacgcgcccgccgc

SEQ ID NO: 2652406 - RNA, 13 nt, Escherichia coli CFT073
gcacauaaccagu

SEQ ID NO: 2652407 - RNA, 16 nt, Escherichia coli CFT073
gcacauacugcaucag

SEQ ID NO: 2652408 - RNA, 20 nt, Escherichia coli CFT073
gcacauacugcaucagcgcc

SEQ ID NO: 2652409 - RNA, 20 nt, Escherichia coli CFT073
gcacauagacggugacacuu

SEQ ID NO: 2652410 - RNA, 17 nt, Escherichia coli CFT073
gcacauagccgaaaaug

SEQ ID NO: 2652411 - RNA, 19 nt, Escherichia coli CFT073
gcacauagccgaaaaugcu

SEQ ID NO: 2652412 - RNA, 16 nt, Escherichia coli CFT073
gcacauauucacgggc

SEQ ID NO: 2652413 - RNA, 16 nt, Escherichia coli CFT073
gcacaucaucaaagcc

SEQ ID NO: 2652414 - RNA, 17 nt, Escherichia coli CFT073
gcacaucaucaaagcca

SEQ ID NO: 2652415 - RNA, 15 nt, Escherichia coli CFT073
gcacaucgcugugcu

SEQ ID NO: 2652416 - RNA, 17 nt, Escherichia coli CFT073
gcacaugcauaaagcgg

SEQ ID NO: 2652417 - RNA, 19 nt, Escherichia coli CFT073
gcacaugcuuuugcgccau

SEQ ID NO: 2652418 - RNA, 19 nt, Escherichia coli CFT073
gcacauggccgggguuuug

SEQ ID NO: 2652419 - RNA, 21 nt, Escherichia coli CFT073
gcacaugucaguugcauacca

SEQ ID NO: 2652420 - RNA, 21 nt, Escherichia coli CFT073
gcacauuagcgaccuucugaa

SEQ ID NO: 2652421 - RNA, 17 nt, Escherichia coli CFT073
gcacauuccagaugcgc

SEQ ID NO: 2652422 - RNA, 22 nt, Escherichia coli CFT073
gcacauugccguaauggucugc

SEQ ID NO: 2652423 - RNA, 24 nt, Escherichia coli CFT073
gcacauugccugaugcgacgcugc

SEQ ID NO: 2652424 - RNA, 16 nt, Escherichia coli CFT073
gcacauugugcgccau

SEQ ID NO: 2652425 - RNA, 21 nt, Escherichia coli CFT073
gcaccaaacgggcaagccagc

SEQ ID NO: 2652426 - RNA, 14 nt, Escherichia coli CFT073
gcaccaaagcguuu

SEQ ID NO: 2652427 - RNA, 19 nt, Escherichia coli CFT073
gcaccaaauccauuuucga

SEQ ID NO: 2652428 - RNA, 12 nt, Escherichia coli CFT073
gcaccaaccauc

SEQ ID NO: 2652429 - RNA, 12 nt, Escherichia coli CFT073
gcaccaacgcaa

SEQ ID NO: 2652430 - RNA, 17 nt, Escherichia coli CFT073
gcaccaacggucagcgc

SEQ ID NO: 2652431 - RNA, 16 nt, Escherichia coli CFT073
gcaccaaguucuucac

SEQ ID NO: 2652432 - RNA, 21 nt, Escherichia coli CFT073
gcaccaaguucuucacugacg

SEQ ID NO: 2652433 - RNA, 16 nt, Escherichia coli CFT073
gcaccaaugacggcca

SEQ ID NO: 2652434 - RNA, 17 nt, Escherichia coli CFT073
gcaccacacaucggcag

SEQ ID NO: 2652435 - RNA, 18 nt, Escherichia coli CFT073
gcaccacaccgucgccuu

SEQ ID NO: 2652436 - RNA, 14 nt, Escherichia coli CFT073
gcaccacauaagau

SEQ ID NO: 2652437 - RNA, 18 nt, Escherichia coli CFT073
gcaccaccagcagcugcu

SEQ ID NO: 2652438 - RNA, 19 nt, Escherichia coli CFT073
gcaccaccagcagcugcuc

SEQ ID NO: 2652439 - RNA, 20 nt, Escherichia coli CFT073
gcaccaccagcagcugcucc

SEQ ID NO: 2652440 - RNA, 16 nt, Escherichia coli CFT073
gcaccaccugauugcu

SEQ ID NO: 2652441 - RNA, 17 nt, Escherichia coli CFT073
gcaccacgguacgccag

SEQ ID NO: 2652442 - RNA, 20 nt, Escherichia coli CFT073
gcaccacuguuuuucagcac

SEQ ID NO: 2652443 - RNA, 21 nt, Escherichia coli CFT073
gcaccacuuguagaccaggau

SEQ ID NO: 2652444 - RNA, 21 nt, Escherichia coli CFT073
gcaccagaacucccuguuccu

SEQ ID NO: 2652445 - RNA, 15 nt, Escherichia coli CFT073
gcaccagaucuucca

SEQ ID NO: 2652446 - RNA, 16 nt, Escherichia coli CFT073
gcaccagaucuuccag

SEQ ID NO: 2652447 - RNA, 13 nt, Escherichia coli CFT073
gcaccagcaacaa

SEQ ID NO: 2652448 - RNA, 17 nt, Escherichia coli CFT073
gcaccagcaauaagcca

SEQ ID NO: 2652449 - RNA, 12 nt, Escherichia coli CFT073
gcaccagcaauu

SEQ ID NO: 2652450 - RNA, 22 nt, Escherichia coli CFT073
gcaccagcaccguguuuucguc

SEQ ID NO: 2652451 - RNA, 11 nt, Escherichia coli CFT073
gcaccagcagc

SEQ ID NO: 2652452 - RNA, 20 nt, Escherichia coli CFT073
gcaccagcagcgucagcacu

SEQ ID NO: 2652453 - RNA, 15 nt, Escherichia coli CFT073
gcaccagcuccggca

SEQ ID NO: 2652454 - RNA, 17 nt, Escherichia coli CFT073
gcaccagcuccggcacu

SEQ ID NO: 2652455 - RNA, 13 nt, Escherichia coli CFT073
gcaccagcuggcu

SEQ ID NO: 2652456 - RNA, 17 nt, Escherichia coli CFT073
gcaccaggcaguuuauc

SEQ ID NO: 2652457 - RNA, 13 nt, Escherichia coli CFT073
gcaccaggcgaaa

SEQ ID NO: 2652458 - RNA, 17 nt, Escherichia coli CFT073
gcaccaggcgaaaacgc

SEQ ID NO: 2652459 - RNA, 20 nt, Escherichia coli CFT073
gcaccaggguggcaaaugca

SEQ ID NO: 2652460 - RNA, 12 nt, Escherichia coli CFT073
gcaccaucagcu

SEQ ID NO: 2652461 - RNA, 20 nt, Escherichia coli CFT073
gcaccaucaggcauauucac

SEQ ID NO: 2652462 - RNA, 17 nt, Escherichia coli CFT073
gcaccaucccuaugcau

SEQ ID NO: 2652463 - RNA, 17 nt, Escherichia coli CFT073
gcaccaucgcgauccac

SEQ ID NO: 2652464 - RNA, 13 nt, Escherichia coli CFT073
gcaccaucucuua

SEQ ID NO: 2652465 - RNA, 13 nt, Escherichia coli CFT073
gcaccaugcacgg

SEQ ID NO: 2652466 - RNA, 14 nt, Escherichia coli CFT073
gcacccaaugccau

SEQ ID NO: 2652467 - RNA, 17 nt, Escherichia coli CFT073
gcacccagaacgccgaa

SEQ ID NO: 2652468 - RNA, 14 nt, Escherichia coli CFT073
gcacccaucgccag

SEQ ID NO: 2652469 - RNA, 15 nt, Escherichia coli CFT073
gcacccaucgccagc

SEQ ID NO: 2652470 - RNA, 19 nt, Escherichia coli CFT073
gcacccauuuauccagcgg

SEQ ID NO: 2652471 - RNA, 22 nt, Escherichia coli CFT073
gcacccauuuauccagcggcag

SEQ ID NO: 2652472 - RNA, 23 nt, Escherichia coli CFT073
gcaccccacaaacagaauggugc

SEQ ID NO: 2652473 - RNA, 19 nt, Escherichia coli CFT073
gcaccccauagccagcgac

SEQ ID NO: 2652474 - RNA, 18 nt, Escherichia coli CFT073
gcaccccugaagcggcag

SEQ ID NO: 2652475 - RNA, 17 nt, Escherichia coli CFT073
gcacccgaugcggcagu

SEQ ID NO: 2652476 - RNA, 12 nt, Escherichia coli CFT073
gcacccgccaga

SEQ ID NO: 2652477 - RNA, 14 nt, Escherichia coli CFT073
gcacccgccagcgc

SEQ ID NO: 2652478 - RNA, 16 nt, Escherichia coli CFT073
gcaccgaacaagaaac

SEQ ID NO: 2652479 - RNA, 15 nt, Escherichia coli CFT073
gcaccgacaauccag

SEQ ID NO: 2652480 - RNA, 19 nt, Escherichia coli CFT073
gcaccgacaucgacauacu

SEQ ID NO: 2652481 - RNA, 16 nt, Escherichia coli CFT073
gcaccgaccaucggca

SEQ ID NO: 2652482 - RNA, 21 nt, Escherichia coli CFT073
gcaccgaggccaaaaccacag

SEQ ID NO: 2652483 - RNA, 15 nt, Escherichia coli CFT073
gcaccgagugguuca

SEQ ID NO: 2652484 - RNA, 14 nt, Escherichia coli CFT073
gcaccgccagcagg

SEQ ID NO: 2652485 - RNA, 15 nt, Escherichia coli CFT073
gcaccgccagcagga

SEQ ID NO: 2652486 - RNA, 16 nt, Escherichia coli CFT073
gcaccgccagcaggaa

SEQ ID NO: 2652487 - RNA, 19 nt, Escherichia coli CFT073
gcaccgccauauugaccgu

SEQ ID NO: 2652488 - RNA, 18 nt, Escherichia coli CFT073
gcaccgcccugcaucaug

SEQ ID NO: 2652489 - RNA, 12 nt, Escherichia coli CFT073
gcaccgccgcca

SEQ ID NO: 2652490 - RNA, 18 nt, Escherichia coli CFT073
gcaccgcgacaaucaggu

SEQ ID NO: 2652491 - RNA, 15 nt, Escherichia coli CFT073
gcaccgcgccacugg

SEQ ID NO: 2652492 - RNA, 21 nt, Escherichia coli CFT073
gcaccgcgcccacauaaccaa

SEQ ID NO: 2652493 - RNA, 20 nt, Escherichia coli CFT073
gcaccggaaauugcugccgc

SEQ ID NO: 2652494 - RNA, 16 nt, Escherichia coli CFT073
gcaccggaagcgugca

SEQ ID NO: 2652495 - RNA, 15 nt, Escherichia coli CFT073
gcaccggaucgaugc

SEQ ID NO: 2652496 - RNA, 18 nt, Escherichia coli CFT073
gcaccggcgauaucccag

SEQ ID NO: 2652497 - RNA, 19 nt, Escherichia coli CFT073
gcaccgggggguugccgcc

SEQ ID NO: 2652498 - RNA, 20 nt, Escherichia coli CFT073
gcaccgguacacaaccgccg

SEQ ID NO: 2652499 - RNA, 21 nt, Escherichia coli CFT073
gcaccgguaucugccagcacu

SEQ ID NO: 2652500 - RNA, 22 nt, Escherichia coli CFT073
gcaccgguaucugccagcacug

SEQ ID NO: 2652501 - RNA, 20 nt, Escherichia coli CFT073
gcaccguaucuucauugugc

SEQ ID NO: 2652502 - RNA, 21 nt, Escherichia coli CFT073
gcaccgucaccgguucggaca

SEQ ID NO: 2652503 - RNA, 17 nt, Escherichia coli CFT073
gcaccgucacuucuucg

SEQ ID NO: 2652504 - RNA, 13 nt, Escherichia coli CFT073
gcaccgugaaaga

SEQ ID NO: 2652505 - RNA, 16 nt, Escherichia coli CFT073
gcaccgugaccaccca

SEQ ID NO: 2652506 - RNA, 12 nt, Escherichia coli CFT073
gcagcaaccacu

SEQ ID NO: 2652507 - RNA, 11 nt, Escherichia coli CFT073
gcagcaaccag

SEQ ID NO: 2652508 - RNA, 14 nt, Escherichia coli CFT073
gcagcaaccagagc

SEQ ID NO: 2652509 - RNA, 15 nt, Escherichia coli CFT073
gcagcaaccagagcc

SEQ ID NO: 2652510 - RNA, 14 nt, Escherichia coli CFT073
gcagcaaccgucgu

SEQ ID NO: 2652511 - RNA, 18 nt, Escherichia coli CFT073
gcagcaacuuaaucauca

SEQ ID NO: 2652512 - RNA, 20 nt, Escherichia coli CFT073
gcagcaagcgcaucggaaga

SEQ ID NO: 2652513 - RNA, 21 nt, Escherichia coli CFT073
gcagcaauauagcgcauggca

SEQ ID NO: 2652514 - RNA, 17 nt, Escherichia coli CFT073
gcagcaauauguugaua

SEQ ID NO: 2652515 - RNA, 18 nt, Escherichia coli CFT073
gcagcaaugcuuacuugc

SEQ ID NO: 2652516 - RNA, 13 nt, Escherichia coli CFT073
gcagcacaaugcc

SEQ ID NO: 2652517 - RNA, 13 nt, Escherichia coli CFT073
gcagcacaugcaa

SEQ ID NO: 2652518 - RNA, 15 nt, Escherichia coli CFT073
gcagcacccagaacg

SEQ ID NO: 2652519 - RNA, 15 nt, Escherichia coli CFT073
gcagcacuugcagca

SEQ ID NO: 2652520 - RNA, 21 nt, Escherichia coli CFT073
gcagcagacgcaucgcccagc

SEQ ID NO: 2652521 - RNA, 13 nt, Escherichia coli CFT073
gcagcagaugauc

SEQ ID NO: 2652522 - RNA, 18 nt, Escherichia coli CFT073
gcagcagcacccgcggcu

SEQ ID NO: 2652523 - RNA, 14 nt, Escherichia coli CFT073
gcagcagcgccaac

SEQ ID NO: 2652524 - RNA, 12 nt, Escherichia coli CFT073
gcagcagcgucc

SEQ ID NO: 2652525 - RNA, 12 nt, Escherichia coli CFT073
gcagcagcuucg

SEQ ID NO: 2652526 - RNA, 17 nt, Escherichia coli CFT073
gcagcaggaauaaucag

SEQ ID NO: 2652527 - RNA, 19 nt, Escherichia coli CFT073
gcagcaggcaauuucgccu

SEQ ID NO: 2652528 - RNA, 17 nt, Escherichia coli CFT073
gcagcagggcaauacgc

SEQ ID NO: 2652529 - RNA, 17 nt, Escherichia coli CFT073
gcagcaggugcgccagc

SEQ ID NO: 2652530 - RNA, 18 nt, Escherichia coli CFT073
gcagcagugggauuaagg

SEQ ID NO: 2652531 - RNA, 14 nt, Escherichia coli CFT073
gcagcauagaagaa

SEQ ID NO: 2652532 - RNA, 12 nt, Escherichia coli CFT073
gcagcaucacgg

SEQ ID NO: 2652533 - RNA, 14 nt, Escherichia coli CFT073
gcagcaucaguagc

SEQ ID NO: 2652534 - RNA, 23 nt, Escherichia coli CFT073
gcagcaucaguagcaguaauuua

SEQ ID NO: 2652535 - RNA, 15 nt, Escherichia coli CFT073
gcagcaucgcucacc

SEQ ID NO: 2652536 - RNA, 19 nt, Escherichia coli CFT073
gcagcaugauacaaaacag

SEQ ID NO: 2652537 - RNA, 20 nt, Escherichia coli CFT073
gcagcaugauacaaaacaga

SEQ ID NO: 2652538 - RNA, 15 nt, Escherichia coli CFT073
gcagcauggucgcag

SEQ ID NO: 2652539 - RNA, 12 nt, Escherichia coli CFT073
gcagcauucauc

SEQ ID NO: 2652540 - RNA, 17 nt, Escherichia coli CFT073
gcagcauucaucacaaa

SEQ ID NO: 2652541 - RNA, 15 nt, Escherichia coli CFT073
gcagcauuuccucaa

SEQ ID NO: 2652542 - RNA, 17 nt, Escherichia coli CFT073
gcagccaacucuucuuc

SEQ ID NO: 2652543 - RNA, 15 nt, Escherichia coli CFT073
gcagccacggcagca

SEQ ID NO: 2652544 - RNA, 14 nt, Escherichia coli CFT073
gcagccacugcggc

SEQ ID NO: 2652545 - RNA, 15 nt, Escherichia coli CFT073
gcagccacugcugcg

SEQ ID NO: 2652546 - RNA, 11 nt, Escherichia coli CFT073
gcagccaggau

SEQ ID NO: 2652547 - RNA, 13 nt, Escherichia coli CFT073
gcagccaggccau

SEQ ID NO: 2652548 - RNA, 19 nt, Escherichia coli CFT073
gcagccaggccauuuuuuc

SEQ ID NO: 2652549 - RNA, 18 nt, Escherichia coli CFT073
gcagccaguuaaccugcg

SEQ ID NO: 2652550 - RNA, 14 nt, Escherichia coli CFT073
gcagccaucgucgc

SEQ ID NO: 2652551 - RNA, 16 nt, Escherichia coli CFT073
gcagccauucauucaa

SEQ ID NO: 2652552 - RNA, 22 nt, Escherichia coli CFT073
gcagccauuuguuggcgcugcu

SEQ ID NO: 2652553 - RNA, 18 nt, Escherichia coli CFT073
gcagcccauaagcaaaag

SEQ ID NO: 2652554 - RNA, 19 nt, Escherichia coli CFT073
gcagccccagcgcauguuc

SEQ ID NO: 2652555 - RNA, 17 nt, Escherichia coli CFT073
gcagcccguggcgcgaa

SEQ ID NO: 2652556 - RNA, 16 nt, Escherichia coli CFT073
gcagccgauuuuaugu

SEQ ID NO: 2652557 - RNA, 14 nt, Escherichia coli CFT073
gcagccgccacaau

SEQ ID NO: 2652558 - RNA, 12 nt, Escherichia coli CFT073
gcagccgccauc

SEQ ID NO: 2652559 - RNA, 19 nt, Escherichia coli CFT073
gcagccgcugauuuuuauc

SEQ ID NO: 2652560 - RNA, 12 nt, Escherichia coli CFT073
gcagccggaaaa

SEQ ID NO: 2652561 - RNA, 14 nt, Escherichia coli CFT073
gcagccggaaaacc

SEQ ID NO: 2652562 - RNA, 15 nt, Escherichia coli CFT073
gcagccuuaccggag

SEQ ID NO: 2652563 - RNA, 17 nt, Escherichia coli CFT073
gcagccuuucacaucag

SEQ ID NO: 2652564 - RNA, 14 nt, Escherichia coli CFT073
gcagcgaaucagcc

SEQ ID NO: 2652565 - RNA, 22 nt, Escherichia coli CFT073
gcagcgauagcuucugcguucu

SEQ ID NO: 2652566 - RNA, 23 nt, Escherichia coli CFT073
gcagcgaugguacuucaaucgcc

SEQ ID NO: 2652567 - RNA, 20 nt, Escherichia coli CFT073
gcagcgauuaacugcgcggu

SEQ ID NO: 2652568 - RNA, 20 nt, Escherichia coli CFT073
gcagcgcaauucgcgucggc

SEQ ID NO: 2652569 - RNA, 19 nt, Escherichia coli CFT073
gcagcgcauaagccacaau

SEQ ID NO: 2652570 - RNA, 16 nt, Escherichia coli CFT073
gcagcgcauuguuucu

SEQ ID NO: 2652571 - RNA, 15 nt, Escherichia coli CFT073
gcagcgccggauuca

SEQ ID NO: 2652572 - RNA, 16 nt, Escherichia coli CFT073
gcagcgccgguuuuca

SEQ ID NO: 2652573 - RNA, 21 nt, Escherichia coli CFT073
gcagcgcggcgagagccuucg

SEQ ID NO: 2652574 - RNA, 16 nt, Escherichia coli CFT073
gcagcgcgugcgccac

SEQ ID NO: 2652575 - RNA, 13 nt, Escherichia coli CFT073
gcagcgcuggaga

SEQ ID NO: 2652576 - RNA, 21 nt, Escherichia coli CFT073
gcagcgcuggagagcgccggg

SEQ ID NO: 2652577 - RNA, 18 nt, Escherichia coli CFT073
gcagcggagaucgccagc

SEQ ID NO: 2652578 - RNA, 18 nt, Escherichia coli CFT073
gcagcggaggcgauaaug

SEQ ID NO: 2652579 - RNA, 15 nt, Escherichia coli CFT073
gcagcggcaagcugg

SEQ ID NO: 2652580 - RNA, 17 nt, Escherichia coli CFT073
gcagcggcaagcuggcg

SEQ ID NO: 2652581 - RNA, 14 nt, Escherichia coli CFT073
gcagcggcacguuc

SEQ ID NO: 2652582 - RNA, 15 nt, Escherichia coli CFT073
gcagcggccaguagc

SEQ ID NO: 2652583 - RNA, 17 nt, Escherichia coli CFT073
gcagcggcuuccccaac

SEQ ID NO: 2652584 - RNA, 21 nt, Escherichia coli CFT073
gcagcgucagugacggcuucu

SEQ ID NO: 2652585 - RNA, 14 nt, Escherichia coli CFT073
gcagcguccagcgc

SEQ ID NO: 2652586 - RNA, 15 nt, Escherichia coli CFT073
gcagcguccagcgcc

SEQ ID NO: 2652587 - RNA, 16 nt, Escherichia coli CFT073
gcagcgugccaggcgc

SEQ ID NO: 2652588 - RNA, 19 nt, Escherichia coli CFT073
gcagcgugccaggcgcgcu

SEQ ID NO: 2652589 - RNA, 18 nt, Escherichia coli CFT073
gcagcgugcucucaaaua

SEQ ID NO: 2652590 - RNA, 19 nt, Escherichia coli CFT073
gcagcgugcucucaaauau

SEQ ID NO: 2652591 - RNA, 23 nt, Escherichia coli CFT073
gcagcguucauaaauacagagca

SEQ ID NO: 2652592 - RNA, 14 nt, Escherichia coli CFT073
gcagcguucccagc

SEQ ID NO: 2652593 - RNA, 15 nt, Escherichia coli CFT073
gcagcuaccguuuca

SEQ ID NO: 2652594 - RNA, 15 nt, Escherichia coli CFT073
gcagcucacgcacga

SEQ ID NO: 2652595 - RNA, 23 nt, Escherichia coli CFT073
gcagcuccagaguaacuucacca

SEQ ID NO: 2652596 - RNA, 15 nt, Escherichia coli CFT073
gcagcuccgccagcu

SEQ ID NO: 2652597 - RNA, 17 nt, Escherichia coli CFT073
gcagcuccugcucugac

SEQ ID NO: 2652598 - RNA, 18 nt, Escherichia coli CFT073
gcagcucgcacgccacgc

SEQ ID NO: 2652599 - RNA, 21 nt, Escherichia coli CFT073
gcagcucgcguucggaaauau

SEQ ID NO: 2652600 - RNA, 15 nt, Escherichia coli CFT073
gcagcucuaucugca

SEQ ID NO: 2652601 - RNA, 18 nt, Escherichia coli CFT073
gcagcucuaucugcacug

SEQ ID NO: 2652602 - RNA, 14 nt, Escherichia coli CFT073
gcagcucuguuuug

SEQ ID NO: 2652603 - RNA, 17 nt, Escherichia coli CFT073
gcagcucuuuauccagc

SEQ ID NO: 2652604 - RNA, 18 nt, Escherichia coli CFT073
gcagcucuuuauccagca

SEQ ID NO: 2652605 - RNA, 16 nt, Escherichia coli CFT073
gcagcugugccgcugg

SEQ ID NO: 2652606 - RNA, 15 nt, Escherichia coli CFT073
gcagcuguugcgcca

SEQ ID NO: 2652607 - RNA, 18 nt, Escherichia coli CFT073
gcagcuuaucuuuuucgg

SEQ ID NO: 2652608 - RNA, 12 nt, Escherichia coli CFT073
gcagcuucacgg

SEQ ID NO: 2652609 - RNA, 15 nt, Escherichia coli CFT073
gcagcuuuaacgauc

SEQ ID NO: 2652610 - RNA, 23 nt, Escherichia coli CFT073
gcagcuuuaauauuacgugccgc

SEQ ID NO: 2652611 - RNA, 16 nt, Escherichia coli CFT073
gcagcuuuaccggcuu

SEQ ID NO: 2652612 - RNA, 13 nt, Escherichia coli CFT073
gcagcuuuuucag

SEQ ID NO: 2652613 - RNA, 18 nt, Escherichia coli CFT073
gcaggaaaaucagcauca

SEQ ID NO: 2652614 - RNA, 19 nt, Escherichia coli CFT073
gcaggaaaaucagcaucaa

SEQ ID NO: 2652615 - RNA, 21 nt, Escherichia coli CFT073
gcaggaaagcaagaccaacac

SEQ ID NO: 2652616 - RNA, 12 nt, Escherichia coli CFT073
gcaguggcuucg

SEQ ID NO: 2652617 - RNA, 14 nt, Escherichia coli CFT073
gcaguggcuucggc

SEQ ID NO: 2652618 - RNA, 16 nt, Escherichia coli CFT073
gcagugguaucaauau

SEQ ID NO: 2652619 - RNA, 19 nt, Escherichia coli CFT073
gcagugguaucaauaucca

SEQ ID NO: 2652620 - RNA, 13 nt, Escherichia coli CFT073
gcagugucagcac

SEQ ID NO: 2652621 - RNA, 14 nt, Escherichia coli CFT073
gcaguuagcuuuuc

SEQ ID NO: 2652622 - RNA, 22 nt, Escherichia coli CFT073
gcaguuagcuuuucuccugcuu

SEQ ID NO: 2652623 - RNA, 16 nt, Escherichia coli CFT073
gcaguucccuacucuc

SEQ ID NO: 2652624 - RNA, 21 nt, Escherichia coli CFT073
gcaguucgucgcguuugcccg

SEQ ID NO: 2652625 - RNA, 19 nt, Escherichia coli CFT073
gcaguugccagcuuuuguu

SEQ ID NO: 2652626 - RNA, 17 nt, Escherichia coli CFT073
gcaguugcccgguuucg

SEQ ID NO: 2652627 - RNA, 19 nt, Escherichia coli CFT073
gcaguugccggaugcggca

SEQ ID NO: 2652628 - RNA, 19 nt, Escherichia coli CFT073
gcaguugccggaugcggcg

SEQ ID NO: 2652629 - RNA, 14 nt, Escherichia coli CFT073
gcaguuggucagca

SEQ ID NO: 2652630 - RNA, 17 nt, Escherichia coli CFT073
gcaguuguaaucacgcu

SEQ ID NO: 2652631 - RNA, 20 nt, Escherichia coli CFT073
gcaguuguaaucacgcucaa

SEQ ID NO: 2652632 - RNA, 15 nt, Escherichia coli CFT073
gcaguugugugccag

SEQ ID NO: 2652633 - RNA, 19 nt, Escherichia coli CFT073
gcaguugugugccaguaau

SEQ ID NO: 2652634 - RNA, 17 nt, Escherichia coli CFT073
gcaguuucaccagcagu

SEQ ID NO: 2652635 - RNA, 13 nt, Escherichia coli CFT073
gcaguuucgucaa

SEQ ID NO: 2652636 - RNA, 21 nt, Escherichia coli CFT073
gcaguuugcgguguguggcug

SEQ ID NO: 2652637 - RNA, 18 nt, Escherichia coli CFT073
  misc_feature (4)..(4): n is a, c, g or u
gcanuaucgucuggcgcg

SEQ ID NO: 2652638 - RNA, 18 nt, Escherichia coli CFT073
gcauaaaagggcagcagg

SEQ ID NO: 2652639 - RNA, 19 nt, Escherichia coli CFT073
gcauaaaaucuaaugcucc

SEQ ID NO: 2652640 - RNA, 16 nt, Escherichia coli CFT073
gcauaaacacaggcac

SEQ ID NO: 2652641 - RNA, 15 nt, Escherichia coli CFT073
gcauaaacaccugcg

SEQ ID NO: 2652642 - RNA, 16 nt, Escherichia coli CFT073
gcauaaaccgggucag

SEQ ID NO: 2652643 - RNA, 13 nt, Escherichia coli CFT073
gcauaaacgccuu

SEQ ID NO: 2652644 - RNA, 19 nt, Escherichia coli CFT073
gcauaaauuucaggcaaca

SEQ ID NO: 2652645 - RNA, 21 nt, Escherichia coli CFT073
gcauaaauuucaggcaacaaa

SEQ ID NO: 2652646 - RNA, 23 nt, Escherichia coli CFT073
gcauaaauuucucgccguucucc

SEQ ID NO: 2652647 - RNA, 11 nt, Escherichia coli CFT073
gcauaacacaa

SEQ ID NO: 2652648 - RNA, 20 nt, Escherichia coli CFT073
gcauaacacaauaccuucug

SEQ ID NO: 2652649 - RNA, 23 nt, Escherichia coli CFT073
gcauaaccagagagcuuauccag

SEQ ID NO: 2652650 - RNA, 15 nt, Escherichia coli CFT073
gcauaaccgagcaga

SEQ ID NO: 2652651 - RNA, 19 nt, Escherichia coli CFT073
gcauaaccgauaccgacga

SEQ ID NO: 2652652 - RNA, 19 nt, Escherichia coli CFT073
gcauaaccgguaccugccg

SEQ ID NO: 2652653 - RNA, 19 nt, Escherichia coli CFT073
gcauaacguugcagcguuu

SEQ ID NO: 2652654 - RNA, 22 nt, Escherichia coli CFT073
gcauaagaccgugagcaaugca

SEQ ID NO: 2652655 - RNA, 23 nt, Escherichia coli CFT073
gcauaagaccgugagcaaugcac

SEQ ID NO: 2652656 - RNA, 19 nt, Escherichia coli CFT073
gcauaaggugcgaccuaca

SEQ ID NO: 2652657 - RNA, 17 nt, Escherichia coli CFT073
gcauaagucccgaccac

SEQ ID NO: 2652658 - RNA, 23 nt, Escherichia coli CFT073
gcauaauaccgcgagauauccac

SEQ ID NO: 2652659 - RNA, 14 nt, Escherichia coli CFT073
gcauaauaucuuuc

SEQ ID NO: 2652660 - RNA, 19 nt, Escherichia coli CFT073
gcauaaucaccaucagcag

SEQ ID NO: 2652661 - RNA, 21 nt, Escherichia coli CFT073
gcauaaucaccaucagcagca

SEQ ID NO: 2652662 - RNA, 18 nt, Escherichia coli CFT073
gcauaauccacuuucuua

SEQ ID NO: 2652663 - RNA, 18 nt, Escherichia coli CFT073
gcauaaucgcuacgccuu

SEQ ID NO: 2652664 - RNA, 15 nt, Escherichia coli CFT073
gcauaaucggcuggg

SEQ ID NO: 2652665 - RNA, 21 nt, Escherichia coli CFT073
gcauaaugguggaguggccca

SEQ ID NO: 2652666 - RNA, 19 nt, Escherichia coli CFT073
gcauaaugucgcuggccgg

SEQ ID NO: 2652667 - RNA, 14 nt, Escherichia coli CFT073
gcauacaacgccau

SEQ ID NO: 2652668 - RNA, 16 nt, Escherichia coli CFT073
gcauacaacgccauga

SEQ ID NO: 2652669 - RNA, 20 nt, Escherichia coli CFT073
gcauacagcuuuuacagcca

SEQ ID NO: 2652670 - RNA, 21 nt, Escherichia coli CFT073
gcauacauaacagaauaucug

SEQ ID NO: 2652671 - RNA, 19 nt, Escherichia coli CFT073
gcauacaucaacgcgcaac

SEQ ID NO: 2652672 - RNA, 15 nt, Escherichia coli CFT073
gcauacaugcuuaac

SEQ ID NO: 2652673 - RNA, 16 nt, Escherichia coli CFT073
gcauaccgaucgcggu

SEQ ID NO: 2652674 - RNA, 16 nt, Escherichia coli CFT073
gcauaccuauuuaaau

SEQ ID NO: 2652675 - RNA, 17 nt, Escherichia coli CFT073
gcauaccuuccagcgcg

SEQ ID NO: 2652676 - RNA, 15 nt, Escherichia coli CFT073
gcauacuaauaucau

SEQ ID NO: 2652677 - RNA, 22 nt, Escherichia coli CFT073
gcauacuaauaucauugaaguu

SEQ ID NO: 2652678 - RNA, 13 nt, Escherichia coli CFT073
gcauacuccagcc

SEQ ID NO: 2652679 - RNA, 16 nt, Escherichia coli CFT073
gcauacucuccuccag

SEQ ID NO: 2652680 - RNA, 18 nt, Escherichia coli CFT073
gcauacucuccuccaggu

SEQ ID NO: 2652681 - RNA, 16 nt, Escherichia coli CFT073
gcauacugauuaccca

SEQ ID NO: 2652682 - RNA, 23 nt, Escherichia coli CFT073
gcauacugcgugucguaagccac

SEQ ID NO: 2652683 - RNA, 14 nt, Escherichia coli CFT073
gcauagaaaaagaa

SEQ ID NO: 2652684 - RNA, 13 nt, Escherichia coli CFT073
gcauagacagcca

SEQ ID NO: 2652685 - RNA, 15 nt, Escherichia coli CFT073
gcauagacuuaugcc

SEQ ID NO: 2652686 - RNA, 14 nt, Escherichia coli CFT073
gcauagccccagcg

SEQ ID NO: 2652687 - RNA, 19 nt, Escherichia coli CFT073
gcauagccggagguuuuuc

SEQ ID NO: 2652688 - RNA, 16 nt, Escherichia coli CFT073
gcauagcuaauccccu

SEQ ID NO: 2652689 - RNA, 22 nt, Escherichia coli CFT073
gcauagcuaauccccuccagcg

SEQ ID NO: 2652690 - RNA, 22 nt, Escherichia coli CFT073
gcauaggcuuugcuuagcgcaa

SEQ ID NO: 2652691 - RNA, 17 nt, Escherichia coli CFT073
gcauagguugaaauaaa

SEQ ID NO: 2652692 - RNA, 16 nt, Escherichia coli CFT073
gcauaguccaguaaau

SEQ ID NO: 2652693 - RNA, 23 nt, Escherichia coli CFT073
gcauagugaucagccucucucug

SEQ ID NO: 2652694 - RNA, 20 nt, Escherichia coli CFT073
gcauauaaaugcgaauagug

SEQ ID NO: 2652695 - RNA, 14 nt, Escherichia coli CFT073
gcauauacaaccaa

SEQ ID NO: 2652696 - RNA, 15 nt, Escherichia coli CFT073
gcauauaccgucagc

SEQ ID NO: 2652697 - RNA, 19 nt, Escherichia coli CFT073
gcauauagccaaagcacca

SEQ ID NO: 2652698 - RNA, 18 nt, Escherichia coli CFT073
gcauauaugaauauugcu

SEQ ID NO: 2652699 - RNA, 21 nt, Escherichia coli CFT073
gcauauaugaauauugcugaa

SEQ ID NO: 2652700 - RNA, 22 nt, Escherichia coli CFT073
gcauaucaccucuguucaggug

SEQ ID NO: 2652701 - RNA, 18 nt, Escherichia coli CFT073
gcauauccggccugggua

SEQ ID NO: 2652702 - RNA, 17 nt, Escherichia coli CFT073
gcauaucgcccugggua

SEQ ID NO: 2652703 - RNA, 19 nt, Escherichia coli CFT073
gcauaucgguaaaugcuuu

SEQ ID NO: 2652704 - RNA, 18 nt, Escherichia coli CFT073
gcauaucguagccccagu

SEQ ID NO: 2652705 - RNA, 16 nt, Escherichia coli CFT073
gcauaucuucugaagg

SEQ ID NO: 2652706 - RNA, 16 nt, Escherichia coli CFT073
gcauaugaaugccagc

SEQ ID NO: 2652707 - RNA, 22 nt, Escherichia coli CFT073
gcauaugcacacgcagcugaug

SEQ ID NO: 2652708 - RNA, 16 nt, Escherichia coli CFT073
gcauauggauaugauc

SEQ ID NO: 2652709 - RNA, 22 nt, Escherichia coli CFT073
gcauauuauucauaaugcccag

SEQ ID NO: 2652710 - RNA, 22 nt, Escherichia coli CFT073
gcauauuccaccacuucauacu

SEQ ID NO: 2652711 - RNA, 23 nt, Escherichia coli CFT073
gcauauucccuagucgauacugc

SEQ ID NO: 2652712 - RNA, 17 nt, Escherichia coli CFT073
gcauauuuaaaaacgag

SEQ ID NO: 2652713 - RNA, 16 nt, Escherichia coli CFT073
gcaucaaacuuuuaaa

SEQ ID NO: 2652714 - RNA, 17 nt, Escherichia coli CFT073
gcaucaaccagcaccuu

SEQ ID NO: 2652715 - RNA, 17 nt, Escherichia coli CFT073
gcaucaacccgcucaua

SEQ ID NO: 2652716 - RNA, 15 nt, Escherichia coli CFT073
gcaucaaccgccgga

SEQ ID NO: 2652717 - RNA, 21 nt, Escherichia coli CFT073
gcaucaacugcgcuauaucgc

SEQ ID NO: 2652718 - RNA, 13 nt, Escherichia coli CFT073
gcaucaagaaaaa

SEQ ID NO: 2652719 - RNA, 15 nt, Escherichia coli CFT073
gcaucaagaaaaaua

SEQ ID NO: 2652720 - RNA, 14 nt, Escherichia coli CFT073
gcaucaagaaaacu

SEQ ID NO: 2652721 - RNA, 12 nt, Escherichia coli CFT073
gcaucaagaaac

SEQ ID NO: 2652722 - RNA, 17 nt, Escherichia coli CFT073
gcaucaauuacuucugg

SEQ ID NO: 2652723 - RNA, 21 nt, Escherichia coli CFT073
gcaucacauaaucgaaaacau

SEQ ID NO: 2652724 - RNA, 19 nt, Escherichia coli CFT073
gcaucacauugcguaaauc

SEQ ID NO: 2652725 - RNA, 19 nt, Escherichia coli CFT073
gcaucaccacguuagcaaa

SEQ ID NO: 2652726 - RNA, 21 nt, Escherichia coli CFT073
gcaucacccgcauaugcggcg

SEQ ID NO: 2652727 - RNA, 17 nt, Escherichia coli CFT073
gcaucaccgaugcgguu

SEQ ID NO: 2652728 - RNA, 17 nt, Escherichia coli CFT073
gcaucacgaauccgcac

SEQ ID NO: 2652729 - RNA, 23 nt, Escherichia coli CFT073
gcaucacgacaaaugcgccgcca

SEQ ID NO: 2652730 - RNA, 17 nt, Escherichia coli CFT073
gcaucacgacagcacca

SEQ ID NO: 2652731 - RNA, 18 nt, Escherichia coli CFT073
gcaucacgacagcaccac

SEQ ID NO: 2652732 - RNA, 19 nt, Escherichia coli CFT073
gcaucacgacagcaccacu

SEQ ID NO: 2652733 - RNA, 18 nt, Escherichia coli CFT073
gcaucacgaccgcuucag

SEQ ID NO: 2652734 - RNA, 17 nt, Escherichia coli CFT073
gcaucacgcaacauucc

SEQ ID NO: 2652735 - RNA, 20 nt, Escherichia coli CFT073
gcaucacgguaccuaccggu

SEQ ID NO: 2652736 - RNA, 18 nt, Escherichia coli CFT073
gcaucacugacaucacgc

SEQ ID NO: 2652737 - RNA, 20 nt, Escherichia coli CFT073
gcaucacugacaucacgcca

SEQ ID NO: 2652738 - RNA, 21 nt, Escherichia coli CFT073
gcaucacugacaucacgccac

SEQ ID NO: 2652739 - RNA, 21 nt, Escherichia coli CFT073
gcaucagacccacccaacaug

SEQ ID NO: 2652740 - RNA, 18 nt, Escherichia coli CFT073
gcaucagacugcuuuucc

SEQ ID NO: 2652741 - RNA, 11 nt, Escherichia coli CFT073
gcaucagcaau

SEQ ID NO: 2652742 - RNA, 12 nt, Escherichia coli CFT073
gcaucagcaauu

SEQ ID NO: 2652743 - RNA, 18 nt, Escherichia coli CFT073
gcaucagcaguuuuuccc

SEQ ID NO: 2652744 - RNA, 12 nt, Escherichia coli CFT073
gcaucagcaucg

SEQ ID NO: 2652745 - RNA, 16 nt, Escherichia coli CFT073
gcaucagccaggguuc

SEQ ID NO: 2652746 - RNA, 18 nt, Escherichia coli CFT073
gcaucagcgccuuaccaa

SEQ ID NO: 2652747 - RNA, 16 nt, Escherichia coli CFT073
gcaucagcgcuaccag

SEQ ID NO: 2652748 - RNA, 14 nt, Escherichia coli CFT073
gcaucagcuggcgu

SEQ ID NO: 2652749 - RNA, 19 nt, Escherichia coli CFT073
gcaucaggcaacccagaag

SEQ ID NO: 2652750 - RNA, 21 nt, Escherichia coli CFT073
gcaucaggcaucggagcaccg

SEQ ID NO: 2652751 - RNA, 15 nt, Escherichia coli CFT073
gcaucaggcaugaua

SEQ ID NO: 2652752 - RNA, 21 nt, Escherichia coli CFT073
gcaucaggcauuuaucgccug

SEQ ID NO: 2652753 - RNA, 17 nt, Escherichia coli CFT073
gcaucaggccaaacaga

SEQ ID NO: 2652754 - RNA, 15 nt, Escherichia coli CFT073
gcaucaggcuggugu

SEQ ID NO: 2652755 - RNA, 20 nt, Escherichia coli CFT073
gcaucaguuucgaucagcaa

SEQ ID NO: 2652756 - RNA, 21 nt, Escherichia coli CFT073
gcaucauccucuucaccggua

SEQ ID NO: 2652757 - RNA, 17 nt, Escherichia coli CFT073
gcaucaucgagaucgac

SEQ ID NO: 2652758 - RNA, 22 nt, Escherichia coli CFT073
gcaucaucucacgcaguuuauc

SEQ ID NO: 2652759 - RNA, 11 nt, Escherichia coli CFT073
gcaucaugcgg

SEQ ID NO: 2652760 - RNA, 17 nt, Escherichia coli CFT073
gcaucauguaaaucaau

SEQ ID NO: 2652761 - RNA, 18 nt, Escherichia coli CFT073
gcauccaacuucguuacu

SEQ ID NO: 2652762 - RNA, 20 nt, Escherichia coli CFT073
gcauccacaguaagccggua

SEQ ID NO: 2652763 - RNA, 17 nt, Escherichia coli CFT073
gcauccaggcaaaguac

SEQ ID NO: 2652764 - RNA, 17 nt, Escherichia coli CFT073
gcauccaggccaaaagc

SEQ ID NO: 2652765 - RNA, 18 nt, Escherichia coli CFT073
gcauccaggccaaaagcu

SEQ ID NO: 2652766 - RNA, 13 nt, Escherichia coli CFT073
gcauccaguucca

SEQ ID NO: 2652767 - RNA, 13 nt, Escherichia coli CFT073
gcauccaguuccu

SEQ ID NO: 2652768 - RNA, 21 nt, Escherichia coli CFT073
gcauccaguugcauacauaaa

SEQ ID NO: 2652769 - RNA, 18 nt, Escherichia coli CFT073
gcauccaguugcgccgca

SEQ ID NO: 2652770 - RNA, 20 nt, Escherichia coli CFT073
gcauccaguugcgccgcauu

SEQ ID NO: 2652771 - RNA, 16 nt, Escherichia coli CFT073
gcauccauaucgccau

SEQ ID NO: 2652772 - RNA, 22 nt, Escherichia coli CFT073
gcauccauaucgccauugcugg

SEQ ID NO: 2652773 - RNA, 18 nt, Escherichia coli CFT073
gcaucccauugcgugcag

SEQ ID NO: 2652774 - RNA, 12 nt, Escherichia coli CFT073
gcaucccgccgu

SEQ ID NO: 2652775 - RNA, 14 nt, Escherichia coli CFT073
gcaucccggcagga

SEQ ID NO: 2652776 - RNA, 23 nt, Escherichia coli CFT073
gcaucccgguaucaaagcgccag

SEQ ID NO: 2652777 - RNA, 17 nt, Escherichia coli CFT073
gcauccgaacgcugaca

SEQ ID NO: 2652778 - RNA, 16 nt, Escherichia coli CFT073
gcauccgacacuggca

SEQ ID NO: 2652779 - RNA, 20 nt, Escherichia coli CFT073
gcauccgacaucaacgccug

SEQ ID NO: 2652780 - RNA, 16 nt, Escherichia coli CFT073
gcauccgacuuugaag

SEQ ID NO: 2652781 - RNA, 23 nt, Escherichia coli CFT073
gcauccgauuguuccugcucauc

SEQ ID NO: 2652782 - RNA, 16 nt, Escherichia coli CFT073
gcauccgccagcagcu

SEQ ID NO: 2652783 - RNA, 19 nt, Escherichia coli CFT073
gcauccgcgcacaggcggc

SEQ ID NO: 2652784 - RNA, 18 nt, Escherichia coli CFT073
gcauccggcaacagugcc

SEQ ID NO: 2652785 - RNA, 14 nt, Escherichia coli CFT073
gcauccggcaucaa

SEQ ID NO: 2652786 - RNA, 18 nt, Escherichia coli CFT073
gcauccggcaugaacaaa

SEQ ID NO: 2652787 - RNA, 20 nt, Escherichia coli CFT073
gcauccggcaugaacaaagc

SEQ ID NO: 2652788 - RNA, 15 nt, Escherichia coli CFT073
gcauccggccaucag

SEQ ID NO: 2652789 - RNA, 16 nt, Escherichia coli CFT073
gcauccggcgcaaaaa

SEQ ID NO: 2652790 - RNA, 24 nt, Escherichia coli CFT073
gcauccguucuucggcgcugacca

SEQ ID NO: 2652791 - RNA, 13 nt, Escherichia coli CFT073
gcauccugaauua

SEQ ID NO: 2652792 - RNA, 19 nt, Escherichia coli CFT073
gcauccugcgcguuacugg

SEQ ID NO: 2652793 - RNA, 21 nt, Escherichia coli CFT073
gcauccuggcuguuacucaac

SEQ ID NO: 2652794 - RNA, 14 nt, Escherichia coli CFT073
gcauccuugcuaac

SEQ ID NO: 2652795 - RNA, 13 nt, Escherichia coli CFT073
gcaucgaccagga

SEQ ID NO: 2652796 - RNA, 12 nt, Escherichia coli CFT073
gcaucgacgcca

SEQ ID NO: 2652797 - RNA, 13 nt, Escherichia coli CFT073
gcaucgacgccau

SEQ ID NO: 2652798 - RNA, 21 nt, Escherichia coli CFT073
gcaucgcaaaccagacgcgcg

SEQ ID NO: 2652799 - RNA, 20 nt, Escherichia coli CFT073
gcaucgcaacgcaucuuuuu

SEQ ID NO: 2652800 - RNA, 16 nt, Escherichia coli CFT073
gcaucgcaccauucac

SEQ ID NO: 2652801 - RNA, 12 nt, Escherichia coli CFT073
gcaucgcaucaa

SEQ ID NO: 2652802 - RNA, 15 nt, Escherichia coli CFT073
gcaucgcaucaggcu

SEQ ID NO: 2652803 - RNA, 16 nt, Escherichia coli CFT073
gcaucgcaucaggcua

SEQ ID NO: 2652804 - RNA, 17 nt, Escherichia coli CFT073
gcaucgccaucaacaau

SEQ ID NO: 2652805 - RNA, 17 nt, Escherichia coli CFT073
gcaucgccauccuuucc

SEQ ID NO: 2652806 - RNA, 19 nt, Escherichia coli CFT073
gcaucgccauccuuucccu

SEQ ID NO: 2652807 - RNA, 23 nt, Escherichia coli CFT073
gcaucgcccagccaucgacacca

SEQ ID NO: 2652808 - RNA, 22 nt, Escherichia coli CFT073
gcaucgccgggaguuucagcgg

SEQ ID NO: 2652809 - RNA, 15 nt, Escherichia coli CFT073
gcaucgccgguuuug

SEQ ID NO: 2652810 - RNA, 18 nt, Escherichia coli CFT073
gcaucgccgguuuugcca

SEQ ID NO: 2652811 - RNA, 21 nt, Escherichia coli CFT073
gcaucgccgguuuugccaguc

SEQ ID NO: 2652812 - RNA, 23 nt, Escherichia coli CFT073
gcaucgcgacagugcauaaauac

SEQ ID NO: 2652813 - RNA, 16 nt, Escherichia coli CFT073
gcaucgcgaggaauga

SEQ ID NO: 2652814 - RNA, 15 nt, Escherichia coli CFT073
gcaucgcgcaccagc

SEQ ID NO: 2652815 - RNA, 21 nt, Escherichia coli CFT073
gcaucgcuaaucuggcggauc

SEQ ID NO: 2652816 - RNA, 19 nt, Escherichia coli CFT073
gcaucgcuagauauauauu

SEQ ID NO: 2652817 - RNA, 16 nt, Escherichia coli CFT073
gcaucggagcaccggg

SEQ ID NO: 2652818 - RNA, 13 nt, Escherichia coli CFT073
gcaucggcaucaa

SEQ ID NO: 2652819 - RNA, 22 nt, Escherichia coli CFT073
gcaucguaguuuuugcccauca

SEQ ID NO: 2652820 - RNA, 22 nt, Escherichia coli CFT073
gcaucguauuggugcauaacac

SEQ ID NO: 2652821 - RNA, 23 nt, Escherichia coli CFT073
gcaucguauuggugcauaacaca

SEQ ID NO: 2652822 - RNA, 18 nt, Escherichia coli CFT073
gcaucguauuucagaccu

SEQ ID NO: 2652823 - RNA, 18 nt, Escherichia coli CFT073
gcaucgucaucagcucca

SEQ ID NO: 2652824 - RNA, 21 nt, Escherichia coli CFT073
gcaucguccgucgaaagccca

SEQ ID NO: 2652825 - RNA, 15 nt, Escherichia coli CFT073
gcaucgugaauuuua

SEQ ID NO: 2652826 - RNA, 18 nt, Escherichia coli CFT073
gcaucuaucgaaucuguu

SEQ ID NO: 2652827 - RNA, 14 nt, Escherichia coli CFT073
gcaucuccugcaac

SEQ ID NO: 2652828 - RNA, 13 nt, Escherichia coli CFT073
gcaucucgcgcuc

SEQ ID NO: 2652829 - RNA, 21 nt, Escherichia coli CFT073
gcaucucgcgcucuucuucac

SEQ ID NO: 2652830 - RNA, 19 nt, Escherichia coli CFT073
gcaucucuucaaauagcgg

SEQ ID NO: 2652831 - RNA, 14 nt, Escherichia coli CFT073
gcaucugaagccug

SEQ ID NO: 2652832 - RNA, 22 nt, Escherichia coli CFT073
gcauuuaugccauguucaucaa

SEQ ID NO: 2652833 - RNA, 12 nt, Escherichia coli CFT073
gcauuuccgcca

SEQ ID NO: 2652834 - RNA, 19 nt, Escherichia coli CFT073
gcauuuccgccaaucaaga

SEQ ID NO: 2652835 - RNA, 16 nt, Escherichia coli CFT073
gcauuuccgcugauuc

SEQ ID NO: 2652836 - RNA, 17 nt, Escherichia coli CFT073
gcauuuccgcugauuca

SEQ ID NO: 2652837 - RNA, 18 nt, Escherichia coli CFT073
gcauuucggcccaugaca

SEQ ID NO: 2652838 - RNA, 20 nt, Escherichia coli CFT073
gcauuucggcccaugacaaa

SEQ ID NO: 2652839 - RNA, 19 nt, Escherichia coli CFT073
gcauuucucgguauuacaa

SEQ ID NO: 2652840 - RNA, 18 nt, Escherichia coli CFT073
gcauuugaacuggaaaaa

SEQ ID NO: 2652841 - RNA, 19 nt, Escherichia coli CFT073
gcauuugagcaggaugccu

SEQ ID NO: 2652842 - RNA, 16 nt, Escherichia coli CFT073
gcauuuguaggcagga

SEQ ID NO: 2652843 - RNA, 17 nt, Escherichia coli CFT073
gcauuuguugguacacc

SEQ ID NO: 2652844 - RNA, 16 nt, Escherichia coli CFT073
gcauuuucugcccguu

SEQ ID NO: 2652845 - RNA, 15 nt, Escherichia coli CFT073
gcauuuugcagcugu

SEQ ID NO: 2652846 - RNA, 19 nt, Escherichia coli CFT073
gcauuuugcggaucugcuc

SEQ ID NO: 2652847 - RNA, 22 nt, Escherichia coli CFT073
gcauuuuuuaucacuucuucuu

SEQ ID NO: 2652848 - RNA, 23 nt, Escherichia coli CFT073
gcauuuuuucuucaguucagcug

SEQ ID NO: 2652849 - RNA, 23 nt, Escherichia coli CFT073
gccaaaaauggagagaaccagcg

SEQ ID NO: 2652850 - RNA, 11 nt, Escherichia coli CFT073
gccaaaaugcu

SEQ ID NO: 2652851 - RNA, 14 nt, Escherichia coli CFT073
gccaaacaccaggc

SEQ ID NO: 2652852 - RNA, 17 nt, Escherichia coli CFT073
gccaaacauuucacguu

SEQ ID NO: 2652853 - RNA, 12 nt, Escherichia coli CFT073
gccaaaccagcu

SEQ ID NO: 2652854 - RNA, 20 nt, Escherichia coli CFT073
gccaaaccauugcuuaaagu

SEQ ID NO: 2652855 - RNA, 18 nt, Escherichia coli CFT073
gccaaacgcucccagcca

SEQ ID NO: 2652856 - RNA, 22 nt, Escherichia coli CFT073
gccaaacugugcaccgcccugc

SEQ ID NO: 2652857 - RNA, 21 nt, Escherichia coli CFT073
gccaaagaauuggcuuuaucu

SEQ ID NO: 2652858 - RNA, 14 nt, Escherichia coli CFT073
gccaaagccgccga

SEQ ID NO: 2652859 - RNA, 23 nt, Escherichia coli CFT073
gccaaagcgacacaaucaaaucc

SEQ ID NO: 2652860 - RNA, 21 nt, Escherichia coli CFT073
gccaaagcgccguagcuggcg

SEQ ID NO: 2652861 - RNA, 18 nt, Escherichia coli CFT073
gccaaagcggcaguuaaa

SEQ ID NO: 2652862 - RNA, 17 nt, Escherichia coli CFT073
gccaaagggagcagacu

SEQ ID NO: 2652863 - RNA, 16 nt, Escherichia coli CFT073
gccaaagucaucaauu

SEQ ID NO: 2652864 - RNA, 15 nt, Escherichia coli CFT073
gccaaauccagcgca

SEQ ID NO: 2652865 - RNA, 20 nt, Escherichia coli CFT073
gccaaauggcaggcacaggu

SEQ ID NO: 2652866 - RNA, 20 nt, Escherichia coli CFT073
gccaaauguauccaucacca

SEQ ID NO: 2652867 - RNA, 16 nt, Escherichia coli CFT073
gccaaaugucaccagc

SEQ ID NO: 2652868 - RNA, 20 nt, Escherichia coli CFT073
gccaaauucggcgguuuuuu

SEQ ID NO: 2652869 - RNA, 18 nt, Escherichia coli CFT073
gccaacaaaaaugcaggc

SEQ ID NO: 2652870 - RNA, 17 nt, Escherichia coli CFT073
gccaacaaaagcaacaa

SEQ ID NO: 2652871 - RNA, 12 nt, Escherichia coli CFT073
gccaacagcagc

SEQ ID NO: 2652872 - RNA, 21 nt, Escherichia coli CFT073
gccaacagcagccacaccaau

SEQ ID NO: 2652873 - RNA, 20 nt, Escherichia coli CFT073
gccaacagcgacaucaaauu

SEQ ID NO: 2652874 - RNA, 21 nt, Escherichia coli CFT073
gccaacagugccgaugccgcu

SEQ ID NO: 2652875 - RNA, 14 nt, Escherichia coli CFT073
gccaaccacaugau

SEQ ID NO: 2652876 - RNA, 12 nt, Escherichia coli CFT073
gccaaccaccgg

SEQ ID NO: 2652877 - RNA, 15 nt, Escherichia coli CFT073
gccaaccaggaugau

SEQ ID NO: 2652878 - RNA, 22 nt, Escherichia coli CFT073
gccaaccaucgccguaaagccg

SEQ ID NO: 2652879 - RNA, 16 nt, Escherichia coli CFT073
gccaaccaugccgccc

SEQ ID NO: 2652880 - RNA, 22 nt, Escherichia coli CFT073
gccaaccgcgacaauaucauca

SEQ ID NO: 2652881 - RNA, 19 nt, Escherichia coli CFT073
gccaaccucaaaaagaaac

SEQ ID NO: 2652882 - RNA, 16 nt, Escherichia coli CFT073
gccaaccugcugguca

SEQ ID NO: 2652883 - RNA, 20 nt, Escherichia coli CFT073
gccaacgaucuggcgucagc

SEQ ID NO: 2652884 - RNA, 22 nt, Escherichia coli CFT073
gccaacgaucuggcgucagcgg

SEQ ID NO: 2652885 - RNA, 17 nt, Escherichia coli CFT073
gccaacgcaccguaacc

SEQ ID NO: 2652886 - RNA, 18 nt, Escherichia coli CFT073
gccaacggggccagcaca

SEQ ID NO: 2652887 - RNA, 17 nt, Escherichia coli CFT073
gccaacgugacguuuca

SEQ ID NO: 2652888 - RNA, 23 nt, Escherichia coli CFT073
gccaacgugguuuaccaccagcg

SEQ ID NO: 2652889 - RNA, 14 nt, Escherichia coli CFT073
gccaacguuucugg

SEQ ID NO: 2652890 - RNA, 16 nt, Escherichia coli CFT073
gccaacucaacgccug

SEQ ID NO: 2652891 - RNA, 19 nt, Escherichia coli CFT073
gccaacuccaccaauaaug

SEQ ID NO: 2652892 - RNA, 16 nt, Escherichia coli CFT073
gccaagauagaaccac

SEQ ID NO: 2652893 - RNA, 11 nt, Escherichia coli CFT073
gccaagcaggc

SEQ ID NO: 2652894 - RNA, 18 nt, Escherichia coli CFT073
gccaagcaugucauacau

SEQ ID NO: 2652895 - RNA, 18 nt, Escherichia coli CFT073
gccaagcauuacgaaauc

SEQ ID NO: 2652896 - RNA, 13 nt, Escherichia coli CFT073
gccaagcgccgcc

SEQ ID NO: 2652897 - RNA, 15 nt, Escherichia coli CFT073
gccaagcgccgccuc

SEQ ID NO: 2652898 - RNA, 20 nt, Escherichia coli CFT073
gccaagcgccgccucagcca

SEQ ID NO: 2652899 - RNA, 19 nt, Escherichia coli CFT073
gccaaggaguuugaacaua

SEQ ID NO: 2652900 - RNA, 15 nt, Escherichia coli CFT073
gccaaggucgggguc

SEQ ID NO: 2652901 - RNA, 19 nt, Escherichia coli CFT073
gccaaguucgaacgccgcc

SEQ ID NO: 2652902 - RNA, 20 nt, Escherichia coli CFT073
gccaaguucgaacgccgcca

SEQ ID NO: 2652903 - RNA, 19 nt, Escherichia coli CFT073
gccaauaaaacgcaccggc

SEQ ID NO: 2652904 - RNA, 11 nt, Escherichia coli CFT073
gccaauaaucu

SEQ ID NO: 2652905 - RNA, 13 nt, Escherichia coli CFT073
gccaauaaucugc

SEQ ID NO: 2652906 - RNA, 21 nt, Escherichia coli CFT073
gccaauaaugcccgcaccacc

SEQ ID NO: 2652907 - RNA, 18 nt, Escherichia coli CFT073
gccaauaccaaaaucauc

SEQ ID NO: 2652908 - RNA, 18 nt, Escherichia coli CFT073
gccaauaccgaucaguac

SEQ ID NO: 2652909 - RNA, 22 nt, Escherichia coli CFT073
gccaauaccgaucaguaccagc

SEQ ID NO: 2652910 - RNA, 19 nt, Escherichia coli CFT073
gccaauagccgcaccgagc

SEQ ID NO: 2652911 - RNA, 16 nt, Escherichia coli CFT073
gccaaucacaucaggc

SEQ ID NO: 2652912 - RNA, 19 nt, Escherichia coli CFT073
gccaaucaucguaccgaua

SEQ ID NO: 2652913 - RNA, 19 nt, Escherichia coli CFT073
gccaaucccggaagccacc

SEQ ID NO: 2652914 - RNA, 20 nt, Escherichia coli CFT073
gccaaucccggaagccacca

SEQ ID NO: 2652915 - RNA, 20 nt, Escherichia coli CFT073
gccaaucccgucuucgucug

SEQ ID NO: 2652916 - RNA, 16 nt, Escherichia coli CFT073
gccaaucgccacgcca

SEQ ID NO: 2652917 - RNA, 18 nt, Escherichia coli CFT073
gccaaucgucgccgucau

SEQ ID NO: 2652918 - RNA, 19 nt, Escherichia coli CFT073
gccaaucuucacaucauca

SEQ ID NO: 2652919 - RNA, 17 nt, Escherichia coli CFT073
gccaauggugucgucga

SEQ ID NO: 2652920 - RNA, 19 nt, Escherichia coli CFT073
gccaauguagccacggauc

SEQ ID NO: 2652921 - RNA, 18 nt, Escherichia coli CFT073
gccaauuaccacugaggc

SEQ ID NO: 2652922 - RNA, 17 nt, Escherichia coli CFT073
gccaauuacgccugccc

SEQ ID NO: 2652923 - RNA, 11 nt, Escherichia coli CFT073
gccaauuccca

SEQ ID NO: 2652924 - RNA, 19 nt, Escherichia coli CFT073
gccaauuucccgcguccgc

SEQ ID NO: 2652925 - RNA, 17 nt, Escherichia coli CFT073
gccaauuugcgccgccg

SEQ ID NO: 2652926 - RNA, 22 nt, Escherichia coli CFT073
gccacaacgauaauccagcaga

SEQ ID NO: 2652927 - RNA, 13 nt, Escherichia coli CFT073
gccacaacuucaa

SEQ ID NO: 2652928 - RNA, 14 nt, Escherichia coli CFT073
gccacaacuucaac

SEQ ID NO: 2652929 - RNA, 17 nt, Escherichia coli CFT073
gccacaacuucaacguu

SEQ ID NO: 2652930 - RNA, 13 nt, Escherichia coli CFT073
gccacaagggcau

SEQ ID NO: 2652931 - RNA, 20 nt, Escherichia coli CFT073
gccacaauaaagcgauaaau

SEQ ID NO: 2652932 - RNA, 19 nt, Escherichia coli CFT073
gccacaauacugaucauca

SEQ ID NO: 2652933 - RNA, 21 nt, Escherichia coli CFT073
gccacaauacugaucaucauu

SEQ ID NO: 2652934 - RNA, 13 nt, Escherichia coli CFT073
gccacaaucagcg

SEQ ID NO: 2652935 - RNA, 22 nt, Escherichia coli CFT073
gccacaaucgcagcgcaagcug

SEQ ID NO: 2652936 - RNA, 22 nt, Escherichia coli CFT073
gccacaaucggcguaccgcaca

SEQ ID NO: 2652937 - RNA, 17 nt, Escherichia coli CFT073
gccacaaucucgcccgc

SEQ ID NO: 2652938 - RNA, 23 nt, Escherichia coli CFT073
gccacaccacgguguugguaaac

SEQ ID NO: 2652939 - RNA, 22 nt, Escherichia coli CFT073
gccacaccugccgggaauacug

SEQ ID NO: 2652940 - RNA, 14 nt, Escherichia coli CFT073
gccacuuugcgggc

SEQ ID NO: 2652941 - RNA, 20 nt, Escherichia coli CFT073
gccacuuuuuucacccacac

SEQ ID NO: 2652942 - RNA, 16 nt, Escherichia coli CFT073
gccagaaaaccuggcg

SEQ ID NO: 2652943 - RNA, 18 nt, Escherichia coli CFT073
gccagaaaaccuggcgca

SEQ ID NO: 2652944 - RNA, 20 nt, Escherichia coli CFT073
gccagaaaaccuggcgcagu

SEQ ID NO: 2652945 - RNA, 21 nt, Escherichia coli CFT073
gccagaaaaccuggcgcagug

SEQ ID NO: 2652946 - RNA, 13 nt, Escherichia coli CFT073
gccagaaaccagc

SEQ ID NO: 2652947 - RNA, 14 nt, Escherichia coli CFT073
gccagaaaccagcc

SEQ ID NO: 2652948 - RNA, 22 nt, Escherichia coli CFT073
gccagaaaccagccacggcgca

SEQ ID NO: 2652949 - RNA, 19 nt, Escherichia coli CFT073
gccagaaaccaucuauaaa

SEQ ID NO: 2652950 - RNA, 14 nt, Escherichia coli CFT073
gccagaaaggcuuu

SEQ ID NO: 2652951 - RNA, 15 nt, Escherichia coli CFT073
gccagaaagguauuu

SEQ ID NO: 2652952 - RNA, 16 nt, Escherichia coli CFT073
gccagaaaucagcagc

SEQ ID NO: 2652953 - RNA, 21 nt, Escherichia coli CFT073
gccagaaauuugcagugcugu

SEQ ID NO: 2652954 - RNA, 21 nt, Escherichia coli CFT073
gccagaacacgcucccagcag

SEQ ID NO: 2652955 - RNA, 14 nt, Escherichia coli CFT073
gccagaacagaaau

SEQ ID NO: 2652956 - RNA, 15 nt, Escherichia coli CFT073
gccagaacagaaaug

SEQ ID NO: 2652957 - RNA, 13 nt, Escherichia coli CFT073
gccagaaccgagc

SEQ ID NO: 2652958 - RNA, 14 nt, Escherichia coli CFT073
gccagaaccgagca

SEQ ID NO: 2652959 - RNA, 15 nt, Escherichia coli CFT073
gccagaagcagaaug

SEQ ID NO: 2652960 - RNA, 14 nt, Escherichia coli CFT073
gccagaagcccgga

SEQ ID NO: 2652961 - RNA, 23 nt, Escherichia coli CFT073
gccagaagcccggaucguucacg

SEQ ID NO: 2652962 - RNA, 23 nt, Escherichia coli CFT073
gccagaauaagucucccgcccug

SEQ ID NO: 2652963 - RNA, 15 nt, Escherichia coli CFT073
gccagaauagccgca

SEQ ID NO: 2652964 - RNA, 14 nt, Escherichia coli CFT073
gccagaauagcgcc

SEQ ID NO: 2652965 - RNA, 16 nt, Escherichia coli CFT073
gccagaauagcgccgc

SEQ ID NO: 2652966 - RNA, 14 nt, Escherichia coli CFT073
gccagaaucaccuc

SEQ ID NO: 2652967 - RNA, 17 nt, Escherichia coli CFT073
gccagaauccccggcag

SEQ ID NO: 2652968 - RNA, 21 nt, Escherichia coli CFT073
gccagaauccccggcaggaag

SEQ ID NO: 2652969 - RNA, 22 nt, Escherichia coli CFT073
gccagaauccggugauugcugc

SEQ ID NO: 2652970 - RNA, 19 nt, Escherichia coli CFT073
gccagaaugaggcaucauu

SEQ ID NO: 2652971 - RNA, 21 nt, Escherichia coli CFT073
gccagacaaaacugacgccau

SEQ ID NO: 2652972 - RNA, 15 nt, Escherichia coli CFT073
gccagacaauccagc

SEQ ID NO: 2652973 - RNA, 18 nt, Escherichia coli CFT073
gccagacacuggaaacag

SEQ ID NO: 2652974 - RNA, 14 nt, Escherichia coli CFT073
gccagacagugucu

SEQ ID NO: 2652975 - RNA, 16 nt, Escherichia coli CFT073
gccagacauuacaaaa

SEQ ID NO: 2652976 - RNA, 22 nt, Escherichia coli CFT073
gccagacauuacaaaauacaaa

SEQ ID NO: 2652977 - RNA, 15 nt, Escherichia coli CFT073
gccagaccacucauu

SEQ ID NO: 2652978 - RNA, 12 nt, Escherichia coli CFT073
gccagaccacug

SEQ ID NO: 2652979 - RNA, 19 nt, Escherichia coli CFT073
gccagaccacugcgccgcu

SEQ ID NO: 2652980 - RNA, 13 nt, Escherichia coli CFT073
gccagaccgaaca

SEQ ID NO: 2652981 - RNA, 22 nt, Escherichia coli CFT073
gccagaccgaacagcauacggc

SEQ ID NO: 2652982 - RNA, 20 nt, Escherichia coli CFT073
gccagaccuuaucccgccgg

SEQ ID NO: 2652983 - RNA, 21 nt, Escherichia coli CFT073
gccagacgcgucacgcacugg

SEQ ID NO: 2652984 - RNA, 20 nt, Escherichia coli CFT073
gccagacguugauaaccacg

SEQ ID NO: 2652985 - RNA, 17 nt, Escherichia coli CFT073
gccagacucaccagcau

SEQ ID NO: 2652986 - RNA, 19 nt, Escherichia coli CFT073
gccagacucaccagcaucg

SEQ ID NO: 2652987 - RNA, 13 nt, Escherichia coli CFT073
gccagacucagca

SEQ ID NO: 2652988 - RNA, 13 nt, Escherichia coli CFT073
gccagacucgcca

SEQ ID NO: 2652989 - RNA, 20 nt, Escherichia coli CFT073
gccagacugacaaucaucgc

SEQ ID NO: 2652990 - RNA, 17 nt, Escherichia coli CFT073
gccagacugaucaucgc

SEQ ID NO: 2652991 - RNA, 20 nt, Escherichia coli CFT073
gccagagaaagcccgcguaa

SEQ ID NO: 2652992 - RNA, 15 nt, Escherichia coli CFT073
gccagagaagcgacu

SEQ ID NO: 2652993 - RNA, 14 nt, Escherichia coli CFT073
gccagagaucgcac

SEQ ID NO: 2652994 - RNA, 16 nt, Escherichia coli CFT073
gccagagaucgcacau

SEQ ID NO: 2652995 - RNA, 16 nt, Escherichia coli CFT073
gccagagcagcaacaa

SEQ ID NO: 2652996 - RNA, 12 nt, Escherichia coli CFT073
gccagagcagcg

SEQ ID NO: 2652997 - RNA, 12 nt, Escherichia coli CFT073
gccagagcugcg

SEQ ID NO: 2652998 - RNA, 19 nt, Escherichia coli CFT073
gccagagucagcaaugcca

SEQ ID NO: 2652999 - RNA, 22 nt, Escherichia coli CFT073
gccagagucagcacgagugagu

SEQ ID NO: 2653000 - RNA, 21 nt, Escherichia coli CFT073
gccagauaaauauuauuggca

SEQ ID NO: 2653001 - RNA, 20 nt, Escherichia coli CFT073
gccagauaaccggcacugaa

SEQ ID NO: 2653002 - RNA, 18 nt, Escherichia coli CFT073
gccagauaagacgcguca

SEQ ID NO: 2653003 - RNA, 19 nt, Escherichia coli CFT073
gccagauaagacgcgucag

SEQ ID NO: 2653004 - RNA, 14 nt, Escherichia coli CFT073
gccagauaauggcu

SEQ ID NO: 2653005 - RNA, 11 nt, Escherichia coli CFT073
gccagauagcc

SEQ ID NO: 2653006 - RNA, 23 nt, Escherichia coli CFT073
gccagauagccgaccgcaaggaa

SEQ ID NO: 2653007 - RNA, 17 nt, Escherichia coli CFT073
gccagauauugauucau

SEQ ID NO: 2653008 - RNA, 13 nt, Escherichia coli CFT073
gccagauccgcca

SEQ ID NO: 2653009 - RNA, 16 nt, Escherichia coli CFT073
gccagauccuggcugu

SEQ ID NO: 2653010 - RNA, 14 nt, Escherichia coli CFT073
gccagaugcggcgu

SEQ ID NO: 2653011 - RNA, 14 nt, Escherichia coli CFT073
gccagauggcaucc

SEQ ID NO: 2653012 - RNA, 18 nt, Escherichia coli CFT073
gccagauguuccgccauu

SEQ ID NO: 2653013 - RNA, 13 nt, Escherichia coli CFT073
gccagauugcugc

SEQ ID NO: 2653014 - RNA, 14 nt, Escherichia coli CFT073
gccagauugcugcu

SEQ ID NO: 2653015 - RNA, 23 nt, Escherichia coli CFT073
gccagauuguuauccagcuguuc

SEQ ID NO: 2653016 - RNA, 20 nt, Escherichia coli CFT073
gccagauuuucuucagcuua

SEQ ID NO: 2653017 - RNA, 13 nt, Escherichia coli CFT073
gccagcaaaaaau

SEQ ID NO: 2653018 - RNA, 19 nt, Escherichia coli CFT073
gccagcaaaaucaccauca

SEQ ID NO: 2653019 - RNA, 15 nt, Escherichia coli CFT073
gccagcaaaucagcc

SEQ ID NO: 2653020 - RNA, 19 nt, Escherichia coli CFT073
gccagcaacuguaacgcag

SEQ ID NO: 2653021 - RNA, 19 nt, Escherichia coli CFT073
gccagcaagagcaaauaaa

SEQ ID NO: 2653022 - RNA, 22 nt, Escherichia coli CFT073
gccagcaagagcaaauaaaaca

SEQ ID NO: 2653023 - RNA, 15 nt, Escherichia coli CFT073
gccagcaauccccag

SEQ ID NO: 2653024 - RNA, 18 nt, Escherichia coli CFT073
gccagcaauccccagaca

SEQ ID NO: 2653025 - RNA, 14 nt, Escherichia coli CFT073
gccagcaauggaca

SEQ ID NO: 2653026 - RNA, 18 nt, Escherichia coli CFT073
gccagcacacccagcgaa

SEQ ID NO: 2653027 - RNA, 21 nt, Escherichia coli CFT073
gccagcacagaucgcacuuaa

SEQ ID NO: 2653028 - RNA, 15 nt, Escherichia coli CFT073
gccagcacagccagc

SEQ ID NO: 2653029 - RNA, 16 nt, Escherichia coli CFT073
gccagcacagccagcc

SEQ ID NO: 2653030 - RNA, 13 nt, Escherichia coli CFT073
gccagcaccaaac

SEQ ID NO: 2653031 - RNA, 20 nt, Escherichia coli CFT073
gccagcaccacuuuacgggc

SEQ ID NO: 2653032 - RNA, 12 nt, Escherichia coli CFT073
gccagcaccagc

SEQ ID NO: 2653033 - RNA, 14 nt, Escherichia coli CFT073
gccagcaccagcaa

SEQ ID NO: 2653034 - RNA, 15 nt, Escherichia coli CFT073
gccagcaccagcaac

SEQ ID NO: 2653035 - RNA, 13 nt, Escherichia coli CFT073
gccagcaccaggc

SEQ ID NO: 2653036 - RNA, 12 nt, Escherichia coli CFT073
gccagcaccauc

SEQ ID NO: 2653037 - RNA, 13 nt, Escherichia coli CFT073
gccagcaccaucg

SEQ ID NO: 2653038 - RNA, 15 nt, Escherichia coli CFT073
gccagcaccgggcca

SEQ ID NO: 2653039 - RNA, 15 nt, Escherichia coli CFT073
gccagcacggcgcag

SEQ ID NO: 2653040 - RNA, 21 nt, Escherichia coli CFT073
gccagcacggcgcagacgguc

SEQ ID NO: 2653041 - RNA, 18 nt, Escherichia coli CFT073
gccagcacugccagccac

SEQ ID NO: 2653042 - RNA, 22 nt, Escherichia coli CFT073
gccagcagaaugacaucaucgc

SEQ ID NO: 2653043 - RNA, 15 nt, Escherichia coli CFT073
gccagcagagcaaaa

SEQ ID NO: 2653044 - RNA, 18 nt, Escherichia coli CFT073
gccagcagaggaauaucu

SEQ ID NO: 2653045 - RNA, 13 nt, Escherichia coli CFT073
gccagcagcaacc

SEQ ID NO: 2653046 - RNA, 23 nt, Escherichia coli CFT073
gccagcagcgaaucagcccagcc

SEQ ID NO: 2653047 - RNA, 22 nt, Escherichia coli CFT073
gccagcagcugacugacuucaa

SEQ ID NO: 2653048 - RNA, 21 nt, Escherichia coli CFT073
gccagcagggcaaucgcgcca

SEQ ID NO: 2653049 - RNA, 22 nt, Escherichia coli CFT073
gccaguaaaccaaucaauucuc

SEQ ID NO: 2653050 - RNA, 15 nt, Escherichia coli CFT073
gccaguaaagcagcg

SEQ ID NO: 2653051 - RNA, 14 nt, Escherichia coli CFT073
gccaguaacucauu

SEQ ID NO: 2653052 - RNA, 18 nt, Escherichia coli CFT073
gccaguaagcaguccagc

SEQ ID NO: 2653053 - RNA, 16 nt, Escherichia coli CFT073
gccaguaagguaacgc

SEQ ID NO: 2653054 - RNA, 14 nt, Escherichia coli CFT073
gccaguaauaaaga

SEQ ID NO: 2653055 - RNA, 19 nt, Escherichia coli CFT073
gccaguaauccggcuuccu

SEQ ID NO: 2653056 - RNA, 20 nt, Escherichia coli CFT073
gccaguaaucggcugaacgu

SEQ ID NO: 2653057 - RNA, 22 nt, Escherichia coli CFT073
gccaguaaucggcugaacgugc

SEQ ID NO: 2653058 - RNA, 15 nt, Escherichia coli CFT073
gccaguacacgcuga

SEQ ID NO: 2653059 - RNA, 17 nt, Escherichia coli CFT073
gccaguacagcccgccg

SEQ ID NO: 2653060 - RNA, 20 nt, Escherichia coli CFT073
gccaguacagcccgccggaa

SEQ ID NO: 2653061 - RNA, 14 nt, Escherichia coli CFT073
gccaguaccagcag

SEQ ID NO: 2653062 - RNA, 17 nt, Escherichia coli CFT073
gccaguaccgccgcagu

SEQ ID NO: 2653063 - RNA, 19 nt, Escherichia coli CFT073
gccaguaccgccgcaguca

SEQ ID NO: 2653064 - RNA, 13 nt, Escherichia coli CFT073
gccaguacgccca

SEQ ID NO: 2653065 - RNA, 12 nt, Escherichia coli CFT073
gccaguacugca

SEQ ID NO: 2653066 - RNA, 19 nt, Escherichia coli CFT073
gccaguacugcagguugca

SEQ ID NO: 2653067 - RNA, 14 nt, Escherichia coli CFT073
gccaguagaacaau

SEQ ID NO: 2653068 - RNA, 17 nt, Escherichia coli CFT073
gccaguagaacaauuaa

SEQ ID NO: 2653069 - RNA, 18 nt, Escherichia coli CFT073
gccaguagcaccucucca

SEQ ID NO: 2653070 - RNA, 19 nt, Escherichia coli CFT073
gccaguagcaccucuccac

SEQ ID NO: 2653071 - RNA, 22 nt, Escherichia coli CFT073
gccaguagcaccucuccacgca

SEQ ID NO: 2653072 - RNA, 20 nt, Escherichia coli CFT073
gccagucacugccaccaucc

SEQ ID NO: 2653073 - RNA, 16 nt, Escherichia coli CFT073
gccagucaguuaagca

SEQ ID NO: 2653074 - RNA, 22 nt, Escherichia coli CFT073
gccagucauuuucuucagcagu

SEQ ID NO: 2653075 - RNA, 22 nt, Escherichia coli CFT073
gccaguccccucgccccuccgg

SEQ ID NO: 2653076 - RNA, 16 nt, Escherichia coli CFT073
gccagucccuuucagg

SEQ ID NO: 2653077 - RNA, 16 nt, Escherichia coli CFT073
gccaguccuucaauau

SEQ ID NO: 2653078 - RNA, 18 nt, Escherichia coli CFT073
gccagucgguagugccgu

SEQ ID NO: 2653079 - RNA, 18 nt, Escherichia coli CFT073
gccagucuuccaucacaa

SEQ ID NO: 2653080 - RNA, 16 nt, Escherichia coli CFT073
gccagugcacuaccgu

SEQ ID NO: 2653081 - RNA, 14 nt, Escherichia coli CFT073
gccagugcaucagc

SEQ ID NO: 2653082 - RNA, 18 nt, Escherichia coli CFT073
gccagugccgagauauuu

SEQ ID NO: 2653083 - RNA, 18 nt, Escherichia coli CFT073
gccagugccugacgaaug

SEQ ID NO: 2653084 - RNA, 20 nt, Escherichia coli CFT073
gccagugguaaaaaagugau

SEQ ID NO: 2653085 - RNA, 17 nt, Escherichia coli CFT073
gccaguguagcgauuuc

SEQ ID NO: 2653086 - RNA, 23 nt, Escherichia coli CFT073
gccaguguagcgauuucacgcuc

SEQ ID NO: 2653087 - RNA, 18 nt, Escherichia coli CFT073
gccagugucgcaucaggc

SEQ ID NO: 2653088 - RNA, 15 nt, Escherichia coli CFT073
gccaguguucuuccg

SEQ ID NO: 2653089 - RNA, 23 nt, Escherichia coli CFT073
gccaguguuuaucaucucggguu

SEQ ID NO: 2653090 - RNA, 18 nt, Escherichia coli CFT073
gccaguucauccagacgg

SEQ ID NO: 2653091 - RNA, 22 nt, Escherichia coli CFT073
gccaguuccacuucugcacggu

SEQ ID NO: 2653092 - RNA, 12 nt, Escherichia coli CFT073
gccaguuccccc

SEQ ID NO: 2653093 - RNA, 14 nt, Escherichia coli CFT073
gccaguucccccug

SEQ ID NO: 2653094 - RNA, 14 nt, Escherichia coli CFT073
gccaguucgauguu

SEQ ID NO: 2653095 - RNA, 14 nt, Escherichia coli CFT073
gccaguucucacca

SEQ ID NO: 2653096 - RNA, 19 nt, Escherichia coli CFT073
gccaguucuuccgcagagu

SEQ ID NO: 2653097 - RNA, 19 nt, Escherichia coli CFT073
gccaguuuacccagugaau

SEQ ID NO: 2653098 - RNA, 19 nt, Escherichia coli CFT073
gccaguuucggacgcggca

SEQ ID NO: 2653099 - RNA, 21 nt, Escherichia coli CFT073
gccaguuucgggaucaucuca

SEQ ID NO: 2653100 - RNA, 21 nt, Escherichia coli CFT073
gccaguuucugcccaaucaaa

SEQ ID NO: 2653101 - RNA, 18 nt, Escherichia coli CFT073
gccaguuugacaucguca

SEQ ID NO: 2653102 - RNA, 21 nt, Escherichia coli CFT073
gccaguuugcaggccaaacag

SEQ ID NO: 2653103 - RNA, 17 nt, Escherichia coli CFT073
gccaguuugcgcgugcu

SEQ ID NO: 2653104 - RNA, 22 nt, Escherichia coli CFT073
gccaguuuggucuggcaaaaau

SEQ ID NO: 2653105 - RNA, 22 nt, Escherichia coli CFT073
gccaguuuuucagcgccagcgc

SEQ ID NO: 2653106 - RNA, 23 nt, Escherichia coli CFT073
gccaguuuuuccgcuuacugguu

SEQ ID NO: 2653107 - RNA, 20 nt, Escherichia coli CFT073
gccaguuuuugcuucugaau

SEQ ID NO: 2653108 - RNA, 20 nt, Escherichia coli CFT073
gccaguuuuuuagcguguuc

SEQ ID NO: 2653109 - RNA, 14 nt, Escherichia coli CFT073
gccauaaaaacgau

SEQ ID NO: 2653110 - RNA, 20 nt, Escherichia coli CFT073
gccauaaaccgagccaaacg

SEQ ID NO: 2653111 - RNA, 16 nt, Escherichia coli CFT073
gccauaaacgguuuca

SEQ ID NO: 2653112 - RNA, 19 nt, Escherichia coli CFT073
gccauaaacuucauucagc

SEQ ID NO: 2653113 - RNA, 20 nt, Escherichia coli CFT073
gccauaaacuucauucagcc

SEQ ID NO: 2653114 - RNA, 19 nt, Escherichia coli CFT073
gccauaaagaaaucaccug

SEQ ID NO: 2653115 - RNA, 16 nt, Escherichia coli CFT073
gccauaaccaugcagc

SEQ ID NO: 2653116 - RNA, 15 nt, Escherichia coli CFT073
gccauaaccgccagc

SEQ ID NO: 2653117 - RNA, 18 nt, Escherichia coli CFT073
gccauaaccgccagcaca

SEQ ID NO: 2653118 - RNA, 19 nt, Escherichia coli CFT073
gccauaaccugccagcagu

SEQ ID NO: 2653119 - RNA, 23 nt, Escherichia coli CFT073
gccauaaccugccagcaguuuga

SEQ ID NO: 2653120 - RNA, 15 nt, Escherichia coli CFT073
gccauaaucagcgca

SEQ ID NO: 2653121 - RNA, 19 nt, Escherichia coli CFT073
gccauaccaugcaccaacc

SEQ ID NO: 2653122 - RNA, 24 nt, Escherichia coli CFT073
gccauacccgcacaaauagccagc

SEQ ID NO: 2653123 - RNA, 19 nt, Escherichia coli CFT073
gccauaccuggugcagcgg

SEQ ID NO: 2653124 - RNA, 13 nt, Escherichia coli CFT073
gccauacgcccgc

SEQ ID NO: 2653125 - RNA, 20 nt, Escherichia coli CFT073
gccauagcgggcaaucagcg

SEQ ID NO: 2653126 - RNA, 15 nt, Escherichia coli CFT073
gccauauaugccauc

SEQ ID NO: 2653127 - RNA, 19 nt, Escherichia coli CFT073
gccauauggcugcauccag

SEQ ID NO: 2653128 - RNA, 16 nt, Escherichia coli CFT073
gccauauugaccguuu

SEQ ID NO: 2653129 - RNA, 17 nt, Escherichia coli CFT073
gccauauuuaacuccuu

SEQ ID NO: 2653130 - RNA, 15 nt, Escherichia coli CFT073
gccauauuucacaua

SEQ ID NO: 2653131 - RNA, 17 nt, Escherichia coli CFT073
gccaucaacaauuccca

SEQ ID NO: 2653132 - RNA, 17 nt, Escherichia coli CFT073
gccaucaauaaccagcg

SEQ ID NO: 2653133 - RNA, 20 nt, Escherichia coli CFT073
gccaucaaucacuuugcgcu

SEQ ID NO: 2653134 - RNA, 16 nt, Escherichia coli CFT073
gccaucaaucccaucu

SEQ ID NO: 2653135 - RNA, 14 nt, Escherichia coli CFT073
gccaucaaucgacc

SEQ ID NO: 2653136 - RNA, 18 nt, Escherichia coli CFT073
gccaucaaucgaccgacu

SEQ ID NO: 2653137 - RNA, 21 nt, Escherichia coli CFT073
gccaucaauugcucacucccg

SEQ ID NO: 2653138 - RNA, 14 nt, Escherichia coli CFT073
gccaucacacccug

SEQ ID NO: 2653139 - RNA, 17 nt, Escherichia coli CFT073
gccaucacauccugaua

SEQ ID NO: 2653140 - RNA, 13 nt, Escherichia coli CFT073
gccaucacggauc

SEQ ID NO: 2653141 - RNA, 20 nt, Escherichia coli CFT073
gccaucacuauucagaucuu

SEQ ID NO: 2653142 - RNA, 12 nt, Escherichia coli CFT073
gccaucagcagc

SEQ ID NO: 2653143 - RNA, 16 nt, Escherichia coli CFT073
gccaucagcagcggag

SEQ ID NO: 2653144 - RNA, 16 nt, Escherichia coli CFT073
gccaucagccacuuca

SEQ ID NO: 2653145 - RNA, 19 nt, Escherichia coli CFT073
gccaucagggccaaucaac

SEQ ID NO: 2653146 - RNA, 23 nt, Escherichia coli CFT073
gccaucaguauuaucaaaucacc

SEQ ID NO: 2653147 - RNA, 18 nt, Escherichia coli CFT073
gccaucaucccuacaggu

SEQ ID NO: 2653148 - RNA, 22 nt, Escherichia coli CFT073
gccaucaucuuccacuuugucg

SEQ ID NO: 2653149 - RNA, 15 nt, Escherichia coli CFT073
gccaucauuuugcua

SEQ ID NO: 2653150 - RNA, 16 nt, Escherichia coli CFT073
gccaucauuuugcuau

SEQ ID NO: 2653151 - RNA, 18 nt, Escherichia coli CFT073
gccauccaucaacgccag

SEQ ID NO: 2653152 - RNA, 18 nt, Escherichia coli CFT073
gccaucccugcaacauca

SEQ ID NO: 2653153 - RNA, 20 nt, Escherichia coli CFT073
gccauccgcgugacgcuggc

SEQ ID NO: 2653154 - RNA, 16 nt, Escherichia coli CFT073
gccauccggcucgcau

SEQ ID NO: 2653155 - RNA, 19 nt, Escherichia coli CFT073
gccauccguaauuauuacu

SEQ ID NO: 2653156 - RNA, 17 nt, Escherichia coli CFT073
gccaucgacaccagcca

SEQ ID NO: 2653157 - RNA, 22 nt, Escherichia coli CFT073
gcccaggaagcccgcccagcuu

SEQ ID NO: 2653158 - RNA, 13 nt, Escherichia coli CFT073
gcccaggaaggcu

SEQ ID NO: 2653159 - RNA, 22 nt, Escherichia coli CFT073
gcccaggacaaucacauccgga

SEQ ID NO: 2653160 - RNA, 20 nt, Escherichia coli CFT073
gcccaggaguuacugcaacg

SEQ ID NO: 2653161 - RNA, 21 nt, Escherichia coli CFT073
gcccaggcaaguagcgccaga

SEQ ID NO: 2653162 - RNA, 21 nt, Escherichia coli CFT073
gcccagguuauacaccuguuc

SEQ ID NO: 2653163 - RNA, 12 nt, Escherichia coli CFT073
gcccaguaccgc

SEQ ID NO: 2653164 - RNA, 14 nt, Escherichia coli CFT073
gcccagugccagca

SEQ ID NO: 2653165 - RNA, 13 nt, Escherichia coli CFT073
gcccaguguuuua

SEQ ID NO: 2653166 - RNA, 21 nt, Escherichia coli CFT073
gcccaguuagacgugcgaaug

SEQ ID NO: 2653167 - RNA, 23 nt, Escherichia coli CFT073
gcccaguuucgacaucacauuaa

SEQ ID NO: 2653168 - RNA, 17 nt, Escherichia coli CFT073
gcccauaaauacgucuu

SEQ ID NO: 2653169 - RNA, 15 nt, Escherichia coli CFT073
gcccauaagcaaaag

SEQ ID NO: 2653170 - RNA, 19 nt, Escherichia coli CFT073
gcccauacauaccagcagg

SEQ ID NO: 2653171 - RNA, 16 nt, Escherichia coli CFT073
gcccauaccacagcaa

SEQ ID NO: 2653172 - RNA, 22 nt, Escherichia coli CFT073
gcccauacuuaaugccaguuca

SEQ ID NO: 2653173 - RNA, 21 nt, Escherichia coli CFT073
gcccauaugcagccacugcug

SEQ ID NO: 2653174 - RNA, 14 nt, Escherichia coli CFT073
gcccaucaggccag

SEQ ID NO: 2653175 - RNA, 15 nt, Escherichia coli CFT073
gcccaucaggccagg

SEQ ID NO: 2653176 - RNA, 19 nt, Escherichia coli CFT073
gcccaucaggccaggcgug

SEQ ID NO: 2653177 - RNA, 15 nt, Escherichia coli CFT073
gcccaucaucaucgg

SEQ ID NO: 2653178 - RNA, 17 nt, Escherichia coli CFT073
gcccaucaucaucggca

SEQ ID NO: 2653179 - RNA, 23 nt, Escherichia coli CFT073
gcccaucaucaucggcaccgcca

SEQ ID NO: 2653180 - RNA, 15 nt, Escherichia coli CFT073
gcccaucauccgcgc

SEQ ID NO: 2653181 - RNA, 15 nt, Escherichia coli CFT073
gcccaucaugcgcca

SEQ ID NO: 2653182 - RNA, 18 nt, Escherichia coli CFT073
gcccaucaugcgccaggu

SEQ ID NO: 2653183 - RNA, 15 nt, Escherichia coli CFT073
gcccauccaggguuu

SEQ ID NO: 2653184 - RNA, 24 nt, Escherichia coli CFT073
gcccauccaggguuuuauuauucc

SEQ ID NO: 2653185 - RNA, 21 nt, Escherichia coli CFT073
gcccaucgccacgccuguacc

SEQ ID NO: 2653186 - RNA, 15 nt, Escherichia coli CFT073
gcccaucgccagcgc

SEQ ID NO: 2653187 - RNA, 19 nt, Escherichia coli CFT073
gcccaucggaccauuggca

SEQ ID NO: 2653188 - RNA, 16 nt, Escherichia coli CFT073
gcccaucguugaaaaa

SEQ ID NO: 2653189 - RNA, 17 nt, Escherichia coli CFT073
gcccaucguugaaaaaa

SEQ ID NO: 2653190 - RNA, 15 nt, Escherichia coli CFT073
gcccaugacaaacuc

SEQ ID NO: 2653191 - RNA, 16 nt, Escherichia coli CFT073
gcccaugacaaacuca

SEQ ID NO: 2653192 - RNA, 12 nt, Escherichia coli CFT073
gcccaugccagu

SEQ ID NO: 2653193 - RNA, 17 nt, Escherichia coli CFT073
gcccaugccaguaauaa

SEQ ID NO: 2653194 - RNA, 18 nt, Escherichia coli CFT073
gcccaugcgggcaacuuu

SEQ ID NO: 2653195 - RNA, 24 nt, Escherichia coli CFT073
gcccauugccagcgcugcccacca

SEQ ID NO: 2653196 - RNA, 17 nt, Escherichia coli CFT073
gccccacaagcccgcca

SEQ ID NO: 2653197 - RNA, 20 nt, Escherichia coli CFT073
gccccacagagugguggggc

SEQ ID NO: 2653198 - RNA, 14 nt, Escherichia coli CFT073
gccccaccagcaaa

SEQ ID NO: 2653199 - RNA, 15 nt, Escherichia coli CFT073
gccccaccagcaaaa

SEQ ID NO: 2653200 - RNA, 20 nt, Escherichia coli CFT073
gccccacgccauaaccggcc

SEQ ID NO: 2653201 - RNA, 22 nt, Escherichia coli CFT073
gccccagaacucacgcacuucc

SEQ ID NO: 2653202 - RNA, 19 nt, Escherichia coli CFT073
gccccagaauuuucccuuu

SEQ ID NO: 2653203 - RNA, 13 nt, Escherichia coli CFT073
gccccagacacag

SEQ ID NO: 2653204 - RNA, 16 nt, Escherichia coli CFT073
gccccagaccugaauu

SEQ ID NO: 2653205 - RNA, 17 nt, Escherichia coli CFT073
gccccagagacaacccg

SEQ ID NO: 2653206 - RNA, 12 nt, Escherichia coli CFT073
gccccagagcua

SEQ ID NO: 2653207 - RNA, 22 nt, Escherichia coli CFT073
gccccaguaaacacaccacagc

SEQ ID NO: 2653208 - RNA, 16 nt, Escherichia coli CFT073
gccccagucuuccugc

SEQ ID NO: 2653209 - RNA, 12 nt, Escherichia coli CFT073
gccccaguuccu

SEQ ID NO: 2653210 - RNA, 22 nt, Escherichia coli CFT073
gccccaguuccuuaacuucauc

SEQ ID NO: 2653211 - RNA, 20 nt, Escherichia coli CFT073
gccccauaauauugccggga

SEQ ID NO: 2653212 - RNA, 19 nt, Escherichia coli CFT073
gccccauaugcagcacuug

SEQ ID NO: 2653213 - RNA, 20 nt, Escherichia coli CFT073
gccccaucgaaccaucggcu

SEQ ID NO: 2653214 - RNA, 15 nt, Escherichia coli CFT073
gccccaucugcccca

SEQ ID NO: 2653215 - RNA, 22 nt, Escherichia coli CFT073
gccccauugcucuuucacuuua

SEQ ID NO: 2653216 - RNA, 20 nt, Escherichia coli CFT073
gccccauugcugaugcaccu

SEQ ID NO: 2653217 - RNA, 18 nt, Escherichia coli CFT073
gccccauuuuuaauaacu

SEQ ID NO: 2653218 - RNA, 13 nt, Escherichia coli CFT073
gcccccagacuga

SEQ ID NO: 2653219 - RNA, 16 nt, Escherichia coli CFT073
gcccccagucgccagu

SEQ ID NO: 2653220 - RNA, 18 nt, Escherichia coli CFT073
gcccccauaagccgcggc

SEQ ID NO: 2653221 - RNA, 13 nt, Escherichia coli CFT073
gcccccgauccag

SEQ ID NO: 2653222 - RNA, 15 nt, Escherichia coli CFT073
gcccccgccagcgcc

SEQ ID NO: 2653223 - RNA, 13 nt, Escherichia coli CFT073
gcccccguucugu

SEQ ID NO: 2653224 - RNA, 17 nt, Escherichia coli CFT073
gccccgaugccaucaug

SEQ ID NO: 2653225 - RNA, 11 nt, Escherichia coli CFT073
gccccgcagcc

SEQ ID NO: 2653226 - RNA, 11 nt, Escherichia coli CFT073
gccccgccagu

SEQ ID NO: 2653227 - RNA, 21 nt, Escherichia coli CFT073
gccccgccgguaauuccagcg

SEQ ID NO: 2653228 - RNA, 23 nt, Escherichia coli CFT073
gccccgcgaacggggcugccagc

SEQ ID NO: 2653229 - RNA, 13 nt, Escherichia coli CFT073
gccccgcgcggcg

SEQ ID NO: 2653230 - RNA, 15 nt, Escherichia coli CFT073
gccccgcgcggcgca

SEQ ID NO: 2653231 - RNA, 19 nt, Escherichia coli CFT073
gccccgcucacgcagcggc

SEQ ID NO: 2653232 - RNA, 23 nt, Escherichia coli CFT073
gccccgcuucccgauaagggagc

SEQ ID NO: 2653233 - RNA, 18 nt, Escherichia coli CFT073
gccccggaagccagacgu

SEQ ID NO: 2653234 - RNA, 17 nt, Escherichia coli CFT073
gccccggcaauaaaaca

SEQ ID NO: 2653235 - RNA, 15 nt, Escherichia coli CFT073
gccccggccuuaccu

SEQ ID NO: 2653236 - RNA, 16 nt, Escherichia coli CFT073
gccccgguuucucuuc

SEQ ID NO: 2653237 - RNA, 18 nt, Escherichia coli CFT073
gccccgucgcccgaugcc

SEQ ID NO: 2653238 - RNA, 22 nt, Escherichia coli CFT073
gccccucacgcuuuauuuuuga

SEQ ID NO: 2653239 - RNA, 17 nt, Escherichia coli CFT073
gccccuccgcacagggg

SEQ ID NO: 2653240 - RNA, 21 nt, Escherichia coli CFT073
gccccuggaaaaaaugcccca

SEQ ID NO: 2653241 - RNA, 23 nt, Escherichia coli CFT073
gccccuggaaaaaaugccccagu

SEQ ID NO: 2653242 - RNA, 23 nt, Escherichia coli CFT073
gccccuggcgaugcccccaggag

SEQ ID NO: 2653243 - RNA, 17 nt, Escherichia coli CFT073
gccccuggcuggucagc

SEQ ID NO: 2653244 - RNA, 17 nt, Escherichia coli CFT073
gccccuggucgcgcggc

SEQ ID NO: 2653245 - RNA, 19 nt, Escherichia coli CFT073
gccccuggucgcgcggcag

SEQ ID NO: 2653246 - RNA, 22 nt, Escherichia coli CFT073
gccccuggugcuugccagagca

SEQ ID NO: 2653247 - RNA, 21 nt, Escherichia coli CFT073
gccccuuguucaagagcuuca

SEQ ID NO: 2653248 - RNA, 14 nt, Escherichia coli CFT073
gcccgaccacuuca

SEQ ID NO: 2653249 - RNA, 20 nt, Escherichia coli CFT073
gcccgaccaucgccagcuca

SEQ ID NO: 2653250 - RNA, 17 nt, Escherichia coli CFT073
gcccgacgaggcgcugg

SEQ ID NO: 2653251 - RNA, 21 nt, Escherichia coli CFT073
gcccgacgaggcgcuggcgca

SEQ ID NO: 2653252 - RNA, 18 nt, Escherichia coli CFT073
gcccgacgauaccgccgc

SEQ ID NO: 2653253 - RNA, 13 nt, Escherichia coli CFT073
gcccgagccgguu

SEQ ID NO: 2653254 - RNA, 16 nt, Escherichia coli CFT073
gcccgauagacaccau

SEQ ID NO: 2653255 - RNA, 20 nt, Escherichia coli CFT073
gcccgauagacaccaugucc

SEQ ID NO: 2653256 - RNA, 13 nt, Escherichia coli CFT073
gcccgaucgagga

SEQ ID NO: 2653257 - RNA, 19 nt, Escherichia coli CFT073
gcccgaugaucaucaucgc

SEQ ID NO: 2653258 - RNA, 20 nt, Escherichia coli CFT073
gcccgauggugaugccaucg

SEQ ID NO: 2653259 - RNA, 13 nt, Escherichia coli CFT073
gcccgauucacau

SEQ ID NO: 2653260 - RNA, 20 nt, Escherichia coli CFT073
gcccgauugguucagacgcc

SEQ ID NO: 2653261 - RNA, 18 nt, Escherichia coli CFT073
gcccgcacaaagcacguu

SEQ ID NO: 2653262 - RNA, 21 nt, Escherichia coli CFT073
gcccgcacaccucacaccccg

SEQ ID NO: 2653263 - RNA, 16 nt, Escherichia coli CFT073
gcccgcacugucgcca

SEQ ID NO: 2653264 - RNA, 13 nt, Escherichia coli CFT073
gcccgcagcggcg

SEQ ID NO: 2653265 - RNA, 21 nt, Escherichia coli CFT073
gccgagaagauuuuuugccag

SEQ ID NO: 2653266 - RNA, 22 nt, Escherichia coli CFT073
gccgagaagauuuuuugccagc

SEQ ID NO: 2653267 - RNA, 22 nt, Escherichia coli CFT073
gccgagaauaaaacaagcagcu

SEQ ID NO: 2653268 - RNA, 18 nt, Escherichia coli CFT073
gccgagagaagcgcguuc

SEQ ID NO: 2653269 - RNA, 19 nt, Escherichia coli CFT073
gccgagagaagcgcguuca

SEQ ID NO: 2653270 - RNA, 16 nt, Escherichia coli CFT073
gccgagcgcaagccac

SEQ ID NO: 2653271 - RNA, 23 nt, Escherichia coli CFT073
gccgagcgcuaccaucgacacca

SEQ ID NO: 2653272 - RNA, 14 nt, Escherichia coli CFT073
gccgaggaacauaa

SEQ ID NO: 2653273 - RNA, 22 nt, Escherichia coli CFT073
gccgaggcaaugccccagaaua

SEQ ID NO: 2653274 - RNA, 23 nt, Escherichia coli CFT073
gccgaggccgaguagccagcugc

SEQ ID NO: 2653275 - RNA, 17 nt, Escherichia coli CFT073
gccgaguagccagcugc

SEQ ID NO: 2653276 - RNA, 16 nt, Escherichia coli CFT073
gccgauaaagcgacca

SEQ ID NO: 2653277 - RNA, 23 nt, Escherichia coli CFT073
gccgauaaaggucgacaguagcc

SEQ ID NO: 2653278 - RNA, 15 nt, Escherichia coli CFT073
gccgauaaucaacgc

SEQ ID NO: 2653279 - RNA, 17 nt, Escherichia coli CFT073
gccgauagaagcgccau

SEQ ID NO: 2653280 - RNA, 21 nt, Escherichia coli CFT073
gccgauagacacugccgccgu

SEQ ID NO: 2653281 - RNA, 22 nt, Escherichia coli CFT073
gccgauagacacugccgccguc

SEQ ID NO: 2653282 - RNA, 18 nt, Escherichia coli CFT073
gccgauauaaauuccacg

SEQ ID NO: 2653283 - RNA, 20 nt, Escherichia coli CFT073
gccgauaucgauaaacagcg

SEQ ID NO: 2653284 - RNA, 13 nt, Escherichia coli CFT073
gccgaucagcggc

SEQ ID NO: 2653285 - RNA, 15 nt, Escherichia coli CFT073
gccgauccgcgucau

SEQ ID NO: 2653286 - RNA, 20 nt, Escherichia coli CFT073
gccgaucgucgcucacuuca

SEQ ID NO: 2653287 - RNA, 17 nt, Escherichia coli CFT073
gccgaugacgcagacuu

SEQ ID NO: 2653288 - RNA, 14 nt, Escherichia coli CFT073
gccgaugccgcuac

SEQ ID NO: 2653289 - RNA, 14 nt, Escherichia coli CFT073
gccgauggcagaaa

SEQ ID NO: 2653290 - RNA, 21 nt, Escherichia coli CFT073
gccgauguuauugcagacauc

SEQ ID NO: 2653291 - RNA, 15 nt, Escherichia coli CFT073
gccgcaaaacccagg

SEQ ID NO: 2653292 - RNA, 17 nt, Escherichia coli CFT073
gccgcaaaucgccgaga

SEQ ID NO: 2653293 - RNA, 17 nt, Escherichia coli CFT073
gccgcaauauuccggca

SEQ ID NO: 2653294 - RNA, 13 nt, Escherichia coli CFT073
gccgcaaucagcc

SEQ ID NO: 2653295 - RNA, 21 nt, Escherichia coli CFT073
gccgcaauggccguuccggca

SEQ ID NO: 2653296 - RNA, 18 nt, Escherichia coli CFT073
gccgcacaauacauagaa

SEQ ID NO: 2653297 - RNA, 12 nt, Escherichia coli CFT073
gccgcaccgaag

SEQ ID NO: 2653298 - RNA, 16 nt, Escherichia coli CFT073
gccgcacuuacagcaa

SEQ ID NO: 2653299 - RNA, 12 nt, Escherichia coli CFT073
gccgcaggcgug

SEQ ID NO: 2653300 - RNA, 18 nt, Escherichia coli CFT073
gccgcaggcuguuacccc

SEQ ID NO: 2653301 - RNA, 21 nt, Escherichia coli CFT073
gccgcagguagcagcagcgcc

SEQ ID NO: 2653302 - RNA, 15 nt, Escherichia coli CFT073
gccgcauaguccagu

SEQ ID NO: 2653303 - RNA, 15 nt, Escherichia coli CFT073
gccgcaucagugauc

SEQ ID NO: 2653304 - RNA, 21 nt, Escherichia coli CFT073
gccgcaucagugaucagccac

SEQ ID NO: 2653305 - RNA, 22 nt, Escherichia coli CFT073
gccgcauccgacaaauguguuc

SEQ ID NO: 2653306 - RNA, 20 nt, Escherichia coli CFT073
gccgcauccgacaucaacgc

SEQ ID NO: 2653307 - RNA, 15 nt, Escherichia coli CFT073
gccgcauccgacgau

SEQ ID NO: 2653308 - RNA, 12 nt, Escherichia coli CFT073
gccgcauccggc

SEQ ID NO: 2653309 - RNA, 13 nt, Escherichia coli CFT073
gccgcauccggca

SEQ ID NO: 2653310 - RNA, 21 nt, Escherichia coli CFT073
gccgcauccggcaaucaacgc

SEQ ID NO: 2653311 - RNA, 21 nt, Escherichia coli CFT073
gccgcauccggcauaauacau

SEQ ID NO: 2653312 - RNA, 21 nt, Escherichia coli CFT073
gccgcauccggcauuguucau

SEQ ID NO: 2653313 - RNA, 21 nt, Escherichia coli CFT073
gccgcauccggccaucaguau

SEQ ID NO: 2653314 - RNA, 13 nt, Escherichia coli CFT073
gccgcauccggcg

SEQ ID NO: 2653315 - RNA, 18 nt, Escherichia coli CFT073
gccgcauccggcuuaaau

SEQ ID NO: 2653316 - RNA, 22 nt, Escherichia coli CFT073
gccgcaucuggcauucagaaca

SEQ ID NO: 2653317 - RNA, 16 nt, Escherichia coli CFT073
gccgcaucuggcauuu

SEQ ID NO: 2653318 - RNA, 18 nt, Escherichia coli CFT073
gccgcauugagaucuuuc

SEQ ID NO: 2653319 - RNA, 20 nt, Escherichia coli CFT073
gccgcauugcccaauacugc

SEQ ID NO: 2653320 - RNA, 18 nt, Escherichia coli CFT073
gccgcauugcgcauucua

SEQ ID NO: 2653321 - RNA, 18 nt, Escherichia coli CFT073
gccgccaaacgccgcaug

SEQ ID NO: 2653322 - RNA, 21 nt, Escherichia coli CFT073
gccgccaaacugugcaccgcc

SEQ ID NO: 2653323 - RNA, 19 nt, Escherichia coli CFT073
gccgccaacuccaccaaua

SEQ ID NO: 2653324 - RNA, 15 nt, Escherichia coli CFT073
gccgccaccagaacc

SEQ ID NO: 2653325 - RNA, 21 nt, Escherichia coli CFT073
gccgccacuucuggcggcggc

SEQ ID NO: 2653326 - RNA, 19 nt, Escherichia coli CFT073
gccgccacuugagccgcca

SEQ ID NO: 2653327 - RNA, 18 nt, Escherichia coli CFT073
gccgccagaaucaccucu

SEQ ID NO: 2653328 - RNA, 22 nt, Escherichia coli CFT073
gccgccagaccacugcgccgcu

SEQ ID NO: 2653329 - RNA, 20 nt, Escherichia coli CFT073
gccgccagauccuggcugua

SEQ ID NO: 2653330 - RNA, 17 nt, Escherichia coli CFT073
gccgccagcagacacau

SEQ ID NO: 2653331 - RNA, 22 nt, Escherichia coli CFT073
gccgccagggauaaagccccca

SEQ ID NO: 2653332 - RNA, 21 nt, Escherichia coli CFT073
gccgccaguuccaggcaaacu

SEQ ID NO: 2653333 - RNA, 15 nt, Escherichia coli CFT073
gccgccauaaacagc

SEQ ID NO: 2653334 - RNA, 17 nt, Escherichia coli CFT073
gccgccauaaacagcag

SEQ ID NO: 2653335 - RNA, 20 nt, Escherichia coli CFT073
gccgccauuccagccagaaa

SEQ ID NO: 2653336 - RNA, 21 nt, Escherichia coli CFT073
gccgccauuccagccagaaau

SEQ ID NO: 2653337 - RNA, 21 nt, Escherichia coli CFT073
gccgccauugacguucccuuc

SEQ ID NO: 2653338 - RNA, 13 nt, Escherichia coli CFT073
gccgcccagcagc

SEQ ID NO: 2653339 - RNA, 21 nt, Escherichia coli CFT073
gccgccccagacuccagcagu

SEQ ID NO: 2653340 - RNA, 17 nt, Escherichia coli CFT073
gccgcccguuuucucca

SEQ ID NO: 2653341 - RNA, 16 nt, Escherichia coli CFT073
gccgccgacaguuauc

SEQ ID NO: 2653342 - RNA, 15 nt, Escherichia coli CFT073
gccgccgagcaaacc

SEQ ID NO: 2653343 - RNA, 14 nt, Escherichia coli CFT073
gccgccgcauuaug

SEQ ID NO: 2653344 - RNA, 23 nt, Escherichia coli CFT073
gccgccggaaucaacgguugcaa

SEQ ID NO: 2653345 - RNA, 17 nt, Escherichia coli CFT073
gccgccucagccagaau

SEQ ID NO: 2653346 - RNA, 22 nt, Escherichia coli CFT073
gccgccugggugcgauuuuuga

SEQ ID NO: 2653347 - RNA, 15 nt, Escherichia coli CFT073
gccgccuggugcagg

SEQ ID NO: 2653348 - RNA, 17 nt, Escherichia coli CFT073
gccgccuuuacgcaaag

SEQ ID NO: 2653349 - RNA, 19 nt, Escherichia coli CFT073
gccgccuuuacgcaaagca

SEQ ID NO: 2653350 - RNA, 22 nt, Escherichia coli CFT073
gccgccuuuugccuuacgcacc

SEQ ID NO: 2653351 - RNA, 14 nt, Escherichia coli CFT073
gccgcgaaacugcg

SEQ ID NO: 2653352 - RNA, 16 nt, Escherichia coli CFT073
gccgcgaaacugcgug

SEQ ID NO: 2653353 - RNA, 21 nt, Escherichia coli CFT073
gccgcgaaacugcguggcgaa

SEQ ID NO: 2653354 - RNA, 20 nt, Escherichia coli CFT073
gccgcgaaccagaccagcaa

SEQ ID NO: 2653355 - RNA, 15 nt, Escherichia coli CFT073
gccgcgacacaacgc

SEQ ID NO: 2653356 - RNA, 20 nt, Escherichia coli CFT073
gccgcgacgauacgcccgga

SEQ ID NO: 2653357 - RNA, 15 nt, Escherichia coli CFT073
gccgcgacgguugcg

SEQ ID NO: 2653358 - RNA, 18 nt, Escherichia coli CFT073
gccgcgauagcaagcgcu

SEQ ID NO: 2653359 - RNA, 17 nt, Escherichia coli CFT073
gccgcgaucccagacca

SEQ ID NO: 2653360 - RNA, 17 nt, Escherichia coli CFT073
gccgcgaucgucaaaac

SEQ ID NO: 2653361 - RNA, 21 nt, Escherichia coli CFT073
gccgcgaucgucaaaacgcgc

SEQ ID NO: 2653362 - RNA, 14 nt, Escherichia coli CFT073
gccgcgcaguuucu

SEQ ID NO: 2653363 - RNA, 13 nt, Escherichia coli CFT073
gccgcgcccgcua

SEQ ID NO: 2653364 - RNA, 14 nt, Escherichia coli CFT073
gccgcgccgacugc

SEQ ID NO: 2653365 - RNA, 12 nt, Escherichia coli CFT073
gccgcgccgcgc

SEQ ID NO: 2653366 - RNA, 22 nt, Escherichia coli CFT073
gccgcgcggguggugcgcacca

SEQ ID NO: 2653367 - RNA, 15 nt, Escherichia coli CFT073
gccgcgcuuucuucu

SEQ ID NO: 2653368 - RNA, 16 nt, Escherichia coli CFT073
gccgcgugccaccauu

SEQ ID NO: 2653369 - RNA, 14 nt, Escherichia coli CFT073
gccgcguucgccag

SEQ ID NO: 2653370 - RNA, 16 nt, Escherichia coli CFT073
gccgcguucgccagcg

SEQ ID NO: 2653371 - RNA, 19 nt, Escherichia coli CFT073
gccgcguucgccagcguca

SEQ ID NO: 2653372 - RNA, 18 nt, Escherichia coli CFT073
gccgcuaaauaccagcgu

SEQ ID NO: 2653373 - RNA, 14 nt, Escherichia coli CFT073
gccguacaggcagc

SEQ ID NO: 2653374 - RNA, 17 nt, Escherichia coli CFT073
gccguaccaucgccagc

SEQ ID NO: 2653375 - RNA, 17 nt, Escherichia coli CFT073
gccguauacgcuucgga

SEQ ID NO: 2653376 - RNA, 21 nt, Escherichia coli CFT073
gccguaugcgaagcuuugcac

SEQ ID NO: 2653377 - RNA, 18 nt, Escherichia coli CFT073
gccguaugcgguacugac

SEQ ID NO: 2653378 - RNA, 19 nt, Escherichia coli CFT073
gccgucaacaauccauuca

SEQ ID NO: 2653379 - RNA, 23 nt, Escherichia coli CFT073
gccgucaacaauccauucaucac

SEQ ID NO: 2653380 - RNA, 21 nt, Escherichia coli CFT073
gccgucaccagcaucaacaac

SEQ ID NO: 2653381 - RNA, 17 nt, Escherichia coli CFT073
gccgucagacgcgcggu

SEQ ID NO: 2653382 - RNA, 22 nt, Escherichia coli CFT073
gccgucaguugugccaguuuca

SEQ ID NO: 2653383 - RNA, 19 nt, Escherichia coli CFT073
gccgucaucaucggcugcg

SEQ ID NO: 2653384 - RNA, 20 nt, Escherichia coli CFT073
gccgucgcuaucgaugccgc

SEQ ID NO: 2653385 - RNA, 14 nt, Escherichia coli CFT073
gccgucucuuucau

SEQ ID NO: 2653386 - RNA, 13 nt, Escherichia coli CFT073
gccgucugccacu

SEQ ID NO: 2653387 - RNA, 22 nt, Escherichia coli CFT073
gccgucugccacuucuuccagc

SEQ ID NO: 2653388 - RNA, 15 nt, Escherichia coli CFT073
gccgucuucuuccca

SEQ ID NO: 2653389 - RNA, 23 nt, Escherichia coli CFT073
gccgugaaugguaacuuucugcc

SEQ ID NO: 2653390 - RNA, 23 nt, Escherichia coli CFT073
gccgugaguauauuucaggccaa

SEQ ID NO: 2653391 - RNA, 20 nt, Escherichia coli CFT073
gccguggagauuggcccgcc

SEQ ID NO: 2653392 - RNA, 23 nt, Escherichia coli CFT073
gccguggagauuggcccgccaag

SEQ ID NO: 2653393 - RNA, 15 nt, Escherichia coli CFT073
gccguggcaggcaaa

SEQ ID NO: 2653394 - RNA, 20 nt, Escherichia coli CFT073
gccguguuauccgccgcaua

SEQ ID NO: 2653395 - RNA, 16 nt, Escherichia coli CFT073
gccguguucuuaccca

SEQ ID NO: 2653396 - RNA, 21 nt, Escherichia coli CFT073
gccguuaacuucaccgguuca

SEQ ID NO: 2653397 - RNA, 14 nt, Escherichia coli CFT073
gccguuaccuuacc

SEQ ID NO: 2653398 - RNA, 15 nt, Escherichia coli CFT073
gccguuauguugauu

SEQ ID NO: 2653399 - RNA, 21 nt, Escherichia coli CFT073
gccguuccuggcaccaucagc

SEQ ID NO: 2653400 - RNA, 19 nt, Escherichia coli CFT073
gccguucguccgagcggca

SEQ ID NO: 2653401 - RNA, 13 nt, Escherichia coli CFT073
gccguucuucagc

SEQ ID NO: 2653402 - RNA, 16 nt, Escherichia coli CFT073
gccguugaguucaaau

SEQ ID NO: 2653403 - RNA, 21 nt, Escherichia coli CFT073
gccguugaucugccccauaga

SEQ ID NO: 2653404 - RNA, 14 nt, Escherichia coli CFT073
gccguugugcugau

SEQ ID NO: 2653405 - RNA, 19 nt, Escherichia coli CFT073
gccguuuaacacgcucugg

SEQ ID NO: 2653406 - RNA, 21 nt, Escherichia coli CFT073
gccguuuaacacgcucuggau

SEQ ID NO: 2653407 - RNA, 13 nt, Escherichia coli CFT073
gccguuucaccac

SEQ ID NO: 2653408 - RNA, 14 nt, Escherichia coli CFT073
gccguuucaccacg

SEQ ID NO: 2653409 - RNA, 16 nt, Escherichia coli CFT073
gccguuugcugcauga

SEQ ID NO: 2653410 - RNA, 20 nt, Escherichia coli CFT073
gccguuuguuagcaugcuga

SEQ ID NO: 2653411 - RNA, 14 nt, Escherichia coli CFT073
gccguuuucgucaa

SEQ ID NO: 2653412 - RNA, 18 nt, Escherichia coli CFT073
gccguuuuuauugacggu

SEQ ID NO: 2653413 - RNA, 13 nt, Escherichia coli CFT073
gccuaaagugcug

SEQ ID NO: 2653414 - RNA, 18 nt, Escherichia coli CFT073
gccuaacgacaaaucaua

SEQ ID NO: 2653415 - RNA, 18 nt, Escherichia coli CFT073
gccuacaaaggcacgcca

SEQ ID NO: 2653416 - RNA, 20 nt, Escherichia coli CFT073
gccuacaaucccguugaaaa

SEQ ID NO: 2653417 - RNA, 18 nt, Escherichia coli CFT073
gccuacacaacauaucgc

SEQ ID NO: 2653418 - RNA, 19 nt, Escherichia coli CFT073
gccuacacguugaaacuua

SEQ ID NO: 2653419 - RNA, 18 nt, Escherichia coli CFT073
gccuacagaacgcugcaa

SEQ ID NO: 2653420 - RNA, 21 nt, Escherichia coli CFT073
gccuacagaacgcugcaauuu

SEQ ID NO: 2653421 - RNA, 20 nt, Escherichia coli CFT073
gccuacaggugcaccgcauc

SEQ ID NO: 2653422 - RNA, 16 nt, Escherichia coli CFT073
gccuacauagccccug

SEQ ID NO: 2653423 - RNA, 14 nt, Escherichia coli CFT073
gccuacauauccgc

SEQ ID NO: 2653424 - RNA, 13 nt, Escherichia coli CFT073
gccuacaucgaca

SEQ ID NO: 2653425 - RNA, 13 nt, Escherichia coli CFT073
gccuaccaccagc

SEQ ID NO: 2653426 - RNA, 14 nt, Escherichia coli CFT073
gccuaccaccagcu

SEQ ID NO: 2653427 - RNA, 21 nt, Escherichia coli CFT073
gccuaccaccagcuuguuauc

SEQ ID NO: 2653428 - RNA, 20 nt, Escherichia coli CFT073
gccuaccgaacuucgccagc

SEQ ID NO: 2653429 - RNA, 13 nt, Escherichia coli CFT073
gccuaccgccagu

SEQ ID NO: 2653430 - RNA, 23 nt, Escherichia coli CFT073
gccuaccggacggcucacuuugu

SEQ ID NO: 2653431 - RNA, 13 nt, Escherichia coli CFT073
gccuaccguuccg

SEQ ID NO: 2653432 - RNA, 14 nt, Escherichia coli CFT073
gccuauaccuaaca

SEQ ID NO: 2653433 - RNA, 21 nt, Escherichia coli CFT073
gccuauugcucuaaaaaguuc

SEQ ID NO: 2653434 - RNA, 20 nt, Escherichia coli CFT073
gccucaacauacaaauagcc

SEQ ID NO: 2653435 - RNA, 15 nt, Escherichia coli CFT073
gccucaacccauuuc

SEQ ID NO: 2653436 - RNA, 19 nt, Escherichia coli CFT073
gccucaacgccuaaugcca

SEQ ID NO: 2653437 - RNA, 20 nt, Escherichia coli CFT073
gccucaagcacccaaugcca

SEQ ID NO: 2653438 - RNA, 14 nt, Escherichia coli CFT073
gccucaagcacccg

SEQ ID NO: 2653439 - RNA, 20 nt, Escherichia coli CFT073
gccucaagcacccgccgcua

SEQ ID NO: 2653440 - RNA, 22 nt, Escherichia coli CFT073
gccucaagcuuacugagcagau

SEQ ID NO: 2653441 - RNA, 24 nt, Escherichia coli CFT073
gccucacagcuaaucaucaucagc

SEQ ID NO: 2653442 - RNA, 18 nt, Escherichia coli CFT073
gccucaggcacuucuucc

SEQ ID NO: 2653443 - RNA, 12 nt, Escherichia coli CFT073
gccucaucacaa

SEQ ID NO: 2653444 - RNA, 21 nt, Escherichia coli CFT073
gccucaugugaugguaacgcg

SEQ ID NO: 2653445 - RNA, 20 nt, Escherichia coli CFT073
gccucccauucaucgccacc

SEQ ID NO: 2653446 - RNA, 12 nt, Escherichia coli CFT073
gccuccccagca

SEQ ID NO: 2653447 - RNA, 18 nt, Escherichia coli CFT073
gccucccgcaacauaucu

SEQ ID NO: 2653448 - RNA, 16 nt, Escherichia coli CFT073
gccuccgcucaucacc

SEQ ID NO: 2653449 - RNA, 15 nt, Escherichia coli CFT073
gccuccucuuuuucc

SEQ ID NO: 2653450 - RNA, 13 nt, Escherichia coli CFT073
gccucgcagcggc

SEQ ID NO: 2653451 - RNA, 14 nt, Escherichia coli CFT073
gccucgccgagcag

SEQ ID NO: 2653452 - RNA, 14 nt, Escherichia coli CFT073
gccucgcuuugcca

SEQ ID NO: 2653453 - RNA, 15 nt, Escherichia coli CFT073
gccucgguuuugcgg

SEQ ID NO: 2653454 - RNA, 22 nt, Escherichia coli CFT073
gccucguggaaaccgagauaaa

SEQ ID NO: 2653455 - RNA, 21 nt, Escherichia coli CFT073
gccucuaacagaucauccauc

SEQ ID NO: 2653456 - RNA, 18 nt, Escherichia coli CFT073
gccucuauggaaguacca

SEQ ID NO: 2653457 - RNA, 21 nt, Escherichia coli CFT073
gccucucugacagcuccuccg

SEQ ID NO: 2653458 - RNA, 13 nt, Escherichia coli CFT073
gccucugccagcu

SEQ ID NO: 2653459 - RNA, 13 nt, Escherichia coli CFT073
gccucugcgccca

SEQ ID NO: 2653460 - RNA, 18 nt, Escherichia coli CFT073
gccucuuccaguaaacca

SEQ ID NO: 2653461 - RNA, 13 nt, Escherichia coli CFT073
gccucuucucucg

SEQ ID NO: 2653462 - RNA, 12 nt, Escherichia coli CFT073
gccugaaaaaug

SEQ ID NO: 2653463 - RNA, 21 nt, Escherichia coli CFT073
gccugaaaacgaaaucguugu

SEQ ID NO: 2653464 - RNA, 13 nt, Escherichia coli CFT073
gccugaaacagaa

SEQ ID NO: 2653465 - RNA, 17 nt, Escherichia coli CFT073
gccugaacaccagaacc

SEQ ID NO: 2653466 - RNA, 21 nt, Escherichia coli CFT073
gccugaacaccagaaccagca

SEQ ID NO: 2653467 - RNA, 21 nt, Escherichia coli CFT073
gccugaagaucaacgucugcg

SEQ ID NO: 2653468 - RNA, 18 nt, Escherichia coli CFT073
gccugaauacacugcuga

SEQ ID NO: 2653469 - RNA, 14 nt, Escherichia coli CFT073
gccugaaugccaca

SEQ ID NO: 2653470 - RNA, 17 nt, Escherichia coli CFT073
gccugaaugccgcgccc

SEQ ID NO: 2653471 - RNA, 17 nt, Escherichia coli CFT073
gccugacauuuccguaa

SEQ ID NO: 2653472 - RNA, 17 nt, Escherichia coli CFT073
gccugaccacccgcugg

SEQ ID NO: 2653473 - RNA, 16 nt, Escherichia coli CFT073
gccugaccauuaucaa

SEQ ID NO: 2653474 - RNA, 18 nt, Escherichia coli CFT073
gccugacggaaaucaucc

SEQ ID NO: 2653475 - RNA, 16 nt, Escherichia coli CFT073
gccugacggaucggcu

SEQ ID NO: 2653476 - RNA, 20 nt, Escherichia coli CFT073
gccugagacagacagccuca

SEQ ID NO: 2653477 - RNA, 15 nt, Escherichia coli CFT073
gccugagcuaaugga

SEQ ID NO: 2653478 - RNA, 20 nt, Escherichia coli CFT073
gccugauaagacacgccagu

SEQ ID NO: 2653479 - RNA, 22 nt, Escherichia coli CFT073
gccugauaagacgcggcagcgu

SEQ ID NO: 2653480 - RNA, 19 nt, Escherichia coli CFT073
gccugauaagacgcggccc

SEQ ID NO: 2653481 - RNA, 18 nt, Escherichia coli CFT073
gccuuguuuaaucaucgg

SEQ ID NO: 2653482 - RNA, 17 nt, Escherichia coli CFT073
gccuuuauuaaugacau

SEQ ID NO: 2653483 - RNA, 21 nt, Escherichia coli CFT073
gccuuuauuaaugacauucag

SEQ ID NO: 2653484 - RNA, 23 nt, Escherichia coli CFT073
gccuuucacgccgggaaauuuuu

SEQ ID NO: 2653485 - RNA, 13 nt, Escherichia coli CFT073
gccuuucagauca

SEQ ID NO: 2653486 - RNA, 15 nt, Escherichia coli CFT073
gccuuucagccccag

SEQ ID NO: 2653487 - RNA, 20 nt, Escherichia coli CFT073
gccuuucagccccagcgcaa

SEQ ID NO: 2653488 - RNA, 23 nt, Escherichia coli CFT073
gccuuucaggugguuagccgcgu

SEQ ID NO: 2653489 - RNA, 20 nt, Escherichia coli CFT073
gccuuucauggucgucaccg

SEQ ID NO: 2653490 - RNA, 16 nt, Escherichia coli CFT073
gccuuucgcuccggca

SEQ ID NO: 2653491 - RNA, 18 nt, Escherichia coli CFT073
gccuuucuuuguucuucu

SEQ ID NO: 2653492 - RNA, 21 nt, Escherichia coli CFT073
gccuuugaaaucgaacagguu

SEQ ID NO: 2653493 - RNA, 21 nt, Escherichia coli CFT073
gccuuugacuauuucaucaga

SEQ ID NO: 2653494 - RNA, 21 nt, Escherichia coli CFT073
gccuuugagcgugcgcgcugc

SEQ ID NO: 2653495 - RNA, 18 nt, Escherichia coli CFT073
gccuuugaugccaccagg

SEQ ID NO: 2653496 - RNA, 21 nt, Escherichia coli CFT073
gccuuugaugccaccaggcag

SEQ ID NO: 2653497 - RNA, 20 nt, Escherichia coli CFT073
gccuuuuuaggucgcccugu

SEQ ID NO: 2653498 - RNA, 16 nt, Escherichia coli CFT073
gccuuuuucuccgagc

SEQ ID NO: 2653499 - RNA, 18 nt, Escherichia coli CFT073
gccuuuuuuaauauuuca

SEQ ID NO: 2653500 - RNA, 19 nt, Escherichia coli CFT073
gccuuuuuuaauauuucau

SEQ ID NO: 2653501 - RNA, 12 nt, Escherichia coli CFT073
gccuuuuuucac

SEQ ID NO: 2653502 - RNA, 20 nt, Escherichia coli CFT073
gccuuuuuucgccgcagcau

SEQ ID NO: 2653503 - RNA, 15 nt, Escherichia coli CFT073
gcgaaaaagcguuca

SEQ ID NO: 2653504 - RNA, 23 nt, Escherichia coli CFT073
gcgaaaaucagccauacggucug

SEQ ID NO: 2653505 - RNA, 18 nt, Escherichia coli CFT073
gcgaaaaucauuuaucuc

SEQ ID NO: 2653506 - RNA, 18 nt, Escherichia coli CFT073
gcgaaaaucccggcaaca

SEQ ID NO: 2653507 - RNA, 14 nt, Escherichia coli CFT073
gcgaaaaugccggu

SEQ ID NO: 2653508 - RNA, 15 nt, Escherichia coli CFT073
gcgaaaaugcucgcc

SEQ ID NO: 2653509 - RNA, 13 nt, Escherichia coli CFT073
gcgaaacagcgcc

SEQ ID NO: 2653510 - RNA, 22 nt, Escherichia coli CFT073
gcgaaacagcugggcgauuuuc

SEQ ID NO: 2653511 - RNA, 12 nt, Escherichia coli CFT073
gcgaaaccagca

SEQ ID NO: 2653512 - RNA, 18 nt, Escherichia coli CFT073
gcgaaaccauauuaaaug

SEQ ID NO: 2653513 - RNA, 23 nt, Escherichia coli CFT073
gcgaaaccugaauccacuggcug

SEQ ID NO: 2653514 - RNA, 12 nt, Escherichia coli CFT073
gcgaaaccuuac

SEQ ID NO: 2653515 - RNA, 13 nt, Escherichia coli CFT073
gcgaaacugcgug

SEQ ID NO: 2653516 - RNA, 18 nt, Escherichia coli CFT073
gcgaaagcgugagugccc

SEQ ID NO: 2653517 - RNA, 14 nt, Escherichia coli CFT073
gcgaaaucacgcac

SEQ ID NO: 2653518 - RNA, 14 nt, Escherichia coli CFT073
gcgaaauugguaga

SEQ ID NO: 2653519 - RNA, 19 nt, Escherichia coli CFT073
gcgaaauugguagacgcac

SEQ ID NO: 2653520 - RNA, 23 nt, Escherichia coli CFT073
gcgaaccaucaccucuucaccgu

SEQ ID NO: 2653521 - RNA, 21 nt, Escherichia coli CFT073
gcgaacccgcaguccugcagg

SEQ ID NO: 2653522 - RNA, 15 nt, Escherichia coli CFT073
gcgaaccgcaggugg

SEQ ID NO: 2653523 - RNA, 19 nt, Escherichia coli CFT073
gcgaaccgccaaucgccac

SEQ ID NO: 2653524 - RNA, 22 nt, Escherichia coli CFT073
gcgaaccgggcuuuguuuuggg

SEQ ID NO: 2653525 - RNA, 16 nt, Escherichia coli CFT073
gcgaaccuuccaucgc

SEQ ID NO: 2653526 - RNA, 16 nt, Escherichia coli CFT073
gcgaaccuugcgcggu

SEQ ID NO: 2653527 - RNA, 12 nt, Escherichia coli CFT073
gcgaacgacauc

SEQ ID NO: 2653528 - RNA, 22 nt, Escherichia coli CFT073
gcgaacgacauccgccagcgcc

SEQ ID NO: 2653529 - RNA, 16 nt, Escherichia coli CFT073
gcgaacgggauaaacg

SEQ ID NO: 2653530 - RNA, 17 nt, Escherichia coli CFT073
gcgaacgggauaaacga

SEQ ID NO: 2653531 - RNA, 13 nt, Escherichia coli CFT073
gcgaacuaaacaa

SEQ ID NO: 2653532 - RNA, 14 nt, Escherichia coli CFT073
gcgaacuaaacaac

SEQ ID NO: 2653533 - RNA, 21 nt, Escherichia coli CFT073
gcgaacuaaacaacgccgcca

SEQ ID NO: 2653534 - RNA, 22 nt, Escherichia coli CFT073
gcgaacucugacgauucuccca

SEQ ID NO: 2653535 - RNA, 20 nt, Escherichia coli CFT073
gcgaacugguuucaauacuc

SEQ ID NO: 2653536 - RNA, 17 nt, Escherichia coli CFT073
gcgaacuucaggcagga

SEQ ID NO: 2653537 - RNA, 23 nt, Escherichia coli CFT073
gcgaagaccgcaucacgacagca

SEQ ID NO: 2653538 - RNA, 14 nt, Escherichia coli CFT073
gcgaagccagcucc

SEQ ID NO: 2653539 - RNA, 23 nt, Escherichia coli CFT073
gcgaaggcaucggcaacgaaaua

SEQ ID NO: 2653540 - RNA, 17 nt, Escherichia coli CFT073
gcgaagugaugaaaaac

SEQ ID NO: 2653541 - RNA, 12 nt, Escherichia coli CFT073
gcgaagugcaga

SEQ ID NO: 2653542 - RNA, 14 nt, Escherichia coli CFT073
gcgaaguucgccau

SEQ ID NO: 2653543 - RNA, 19 nt, Escherichia coli CFT073
gcgaauaacaaacggcggu

SEQ ID NO: 2653544 - RNA, 13 nt, Escherichia coli CFT073
gcgaauaauggua

SEQ ID NO: 2653545 - RNA, 15 nt, Escherichia coli CFT073
gcgaauauggcggcg

SEQ ID NO: 2653546 - RNA, 20 nt, Escherichia coli CFT073
gcgaauccgcggaugauucc

SEQ ID NO: 2653547 - RNA, 15 nt, Escherichia coli CFT073
gcgaauccggcagcg

SEQ ID NO: 2653548 - RNA, 13 nt, Escherichia coli CFT073
gcgaauccguucu

SEQ ID NO: 2653549 - RNA, 12 nt, Escherichia coli CFT073
gcgaaucgccgu

SEQ ID NO: 2653550 - RNA, 20 nt, Escherichia coli CFT073
gcgaaucgcuucauuuacau

SEQ ID NO: 2653551 - RNA, 14 nt, Escherichia coli CFT073
gcgaaucuaaauca

SEQ ID NO: 2653552 - RNA, 15 nt, Escherichia coli CFT073
gcgaaucuaaaucag

SEQ ID NO: 2653553 - RNA, 13 nt, Escherichia coli CFT073
gcgaaugaaagau

SEQ ID NO: 2653554 - RNA, 16 nt, Escherichia coli CFT073
gcgaaugaaagaugaa

SEQ ID NO: 2653555 - RNA, 17 nt, Escherichia coli CFT073
gcgaaugccaacgggaa

SEQ ID NO: 2653556 - RNA, 22 nt, Escherichia coli CFT073
gcgaauggcguugccguacucu

SEQ ID NO: 2653557 - RNA, 19 nt, Escherichia coli CFT073
gcgaauuaacaccaccagc

SEQ ID NO: 2653558 - RNA, 22 nt, Escherichia coli CFT073
gcgaauuaacaccaccagcgcc

SEQ ID NO: 2653559 - RNA, 21 nt, Escherichia coli CFT073
gcgaauuaagaauuucucagu

SEQ ID NO: 2653560 - RNA, 23 nt, Escherichia coli CFT073
gcgaauuaagaauuucucaguug

SEQ ID NO: 2653561 - RNA, 18 nt, Escherichia coli CFT073
gcgaauugacuagcuuuu

SEQ ID NO: 2653562 - RNA, 20 nt, Escherichia coli CFT073
gcgaauugagaugacgccac

SEQ ID NO: 2653563 - RNA, 14 nt, Escherichia coli CFT073
gcgaauugccuguu

SEQ ID NO: 2653564 - RNA, 14 nt, Escherichia coli CFT073
gcgaauuuccugcc

SEQ ID NO: 2653565 - RNA, 22 nt, Escherichia coli CFT073
gcgacaaacauugcugccagaa

SEQ ID NO: 2653566 - RNA, 18 nt, Escherichia coli CFT073
gcgacaagcucauuuccc

SEQ ID NO: 2653567 - RNA, 20 nt, Escherichia coli CFT073
gcgacaaucgcccccaucac

SEQ ID NO: 2653568 - RNA, 14 nt, Escherichia coli CFT073
gcgacaccagcaug

SEQ ID NO: 2653569 - RNA, 18 nt, Escherichia coli CFT073
gcgacacgcaucacgcgc

SEQ ID NO: 2653570 - RNA, 14 nt, Escherichia coli CFT073
gcgacagaaaucag

SEQ ID NO: 2653571 - RNA, 15 nt, Escherichia coli CFT073
gcgacagacggcgac

SEQ ID NO: 2653572 - RNA, 19 nt, Escherichia coli CFT073
gcgacagacggcgacgcgc

SEQ ID NO: 2653573 - RNA, 15 nt, Escherichia coli CFT073
gcgacagauucagcg

SEQ ID NO: 2653574 - RNA, 13 nt, Escherichia coli CFT073
gcgacagcaaaau

SEQ ID NO: 2653575 - RNA, 15 nt, Escherichia coli CFT073
gcgacagcaaaaucu

SEQ ID NO: 2653576 - RNA, 15 nt, Escherichia coli CFT073
gcgacagccagccca

SEQ ID NO: 2653577 - RNA, 17 nt, Escherichia coli CFT073
gcgacagccauccccac

SEQ ID NO: 2653578 - RNA, 14 nt, Escherichia coli CFT073
gcgacaggagccgc

SEQ ID NO: 2653579 - RNA, 15 nt, Escherichia coli CFT073
gcgacaguugccgcu

SEQ ID NO: 2653580 - RNA, 21 nt, Escherichia coli CFT073
gcgacaguuuugccaauagcg

SEQ ID NO: 2653581 - RNA, 13 nt, Escherichia coli CFT073
gcgacauaucauu

SEQ ID NO: 2653582 - RNA, 15 nt, Escherichia coli CFT073
gcgacaucgucucca

SEQ ID NO: 2653583 - RNA, 15 nt, Escherichia coli CFT073
gcgacaugcucugca

SEQ ID NO: 2653584 - RNA, 20 nt, Escherichia coli CFT073
gcgaccaaucacacaaccau

SEQ ID NO: 2653585 - RNA, 15 nt, Escherichia coli CFT073
gcgaccaccacccug

SEQ ID NO: 2653586 - RNA, 20 nt, Escherichia coli CFT073
gcgaccagaacugauccaua

SEQ ID NO: 2653587 - RNA, 16 nt, Escherichia coli CFT073
gcgaccauuggugcug

SEQ ID NO: 2653588 - RNA, 22 nt, Escherichia coli CFT073
gcgaccgaagccuuuaccgcgc

SEQ ID NO: 2653589 - RNA, 17 nt, Escherichia coli CFT073
gcgauggacgcagacca

SEQ ID NO: 2653590 - RNA, 20 nt, Escherichia coli CFT073
gcgauggcccgcuugccaga

SEQ ID NO: 2653591 - RNA, 15 nt, Escherichia coli CFT073
gcgauggcggcagcc

SEQ ID NO: 2653592 - RNA, 18 nt, Escherichia coli CFT073
gcgauggcgggaucgccg

SEQ ID NO: 2653593 - RNA, 18 nt, Escherichia coli CFT073
gcgauggcgucaucaccu

SEQ ID NO: 2653594 - RNA, 16 nt, Escherichia coli CFT073
gcgauggcuuuccacc

SEQ ID NO: 2653595 - RNA, 17 nt, Escherichia coli CFT073
gcgauggcuuuccaccu

SEQ ID NO: 2653596 - RNA, 16 nt, Escherichia coli CFT073
gcgauggguuguugag

SEQ ID NO: 2653597 - RNA, 22 nt, Escherichia coli CFT073
gcgaugguacuucaaucgccac

SEQ ID NO: 2653598 - RNA, 20 nt, Escherichia coli CFT073
gcgaugguguuggcaaucag

SEQ ID NO: 2653599 - RNA, 17 nt, Escherichia coli CFT073
gcgauguuagcgucaac

SEQ ID NO: 2653600 - RNA, 13 nt, Escherichia coli CFT073
gcgauuaaccguu

SEQ ID NO: 2653601 - RNA, 22 nt, Escherichia coli CFT073
gcgauuacauacgcucuacugu

SEQ ID NO: 2653602 - RNA, 18 nt, Escherichia coli CFT073
gcgauuacguucggcaaa

SEQ ID NO: 2653603 - RNA, 18 nt, Escherichia coli CFT073
gcgauuauccaugccaca

SEQ ID NO: 2653604 - RNA, 14 nt, Escherichia coli CFT073
gcgauuaucccaua

SEQ ID NO: 2653605 - RNA, 17 nt, Escherichia coli CFT073
gcgauuaugaaacaaga

SEQ ID NO: 2653606 - RNA, 21 nt, Escherichia coli CFT073
gcgauuauuuauucccgccag

SEQ ID NO: 2653607 - RNA, 14 nt, Escherichia coli CFT073
gcgauucaaauucg

SEQ ID NO: 2653608 - RNA, 12 nt, Escherichia coli CFT073
gcgauucagcaa

SEQ ID NO: 2653609 - RNA, 19 nt, Escherichia coli CFT073
gcgauucauaugcgccagc

SEQ ID NO: 2653610 - RNA, 21 nt, Escherichia coli CFT073
gcgauucauaugcgccagcug

SEQ ID NO: 2653611 - RNA, 21 nt, Escherichia coli CFT073
gcgauuccaguucaaucucuu

SEQ ID NO: 2653612 - RNA, 23 nt, Escherichia coli CFT073
gcgauucccguuuauggucgggu

SEQ ID NO: 2653613 - RNA, 20 nt, Escherichia coli CFT073
gcgauugccggaugcaacgc

SEQ ID NO: 2653614 - RNA, 23 nt, Escherichia coli CFT073
gcgauugcuguuggcguugcacc

SEQ ID NO: 2653615 - RNA, 17 nt, Escherichia coli CFT073
gcgauugugacacgcgc

SEQ ID NO: 2653616 - RNA, 17 nt, Escherichia coli CFT073
gcgauuuauguaccguc

SEQ ID NO: 2653617 - RNA, 17 nt, Escherichia coli CFT073
gcgauuucagcgccgcg

SEQ ID NO: 2653618 - RNA, 14 nt, Escherichia coli CFT073
gcgauuucgcggau

SEQ ID NO: 2653619 - RNA, 14 nt, Escherichia coli CFT073
gcgauuuucgucca

SEQ ID NO: 2653620 - RNA, 19 nt, Escherichia coli CFT073
gcgauuuucguccaccagg

SEQ ID NO: 2653621 - RNA, 20 nt, Escherichia coli CFT073
gcgauuuucuacuucuuuca

SEQ ID NO: 2653622 - RNA, 22 nt, Escherichia coli CFT073
gcgcaaaaaacuaucccaucag

SEQ ID NO: 2653623 - RNA, 23 nt, Escherichia coli CFT073
gcgcaaaaaacuaucccaucagc

SEQ ID NO: 2653624 - RNA, 15 nt, Escherichia coli CFT073
gcgcaaacagugacc

SEQ ID NO: 2653625 - RNA, 16 nt, Escherichia coli CFT073
gcgcaaagcccgccgc

SEQ ID NO: 2653626 - RNA, 13 nt, Escherichia coli CFT073
gcgcaaaggccag

SEQ ID NO: 2653627 - RNA, 16 nt, Escherichia coli CFT073
gcgcaaaggccagcaa

SEQ ID NO: 2653628 - RNA, 21 nt, Escherichia coli CFT073
gcgcaaauccacguuccagau

SEQ ID NO: 2653629 - RNA, 15 nt, Escherichia coli CFT073
gcgcaacagcgcgcc

SEQ ID NO: 2653630 - RNA, 22 nt, Escherichia coli CFT073
gcgcaacauccgcuuuugguuu

SEQ ID NO: 2653631 - RNA, 16 nt, Escherichia coli CFT073
gcgcaaccacaacgca

SEQ ID NO: 2653632 - RNA, 14 nt, Escherichia coli CFT073
gcgcaaccaucagu

SEQ ID NO: 2653633 - RNA, 16 nt, Escherichia coli CFT073
gcgcaacccccacacu

SEQ ID NO: 2653634 - RNA, 13 nt, Escherichia coli CFT073
gcgcaacuugugc

SEQ ID NO: 2653635 - RNA, 19 nt, Escherichia coli CFT073
gcgcaacuugugcucgcgu

SEQ ID NO: 2653636 - RNA, 22 nt, Escherichia coli CFT073
gcgcaagcugcugacauacggc

SEQ ID NO: 2653637 - RNA, 22 nt, Escherichia coli CFT073
gcgcaaggcauugaggguaucc

SEQ ID NO: 2653638 - RNA, 20 nt, Escherichia coli CFT073
gcgcaaguuuauguaguguu

SEQ ID NO: 2653639 - RNA, 22 nt, Escherichia coli CFT073
gcgcaauaccgauaucgccauu

SEQ ID NO: 2653640 - RNA, 16 nt, Escherichia coli CFT073
gcgcaauacgcgcaga

SEQ ID NO: 2653641 - RNA, 14 nt, Escherichia coli CFT073
gcgcaauauucaag

SEQ ID NO: 2653642 - RNA, 20 nt, Escherichia coli CFT073
gcgcaauauucaagauaacg

SEQ ID NO: 2653643 - RNA, 15 nt, Escherichia coli CFT073
gcgcaaucagcaccg

SEQ ID NO: 2653644 - RNA, 16 nt, Escherichia coli CFT073
gcgcaaucagcaccgc

SEQ ID NO: 2653645 - RNA, 13 nt, Escherichia coli CFT073
gcgcaaucgccag

SEQ ID NO: 2653646 - RNA, 22 nt, Escherichia coli CFT073
gcgcaaucgcuguacucaccaa

SEQ ID NO: 2653647 - RNA, 17 nt, Escherichia coli CFT073
gcgcaaugccauccagc

SEQ ID NO: 2653648 - RNA, 19 nt, Escherichia coli CFT073
gcgcaaugccauccagcuu

SEQ ID NO: 2653649 - RNA, 14 nt, Escherichia coli CFT073
gcgcaaugcccgca

SEQ ID NO: 2653650 - RNA, 15 nt, Escherichia coli CFT073
gcgcaaugcccgcag

SEQ ID NO: 2653651 - RNA, 17 nt, Escherichia coli CFT073
gcgcaaugcccgcagua

SEQ ID NO: 2653652 - RNA, 20 nt, Escherichia coli CFT073
gcgcacaaccgccggaugcg

SEQ ID NO: 2653653 - RNA, 15 nt, Escherichia coli CFT073
gcgcacaggcggccc

SEQ ID NO: 2653654 - RNA, 13 nt, Escherichia coli CFT073
gcgcacaugcagc

SEQ ID NO: 2653655 - RNA, 14 nt, Escherichia coli CFT073
gcgcaccagcaggc

SEQ ID NO: 2653656 - RNA, 22 nt, Escherichia coli CFT073
gcgcaccgagugguucaucaag

SEQ ID NO: 2653657 - RNA, 23 nt, Escherichia coli CFT073
gcgcaccgcauguugcucuguuu

SEQ ID NO: 2653658 - RNA, 23 nt, Escherichia coli CFT073
gcgcaccggucccugaucggcca

SEQ ID NO: 2653659 - RNA, 18 nt, Escherichia coli CFT073
gcgcaccguccagcguuc

SEQ ID NO: 2653660 - RNA, 21 nt, Escherichia coli CFT073
gcgcaccuucauucaggccaa

SEQ ID NO: 2653661 - RNA, 20 nt, Escherichia coli CFT073
gcgcacgaggugccaccagu

SEQ ID NO: 2653662 - RNA, 14 nt, Escherichia coli CFT073
gcgcacuuuauuaa

SEQ ID NO: 2653663 - RNA, 17 nt, Escherichia coli CFT073
gcgcagaauuuggugaa

SEQ ID NO: 2653664 - RNA, 20 nt, Escherichia coli CFT073
gcgcagacaccagaauagug

SEQ ID NO: 2653665 - RNA, 23 nt, Escherichia coli CFT073
gcgcagagccugaauaaacgcca

SEQ ID NO: 2653666 - RNA, 19 nt, Escherichia coli CFT073
gcgcagauuaauugggcga

SEQ ID NO: 2653667 - RNA, 18 nt, Escherichia coli CFT073
gcgcagauuuuugcgcca

SEQ ID NO: 2653668 - RNA, 20 nt, Escherichia coli CFT073
gcgcagcaaggucaggcgaa

SEQ ID NO: 2653669 - RNA, 17 nt, Escherichia coli CFT073
gcgcagcacggugcggg

SEQ ID NO: 2653670 - RNA, 14 nt, Escherichia coli CFT073
gcgcagcaggcggu

SEQ ID NO: 2653671 - RNA, 18 nt, Escherichia coli CFT073
gcgcagcauaaucggcug

SEQ ID NO: 2653672 - RNA, 14 nt, Escherichia coli CFT073
gcgcagcaucggcg

SEQ ID NO: 2653673 - RNA, 16 nt, Escherichia coli CFT073
gcgcaggagcggcgga

SEQ ID NO: 2653674 - RNA, 22 nt, Escherichia coli CFT073
gcgcaggcaagccuugcagcca

SEQ ID NO: 2653675 - RNA, 18 nt, Escherichia coli CFT073
gcgcaggggcaaucagca

SEQ ID NO: 2653676 - RNA, 18 nt, Escherichia coli CFT073
gcgcaggggcagaaacaa

SEQ ID NO: 2653677 - RNA, 20 nt, Escherichia coli CFT073
gcgcaggguuugcaucgcca

SEQ ID NO: 2653678 - RNA, 18 nt, Escherichia coli CFT073
gcgcagguaguuaucugc

SEQ ID NO: 2653679 - RNA, 22 nt, Escherichia coli CFT073
gcgcaguaccacuucauccgga

SEQ ID NO: 2653680 - RNA, 23 nt, Escherichia coli CFT073
gcgcaguaccagcaacgcuucaa

SEQ ID NO: 2653681 - RNA, 22 nt, Escherichia coli CFT073
gcgcagugugcgaugcucgccg

SEQ ID NO: 2653682 - RNA, 21 nt, Escherichia coli CFT073
gcgcaguucgcacaccgcuga

SEQ ID NO: 2653683 - RNA, 11 nt, Escherichia coli CFT073
gcgcaguugcc

SEQ ID NO: 2653684 - RNA, 15 nt, Escherichia coli CFT073
gcgcaguugccggau

SEQ ID NO: 2653685 - RNA, 21 nt, Escherichia coli CFT073
gcgcauaaaagcuguacaucg

SEQ ID NO: 2653686 - RNA, 16 nt, Escherichia coli CFT073
gcgcauaagaccguga

SEQ ID NO: 2653687 - RNA, 20 nt, Escherichia coli CFT073
gcgcauaccaaaaucuacca

SEQ ID NO: 2653688 - RNA, 22 nt, Escherichia coli CFT073
gcgcauagcaccaccgacgggc

SEQ ID NO: 2653689 - RNA, 21 nt, Escherichia coli CFT073
gcgcauaguuuuuugggauga

SEQ ID NO: 2653690 - RNA, 17 nt, Escherichia coli CFT073
gcgcauauugccaucac

SEQ ID NO: 2653691 - RNA, 13 nt, Escherichia coli CFT073
gcgcaucagcaga

SEQ ID NO: 2653692 - RNA, 12 nt, Escherichia coli CFT073
gcgcauccgcca

SEQ ID NO: 2653693 - RNA, 17 nt, Escherichia coli CFT073
gcgcauccgccagcagc

SEQ ID NO: 2653694 - RNA, 17 nt, Escherichia coli CFT073
gcgcaucgacgccauca

SEQ ID NO: 2653695 - RNA, 14 nt, Escherichia coli CFT073
gcgcaucgggcgau

SEQ ID NO: 2653696 - RNA, 19 nt, Escherichia coli CFT073
gcgcaugaccagugaggau

SEQ ID NO: 2653697 - RNA, 23 nt, Escherichia coli CFT073
gcgccugcacaaagcgccagaau

SEQ ID NO: 2653698 - RNA, 19 nt, Escherichia coli CFT073
gcgccugcagcggccagua

SEQ ID NO: 2653699 - RNA, 22 nt, Escherichia coli CFT073
gcgccugcagcugcagauaacu

SEQ ID NO: 2653700 - RNA, 20 nt, Escherichia coli CFT073
gcgccugcggccagcagcug

SEQ ID NO: 2653701 - RNA, 20 nt, Escherichia coli CFT073
gcgccuggguguauuguucc

SEQ ID NO: 2653702 - RNA, 22 nt, Escherichia coli CFT073
gcgccugguuuugccaugcaau

SEQ ID NO: 2653703 - RNA, 21 nt, Escherichia coli CFT073
gcgccugucaccgccuccacc

SEQ ID NO: 2653704 - RNA, 23 nt, Escherichia coli CFT073
gcgccugucaccgccuccaccug

SEQ ID NO: 2653705 - RNA, 22 nt, Escherichia coli CFT073
gcgccuguguuuuuacgcaggc

SEQ ID NO: 2653706 - RNA, 13 nt, Escherichia coli CFT073
gcgccuguugauu

SEQ ID NO: 2653707 - RNA, 17 nt, Escherichia coli CFT073
gcgccuuauccggccug

SEQ ID NO: 2653708 - RNA, 19 nt, Escherichia coli CFT073
gcgccuuccccguuuugcc

SEQ ID NO: 2653709 - RNA, 19 nt, Escherichia coli CFT073
gcgccuucgugcggcugca

SEQ ID NO: 2653710 - RNA, 13 nt, Escherichia coli CFT073
gcgccuuuauaag

SEQ ID NO: 2653711 - RNA, 23 nt, Escherichia coli CFT073
gcgccuuugaugccaccaggcag

SEQ ID NO: 2653712 - RNA, 20 nt, Escherichia coli CFT073
gcgccuuuuuucgccgcagc

SEQ ID NO: 2653713 - RNA, 21 nt, Escherichia coli CFT073
gcgccuuuuuucgccgcagca

SEQ ID NO: 2653714 - RNA, 18 nt, Escherichia coli CFT073
gcgcgaaaacaacuggca

SEQ ID NO: 2653715 - RNA, 22 nt, Escherichia coli CFT073
gcgcgaaaacgcauaucuucug

SEQ ID NO: 2653716 - RNA, 16 nt, Escherichia coli CFT073
gcgcgaaccagagaca

SEQ ID NO: 2653717 - RNA, 17 nt, Escherichia coli CFT073
gcgcgaaccaucaccuc

SEQ ID NO: 2653718 - RNA, 19 nt, Escherichia coli CFT073
gcgcgaauauggcggcggc

SEQ ID NO: 2653719 - RNA, 15 nt, Escherichia coli CFT073
gcgcgaaucuucaua

SEQ ID NO: 2653720 - RNA, 13 nt, Escherichia coli CFT073
gcgcgaccaaugu

SEQ ID NO: 2653721 - RNA, 22 nt, Escherichia coli CFT073
gcgcgaccaucggaucggccau

SEQ ID NO: 2653722 - RNA, 14 nt, Escherichia coli CFT073
gcgcgaccgccaug

SEQ ID NO: 2653723 - RNA, 17 nt, Escherichia coli CFT073
gcgcgacggcgaccgaa

SEQ ID NO: 2653724 - RNA, 18 nt, Escherichia coli CFT073
gcgcgacugaaaggucau

SEQ ID NO: 2653725 - RNA, 16 nt, Escherichia coli CFT073
gcgcgagguaacaaua

SEQ ID NO: 2653726 - RNA, 21 nt, Escherichia coli CFT073
gcgcgagguggaacaucagga

SEQ ID NO: 2653727 - RNA, 22 nt, Escherichia coli CFT073
gcgcgagguggaacaucaggau

SEQ ID NO: 2653728 - RNA, 15 nt, Escherichia coli CFT073
gcgcgaucuuccucu

SEQ ID NO: 2653729 - RNA, 14 nt, Escherichia coli CFT073
gcgcgauggucagu

SEQ ID NO: 2653730 - RNA, 19 nt, Escherichia coli CFT073
gcgcgauuugcccaucagg

SEQ ID NO: 2653731 - RNA, 18 nt, Escherichia coli CFT073
gcgcgcaccguccagcgu

SEQ ID NO: 2653732 - RNA, 13 nt, Escherichia coli CFT073
gcgcgcaggcaac

SEQ ID NO: 2653733 - RNA, 22 nt, Escherichia coli CFT073
gcgcgccaguaaucagcgcgga

SEQ ID NO: 2653734 - RNA, 18 nt, Escherichia coli CFT073
gcgcgccgaagcugacca

SEQ ID NO: 2653735 - RNA, 16 nt, Escherichia coli CFT073
gcgcgccgauaaaggu

SEQ ID NO: 2653736 - RNA, 23 nt, Escherichia coli CFT073
gcgcgcggauuucggcggcuuau

SEQ ID NO: 2653737 - RNA, 13 nt, Escherichia coli CFT073
gcgcgcggcuggc

SEQ ID NO: 2653738 - RNA, 14 nt, Escherichia coli CFT073
gcgcgcggcuggca

SEQ ID NO: 2653739 - RNA, 18 nt, Escherichia coli CFT073
gcgcgcgggucacugcgg

SEQ ID NO: 2653740 - RNA, 20 nt, Escherichia coli CFT073
gcgcgcgucaucggcgcggu

SEQ ID NO: 2653741 - RNA, 20 nt, Escherichia coli CFT073
gcgcggaacaagucggcgug

SEQ ID NO: 2653742 - RNA, 22 nt, Escherichia coli CFT073
gcgcggaccccgcgcucgcgca

SEQ ID NO: 2653743 - RNA, 15 nt, Escherichia coli CFT073
gcgcggauuucggcg

SEQ ID NO: 2653744 - RNA, 19 nt, Escherichia coli CFT073
gcgcggcaauggucccuug

SEQ ID NO: 2653745 - RNA, 16 nt, Escherichia coli CFT073
gcgcggcgcaggcgcu

SEQ ID NO: 2653746 - RNA, 21 nt, Escherichia coli CFT073
gcgcggcgguugacgccccug

SEQ ID NO: 2653747 - RNA, 15 nt, Escherichia coli CFT073
gcgcgggcuggcgua

SEQ ID NO: 2653748 - RNA, 22 nt, Escherichia coli CFT073
gcgcgguacgacccgauucggu

SEQ ID NO: 2653749 - RNA, 20 nt, Escherichia coli CFT073
gcgcgguaucucgcgccagu

SEQ ID NO: 2653750 - RNA, 20 nt, Escherichia coli CFT073
gcgcgguggcguacagcugg

SEQ ID NO: 2653751 - RNA, 21 nt, Escherichia coli CFT073
gcgcgguuuuggagagcggcg

SEQ ID NO: 2653752 - RNA, 16 nt, Escherichia coli CFT073
gcgcgucaucggcgcg

SEQ ID NO: 2653753 - RNA, 21 nt, Escherichia coli CFT073
gcgcguccccugcccgcgauc

SEQ ID NO: 2653754 - RNA, 12 nt, Escherichia coli CFT073
gcgcguccgguu

SEQ ID NO: 2653755 - RNA, 12 nt, Escherichia coli CFT073
gcgcgugccgga

SEQ ID NO: 2653756 - RNA, 22 nt, Escherichia coli CFT073
gcgcguugauaccgugcagcac

SEQ ID NO: 2653757 - RNA, 14 nt, Escherichia coli CFT073
gcgcguuugucagc

SEQ ID NO: 2653758 - RNA, 22 nt, Escherichia coli CFT073
gcgcguuuucaaccggaucggu

SEQ ID NO: 2653759 - RNA, 17 nt, Escherichia coli CFT073
gcgcuaaaagcauagcc

SEQ ID NO: 2653760 - RNA, 15 nt, Escherichia coli CFT073
gcgcuaaaauuucuu

SEQ ID NO: 2653761 - RNA, 21 nt, Escherichia coli CFT073
gcgcuaaaauuucuuuuuuuc

SEQ ID NO: 2653762 - RNA, 23 nt, Escherichia coli CFT073
gcgcuaacggagaauccagcccc

SEQ ID NO: 2653763 - RNA, 13 nt, Escherichia coli CFT073
gcgcuaacucauc

SEQ ID NO: 2653764 - RNA, 15 nt, Escherichia coli CFT073
gcgcuaccaucgaca

SEQ ID NO: 2653765 - RNA, 22 nt, Escherichia coli CFT073
gcgcuaccaucgacaccaucgc

SEQ ID NO: 2653766 - RNA, 16 nt, Escherichia coli CFT073
gcgcuacggcguuuca

SEQ ID NO: 2653767 - RNA, 15 nt, Escherichia coli CFT073
gcgcuacugaagcga

SEQ ID NO: 2653768 - RNA, 15 nt, Escherichia coli CFT073
gcgcuauaucgcuga

SEQ ID NO: 2653769 - RNA, 12 nt, Escherichia coli CFT073
gcgcuaucaaua

SEQ ID NO: 2653770 - RNA, 13 nt, Escherichia coli CFT073
gcgcuaucgccug

SEQ ID NO: 2653771 - RNA, 15 nt, Escherichia coli CFT073
gcgcuaugaugaaaa

SEQ ID NO: 2653772 - RNA, 14 nt, Escherichia coli CFT073
gcgcuauugccgua

SEQ ID NO: 2653773 - RNA, 13 nt, Escherichia coli CFT073
gcgcucagaguac

SEQ ID NO: 2653774 - RNA, 22 nt, Escherichia coli CFT073
gcgcucaucggcauacagcgac

SEQ ID NO: 2653775 - RNA, 14 nt, Escherichia coli CFT073
gcgcuccagcaucu

SEQ ID NO: 2653776 - RNA, 23 nt, Escherichia coli CFT073
gcgcuccaucagauucagcagcg

SEQ ID NO: 2653777 - RNA, 20 nt, Escherichia coli CFT073
gcgcuccgcuuaucaggccu

SEQ ID NO: 2653778 - RNA, 15 nt, Escherichia coli CFT073
gcgcucgacuuuagu

SEQ ID NO: 2653779 - RNA, 15 nt, Escherichia coli CFT073
gcgcucgauaugcgc

SEQ ID NO: 2653780 - RNA, 18 nt, Escherichia coli CFT073
gcgcucgccguaggccau

SEQ ID NO: 2653781 - RNA, 14 nt, Escherichia coli CFT073
gcgcucgcgccgca

SEQ ID NO: 2653782 - RNA, 20 nt, Escherichia coli CFT073
gcgcucgcgccgcauccggc

SEQ ID NO: 2653783 - RNA, 12 nt, Escherichia coli CFT073
gcgcucgcugau

SEQ ID NO: 2653784 - RNA, 19 nt, Escherichia coli CFT073
gcgcucguagguuucugcc

SEQ ID NO: 2653785 - RNA, 20 nt, Escherichia coli CFT073
gcgcucugcuagauaagcaa

SEQ ID NO: 2653786 - RNA, 21 nt, Escherichia coli CFT073
gcgcucuucaacuucagcagc

SEQ ID NO: 2653787 - RNA, 22 nt, Escherichia coli CFT073
gcgcugaauaauggugaauuug

SEQ ID NO: 2653788 - RNA, 20 nt, Escherichia coli CFT073
gcgcugaccuucuucagcaa

SEQ ID NO: 2653789 - RNA, 17 nt, Escherichia coli CFT073
gcgcugagguuaugcaa

SEQ ID NO: 2653790 - RNA, 14 nt, Escherichia coli CFT073
gcgcugaucgucag

SEQ ID NO: 2653791 - RNA, 18 nt, Escherichia coli CFT073
gcgcugccagaaccgcuu

SEQ ID NO: 2653792 - RNA, 15 nt, Escherichia coli CFT073
gcgcugcgucuucca

SEQ ID NO: 2653793 - RNA, 14 nt, Escherichia coli CFT073
gcgcugcucaggcg

SEQ ID NO: 2653794 - RNA, 15 nt, Escherichia coli CFT073
gcgcugcugcacaua

SEQ ID NO: 2653795 - RNA, 15 nt, Escherichia coli CFT073
gcgcugcuggagcag

SEQ ID NO: 2653796 - RNA, 21 nt, Escherichia coli CFT073
gcgcuggcaucgcaaaauuuc

SEQ ID NO: 2653797 - RNA, 23 nt, Escherichia coli CFT073
gcgcuggccaugauuaccagcau

SEQ ID NO: 2653798 - RNA, 18 nt, Escherichia coli CFT073
gcgcuggcgaucguccag

SEQ ID NO: 2653799 - RNA, 11 nt, Escherichia coli CFT073
gcgcuggcgca

SEQ ID NO: 2653800 - RNA, 19 nt, Escherichia coli CFT073
gcgcuggcgcaacugcgcc

SEQ ID NO: 2653801 - RNA, 16 nt, Escherichia coli CFT073
gcgcuggcgcagcauc

SEQ ID NO: 2653802 - RNA, 16 nt, Escherichia coli CFT073
gcgcuguaagccacga

SEQ ID NO: 2653803 - RNA, 16 nt, Escherichia coli CFT073
gcgcugugagcaggcg

SEQ ID NO: 2653804 - RNA, 23 nt, Escherichia coli CFT073
gcgcuguuacuuucacaaugccc

SEQ ID NO: 2653805 - RNA, 22 nt, Escherichia coli CFT073
gcggccaguagcuugaaaucac

SEQ ID NO: 2653806 - RNA, 13 nt, Escherichia coli CFT073
gcggccaguuucg

SEQ ID NO: 2653807 - RNA, 21 nt, Escherichia coli CFT073
gcggccauuacacguuguuua

SEQ ID NO: 2653808 - RNA, 18 nt, Escherichia coli CFT073
gcggccuccaacaacccu

SEQ ID NO: 2653809 - RNA, 17 nt, Escherichia coli CFT073
gcggccugaugcggcgu

SEQ ID NO: 2653810 - RNA, 18 nt, Escherichia coli CFT073
gcggcgaaccagccguug

SEQ ID NO: 2653811 - RNA, 14 nt, Escherichia coli CFT073
gcggcgaaggugcc

SEQ ID NO: 2653812 - RNA, 14 nt, Escherichia coli CFT073
gcggcgacaauaau

SEQ ID NO: 2653813 - RNA, 20 nt, Escherichia coli CFT073
gcggcgagaacgccuuaucc

SEQ ID NO: 2653814 - RNA, 22 nt, Escherichia coli CFT073
gcggcgagaucuuuaucaauca

SEQ ID NO: 2653815 - RNA, 16 nt, Escherichia coli CFT073
gcggcgauaauaccca

SEQ ID NO: 2653816 - RNA, 21 nt, Escherichia coli CFT073
gcggcgauaauacccagcaac

SEQ ID NO: 2653817 - RNA, 23 nt, Escherichia coli CFT073
gcggcgauaauauugaugcacac

SEQ ID NO: 2653818 - RNA, 17 nt, Escherichia coli CFT073
gcggcgauauccagcgc

SEQ ID NO: 2653819 - RNA, 16 nt, Escherichia coli CFT073
gcggcgaucgccugcu

SEQ ID NO: 2653820 - RNA, 19 nt, Escherichia coli CFT073
gcggcgaucuucaaacugg

SEQ ID NO: 2653821 - RNA, 21 nt, Escherichia coli CFT073
gcggcgaucuucaaacuggcg

SEQ ID NO: 2653822 - RNA, 15 nt, Escherichia coli CFT073
gcggcgaugaccgcc

SEQ ID NO: 2653823 - RNA, 17 nt, Escherichia coli CFT073
gcggcgauuaauccagu

SEQ ID NO: 2653824 - RNA, 14 nt, Escherichia coli CFT073
gcggcgcaaccauc

SEQ ID NO: 2653825 - RNA, 15 nt, Escherichia coli CFT073
gcggcgcaaccauca

SEQ ID NO: 2653826 - RNA, 18 nt, Escherichia coli CFT073
gcggcgcaacccccacac

SEQ ID NO: 2653827 - RNA, 16 nt, Escherichia coli CFT073
gcggcgcaccagcagg

SEQ ID NO: 2653828 - RNA, 19 nt, Escherichia coli CFT073
gcggcgcacggcguucagg

SEQ ID NO: 2653829 - RNA, 17 nt, Escherichia coli CFT073
gcggcgcaggcgcuuau

SEQ ID NO: 2653830 - RNA, 14 nt, Escherichia coli CFT073
gcggcgcaugcagg

SEQ ID NO: 2653831 - RNA, 15 nt, Escherichia coli CFT073
gcggcgcaugcaggc

SEQ ID NO: 2653832 - RNA, 16 nt, Escherichia coli CFT073
gcggcgcauucaccag

SEQ ID NO: 2653833 - RNA, 20 nt, Escherichia coli CFT073
gcggcgcgagcgccuuaucc

SEQ ID NO: 2653834 - RNA, 13 nt, Escherichia coli CFT073
gcggcgcggcggg

SEQ ID NO: 2653835 - RNA, 20 nt, Escherichia coli CFT073
gcggcgcugacgcgucuuau

SEQ ID NO: 2653836 - RNA, 22 nt, Escherichia coli CFT073
gcggcgcugacgcgucuuaucc

SEQ ID NO: 2653837 - RNA, 11 nt, Escherichia coli CFT073
gcggcggcaga

SEQ ID NO: 2653838 - RNA, 13 nt, Escherichia coli CFT073
gcggcggcgaccu

SEQ ID NO: 2653839 - RNA, 20 nt, Escherichia coli CFT073
gcggcggguuaaccagcacc

SEQ ID NO: 2653840 - RNA, 23 nt, Escherichia coli CFT073
gcggcggguuaaccagcaccagc

SEQ ID NO: 2653841 - RNA, 15 nt, Escherichia coli CFT073
gcggcgguugacgcc

SEQ ID NO: 2653842 - RNA, 18 nt, Escherichia coli CFT073
gcggcguaaacgccuuau

SEQ ID NO: 2653843 - RNA, 19 nt, Escherichia coli CFT073
gcggcguaaacgccuuauc

SEQ ID NO: 2653844 - RNA, 14 nt, Escherichia coli CFT073
gcggcgucagccag

SEQ ID NO: 2653845 - RNA, 16 nt, Escherichia coli CFT073
gcggcgucauaauccg

SEQ ID NO: 2653846 - RNA, 13 nt, Escherichia coli CFT073
gcggcguccccac

SEQ ID NO: 2653847 - RNA, 20 nt, Escherichia coli CFT073
gcggcgugaacaccucaucc

SEQ ID NO: 2653848 - RNA, 19 nt, Escherichia coli CFT073
gcggcgugaacaccuuauc

SEQ ID NO: 2653849 - RNA, 18 nt, Escherichia coli CFT073
gcggcgugaacgccuuau

SEQ ID NO: 2653850 - RNA, 19 nt, Escherichia coli CFT073
gcggcgugaacgccuuauc

SEQ ID NO: 2653851 - RNA, 20 nt, Escherichia coli CFT073
gcggcgugaacgccuucucc

SEQ ID NO: 2653852 - RNA, 19 nt, Escherichia coli CFT073
gcggcgugaccgccuuauc

SEQ ID NO: 2653853 - RNA, 15 nt, Escherichia coli CFT073
gcggcgugaugccga

SEQ ID NO: 2653854 - RNA, 19 nt, Escherichia coli CFT073
gcggcgugguuccggcuua

SEQ ID NO: 2653855 - RNA, 21 nt, Escherichia coli CFT073
gcggcuacugauguucgccag

SEQ ID NO: 2653856 - RNA, 22 nt, Escherichia coli CFT073
gcggcuacugauguucgccaga

SEQ ID NO: 2653857 - RNA, 23 nt, Escherichia coli CFT073
gcggcuauucuugaauuguugau

SEQ ID NO: 2653858 - RNA, 19 nt, Escherichia coli CFT073
gcggcucucuuucuccagc

SEQ ID NO: 2653859 - RNA, 19 nt, Escherichia coli CFT073
gcggcugacaugcaguuga

SEQ ID NO: 2653860 - RNA, 21 nt, Escherichia coli CFT073
gcggcugacugcuucgcacag

SEQ ID NO: 2653861 - RNA, 21 nt, Escherichia coli CFT073
gcggcugcccaucaucgucgu

SEQ ID NO: 2653862 - RNA, 12 nt, Escherichia coli CFT073
gcggcugcgcag

SEQ ID NO: 2653863 - RNA, 13 nt, Escherichia coli CFT073
gcggcugcgcagc

SEQ ID NO: 2653864 - RNA, 15 nt, Escherichia coli CFT073
gcggcugcgcagcgg

SEQ ID NO: 2653865 - RNA, 21 nt, Escherichia coli CFT073
gcggcugcguaauucgccacc

SEQ ID NO: 2653866 - RNA, 23 nt, Escherichia coli CFT073
gcggcuggcacucuuccagacca

SEQ ID NO: 2653867 - RNA, 19 nt, Escherichia coli CFT073
gcggcugguaacaguccgu

SEQ ID NO: 2653868 - RNA, 17 nt, Escherichia coli CFT073
gcggcuuaguugaucga

SEQ ID NO: 2653869 - RNA, 22 nt, Escherichia coli CFT073
gcggcuuaguugaucgacaaaa

SEQ ID NO: 2653870 - RNA, 22 nt, Escherichia coli CFT073
gcggcuucaucuuuaucaauca

SEQ ID NO: 2653871 - RNA, 21 nt, Escherichia coli CFT073
gcggcuugucguauuucagcc

SEQ ID NO: 2653872 - RNA, 13 nt, Escherichia coli CFT073
gcggcuuuuacga

SEQ ID NO: 2653873 - RNA, 20 nt, Escherichia coli CFT073
gcgggaaaaauugccugaug

SEQ ID NO: 2653874 - RNA, 20 nt, Escherichia coli CFT073
gcgggaaacuuccagcuuca

SEQ ID NO: 2653875 - RNA, 15 nt, Escherichia coli CFT073
gcgggaacagcgacc

SEQ ID NO: 2653876 - RNA, 18 nt, Escherichia coli CFT073
gcgggaauagcucaguug

SEQ ID NO: 2653877 - RNA, 20 nt, Escherichia coli CFT073
gcgggaauagcucaguuggu

SEQ ID NO: 2653878 - RNA, 20 nt, Escherichia coli CFT073
gcgggacaacaaacgcaaac

SEQ ID NO: 2653879 - RNA, 13 nt, Escherichia coli CFT073
gcgggaccagcac

SEQ ID NO: 2653880 - RNA, 14 nt, Escherichia coli CFT073
gcgggaccagcacg

SEQ ID NO: 2653881 - RNA, 18 nt, Escherichia coli CFT073
gcgggauaauccggaaaa

SEQ ID NO: 2653882 - RNA, 15 nt, Escherichia coli CFT073
gcgggcagacaaaac

SEQ ID NO: 2653883 - RNA, 17 nt, Escherichia coli CFT073
gcgggccgcgucgggcg

SEQ ID NO: 2653884 - RNA, 22 nt, Escherichia coli CFT073
gcgggcgaaucaacuccagaau

SEQ ID NO: 2653885 - RNA, 17 nt, Escherichia coli CFT073
gcggggagaaugccagc

SEQ ID NO: 2653886 - RNA, 18 nt, Escherichia coli CFT073
gcggggagaaugccagca

SEQ ID NO: 2653887 - RNA, 21 nt, Escherichia coli CFT073
gcggggagaaugccagcagca

SEQ ID NO: 2653888 - RNA, 23 nt, Escherichia coli CFT073
gcggggaucacuggcagggaaag

SEQ ID NO: 2653889 - RNA, 13 nt, Escherichia coli CFT073
gcggggcuaccgc

SEQ ID NO: 2653890 - RNA, 17 nt, Escherichia coli CFT073
gcgggguaaucgccagc

SEQ ID NO: 2653891 - RNA, 14 nt, Escherichia coli CFT073
gcggguaaccagcc

SEQ ID NO: 2653892 - RNA, 14 nt, Escherichia coli CFT073
gcggguaagugcgg

SEQ ID NO: 2653893 - RNA, 20 nt, Escherichia coli CFT073
gcggguaauuaccccaucca

SEQ ID NO: 2653894 - RNA, 16 nt, Escherichia coli CFT073
gcggguacguuucgcc

SEQ ID NO: 2653895 - RNA, 22 nt, Escherichia coli CFT073
gcggguaucguuaaagagauca

SEQ ID NO: 2653896 - RNA, 19 nt, Escherichia coli CFT073
gcgggucaaucggcgcgag

SEQ ID NO: 2653897 - RNA, 16 nt, Escherichia coli CFT073
gcgggugaacgcguua

SEQ ID NO: 2653898 - RNA, 14 nt, Escherichia coli CFT073
gcggguggugcgca

SEQ ID NO: 2653899 - RNA, 16 nt, Escherichia coli CFT073
gcggguuaaccagcac

SEQ ID NO: 2653900 - RNA, 17 nt, Escherichia coli CFT073
gcggguuaaccagcacc

SEQ ID NO: 2653901 - RNA, 15 nt, Escherichia coli CFT073
gcggguucuggcgca

SEQ ID NO: 2653902 - RNA, 20 nt, Escherichia coli CFT073
gcggguugcucucgccagca

SEQ ID NO: 2653903 - RNA, 18 nt, Escherichia coli CFT073
gcggguuucgacauuucc

SEQ ID NO: 2653904 - RNA, 21 nt, Escherichia coli CFT073
gcgguaaaagccauucuggcg

SEQ ID NO: 2653905 - RNA, 21 nt, Escherichia coli CFT073
gcgguaaaauggucagccagc

SEQ ID NO: 2653906 - RNA, 22 nt, Escherichia coli CFT073
gcgguaaaauggucagccagcg

SEQ ID NO: 2653907 - RNA, 17 nt, Escherichia coli CFT073
gcgguaaaccguuauca

SEQ ID NO: 2653908 - RNA, 13 nt, Escherichia coli CFT073
gcgguaaauuuuu

SEQ ID NO: 2653909 - RNA, 14 nt, Escherichia coli CFT073
gcgguaacggcaga

SEQ ID NO: 2653910 - RNA, 21 nt, Escherichia coli CFT073
gcgguaacuccggcauaauaa

SEQ ID NO: 2653911 - RNA, 22 nt, Escherichia coli CFT073
gcgguaaucauggcguuuuucc

SEQ ID NO: 2653912 - RNA, 20 nt, Escherichia coli CFT073
gcgguaaucuguugagcgcc

SEQ ID NO: 2653913 - RNA, 20 nt, Escherichia coli CFT073
gcgucguucgcgccaacagc

SEQ ID NO: 2653914 - RNA, 20 nt, Escherichia coli CFT073
gcgucuaaaucguaccagga

SEQ ID NO: 2653915 - RNA, 19 nt, Escherichia coli CFT073
gcgucucacuaucgccgag

SEQ ID NO: 2653916 - RNA, 14 nt, Escherichia coli CFT073
gcgucucaucuuua

SEQ ID NO: 2653917 - RNA, 23 nt, Escherichia coli CFT073
gcgucucaucuuuaucggugaga

SEQ ID NO: 2653918 - RNA, 23 nt, Escherichia coli CFT073
gcgucuccagacaauccgcagca

SEQ ID NO: 2653919 - RNA, 22 nt, Escherichia coli CFT073
gcgucugaauaucaucacccug

SEQ ID NO: 2653920 - RNA, 15 nt, Escherichia coli CFT073
gcgucuggcugggga

SEQ ID NO: 2653921 - RNA, 23 nt, Escherichia coli CFT073
gcgucuggcuggggaaggcaaag

SEQ ID NO: 2653922 - RNA, 19 nt, Escherichia coli CFT073
gcgucuuaucagcauacgc

SEQ ID NO: 2653923 - RNA, 14 nt, Escherichia coli CFT073
gcgucuuaucaggc

SEQ ID NO: 2653924 - RNA, 16 nt, Escherichia coli CFT073
gcgucuuaucaggccu

SEQ ID NO: 2653925 - RNA, 20 nt, Escherichia coli CFT073
gcgucuuaucaggccuacca

SEQ ID NO: 2653926 - RNA, 20 nt, Escherichia coli CFT073
gcgucuuaucaggccuacgc

SEQ ID NO: 2653927 - RNA, 17 nt, Escherichia coli CFT073
gcgucuuaucaugccua

SEQ ID NO: 2653928 - RNA, 20 nt, Escherichia coli CFT073
gcgucuuaucaugccuacga

SEQ ID NO: 2653929 - RNA, 16 nt, Escherichia coli CFT073
gcgucuuauccgaccu

SEQ ID NO: 2653930 - RNA, 19 nt, Escherichia coli CFT073
gcgucuuauccgaccuaca

SEQ ID NO: 2653931 - RNA, 20 nt, Escherichia coli CFT073
gcgucuuauccgaccuacag

SEQ ID NO: 2653932 - RNA, 20 nt, Escherichia coli CFT073
gcgucuuauccgaccugcgg

SEQ ID NO: 2653933 - RNA, 17 nt, Escherichia coli CFT073
gcgucuuaucuggccua

SEQ ID NO: 2653934 - RNA, 17 nt, Escherichia coli CFT073
gcgucuucaucguccag

SEQ ID NO: 2653935 - RNA, 11 nt, Escherichia coli CFT073
gcgucuuccac

SEQ ID NO: 2653936 - RNA, 22 nt, Escherichia coli CFT073
gcgucuugaauaaauuggcugg

SEQ ID NO: 2653937 - RNA, 18 nt, Escherichia coli CFT073
gcgucuuguugaacagac

SEQ ID NO: 2653938 - RNA, 13 nt, Escherichia coli CFT073
gcgugaacgccuu

SEQ ID NO: 2653939 - RNA, 14 nt, Escherichia coli CFT073
gcgugaacgccuua

SEQ ID NO: 2653940 - RNA, 14 nt, Escherichia coli CFT073
gcgugaaucaacac

SEQ ID NO: 2653941 - RNA, 15 nt, Escherichia coli CFT073
gcgugaaucaacacc

SEQ ID NO: 2653942 - RNA, 14 nt, Escherichia coli CFT073
gcgugacaccagca

SEQ ID NO: 2653943 - RNA, 23 nt, Escherichia coli CFT073
gcgugacaccagcacaucaucaa

SEQ ID NO: 2653944 - RNA, 18 nt, Escherichia coli CFT073
gcgugagaacacgaccug

SEQ ID NO: 2653945 - RNA, 18 nt, Escherichia coli CFT073
gcgugagggaaacagcac

SEQ ID NO: 2653946 - RNA, 20 nt, Escherichia coli CFT073
gcgugagguuaucgcccugc

SEQ ID NO: 2653947 - RNA, 14 nt, Escherichia coli CFT073
gcgugcaauaucaa

SEQ ID NO: 2653948 - RNA, 20 nt, Escherichia coli CFT073
gcgugcaauaucaaccugau

SEQ ID NO: 2653949 - RNA, 18 nt, Escherichia coli CFT073
gcgugcaggaacaggcga

SEQ ID NO: 2653950 - RNA, 12 nt, Escherichia coli CFT073
gcgugccaucaa

SEQ ID NO: 2653951 - RNA, 20 nt, Escherichia coli CFT073
gcgugcccgggucagcgcca

SEQ ID NO: 2653952 - RNA, 20 nt, Escherichia coli CFT073
gcgugccuaauuccgcgcga

SEQ ID NO: 2653953 - RNA, 20 nt, Escherichia coli CFT073
gcgugcgccagagcccguua

SEQ ID NO: 2653954 - RNA, 12 nt, Escherichia coli CFT073
gcgugcggcggc

SEQ ID NO: 2653955 - RNA, 14 nt, Escherichia coli CFT073
gcgugcggcggcug

SEQ ID NO: 2653956 - RNA, 22 nt, Escherichia coli CFT073
gcguggagcaacacgccagcgu

SEQ ID NO: 2653957 - RNA, 19 nt, Escherichia coli CFT073
gcguggauacaggcgggcg

SEQ ID NO: 2653958 - RNA, 22 nt, Escherichia coli CFT073
gcguggcgauaaucagcgccag

SEQ ID NO: 2653959 - RNA, 22 nt, Escherichia coli CFT073
gcguggucguuggugaaguggu

SEQ ID NO: 2653960 - RNA, 19 nt, Escherichia coli CFT073
gcguggugcagccgccauc

SEQ ID NO: 2653961 - RNA, 19 nt, Escherichia coli CFT073
gcgugguuugcucaucaug

SEQ ID NO: 2653962 - RNA, 19 nt, Escherichia coli CFT073
gcgugucgagcauugccag

SEQ ID NO: 2653963 - RNA, 13 nt, Escherichia coli CFT073
gcgugucggacgg

SEQ ID NO: 2653964 - RNA, 21 nt, Escherichia coli CFT073
gcgugugcgagugcauccagu

SEQ ID NO: 2653965 - RNA, 13 nt, Escherichia coli CFT073
gcguguggugagg

SEQ ID NO: 2653966 - RNA, 20 nt, Escherichia coli CFT073
gcguguuucaucucaucaau

SEQ ID NO: 2653967 - RNA, 15 nt, Escherichia coli CFT073
gcguuaaaaucagcg

SEQ ID NO: 2653968 - RNA, 13 nt, Escherichia coli CFT073
gcguuaaaauuuc

SEQ ID NO: 2653969 - RNA, 19 nt, Escherichia coli CFT073
gcguuaaauccugccaacg

SEQ ID NO: 2653970 - RNA, 15 nt, Escherichia coli CFT073
gcguuaacaauaaga

SEQ ID NO: 2653971 - RNA, 14 nt, Escherichia coli CFT073
gcguuaagcauucg

SEQ ID NO: 2653972 - RNA, 15 nt, Escherichia coli CFT073
gcguuaagcccaguu

SEQ ID NO: 2653973 - RNA, 18 nt, Escherichia coli CFT073
gcguuaauauaaacgaca

SEQ ID NO: 2653974 - RNA, 21 nt, Escherichia coli CFT073
gcguuaauauugugugccggg

SEQ ID NO: 2653975 - RNA, 19 nt, Escherichia coli CFT073
gcguuaaugauaucccugc

SEQ ID NO: 2653976 - RNA, 18 nt, Escherichia coli CFT073
gcguuaaugucgcgauca

SEQ ID NO: 2653977 - RNA, 20 nt, Escherichia coli CFT073
gcguuaauuuccucuucccg

SEQ ID NO: 2653978 - RNA, 23 nt, Escherichia coli CFT073
gcguuacccuuguggauaacgcc

SEQ ID NO: 2653979 - RNA, 16 nt, Escherichia coli CFT073
gcguuacgcagcuuuu

SEQ ID NO: 2653980 - RNA, 18 nt, Escherichia coli CFT073
gcguuagacgcguuuaca

SEQ ID NO: 2653981 - RNA, 17 nt, Escherichia coli CFT073
gcguuagcuuaauaaga

SEQ ID NO: 2653982 - RNA, 17 nt, Escherichia coli CFT073
gcguuauaaaacacauu

SEQ ID NO: 2653983 - RNA, 19 nt, Escherichia coli CFT073
gcguuauccggccaacaaa

SEQ ID NO: 2653984 - RNA, 21 nt, Escherichia coli CFT073
gcguuauccggccaacaaaaa

SEQ ID NO: 2653985 - RNA, 18 nt, Escherichia coli CFT073
gcguuauuuguugccgga

SEQ ID NO: 2653986 - RNA, 22 nt, Escherichia coli CFT073
gcguuauuuguugccggaugcg

SEQ ID NO: 2653987 - RNA, 20 nt, Escherichia coli CFT073
gcguucaaaacggcugguga

SEQ ID NO: 2653988 - RNA, 20 nt, Escherichia coli CFT073
gcguucaagccgcauccggc

SEQ ID NO: 2653989 - RNA, 16 nt, Escherichia coli CFT073
gcguucaaucuguccu

SEQ ID NO: 2653990 - RNA, 22 nt, Escherichia coli CFT073
gcguucacgccgcauccggcau

SEQ ID NO: 2653991 - RNA, 23 nt, Escherichia coli CFT073
gcguucacuguaguuauccgcaa

SEQ ID NO: 2653992 - RNA, 19 nt, Escherichia coli CFT073
gcguucagcaguucugcca

SEQ ID NO: 2653993 - RNA, 21 nt, Escherichia coli CFT073
gcguucaguuuauucugccgc

SEQ ID NO: 2653994 - RNA, 22 nt, Escherichia coli CFT073
gcguucauaaauacagagcacg

SEQ ID NO: 2653995 - RNA, 13 nt, Escherichia coli CFT073
gcguuccagcagc

SEQ ID NO: 2653996 - RNA, 21 nt, Escherichia coli CFT073
gcguuccagcagcuuaagcga

SEQ ID NO: 2653997 - RNA, 22 nt, Escherichia coli CFT073
gcguucccuuguugugccagac

SEQ ID NO: 2653998 - RNA, 22 nt, Escherichia coli CFT073
gcguuccggcggcacagccagc

SEQ ID NO: 2653999 - RNA, 19 nt, Escherichia coli CFT073
gcguuccugccgcgacugc

SEQ ID NO: 2654000 - RNA, 20 nt, Escherichia coli CFT073
gcguucgauagcgcgccagc

SEQ ID NO: 2654001 - RNA, 19 nt, Escherichia coli CFT073
gcguucgccagcgucaguu

SEQ ID NO: 2654002 - RNA, 21 nt, Escherichia coli CFT073
gcguucgcgccgcauccggca

SEQ ID NO: 2654003 - RNA, 22 nt, Escherichia coli CFT073
gcguucgguauuaauuugccag

SEQ ID NO: 2654004 - RNA, 19 nt, Escherichia coli CFT073
gcguucuguggcagggcag

SEQ ID NO: 2654005 - RNA, 15 nt, Escherichia coli CFT073
gcguucuuccaucac

SEQ ID NO: 2654006 - RNA, 18 nt, Escherichia coli CFT073
gcguugagaaacgccgga

SEQ ID NO: 2654007 - RNA, 22 nt, Escherichia coli CFT073
gcguugauuagcagagcguuua

SEQ ID NO: 2654008 - RNA, 15 nt, Escherichia coli CFT073
gcguugauugccgga

SEQ ID NO: 2654009 - RNA, 16 nt, Escherichia coli CFT073
gcguugauugccggau

SEQ ID NO: 2654010 - RNA, 20 nt, Escherichia coli CFT073
gcguugauugccggaugcgg

SEQ ID NO: 2654011 - RNA, 15 nt, Escherichia coli CFT073
gcguugauuggcgca

SEQ ID NO: 2654012 - RNA, 17 nt, Escherichia coli CFT073
gcguugauuggcgcagg

SEQ ID NO: 2654013 - RNA, 18 nt, Escherichia coli CFT073
gcguugauuggcgcaggu

SEQ ID NO: 2654014 - RNA, 20 nt, Escherichia coli CFT073
gcguugcaccaaguucuuca

SEQ ID NO: 2654015 - RNA, 17 nt, Escherichia coli CFT073
gcguugcacgugcuuau

SEQ ID NO: 2654016 - RNA, 21 nt, Escherichia coli CFT073
gcguugcagauggcauccagc

SEQ ID NO: 2654017 - RNA, 18 nt, Escherichia coli CFT073
gcguugcggaaaguuuac

SEQ ID NO: 2654018 - RNA, 21 nt, Escherichia coli CFT073
gcguuguaauuacgcagcgcg

SEQ ID NO: 2654019 - RNA, 21 nt, Escherichia coli CFT073
gcguugucauacgagucgccu

SEQ ID NO: 2654020 - RNA, 15 nt, Escherichia coli CFT073
gcuauaccgccaggc

SEQ ID NO: 2654021 - RNA, 16 nt, Escherichia coli CFT073
gcuauaccgccaggca

SEQ ID NO: 2654022 - RNA, 15 nt, Escherichia coli CFT073
gcuauacgagcuucg

SEQ ID NO: 2654023 - RNA, 18 nt, Escherichia coli CFT073
gcuauacgccucacagag

SEQ ID NO: 2654024 - RNA, 13 nt, Escherichia coli CFT073
gcuaucaggccac

SEQ ID NO: 2654025 - RNA, 14 nt, Escherichia coli CFT073
gcuaucgaaaucaa

SEQ ID NO: 2654026 - RNA, 22 nt, Escherichia coli CFT073
gcuaucgaaaucaaaguaccgg

SEQ ID NO: 2654027 - RNA, 15 nt, Escherichia coli CFT073
gcuaucuauugcuga

SEQ ID NO: 2654028 - RNA, 21 nt, Escherichia coli CFT073
gcuaucuauugcugaauggau

SEQ ID NO: 2654029 - RNA, 21 nt, Escherichia coli CFT073
gcuaugcuggaggagauauug

SEQ ID NO: 2654030 - RNA, 19 nt, Escherichia coli CFT073
gcuauuacgccagccuuuc

SEQ ID NO: 2654031 - RNA, 13 nt, Escherichia coli CFT073
gcuauucagcagu

SEQ ID NO: 2654032 - RNA, 15 nt, Escherichia coli CFT073
gcuauucccgcaaaa

SEQ ID NO: 2654033 - RNA, 22 nt, Escherichia coli CFT073
gcuauugcuuuagacagcuucg

SEQ ID NO: 2654034 - RNA, 13 nt, Escherichia coli CFT073
gcuauuuaccagc

SEQ ID NO: 2654035 - RNA, 18 nt, Escherichia coli CFT073
gcuauuuaccgcuacugc

SEQ ID NO: 2654036 - RNA, 15 nt, Escherichia coli CFT073
gcucaaacuggcuga

SEQ ID NO: 2654037 - RNA, 18 nt, Escherichia coli CFT073
gcucaaagacgcgguaaa

SEQ ID NO: 2654038 - RNA, 20 nt, Escherichia coli CFT073
gcucaaaggcauuaaaugca

SEQ ID NO: 2654039 - RNA, 13 nt, Escherichia coli CFT073
gcucaacaauaaa

SEQ ID NO: 2654040 - RNA, 17 nt, Escherichia coli CFT073
gcucaacaauaaacugg

SEQ ID NO: 2654041 - RNA, 22 nt, Escherichia coli CFT073
gcucaacaauaaacuggcugug

SEQ ID NO: 2654042 - RNA, 23 nt, Escherichia coli CFT073
gcucaacaguaaggccugguuca

SEQ ID NO: 2654043 - RNA, 13 nt, Escherichia coli CFT073
gcucaacaucgcg

SEQ ID NO: 2654044 - RNA, 12 nt, Escherichia coli CFT073
gcucaaccagau

SEQ ID NO: 2654045 - RNA, 13 nt, Escherichia coli CFT073
gcucaaccuucuu

SEQ ID NO: 2654046 - RNA, 21 nt, Escherichia coli CFT073
gcucaagcaaucaagcccugg

SEQ ID NO: 2654047 - RNA, 17 nt, Escherichia coli CFT073
gcucaagcugaccgaua

SEQ ID NO: 2654048 - RNA, 23 nt, Escherichia coli CFT073
gcucaagcugaccgauaaccugc

SEQ ID NO: 2654049 - RNA, 15 nt, Escherichia coli CFT073
gcucaauauauuaaa

SEQ ID NO: 2654050 - RNA, 14 nt, Escherichia coli CFT073
gcucaauauauucu

SEQ ID NO: 2654051 - RNA, 19 nt, Escherichia coli CFT073
gcucaauccuacauccagu

SEQ ID NO: 2654052 - RNA, 16 nt, Escherichia coli CFT073
gcucaaugaaacgcaa

SEQ ID NO: 2654053 - RNA, 21 nt, Escherichia coli CFT073
gcucacaucaugcgucaccag

SEQ ID NO: 2654054 - RNA, 20 nt, Escherichia coli CFT073
gcucacccaucgauacccag

SEQ ID NO: 2654055 - RNA, 15 nt, Escherichia coli CFT073
gcucacccccaucag

SEQ ID NO: 2654056 - RNA, 14 nt, Escherichia coli CFT073
gcucaccugacugu

SEQ ID NO: 2654057 - RNA, 14 nt, Escherichia coli CFT073
gcucacgaugccgc

SEQ ID NO: 2654058 - RNA, 18 nt, Escherichia coli CFT073
gcucacgcagcggcggca

SEQ ID NO: 2654059 - RNA, 13 nt, Escherichia coli CFT073
gcucacgcaucaa

SEQ ID NO: 2654060 - RNA, 14 nt, Escherichia coli CFT073
gcucacgcaucaac

SEQ ID NO: 2654061 - RNA, 19 nt, Escherichia coli CFT073
gcucacgcgccagcuucac

SEQ ID NO: 2654062 - RNA, 21 nt, Escherichia coli CFT073
gcucacgucaccgcagcaucg

SEQ ID NO: 2654063 - RNA, 20 nt, Escherichia coli CFT073
gcucacugcacgaugccuca

SEQ ID NO: 2654064 - RNA, 23 nt, Escherichia coli CFT073
gcucacuucacgcugccagccgu

SEQ ID NO: 2654065 - RNA, 21 nt, Escherichia coli CFT073
gcucacuucgauccagugauu

SEQ ID NO: 2654066 - RNA, 22 nt, Escherichia coli CFT073
gcucaggcgcacgccaacaaaa

SEQ ID NO: 2654067 - RNA, 16 nt, Escherichia coli CFT073
gcucaggcuggcugac

SEQ ID NO: 2654068 - RNA, 12 nt, Escherichia coli CFT073
gcucaggugacg

SEQ ID NO: 2654069 - RNA, 21 nt, Escherichia coli CFT073
gcucagucggcgcuuuugcau

SEQ ID NO: 2654070 - RNA, 12 nt, Escherichia coli CFT073
gcucaguuggua

SEQ ID NO: 2654071 - RNA, 14 nt, Escherichia coli CFT073
gcucaguugguaga

SEQ ID NO: 2654072 - RNA, 18 nt, Escherichia coli CFT073
gcucaguuuauagaacgg

SEQ ID NO: 2654073 - RNA, 16 nt, Escherichia coli CFT073
gcucauaaaaucacgc

SEQ ID NO: 2654074 - RNA, 15 nt, Escherichia coli CFT073
gcucauagcggcugc

SEQ ID NO: 2654075 - RNA, 20 nt, Escherichia coli CFT073
gcucauaugcagcauccagc

SEQ ID NO: 2654076 - RNA, 22 nt, Escherichia coli CFT073
gcucauaugcagcauccagcug

SEQ ID NO: 2654077 - RNA, 18 nt, Escherichia coli CFT073
gcucaucaccgcaaaguc

SEQ ID NO: 2654078 - RNA, 20 nt, Escherichia coli CFT073
gcucaucaccgcaaagucgg

SEQ ID NO: 2654079 - RNA, 22 nt, Escherichia coli CFT073
gcucaucagcggguuuucuacu

SEQ ID NO: 2654080 - RNA, 18 nt, Escherichia coli CFT073
gcucaucaggccuggcac

SEQ ID NO: 2654081 - RNA, 23 nt, Escherichia coli CFT073
gcucauccuguggcuuuuuugua

SEQ ID NO: 2654082 - RNA, 21 nt, Escherichia coli CFT073
gcucaucggcauacagcgaca

SEQ ID NO: 2654083 - RNA, 17 nt, Escherichia coli CFT073
gcucaucguuacgccca

SEQ ID NO: 2654084 - RNA, 13 nt, Escherichia coli CFT073
gcucaucugacgu

SEQ ID NO: 2654085 - RNA, 18 nt, Escherichia coli CFT073
gcucaugcaacacaagcc

SEQ ID NO: 2654086 - RNA, 22 nt, Escherichia coli CFT073
gcucauguagccgcuuuuucug

SEQ ID NO: 2654087 - RNA, 18 nt, Escherichia coli CFT073
gcucauuauucaaucggg

SEQ ID NO: 2654088 - RNA, 15 nt, Escherichia coli CFT073
gcucauuuucuuuca

SEQ ID NO: 2654089 - RNA, 23 nt, Escherichia coli CFT073
gcuccaaucguucaaccacuucg

SEQ ID NO: 2654090 - RNA, 23 nt, Escherichia coli CFT073
gcuccacaagaaugccugccagc

SEQ ID NO: 2654091 - RNA, 18 nt, Escherichia coli CFT073
gcuccacacgcucuucca

SEQ ID NO: 2654092 - RNA, 19 nt, Escherichia coli CFT073
gcuccagaauuccgugcca

SEQ ID NO: 2654093 - RNA, 20 nt, Escherichia coli CFT073
gcuccagaguaacuucacca

SEQ ID NO: 2654094 - RNA, 21 nt, Escherichia coli CFT073
gcuccagauaacaaucaucaa

SEQ ID NO: 2654095 - RNA, 16 nt, Escherichia coli CFT073
gcuccagauauugcuc

SEQ ID NO: 2654096 - RNA, 20 nt, Escherichia coli CFT073
gcuccagcaggaagcggcuc

SEQ ID NO: 2654097 - RNA, 17 nt, Escherichia coli CFT073
gcuccagcaucuccugc

SEQ ID NO: 2654098 - RNA, 18 nt, Escherichia coli CFT073
gcuccagcaucuccugca

SEQ ID NO: 2654099 - RNA, 17 nt, Escherichia coli CFT073
gcuccagccgcuccccu

SEQ ID NO: 2654100 - RNA, 16 nt, Escherichia coli CFT073
gcuccagcguaccugc

SEQ ID NO: 2654101 - RNA, 22 nt, Escherichia coli CFT073
gcuccaguaccugcaaaccgua

SEQ ID NO: 2654102 - RNA, 15 nt, Escherichia coli CFT073
gcuccagugccuggc

SEQ ID NO: 2654103 - RNA, 20 nt, Escherichia coli CFT073
gcuccaucagauucagcagc

SEQ ID NO: 2654104 - RNA, 18 nt, Escherichia coli CFT073
gcuccaucauccgcggau

SEQ ID NO: 2654105 - RNA, 16 nt, Escherichia coli CFT073
gcuccaucgcaugcca

SEQ ID NO: 2654106 - RNA, 18 nt, Escherichia coli CFT073
gcucccaaaccgcccagc

SEQ ID NO: 2654107 - RNA, 24 nt, Escherichia coli CFT073
gcucccauaaugccccagcgcacu

SEQ ID NO: 2654108 - RNA, 19 nt, Escherichia coli CFT073
gcucccccucuuccggaac

SEQ ID NO: 2654109 - RNA, 17 nt, Escherichia coli CFT073
gcuccccucagggcggc

SEQ ID NO: 2654110 - RNA, 20 nt, Escherichia coli CFT073
gcucccgcaggagcgccgaa

SEQ ID NO: 2654111 - RNA, 11 nt, Escherichia coli CFT073
gcuccgccagc

SEQ ID NO: 2654112 - RNA, 17 nt, Escherichia coli CFT073
gcuccggaagaugaaaa

SEQ ID NO: 2654113 - RNA, 20 nt, Escherichia coli CFT073
gcuccggcagcagcacccgc

SEQ ID NO: 2654114 - RNA, 22 nt, Escherichia coli CFT073
gcuccgggcuaacacccgucgu

SEQ ID NO: 2654115 - RNA, 19 nt, Escherichia coli CFT073
gcuccgggcugguuuucag

SEQ ID NO: 2654116 - RNA, 20 nt, Escherichia coli CFT073
gcuccgggugugacaacaac

SEQ ID NO: 2654117 - RNA, 17 nt, Escherichia coli CFT073
gcuccgguacucaucag

SEQ ID NO: 2654118 - RNA, 22 nt, Escherichia coli CFT073
gcuccgguacucaucagagaaa

SEQ ID NO: 2654119 - RNA, 18 nt, Escherichia coli CFT073
gcuccguccagccaccgc

SEQ ID NO: 2654120 - RNA, 20 nt, Escherichia coli CFT073
gcuccugcagaaaauccagc

SEQ ID NO: 2654121 - RNA, 15 nt, Escherichia coli CFT073
gcuccuucucugagc

SEQ ID NO: 2654122 - RNA, 21 nt, Escherichia coli CFT073
gcuccuuuaaucaacguucgg

SEQ ID NO: 2654123 - RNA, 18 nt, Escherichia coli CFT073
gcucgaacagcugguuga

SEQ ID NO: 2654124 - RNA, 23 nt, Escherichia coli CFT073
gcucgaagaguuccagcgccgcg

SEQ ID NO: 2654125 - RNA, 16 nt, Escherichia coli CFT073
gcucgacaccaaacag

SEQ ID NO: 2654126 - RNA, 21 nt, Escherichia coli CFT073
gcucgcagaaauaccccgcca

SEQ ID NO: 2654127 - RNA, 18 nt, Escherichia coli CFT073
gcugcuguagcaguucca

SEQ ID NO: 2654128 - RNA, 21 nt, Escherichia coli CFT073
gcugcuuacauaguucuucaa

SEQ ID NO: 2654129 - RNA, 18 nt, Escherichia coli CFT073
gcugcuuuuucguuacac

SEQ ID NO: 2654130 - RNA, 22 nt, Escherichia coli CFT073
gcuggaaagcucuucaugcagc

SEQ ID NO: 2654131 - RNA, 14 nt, Escherichia coli CFT073
gcuggaagaccgua

SEQ ID NO: 2654132 - RNA, 14 nt, Escherichia coli CFT073
gcuggaaggcgcgu

SEQ ID NO: 2654133 - RNA, 16 nt, Escherichia coli CFT073
gcuggaaucaucaagc

SEQ ID NO: 2654134 - RNA, 19 nt, Escherichia coli CFT073
gcuggacaucgucugcggu

SEQ ID NO: 2654135 - RNA, 13 nt, Escherichia coli CFT073
gcuggacguggug

SEQ ID NO: 2654136 - RNA, 19 nt, Escherichia coli CFT073
gcuggacugagcaaucugg

SEQ ID NO: 2654137 - RNA, 19 nt, Escherichia coli CFT073
gcuggauagggggguaaca

SEQ ID NO: 2654138 - RNA, 13 nt, Escherichia coli CFT073
gcuggaucccaga

SEQ ID NO: 2654139 - RNA, 23 nt, Escherichia coli CFT073
gcuggauggcgcaaugccaucca

SEQ ID NO: 2654140 - RNA, 17 nt, Escherichia coli CFT073
gcuggcaaacaugcagc

SEQ ID NO: 2654141 - RNA, 22 nt, Escherichia coli CFT073
gcuggcaagauggcgaacauaa

SEQ ID NO: 2654142 - RNA, 14 nt, Escherichia coli CFT073
gcuggcaaguucgu

SEQ ID NO: 2654143 - RNA, 23 nt, Escherichia coli CFT073
gcuggcaccgugaaagagaucaa

SEQ ID NO: 2654144 - RNA, 20 nt, Escherichia coli CFT073
gcuggcagaugcgucuucug

SEQ ID NO: 2654145 - RNA, 21 nt, Escherichia coli CFT073
gcuggcagccagggcaccagu

SEQ ID NO: 2654146 - RNA, 14 nt, Escherichia coli CFT073
gcuggcaggccgcg

SEQ ID NO: 2654147 - RNA, 14 nt, Escherichia coli CFT073
gcuggcaggccugc

SEQ ID NO: 2654148 - RNA, 13 nt, Escherichia coli CFT073
gcuggcaucacca

SEQ ID NO: 2654149 - RNA, 14 nt, Escherichia coli CFT073
gcuggcaucaccaa

SEQ ID NO: 2654150 - RNA, 17 nt, Escherichia coli CFT073
gcuggcaucggcaaaau

SEQ ID NO: 2654151 - RNA, 22 nt, Escherichia coli CFT073
gcuggcauuacaagaaucaugc

SEQ ID NO: 2654152 - RNA, 13 nt, Escherichia coli CFT073
gcuggcauuccgu

SEQ ID NO: 2654153 - RNA, 14 nt, Escherichia coli CFT073
gcuggccaucaccu

SEQ ID NO: 2654154 - RNA, 21 nt, Escherichia coli CFT073
gcuggccaugauuaccagcau

SEQ ID NO: 2654155 - RNA, 22 nt, Escherichia coli CFT073
gcuggccaugauuaccagcauc

SEQ ID NO: 2654156 - RNA, 18 nt, Escherichia coli CFT073
gcuggccgguuugccaua

SEQ ID NO: 2654157 - RNA, 16 nt, Escherichia coli CFT073
gcuggccuccagcacu

SEQ ID NO: 2654158 - RNA, 15 nt, Escherichia coli CFT073
gcuggcgagugcauc

SEQ ID NO: 2654159 - RNA, 20 nt, Escherichia coli CFT073
gcuggcgaucguccagcugc

SEQ ID NO: 2654160 - RNA, 15 nt, Escherichia coli CFT073
gcuggcgcagcaucu

SEQ ID NO: 2654161 - RNA, 12 nt, Escherichia coli CFT073
gcuggcgcagcg

SEQ ID NO: 2654162 - RNA, 13 nt, Escherichia coli CFT073
gcuggcgcauacc

SEQ ID NO: 2654163 - RNA, 18 nt, Escherichia coli CFT073
gcuggcgcauuaacucac

SEQ ID NO: 2654164 - RNA, 21 nt, Escherichia coli CFT073
gcuggcgcgucuuaucaggcc

SEQ ID NO: 2654165 - RNA, 13 nt, Escherichia coli CFT073
gcuggcggcuggc

SEQ ID NO: 2654166 - RNA, 16 nt, Escherichia coli CFT073
gcuggcggggccgcgu

SEQ ID NO: 2654167 - RNA, 13 nt, Escherichia coli CFT073
gcuggcguagcca

SEQ ID NO: 2654168 - RNA, 11 nt, Escherichia coli CFT073
gcuggcugacc

SEQ ID NO: 2654169 - RNA, 18 nt, Escherichia coli CFT073
gcuggcuucuaucuucau

SEQ ID NO: 2654170 - RNA, 17 nt, Escherichia coli CFT073
gcugggaaaucaccacc

SEQ ID NO: 2654171 - RNA, 21 nt, Escherichia coli CFT073
gcugggaaaucaccaccagca

SEQ ID NO: 2654172 - RNA, 20 nt, Escherichia coli CFT073
gcugggaucugauuuucuuc

SEQ ID NO: 2654173 - RNA, 21 nt, Escherichia coli CFT073
gcugggccaucaggcgacacu

SEQ ID NO: 2654174 - RNA, 15 nt, Escherichia coli CFT073
gcugggcgcguucgg

SEQ ID NO: 2654175 - RNA, 22 nt, Escherichia coli CFT073
gcugggcgcguucggcggaugc

SEQ ID NO: 2654176 - RNA, 19 nt, Escherichia coli CFT073
gcugggcuucaccaccaga

SEQ ID NO: 2654177 - RNA, 17 nt, Escherichia coli CFT073
gcuggggccaucgccgc

SEQ ID NO: 2654178 - RNA, 19 nt, Escherichia coli CFT073
gcuggguaaagacaucgcc

SEQ ID NO: 2654179 - RNA, 22 nt, Escherichia coli CFT073
gcuggguuucgccugccagaug

SEQ ID NO: 2654180 - RNA, 12 nt, Escherichia coli CFT073
gcugguaaacga

SEQ ID NO: 2654181 - RNA, 18 nt, Escherichia coli CFT073
gcugguaaugcucaagca

SEQ ID NO: 2654182 - RNA, 22 nt, Escherichia coli CFT073
gcuggucagcaucgucaacgcc

SEQ ID NO: 2654183 - RNA, 22 nt, Escherichia coli CFT073
gcuggucaggccaaacuacgcu

SEQ ID NO: 2654184 - RNA, 18 nt, Escherichia coli CFT073
gcuggugauucagggcag

SEQ ID NO: 2654185 - RNA, 15 nt, Escherichia coli CFT073
gcuggugcaggcgau

SEQ ID NO: 2654186 - RNA, 18 nt, Escherichia coli CFT073
gcugguggaacagcugca

SEQ ID NO: 2654187 - RNA, 19 nt, Escherichia coli CFT073
gcugguggcaagaccugcc

SEQ ID NO: 2654188 - RNA, 18 nt, Escherichia coli CFT073
gcugguggcaggcaaaaa

SEQ ID NO: 2654189 - RNA, 18 nt, Escherichia coli CFT073
gcugguguaacugcgcca

SEQ ID NO: 2654190 - RNA, 22 nt, Escherichia coli CFT073
gcugguugcgucuuaucaggcc

SEQ ID NO: 2654191 - RNA, 14 nt, Escherichia coli CFT073
gcugguuuucagcg

SEQ ID NO: 2654192 - RNA, 23 nt, Escherichia coli CFT073
gcugguuuucagcgaaacagcug

SEQ ID NO: 2654193 - RNA, 17 nt, Escherichia coli CFT073
gcuguaacgaucaauuu

SEQ ID NO: 2654194 - RNA, 20 nt, Escherichia coli CFT073
gcuguaacguuuggcacgcc

SEQ ID NO: 2654195 - RNA, 19 nt, Escherichia coli CFT073
gcuguaagccgccgccauc

SEQ ID NO: 2654196 - RNA, 16 nt, Escherichia coli CFT073
gcuguaauuaccagcg

SEQ ID NO: 2654197 - RNA, 20 nt, Escherichia coli CFT073
gcuguaauuaccagcgcagg

SEQ ID NO: 2654198 - RNA, 22 nt, Escherichia coli CFT073
gcuguaauuaccagcgcaggaa

SEQ ID NO: 2654199 - RNA, 14 nt, Escherichia coli CFT073
gcuguaauuucaca

SEQ ID NO: 2654200 - RNA, 14 nt, Escherichia coli CFT073
gcuguacagcagua

SEQ ID NO: 2654201 - RNA, 24 nt, Escherichia coli CFT073
gcuguaccacgguucgcuggcaag

SEQ ID NO: 2654202 - RNA, 14 nt, Escherichia coli CFT073
gcuguaccagcaac

SEQ ID NO: 2654203 - RNA, 13 nt, Escherichia coli CFT073
gcuguacucacca

SEQ ID NO: 2654204 - RNA, 17 nt, Escherichia coli CFT073
gcuguacucaccaacgc

SEQ ID NO: 2654205 - RNA, 15 nt, Escherichia coli CFT073
gcuguagaggcguuc

SEQ ID NO: 2654206 - RNA, 22 nt, Escherichia coli CFT073
gcuguaguucagaauugccgcc

SEQ ID NO: 2654207 - RNA, 18 nt, Escherichia coli CFT073
gcuguauucaagccauga

SEQ ID NO: 2654208 - RNA, 14 nt, Escherichia coli CFT073
gcuguauuuuucca

SEQ ID NO: 2654209 - RNA, 14 nt, Escherichia coli CFT073
gcugucaauugaga

SEQ ID NO: 2654210 - RNA, 20 nt, Escherichia coli CFT073
gcugucaccaaucagguaag

SEQ ID NO: 2654211 - RNA, 14 nt, Escherichia coli CFT073
gcugucauccagca

SEQ ID NO: 2654212 - RNA, 16 nt, Escherichia coli CFT073
gcuguccggcaccauu

SEQ ID NO: 2654213 - RNA, 19 nt, Escherichia coli CFT073
gcuguccggcgcacuggug

SEQ ID NO: 2654214 - RNA, 14 nt, Escherichia coli CFT073
gcugucgcgcagca

SEQ ID NO: 2654215 - RNA, 18 nt, Escherichia coli CFT073
gcugucggaauaagggau

SEQ ID NO: 2654216 - RNA, 18 nt, Escherichia coli CFT073
gcugugaagugcugcaac

SEQ ID NO: 2654217 - RNA, 15 nt, Escherichia coli CFT073
gcugugacauccaga

SEQ ID NO: 2654218 - RNA, 21 nt, Escherichia coli CFT073
gcugugacauccagaucacgc

SEQ ID NO: 2654219 - RNA, 21 nt, Escherichia coli CFT073
gcugugagcaggcguaccuuu

SEQ ID NO: 2654220 - RNA, 15 nt, Escherichia coli CFT073
gcugugauuaagcag

SEQ ID NO: 2654221 - RNA, 17 nt, Escherichia coli CFT073
gcugugccagcuccaca

SEQ ID NO: 2654222 - RNA, 14 nt, Escherichia coli CFT073
gcugugccuccugc

SEQ ID NO: 2654223 - RNA, 22 nt, Escherichia coli CFT073
gcugugccuccugcggcuucaa

SEQ ID NO: 2654224 - RNA, 15 nt, Escherichia coli CFT073
gcugugcgauagcaa

SEQ ID NO: 2654225 - RNA, 23 nt, Escherichia coli CFT073
gcugugcuccuucucugagcugg

SEQ ID NO: 2654226 - RNA, 18 nt, Escherichia coli CFT073
gcuguggcagucacuucc

SEQ ID NO: 2654227 - RNA, 19 nt, Escherichia coli CFT073
gcuguuaaacgccgguucc

SEQ ID NO: 2654228 - RNA, 18 nt, Escherichia coli CFT073
gcuguuccggcacaccuu

SEQ ID NO: 2654229 - RNA, 17 nt, Escherichia coli CFT073
gcuguuccggcuuuguu

SEQ ID NO: 2654230 - RNA, 14 nt, Escherichia coli CFT073
gcuguugccagcag

SEQ ID NO: 2654231 - RNA, 18 nt, Escherichia coli CFT073
gcuguugcuuccaccauc

SEQ ID NO: 2654232 - RNA, 15 nt, Escherichia coli CFT073
gcuguuggugccaga

SEQ ID NO: 2654233 - RNA, 16 nt, Escherichia coli CFT073
gcuguuguuccagcuu

SEQ ID NO: 2654234 - RNA, 18 nt, Escherichia coli CFT073
gcuguuguuccagcuucc

SEQ ID NO: 2654235 - RNA, 20 nt, Escherichia coli CFT073
gcuucgcggacuucuggcag

SEQ ID NO: 2654236 - RNA, 19 nt, Escherichia coli CFT073
gcuucgcuggcagcugcua

SEQ ID NO: 2654237 - RNA, 14 nt, Escherichia coli CFT073
gcuucgcuucccaa

SEQ ID NO: 2654238 - RNA, 16 nt, Escherichia coli CFT073
gcuucggaaaacaaca

SEQ ID NO: 2654239 - RNA, 14 nt, Escherichia coli CFT073
gcuucggucgcccc

SEQ ID NO: 2654240 - RNA, 23 nt, Escherichia coli CFT073
gcuucgguuuuguugccgcccgu

SEQ ID NO: 2654241 - RNA, 16 nt, Escherichia coli CFT073
gcuucgucaccuguuc

SEQ ID NO: 2654242 - RNA, 15 nt, Escherichia coli CFT073
gcuucgucgccagcu

SEQ ID NO: 2654243 - RNA, 14 nt, Escherichia coli CFT073
gcuucgugcuuaau

SEQ ID NO: 2654244 - RNA, 16 nt, Escherichia coli CFT073
gcuucgugcuuaauca

SEQ ID NO: 2654245 - RNA, 21 nt, Escherichia coli CFT073
gcuucguucaucucgaauacg

SEQ ID NO: 2654246 - RNA, 17 nt, Escherichia coli CFT073
gcuucguuuuccgccac

SEQ ID NO: 2654247 - RNA, 14 nt, Escherichia coli CFT073
gcuucguuuugaca

SEQ ID NO: 2654248 - RNA, 14 nt, Escherichia coli CFT073
gcuucuaccgucug

SEQ ID NO: 2654249 - RNA, 19 nt, Escherichia coli CFT073
gcuucuaccuuauccagca

SEQ ID NO: 2654250 - RNA, 21 nt, Escherichia coli CFT073
gcuucuaccuuauccagcaga

SEQ ID NO: 2654251 - RNA, 21 nt, Escherichia coli CFT073
gcuucuacgccaucaguuuca

SEQ ID NO: 2654252 - RNA, 14 nt, Escherichia coli CFT073
gcuucuaucgcauu

SEQ ID NO: 2654253 - RNA, 18 nt, Escherichia coli CFT073
gcuucucgugaaauucac

SEQ ID NO: 2654254 - RNA, 16 nt, Escherichia coli CFT073
gcuucucuuccaggua

SEQ ID NO: 2654255 - RNA, 22 nt, Escherichia coli CFT073
gcuucucuugcuggauuucccu

SEQ ID NO: 2654256 - RNA, 17 nt, Escherichia coli CFT073
gcuucugacauagccac

SEQ ID NO: 2654257 - RNA, 21 nt, Escherichia coli CFT073
gcuucuguuuucgcaccugcc

SEQ ID NO: 2654258 - RNA, 22 nt, Escherichia coli CFT073
gcuucuguuuucgcaccugcca

SEQ ID NO: 2654259 - RNA, 20 nt, Escherichia coli CFT073
gcuucuuacuauauaaaccu

SEQ ID NO: 2654260 - RNA, 13 nt, Escherichia coli CFT073
gcuucuuccagcu

SEQ ID NO: 2654261 - RNA, 14 nt, Escherichia coli CFT073
gcuucuuccagcuu

SEQ ID NO: 2654262 - RNA, 14 nt, Escherichia coli CFT073
gcuucuucuccagc

SEQ ID NO: 2654263 - RNA, 16 nt, Escherichia coli CFT073
gcuucuucuuucgcca

SEQ ID NO: 2654264 - RNA, 22 nt, Escherichia coli CFT073
gcuucuuucucaaucugcuugc

SEQ ID NO: 2654265 - RNA, 16 nt, Escherichia coli CFT073
gcuugaaaccgguuug

SEQ ID NO: 2654266 - RNA, 17 nt, Escherichia coli CFT073
gcuugaaggguuuaaua

SEQ ID NO: 2654267 - RNA, 21 nt, Escherichia coli CFT073
gcuugaauuuaucuucaccaa

SEQ ID NO: 2654268 - RNA, 17 nt, Escherichia coli CFT073
gcuugagccguagguga

SEQ ID NO: 2654269 - RNA, 13 nt, Escherichia coli CFT073
gcuugauuucagg

SEQ ID NO: 2654270 - RNA, 19 nt, Escherichia coli CFT073
gcuugccagauggcaucca

SEQ ID NO: 2654271 - RNA, 12 nt, Escherichia coli CFT073
gcuugccagcag

SEQ ID NO: 2654272 - RNA, 18 nt, Escherichia coli CFT073
gcuugccgcgucuuauca

SEQ ID NO: 2654273 - RNA, 17 nt, Escherichia coli CFT073
gcuugcgauccugcaga

SEQ ID NO: 2654274 - RNA, 22 nt, Escherichia coli CFT073
gcuugcgcaucgggcgauucga

SEQ ID NO: 2654275 - RNA, 13 nt, Escherichia coli CFT073
gcuugcugaugca

SEQ ID NO: 2654276 - RNA, 15 nt, Escherichia coli CFT073
gcuugcuuuccagcu

SEQ ID NO: 2654277 - RNA, 16 nt, Escherichia coli CFT073
gcuugcuuuccagcuu

SEQ ID NO: 2654278 - RNA, 12 nt, Escherichia coli CFT073
gcuuggcagagc

SEQ ID NO: 2654279 - RNA, 14 nt, Escherichia coli CFT073
gcuuggcugcaaau

SEQ ID NO: 2654280 - RNA, 13 nt, Escherichia coli CFT073
gcuuguaaaacag

SEQ ID NO: 2654281 - RNA, 16 nt, Escherichia coli CFT073
gcuuguaaaacagcca

SEQ ID NO: 2654282 - RNA, 22 nt, Escherichia coli CFT073
gcuuguaaaugaacucaacgcc

SEQ ID NO: 2654283 - RNA, 18 nt, Escherichia coli CFT073
gcuugucagacggugcca

SEQ ID NO: 2654284 - RNA, 14 nt, Escherichia coli CFT073
gcuugugcaccagc

SEQ ID NO: 2654285 - RNA, 16 nt, Escherichia coli CFT073
gcuugugcaccagcug

SEQ ID NO: 2654286 - RNA, 17 nt, Escherichia coli CFT073
gcuugugcaccagcugg

SEQ ID NO: 2654287 - RNA, 16 nt, Escherichia coli CFT073
gcuugugccaccagca

SEQ ID NO: 2654288 - RNA, 16 nt, Escherichia coli CFT073
gcuuguugauucugau

SEQ ID NO: 2654289 - RNA, 14 nt, Escherichia coli CFT073
gcuuuaaagcaggc

SEQ ID NO: 2654290 - RNA, 23 nt, Escherichia coli CFT073
gcuuuaauuucaugcucaccaau

SEQ ID NO: 2654291 - RNA, 19 nt, Escherichia coli CFT073
gcuuuaccaccgucaauaa

SEQ ID NO: 2654292 - RNA, 22 nt, Escherichia coli CFT073
gcuuuaccaccgucaauaaaaa

SEQ ID NO: 2654293 - RNA, 19 nt, Escherichia coli CFT073
gcuuuaccgcugcgccaua

SEQ ID NO: 2654294 - RNA, 15 nt, Escherichia coli CFT073
gcuuuauacaaauga

SEQ ID NO: 2654295 - RNA, 22 nt, Escherichia coli CFT073
gcuuuauccugcccgcuccagc

SEQ ID NO: 2654296 - RNA, 20 nt, Escherichia coli CFT073
gcuuuaucgacuaacuucug

SEQ ID NO: 2654297 - RNA, 23 nt, Escherichia coli CFT073
gcuuuaucuguacuuaaaacuca

SEQ ID NO: 2654298 - RNA, 18 nt, Escherichia coli CFT073
gcuuuauguaauccugua

SEQ ID NO: 2654299 - RNA, 22 nt, Escherichia coli CFT073
gcuuucaacgcgcuaauuucag

SEQ ID NO: 2654300 - RNA, 15 nt, Escherichia coli CFT073
gcuuucaccaauguu

SEQ ID NO: 2654301 - RNA, 15 nt, Escherichia coli CFT073
gcuuucacucugaaa

SEQ ID NO: 2654302 - RNA, 15 nt, Escherichia coli CFT073
gcuuucagcacgaca

SEQ ID NO: 2654303 - RNA, 19 nt, Escherichia coli CFT073
gcuuucagcacuuaucucu

SEQ ID NO: 2654304 - RNA, 17 nt, Escherichia coli CFT073
gcuuucauauuccagcc

SEQ ID NO: 2654305 - RNA, 21 nt, Escherichia coli CFT073
gcuuucaucacuugauccaua

SEQ ID NO: 2654306 - RNA, 14 nt, Escherichia coli CFT073
gcuuucauucagaa

SEQ ID NO: 2654307 - RNA, 20 nt, Escherichia coli CFT073
gcuuucauuuucggcaguga

SEQ ID NO: 2654308 - RNA, 17 nt, Escherichia coli CFT073
gcuuuccagcuguacca

SEQ ID NO: 2654309 - RNA, 16 nt, Escherichia coli CFT073
gcuuucgagcacgacu

SEQ ID NO: 2654310 - RNA, 21 nt, Escherichia coli CFT073
gcuuucgauaugaacuugcuc

SEQ ID NO: 2654311 - RNA, 21 nt, Escherichia coli CFT073
gcuuucgcaauaaucaucucu

SEQ ID NO: 2654312 - RNA, 16 nt, Escherichia coli CFT073
gcuuucgcuuucucuu

SEQ ID NO: 2654313 - RNA, 17 nt, Escherichia coli CFT073
gcuuucgucgagaaugu

SEQ ID NO: 2654314 - RNA, 22 nt, Escherichia coli CFT073
gcuuucgucgagaauguagaua

SEQ ID NO: 2654315 - RNA, 11 nt, Escherichia coli CFT073
gcuuucucaaa

SEQ ID NO: 2654316 - RNA, 14 nt, Escherichia coli CFT073
gcuuucucaacaaa

SEQ ID NO: 2654317 - RNA, 19 nt, Escherichia coli CFT073
gcuuucucuuccagcagcg

SEQ ID NO: 2654318 - RNA, 18 nt, Escherichia coli CFT073
gcuuucugcaaccagaaa

SEQ ID NO: 2654319 - RNA, 13 nt, Escherichia coli CFT073
gcuuucuucagcu

SEQ ID NO: 2654320 - RNA, 23 nt, Escherichia coli CFT073
gcuuucuucgcagcaaaucucac

SEQ ID NO: 2654321 - RNA, 15 nt, Escherichia coli CFT073
gcuuugauauucauu

SEQ ID NO: 2654322 - RNA, 15 nt, Escherichia coli CFT073
gcuuugauccgccag

SEQ ID NO: 2654323 - RNA, 13 nt, Escherichia coli CFT073
gcuuugcccggca

SEQ ID NO: 2654324 - RNA, 18 nt, Escherichia coli CFT073
gcuuugccuccgcaacau

SEQ ID NO: 2654325 - RNA, 17 nt, Escherichia coli CFT073
gcuuugcugccuuccuc

SEQ ID NO: 2654326 - RNA, 15 nt, Escherichia coli CFT073
gcuuugcugugaagc

SEQ ID NO: 2654327 - RNA, 12 nt, Escherichia coli CFT073
gcuuuggcaaau

SEQ ID NO: 2654328 - RNA, 20 nt, Escherichia coli CFT073
gcuuuggcaaauggcgcuaa

SEQ ID NO: 2654329 - RNA, 21 nt, Escherichia coli CFT073
gcuuuggcggccuucuuccag

SEQ ID NO: 2654330 - RNA, 18 nt, Escherichia coli CFT073
gcuuuggugccagauuua

SEQ ID NO: 2654331 - RNA, 20 nt, Escherichia coli CFT073
gcuuuguccagugcaacuuu

SEQ ID NO: 2654332 - RNA, 21 nt, Escherichia coli CFT073
gcuuuguuacccccauccacg

SEQ ID NO: 2654333 - RNA, 18 nt, Escherichia coli CFT073
gcuuuuaauucacuucug

SEQ ID NO: 2654334 - RNA, 12 nt, Escherichia coli CFT073
gcuuuuacaucg

SEQ ID NO: 2654335 - RNA, 13 nt, Escherichia coli CFT073
gcuuuuauucaug

SEQ ID NO: 2654336 - RNA, 19 nt, Escherichia coli CFT073
gcuuuuauucauguugauu

SEQ ID NO: 2654337 - RNA, 22 nt, Escherichia coli CFT073
gcuuuugcaaacaacgcuucaa

SEQ ID NO: 2654338 - RNA, 16 nt, Escherichia coli CFT073
gcuuuuggaaaucacg

SEQ ID NO: 2654339 - RNA, 13 nt, Escherichia coli CFT073
gcuuuuggcgcgu

SEQ ID NO: 2654340 - RNA, 17 nt, Escherichia coli CFT073
gcuuuuguggucaccau

SEQ ID NO: 2654341 - RNA, 18 nt, Escherichia coli CFT073
gcuuuuguggucaccaug

SEQ ID NO: 2654342 - RNA, 21 nt, Escherichia coli CFT073
gcuuuuucagcguuuucuuca

SEQ ID NO: 2654343 - RNA, 22 nt, Escherichia coli CFT073
ggacacuguaccggcaaaauca

SEQ ID NO: 2654344 - RNA, 22 nt, Escherichia coli CFT073
ggacauaaagcccgcuucaaac

SEQ ID NO: 2654345 - RNA, 14 nt, Escherichia coli CFT073
ggacauagcucugc

SEQ ID NO: 2654346 - RNA, 18 nt, Escherichia coli CFT073
ggacauaguacuggaaga

SEQ ID NO: 2654347 - RNA, 15 nt, Escherichia coli CFT073
ggacaucaaagaaaa

SEQ ID NO: 2654348 - RNA, 21 nt, Escherichia coli CFT073
ggacaucaaagaaaagcagug

SEQ ID NO: 2654349 - RNA, 17 nt, Escherichia coli CFT073
ggacaucccggcagaga

SEQ ID NO: 2654350 - RNA, 22 nt, Escherichia coli CFT073
ggacauguugcuuaaugcggga

SEQ ID NO: 2654351 - RNA, 14 nt, Escherichia coli CFT073
ggacauguuuucca

SEQ ID NO: 2654352 - RNA, 18 nt, Escherichia coli CFT073
ggaccaaagaaugacacu

SEQ ID NO: 2654353 - RNA, 13 nt, Escherichia coli CFT073
ggaccaacgcguu

SEQ ID NO: 2654354 - RNA, 16 nt, Escherichia coli CFT073
ggaccacgcacagccc

SEQ ID NO: 2654355 - RNA, 17 nt, Escherichia coli CFT073
ggaccaucuuccagcug

SEQ ID NO: 2654356 - RNA, 22 nt, Escherichia coli CFT073
ggaccauucacacuccaguccc

SEQ ID NO: 2654357 - RNA, 22 nt, Escherichia coli CFT073
ggaccugcgucugaugaaagca

SEQ ID NO: 2654358 - RNA, 13 nt, Escherichia coli CFT073
ggacgaugaagcg

SEQ ID NO: 2654359 - RNA, 14 nt, Escherichia coli CFT073
ggacgcgcaggagc

SEQ ID NO: 2654360 - RNA, 20 nt, Escherichia coli CFT073
ggacgcgcaggagcggcgga

SEQ ID NO: 2654361 - RNA, 12 nt, Escherichia coli CFT073
ggacgcgucaga

SEQ ID NO: 2654362 - RNA, 16 nt, Escherichia coli CFT073
ggacggaauuaucagu

SEQ ID NO: 2654363 - RNA, 22 nt, Escherichia coli CFT073
ggacgugcaccgucacuucuuc

SEQ ID NO: 2654364 - RNA, 19 nt, Escherichia coli CFT073
ggacguugaguuuacgcag

SEQ ID NO: 2654365 - RNA, 17 nt, Escherichia coli CFT073
ggacguuuucucgucca

SEQ ID NO: 2654366 - RNA, 11 nt, Escherichia coli CFT073
ggacucugccg

SEQ ID NO: 2654367 - RNA, 22 nt, Escherichia coli CFT073
ggacugccgcacuuacagcaac

SEQ ID NO: 2654368 - RNA, 14 nt, Escherichia coli CFT073
ggacuguucauuuu

SEQ ID NO: 2654369 - RNA, 23 nt, Escherichia coli CFT073
ggacuguucauuuuguaggccug

SEQ ID NO: 2654370 - RNA, 19 nt, Escherichia coli CFT073
ggacuuaacgucacagaag

SEQ ID NO: 2654371 - RNA, 17 nt, Escherichia coli CFT073
ggacuucaugcgcagca

SEQ ID NO: 2654372 - RNA, 14 nt, Escherichia coli CFT073
ggacuuccccugcc

SEQ ID NO: 2654373 - RNA, 14 nt, Escherichia coli CFT073
ggacuucuggcaga

SEQ ID NO: 2654374 - RNA, 13 nt, Escherichia coli CFT073
ggacuuuuuauuu

SEQ ID NO: 2654375 - RNA, 22 nt, Escherichia coli CFT073
ggagaaaagaccagccagcaau

SEQ ID NO: 2654376 - RNA, 16 nt, Escherichia coli CFT073
ggagaaaauccgccaa

SEQ ID NO: 2654377 - RNA, 22 nt, Escherichia coli CFT073
ggagaaagucguaggccugaua

SEQ ID NO: 2654378 - RNA, 16 nt, Escherichia coli CFT073
ggagaauccagcccca

SEQ ID NO: 2654379 - RNA, 14 nt, Escherichia coli CFT073
ggagacagcuuaga

SEQ ID NO: 2654380 - RNA, 15 nt, Escherichia coli CFT073
ggagacuaaggcagc

SEQ ID NO: 2654381 - RNA, 15 nt, Escherichia coli CFT073
ggagagcgccgggca

SEQ ID NO: 2654382 - RNA, 22 nt, Escherichia coli CFT073
ggagagggggcgauagaauagc

SEQ ID NO: 2654383 - RNA, 20 nt, Escherichia coli CFT073
ggagaguaugcgcgucagag

SEQ ID NO: 2654384 - RNA, 17 nt, Escherichia coli CFT073
ggagaguugcaccagca

SEQ ID NO: 2654385 - RNA, 21 nt, Escherichia coli CFT073
ggagaguugcaccagcaauaa

SEQ ID NO: 2654386 - RNA, 14 nt, Escherichia coli CFT073
ggagauccagcauu

SEQ ID NO: 2654387 - RNA, 15 nt, Escherichia coli CFT073
ggagaucccgugacg

SEQ ID NO: 2654388 - RNA, 18 nt, Escherichia coli CFT073
ggagaugggugugcugac

SEQ ID NO: 2654389 - RNA, 14 nt, Escherichia coli CFT073
ggagauucaaagac

SEQ ID NO: 2654390 - RNA, 17 nt, Escherichia coli CFT073
ggagauuugcaucauca

SEQ ID NO: 2654391 - RNA, 22 nt, Escherichia coli CFT073
ggagcacggaggcuccgccuga

SEQ ID NO: 2654392 - RNA, 22 nt, Escherichia coli CFT073
ggagcagagcauucccgccauc

SEQ ID NO: 2654393 - RNA, 22 nt, Escherichia coli CFT073
ggagcauuaacuccccuuuaaa

SEQ ID NO: 2654394 - RNA, 15 nt, Escherichia coli CFT073
ggagccaaaaucaaa

SEQ ID NO: 2654395 - RNA, 17 nt, Escherichia coli CFT073
ggagccaucccugcagg

SEQ ID NO: 2654396 - RNA, 15 nt, Escherichia coli CFT073
ggagcgauuaugaaa

SEQ ID NO: 2654397 - RNA, 21 nt, Escherichia coli CFT073
ggagcggaauugcgcaacaga

SEQ ID NO: 2654398 - RNA, 15 nt, Escherichia coli CFT073
ggagcguugcgccaa

SEQ ID NO: 2654399 - RNA, 15 nt, Escherichia coli CFT073
ggagcuaaacagagc

SEQ ID NO: 2654400 - RNA, 20 nt, Escherichia coli CFT073
ggagcuaaacagagcugcaa

SEQ ID NO: 2654401 - RNA, 18 nt, Escherichia coli CFT073
ggagcucccccucuuccg

SEQ ID NO: 2654402 - RNA, 12 nt, Escherichia coli CFT073
ggagcugcagcc

SEQ ID NO: 2654403 - RNA, 17 nt, Escherichia coli CFT073
ggaggcauugaacaucg

SEQ ID NO: 2654404 - RNA, 15 nt, Escherichia coli CFT073
ggaggcgcugguaau

SEQ ID NO: 2654405 - RNA, 20 nt, Escherichia coli CFT073
ggagggguuagucgaacaga

SEQ ID NO: 2654406 - RNA, 14 nt, Escherichia coli CFT073
ggaggguggcaccu

SEQ ID NO: 2654407 - RNA, 11 nt, Escherichia coli CFT073
ggagguggcag

SEQ ID NO: 2654408 - RNA, 20 nt, Escherichia coli CFT073
ggaguaaacuuucccugagg

SEQ ID NO: 2654409 - RNA, 16 nt, Escherichia coli CFT073
ggaguggcgaaauugg

SEQ ID NO: 2654410 - RNA, 15 nt, Escherichia coli CFT073
ggaguggugaugguu

SEQ ID NO: 2654411 - RNA, 19 nt, Escherichia coli CFT073
ggaguuuaggaaaguaagu

SEQ ID NO: 2654412 - RNA, 17 nt, Escherichia coli CFT073
ggauaaaacugccagaa

SEQ ID NO: 2654413 - RNA, 13 nt, Escherichia coli CFT073
ggauaaagccccc

SEQ ID NO: 2654414 - RNA, 13 nt, Escherichia coli CFT073
ggauaaaucaacg

SEQ ID NO: 2654415 - RNA, 19 nt, Escherichia coli CFT073
ggauaagaaagauacaaaa

SEQ ID NO: 2654416 - RNA, 22 nt, Escherichia coli CFT073
ggauaaggcguuugaacugaac

SEQ ID NO: 2654417 - RNA, 15 nt, Escherichia coli CFT073
ggauaaugcgccaga

SEQ ID NO: 2654418 - RNA, 20 nt, Escherichia coli CFT073
ggauaauuaauccuucuccg

SEQ ID NO: 2654419 - RNA, 14 nt, Escherichia coli CFT073
ggauacaacucgcu

SEQ ID NO: 2654420 - RNA, 21 nt, Escherichia coli CFT073
ggauaccgcacgcucaaagac

SEQ ID NO: 2654421 - RNA, 17 nt, Escherichia coli CFT073
ggauagagcgcugcgca

SEQ ID NO: 2654422 - RNA, 12 nt, Escherichia coli CFT073
ggauagaguguu

SEQ ID NO: 2654423 - RNA, 23 nt, Escherichia coli CFT073
ggauagccgccccagacuccagc

SEQ ID NO: 2654424 - RNA, 13 nt, Escherichia coli CFT073
ggauauaaaaaua

SEQ ID NO: 2654425 - RNA, 16 nt, Escherichia coli CFT073
ggauauaaacucgcca

SEQ ID NO: 2654426 - RNA, 17 nt, Escherichia coli CFT073
ggauauaugucaccagc

SEQ ID NO: 2654427 - RNA, 14 nt, Escherichia coli CFT073
ggauaucaccguaa

SEQ ID NO: 2654428 - RNA, 18 nt, Escherichia coli CFT073
ggauauccacccgcagcc

SEQ ID NO: 2654429 - RNA, 21 nt, Escherichia coli CFT073
ggauaucuucaaucagaugug

SEQ ID NO: 2654430 - RNA, 18 nt, Escherichia coli CFT073
ggauauuuauauuuugcg

SEQ ID NO: 2654431 - RNA, 19 nt, Escherichia coli CFT073
ggaucaauccccagaugcu

SEQ ID NO: 2654432 - RNA, 21 nt, Escherichia coli CFT073
ggaucaauuaauccuuucgaa

SEQ ID NO: 2654433 - RNA, 20 nt, Escherichia coli CFT073
ggaucaccaauaccagcauc

SEQ ID NO: 2654434 - RNA, 21 nt, Escherichia coli CFT073
ggaucaccagaccaauggcuu

SEQ ID NO: 2654435 - RNA, 20 nt, Escherichia coli CFT073
ggaucaccaguccaucggca

SEQ ID NO: 2654436 - RNA, 19 nt, Escherichia coli CFT073
ggaucagaaugcgcucuuc

SEQ ID NO: 2654437 - RNA, 16 nt, Escherichia coli CFT073
ggaucagcuccggcag

SEQ ID NO: 2654438 - RNA, 15 nt, Escherichia coli CFT073
ggaucauaugcacaa

SEQ ID NO: 2654439 - RNA, 15 nt, Escherichia coli CFT073
ggaucauguuuuuca

SEQ ID NO: 2654440 - RNA, 15 nt, Escherichia coli CFT073
ggaucauuaaccagu

SEQ ID NO: 2654441 - RNA, 21 nt, Escherichia coli CFT073
ggauccacaccugacgaugcg

SEQ ID NO: 2654442 - RNA, 12 nt, Escherichia coli CFT073
ggauccacgcca

SEQ ID NO: 2654443 - RNA, 15 nt, Escherichia coli CFT073
ggauccgcucugccc

SEQ ID NO: 2654444 - RNA, 17 nt, Escherichia coli CFT073
ggauccugagcaaacag

SEQ ID NO: 2654445 - RNA, 21 nt, Escherichia coli CFT073
ggaucgaagacaucaucguga

SEQ ID NO: 2654446 - RNA, 16 nt, Escherichia coli CFT073
ggaucgauacggaucg

SEQ ID NO: 2654447 - RNA, 20 nt, Escherichia coli CFT073
ggaucgcauaaugccugcaa

SEQ ID NO: 2654448 - RNA, 15 nt, Escherichia coli CFT073
ggaucgcuuuuacau

SEQ ID NO: 2654449 - RNA, 16 nt, Escherichia coli CFT073
ggaucgguagaccgga

SEQ ID NO: 2654450 - RNA, 16 nt, Escherichia coli CFT073
ggaucggucagcgagc

SEQ ID NO: 2654451 - RNA, 14 nt, Escherichia coli CFT073
ggcaagccagcaua

SEQ ID NO: 2654452 - RNA, 18 nt, Escherichia coli CFT073
ggcaagccgcuaacagca

SEQ ID NO: 2654453 - RNA, 20 nt, Escherichia coli CFT073
ggcaagccgcuaacagcagc

SEQ ID NO: 2654454 - RNA, 17 nt, Escherichia coli CFT073
ggcaagcgucgcaucag

SEQ ID NO: 2654455 - RNA, 19 nt, Escherichia coli CFT073
ggcaagcgucgcaucaggc

SEQ ID NO: 2654456 - RNA, 21 nt, Escherichia coli CFT073
ggcaaggcugucgcaaauucg

SEQ ID NO: 2654457 - RNA, 21 nt, Escherichia coli CFT073
ggcaaguaauuguuucaucgu

SEQ ID NO: 2654458 - RNA, 14 nt, Escherichia coli CFT073
ggcaagugucgccu

SEQ ID NO: 2654459 - RNA, 19 nt, Escherichia coli CFT073
ggcaagugugaugguauuc

SEQ ID NO: 2654460 - RNA, 15 nt, Escherichia coli CFT073
ggcaauaaacagcac

SEQ ID NO: 2654461 - RNA, 16 nt, Escherichia coli CFT073
ggcaauaacucccagg

SEQ ID NO: 2654462 - RNA, 22 nt, Escherichia coli CFT073
ggcaauacgauccugagcagca

SEQ ID NO: 2654463 - RNA, 22 nt, Escherichia coli CFT073
ggcaauauagauaucaugcucu

SEQ ID NO: 2654464 - RNA, 14 nt, Escherichia coli CFT073
ggcaauaucgcggc

SEQ ID NO: 2654465 - RNA, 19 nt, Escherichia coli CFT073
ggcaaucaacagauaaaug

SEQ ID NO: 2654466 - RNA, 19 nt, Escherichia coli CFT073
ggcaaucacgcccgccaga

SEQ ID NO: 2654467 - RNA, 22 nt, Escherichia coli CFT073
ggcaaucagcacuacugccaga

SEQ ID NO: 2654468 - RNA, 23 nt, Escherichia coli CFT073
ggcaaucaucaccggucgaccuu

SEQ ID NO: 2654469 - RNA, 18 nt, Escherichia coli CFT073
ggcaaucauucccagacc

SEQ ID NO: 2654470 - RNA, 16 nt, Escherichia coli CFT073
ggcaauccccgccagc

SEQ ID NO: 2654471 - RNA, 13 nt, Escherichia coli CFT073
ggcaauccugcuu

SEQ ID NO: 2654472 - RNA, 12 nt, Escherichia coli CFT073
ggcaaucgccag

SEQ ID NO: 2654473 - RNA, 13 nt, Escherichia coli CFT073
ggcaaucgccaga

SEQ ID NO: 2654474 - RNA, 22 nt, Escherichia coli CFT073
ggcaaucucguggucaauauca

SEQ ID NO: 2654475 - RNA, 14 nt, Escherichia coli CFT073
ggcaaucugcuggc

SEQ ID NO: 2654476 - RNA, 22 nt, Escherichia coli CFT073
ggcaaucugcuggcaaacguca

SEQ ID NO: 2654477 - RNA, 14 nt, Escherichia coli CFT073
ggcaaugaaacuca

SEQ ID NO: 2654478 - RNA, 18 nt, Escherichia coli CFT073
ggcaaugacaucgcccuc

SEQ ID NO: 2654479 - RNA, 22 nt, Escherichia coli CFT073
ggcaaugauauuaauguuuuca

SEQ ID NO: 2654480 - RNA, 17 nt, Escherichia coli CFT073
ggcaaugucaagugaau

SEQ ID NO: 2654481 - RNA, 22 nt, Escherichia coli CFT073
ggcaauucuuuccguuuucacc

SEQ ID NO: 2654482 - RNA, 15 nt, Escherichia coli CFT073
ggcaauugcaccgcg

SEQ ID NO: 2654483 - RNA, 18 nt, Escherichia coli CFT073
ggcaauugccauaaaaac

SEQ ID NO: 2654484 - RNA, 21 nt, Escherichia coli CFT073
ggcaauugccgcacuuaaaau

SEQ ID NO: 2654485 - RNA, 14 nt, Escherichia coli CFT073
ggcaauuggcacau

SEQ ID NO: 2654486 - RNA, 12 nt, Escherichia coli CFT073
ggcaauuucagu

SEQ ID NO: 2654487 - RNA, 12 nt, Escherichia coli CFT073
ggcacaaagucg

SEQ ID NO: 2654488 - RNA, 21 nt, Escherichia coli CFT073
ggcacacaaauaauucagccc

SEQ ID NO: 2654489 - RNA, 21 nt, Escherichia coli CFT073
ggcacacacuaccgccgagca

SEQ ID NO: 2654490 - RNA, 21 nt, Escherichia coli CFT073
ggcacaccagccaguagcacc

SEQ ID NO: 2654491 - RNA, 20 nt, Escherichia coli CFT073
ggcacacugccagugucgga

SEQ ID NO: 2654492 - RNA, 13 nt, Escherichia coli CFT073
ggcacagccagcg

SEQ ID NO: 2654493 - RNA, 17 nt, Escherichia coli CFT073
ggcacagccagcgcagg

SEQ ID NO: 2654494 - RNA, 21 nt, Escherichia coli CFT073
ggcacagccagcgcaggcagu

SEQ ID NO: 2654495 - RNA, 22 nt, Escherichia coli CFT073
ggcacauagacggugacacuuu

SEQ ID NO: 2654496 - RNA, 23 nt, Escherichia coli CFT073
ggcaccaaaaaucaccgcgacca

SEQ ID NO: 2654497 - RNA, 22 nt, Escherichia coli CFT073
ggcaccagccccuggaaaaaau

SEQ ID NO: 2654498 - RNA, 12 nt, Escherichia coli CFT073
ggcaccaguaaa

SEQ ID NO: 2654499 - RNA, 18 nt, Escherichia coli CFT073
ggcaccaguaaaacgggc

SEQ ID NO: 2654500 - RNA, 19 nt, Escherichia coli CFT073
ggcaccgauucccccggug

SEQ ID NO: 2654501 - RNA, 19 nt, Escherichia coli CFT073
ggcaccgccagcaggaacg

SEQ ID NO: 2654502 - RNA, 13 nt, Escherichia coli CFT073
ggcaccgccgcca

SEQ ID NO: 2654503 - RNA, 14 nt, Escherichia coli CFT073
ggcaccgccgccac

SEQ ID NO: 2654504 - RNA, 18 nt, Escherichia coli CFT073
ggcaccgccgccacuucu

SEQ ID NO: 2654505 - RNA, 18 nt, Escherichia coli CFT073
ggcaccgguacacaaccg

SEQ ID NO: 2654506 - RNA, 17 nt, Escherichia coli CFT073
ggcaccguuagugauuu

SEQ ID NO: 2654507 - RNA, 18 nt, Escherichia coli CFT073
ggcaccuaucgcgucgcc

SEQ ID NO: 2654508 - RNA, 16 nt, Escherichia coli CFT073
ggcacgaccaggaacg

SEQ ID NO: 2654509 - RNA, 21 nt, Escherichia coli CFT073
ggcacgccaauuacgccugcc

SEQ ID NO: 2654510 - RNA, 15 nt, Escherichia coli CFT073
ggcacgcccgcgcca

SEQ ID NO: 2654511 - RNA, 13 nt, Escherichia coli CFT073
ggcacggaaagca

SEQ ID NO: 2654512 - RNA, 16 nt, Escherichia coli CFT073
ggcacguacaugcagg

SEQ ID NO: 2654513 - RNA, 17 nt, Escherichia coli CFT073
ggcacguugcugcggcg

SEQ ID NO: 2654514 - RNA, 13 nt, Escherichia coli CFT073
ggcacuccgccac

SEQ ID NO: 2654515 - RNA, 13 nt, Escherichia coli CFT073
ggcacucgcugac

SEQ ID NO: 2654516 - RNA, 19 nt, Escherichia coli CFT073
ggcacucuccggcagacca

SEQ ID NO: 2654517 - RNA, 14 nt, Escherichia coli CFT073
ggcacugaccacca

SEQ ID NO: 2654518 - RNA, 23 nt, Escherichia coli CFT073
ggcacugacgcgcuuuucaccga

SEQ ID NO: 2654519 - RNA, 14 nt, Escherichia coli CFT073
ggcacugcgaccag

SEQ ID NO: 2654520 - RNA, 21 nt, Escherichia coli CFT073
ggcacugcgaccagugaaaau

SEQ ID NO: 2654521 - RNA, 15 nt, Escherichia coli CFT073
ggcacugcgaucccg

SEQ ID NO: 2654522 - RNA, 18 nt, Escherichia coli CFT073
ggcacuggccuuuucaca

SEQ ID NO: 2654523 - RNA, 16 nt, Escherichia coli CFT073
ggcacugguacucaac

SEQ ID NO: 2654524 - RNA, 21 nt, Escherichia coli CFT073
ggcacuucuuccgccagcauc

SEQ ID NO: 2654525 - RNA, 14 nt, Escherichia coli CFT073
ggcagaaaauccag

SEQ ID NO: 2654526 - RNA, 17 nt, Escherichia coli CFT073
ggcagaaacaaccucuu

SEQ ID NO: 2654527 - RNA, 18 nt, Escherichia coli CFT073
ggcagaaaccaggucaau

SEQ ID NO: 2654528 - RNA, 16 nt, Escherichia coli CFT073
ggcagaaacggcuucu

SEQ ID NO: 2654529 - RNA, 19 nt, Escherichia coli CFT073
ggcagaaaucaacggcguc

SEQ ID NO: 2654530 - RNA, 21 nt, Escherichia coli CFT073
ggcagaaaucaacggcgucag

SEQ ID NO: 2654531 - RNA, 18 nt, Escherichia coli CFT073
ggcagaacaccggcagcg

SEQ ID NO: 2654532 - RNA, 21 nt, Escherichia coli CFT073
ggcagaaucuuaagucugcgu

SEQ ID NO: 2654533 - RNA, 16 nt, Escherichia coli CFT073
ggcagacgaugaugca

SEQ ID NO: 2654534 - RNA, 22 nt, Escherichia coli CFT073
ggcagacgcucgccauuuuuca

SEQ ID NO: 2654535 - RNA, 17 nt, Escherichia coli CFT073
ggcagagaaaccacauc

SEQ ID NO: 2654536 - RNA, 15 nt, Escherichia coli CFT073
ggcagagaaagcaaa

SEQ ID NO: 2654537 - RNA, 16 nt, Escherichia coli CFT073
ggcagagaaagcaaaa

SEQ ID NO: 2654538 - RNA, 18 nt, Escherichia coli CFT073
ggcagagaaagcaaaaau

SEQ ID NO: 2654539 - RNA, 16 nt, Escherichia coli CFT073
ggcagagccaaauaau

SEQ ID NO: 2654540 - RNA, 17 nt, Escherichia coli CFT073
ggcagagucuccgguuu

SEQ ID NO: 2654541 - RNA, 13 nt, Escherichia coli CFT073
ggcagauaaaaug

SEQ ID NO: 2654542 - RNA, 15 nt, Escherichia coli CFT073
ggcagauaaaaugcg

SEQ ID NO: 2654543 - RNA, 23 nt, Escherichia coli CFT073
ggcagauaaaaugcgaaaaaaac

SEQ ID NO: 2654544 - RNA, 21 nt, Escherichia coli CFT073
ggcagauacaaccaaucgcgg

SEQ ID NO: 2654545 - RNA, 13 nt, Escherichia coli CFT073
ggcagauccacca

SEQ ID NO: 2654546 - RNA, 17 nt, Escherichia coli CFT073
ggcagauccaccagacc

SEQ ID NO: 2654547 - RNA, 13 nt, Escherichia coli CFT073
ggcagaucgguua

SEQ ID NO: 2654548 - RNA, 13 nt, Escherichia coli CFT073
ggcagaugcgucu

SEQ ID NO: 2654549 - RNA, 16 nt, Escherichia coli CFT073
ggcagauugagcguca

SEQ ID NO: 2654550 - RNA, 17 nt, Escherichia coli CFT073
ggcagauugagcgucaa

SEQ ID NO: 2654551 - RNA, 16 nt, Escherichia coli CFT073
ggcagcaacagcaguu

SEQ ID NO: 2654552 - RNA, 23 nt, Escherichia coli CFT073
ggcagcaaggcuauucagcaguu

SEQ ID NO: 2654553 - RNA, 16 nt, Escherichia coli CFT073
ggcagcaaucacugcc

SEQ ID NO: 2654554 - RNA, 19 nt, Escherichia coli CFT073
ggcagcaaucacugccaga

SEQ ID NO: 2654555 - RNA, 20 nt, Escherichia coli CFT073
ggcagcaaucacugccagaa

SEQ ID NO: 2654556 - RNA, 12 nt, Escherichia coli CFT073
ggcagcagaaag

SEQ ID NO: 2654557 - RNA, 12 nt, Escherichia coli CFT073
ggcagcagacca

SEQ ID NO: 2654558 - RNA, 13 nt, Escherichia coli CFT073
ggcagcagaccaa

SEQ ID NO: 2654559 - RNA, 19 nt, Escherichia coli CFT073
ggccauuuuuuuacccagc

SEQ ID NO: 2654560 - RNA, 16 nt, Escherichia coli CFT073
ggcccauaacccacac

SEQ ID NO: 2654561 - RNA, 20 nt, Escherichia coli CFT073
ggcccauaacccacaccaua

SEQ ID NO: 2654562 - RNA, 13 nt, Escherichia coli CFT073
ggcccaugacaaa

SEQ ID NO: 2654563 - RNA, 13 nt, Escherichia coli CFT073
ggccccaccugcu

SEQ ID NO: 2654564 - RNA, 23 nt, Escherichia coli CFT073
ggccccgucgcccgaugccagca

SEQ ID NO: 2654565 - RNA, 14 nt, Escherichia coli CFT073
ggccccuggcuggu

SEQ ID NO: 2654566 - RNA, 17 nt, Escherichia coli CFT073
ggcccgcgugccggaag

SEQ ID NO: 2654567 - RNA, 21 nt, Escherichia coli CFT073
ggcccguacugaacccgggua

SEQ ID NO: 2654568 - RNA, 17 nt, Escherichia coli CFT073
ggcccuugcgcaaugag

SEQ ID NO: 2654569 - RNA, 14 nt, Escherichia coli CFT073
ggccgagaggcuga

SEQ ID NO: 2654570 - RNA, 21 nt, Escherichia coli CFT073
ggccgauagacacugccgccg

SEQ ID NO: 2654571 - RNA, 16 nt, Escherichia coli CFT073
ggccgcaaaccagcgc

SEQ ID NO: 2654572 - RNA, 18 nt, Escherichia coli CFT073
ggccgcaaaccagcgcau

SEQ ID NO: 2654573 - RNA, 12 nt, Escherichia coli CFT073
ggccgcagagau

SEQ ID NO: 2654574 - RNA, 22 nt, Escherichia coli CFT073
ggccgcaugugcccccugcaau

SEQ ID NO: 2654575 - RNA, 19 nt, Escherichia coli CFT073
ggccgcgccgacugcgcca

SEQ ID NO: 2654576 - RNA, 17 nt, Escherichia coli CFT073
ggccgcucugaaagcgg

SEQ ID NO: 2654577 - RNA, 15 nt, Escherichia coli CFT073
ggccgcuguuuuuca

SEQ ID NO: 2654578 - RNA, 23 nt, Escherichia coli CFT073
ggccgcuguuuuucauugcguaa

SEQ ID NO: 2654579 - RNA, 19 nt, Escherichia coli CFT073
ggccgcuuucagagcggcc

SEQ ID NO: 2654580 - RNA, 20 nt, Escherichia coli CFT073
ggccgcuuucagagcggccu

SEQ ID NO: 2654581 - RNA, 13 nt, Escherichia coli CFT073
ggccggagccagu

SEQ ID NO: 2654582 - RNA, 19 nt, Escherichia coli CFT073
ggccggauaagacgcguca

SEQ ID NO: 2654583 - RNA, 19 nt, Escherichia coli CFT073
ggccggauaaggcgcguca

SEQ ID NO: 2654584 - RNA, 14 nt, Escherichia coli CFT073
ggccgguaacgcuu

SEQ ID NO: 2654585 - RNA, 17 nt, Escherichia coli CFT073
ggccguacagcccagga

SEQ ID NO: 2654586 - RNA, 17 nt, Escherichia coli CFT073
ggccguacccagcgguc

SEQ ID NO: 2654587 - RNA, 13 nt, Escherichia coli CFT073
ggccguuccggca

SEQ ID NO: 2654588 - RNA, 22 nt, Escherichia coli CFT073
ggccuaaacgcuccaugcugcg

SEQ ID NO: 2654589 - RNA, 15 nt, Escherichia coli CFT073
ggccuacaaaagcaa

SEQ ID NO: 2654590 - RNA, 21 nt, Escherichia coli CFT073
ggccuacaaguccguugaaau

SEQ ID NO: 2654591 - RNA, 22 nt, Escherichia coli CFT073
ggccuacaaucccguugaaaau

SEQ ID NO: 2654592 - RNA, 20 nt, Escherichia coli CFT073
ggccuacauagccccugcaa

SEQ ID NO: 2654593 - RNA, 21 nt, Escherichia coli CFT073
ggccuacauagccccugcaau

SEQ ID NO: 2654594 - RNA, 19 nt, Escherichia coli CFT073
ggccuacaugccaucacac

SEQ ID NO: 2654595 - RNA, 21 nt, Escherichia coli CFT073
ggccuaccaugaucugcaaau

SEQ ID NO: 2654596 - RNA, 17 nt, Escherichia coli CFT073
ggccuaccggacggcuc

SEQ ID NO: 2654597 - RNA, 23 nt, Escherichia coli CFT073
ggccuaccguuccgacaccgccu

SEQ ID NO: 2654598 - RNA, 21 nt, Escherichia coli CFT073
ggccuacgaucuucuugcaau

SEQ ID NO: 2654599 - RNA, 17 nt, Escherichia coli CFT073
ggccuacgggacuguuc

SEQ ID NO: 2654600 - RNA, 22 nt, Escherichia coli CFT073
ggccuacguguuuuuuugcaau

SEQ ID NO: 2654601 - RNA, 22 nt, Escherichia coli CFT073
ggccucacuuugauuuauaguc

SEQ ID NO: 2654602 - RNA, 18 nt, Escherichia coli CFT073
ggccucaugugaugguaa

SEQ ID NO: 2654603 - RNA, 19 nt, Escherichia coli CFT073
ggccuccagcacuuccuga

SEQ ID NO: 2654604 - RNA, 20 nt, Escherichia coli CFT073
ggccuccggcacuaacgcaa

SEQ ID NO: 2654605 - RNA, 13 nt, Escherichia coli CFT073
ggccuccugcagc

SEQ ID NO: 2654606 - RNA, 14 nt, Escherichia coli CFT073
ggccuccugcagcg

SEQ ID NO: 2654607 - RNA, 19 nt, Escherichia coli CFT073
ggccuccugcagcguugcc

SEQ ID NO: 2654608 - RNA, 16 nt, Escherichia coli CFT073
ggccucgcagcggcag

SEQ ID NO: 2654609 - RNA, 13 nt, Escherichia coli CFT073
ggccucugccagc

SEQ ID NO: 2654610 - RNA, 12 nt, Escherichia coli CFT073
ggccugaaagcu

SEQ ID NO: 2654611 - RNA, 17 nt, Escherichia coli CFT073
ggccugaacaagcaaga

SEQ ID NO: 2654612 - RNA, 16 nt, Escherichia coli CFT073
ggccugaauaacggcg

SEQ ID NO: 2654613 - RNA, 21 nt, Escherichia coli CFT073
ggccugagaagcgcagcgcau

SEQ ID NO: 2654614 - RNA, 19 nt, Escherichia coli CFT073
ggccugauaaaacgcgcag

SEQ ID NO: 2654615 - RNA, 20 nt, Escherichia coli CFT073
ggccugauaagacgcgaaca

SEQ ID NO: 2654616 - RNA, 20 nt, Escherichia coli CFT073
ggccugauaagaugcguuaa

SEQ ID NO: 2654617 - RNA, 14 nt, Escherichia coli CFT073
ggccugauaaggca

SEQ ID NO: 2654618 - RNA, 21 nt, Escherichia coli CFT073
ggccugaugagcggagcacau

SEQ ID NO: 2654619 - RNA, 23 nt, Escherichia coli CFT073
ggccugauuaagaucgugcagca

SEQ ID NO: 2654620 - RNA, 13 nt, Escherichia coli CFT073
ggccugcaggugu

SEQ ID NO: 2654621 - RNA, 18 nt, Escherichia coli CFT073
ggccugcucacgcaucaa

SEQ ID NO: 2654622 - RNA, 14 nt, Escherichia coli CFT073
ggccuggcgcgaca

SEQ ID NO: 2654623 - RNA, 15 nt, Escherichia coli CFT073
ggccuggggaaugag

SEQ ID NO: 2654624 - RNA, 19 nt, Escherichia coli CFT073
ggccuuccggcacaucgcc

SEQ ID NO: 2654625 - RNA, 21 nt, Escherichia coli CFT073
ggccuuccggguuuucuccaa

SEQ ID NO: 2654626 - RNA, 21 nt, Escherichia coli CFT073
ggccuugaacucugaaucgcu

SEQ ID NO: 2654627 - RNA, 18 nt, Escherichia coli CFT073
ggccuugauuauuucccu

SEQ ID NO: 2654628 - RNA, 19 nt, Escherichia coli CFT073
ggcgaaaaaccuaauacuc

SEQ ID NO: 2654629 - RNA, 14 nt, Escherichia coli CFT073
ggcgaaaagcuucu

SEQ ID NO: 2654630 - RNA, 18 nt, Escherichia coli CFT073
ggcgaaaagcuucuuccu

SEQ ID NO: 2654631 - RNA, 14 nt, Escherichia coli CFT073
ggcgaaaccagcag

SEQ ID NO: 2654632 - RNA, 22 nt, Escherichia coli CFT073
ggcgaaaccagcagccaucgca

SEQ ID NO: 2654633 - RNA, 11 nt, Escherichia coli CFT073
ggcgaaagggc

SEQ ID NO: 2654634 - RNA, 22 nt, Escherichia coli CFT073
ggcgaacaaguucgcuccagcc

SEQ ID NO: 2654635 - RNA, 19 nt, Escherichia coli CFT073
ggcgaacgagauaauggca

SEQ ID NO: 2654636 - RNA, 23 nt, Escherichia coli CFT073
ggcgaacucuuccggcagggugu

SEQ ID NO: 2654637 - RNA, 21 nt, Escherichia coli CFT073
ggcgaacuuccauacggcguu

SEQ ID NO: 2654638 - RNA, 13 nt, Escherichia coli CFT073
ggcgaauaaccgc

SEQ ID NO: 2654639 - RNA, 22 nt, Escherichia coli CFT073
ggcgaauacguuucagccacgc

SEQ ID NO: 2654640 - RNA, 13 nt, Escherichia coli CFT073
ggcgaauuccuga

SEQ ID NO: 2654641 - RNA, 19 nt, Escherichia coli CFT073
ggcgaauucugcagacugu

SEQ ID NO: 2654642 - RNA, 23 nt, Escherichia coli CFT073
ggcgacaaagccucuauggaagu

SEQ ID NO: 2654643 - RNA, 22 nt, Escherichia coli CFT073
ggcgacaagcauaacaaaaugc

SEQ ID NO: 2654644 - RNA, 13 nt, Escherichia coli CFT073
ggcgacacgcauc

SEQ ID NO: 2654645 - RNA, 18 nt, Escherichia coli CFT073
ggcgacagcugcgaccag

SEQ ID NO: 2654646 - RNA, 23 nt, Escherichia coli CFT073
ggcgaccacugaccgcccggccc

SEQ ID NO: 2654647 - RNA, 18 nt, Escherichia coli CFT073
ggcgaccguucgccaggu

SEQ ID NO: 2654648 - RNA, 22 nt, Escherichia coli CFT073
ggcgaccguucgccaggucaga

SEQ ID NO: 2654649 - RNA, 21 nt, Escherichia coli CFT073
ggcgaccguuuucaccaguug

SEQ ID NO: 2654650 - RNA, 20 nt, Escherichia coli CFT073
ggcgaccugugccgccgccc

SEQ ID NO: 2654651 - RNA, 17 nt, Escherichia coli CFT073
ggcgacggcuggcaaaa

SEQ ID NO: 2654652 - RNA, 16 nt, Escherichia coli CFT073
ggcgacguaccagcgu

SEQ ID NO: 2654653 - RNA, 20 nt, Escherichia coli CFT073
ggcgacucgguugcacagac

SEQ ID NO: 2654654 - RNA, 14 nt, Escherichia coli CFT073
ggcgacugccagcc

SEQ ID NO: 2654655 - RNA, 23 nt, Escherichia coli CFT073
ggcgaggggacgguccgugcgcu

SEQ ID NO: 2654656 - RNA, 15 nt, Escherichia coli CFT073
ggcgaguugccgaga

SEQ ID NO: 2654657 - RNA, 14 nt, Escherichia coli CFT073
ggcgauaaacagca

SEQ ID NO: 2654658 - RNA, 20 nt, Escherichia coli CFT073
ggcgauaaucagcgccagcg

SEQ ID NO: 2654659 - RNA, 21 nt, Escherichia coli CFT073
ggcgauaaucagcgccagcgc

SEQ ID NO: 2654660 - RNA, 13 nt, Escherichia coli CFT073
ggcgauaccagua

SEQ ID NO: 2654661 - RNA, 21 nt, Escherichia coli CFT073
ggcgauaccaguaauaagccc

SEQ ID NO: 2654662 - RNA, 14 nt, Escherichia coli CFT073
ggcgauagcaucca

SEQ ID NO: 2654663 - RNA, 15 nt, Escherichia coli CFT073
ggcgauauccagcgc

SEQ ID NO: 2654664 - RNA, 14 nt, Escherichia coli CFT073
ggcgauaucuuccg

SEQ ID NO: 2654665 - RNA, 13 nt, Escherichia coli CFT073
ggcgaucagugau

SEQ ID NO: 2654666 - RNA, 20 nt, Escherichia coli CFT073
ggcguuaucggguccgggca

SEQ ID NO: 2654667 - RNA, 16 nt, Escherichia coli CFT073
ggcguuauggcaaucu

SEQ ID NO: 2654668 - RNA, 12 nt, Escherichia coli CFT073
ggcguucacgcc

SEQ ID NO: 2654669 - RNA, 13 nt, Escherichia coli CFT073
ggcguucacugcc

SEQ ID NO: 2654670 - RNA, 17 nt, Escherichia coli CFT073
ggcguugcccaucgcca

SEQ ID NO: 2654671 - RNA, 14 nt, Escherichia coli CFT073
ggcguuucacuuuc

SEQ ID NO: 2654672 - RNA, 13 nt, Escherichia coli CFT073
ggcguuucuucac

SEQ ID NO: 2654673 - RNA, 20 nt, Escherichia coli CFT073
ggcguuuucuuuuucagcaa

SEQ ID NO: 2654674 - RNA, 18 nt, Escherichia coli CFT073
ggcguuuugauuuucacc

SEQ ID NO: 2654675 - RNA, 12 nt, Escherichia coli CFT073
ggcguuuugcuu

SEQ ID NO: 2654676 - RNA, 23 nt, Escherichia coli CFT073
ggcguuuuuaucgcccacgcacc

SEQ ID NO: 2654677 - RNA, 12 nt, Escherichia coli CFT073
ggcuaaaaaaag

SEQ ID NO: 2654678 - RNA, 19 nt, Escherichia coli CFT073
ggcuaaaaacgccgccagc

SEQ ID NO: 2654679 - RNA, 12 nt, Escherichia coli CFT073
ggcuaacagucu

SEQ ID NO: 2654680 - RNA, 16 nt, Escherichia coli CFT073
ggcuaaccaaacuuca

SEQ ID NO: 2654681 - RNA, 17 nt, Escherichia coli CFT073
ggcuaaccgcuuuuccg

SEQ ID NO: 2654682 - RNA, 18 nt, Escherichia coli CFT073
ggcuaacgagcaguuugg

SEQ ID NO: 2654683 - RNA, 14 nt, Escherichia coli CFT073
ggcuaauaaacagg

SEQ ID NO: 2654684 - RNA, 22 nt, Escherichia coli CFT073
ggcuaauuaaucggucgaugcg

SEQ ID NO: 2654685 - RNA, 15 nt, Escherichia coli CFT073
ggcuacgccaccagc

SEQ ID NO: 2654686 - RNA, 14 nt, Escherichia coli CFT073
ggcuacgugccggg

SEQ ID NO: 2654687 - RNA, 14 nt, Escherichia coli CFT073
ggcuauaccgccga

SEQ ID NO: 2654688 - RNA, 16 nt, Escherichia coli CFT073
ggcuauauacagcgcc

SEQ ID NO: 2654689 - RNA, 14 nt, Escherichia coli CFT073
ggcuaucaugcccg

SEQ ID NO: 2654690 - RNA, 19 nt, Escherichia coli CFT073
ggcuaucuucgauaaacuc

SEQ ID NO: 2654691 - RNA, 12 nt, Escherichia coli CFT073
ggcuaugcugga

SEQ ID NO: 2654692 - RNA, 12 nt, Escherichia coli CFT073
ggcucagcucug

SEQ ID NO: 2654693 - RNA, 23 nt, Escherichia coli CFT073
ggcucagcucuggcacaugcaua

SEQ ID NO: 2654694 - RNA, 16 nt, Escherichia coli CFT073
ggcucaggcuggcuga

SEQ ID NO: 2654695 - RNA, 18 nt, Escherichia coli CFT073
ggcucaggcuggcugacc

SEQ ID NO: 2654696 - RNA, 15 nt, Escherichia coli CFT073
ggcucauaccuucca

SEQ ID NO: 2654697 - RNA, 13 nt, Escherichia coli CFT073
ggcucaucaaaca

SEQ ID NO: 2654698 - RNA, 20 nt, Escherichia coli CFT073
ggcucauccccugaugcugu

SEQ ID NO: 2654699 - RNA, 12 nt, Escherichia coli CFT073
ggcuccagacgc

SEQ ID NO: 2654700 - RNA, 19 nt, Escherichia coli CFT073
ggcuccagacgcccgcgcc

SEQ ID NO: 2654701 - RNA, 20 nt, Escherichia coli CFT073
ggcuccagacgcccgcgccc

SEQ ID NO: 2654702 - RNA, 14 nt, Escherichia coli CFT073
ggcuccagcaaugu

SEQ ID NO: 2654703 - RNA, 21 nt, Escherichia coli CFT073
ggcuccauagggcagggugcc

SEQ ID NO: 2654704 - RNA, 20 nt, Escherichia coli CFT073
ggcucccaccgcacaaagcg

SEQ ID NO: 2654705 - RNA, 19 nt, Escherichia coli CFT073
ggcuccgggcagggcggga

SEQ ID NO: 2654706 - RNA, 20 nt, Escherichia coli CFT073
ggcuccgggugugacaacaa

SEQ ID NO: 2654707 - RNA, 21 nt, Escherichia coli CFT073
ggcucgauugguugcagcacg

SEQ ID NO: 2654708 - RNA, 12 nt, Escherichia coli CFT073
ggcucuaucugg

SEQ ID NO: 2654709 - RNA, 17 nt, Escherichia coli CFT073
ggcucucauuuuucagc

SEQ ID NO: 2654710 - RNA, 13 nt, Escherichia coli CFT073
ggcugaagaagua

SEQ ID NO: 2654711 - RNA, 23 nt, Escherichia coli CFT073
ggcugaccgucgcagccagcgca

SEQ ID NO: 2654712 - RNA, 22 nt, Escherichia coli CFT073
ggcugagucccccaagacugag

SEQ ID NO: 2654713 - RNA, 22 nt, Escherichia coli CFT073
ggcugaguuaccagcggccaga

SEQ ID NO: 2654714 - RNA, 12 nt, Escherichia coli CFT073
ggcugauaaucu

SEQ ID NO: 2654715 - RNA, 20 nt, Escherichia coli CFT073
ggcugaugaaguugaaauca

SEQ ID NO: 2654716 - RNA, 19 nt, Escherichia coli CFT073
ggcugauggagauuuuccg

SEQ ID NO: 2654717 - RNA, 16 nt, Escherichia coli CFT073
ggcugauguugauaaa

SEQ ID NO: 2654718 - RNA, 15 nt, Escherichia coli CFT073
ggcugcaaacccuga

SEQ ID NO: 2654719 - RNA, 22 nt, Escherichia coli CFT073
ggcugcaugccuaaagugcugg

SEQ ID NO: 2654720 - RNA, 12 nt, Escherichia coli CFT073
ggcugcauuccu

SEQ ID NO: 2654721 - RNA, 14 nt, Escherichia coli CFT073
ggcugccagcucuc

SEQ ID NO: 2654722 - RNA, 19 nt, Escherichia coli CFT073
ggcugccagcucucagaca

SEQ ID NO: 2654723 - RNA, 13 nt, Escherichia coli CFT073
ggcugccaugguu

SEQ ID NO: 2654724 - RNA, 18 nt, Escherichia coli CFT073
ggcugcccggauagggaa

SEQ ID NO: 2654725 - RNA, 12 nt, Escherichia coli CFT073
ggcugccgagca

SEQ ID NO: 2654726 - RNA, 13 nt, Escherichia coli CFT073
ggcugccgccagg

SEQ ID NO: 2654727 - RNA, 21 nt, Escherichia coli CFT073
ggcugccggaccaucuuccag

SEQ ID NO: 2654728 - RNA, 15 nt, Escherichia coli CFT073
ggcugcguuucaugu

SEQ ID NO: 2654729 - RNA, 16 nt, Escherichia coli CFT073
ggcugcugccagcaug

SEQ ID NO: 2654730 - RNA, 14 nt, Escherichia coli CFT073
ggcugcuugagcca

SEQ ID NO: 2654731 - RNA, 20 nt, Escherichia coli CFT073
ggcuggaaacgcgaucgcca

SEQ ID NO: 2654732 - RNA, 17 nt, Escherichia coli CFT073
ggcuggcaacaacgcaa

SEQ ID NO: 2654733 - RNA, 12 nt, Escherichia coli CFT073
ggcuggcacugg

SEQ ID NO: 2654734 - RNA, 14 nt, Escherichia coli CFT073
ggcuggcacuggca

SEQ ID NO: 2654735 - RNA, 20 nt, Escherichia coli CFT073
ggcuggcggcaaucgccaga

SEQ ID NO: 2654736 - RNA, 22 nt, Escherichia coli CFT073
ggcuggguagcuuccugcuguu

SEQ ID NO: 2654737 - RNA, 21 nt, Escherichia coli CFT073
ggcugguaacaguccguggca

SEQ ID NO: 2654738 - RNA, 20 nt, Escherichia coli CFT073
ggcugguagcgauauuucgu

SEQ ID NO: 2654739 - RNA, 16 nt, Escherichia coli CFT073
ggcugucauccagcag

SEQ ID NO: 2654740 - RNA, 17 nt, Escherichia coli CFT073
ggcugucgcacggcgca

SEQ ID NO: 2654741 - RNA, 20 nt, Escherichia coli CFT073
ggcuguugauguccaguucc

SEQ ID NO: 2654742 - RNA, 22 nt, Escherichia coli CFT073
ggcuguugccguauaacgcgau

SEQ ID NO: 2654743 - RNA, 18 nt, Escherichia coli CFT073
ggcuguuuacauggcaga

SEQ ID NO: 2654744 - RNA, 18 nt, Escherichia coli CFT073
ggcuguuuucagcaccag

SEQ ID NO: 2654745 - RNA, 13 nt, Escherichia coli CFT073
ggcuuaauugccc

SEQ ID NO: 2654746 - RNA, 20 nt, Escherichia coli CFT073
ggcuuacgaaguuccugcaa

SEQ ID NO: 2654747 - RNA, 20 nt, Escherichia coli CFT073
ggcuuacguuacccagcacg

SEQ ID NO: 2654748 - RNA, 22 nt, Escherichia coli CFT073
ggcuuauauaggugauaaagua

SEQ ID NO: 2654749 - RNA, 15 nt, Escherichia coli CFT073
ggcuuaucuuccugu

SEQ ID NO: 2654750 - RNA, 18 nt, Escherichia coli CFT073
ggcuucaaccguuucuuu

SEQ ID NO: 2654751 - RNA, 17 nt, Escherichia coli CFT073
ggcuucaauuuuuuccg

SEQ ID NO: 2654752 - RNA, 20 nt, Escherichia coli CFT073
ggcuucacgcccagcacauu

SEQ ID NO: 2654753 - RNA, 20 nt, Escherichia coli CFT073
ggcuucagcgacaucgucac

SEQ ID NO: 2654754 - RNA, 16 nt, Escherichia coli CFT073
ggcuucauccagcagc

SEQ ID NO: 2654755 - RNA, 13 nt, Escherichia coli CFT073
ggcuuccugcagc

SEQ ID NO: 2654756 - RNA, 21 nt, Escherichia coli CFT073
ggcuucuaccuuauccagcag

SEQ ID NO: 2654757 - RNA, 15 nt, Escherichia coli CFT073
ggcuucuucugccgc

SEQ ID NO: 2654758 - RNA, 14 nt, Escherichia coli CFT073
ggcuugcaccagca

SEQ ID NO: 2654759 - RNA, 16 nt, Escherichia coli CFT073
ggcuugcaccagcagc

SEQ ID NO: 2654760 - RNA, 17 nt, Escherichia coli CFT073
ggcuugccagccacaug

SEQ ID NO: 2654761 - RNA, 19 nt, Escherichia coli CFT073
ggcuugcucguuuucaaug

SEQ ID NO: 2654762 - RNA, 12 nt, Escherichia coli CFT073
ggcuuucuucag

SEQ ID NO: 2654763 - RNA, 23 nt, Escherichia coli CFT073
ggcuuucuucuggguugccugau

SEQ ID NO: 2654764 - RNA, 21 nt, Escherichia coli CFT073
ggcuuuguuacccccauccac

SEQ ID NO: 2654765 - RNA, 18 nt, Escherichia coli CFT073
ggcuuuuuuacaucauca

SEQ ID NO: 2654766 - RNA, 19 nt, Escherichia coli CFT073
ggcuuuuuuauugcugcac

SEQ ID NO: 2654767 - RNA, 12 nt, Escherichia coli CFT073
ggcuuuuuucau

SEQ ID NO: 2654768 - RNA, 20 nt, Escherichia coli CFT073
gggaaaacaucgcccggcga

SEQ ID NO: 2654769 - RNA, 14 nt, Escherichia coli CFT073
gggaaacuccagcc

SEQ ID NO: 2654770 - RNA, 16 nt, Escherichia coli CFT073
gggaacagccacaguu

SEQ ID NO: 2654771 - RNA, 14 nt, Escherichia coli CFT073
gggaagaaaccauu

SEQ ID NO: 2654772 - RNA, 17 nt, Escherichia coli CFT073
gggaagaaaccauugca

SEQ ID NO: 2654773 - RNA, 14 nt, Escherichia coli CFT073
gggaagauaaaaac

SEQ ID NO: 2654774 - RNA, 21 nt, Escherichia coli CFT073
gggaagcucucuuccaguucg

SEQ ID NO: 2654775 - RNA, 18 nt, Escherichia coli CFT073
gggucgcgacugccagca

SEQ ID NO: 2654776 - RNA, 23 nt, Escherichia coli CFT073
gggugaacccggcgauugauagc

SEQ ID NO: 2654777 - RNA, 17 nt, Escherichia coli CFT073
gggugaauaaaagaaau

SEQ ID NO: 2654778 - RNA, 22 nt, Escherichia coli CFT073
gggugaauaaaagaaauagcgg

SEQ ID NO: 2654779 - RNA, 19 nt, Escherichia coli CFT073
gggugacgaguccuuccug

SEQ ID NO: 2654780 - RNA, 19 nt, Escherichia coli CFT073
gggugagggcguagagaga

SEQ ID NO: 2654781 - RNA, 19 nt, Escherichia coli CFT073
gggugaucaagcguagugg

SEQ ID NO: 2654782 - RNA, 21 nt, Escherichia coli CFT073
gggugauuucaaaauuaaagc

SEQ ID NO: 2654783 - RNA, 13 nt, Escherichia coli CFT073
ggguggcaaaugc

SEQ ID NO: 2654784 - RNA, 17 nt, Escherichia coli CFT073
gggugugacgacaccug

SEQ ID NO: 2654785 - RNA, 16 nt, Escherichia coli CFT073
ggguguguagcgggug

SEQ ID NO: 2654786 - RNA, 15 nt, Escherichia coli CFT073
ggguguuaagcgcag

SEQ ID NO: 2654787 - RNA, 15 nt, Escherichia coli CFT073
ggguuagccagaaca

SEQ ID NO: 2654788 - RNA, 19 nt, Escherichia coli CFT073
ggguucccgagcggccaaa

SEQ ID NO: 2654789 - RNA, 17 nt, Escherichia coli CFT073
ggguucgacgcgguuga

SEQ ID NO: 2654790 - RNA, 14 nt, Escherichia coli CFT073
ggguugccagcgac

SEQ ID NO: 2654791 - RNA, 13 nt, Escherichia coli CFT073
ggguuuaauaauc

SEQ ID NO: 2654792 - RNA, 19 nt, Escherichia coli CFT073
ggguuuccuggagaguguu

SEQ ID NO: 2654793 - RNA, 16 nt, Escherichia coli CFT073
ggguuuuauuauucca

SEQ ID NO: 2654794 - RNA, 20 nt, Escherichia coli CFT073
gguaaaaccccgcguacuga

SEQ ID NO: 2654795 - RNA, 18 nt, Escherichia coli CFT073
gguaaaaccgacuuaaaa

SEQ ID NO: 2654796 - RNA, 14 nt, Escherichia coli CFT073
gguaaaaccgguuu

SEQ ID NO: 2654797 - RNA, 22 nt, Escherichia coli CFT073
gguaaaacgacuggcccggcga

SEQ ID NO: 2654798 - RNA, 11 nt, Escherichia coli CFT073
gguaaaaggga

SEQ ID NO: 2654799 - RNA, 17 nt, Escherichia coli CFT073
gguaaagcaccugauua

SEQ ID NO: 2654800 - RNA, 19 nt, Escherichia coli CFT073
gguaaagcccaucgccagc

SEQ ID NO: 2654801 - RNA, 14 nt, Escherichia coli CFT073
gguaaagcccucac

SEQ ID NO: 2654802 - RNA, 13 nt, Escherichia coli CFT073
gguaaaugcucau

SEQ ID NO: 2654803 - RNA, 23 nt, Escherichia coli CFT073
gguaacaauaaauucgccagaca

SEQ ID NO: 2654804 - RNA, 22 nt, Escherichia coli CFT073
gguaacaccagagugaccacca

SEQ ID NO: 2654805 - RNA, 14 nt, Escherichia coli CFT073
gguaacaggaagaa

SEQ ID NO: 2654806 - RNA, 22 nt, Escherichia coli CFT073
gguaacugccagggcuuuuuua

SEQ ID NO: 2654807 - RNA, 15 nt, Escherichia coli CFT073
gguaacuucgcugau

SEQ ID NO: 2654808 - RNA, 13 nt, Escherichia coli CFT073
gguaagcaacaga

SEQ ID NO: 2654809 - RNA, 17 nt, Escherichia coli CFT073
gguaagcaugaauauca

SEQ ID NO: 2654810 - RNA, 22 nt, Escherichia coli CFT073
gguaauacuaaucucacccaua

SEQ ID NO: 2654811 - RNA, 15 nt, Escherichia coli CFT073
gguaauaggcaggca

SEQ ID NO: 2654812 - RNA, 21 nt, Escherichia coli CFT073
gguaauauauaacagaagguu

SEQ ID NO: 2654813 - RNA, 15 nt, Escherichia coli CFT073
gguaaucaccaccca

SEQ ID NO: 2654814 - RNA, 13 nt, Escherichia coli CFT073
gguaaucaccagc

SEQ ID NO: 2654815 - RNA, 22 nt, Escherichia coli CFT073
gguaaucaccagcaacacgagg

SEQ ID NO: 2654816 - RNA, 21 nt, Escherichia coli CFT073
gguaaucaucgccuucaucug

SEQ ID NO: 2654817 - RNA, 19 nt, Escherichia coli CFT073
gguaaucgucauugaugcu

SEQ ID NO: 2654818 - RNA, 22 nt, Escherichia coli CFT073
gguaaucucaccgcaggcggca

SEQ ID NO: 2654819 - RNA, 23 nt, Escherichia coli CFT073
gguaaugucucgguagagaaaac

SEQ ID NO: 2654820 - RNA, 11 nt, Escherichia coli CFT073
gguaauucccu

SEQ ID NO: 2654821 - RNA, 20 nt, Escherichia coli CFT073
gguaauugaguuuauagcaa

SEQ ID NO: 2654822 - RNA, 14 nt, Escherichia coli CFT073
gguacaaacaucau

SEQ ID NO: 2654823 - RNA, 13 nt, Escherichia coli CFT073
gguacaaagccaa

SEQ ID NO: 2654824 - RNA, 16 nt, Escherichia coli CFT073
gguacaaagccaacag

SEQ ID NO: 2654825 - RNA, 17 nt, Escherichia coli CFT073
gguacaaagccaacagc

SEQ ID NO: 2654826 - RNA, 23 nt, Escherichia coli CFT073
gguacaaaucuccagaugacugg

SEQ ID NO: 2654827 - RNA, 11 nt, Escherichia coli CFT073
gguaccaggau

SEQ ID NO: 2654828 - RNA, 17 nt, Escherichia coli CFT073
gguaccaugggaaaugg

SEQ ID NO: 2654829 - RNA, 18 nt, Escherichia coli CFT073
gguaccgacugacgcucu

SEQ ID NO: 2654830 - RNA, 22 nt, Escherichia coli CFT073
gguaccgacugacgcucugcuu

SEQ ID NO: 2654831 - RNA, 19 nt, Escherichia coli CFT073
gguaccuuugaacugcuga

SEQ ID NO: 2654832 - RNA, 23 nt, Escherichia coli CFT073
gguacgcgcaccgcgugaugcgg

SEQ ID NO: 2654833 - RNA, 18 nt, Escherichia coli CFT073
gguacguuucgccugcaa

SEQ ID NO: 2654834 - RNA, 15 nt, Escherichia coli CFT073
gguacucaucagaga

SEQ ID NO: 2654835 - RNA, 16 nt, Escherichia coli CFT073
gguacugaccgcgacc

SEQ ID NO: 2654836 - RNA, 17 nt, Escherichia coli CFT073
gguacuguaucgaugcu

SEQ ID NO: 2654837 - RNA, 22 nt, Escherichia coli CFT073
gguacuucaaucgccaccacgu

SEQ ID NO: 2654838 - RNA, 22 nt, Escherichia coli CFT073
gguagacaccaaggaacugugc

SEQ ID NO: 2654839 - RNA, 14 nt, Escherichia coli CFT073
gguagcgauagaaa

SEQ ID NO: 2654840 - RNA, 12 nt, Escherichia coli CFT073
gguagcggguga

SEQ ID NO: 2654841 - RNA, 18 nt, Escherichia coli CFT073
gguagcuggugaacauuu

SEQ ID NO: 2654842 - RNA, 15 nt, Escherichia coli CFT073
gguagggauaucuuc

SEQ ID NO: 2654843 - RNA, 16 nt, Escherichia coli CFT073
gguagucgcgguccgg

SEQ ID NO: 2654844 - RNA, 23 nt, Escherichia coli CFT073
gguagugaggcauagacuuaugc

SEQ ID NO: 2654845 - RNA, 15 nt, Escherichia coli CFT073
gguaguuaaaggugg

SEQ ID NO: 2654846 - RNA, 13 nt, Escherichia coli CFT073
gguauaaggagca

SEQ ID NO: 2654847 - RNA, 17 nt, Escherichia coli CFT073
gguauagaaugcagcag

SEQ ID NO: 2654848 - RNA, 15 nt, Escherichia coli CFT073
gguauagcgcaucac

SEQ ID NO: 2654849 - RNA, 11 nt, Escherichia coli CFT073
gguauaggauu

SEQ ID NO: 2654850 - RNA, 15 nt, Escherichia coli CFT073
gguauaggccaugcu

SEQ ID NO: 2654851 - RNA, 13 nt, Escherichia coli CFT073
gguaucaauacca

SEQ ID NO: 2654852 - RNA, 16 nt, Escherichia coli CFT073
gguaucgccacugcgc

SEQ ID NO: 2654853 - RNA, 17 nt, Escherichia coli CFT073
gguaucgcgaaaaaaaa

SEQ ID NO: 2654854 - RNA, 20 nt, Escherichia coli CFT073
gguauuccacuccagucuuu

SEQ ID NO: 2654855 - RNA, 14 nt, Escherichia coli CFT073
gguauugcagcucu

SEQ ID NO: 2654856 - RNA, 23 nt, Escherichia coli CFT073
gguauuuaaacucgcugcggaca

SEQ ID NO: 2654857 - RNA, 12 nt, Escherichia coli CFT073
gguauuugauau

SEQ ID NO: 2654858 - RNA, 14 nt, Escherichia coli CFT073
ggucaaaagcugca

SEQ ID NO: 2654859 - RNA, 17 nt, Escherichia coli CFT073
ggucaaagugggcgaca

SEQ ID NO: 2654860 - RNA, 17 nt, Escherichia coli CFT073
ggucaaauucaaaugcc

SEQ ID NO: 2654861 - RNA, 15 nt, Escherichia coli CFT073
ggucacaucgcugac

SEQ ID NO: 2654862 - RNA, 12 nt, Escherichia coli CFT073
ggucaccacacc

SEQ ID NO: 2654863 - RNA, 15 nt, Escherichia coli CFT073
ggucaccggaucuuc

SEQ ID NO: 2654864 - RNA, 19 nt, Escherichia coli CFT073
ggucacgguauuaauacuc

SEQ ID NO: 2654865 - RNA, 17 nt, Escherichia coli CFT073
ggucacugacaccagca

SEQ ID NO: 2654866 - RNA, 22 nt, Escherichia coli CFT073
ggucagagagccagccccacag

SEQ ID NO: 2654867 - RNA, 14 nt, Escherichia coli CFT073
ggucagaucagcca

SEQ ID NO: 2654868 - RNA, 15 nt, Escherichia coli CFT073
ggucagcaagaaacu

SEQ ID NO: 2654869 - RNA, 23 nt, Escherichia coli CFT073
ggucagcagcuuucuuuauaucu

SEQ ID NO: 2654870 - RNA, 23 nt, Escherichia coli CFT073
ggucagccacaguugaucagcca

SEQ ID NO: 2654871 - RNA, 13 nt, Escherichia coli CFT073
ggucagcgcacca

SEQ ID NO: 2654872 - RNA, 13 nt, Escherichia coli CFT073
ggucauaugcaaa

SEQ ID NO: 2654873 - RNA, 20 nt, Escherichia coli CFT073
ggucaucgguuaauuccagc

SEQ ID NO: 2654874 - RNA, 20 nt, Escherichia coli CFT073
ggucaugaugcuccgccagc

SEQ ID NO: 2654875 - RNA, 23 nt, Escherichia coli CFT073
ggucauuaaggcauaagcgcguu

SEQ ID NO: 2654876 - RNA, 18 nt, Escherichia coli CFT073
gguccacacgcgcccagc

SEQ ID NO: 2654877 - RNA, 21 nt, Escherichia coli CFT073
gguccaguuuuuaucauaaua

SEQ ID NO: 2654878 - RNA, 17 nt, Escherichia coli CFT073
gguccaucacuugcugc

SEQ ID NO: 2654879 - RNA, 15 nt, Escherichia coli CFT073
ggucccuugcugguc

SEQ ID NO: 2654880 - RNA, 14 nt, Escherichia coli CFT073
gguccgcgaaucuc

SEQ ID NO: 2654881 - RNA, 16 nt, Escherichia coli CFT073
gguccuggcgaucggg

SEQ ID NO: 2654882 - RNA, 12 nt, Escherichia coli CFT073
gguccuucaucu

SEQ ID NO: 2654883 - RNA, 14 nt, Escherichia coli CFT073
ggucgaaaauaauc

SEQ ID NO: 2654884 - RNA, 12 nt, Escherichia coli CFT073
gguuagcguuug

SEQ ID NO: 2654885 - RNA, 19 nt, Escherichia coli CFT073
gguuaggcugagaaccgca

SEQ ID NO: 2654886 - RNA, 23 nt, Escherichia coli CFT073
gguuauagccuuuauuaaugaca

SEQ ID NO: 2654887 - RNA, 14 nt, Escherichia coli CFT073
gguuaucgcccugc

SEQ ID NO: 2654888 - RNA, 11 nt, Escherichia coli CFT073
gguuauugguu

SEQ ID NO: 2654889 - RNA, 23 nt, Escherichia coli CFT073
gguuauuucacuucaaccacauu

SEQ ID NO: 2654890 - RNA, 18 nt, Escherichia coli CFT073
gguucaagauuagccccc

SEQ ID NO: 2654891 - RNA, 15 nt, Escherichia coli CFT073
gguucagcaaccaca

SEQ ID NO: 2654892 - RNA, 19 nt, Escherichia coli CFT073
gguucauugaacgcaaaug

SEQ ID NO: 2654893 - RNA, 16 nt, Escherichia coli CFT073
gguuccacgcccgcac

SEQ ID NO: 2654894 - RNA, 19 nt, Escherichia coli CFT073
gguuccagauauucauaga

SEQ ID NO: 2654895 - RNA, 18 nt, Escherichia coli CFT073
gguucccaacaacagcgc

SEQ ID NO: 2654896 - RNA, 21 nt, Escherichia coli CFT073
gguuccccccacaaucagcca

SEQ ID NO: 2654897 - RNA, 23 nt, Escherichia coli CFT073
gguuccccccacaaucagccaga

SEQ ID NO: 2654898 - RNA, 20 nt, Escherichia coli CFT073
gguuccggcaaucaacagau

SEQ ID NO: 2654899 - RNA, 23 nt, Escherichia coli CFT073
gguuccuuccaguuguuuuugca

SEQ ID NO: 2654900 - RNA, 22 nt, Escherichia coli CFT073
gguucggacauguuuuccagca

SEQ ID NO: 2654901 - RNA, 16 nt, Escherichia coli CFT073
gguucggauaaaugac

SEQ ID NO: 2654902 - RNA, 15 nt, Escherichia coli CFT073
gguucggcgucgccg

SEQ ID NO: 2654903 - RNA, 21 nt, Escherichia coli CFT073
gguucguaagcgauaaccgca

SEQ ID NO: 2654904 - RNA, 16 nt, Escherichia coli CFT073
gguucgucuucgauua

SEQ ID NO: 2654905 - RNA, 22 nt, Escherichia coli CFT073
gguucuccacucugccaggcag

SEQ ID NO: 2654906 - RNA, 23 nt, Escherichia coli CFT073
gguucugcacagcuuaaaaugcu

SEQ ID NO: 2654907 - RNA, 15 nt, Escherichia coli CFT073
gguucuuaccgguga

SEQ ID NO: 2654908 - RNA, 21 nt, Escherichia coli CFT073
gguucuucaucuucaucaucu

SEQ ID NO: 2654909 - RNA, 15 nt, Escherichia coli CFT073
gguugaagaucauga

SEQ ID NO: 2654910 - RNA, 18 nt, Escherichia coli CFT073
gguugaauagucgugcgg

SEQ ID NO: 2654911 - RNA, 14 nt, Escherichia coli CFT073
gguugacgccccug

SEQ ID NO: 2654912 - RNA, 13 nt, Escherichia coli CFT073
gguugaggaacuu

SEQ ID NO: 2654913 - RNA, 19 nt, Escherichia coli CFT073
gguugaggaacuuccagcc

SEQ ID NO: 2654914 - RNA, 22 nt, Escherichia coli CFT073
gguugaggugcugaagggcauc

SEQ ID NO: 2654915 - RNA, 18 nt, Escherichia coli CFT073
gguugaucaauucgagca

SEQ ID NO: 2654916 - RNA, 17 nt, Escherichia coli CFT073
gguugaugccggaugcg

SEQ ID NO: 2654917 - RNA, 22 nt, Escherichia coli CFT073
gguugauuuuuuugauaaaccu

SEQ ID NO: 2654918 - RNA, 22 nt, Escherichia coli CFT073
gguugcaaucuuucgaguaaau

SEQ ID NO: 2654919 - RNA, 20 nt, Escherichia coli CFT073
gguugcacggaauaaucggg

SEQ ID NO: 2654920 - RNA, 20 nt, Escherichia coli CFT073
gguugcagaucuuucugcag

SEQ ID NO: 2654921 - RNA, 17 nt, Escherichia coli CFT073
gguugcaguaacugcug

SEQ ID NO: 2654922 - RNA, 14 nt, Escherichia coli CFT073
gguugccagcgaca

SEQ ID NO: 2654923 - RNA, 23 nt, Escherichia coli CFT073
gguugccagcgacagaaaucaga

SEQ ID NO: 2654924 - RNA, 16 nt, Escherichia coli CFT073
gguugccguccagcgc

SEQ ID NO: 2654925 - RNA, 18 nt, Escherichia coli CFT073
gguugccguccagcgccu

SEQ ID NO: 2654926 - RNA, 18 nt, Escherichia coli CFT073
gguugcgucuuaucaggc

SEQ ID NO: 2654927 - RNA, 15 nt, Escherichia coli CFT073
gguuggaauugaagc

SEQ ID NO: 2654928 - RNA, 17 nt, Escherichia coli CFT073
gguuggcccgauagaca

SEQ ID NO: 2654929 - RNA, 12 nt, Escherichia coli CFT073
gguuggcgcugu

SEQ ID NO: 2654930 - RNA, 13 nt, Escherichia coli CFT073
gguuggcgugcgg

SEQ ID NO: 2654931 - RNA, 14 nt, Escherichia coli CFT073
gguuguuaagggau

SEQ ID NO: 2654932 - RNA, 14 nt, Escherichia coli CFT073
gguuguuauuuccg

SEQ ID NO: 2654933 - RNA, 23 nt, Escherichia coli CFT073
gguuuaagacaauauaauaagaa

SEQ ID NO: 2654934 - RNA, 15 nt, Escherichia coli CFT073
gguuuaauaaucgca

SEQ ID NO: 2654935 - RNA, 19 nt, Escherichia coli CFT073
gguuuauggaggguggcac

SEQ ID NO: 2654936 - RNA, 23 nt, Escherichia coli CFT073
gguuucaaagauuuuaccaaugg

SEQ ID NO: 2654937 - RNA, 20 nt, Escherichia coli CFT073
gguuucaaauuacgauccac

SEQ ID NO: 2654938 - RNA, 14 nt, Escherichia coli CFT073
gguuucaaccagca

SEQ ID NO: 2654939 - RNA, 15 nt, Escherichia coli CFT073
gguuucaaccagcag

SEQ ID NO: 2654940 - RNA, 16 nt, Escherichia coli CFT073
gguuucaauccaggua

SEQ ID NO: 2654941 - RNA, 18 nt, Escherichia coli CFT073
gguuucacguaccagaug

SEQ ID NO: 2654942 - RNA, 19 nt, Escherichia coli CFT073
gguuucacguaccagaugc

SEQ ID NO: 2654943 - RNA, 16 nt, Escherichia coli CFT073
gguuucacuaagaugu

SEQ ID NO: 2654944 - RNA, 13 nt, Escherichia coli CFT073
gguuucagccagg

SEQ ID NO: 2654945 - RNA, 18 nt, Escherichia coli CFT073
gguuucccggcaaucgcc

SEQ ID NO: 2654946 - RNA, 16 nt, Escherichia coli CFT073
gguuucccggguaaac

SEQ ID NO: 2654947 - RNA, 17 nt, Escherichia coli CFT073
gguuuccggaucgccaa

SEQ ID NO: 2654948 - RNA, 23 nt, Escherichia coli CFT073
gguuucgaacugaugugcggaag

SEQ ID NO: 2654949 - RNA, 15 nt, Escherichia coli CFT073
gguuucgaccacacc

SEQ ID NO: 2654950 - RNA, 18 nt, Escherichia coli CFT073
gguuucggaugggcugau

SEQ ID NO: 2654951 - RNA, 14 nt, Escherichia coli CFT073
gguuucuuuauccg

SEQ ID NO: 2654952 - RNA, 14 nt, Escherichia coli CFT073
gguuugaaaauggc

SEQ ID NO: 2654953 - RNA, 19 nt, Escherichia coli CFT073
gguuugacauaaauuccgc

SEQ ID NO: 2654954 - RNA, 14 nt, Escherichia coli CFT073
gguuugccagcaga

SEQ ID NO: 2654955 - RNA, 13 nt, Escherichia coli CFT073
gguuuguaggccg

SEQ ID NO: 2654956 - RNA, 15 nt, Escherichia coli CFT073
gguuuguaggccgga

SEQ ID NO: 2654957 - RNA, 11 nt, Escherichia coli CFT073
gguuuuaucca

SEQ ID NO: 2654958 - RNA, 14 nt, Escherichia coli CFT073
gguuuuccagaacc

SEQ ID NO: 2654959 - RNA, 18 nt, Escherichia coli CFT073
gguuuucugucuuaacgc

SEQ ID NO: 2654960 - RNA, 22 nt, Escherichia coli CFT073
gguuuuuugaacagaccacauu

SEQ ID NO: 2654961 - RNA, 16 nt, Escherichia coli CFT073
guaaaaaaucccagcg

SEQ ID NO: 2654962 - RNA, 19 nt, Escherichia coli CFT073
guaaaaccccgcguacuga

SEQ ID NO: 2654963 - RNA, 21 nt, Escherichia coli CFT073
guaaaaccgacuuaaaaggaa

SEQ ID NO: 2654964 - RNA, 12 nt, Escherichia coli CFT073
guaaaaccugcc

SEQ ID NO: 2654965 - RNA, 21 nt, Escherichia coli CFT073
guaaaacgggcgcgaugacag

SEQ ID NO: 2654966 - RNA, 20 nt, Escherichia coli CFT073
guaaaacgguggccacagca

SEQ ID NO: 2654967 - RNA, 14 nt, Escherichia coli CFT073
guaaaacugcauuu

SEQ ID NO: 2654968 - RNA, 19 nt, Escherichia coli CFT073
guaaaagccauucuggcgc

SEQ ID NO: 2654969 - RNA, 16 nt, Escherichia coli CFT073
guaaaagcgcauuuau

SEQ ID NO: 2654970 - RNA, 20 nt, Escherichia coli CFT073
guaaaaguagggcgcugcca

SEQ ID NO: 2654971 - RNA, 12 nt, Escherichia coli CFT073
guaaaauacugg

SEQ ID NO: 2654972 - RNA, 19 nt, Escherichia coli CFT073
guaaacaagacaucacuca

SEQ ID NO: 2654973 - RNA, 15 nt, Escherichia coli CFT073
guaaacacccaggcc

SEQ ID NO: 2654974 - RNA, 18 nt, Escherichia coli CFT073
guaaacacccaucgccgu

SEQ ID NO: 2654975 - RNA, 16 nt, Escherichia coli CFT073
guaaacagggggaggc

SEQ ID NO: 2654976 - RNA, 11 nt, Escherichia coli CFT073
guaaacaucag

SEQ ID NO: 2654977 - RNA, 13 nt, Escherichia coli CFT073
guaaacaucaucc

SEQ ID NO: 2654978 - RNA, 21 nt, Escherichia coli CFT073
guaaacaucuucuuaggcauu

SEQ ID NO: 2654979 - RNA, 13 nt, Escherichia coli CFT073
guaaaccaaccag

SEQ ID NO: 2654980 - RNA, 16 nt, Escherichia coli CFT073
guaaaccacaucagcg

SEQ ID NO: 2654981 - RNA, 18 nt, Escherichia coli CFT073
guaaaccacccaccagcg

SEQ ID NO: 2654982 - RNA, 22 nt, Escherichia coli CFT073
guaaaccacccaccagcgccga

SEQ ID NO: 2654983 - RNA, 23 nt, Escherichia coli CFT073
guaaaccacugacacaggcagca

SEQ ID NO: 2654984 - RNA, 19 nt, Escherichia coli CFT073
guaaaccgcucgucacauc

SEQ ID NO: 2654985 - RNA, 17 nt, Escherichia coli CFT073
guaaaccguuaucacca

SEQ ID NO: 2654986 - RNA, 15 nt, Escherichia coli CFT073
guaaacgccagggca

SEQ ID NO: 2654987 - RNA, 19 nt, Escherichia coli CFT073
guaaacgccuuauccgacu

SEQ ID NO: 2654988 - RNA, 17 nt, Escherichia coli CFT073
guaaacgugcggcugug

SEQ ID NO: 2654989 - RNA, 16 nt, Escherichia coli CFT073
guaaacuucaacgcug

SEQ ID NO: 2654990 - RNA, 22 nt, Escherichia coli CFT073
guaaacuuuagcacaaucgcau

SEQ ID NO: 2654991 - RNA, 17 nt, Escherichia coli CFT073
guaaagaccauaaugau

SEQ ID NO: 2654992 - RNA, 14 nt, Escherichia coli CFT073
guaaugaaucagca

SEQ ID NO: 2654993 - RNA, 15 nt, Escherichia coli CFT073
guaaugaaucagcag

SEQ ID NO: 2654994 - RNA, 16 nt, Escherichia coli CFT073
guaaugaaucagcaga

SEQ ID NO: 2654995 - RNA, 17 nt, Escherichia coli CFT073
guaaugaaucagcagau

SEQ ID NO: 2654996 - RNA, 16 nt, Escherichia coli CFT073
guaaugcacuccgccg

SEQ ID NO: 2654997 - RNA, 18 nt, Escherichia coli CFT073
guaaugcacuccgccgca

SEQ ID NO: 2654998 - RNA, 15 nt, Escherichia coli CFT073
guaaugccuuuucca

SEQ ID NO: 2654999 - RNA, 14 nt, Escherichia coli CFT073
guaauggagauugu

SEQ ID NO: 2655000 - RNA, 15 nt, Escherichia coli CFT073
guaaugggaucgaaa

SEQ ID NO: 2655001 - RNA, 22 nt, Escherichia coli CFT073
guaauggggcgaucucacgucc

SEQ ID NO: 2655002 - RNA, 14 nt, Escherichia coli CFT073
guaauguccauaua

SEQ ID NO: 2655003 - RNA, 19 nt, Escherichia coli CFT073
guaauguccauauauaaaa

SEQ ID NO: 2655004 - RNA, 21 nt, Escherichia coli CFT073
guaaugucggugaaaguaacu

SEQ ID NO: 2655005 - RNA, 22 nt, Escherichia coli CFT073
guaaugucucgguagagaaaac

SEQ ID NO: 2655006 - RNA, 19 nt, Escherichia coli CFT073
guaauuaaauuaucaacua

SEQ ID NO: 2655007 - RNA, 17 nt, Escherichia coli CFT073
guaauuaguggcuaacc

SEQ ID NO: 2655008 - RNA, 20 nt, Escherichia coli CFT073
guaauuauucccgcgcuacc

SEQ ID NO: 2655009 - RNA, 20 nt, Escherichia coli CFT073
guaauucaccguucaauucc

SEQ ID NO: 2655010 - RNA, 16 nt, Escherichia coli CFT073
guaauuccccggcuuu

SEQ ID NO: 2655011 - RNA, 20 nt, Escherichia coli CFT073
guaauugacgccaucaacga

SEQ ID NO: 2655012 - RNA, 17 nt, Escherichia coli CFT073
guaauugaucucacaau

SEQ ID NO: 2655013 - RNA, 19 nt, Escherichia coli CFT073
guaauugcgaaccuucggg

SEQ ID NO: 2655014 - RNA, 15 nt, Escherichia coli CFT073
guaauuguucgcuuu

SEQ ID NO: 2655015 - RNA, 21 nt, Escherichia coli CFT073
guaauuucacaccaucaacaa

SEQ ID NO: 2655016 - RNA, 23 nt, Escherichia coli CFT073
guaauuugccguuaaucccagac

SEQ ID NO: 2655017 - RNA, 16 nt, Escherichia coli CFT073
guacaaagccaacagc

SEQ ID NO: 2655018 - RNA, 20 nt, Escherichia coli CFT073
guacaaagugccgccagcuu

SEQ ID NO: 2655019 - RNA, 23 nt, Escherichia coli CFT073
guacaauauuaauuacuucucuu

SEQ ID NO: 2655020 - RNA, 23 nt, Escherichia coli CFT073
guacaauggagcuaaacagagcu

SEQ ID NO: 2655021 - RNA, 16 nt, Escherichia coli CFT073
guacacaaccgccgga

SEQ ID NO: 2655022 - RNA, 11 nt, Escherichia coli CFT073
guacaccaaca

SEQ ID NO: 2655023 - RNA, 12 nt, Escherichia coli CFT073
guacaccaacau

SEQ ID NO: 2655024 - RNA, 14 nt, Escherichia coli CFT073
guacaccaacauca

SEQ ID NO: 2655025 - RNA, 15 nt, Escherichia coli CFT073
guacaccaacaucac

SEQ ID NO: 2655026 - RNA, 17 nt, Escherichia coli CFT073
guacaccaacaucacgu

SEQ ID NO: 2655027 - RNA, 14 nt, Escherichia coli CFT073
guacacccgccaga

SEQ ID NO: 2655028 - RNA, 12 nt, Escherichia coli CFT073
guacaccgcagc

SEQ ID NO: 2655029 - RNA, 13 nt, Escherichia coli CFT073
guacaccugcugu

SEQ ID NO: 2655030 - RNA, 20 nt, Escherichia coli CFT073
guacacgcugaagaucuuca

SEQ ID NO: 2655031 - RNA, 18 nt, Escherichia coli CFT073
guacagagggcaggcaac

SEQ ID NO: 2655032 - RNA, 16 nt, Escherichia coli CFT073
guacagcccgccggaa

SEQ ID NO: 2655033 - RNA, 15 nt, Escherichia coli CFT073
guacagccgccagac

SEQ ID NO: 2655034 - RNA, 18 nt, Escherichia coli CFT073
guacaggauauauuucau

SEQ ID NO: 2655035 - RNA, 20 nt, Escherichia coli CFT073
guacaggauauauuucauca

SEQ ID NO: 2655036 - RNA, 21 nt, Escherichia coli CFT073
guacaggauauauuucaucaa

SEQ ID NO: 2655037 - RNA, 12 nt, Escherichia coli CFT073
guacaggcggca

SEQ ID NO: 2655038 - RNA, 16 nt, Escherichia coli CFT073
guacaguaccgaacgg

SEQ ID NO: 2655039 - RNA, 15 nt, Escherichia coli CFT073
guacaguacugggau

SEQ ID NO: 2655040 - RNA, 23 nt, Escherichia coli CFT073
guacagucacccgcugcgaacac

SEQ ID NO: 2655041 - RNA, 13 nt, Escherichia coli CFT073
guacaguuuccuu

SEQ ID NO: 2655042 - RNA, 15 nt, Escherichia coli CFT073
guacaguuuccuucu

SEQ ID NO: 2655043 - RNA, 21 nt, Escherichia coli CFT073
guacaucacgauuuuuccgcu

SEQ ID NO: 2655044 - RNA, 16 nt, Escherichia coli CFT073
guacaugguaauaaug

SEQ ID NO: 2655045 - RNA, 21 nt, Escherichia coli CFT073
guacauucggcguuaacaaua

SEQ ID NO: 2655046 - RNA, 20 nt, Escherichia coli CFT073
guacauugccgggcgcauca

SEQ ID NO: 2655047 - RNA, 15 nt, Escherichia coli CFT073
guacauuguuuucca

SEQ ID NO: 2655048 - RNA, 20 nt, Escherichia coli CFT073
guaccaaagccucaaugcug

SEQ ID NO: 2655049 - RNA, 22 nt, Escherichia coli CFT073
guaccaaagccucaaugcugaa

SEQ ID NO: 2655050 - RNA, 16 nt, Escherichia coli CFT073
guaccaccgcgaaaac

SEQ ID NO: 2655051 - RNA, 20 nt, Escherichia coli CFT073
guaccacgcaaagcacgcca

SEQ ID NO: 2655052 - RNA, 18 nt, Escherichia coli CFT073
guaccacgguucgcuggc

SEQ ID NO: 2655053 - RNA, 20 nt, Escherichia coli CFT073
guaccagaccaacauaguua

SEQ ID NO: 2655054 - RNA, 17 nt, Escherichia coli CFT073
guaccagacgcgggcaa

SEQ ID NO: 2655055 - RNA, 12 nt, Escherichia coli CFT073
guaccagacuga

SEQ ID NO: 2655056 - RNA, 19 nt, Escherichia coli CFT073
guaccagacugacauguua

SEQ ID NO: 2655057 - RNA, 14 nt, Escherichia coli CFT073
guaccagaugcauu

SEQ ID NO: 2655058 - RNA, 14 nt, Escherichia coli CFT073
guaccagcccgccg

SEQ ID NO: 2655059 - RNA, 17 nt, Escherichia coli CFT073
guaccaggcaauaaaca

SEQ ID NO: 2655060 - RNA, 19 nt, Escherichia coli CFT073
guaccaggcaauaaacauc

SEQ ID NO: 2655061 - RNA, 14 nt, Escherichia coli CFT073
guaccaggcauauu

SEQ ID NO: 2655062 - RNA, 20 nt, Escherichia coli CFT073
guaccaggcauauucaccgu

SEQ ID NO: 2655063 - RNA, 20 nt, Escherichia coli CFT073
guaccagugcagaugcacaa

SEQ ID NO: 2655064 - RNA, 14 nt, Escherichia coli CFT073
guaccaucgccagc

SEQ ID NO: 2655065 - RNA, 18 nt, Escherichia coli CFT073
guaccaucguccagcagc

SEQ ID NO: 2655066 - RNA, 19 nt, Escherichia coli CFT073
guaccaucguccagcagca

SEQ ID NO: 2655067 - RNA, 14 nt, Escherichia coli CFT073
guacccaaucagcg

SEQ ID NO: 2655068 - RNA, 19 nt, Escherichia coli CFT073
guacccgcugcaacucuuu

SEQ ID NO: 2655069 - RNA, 17 nt, Escherichia coli CFT073
guaccgacgaucaacag

SEQ ID NO: 2655070 - RNA, 16 nt, Escherichia coli CFT073
guaccgagauaacguu

SEQ ID NO: 2655071 - RNA, 15 nt, Escherichia coli CFT073
guaccgcagccggaa

SEQ ID NO: 2655072 - RNA, 20 nt, Escherichia coli CFT073
guaccgccagugcagcgaag

SEQ ID NO: 2655073 - RNA, 22 nt, Escherichia coli CFT073
guaccgccgccauaaacagcag

SEQ ID NO: 2655074 - RNA, 17 nt, Escherichia coli CFT073
guaccggcguuucacau

SEQ ID NO: 2655075 - RNA, 23 nt, Escherichia coli CFT073
guaccuggccccuggcuggucag

SEQ ID NO: 2655076 - RNA, 19 nt, Escherichia coli CFT073
guaccuguugugcgcggcu

SEQ ID NO: 2655077 - RNA, 15 nt, Escherichia coli CFT073
guaccuucagcggca

SEQ ID NO: 2655078 - RNA, 19 nt, Escherichia coli CFT073
guaccuucguccaucccac

SEQ ID NO: 2655079 - RNA, 16 nt, Escherichia coli CFT073
guacgaccgcaaaggu

SEQ ID NO: 2655080 - RNA, 18 nt, Escherichia coli CFT073
guacgauaauggcuucca

SEQ ID NO: 2655081 - RNA, 13 nt, Escherichia coli CFT073
guacgcaggcggc

SEQ ID NO: 2655082 - RNA, 15 nt, Escherichia coli CFT073
guacgcaggcggcug

SEQ ID NO: 2655083 - RNA, 18 nt, Escherichia coli CFT073
guacgcauccccagcgca

SEQ ID NO: 2655084 - RNA, 14 nt, Escherichia coli CFT073
guacgccaaucugc

SEQ ID NO: 2655085 - RNA, 17 nt, Escherichia coli CFT073
guacgccaaucugcaaa

SEQ ID NO: 2655086 - RNA, 13 nt, Escherichia coli CFT073
guacgccuucacg

SEQ ID NO: 2655087 - RNA, 21 nt, Escherichia coli CFT073
guacgcgcccguagucggugc

SEQ ID NO: 2655088 - RNA, 21 nt, Escherichia coli CFT073
guacgcggacacuuuccugcu

SEQ ID NO: 2655089 - RNA, 21 nt, Escherichia coli CFT073
guacgcggcaauccccgccag

SEQ ID NO: 2655090 - RNA, 23 nt, Escherichia coli CFT073
guacgcuaucguguugcugugca

SEQ ID NO: 2655091 - RNA, 16 nt, Escherichia coli CFT073
guacgcuuucacccgg

SEQ ID NO: 2655092 - RNA, 18 nt, Escherichia coli CFT073
guacgcuuuguccagugc

SEQ ID NO: 2655093 - RNA, 12 nt, Escherichia coli CFT073
guacggaauaag

SEQ ID NO: 2655094 - RNA, 21 nt, Escherichia coli CFT073
guacggcccauaacccacacc

SEQ ID NO: 2655095 - RNA, 17 nt, Escherichia coli CFT073
guacggcuucgaucagg

SEQ ID NO: 2655096 - RNA, 18 nt, Escherichia coli CFT073
guacgguacugaaaccug

SEQ ID NO: 2655097 - RNA, 19 nt, Escherichia coli CFT073
guacgguacugaaaccuga

SEQ ID NO: 2655098 - RNA, 13 nt, Escherichia coli CFT073
guacguaaaacaa

SEQ ID NO: 2655099 - RNA, 20 nt, Escherichia coli CFT073
guacguaaaacaagaucgcc

SEQ ID NO: 2655100 - RNA, 21 nt, Escherichia coli CFT073
guaucacuggccucuucucuc

SEQ ID NO: 2655101 - RNA, 18 nt, Escherichia coli CFT073
guaucagggcgaaacaga

SEQ ID NO: 2655102 - RNA, 21 nt, Escherichia coli CFT073
guaucaucgcugaacgggcca

SEQ ID NO: 2655103 - RNA, 22 nt, Escherichia coli CFT073
guaucaugcaguaccagauaau

SEQ ID NO: 2655104 - RNA, 21 nt, Escherichia coli CFT073
guauccaccgacacuacaaau

SEQ ID NO: 2655105 - RNA, 21 nt, Escherichia coli CFT073
guauccacucggcacauagac

SEQ ID NO: 2655106 - RNA, 13 nt, Escherichia coli CFT073
guaucccagugca

SEQ ID NO: 2655107 - RNA, 22 nt, Escherichia coli CFT073
guauccgcuauugaccagcgcc

SEQ ID NO: 2655108 - RNA, 23 nt, Escherichia coli CFT073
guauccgcuauugaccagcgccg

SEQ ID NO: 2655109 - RNA, 16 nt, Escherichia coli CFT073
guauccggcaugaaca

SEQ ID NO: 2655110 - RNA, 22 nt, Escherichia coli CFT073
guauccggcaugaacaaaacau

SEQ ID NO: 2655111 - RNA, 13 nt, Escherichia coli CFT073
guauccggcucau

SEQ ID NO: 2655112 - RNA, 15 nt, Escherichia coli CFT073
guauccgggcaucca

SEQ ID NO: 2655113 - RNA, 14 nt, Escherichia coli CFT073
guauccuguuuuua

SEQ ID NO: 2655114 - RNA, 15 nt, Escherichia coli CFT073
guauccuguuuuuaa

SEQ ID NO: 2655115 - RNA, 14 nt, Escherichia coli CFT073
guaucgaaaacauc

SEQ ID NO: 2655116 - RNA, 20 nt, Escherichia coli CFT073
guaucgaacguuuucaccac

SEQ ID NO: 2655117 - RNA, 16 nt, Escherichia coli CFT073
guaucgaccacuaaca

SEQ ID NO: 2655118 - RNA, 17 nt, Escherichia coli CFT073
guaucgaguggcgcagu

SEQ ID NO: 2655119 - RNA, 23 nt, Escherichia coli CFT073
guaucgccacugcgccacgggcu

SEQ ID NO: 2655120 - RNA, 16 nt, Escherichia coli CFT073
guaucgcgaaaaaaaa

SEQ ID NO: 2655121 - RNA, 14 nt, Escherichia coli CFT073
guaucugaaguaaa

SEQ ID NO: 2655122 - RNA, 19 nt, Escherichia coli CFT073
guaucuggcguuaaaacca

SEQ ID NO: 2655123 - RNA, 17 nt, Escherichia coli CFT073
guaucuucaugcuccag

SEQ ID NO: 2655124 - RNA, 22 nt, Escherichia coli CFT073
guaucuucgccguguucuuacc

SEQ ID NO: 2655125 - RNA, 14 nt, Escherichia coli CFT073
guaucuuucaucau

SEQ ID NO: 2655126 - RNA, 14 nt, Escherichia coli CFT073
guaucuuuccagcc

SEQ ID NO: 2655127 - RNA, 20 nt, Escherichia coli CFT073
guaucuuuccagccucuguc

SEQ ID NO: 2655128 - RNA, 23 nt, Escherichia coli CFT073
guaucuuugccaggucgcuugcc

SEQ ID NO: 2655129 - RNA, 15 nt, Escherichia coli CFT073
guaugacaaaagaau

SEQ ID NO: 2655130 - RNA, 21 nt, Escherichia coli CFT073
guaugcacacggaucugauga

SEQ ID NO: 2655131 - RNA, 16 nt, Escherichia coli CFT073
guaugcagccaggcca

SEQ ID NO: 2655132 - RNA, 17 nt, Escherichia coli CFT073
guaugcagccaggccau

SEQ ID NO: 2655133 - RNA, 14 nt, Escherichia coli CFT073
guaugcgcgucaga

SEQ ID NO: 2655134 - RNA, 15 nt, Escherichia coli CFT073
guauggaaaucaccc

SEQ ID NO: 2655135 - RNA, 14 nt, Escherichia coli CFT073
guaugggaucccgu

SEQ ID NO: 2655136 - RNA, 19 nt, Escherichia coli CFT073
guauguaauuaaacagccc

SEQ ID NO: 2655137 - RNA, 21 nt, Escherichia coli CFT073
guauguaauuaaacagcccuu

SEQ ID NO: 2655138 - RNA, 14 nt, Escherichia coli CFT073
guauguuauagagu

SEQ ID NO: 2655139 - RNA, 13 nt, Escherichia coli CFT073
guauguucagaaa

SEQ ID NO: 2655140 - RNA, 18 nt, Escherichia coli CFT073
guauuaaaugucaugaca

SEQ ID NO: 2655141 - RNA, 16 nt, Escherichia coli CFT073
guauuaagccaguucu

SEQ ID NO: 2655142 - RNA, 22 nt, Escherichia coli CFT073
guauuaauuugccagcguaaau

SEQ ID NO: 2655143 - RNA, 22 nt, Escherichia coli CFT073
guauuacgguaaggauauucau

SEQ ID NO: 2655144 - RNA, 17 nt, Escherichia coli CFT073
guauuaguuaaaugauu

SEQ ID NO: 2655145 - RNA, 23 nt, Escherichia coli CFT073
guauuaucggcgcagagcccggg

SEQ ID NO: 2655146 - RNA, 20 nt, Escherichia coli CFT073
guauuauugaugcuuuucaa

SEQ ID NO: 2655147 - RNA, 23 nt, Escherichia coli CFT073
guauucacuuucaaauccagcca

SEQ ID NO: 2655148 - RNA, 16 nt, Escherichia coli CFT073
guauucagaucagcgg

SEQ ID NO: 2655149 - RNA, 20 nt, Escherichia coli CFT073
guauucagaucagcggccag

SEQ ID NO: 2655150 - RNA, 17 nt, Escherichia coli CFT073
guauucaugcccugccc

SEQ ID NO: 2655151 - RNA, 19 nt, Escherichia coli CFT073
guauucaugcccugcccgc

SEQ ID NO: 2655152 - RNA, 22 nt, Escherichia coli CFT073
guauucaugcccugcccgcugc

SEQ ID NO: 2655153 - RNA, 16 nt, Escherichia coli CFT073
guauucgcuaaucggu

SEQ ID NO: 2655154 - RNA, 22 nt, Escherichia coli CFT073
guauucuuugaucgccgccagc

SEQ ID NO: 2655155 - RNA, 12 nt, Escherichia coli CFT073
guauugaaucgg

SEQ ID NO: 2655156 - RNA, 20 nt, Escherichia coli CFT073
guauugcuaagcucucagca

SEQ ID NO: 2655157 - RNA, 21 nt, Escherichia coli CFT073
guauugucauauaauguaucu

SEQ ID NO: 2655158 - RNA, 21 nt, Escherichia coli CFT073
guauuguuagcaauccagcua

SEQ ID NO: 2655159 - RNA, 15 nt, Escherichia coli CFT073
guauuuaaacuucac

SEQ ID NO: 2655160 - RNA, 20 nt, Escherichia coli CFT073
guauuuagcccuucaugcac

SEQ ID NO: 2655161 - RNA, 21 nt, Escherichia coli CFT073
guauuuagcccuucaugcacu

SEQ ID NO: 2655162 - RNA, 14 nt, Escherichia coli CFT073
guauuuauggauga

SEQ ID NO: 2655163 - RNA, 14 nt, Escherichia coli CFT073
guauuucacuguuc

SEQ ID NO: 2655164 - RNA, 12 nt, Escherichia coli CFT073
guauuuccaggg

SEQ ID NO: 2655165 - RNA, 13 nt, Escherichia coli CFT073
guauuuccagggc

SEQ ID NO: 2655166 - RNA, 11 nt, Escherichia coli CFT073
guauuugauac

SEQ ID NO: 2655167 - RNA, 19 nt, Escherichia coli CFT073
guauuuguuuucggucagc

SEQ ID NO: 2655168 - RNA, 15 nt, Escherichia coli CFT073
guauuuuuccagcuc

SEQ ID NO: 2655169 - RNA, 18 nt, Escherichia coli CFT073
guauuuuuuccgcacguu

SEQ ID NO: 2655170 - RNA, 16 nt, Escherichia coli CFT073
gucaaaacuuuucacc

SEQ ID NO: 2655171 - RNA, 20 nt, Escherichia coli CFT073
gucaaaacuuuucaccagcg

SEQ ID NO: 2655172 - RNA, 18 nt, Escherichia coli CFT073
gucaaacauugagcuuug

SEQ ID NO: 2655173 - RNA, 18 nt, Escherichia coli CFT073
gucaaacguaccgccaga

SEQ ID NO: 2655174 - RNA, 23 nt, Escherichia coli CFT073
gucaaacucauaaaccagcggca

SEQ ID NO: 2655175 - RNA, 23 nt, Escherichia coli CFT073
gucaaagauauuauuaaaugcug

SEQ ID NO: 2655176 - RNA, 14 nt, Escherichia coli CFT073
gucaaagcgccagc

SEQ ID NO: 2655177 - RNA, 17 nt, Escherichia coli CFT073
gucaaauacgccggguu

SEQ ID NO: 2655178 - RNA, 22 nt, Escherichia coli CFT073
gucaacaaacguucauacgcaa

SEQ ID NO: 2655179 - RNA, 12 nt, Escherichia coli CFT073
gucaacaaccag

SEQ ID NO: 2655180 - RNA, 17 nt, Escherichia coli CFT073
gucaacaauccauucau

SEQ ID NO: 2655181 - RNA, 20 nt, Escherichia coli CFT073
gucaacaccagggaaauaau

SEQ ID NO: 2655182 - RNA, 12 nt, Escherichia coli CFT073
gucaacagggca

SEQ ID NO: 2655183 - RNA, 14 nt, Escherichia coli CFT073
gucaacagggcaga

SEQ ID NO: 2655184 - RNA, 18 nt, Escherichia coli CFT073
gucaacaguucaugguua

SEQ ID NO: 2655185 - RNA, 18 nt, Escherichia coli CFT073
gucaaccacucaccgcug

SEQ ID NO: 2655186 - RNA, 19 nt, Escherichia coli CFT073
gucaacccaaccugccaga

SEQ ID NO: 2655187 - RNA, 15 nt, Escherichia coli CFT073
gucaaccugaccaaa

SEQ ID NO: 2655188 - RNA, 13 nt, Escherichia coli CFT073
gucaacgcugcca

SEQ ID NO: 2655189 - RNA, 15 nt, Escherichia coli CFT073
gucaacuccgucgcg

SEQ ID NO: 2655190 - RNA, 20 nt, Escherichia coli CFT073
gucaagaaggauauaaaaau

SEQ ID NO: 2655191 - RNA, 21 nt, Escherichia coli CFT073
gucaagaaggauauaaaaaua

SEQ ID NO: 2655192 - RNA, 19 nt, Escherichia coli CFT073
gucaagccaccgccgcuac

SEQ ID NO: 2655193 - RNA, 17 nt, Escherichia coli CFT073
gucaagcgguaaccauc

SEQ ID NO: 2655194 - RNA, 22 nt, Escherichia coli CFT073
gucaagcgguaaccauccauau

SEQ ID NO: 2655195 - RNA, 15 nt, Escherichia coli CFT073
gucaaggaaugaaau

SEQ ID NO: 2655196 - RNA, 19 nt, Escherichia coli CFT073
gucaaggugauuuuacccc

SEQ ID NO: 2655197 - RNA, 21 nt, Escherichia coli CFT073
gucaaguuaagcauuggcaug

SEQ ID NO: 2655198 - RNA, 14 nt, Escherichia coli CFT073
gucaauaaacgccu

SEQ ID NO: 2655199 - RNA, 15 nt, Escherichia coli CFT073
gucaauaauuucuca

SEQ ID NO: 2655200 - RNA, 20 nt, Escherichia coli CFT073
gucaauaguuacgaaaagga

SEQ ID NO: 2655201 - RNA, 19 nt, Escherichia coli CFT073
gucaauaucaucgauuuuc

SEQ ID NO: 2655202 - RNA, 16 nt, Escherichia coli CFT073
gucaauauccagcagg

SEQ ID NO: 2655203 - RNA, 19 nt, Escherichia coli CFT073
gucaaucacacugacuuua

SEQ ID NO: 2655204 - RNA, 13 nt, Escherichia coli CFT073
gucaaucacuuuc

SEQ ID NO: 2655205 - RNA, 12 nt, Escherichia coli CFT073
gucaaucccagg

SEQ ID NO: 2655206 - RNA, 13 nt, Escherichia coli CFT073
gucaauccuucuu

SEQ ID NO: 2655207 - RNA, 18 nt, Escherichia coli CFT073
gucaaucugcccgaccag

SEQ ID NO: 2655208 - RNA, 13 nt, Escherichia coli CFT073
gucaucagucaga

SEQ ID NO: 2655209 - RNA, 16 nt, Escherichia coli CFT073
gucaucauauugucug

SEQ ID NO: 2655210 - RNA, 22 nt, Escherichia coli CFT073
gucaucaucgcucccaaaccgc

SEQ ID NO: 2655211 - RNA, 22 nt, Escherichia coli CFT073
gucaucauugguuaacuccagc

SEQ ID NO: 2655212 - RNA, 21 nt, Escherichia coli CFT073
gucauccggcgucaucuuacu

SEQ ID NO: 2655213 - RNA, 17 nt, Escherichia coli CFT073
gucaucgacgucagcag

SEQ ID NO: 2655214 - RNA, 17 nt, Escherichia coli CFT073
gucaucgcccuguuccu

SEQ ID NO: 2655215 - RNA, 21 nt, Escherichia coli CFT073
gucaucggaucauuagucaca

SEQ ID NO: 2655216 - RNA, 18 nt, Escherichia coli CFT073
gucaucggcguugcccau

SEQ ID NO: 2655217 - RNA, 13 nt, Escherichia coli CFT073
gucaucuuacugc

SEQ ID NO: 2655218 - RNA, 17 nt, Escherichia coli CFT073
gucaugaugcuccgcca

SEQ ID NO: 2655219 - RNA, 22 nt, Escherichia coli CFT073
gucauggcccaugacaucccca

SEQ ID NO: 2655220 - RNA, 16 nt, Escherichia coli CFT073
gucauggcugaccguc

SEQ ID NO: 2655221 - RNA, 20 nt, Escherichia coli CFT073
gucauggugaugaucgccgu

SEQ ID NO: 2655222 - RNA, 17 nt, Escherichia coli CFT073
gucauguauauuaucca

SEQ ID NO: 2655223 - RNA, 11 nt, Escherichia coli CFT073
gucauuaaauc

SEQ ID NO: 2655224 - RNA, 16 nt, Escherichia coli CFT073
gucauuaccacaacaa

SEQ ID NO: 2655225 - RNA, 22 nt, Escherichia coli CFT073
gucauuacgggcaaucaucacc

SEQ ID NO: 2655226 - RNA, 20 nt, Escherichia coli CFT073
gucauuagcgcuaucaaagu

SEQ ID NO: 2655227 - RNA, 13 nt, Escherichia coli CFT073
gucauuaugucug

SEQ ID NO: 2655228 - RNA, 17 nt, Escherichia coli CFT073
gucauuccuuaugcugc

SEQ ID NO: 2655229 - RNA, 16 nt, Escherichia coli CFT073
gucauucggcgcaggu

SEQ ID NO: 2655230 - RNA, 13 nt, Escherichia coli CFT073
gucauugacgcug

SEQ ID NO: 2655231 - RNA, 19 nt, Escherichia coli CFT073
gucauugauaauauccguc

SEQ ID NO: 2655232 - RNA, 22 nt, Escherichia coli CFT073
gucauugaugcugccaucaucu

SEQ ID NO: 2655233 - RNA, 18 nt, Escherichia coli CFT073
gucauuguaaauugcagu

SEQ ID NO: 2655234 - RNA, 11 nt, Escherichia coli CFT073
gucauuuccag

SEQ ID NO: 2655235 - RNA, 19 nt, Escherichia coli CFT073
guccaaauagcucaaugaa

SEQ ID NO: 2655236 - RNA, 20 nt, Escherichia coli CFT073
guccaagaugggccagcacg

SEQ ID NO: 2655237 - RNA, 14 nt, Escherichia coli CFT073
guccaaucagcaca

SEQ ID NO: 2655238 - RNA, 23 nt, Escherichia coli CFT073
guccaaucaggcgaauaaauucc

SEQ ID NO: 2655239 - RNA, 13 nt, Escherichia coli CFT073
guccaauggucau

SEQ ID NO: 2655240 - RNA, 13 nt, Escherichia coli CFT073
guccacaaaccgu

SEQ ID NO: 2655241 - RNA, 23 nt, Escherichia coli CFT073
guccacaaaccguuaauccgccc

SEQ ID NO: 2655242 - RNA, 15 nt, Escherichia coli CFT073
guccacgacagaacc

SEQ ID NO: 2655243 - RNA, 17 nt, Escherichia coli CFT073
guccacgacagaacccg

SEQ ID NO: 2655244 - RNA, 13 nt, Escherichia coli CFT073
guccacggugcga

SEQ ID NO: 2655245 - RNA, 19 nt, Escherichia coli CFT073
guccacuggucugacgcug

SEQ ID NO: 2655246 - RNA, 14 nt, Escherichia coli CFT073
guccagacggagcu

SEQ ID NO: 2655247 - RNA, 21 nt, Escherichia coli CFT073
guccagacggagcugccaggc

SEQ ID NO: 2655248 - RNA, 14 nt, Escherichia coli CFT073
guccagauguucuu

SEQ ID NO: 2655249 - RNA, 16 nt, Escherichia coli CFT073
guccagcgccugaaua

SEQ ID NO: 2655250 - RNA, 18 nt, Escherichia coli CFT073
guccagcgccugaauaau

SEQ ID NO: 2655251 - RNA, 14 nt, Escherichia coli CFT073
guccagcgugucug

SEQ ID NO: 2655252 - RNA, 14 nt, Escherichia coli CFT073
guccagcugccugc

SEQ ID NO: 2655253 - RNA, 16 nt, Escherichia coli CFT073
guccagcuugccuuca

SEQ ID NO: 2655254 - RNA, 22 nt, Escherichia coli CFT073
guccagcuugccuucacaggcc

SEQ ID NO: 2655255 - RNA, 14 nt, Escherichia coli CFT073
guccaggauuuucu

SEQ ID NO: 2655256 - RNA, 23 nt, Escherichia coli CFT073
guccaguaaugcaacacuaccgg

SEQ ID NO: 2655257 - RNA, 22 nt, Escherichia coli CFT073
guccaguccacacugagcacca

SEQ ID NO: 2655258 - RNA, 19 nt, Escherichia coli CFT073
guccauaccggacuccaga

SEQ ID NO: 2655259 - RNA, 18 nt, Escherichia coli CFT073
guccauauauaaaaucau

SEQ ID NO: 2655260 - RNA, 18 nt, Escherichia coli CFT073
guccauauuucgucgcau

SEQ ID NO: 2655261 - RNA, 14 nt, Escherichia coli CFT073
guccaucacuugcu

SEQ ID NO: 2655262 - RNA, 15 nt, Escherichia coli CFT073
guccauucccuggca

SEQ ID NO: 2655263 - RNA, 18 nt, Escherichia coli CFT073
guccauugaagacaacau

SEQ ID NO: 2655264 - RNA, 16 nt, Escherichia coli CFT073
gucccaccaucagacc

SEQ ID NO: 2655265 - RNA, 14 nt, Escherichia coli CFT073
gucccaguucaugu

SEQ ID NO: 2655266 - RNA, 21 nt, Escherichia coli CFT073
gucccauaacauauucacccg

SEQ ID NO: 2655267 - RNA, 17 nt, Escherichia coli CFT073
gucccaugaugcgcggc

SEQ ID NO: 2655268 - RNA, 14 nt, Escherichia coli CFT073
gucccaugcaggcu

SEQ ID NO: 2655269 - RNA, 23 nt, Escherichia coli CFT073
guccccggaugaguaaacuucaa

SEQ ID NO: 2655270 - RNA, 17 nt, Escherichia coli CFT073
gucccguacccagcaag

SEQ ID NO: 2655271 - RNA, 16 nt, Escherichia coli CFT073
gucccuaacaugccac

SEQ ID NO: 2655272 - RNA, 19 nt, Escherichia coli CFT073
gucccugaaucgccacgcc

SEQ ID NO: 2655273 - RNA, 15 nt, Escherichia coli CFT073
gucccugccagcguc

SEQ ID NO: 2655274 - RNA, 15 nt, Escherichia coli CFT073
gucccuuugccugcc

SEQ ID NO: 2655275 - RNA, 17 nt, Escherichia coli CFT073
guccgagcuuaaugaaa

SEQ ID NO: 2655276 - RNA, 20 nt, Escherichia coli CFT073
guccgcaaacguaaaugcca

SEQ ID NO: 2655277 - RNA, 21 nt, Escherichia coli CFT073
guccgcacgcuggagaauaaa

SEQ ID NO: 2655278 - RNA, 18 nt, Escherichia coli CFT073
guccgcaguggcuucggc

SEQ ID NO: 2655279 - RNA, 18 nt, Escherichia coli CFT073
guccgccaccgccaaacg

SEQ ID NO: 2655280 - RNA, 15 nt, Escherichia coli CFT073
guccgccagaauacc

SEQ ID NO: 2655281 - RNA, 17 nt, Escherichia coli CFT073
guccgccauuuccagcg

SEQ ID NO: 2655282 - RNA, 15 nt, Escherichia coli CFT073
guccgcgaacagccg

SEQ ID NO: 2655283 - RNA, 21 nt, Escherichia coli CFT073
guccgcgauuuuguccucggc

SEQ ID NO: 2655284 - RNA, 19 nt, Escherichia coli CFT073
guccgcgguugguuuuauc

SEQ ID NO: 2655285 - RNA, 14 nt, Escherichia coli CFT073
guccggcaccagcg

SEQ ID NO: 2655286 - RNA, 17 nt, Escherichia coli CFT073
guccggcaucgcaaacc

SEQ ID NO: 2655287 - RNA, 14 nt, Escherichia coli CFT073
guccggcugccagc

SEQ ID NO: 2655288 - RNA, 16 nt, Escherichia coli CFT073
guccgggcaucaacag

SEQ ID NO: 2655289 - RNA, 13 nt, Escherichia coli CFT073
guccggucgggaa

SEQ ID NO: 2655290 - RNA, 21 nt, Escherichia coli CFT073
guccguaaucucgaaagaggu

SEQ ID NO: 2655291 - RNA, 14 nt, Escherichia coli CFT073
guccgucgacggca

SEQ ID NO: 2655292 - RNA, 20 nt, Escherichia coli CFT073
guccguugaaauugcugguu

SEQ ID NO: 2655293 - RNA, 20 nt, Escherichia coli CFT073
guccuaacaaccauccccaa

SEQ ID NO: 2655294 - RNA, 22 nt, Escherichia coli CFT073
guccucggcacgcgcaucauua

SEQ ID NO: 2655295 - RNA, 18 nt, Escherichia coli CFT073
guccugagugggcgucag

SEQ ID NO: 2655296 - RNA, 20 nt, Escherichia coli CFT073
guccugauaagugaagaccg

SEQ ID NO: 2655297 - RNA, 18 nt, Escherichia coli CFT073
guccuggcgcuguggugg

SEQ ID NO: 2655298 - RNA, 20 nt, Escherichia coli CFT073
guccuucagcaccugcauca

SEQ ID NO: 2655299 - RNA, 21 nt, Escherichia coli CFT073
guccuucaucuucauccggcu

SEQ ID NO: 2655300 - RNA, 20 nt, Escherichia coli CFT073
guccuuccaguaaccagccg

SEQ ID NO: 2655301 - RNA, 14 nt, Escherichia coli CFT073
guccuucucaucuu

SEQ ID NO: 2655302 - RNA, 17 nt, Escherichia coli CFT073
guccuuuacuucaccau

SEQ ID NO: 2655303 - RNA, 18 nt, Escherichia coli CFT073
gucgaaagcccaucaucc

SEQ ID NO: 2655304 - RNA, 17 nt, Escherichia coli CFT073
gucgaaauaucacugau

SEQ ID NO: 2655305 - RNA, 12 nt, Escherichia coli CFT073
gucgaaggccuc

SEQ ID NO: 2655306 - RNA, 20 nt, Escherichia coli CFT073
gucgaaugcgcaaccguaaa

SEQ ID NO: 2655307 - RNA, 12 nt, Escherichia coli CFT073
gucgacaaccag

SEQ ID NO: 2655308 - RNA, 14 nt, Escherichia coli CFT073
gucgacaaccagca

SEQ ID NO: 2655309 - RNA, 15 nt, Escherichia coli CFT073
gucgacaaccagcau

SEQ ID NO: 2655310 - RNA, 20 nt, Escherichia coli CFT073
gucgacaguagccccgcggg

SEQ ID NO: 2655311 - RNA, 20 nt, Escherichia coli CFT073
gucgacaucaagaaaugcau

SEQ ID NO: 2655312 - RNA, 20 nt, Escherichia coli CFT073
gucgagaauauacagcgucu

SEQ ID NO: 2655313 - RNA, 18 nt, Escherichia coli CFT073
gucgagaauguagauauu

SEQ ID NO: 2655314 - RNA, 21 nt, Escherichia coli CFT073
gucgagauacacggugcucca

SEQ ID NO: 2655315 - RNA, 18 nt, Escherichia coli CFT073
gucgagauugugcucaau

SEQ ID NO: 2655316 - RNA, 21 nt, Escherichia coli CFT073
gucucaagcacccguggcuau

SEQ ID NO: 2655317 - RNA, 17 nt, Escherichia coli CFT073
gucucaauuuauauuca

SEQ ID NO: 2655318 - RNA, 16 nt, Escherichia coli CFT073
gucucauauauuuucg

SEQ ID NO: 2655319 - RNA, 16 nt, Escherichia coli CFT073
gucucaucaggccugc

SEQ ID NO: 2655320 - RNA, 12 nt, Escherichia coli CFT073
gucucaucuuua

SEQ ID NO: 2655321 - RNA, 22 nt, Escherichia coli CFT073
gucuccaggcagaaacaucauc

SEQ ID NO: 2655322 - RNA, 17 nt, Escherichia coli CFT073
gucuccgguuucccggc

SEQ ID NO: 2655323 - RNA, 18 nt, Escherichia coli CFT073
gucuccgguuucccggca

SEQ ID NO: 2655324 - RNA, 20 nt, Escherichia coli CFT073
gucuccgguuucccggcaau

SEQ ID NO: 2655325 - RNA, 20 nt, Escherichia coli CFT073
gucuccucccgagcgugcgg

SEQ ID NO: 2655326 - RNA, 16 nt, Escherichia coli CFT073
gucucgacaaacuccg

SEQ ID NO: 2655327 - RNA, 14 nt, Escherichia coli CFT073
gucucuauuucacc

SEQ ID NO: 2655328 - RNA, 16 nt, Escherichia coli CFT073
gucucuauuucaccca

SEQ ID NO: 2655329 - RNA, 14 nt, Escherichia coli CFT073
gucucuuccggcuc

SEQ ID NO: 2655330 - RNA, 15 nt, Escherichia coli CFT073
gucucuucuuugcug

SEQ ID NO: 2655331 - RNA, 13 nt, Escherichia coli CFT073
gucugaauaccgc

SEQ ID NO: 2655332 - RNA, 15 nt, Escherichia coli CFT073
gucugaaucaguccc

SEQ ID NO: 2655333 - RNA, 11 nt, Escherichia coli CFT073
gucugaaugau

SEQ ID NO: 2655334 - RNA, 18 nt, Escherichia coli CFT073
gucugagauuacauuggg

SEQ ID NO: 2655335 - RNA, 23 nt, Escherichia coli CFT073
gucugauaguaguuugaugagaa

SEQ ID NO: 2655336 - RNA, 19 nt, Escherichia coli CFT073
gucugauauuuuauugauu

SEQ ID NO: 2655337 - RNA, 21 nt, Escherichia coli CFT073
gucugaucggcaaucacgccc

SEQ ID NO: 2655338 - RNA, 18 nt, Escherichia coli CFT073
gucugccacggcagaaug

SEQ ID NO: 2655339 - RNA, 16 nt, Escherichia coli CFT073
gucugccacuucuucc

SEQ ID NO: 2655340 - RNA, 19 nt, Escherichia coli CFT073
gucugccacuucuuccagc

SEQ ID NO: 2655341 - RNA, 18 nt, Escherichia coli CFT073
gucugccaucauggcauc

SEQ ID NO: 2655342 - RNA, 20 nt, Escherichia coli CFT073
gucugccaucauggcauccu

SEQ ID NO: 2655343 - RNA, 14 nt, Escherichia coli CFT073
gucugccccgccgc

SEQ ID NO: 2655344 - RNA, 18 nt, Escherichia coli CFT073
gucugccgggaagcucuc

SEQ ID NO: 2655345 - RNA, 21 nt, Escherichia coli CFT073
gucugccucccauucaucgcc

SEQ ID NO: 2655346 - RNA, 23 nt, Escherichia coli CFT073
gucugccucccauucaucgccac

SEQ ID NO: 2655347 - RNA, 15 nt, Escherichia coli CFT073
gucugccuuucggug

SEQ ID NO: 2655348 - RNA, 16 nt, Escherichia coli CFT073
gucugccuuucgguga

SEQ ID NO: 2655349 - RNA, 22 nt, Escherichia coli CFT073
gucugcgaugaucgccgccagu

SEQ ID NO: 2655350 - RNA, 14 nt, Escherichia coli CFT073
gucugcgccgaucg

SEQ ID NO: 2655351 - RNA, 19 nt, Escherichia coli CFT073
gucugcgccgcauucaggg

SEQ ID NO: 2655352 - RNA, 20 nt, Escherichia coli CFT073
gucugcgccgcauucagggc

SEQ ID NO: 2655353 - RNA, 19 nt, Escherichia coli CFT073
gucugcgccugcgucuauc

SEQ ID NO: 2655354 - RNA, 14 nt, Escherichia coli CFT073
gucugcugaagcau

SEQ ID NO: 2655355 - RNA, 14 nt, Escherichia coli CFT073
gucuggaacggcag

SEQ ID NO: 2655356 - RNA, 21 nt, Escherichia coli CFT073
gucuggagaugggugugcuga

SEQ ID NO: 2655357 - RNA, 17 nt, Escherichia coli CFT073
gucuggaucuucuucau

SEQ ID NO: 2655358 - RNA, 16 nt, Escherichia coli CFT073
gucuggauggcuugcu

SEQ ID NO: 2655359 - RNA, 14 nt, Escherichia coli CFT073
gucuggcagauccu

SEQ ID NO: 2655360 - RNA, 17 nt, Escherichia coli CFT073
gucuggcagauccugaa

SEQ ID NO: 2655361 - RNA, 21 nt, Escherichia coli CFT073
gucuggcagauccugaaauuc

SEQ ID NO: 2655362 - RNA, 16 nt, Escherichia coli CFT073
gucuggcauuuugcug

SEQ ID NO: 2655363 - RNA, 18 nt, Escherichia coli CFT073
gucuggcauuuugcugcu

SEQ ID NO: 2655364 - RNA, 19 nt, Escherichia coli CFT073
gucuggcgaauuuauaaaa

SEQ ID NO: 2655365 - RNA, 14 nt, Escherichia coli CFT073
gucugggcaaaauc

SEQ ID NO: 2655366 - RNA, 14 nt, Escherichia coli CFT073
gucugguaucgcgc

SEQ ID NO: 2655367 - RNA, 18 nt, Escherichia coli CFT073
gucugguaucgcgccagc

SEQ ID NO: 2655368 - RNA, 17 nt, Escherichia coli CFT073
gucuguaaaagccccuu

SEQ ID NO: 2655369 - RNA, 18 nt, Escherichia coli CFT073
gucuguaccaccagaauc

SEQ ID NO: 2655370 - RNA, 16 nt, Escherichia coli CFT073
gucuguauuuggcugc

SEQ ID NO: 2655371 - RNA, 15 nt, Escherichia coli CFT073
gucuguucuggugug

SEQ ID NO: 2655372 - RNA, 16 nt, Escherichia coli CFT073
gucuguuugcgucaug

SEQ ID NO: 2655373 - RNA, 14 nt, Escherichia coli CFT073
gucuguuuuaucac

SEQ ID NO: 2655374 - RNA, 20 nt, Escherichia coli CFT073
gucuuaaaccggacaauaaa

SEQ ID NO: 2655375 - RNA, 14 nt, Escherichia coli CFT073
gucuuaagcggcua

SEQ ID NO: 2655376 - RNA, 16 nt, Escherichia coli CFT073
gucuuaauagcuucuu

SEQ ID NO: 2655377 - RNA, 15 nt, Escherichia coli CFT073
gucuuagcguucugc

SEQ ID NO: 2655378 - RNA, 21 nt, Escherichia coli CFT073
gucuuaucaggccuacaaguc

SEQ ID NO: 2655379 - RNA, 20 nt, Escherichia coli CFT073
gucuuaucaggccuacaauc

SEQ ID NO: 2655380 - RNA, 17 nt, Escherichia coli CFT073
gucuuauccgaccuaca

SEQ ID NO: 2655381 - RNA, 23 nt, Escherichia coli CFT073
gucuuauccggcauauaagugca

SEQ ID NO: 2655382 - RNA, 20 nt, Escherichia coli CFT073
gucuuaucuggcauuugcac

SEQ ID NO: 2655383 - RNA, 21 nt, Escherichia coli CFT073
gucuucaucguccagcgucag

SEQ ID NO: 2655384 - RNA, 22 nt, Escherichia coli CFT073
gucuuccggguagcgcggcagc

SEQ ID NO: 2655385 - RNA, 17 nt, Escherichia coli CFT073
gucuuccgugccugacg

SEQ ID NO: 2655386 - RNA, 23 nt, Escherichia coli CFT073
gucuucgauuaaguuuuccguac

SEQ ID NO: 2655387 - RNA, 22 nt, Escherichia coli CFT073
gucuucgccaaauggcaggcac

SEQ ID NO: 2655388 - RNA, 20 nt, Escherichia coli CFT073
gucuucguacaugguaauaa

SEQ ID NO: 2655389 - RNA, 13 nt, Escherichia coli CFT073
gucuucuucccag

SEQ ID NO: 2655390 - RNA, 11 nt, Escherichia coli CFT073
gucuucuuccg

SEQ ID NO: 2655391 - RNA, 14 nt, Escherichia coli CFT073
gucuucuuccgcgc

SEQ ID NO: 2655392 - RNA, 21 nt, Escherichia coli CFT073
gucuugaauaaauuggcuggg

SEQ ID NO: 2655393 - RNA, 23 nt, Escherichia coli CFT073
gucuugaauaaauuggcuggggu

SEQ ID NO: 2655394 - RNA, 18 nt, Escherichia coli CFT073
gucuugagacagaaacaa

SEQ ID NO: 2655395 - RNA, 15 nt, Escherichia coli CFT073
gucuuguugaacaga

SEQ ID NO: 2655396 - RNA, 14 nt, Escherichia coli CFT073
gucuuucaacagau

SEQ ID NO: 2655397 - RNA, 19 nt, Escherichia coli CFT073
gucuuucuuuuuuucacuu

SEQ ID NO: 2655398 - RNA, 15 nt, Escherichia coli CFT073
gucuuuuauuauaau

SEQ ID NO: 2655399 - RNA, 23 nt, Escherichia coli CFT073
gugaaaaauaaaagcgugaaaca

SEQ ID NO: 2655400 - RNA, 19 nt, Escherichia coli CFT073
gugaaacaaaucacuauua

SEQ ID NO: 2655401 - RNA, 23 nt, Escherichia coli CFT073
gugaaaccgcagcaacuacagca

SEQ ID NO: 2655402 - RNA, 17 nt, Escherichia coli CFT073
gugaaagaaaaugagcg

SEQ ID NO: 2655403 - RNA, 18 nt, Escherichia coli CFT073
gugaaagauaaaacgaca

SEQ ID NO: 2655404 - RNA, 16 nt, Escherichia coli CFT073
gugaaagcauggcacg

SEQ ID NO: 2655405 - RNA, 16 nt, Escherichia coli CFT073
gugaaauaaaaucagc

SEQ ID NO: 2655406 - RNA, 21 nt, Escherichia coli CFT073
gugaaauaaucccguucagcg

SEQ ID NO: 2655407 - RNA, 14 nt, Escherichia coli CFT073
gugaacaucgccau

SEQ ID NO: 2655408 - RNA, 16 nt, Escherichia coli CFT073
gugaaccgucacuguu

SEQ ID NO: 2655409 - RNA, 20 nt, Escherichia coli CFT073
gugaacgccuuauccgaccu

SEQ ID NO: 2655410 - RNA, 20 nt, Escherichia coli CFT073
gugaacgccuuauccggccu

SEQ ID NO: 2655411 - RNA, 20 nt, Escherichia coli CFT073
gugaacgccuuauccggucu

SEQ ID NO: 2655412 - RNA, 20 nt, Escherichia coli CFT073
gugaacgcguuauccggcca

SEQ ID NO: 2655413 - RNA, 18 nt, Escherichia coli CFT073
gugaacugggccugcaua

SEQ ID NO: 2655414 - RNA, 17 nt, Escherichia coli CFT073
gugaacuucgccaggau

SEQ ID NO: 2655415 - RNA, 18 nt, Escherichia coli CFT073
gugaagacggccauccca

SEQ ID NO: 2655416 - RNA, 21 nt, Escherichia coli CFT073
gugaagacggccaucccagug

SEQ ID NO: 2655417 - RNA, 21 nt, Escherichia coli CFT073
gugaaguugccggauguguug

SEQ ID NO: 2655418 - RNA, 18 nt, Escherichia coli CFT073
gugaauaccggucaacaa

SEQ ID NO: 2655419 - RNA, 18 nt, Escherichia coli CFT073
gugaaucccaguacugua

SEQ ID NO: 2655420 - RNA, 18 nt, Escherichia coli CFT073
gugaauccccuuuauggu

SEQ ID NO: 2655421 - RNA, 20 nt, Escherichia coli CFT073
gugaaucggacgugauucca

SEQ ID NO: 2655422 - RNA, 14 nt, Escherichia coli CFT073
gugaaucucaggca

SEQ ID NO: 2655423 - RNA, 18 nt, Escherichia coli CFT073
gugaaugccguaggccca

SEQ ID NO: 2655424 - RNA, 14 nt, Escherichia coli CFT073
gugccagaacagaa

SEQ ID NO: 2655425 - RNA, 15 nt, Escherichia coli CFT073
gugccagaacagaaa

SEQ ID NO: 2655426 - RNA, 17 nt, Escherichia coli CFT073
gugccagaacagaaaug

SEQ ID NO: 2655427 - RNA, 20 nt, Escherichia coli CFT073
gugccagcaccaaacuggaa

SEQ ID NO: 2655428 - RNA, 23 nt, Escherichia coli CFT073
gugccagcaccaaacuggaauag

SEQ ID NO: 2655429 - RNA, 23 nt, Escherichia coli CFT073
gugccagcgauuuugccagccgc

SEQ ID NO: 2655430 - RNA, 15 nt, Escherichia coli CFT073
gugccagcgccagca

SEQ ID NO: 2655431 - RNA, 16 nt, Escherichia coli CFT073
gugccagcgccagcac

SEQ ID NO: 2655432 - RNA, 17 nt, Escherichia coli CFT073
gugccagcgccagcacu

SEQ ID NO: 2655433 - RNA, 15 nt, Escherichia coli CFT073
gugccagcggcagua

SEQ ID NO: 2655434 - RNA, 16 nt, Escherichia coli CFT073
gugccaggaccauuca

SEQ ID NO: 2655435 - RNA, 22 nt, Escherichia coli CFT073
gugccaguacgcccacgccagc

SEQ ID NO: 2655436 - RNA, 23 nt, Escherichia coli CFT073
gugccaguuccgguggcaaugcc

SEQ ID NO: 2655437 - RNA, 22 nt, Escherichia coli CFT073
gugccauagcgggcaaucagcg

SEQ ID NO: 2655438 - RNA, 16 nt, Escherichia coli CFT073
gugccaucacgccugc

SEQ ID NO: 2655439 - RNA, 12 nt, Escherichia coli CFT073
gugccaucccag

SEQ ID NO: 2655440 - RNA, 14 nt, Escherichia coli CFT073
gugccaucuccagu

SEQ ID NO: 2655441 - RNA, 12 nt, Escherichia coli CFT073
gugccaugcuga

SEQ ID NO: 2655442 - RNA, 16 nt, Escherichia coli CFT073
gugccauugcucucgc

SEQ ID NO: 2655443 - RNA, 19 nt, Escherichia coli CFT073
gugccauuuacgaacauua

SEQ ID NO: 2655444 - RNA, 21 nt, Escherichia coli CFT073
gugcccacguucaugccgacg

SEQ ID NO: 2655445 - RNA, 21 nt, Escherichia coli CFT073
gugccccaaaugucggaugcg

SEQ ID NO: 2655446 - RNA, 18 nt, Escherichia coli CFT073
gugcccccauaagccgcg

SEQ ID NO: 2655447 - RNA, 14 nt, Escherichia coli CFT073
gugcccccugcaau

SEQ ID NO: 2655448 - RNA, 17 nt, Escherichia coli CFT073
gugcccgggucagcgcc

SEQ ID NO: 2655449 - RNA, 13 nt, Escherichia coli CFT073
gugcccuuccagc

SEQ ID NO: 2655450 - RNA, 13 nt, Escherichia coli CFT073
gugcccuuucagu

SEQ ID NO: 2655451 - RNA, 17 nt, Escherichia coli CFT073
gugccgacagguggugu

SEQ ID NO: 2655452 - RNA, 14 nt, Escherichia coli CFT073
gugccgacgguuug

SEQ ID NO: 2655453 - RNA, 14 nt, Escherichia coli CFT073
gugccgauaucgau

SEQ ID NO: 2655454 - RNA, 17 nt, Escherichia coli CFT073
gugccgcaccagcuuuc

SEQ ID NO: 2655455 - RNA, 16 nt, Escherichia coli CFT073
gugccgccgcccggca

SEQ ID NO: 2655456 - RNA, 19 nt, Escherichia coli CFT073
gugccgccgucagacgcgc

SEQ ID NO: 2655457 - RNA, 20 nt, Escherichia coli CFT073
gugccgcguuuugacagcuc

SEQ ID NO: 2655458 - RNA, 21 nt, Escherichia coli CFT073
gugccgcguuuugacagcuca

SEQ ID NO: 2655459 - RNA, 14 nt, Escherichia coli CFT073
gugccgcucguuug

SEQ ID NO: 2655460 - RNA, 16 nt, Escherichia coli CFT073
gugccggaagucucuu

SEQ ID NO: 2655461 - RNA, 22 nt, Escherichia coli CFT073
gugccggauguucgcauccggc

SEQ ID NO: 2655462 - RNA, 13 nt, Escherichia coli CFT073
gugccggauuuca

SEQ ID NO: 2655463 - RNA, 14 nt, Escherichia coli CFT073
gugccgggcaaauu

SEQ ID NO: 2655464 - RNA, 18 nt, Escherichia coli CFT073
gugccgguugugugcugg

SEQ ID NO: 2655465 - RNA, 15 nt, Escherichia coli CFT073
gugccgguuucacgu

SEQ ID NO: 2655466 - RNA, 19 nt, Escherichia coli CFT073
gugccgucugccccgccgc

SEQ ID NO: 2655467 - RNA, 19 nt, Escherichia coli CFT073
gugccguggcaggcaaacc

SEQ ID NO: 2655468 - RNA, 14 nt, Escherichia coli CFT073
gugccucccgguga

SEQ ID NO: 2655469 - RNA, 18 nt, Escherichia coli CFT073
gugccugacggacgcgcg

SEQ ID NO: 2655470 - RNA, 22 nt, Escherichia coli CFT073
gugccugagccggaguugcaga

SEQ ID NO: 2655471 - RNA, 22 nt, Escherichia coli CFT073
gugccuuuaauaccaucggcag

SEQ ID NO: 2655472 - RNA, 19 nt, Escherichia coli CFT073
gugccuuuuuuauuuaugc

SEQ ID NO: 2655473 - RNA, 16 nt, Escherichia coli CFT073
gugcgaaaaaaauuac

SEQ ID NO: 2655474 - RNA, 22 nt, Escherichia coli CFT073
gugcgaaaaaaauuacucauac

SEQ ID NO: 2655475 - RNA, 14 nt, Escherichia coli CFT073
gugcgaaaaucaau

SEQ ID NO: 2655476 - RNA, 13 nt, Escherichia coli CFT073
gugcgaaacggaa

SEQ ID NO: 2655477 - RNA, 22 nt, Escherichia coli CFT073
gugcgaauaaugguaucgacac

SEQ ID NO: 2655478 - RNA, 23 nt, Escherichia coli CFT073
gugcgacaaacauugcugccaga

SEQ ID NO: 2655479 - RNA, 23 nt, Escherichia coli CFT073
gugcgagcgccuuauccggccug

SEQ ID NO: 2655480 - RNA, 15 nt, Escherichia coli CFT073
gugcgcaggcgcuga

SEQ ID NO: 2655481 - RNA, 13 nt, Escherichia coli CFT073
gugcgcaguugcc

SEQ ID NO: 2655482 - RNA, 14 nt, Escherichia coli CFT073
gugcgcaucgccag

SEQ ID NO: 2655483 - RNA, 16 nt, Escherichia coli CFT073
gugcgccaaacugccg

SEQ ID NO: 2655484 - RNA, 18 nt, Escherichia coli CFT073
gugcgccacauccggcau

SEQ ID NO: 2655485 - RNA, 12 nt, Escherichia coli CFT073
gugcgccagcaa

SEQ ID NO: 2655486 - RNA, 16 nt, Escherichia coli CFT073
gugcgccagcaaauca

SEQ ID NO: 2655487 - RNA, 19 nt, Escherichia coli CFT073
gugcgcgaaccagagacag

SEQ ID NO: 2655488 - RNA, 23 nt, Escherichia coli CFT073
gugcgcgauagauagcguucuuu

SEQ ID NO: 2655489 - RNA, 15 nt, Escherichia coli CFT073
gugcgcguggcaauu

SEQ ID NO: 2655490 - RNA, 18 nt, Escherichia coli CFT073
gugcggcgcaccagcagg

SEQ ID NO: 2655491 - RNA, 22 nt, Escherichia coli CFT073
gugcggcgcaccagcaggccgu

SEQ ID NO: 2655492 - RNA, 23 nt, Escherichia coli CFT073
gugcgggaacauaucaaaaagcu

SEQ ID NO: 2655493 - RNA, 15 nt, Escherichia coli CFT073
gugcgggcacaggcg

SEQ ID NO: 2655494 - RNA, 16 nt, Escherichia coli CFT073
gugcggguaaccagcc

SEQ ID NO: 2655495 - RNA, 14 nt, Escherichia coli CFT073
gugcgguaagcugc

SEQ ID NO: 2655496 - RNA, 21 nt, Escherichia coli CFT073
gugcgguaagcugcgguuccg

SEQ ID NO: 2655497 - RNA, 18 nt, Escherichia coli CFT073
gugcgguaucaccaccca

SEQ ID NO: 2655498 - RNA, 20 nt, Escherichia coli CFT073
gugcgucgcauccggcaauu

SEQ ID NO: 2655499 - RNA, 23 nt, Escherichia coli CFT073
gugcgugcgcccaucauugcgcc

SEQ ID NO: 2655500 - RNA, 14 nt, Escherichia coli CFT073
gugcguugaccgcc

SEQ ID NO: 2655501 - RNA, 15 nt, Escherichia coli CFT073
gugcguugucaucga

SEQ ID NO: 2655502 - RNA, 21 nt, Escherichia coli CFT073
gugcguugucaucgcggcauu

SEQ ID NO: 2655503 - RNA, 17 nt, Escherichia coli CFT073
gugcuaagccccugagc

SEQ ID NO: 2655504 - RNA, 18 nt, Escherichia coli CFT073
gugcuaauugcaccaucc

SEQ ID NO: 2655505 - RNA, 18 nt, Escherichia coli CFT073
gugcucaauuaccacaau

SEQ ID NO: 2655506 - RNA, 15 nt, Escherichia coli CFT073
gugcucauccuucag

SEQ ID NO: 2655507 - RNA, 18 nt, Escherichia coli CFT073
gugcucauuagcccggca

SEQ ID NO: 2655508 - RNA, 16 nt, Escherichia coli CFT073
gugcuccagugcgcuu

SEQ ID NO: 2655509 - RNA, 18 nt, Escherichia coli CFT073
gugcuccauuguuagcaa

SEQ ID NO: 2655510 - RNA, 19 nt, Escherichia coli CFT073
gugcuccuucucugagcug

SEQ ID NO: 2655511 - RNA, 14 nt, Escherichia coli CFT073
gugcucgcuuucca

SEQ ID NO: 2655512 - RNA, 20 nt, Escherichia coli CFT073
gugcucucaaauaucugccg

SEQ ID NO: 2655513 - RNA, 15 nt, Escherichia coli CFT073
gugcucuggcaggcg

SEQ ID NO: 2655514 - RNA, 12 nt, Escherichia coli CFT073
gugcucuuccuu

SEQ ID NO: 2655515 - RNA, 19 nt, Escherichia coli CFT073
gugcugaagggcaucagcc

SEQ ID NO: 2655516 - RNA, 14 nt, Escherichia coli CFT073
gugcugagaguaac

SEQ ID NO: 2655517 - RNA, 12 nt, Escherichia coli CFT073
gugcugauacgc

SEQ ID NO: 2655518 - RNA, 20 nt, Escherichia coli CFT073
gugcugauacgcgcaccgga

SEQ ID NO: 2655519 - RNA, 16 nt, Escherichia coli CFT073
gugcugcgaucgauau

SEQ ID NO: 2655520 - RNA, 12 nt, Escherichia coli CFT073
gugcugcgguca

SEQ ID NO: 2655521 - RNA, 17 nt, Escherichia coli CFT073
gugcugcuggaaaaggu

SEQ ID NO: 2655522 - RNA, 14 nt, Escherichia coli CFT073
gugcuggcggccug

SEQ ID NO: 2655523 - RNA, 20 nt, Escherichia coli CFT073
gugcuguaaagcacagacca

SEQ ID NO: 2655524 - RNA, 15 nt, Escherichia coli CFT073
gugcuguucugccgg

SEQ ID NO: 2655525 - RNA, 18 nt, Escherichia coli CFT073
gugcuguucugccgggug

SEQ ID NO: 2655526 - RNA, 22 nt, Escherichia coli CFT073
gugcuuauaacugcccgcauca

SEQ ID NO: 2655527 - RNA, 23 nt, Escherichia coli CFT073
gugcuuauaacugcccgcaucaa

SEQ ID NO: 2655528 - RNA, 19 nt, Escherichia coli CFT073
gugcuuuuccucauuuaaa

SEQ ID NO: 2655529 - RNA, 16 nt, Escherichia coli CFT073
gugcuuuuguuauagc

SEQ ID NO: 2655530 - RNA, 20 nt, Escherichia coli CFT073
guggaaaggccaacauccau

SEQ ID NO: 2655531 - RNA, 14 nt, Escherichia coli CFT073
guggaaauccccau

SEQ ID NO: 2655532 - RNA, 14 nt, Escherichia coli CFT073
guguggaugccuga

SEQ ID NO: 2655533 - RNA, 16 nt, Escherichia coli CFT073
gugugggcacucgaag

SEQ ID NO: 2655534 - RNA, 16 nt, Escherichia coli CFT073
gugugggucuaaaaac

SEQ ID NO: 2655535 - RNA, 17 nt, Escherichia coli CFT073
guguguuccucugcucc

SEQ ID NO: 2655536 - RNA, 22 nt, Escherichia coli CFT073
guguguuugaucacuuccagca

SEQ ID NO: 2655537 - RNA, 14 nt, Escherichia coli CFT073
guguuacgccgcac

SEQ ID NO: 2655538 - RNA, 17 nt, Escherichia coli CFT073
guguuaggaucacgccc

SEQ ID NO: 2655539 - RNA, 13 nt, Escherichia coli CFT073
guguuauccgccg

SEQ ID NO: 2655540 - RNA, 22 nt, Escherichia coli CFT073
guguucacgccgcauccggcau

SEQ ID NO: 2655541 - RNA, 15 nt, Escherichia coli CFT073
guguucaugaccgug

SEQ ID NO: 2655542 - RNA, 20 nt, Escherichia coli CFT073
guguucaugaccgugaucgu

SEQ ID NO: 2655543 - RNA, 19 nt, Escherichia coli CFT073
guguuccuugggcucgaca

SEQ ID NO: 2655544 - RNA, 15 nt, Escherichia coli CFT073
guguugcuccacgcc

SEQ ID NO: 2655545 - RNA, 16 nt, Escherichia coli CFT073
guguuggcaaucagcg

SEQ ID NO: 2655546 - RNA, 21 nt, Escherichia coli CFT073
guguugguaaacgcauagauc

SEQ ID NO: 2655547 - RNA, 18 nt, Escherichia coli CFT073
guguuguaaaacgcgccc

SEQ ID NO: 2655548 - RNA, 16 nt, Escherichia coli CFT073
guguuuaucuuccagc

SEQ ID NO: 2655549 - RNA, 19 nt, Escherichia coli CFT073
guguuucgacaauaaucaa

SEQ ID NO: 2655550 - RNA, 18 nt, Escherichia coli CFT073
guguuucggcugaggcgu

SEQ ID NO: 2655551 - RNA, 17 nt, Escherichia coli CFT073
guuaaaaaaagaacaac

SEQ ID NO: 2655552 - RNA, 19 nt, Escherichia coli CFT073
guuaaaaaaagaacaacca

SEQ ID NO: 2655553 - RNA, 11 nt, Escherichia coli CFT073
guuaaaaaaca

SEQ ID NO: 2655554 - RNA, 13 nt, Escherichia coli CFT073
guuaaaaaaugca

SEQ ID NO: 2655555 - RNA, 14 nt, Escherichia coli CFT073
guuaaaaacagcca

SEQ ID NO: 2655556 - RNA, 22 nt, Escherichia coli CFT073
guuaaaaacagccagcagcgaa

SEQ ID NO: 2655557 - RNA, 18 nt, Escherichia coli CFT073
guuaaaaagauuaagaac

SEQ ID NO: 2655558 - RNA, 17 nt, Escherichia coli CFT073
guuaaaacgcacgcugu

SEQ ID NO: 2655559 - RNA, 13 nt, Escherichia coli CFT073
guuaaaauacgcg

SEQ ID NO: 2655560 - RNA, 19 nt, Escherichia coli CFT073
guuaaacuuucauaaacac

SEQ ID NO: 2655561 - RNA, 17 nt, Escherichia coli CFT073
guuaaagcccugcucgc

SEQ ID NO: 2655562 - RNA, 18 nt, Escherichia coli CFT073
guuaaaggugucaauaau

SEQ ID NO: 2655563 - RNA, 19 nt, Escherichia coli CFT073
guuaaaggugucaauaaua

SEQ ID NO: 2655564 - RNA, 22 nt, Escherichia coli CFT073
guuaaauaacggccuggcacgu

SEQ ID NO: 2655565 - RNA, 17 nt, Escherichia coli CFT073
guuaaaucaggaaaacg

SEQ ID NO: 2655566 - RNA, 23 nt, Escherichia coli CFT073
guuaaauugaggcuuugcccaau

SEQ ID NO: 2655567 - RNA, 21 nt, Escherichia coli CFT073
guuaaauugaucgaugguugc

SEQ ID NO: 2655568 - RNA, 17 nt, Escherichia coli CFT073
guuaacaauauuaacaa

SEQ ID NO: 2655569 - RNA, 18 nt, Escherichia coli CFT073
guuaacagcgcaccagaa

SEQ ID NO: 2655570 - RNA, 12 nt, Escherichia coli CFT073
guuaaccauaau

SEQ ID NO: 2655571 - RNA, 16 nt, Escherichia coli CFT073
guuaaccauaaucuca

SEQ ID NO: 2655572 - RNA, 19 nt, Escherichia coli CFT073
guuaacccacagcgcacca

SEQ ID NO: 2655573 - RNA, 22 nt, Escherichia coli CFT073
guuaacccacagcgcaccaacg

SEQ ID NO: 2655574 - RNA, 23 nt, Escherichia coli CFT073
guuaacccacagcgcaccaacgg

SEQ ID NO: 2655575 - RNA, 18 nt, Escherichia coli CFT073
guuaacccagcacuuaac

SEQ ID NO: 2655576 - RNA, 16 nt, Escherichia coli CFT073
guuaaccgcuucggaa

SEQ ID NO: 2655577 - RNA, 15 nt, Escherichia coli CFT073
guuaacgccagccac

SEQ ID NO: 2655578 - RNA, 18 nt, Escherichia coli CFT073
guuaacgugucauaacug

SEQ ID NO: 2655579 - RNA, 19 nt, Escherichia coli CFT073
guuaacugaauauuccagu

SEQ ID NO: 2655580 - RNA, 12 nt, Escherichia coli CFT073
guuaagcauucg

SEQ ID NO: 2655581 - RNA, 15 nt, Escherichia coli CFT073
guuaagccguucugg

SEQ ID NO: 2655582 - RNA, 14 nt, Escherichia coli CFT073
guuaagcgucgcau

SEQ ID NO: 2655583 - RNA, 16 nt, Escherichia coli CFT073
guuaagcgucgcauca

SEQ ID NO: 2655584 - RNA, 20 nt, Escherichia coli CFT073
guuaaggccgcuuucagagc

SEQ ID NO: 2655585 - RNA, 13 nt, Escherichia coli CFT073
guuaauauuuccc

SEQ ID NO: 2655586 - RNA, 23 nt, Escherichia coli CFT073
guuaaucaaaucaacaaccugca

SEQ ID NO: 2655587 - RNA, 17 nt, Escherichia coli CFT073
guuaaucagauaaucaa

SEQ ID NO: 2655588 - RNA, 20 nt, Escherichia coli CFT073
guuaaucgccgcauaauauc

SEQ ID NO: 2655589 - RNA, 22 nt, Escherichia coli CFT073
guuaaucucucccguugcuucu

SEQ ID NO: 2655590 - RNA, 14 nt, Escherichia coli CFT073
guuaaugcccauca

SEQ ID NO: 2655591 - RNA, 18 nt, Escherichia coli CFT073
guuaaugcgaaugaaaga

SEQ ID NO: 2655592 - RNA, 16 nt, Escherichia coli CFT073
guuaauucucccugcg

SEQ ID NO: 2655593 - RNA, 15 nt, Escherichia coli CFT073
guuaauugacaaggu

SEQ ID NO: 2655594 - RNA, 17 nt, Escherichia coli CFT073
guuaauuuccucuuccc

SEQ ID NO: 2655595 - RNA, 14 nt, Escherichia coli CFT073
guuacaaccacaua

SEQ ID NO: 2655596 - RNA, 16 nt, Escherichia coli CFT073
guuacaaccuccuccg

SEQ ID NO: 2655597 - RNA, 19 nt, Escherichia coli CFT073
guuacaucagaguacagau

SEQ ID NO: 2655598 - RNA, 14 nt, Escherichia coli CFT073
guuacauugugaug

SEQ ID NO: 2655599 - RNA, 15 nt, Escherichia coli CFT073
guuaccagcaccguc

SEQ ID NO: 2655600 - RNA, 19 nt, Escherichia coli CFT073
guuaccagcaccgucgcac

SEQ ID NO: 2655601 - RNA, 21 nt, Escherichia coli CFT073
guuaccagccgggcgguuaac

SEQ ID NO: 2655602 - RNA, 13 nt, Escherichia coli CFT073
guuacccagcacg

SEQ ID NO: 2655603 - RNA, 21 nt, Escherichia coli CFT073
guuacccagcgccaugccaac

SEQ ID NO: 2655604 - RNA, 17 nt, Escherichia coli CFT073
guuaccgaauccagcaa

SEQ ID NO: 2655605 - RNA, 15 nt, Escherichia coli CFT073
guuaccgaucgccag

SEQ ID NO: 2655606 - RNA, 16 nt, Escherichia coli CFT073
guuaccgaucgccagc

SEQ ID NO: 2655607 - RNA, 14 nt, Escherichia coli CFT073
guuaccgccagcac

SEQ ID NO: 2655608 - RNA, 19 nt, Escherichia coli CFT073
guuaccgccagcaccgggc

SEQ ID NO: 2655609 - RNA, 19 nt, Escherichia coli CFT073
guuaccgccggcuucaucu

SEQ ID NO: 2655610 - RNA, 19 nt, Escherichia coli CFT073
guuaccgccuuaacgcggc

SEQ ID NO: 2655611 - RNA, 18 nt, Escherichia coli CFT073
guuaccgcgucuucaucu

SEQ ID NO: 2655612 - RNA, 17 nt, Escherichia coli CFT073
guuaccguaccaggcau

SEQ ID NO: 2655613 - RNA, 18 nt, Escherichia coli CFT073
guuaccuucggccccauc

SEQ ID NO: 2655614 - RNA, 14 nt, Escherichia coli CFT073
guuacgaaaaggau

SEQ ID NO: 2655615 - RNA, 18 nt, Escherichia coli CFT073
guuacgaagcagcaucag

SEQ ID NO: 2655616 - RNA, 14 nt, Escherichia coli CFT073
guuacgaccuacaa

SEQ ID NO: 2655617 - RNA, 21 nt, Escherichia coli CFT073
guuacgauaaucaggaaugug

SEQ ID NO: 2655618 - RNA, 17 nt, Escherichia coli CFT073
guuacgcaagccaggua

SEQ ID NO: 2655619 - RNA, 13 nt, Escherichia coli CFT073
guuacgcaccggg

SEQ ID NO: 2655620 - RNA, 12 nt, Escherichia coli CFT073
guuacgccaucu

SEQ ID NO: 2655621 - RNA, 21 nt, Escherichia coli CFT073
guuacgccccgguuucucuuc

SEQ ID NO: 2655622 - RNA, 19 nt, Escherichia coli CFT073
guuacgccgcacccggcac

SEQ ID NO: 2655623 - RNA, 16 nt, Escherichia coli CFT073
guuacgcgcaguuucc

SEQ ID NO: 2655624 - RNA, 14 nt, Escherichia coli CFT073
guuacggaaacucu

SEQ ID NO: 2655625 - RNA, 17 nt, Escherichia coli CFT073
guuacggaucuggaaca

SEQ ID NO: 2655626 - RNA, 23 nt, Escherichia coli CFT073
guuacguccauguagcucaucug

SEQ ID NO: 2655627 - RNA, 12 nt, Escherichia coli CFT073
guuacuaaaagu

SEQ ID NO: 2655628 - RNA, 16 nt, Escherichia coli CFT073
guuacuaaaaguaaau

SEQ ID NO: 2655629 - RNA, 18 nt, Escherichia coli CFT073
guuacuaccggcgugcgu

SEQ ID NO: 2655630 - RNA, 18 nt, Escherichia coli CFT073
guuacuauccugaaagcu

SEQ ID NO: 2655631 - RNA, 13 nt, Escherichia coli CFT073
guuacuccgccac

SEQ ID NO: 2655632 - RNA, 21 nt, Escherichia coli CFT073
guuacuccgccacacucucgc

SEQ ID NO: 2655633 - RNA, 16 nt, Escherichia coli CFT073
guuacugacaucgcuu

SEQ ID NO: 2655634 - RNA, 16 nt, Escherichia coli CFT073
guuacugccaucuucc

SEQ ID NO: 2655635 - RNA, 15 nt, Escherichia coli CFT073
guuacuucgcauccg

SEQ ID NO: 2655636 - RNA, 18 nt, Escherichia coli CFT073
guuacuucuuaaugccca

SEQ ID NO: 2655637 - RNA, 19 nt, Escherichia coli CFT073
guuacuugucgauaaacgg

SEQ ID NO: 2655638 - RNA, 17 nt, Escherichia coli CFT073
guuagaaacgccccagc

SEQ ID NO: 2655639 - RNA, 19 nt, Escherichia coli CFT073
guuagaacccaacagauga

SEQ ID NO: 2655640 - RNA, 18 nt, Escherichia coli CFT073
guuagacgcguuuacaga

SEQ ID NO: 2655641 - RNA, 13 nt, Escherichia coli CFT073
guuccaauaaauc

SEQ ID NO: 2655642 - RNA, 20 nt, Escherichia coli CFT073
guuccacauaaaguagccaa

SEQ ID NO: 2655643 - RNA, 18 nt, Escherichia coli CFT073
guuccaccgcguuuucca

SEQ ID NO: 2655644 - RNA, 22 nt, Escherichia coli CFT073
guuccaccgcguuuuccaguuc

SEQ ID NO: 2655645 - RNA, 21 nt, Escherichia coli CFT073
guuccacggaauauuucaccg

SEQ ID NO: 2655646 - RNA, 18 nt, Escherichia coli CFT073
guuccacgucacaggcca

SEQ ID NO: 2655647 - RNA, 15 nt, Escherichia coli CFT073
guuccacucuucccu

SEQ ID NO: 2655648 - RNA, 15 nt, Escherichia coli CFT073
guuccacuuugcuuu

SEQ ID NO: 2655649 - RNA, 12 nt, Escherichia coli CFT073
guuccagcagaa

SEQ ID NO: 2655650 - RNA, 13 nt, Escherichia coli CFT073
guuccagcagcuc

SEQ ID NO: 2655651 - RNA, 22 nt, Escherichia coli CFT073
guuccagcauguuauucaugcc

SEQ ID NO: 2655652 - RNA, 22 nt, Escherichia coli CFT073
guuccagcuucagauucagcgu

SEQ ID NO: 2655653 - RNA, 18 nt, Escherichia coli CFT073
guuccagggccuccugca

SEQ ID NO: 2655654 - RNA, 17 nt, Escherichia coli CFT073
guuccaguucacgaacg

SEQ ID NO: 2655655 - RNA, 16 nt, Escherichia coli CFT073
guuccaguucgcuggc

SEQ ID NO: 2655656 - RNA, 18 nt, Escherichia coli CFT073
guuccauccaccagcccc

SEQ ID NO: 2655657 - RNA, 19 nt, Escherichia coli CFT073
guuccauuucugcggguga

SEQ ID NO: 2655658 - RNA, 14 nt, Escherichia coli CFT073
guucccaacaacag

SEQ ID NO: 2655659 - RNA, 21 nt, Escherichia coli CFT073
guucccaccucgugcaccgcc

SEQ ID NO: 2655660 - RNA, 13 nt, Escherichia coli CFT073
guuccgauaaguu

SEQ ID NO: 2655661 - RNA, 12 nt, Escherichia coli CFT073
guuccgcaaucc

SEQ ID NO: 2655662 - RNA, 19 nt, Escherichia coli CFT073
guuccggauaucggcagcg

SEQ ID NO: 2655663 - RNA, 23 nt, Escherichia coli CFT073
guuccggcaaucaacagauaaau

SEQ ID NO: 2655664 - RNA, 18 nt, Escherichia coli CFT073
guuccggguuuucaacug

SEQ ID NO: 2655665 - RNA, 21 nt, Escherichia coli CFT073
guuccgguaaaucgacccuga

SEQ ID NO: 2655666 - RNA, 15 nt, Escherichia coli CFT073
guuccguuuccagcc

SEQ ID NO: 2655667 - RNA, 20 nt, Escherichia coli CFT073
guuccugacuugccagccau

SEQ ID NO: 2655668 - RNA, 14 nt, Escherichia coli CFT073
guuccuguauuuga

SEQ ID NO: 2655669 - RNA, 13 nt, Escherichia coli CFT073
guuccuugcugcg

SEQ ID NO: 2655670 - RNA, 15 nt, Escherichia coli CFT073
guucgaauccuuccc

SEQ ID NO: 2655671 - RNA, 15 nt, Escherichia coli CFT073
guucgagaaaaccga

SEQ ID NO: 2655672 - RNA, 17 nt, Escherichia coli CFT073
guucgagguaguagccg

SEQ ID NO: 2655673 - RNA, 17 nt, Escherichia coli CFT073
guucgauaaccaucccu

SEQ ID NO: 2655674 - RNA, 19 nt, Escherichia coli CFT073
guucgaucaccgcacggcg

SEQ ID NO: 2655675 - RNA, 23 nt, Escherichia coli CFT073
guucgaugcgauaaccaggcagu

SEQ ID NO: 2655676 - RNA, 15 nt, Escherichia coli CFT073
guucgauuucauuca

SEQ ID NO: 2655677 - RNA, 17 nt, Escherichia coli CFT073
guucgcaccaaauccaa

SEQ ID NO: 2655678 - RNA, 18 nt, Escherichia coli CFT073
guucgcaccaaauccaac

SEQ ID NO: 2655679 - RNA, 14 nt, Escherichia coli CFT073
guucgccagcguca

SEQ ID NO: 2655680 - RNA, 19 nt, Escherichia coli CFT073
guucgccagcuccagcgcu

SEQ ID NO: 2655681 - RNA, 20 nt, Escherichia coli CFT073
guucgccagucuccaggcag

SEQ ID NO: 2655682 - RNA, 11 nt, Escherichia coli CFT073
guucgccauca

SEQ ID NO: 2655683 - RNA, 20 nt, Escherichia coli CFT073
guucgccccauacagcgucg

SEQ ID NO: 2655684 - RNA, 19 nt, Escherichia coli CFT073
guucgccuucauucaccag

SEQ ID NO: 2655685 - RNA, 17 nt, Escherichia coli CFT073
guucgccuuccagcagc

SEQ ID NO: 2655686 - RNA, 18 nt, Escherichia coli CFT073
guucgccuuccagcagcu

SEQ ID NO: 2655687 - RNA, 18 nt, Escherichia coli CFT073
guucgccuuugauuuuca

SEQ ID NO: 2655688 - RNA, 15 nt, Escherichia coli CFT073
guucgcgccaacagc

SEQ ID NO: 2655689 - RNA, 15 nt, Escherichia coli CFT073
guucgcguaccgcug

SEQ ID NO: 2655690 - RNA, 20 nt, Escherichia coli CFT073
guucgcguagcugcugcuca

SEQ ID NO: 2655691 - RNA, 11 nt, Escherichia coli CFT073
guucgcugccu

SEQ ID NO: 2655692 - RNA, 13 nt, Escherichia coli CFT073
guucgcuuugaau

SEQ ID NO: 2655693 - RNA, 16 nt, Escherichia coli CFT073
guucgcuuugaaugug

SEQ ID NO: 2655694 - RNA, 18 nt, Escherichia coli CFT073
guucgcuuuuauuucugc

SEQ ID NO: 2655695 - RNA, 21 nt, Escherichia coli CFT073
guucggacauguuuuccagca

SEQ ID NO: 2655696 - RNA, 18 nt, Escherichia coli CFT073
guucggaccaaugcccaa

SEQ ID NO: 2655697 - RNA, 21 nt, Escherichia coli CFT073
guucggcagccugcgucgcca

SEQ ID NO: 2655698 - RNA, 13 nt, Escherichia coli CFT073
guucggcaucauc

SEQ ID NO: 2655699 - RNA, 19 nt, Escherichia coli CFT073
guucggcgagcaguuguuc

SEQ ID NO: 2655700 - RNA, 14 nt, Escherichia coli CFT073
guucggcggaugca

SEQ ID NO: 2655701 - RNA, 17 nt, Escherichia coli CFT073
guucggcggaugcagga

SEQ ID NO: 2655702 - RNA, 16 nt, Escherichia coli CFT073
guucggcguucaccag

SEQ ID NO: 2655703 - RNA, 21 nt, Escherichia coli CFT073
guucgguaaguuaccggcaau

SEQ ID NO: 2655704 - RNA, 14 nt, Escherichia coli CFT073
guucggucagcgca

SEQ ID NO: 2655705 - RNA, 16 nt, Escherichia coli CFT073
guucggugcgcgcugg

SEQ ID NO: 2655706 - RNA, 19 nt, Escherichia coli CFT073
guucguagccacgaucgau

SEQ ID NO: 2655707 - RNA, 16 nt, Escherichia coli CFT073
guucgucauacuccag

SEQ ID NO: 2655708 - RNA, 15 nt, Escherichia coli CFT073
guucgucuuccgggu

SEQ ID NO: 2655709 - RNA, 16 nt, Escherichia coli CFT073
guucguugauaauaaa

SEQ ID NO: 2655710 - RNA, 20 nt, Escherichia coli CFT073
guucucaauuaccguuguua

SEQ ID NO: 2655711 - RNA, 17 nt, Escherichia coli CFT073
guucucaccaacuggcg

SEQ ID NO: 2655712 - RNA, 20 nt, Escherichia coli CFT073
guucucccauaggaugaggu

SEQ ID NO: 2655713 - RNA, 12 nt, Escherichia coli CFT073
guucuccucaac

SEQ ID NO: 2655714 - RNA, 23 nt, Escherichia coli CFT073
guucuccucaacgaugcgaccgc

SEQ ID NO: 2655715 - RNA, 16 nt, Escherichia coli CFT073
guucucgcgauaaaac

SEQ ID NO: 2655716 - RNA, 22 nt, Escherichia coli CFT073
guucucgcgauaaaacuucugc

SEQ ID NO: 2655717 - RNA, 14 nt, Escherichia coli CFT073
guucucuucugcuu

SEQ ID NO: 2655718 - RNA, 16 nt, Escherichia coli CFT073
guucugcaaggcgagc

SEQ ID NO: 2655719 - RNA, 19 nt, Escherichia coli CFT073
guucugccaaacgcuccca

SEQ ID NO: 2655720 - RNA, 18 nt, Escherichia coli CFT073
guucugcgacgcgcggug

SEQ ID NO: 2655721 - RNA, 18 nt, Escherichia coli CFT073
guucugcggcguaacgca

SEQ ID NO: 2655722 - RNA, 23 nt, Escherichia coli CFT073
guucugcggcguaacgcaccagg

SEQ ID NO: 2655723 - RNA, 19 nt, Escherichia coli CFT073
guucugcgucuuauuggca

SEQ ID NO: 2655724 - RNA, 22 nt, Escherichia coli CFT073
guucugcguuaagacuuuuuuc

SEQ ID NO: 2655725 - RNA, 22 nt, Escherichia coli CFT073
guucuggucgcggaccaacaaa

SEQ ID NO: 2655726 - RNA, 20 nt, Escherichia coli CFT073
guucugucgauaaacucaug

SEQ ID NO: 2655727 - RNA, 16 nt, Escherichia coli CFT073
guucuguggcagggca

SEQ ID NO: 2655728 - RNA, 12 nt, Escherichia coli CFT073
guucuuacccac

SEQ ID NO: 2655729 - RNA, 17 nt, Escherichia coli CFT073
guucuucacugacgccc

SEQ ID NO: 2655730 - RNA, 15 nt, Escherichia coli CFT073
guucuuccgccagac

SEQ ID NO: 2655731 - RNA, 24 nt, Escherichia coli CFT073
guucuucgagugucacuggccagc

SEQ ID NO: 2655732 - RNA, 22 nt, Escherichia coli CFT073
guucuucgccauaacaaauauc

SEQ ID NO: 2655733 - RNA, 16 nt, Escherichia coli CFT073
guucuucgcugacagu

SEQ ID NO: 2655734 - RNA, 17 nt, Escherichia coli CFT073
guucuucuguuaaauca

SEQ ID NO: 2655735 - RNA, 20 nt, Escherichia coli CFT073
guucuuuaucacgaccguca

SEQ ID NO: 2655736 - RNA, 22 nt, Escherichia coli CFT073
guucuuucaggcgugaagcccc

SEQ ID NO: 2655737 - RNA, 13 nt, Escherichia coli CFT073
guucuuuccugcg

SEQ ID NO: 2655738 - RNA, 15 nt, Escherichia coli CFT073
guucuuucucgccuu

SEQ ID NO: 2655739 - RNA, 13 nt, Escherichia coli CFT073
guucuuuuuuuaa

SEQ ID NO: 2655740 - RNA, 18 nt, Escherichia coli CFT073
guugaaaaccauaaugau

SEQ ID NO: 2655741 - RNA, 16 nt, Escherichia coli CFT073
guugaaauaaaccagu

SEQ ID NO: 2655742 - RNA, 22 nt, Escherichia coli CFT073
guugaaauaauacguagcacca

SEQ ID NO: 2655743 - RNA, 12 nt, Escherichia coli CFT073
guugaacagacg

SEQ ID NO: 2655744 - RNA, 19 nt, Escherichia coli CFT073
guugaagaucaugaugaug

SEQ ID NO: 2655745 - RNA, 15 nt, Escherichia coli CFT073
guugaagcgcgauca

SEQ ID NO: 2655746 - RNA, 18 nt, Escherichia coli CFT073
guugaauugcagggugca

SEQ ID NO: 2655747 - RNA, 22 nt, Escherichia coli CFT073
guugaauuucagguucugacca

SEQ ID NO: 2655748 - RNA, 17 nt, Escherichia coli CFT073
guugaccugcgaccggc

SEQ ID NO: 2655749 - RNA, 17 nt, Escherichia coli CFT073
guuuaauaaucgcauca

SEQ ID NO: 2655750 - RNA, 13 nt, Escherichia coli CFT073
guuuaaugccggc

SEQ ID NO: 2655751 - RNA, 17 nt, Escherichia coli CFT073
guuuaaugguuugcccu

SEQ ID NO: 2655752 - RNA, 19 nt, Escherichia coli CFT073
guuuacauggcagaccaaa

SEQ ID NO: 2655753 - RNA, 22 nt, Escherichia coli CFT073
guuuaccaacgccgggaugaac

SEQ ID NO: 2655754 - RNA, 13 nt, Escherichia coli CFT073
guuuaccacggcu

SEQ ID NO: 2655755 - RNA, 14 nt, Escherichia coli CFT073
guuuaccagcagcc

SEQ ID NO: 2655756 - RNA, 22 nt, Escherichia coli CFT073
guuuacccagugaauccagcau

SEQ ID NO: 2655757 - RNA, 23 nt, Escherichia coli CFT073
guuuaccggugauuucgccauca

SEQ ID NO: 2655758 - RNA, 19 nt, Escherichia coli CFT073
guuuaccggugccagcaac

SEQ ID NO: 2655759 - RNA, 18 nt, Escherichia coli CFT073
guuuaccucgucaccacc

SEQ ID NO: 2655760 - RNA, 14 nt, Escherichia coli CFT073
guuuacgaaccuuc

SEQ ID NO: 2655761 - RNA, 14 nt, Escherichia coli CFT073
guuuacgauuguua

SEQ ID NO: 2655762 - RNA, 13 nt, Escherichia coli CFT073
guuuacgcccgga

SEQ ID NO: 2655763 - RNA, 15 nt, Escherichia coli CFT073
guuuacgccgcauca

SEQ ID NO: 2655764 - RNA, 19 nt, Escherichia coli CFT073
guuuacgccgcaucaggcc

SEQ ID NO: 2655765 - RNA, 22 nt, Escherichia coli CFT073
guuuacgccgcauccgacauca

SEQ ID NO: 2655766 - RNA, 17 nt, Escherichia coli CFT073
guuuacgccggaugcgg

SEQ ID NO: 2655767 - RNA, 18 nt, Escherichia coli CFT073
guuuacggcuaaaaaaag

SEQ ID NO: 2655768 - RNA, 18 nt, Escherichia coli CFT073
guuuacucguccauagua

SEQ ID NO: 2655769 - RNA, 23 nt, Escherichia coli CFT073
guuuacuucgcuuuacccugguu

SEQ ID NO: 2655770 - RNA, 13 nt, Escherichia coli CFT073
guuuagacgcugc

SEQ ID NO: 2655771 - RNA, 15 nt, Escherichia coli CFT073
guuuagacgcugcgg

SEQ ID NO: 2655772 - RNA, 17 nt, Escherichia coli CFT073
guuuagcaguucaucaa

SEQ ID NO: 2655773 - RNA, 15 nt, Escherichia coli CFT073
guuuagccaaaaauc

SEQ ID NO: 2655774 - RNA, 19 nt, Escherichia coli CFT073
guuuagccgcuucugcagc

SEQ ID NO: 2655775 - RNA, 20 nt, Escherichia coli CFT073
guuuauaacggugcugcaca

SEQ ID NO: 2655776 - RNA, 18 nt, Escherichia coli CFT073
guuuauagccuguccaca

SEQ ID NO: 2655777 - RNA, 20 nt, Escherichia coli CFT073
guuuaucaauauccagucgg

SEQ ID NO: 2655778 - RNA, 14 nt, Escherichia coli CFT073
guuuaucaaucuca

SEQ ID NO: 2655779 - RNA, 12 nt, Escherichia coli CFT073
guuuauccaucu

SEQ ID NO: 2655780 - RNA, 19 nt, Escherichia coli CFT073
guuuaucuuccagcauuuc

SEQ ID NO: 2655781 - RNA, 21 nt, Escherichia coli CFT073
guuuaugcaauagcgccugcu

SEQ ID NO: 2655782 - RNA, 17 nt, Escherichia coli CFT073
guuuaugccggaugcgg

SEQ ID NO: 2655783 - RNA, 16 nt, Escherichia coli CFT073
guuucaaaaacaaaga

SEQ ID NO: 2655784 - RNA, 16 nt, Escherichia coli CFT073
guuucaaacaggcugc

SEQ ID NO: 2655785 - RNA, 20 nt, Escherichia coli CFT073
guuucaacaucauuucccac

SEQ ID NO: 2655786 - RNA, 14 nt, Escherichia coli CFT073
guuucaaccagcag

SEQ ID NO: 2655787 - RNA, 15 nt, Escherichia coli CFT073
guuucaaccagcagg

SEQ ID NO: 2655788 - RNA, 23 nt, Escherichia coli CFT073
guuucaacggaccaauaaacgcc

SEQ ID NO: 2655789 - RNA, 15 nt, Escherichia coli CFT073
guuucaauacucugc

SEQ ID NO: 2655790 - RNA, 20 nt, Escherichia coli CFT073
guuucaauauccgguucacu

SEQ ID NO: 2655791 - RNA, 15 nt, Escherichia coli CFT073
guuucaauccaggua

SEQ ID NO: 2655792 - RNA, 22 nt, Escherichia coli CFT073
guuucacaacauugauaagcaa

SEQ ID NO: 2655793 - RNA, 22 nt, Escherichia coli CFT073
guuucaccagcaguaaaccgcu

SEQ ID NO: 2655794 - RNA, 18 nt, Escherichia coli CFT073
guuucaccgaugcacaga

SEQ ID NO: 2655795 - RNA, 16 nt, Escherichia coli CFT073
guuucacguaccagau

SEQ ID NO: 2655796 - RNA, 18 nt, Escherichia coli CFT073
guuucacuaagauguugu

SEQ ID NO: 2655797 - RNA, 18 nt, Escherichia coli CFT073
guuucagaccaauaaucc

SEQ ID NO: 2655798 - RNA, 19 nt, Escherichia coli CFT073
guuucagcaucccaggcau

SEQ ID NO: 2655799 - RNA, 21 nt, Escherichia coli CFT073
guuucagccagucauaauuca

SEQ ID NO: 2655800 - RNA, 15 nt, Escherichia coli CFT073
guuucagccccauca

SEQ ID NO: 2655801 - RNA, 20 nt, Escherichia coli CFT073
guuucagccccaucagcgcc

SEQ ID NO: 2655802 - RNA, 21 nt, Escherichia coli CFT073
guuucagugacgucacuuaau

SEQ ID NO: 2655803 - RNA, 14 nt, Escherichia coli CFT073
guuucauaguuuua

SEQ ID NO: 2655804 - RNA, 16 nt, Escherichia coli CFT073
guuucauaucugccag

SEQ ID NO: 2655805 - RNA, 17 nt, Escherichia coli CFT073
guuucauaucugccaga

SEQ ID NO: 2655806 - RNA, 21 nt, Escherichia coli CFT073
guuucauaucugccagauaau

SEQ ID NO: 2655807 - RNA, 11 nt, Escherichia coli CFT073
guuucaucuca

SEQ ID NO: 2655808 - RNA, 12 nt, Escherichia coli CFT073
guuucaucuuca

SEQ ID NO: 2655809 - RNA, 18 nt, Escherichia coli CFT073
guuucaucuucagucagg

SEQ ID NO: 2655810 - RNA, 16 nt, Escherichia coli CFT073
guuucauguaacgcug

SEQ ID NO: 2655811 - RNA, 12 nt, Escherichia coli CFT073
guuuccagcacc

SEQ ID NO: 2655812 - RNA, 15 nt, Escherichia coli CFT073
guuuccagcaccagu

SEQ ID NO: 2655813 - RNA, 13 nt, Escherichia coli CFT073
guuuccaggcagc

SEQ ID NO: 2655814 - RNA, 14 nt, Escherichia coli CFT073
guuuccaggcuggu

SEQ ID NO: 2655815 - RNA, 16 nt, Escherichia coli CFT073
guuuccaguugaacaa

SEQ ID NO: 2655816 - RNA, 14 nt, Escherichia coli CFT073
guuuccauaaccgc

SEQ ID NO: 2655817 - RNA, 17 nt, Escherichia coli CFT073
guuuccauaucgcuggc

SEQ ID NO: 2655818 - RNA, 18 nt, Escherichia coli CFT073
guuuccauaucgcuggcu

SEQ ID NO: 2655819 - RNA, 17 nt, Escherichia coli CFT073
guuucccagcuuuugac

SEQ ID NO: 2655820 - RNA, 20 nt, Escherichia coli CFT073
guuucccgcuccaaaauuug

SEQ ID NO: 2655821 - RNA, 23 nt, Escherichia coli CFT073
guuuccggugcuuuauacaaaug

SEQ ID NO: 2655822 - RNA, 23 nt, Escherichia coli CFT073
guuuccuggagaguguuuuaucu

SEQ ID NO: 2655823 - RNA, 22 nt, Escherichia coli CFT073
guuucgaaauccgguucauggu

SEQ ID NO: 2655824 - RNA, 16 nt, Escherichia coli CFT073
guuucgacaauaauca

SEQ ID NO: 2655825 - RNA, 15 nt, Escherichia coli CFT073
guuucgauuaacuaa

SEQ ID NO: 2655826 - RNA, 18 nt, Escherichia coli CFT073
guuucgcauccagagauu

SEQ ID NO: 2655827 - RNA, 12 nt, Escherichia coli CFT073
guuucgccagcc

SEQ ID NO: 2655828 - RNA, 12 nt, Escherichia coli CFT073
guuucgccaucg

SEQ ID NO: 2655829 - RNA, 20 nt, Escherichia coli CFT073
guuucgcccguucuuccuca

SEQ ID NO: 2655830 - RNA, 13 nt, Escherichia coli CFT073
guuucgccugcca

SEQ ID NO: 2655831 - RNA, 16 nt, Escherichia coli CFT073
guuucgccugccagau

SEQ ID NO: 2655832 - RNA, 14 nt, Escherichia coli CFT073
guuucgcgccaucc

SEQ ID NO: 2655833 - RNA, 16 nt, Escherichia coli CFT073
guuucgcuucuucagc

SEQ ID NO: 2655834 - RNA, 17 nt, Escherichia coli CFT073
guuucggccccgguucg

SEQ ID NO: 2655835 - RNA, 15 nt, Escherichia coli CFT073
guuucgggcgguuug

SEQ ID NO: 2655836 - RNA, 18 nt, Escherichia coli CFT073
guuucggguucgccaucc

SEQ ID NO: 2655837 - RNA, 16 nt, Escherichia coli CFT073
guuucgguagaaaaau

SEQ ID NO: 2655838 - RNA, 17 nt, Escherichia coli CFT073
guuucuacaagcagaga

SEQ ID NO: 2655839 - RNA, 18 nt, Escherichia coli CFT073
guuucuacaagcagagag

SEQ ID NO: 2655840 - RNA, 20 nt, Escherichia coli CFT073
guuucuacaagcagagagac

SEQ ID NO: 2655841 - RNA, 18 nt, Escherichia coli CFT073
guuucucugacgcucuca

SEQ ID NO: 2655842 - RNA, 23 nt, Escherichia coli CFT073
guuucucugacgcucucaacgcc

SEQ ID NO: 2655843 - RNA, 20 nt, Escherichia coli CFT073
guuucucuuaaaugcacaau

SEQ ID NO: 2655844 - RNA, 12 nt, Escherichia coli CFT073
guuucugauaca

SEQ ID NO: 2655845 - RNA, 19 nt, Escherichia coli CFT073
guuucugccagcguggcga

SEQ ID NO: 2655846 - RNA, 16 nt, Escherichia coli CFT073
guuucugccgguucgg

SEQ ID NO: 2655847 - RNA, 20 nt, Escherichia coli CFT073
guuucugcgcuucugccacg

SEQ ID NO: 2655848 - RNA, 22 nt, Escherichia coli CFT073
guuucuggcguaccggagacga

SEQ ID NO: 2655849 - RNA, 14 nt, Escherichia coli CFT073
guuucuucacccuu

SEQ ID NO: 2655850 - RNA, 15 nt, Escherichia coli CFT073
guuucuuccagccac

SEQ ID NO: 2655851 - RNA, 14 nt, Escherichia coli CFT073
guuucuucgaagaa

SEQ ID NO: 2655852 - RNA, 18 nt, Escherichia coli CFT073
guuucuucgaagaaaaac

SEQ ID NO: 2655853 - RNA, 17 nt, Escherichia coli CFT073
guuucuucgauggcugg

SEQ ID NO: 2655854 - RNA, 20 nt, Escherichia coli CFT073
guuucuucgauggcuggggu

SEQ ID NO: 2655855 - RNA, 21 nt, Escherichia coli CFT073
guuugaaaugauuacucccuu

SEQ ID NO: 2655856 - RNA, 21 nt, Escherichia coli CFT073
guuugacuuauaagucucaga

SEQ ID NO: 2655857 - RNA, 22 nt, Escherichia coli CFT073
uaaaaaagaaaugccugcacuu

SEQ ID NO: 2655858 - RNA, 22 nt, Escherichia coli CFT073
uaaaaaaggcaccgauuccccc

SEQ ID NO: 2655859 - RNA, 19 nt, Escherichia coli CFT073
uaaaaaaggcagccaucug

SEQ ID NO: 2655860 - RNA, 15 nt, Escherichia coli CFT073
uaaaaacagccagca

SEQ ID NO: 2655861 - RNA, 23 nt, Escherichia coli CFT073
uaaaaacaguaccagaccaacau

SEQ ID NO: 2655862 - RNA, 21 nt, Escherichia coli CFT073
uaaaaaccagagaauauuaac

SEQ ID NO: 2655863 - RNA, 17 nt, Escherichia coli CFT073
uaaaaagaagaucauca

SEQ ID NO: 2655864 - RNA, 23 nt, Escherichia coli CFT073
uaaaaagaaugacccauuuguua

SEQ ID NO: 2655865 - RNA, 19 nt, Escherichia coli CFT073
uaaaaagcagguuguuaag

SEQ ID NO: 2655866 - RNA, 19 nt, Escherichia coli CFT073
uaaaaaguuguuaauaagu

SEQ ID NO: 2655867 - RNA, 22 nt, Escherichia coli CFT073
uaaaaaguuguuaauaaguuuu

SEQ ID NO: 2655868 - RNA, 18 nt, Escherichia coli CFT073
uaaaaauaccgagcagcc

SEQ ID NO: 2655869 - RNA, 17 nt, Escherichia coli CFT073
uaaaaauauauuccuau

SEQ ID NO: 2655870 - RNA, 18 nt, Escherichia coli CFT073
uaaaaauauauuccuaua

SEQ ID NO: 2655871 - RNA, 16 nt, Escherichia coli CFT073
uaaaaaucaaaugcug

SEQ ID NO: 2655872 - RNA, 17 nt, Escherichia coli CFT073
uaaaaauccuguuccau

SEQ ID NO: 2655873 - RNA, 15 nt, Escherichia coli CFT073
uaaaacaaauaucug

SEQ ID NO: 2655874 - RNA, 15 nt, Escherichia coli CFT073
uaaaacaagcagcug

SEQ ID NO: 2655875 - RNA, 15 nt, Escherichia coli CFT073
uaaaacagccaaugc

SEQ ID NO: 2655876 - RNA, 18 nt, Escherichia coli CFT073
uaaaacagccuuguauua

SEQ ID NO: 2655877 - RNA, 19 nt, Escherichia coli CFT073
uaaaacagccuuguauuaa

SEQ ID NO: 2655878 - RNA, 19 nt, Escherichia coli CFT073
uaaaacaucucuucccacg

SEQ ID NO: 2655879 - RNA, 12 nt, Escherichia coli CFT073
uaaaacauuacu

SEQ ID NO: 2655880 - RNA, 12 nt, Escherichia coli CFT073
uaaaaccaaugg

SEQ ID NO: 2655881 - RNA, 16 nt, Escherichia coli CFT073
uaaaaccaauucacau

SEQ ID NO: 2655882 - RNA, 20 nt, Escherichia coli CFT073
uaaaacccagaccggcgcac

SEQ ID NO: 2655883 - RNA, 16 nt, Escherichia coli CFT073
uaaaaccgacuuaaaa

SEQ ID NO: 2655884 - RNA, 19 nt, Escherichia coli CFT073
uaaaaccggcggcaaugga

SEQ ID NO: 2655885 - RNA, 23 nt, Escherichia coli CFT073
uaaaaccggugugguaaauuuug

SEQ ID NO: 2655886 - RNA, 17 nt, Escherichia coli CFT073
uaaaaccgugcuucagc

SEQ ID NO: 2655887 - RNA, 13 nt, Escherichia coli CFT073
uaaaaccugccaa

SEQ ID NO: 2655888 - RNA, 18 nt, Escherichia coli CFT073
uaaaacgccgcuggugau

SEQ ID NO: 2655889 - RNA, 21 nt, Escherichia coli CFT073
uaaaacgccgcuggugauuca

SEQ ID NO: 2655890 - RNA, 12 nt, Escherichia coli CFT073
uaaaacgccuga

SEQ ID NO: 2655891 - RNA, 20 nt, Escherichia coli CFT073
uaaaacggcgcauugccuga

SEQ ID NO: 2655892 - RNA, 16 nt, Escherichia coli CFT073
uaaaacgggauagcgu

SEQ ID NO: 2655893 - RNA, 18 nt, Escherichia coli CFT073
uaaaacgggauuccugcg

SEQ ID NO: 2655894 - RNA, 18 nt, Escherichia coli CFT073
uaaaacgguggccacagc

SEQ ID NO: 2655895 - RNA, 16 nt, Escherichia coli CFT073
uaaaacucacaaccag

SEQ ID NO: 2655896 - RNA, 13 nt, Escherichia coli CFT073
uaaaacugccaga

SEQ ID NO: 2655897 - RNA, 23 nt, Escherichia coli CFT073
uaaaacugcgcguuauguagacu

SEQ ID NO: 2655898 - RNA, 13 nt, Escherichia coli CFT073
uaaaacuucauuu

SEQ ID NO: 2655899 - RNA, 20 nt, Escherichia coli CFT073
uaaaagccaggagccaacac

SEQ ID NO: 2655900 - RNA, 20 nt, Escherichia coli CFT073
uaaaagccauucuggcgcaa

SEQ ID NO: 2655901 - RNA, 15 nt, Escherichia coli CFT073
uaaaagcccaucauu

SEQ ID NO: 2655902 - RNA, 14 nt, Escherichia coli CFT073
uaaaagccccuucg

SEQ ID NO: 2655903 - RNA, 16 nt, Escherichia coli CFT073
uaaaagcccggaugcg

SEQ ID NO: 2655904 - RNA, 22 nt, Escherichia coli CFT073
uaaaagcgugaaacaaaucacu

SEQ ID NO: 2655905 - RNA, 21 nt, Escherichia coli CFT073
uaaaagcuuaugcuguacuuu

SEQ ID NO: 2655906 - RNA, 22 nt, Escherichia coli CFT073
uaaaagcuuuccggaaaaauca

SEQ ID NO: 2655907 - RNA, 21 nt, Escherichia coli CFT073
uaaaaggauuggguuaagccg

SEQ ID NO: 2655908 - RNA, 17 nt, Escherichia coli CFT073
uaaaaggcgucauguaa

SEQ ID NO: 2655909 - RNA, 21 nt, Escherichia coli CFT073
uaaaaggcgucauguaaugca

SEQ ID NO: 2655910 - RNA, 15 nt, Escherichia coli CFT073
uaaaagggcagcagg

SEQ ID NO: 2655911 - RNA, 16 nt, Escherichia coli CFT073
uaaaagggcagcagga

SEQ ID NO: 2655912 - RNA, 17 nt, Escherichia coli CFT073
uaaaagggcagcaggau

SEQ ID NO: 2655913 - RNA, 14 nt, Escherichia coli CFT073
uaaaaguuauuaaa

SEQ ID NO: 2655914 - RNA, 20 nt, Escherichia coli CFT073
uaaaauaaccgucuuugcug

SEQ ID NO: 2655915 - RNA, 14 nt, Escherichia coli CFT073
uaaaauaagcacaa

SEQ ID NO: 2655916 - RNA, 19 nt, Escherichia coli CFT073
uaaaauacuggcgauuuca

SEQ ID NO: 2655917 - RNA, 13 nt, Escherichia coli CFT073
uaaaauauaaggu

SEQ ID NO: 2655918 - RNA, 12 nt, Escherichia coli CFT073
uaaaauaucuuc

SEQ ID NO: 2655919 - RNA, 16 nt, Escherichia coli CFT073
uaaaaucaacgccgca

SEQ ID NO: 2655920 - RNA, 16 nt, Escherichia coli CFT073
uaaaaucagcuuccuu

SEQ ID NO: 2655921 - RNA, 21 nt, Escherichia coli CFT073
uaaaaucaucacgcgguuacg

SEQ ID NO: 2655922 - RNA, 12 nt, Escherichia coli CFT073
uaaaauccucaa

SEQ ID NO: 2655923 - RNA, 18 nt, Escherichia coli CFT073
uaaaaucgacaucugcaa

SEQ ID NO: 2655924 - RNA, 23 nt, Escherichia coli CFT073
uaaaaucgagcguugcuucgcca

SEQ ID NO: 2655925 - RNA, 19 nt, Escherichia coli CFT073
uaaaaucgcccacucugua

SEQ ID NO: 2655926 - RNA, 23 nt, Escherichia coli CFT073
uaaaaucuauuauuauuuuugug

SEQ ID NO: 2655927 - RNA, 18 nt, Escherichia coli CFT073
uaaaaugucaccuaauuu

SEQ ID NO: 2655928 - RNA, 20 nt, Escherichia coli CFT073
uaaaaugucaccuaauuuaa

SEQ ID NO: 2655929 - RNA, 14 nt, Escherichia coli CFT073
uaaaauguguacuu

SEQ ID NO: 2655930 - RNA, 22 nt, Escherichia coli CFT073
uaaaauuauccaacuuuuccca

SEQ ID NO: 2655931 - RNA, 15 nt, Escherichia coli CFT073
uaaaauuauccagcg

SEQ ID NO: 2655932 - RNA, 20 nt, Escherichia coli CFT073
uaaaauugauaaccaauagu

SEQ ID NO: 2655933 - RNA, 23 nt, Escherichia coli CFT073
uaaaauugauaaccaauaguagu

SEQ ID NO: 2655934 - RNA, 13 nt, Escherichia coli CFT073
uaaaauuuagcaa

SEQ ID NO: 2655935 - RNA, 13 nt, Escherichia coli CFT073
uaaacaacgccgc

SEQ ID NO: 2655936 - RNA, 18 nt, Escherichia coli CFT073
uaaacaagacaucacuca

SEQ ID NO: 2655937 - RNA, 19 nt, Escherichia coli CFT073
uaaacaauggcauaaccga

SEQ ID NO: 2655938 - RNA, 21 nt, Escherichia coli CFT073
uaaacaauugcauaucaauua

SEQ ID NO: 2655939 - RNA, 16 nt, Escherichia coli CFT073
uaaacacaccacagca

SEQ ID NO: 2655940 - RNA, 12 nt, Escherichia coli CFT073
uaaacaccagca

SEQ ID NO: 2655941 - RNA, 18 nt, Escherichia coli CFT073
uaaacaccagcaauaaug

SEQ ID NO: 2655942 - RNA, 16 nt, Escherichia coli CFT073
uaaacaccagcagcag

SEQ ID NO: 2655943 - RNA, 14 nt, Escherichia coli CFT073
uaaacaccagcagu

SEQ ID NO: 2655944 - RNA, 14 nt, Escherichia coli CFT073
uaaacacucacauc

SEQ ID NO: 2655945 - RNA, 16 nt, Escherichia coli CFT073
uaaacagcagauggca

SEQ ID NO: 2655946 - RNA, 15 nt, Escherichia coli CFT073
uaaacagccccuccg

SEQ ID NO: 2655947 - RNA, 17 nt, Escherichia coli CFT073
uaaacagccccuccgga

SEQ ID NO: 2655948 - RNA, 23 nt, Escherichia coli CFT073
uaaacaggauaucugaaaguugu

SEQ ID NO: 2655949 - RNA, 19 nt, Escherichia coli CFT073
uaaacaucaggcaaaguca

SEQ ID NO: 2655950 - RNA, 16 nt, Escherichia coli CFT073
uaaacaucgccauaaa

SEQ ID NO: 2655951 - RNA, 14 nt, Escherichia coli CFT073
uaaacaucuucuua

SEQ ID NO: 2655952 - RNA, 23 nt, Escherichia coli CFT073
uaaacaucuucuuaggcauugcc

SEQ ID NO: 2655953 - RNA, 22 nt, Escherichia coli CFT073
uaaaccaaagccacccacaccg

SEQ ID NO: 2655954 - RNA, 16 nt, Escherichia coli CFT073
uaaaccaaccagcgug

SEQ ID NO: 2655955 - RNA, 22 nt, Escherichia coli CFT073
uaaaccaacuucauacauugcc

SEQ ID NO: 2655956 - RNA, 14 nt, Escherichia coli CFT073
uaaaccaaucaauu

SEQ ID NO: 2655957 - RNA, 19 nt, Escherichia coli CFT073
uaaaccacccaccagcgcc

SEQ ID NO: 2655958 - RNA, 20 nt, Escherichia coli CFT073
uaaaccacccaccagcgccg

SEQ ID NO: 2655959 - RNA, 14 nt, Escherichia coli CFT073
uaaaccaggaacag

SEQ ID NO: 2655960 - RNA, 13 nt, Escherichia coli CFT073
uaaaccaggccaa

SEQ ID NO: 2655961 - RNA, 15 nt, Escherichia coli CFT073
uaaacccguugcuuc

SEQ ID NO: 2655962 - RNA, 18 nt, Escherichia coli CFT073
uaaacccguugcuucacg

SEQ ID NO: 2655963 - RNA, 16 nt, Escherichia coli CFT073
uaaacccuucacugua

SEQ ID NO: 2655964 - RNA, 18 nt, Escherichia coli CFT073
uaaacccuuucugcugcu

SEQ ID NO: 2655965 - RNA, 21 nt, Escherichia coli CFT073
uaaaucgagaagacaaucccc

SEQ ID NO: 2655966 - RNA, 19 nt, Escherichia coli CFT073
uaaaucguucaauaggugu

SEQ ID NO: 2655967 - RNA, 22 nt, Escherichia coli CFT073
uaaaucugccgucaucgacuuc

SEQ ID NO: 2655968 - RNA, 19 nt, Escherichia coli CFT073
uaaaucugcuuuucauaca

SEQ ID NO: 2655969 - RNA, 14 nt, Escherichia coli CFT073
uaaaugaagaaaaa

SEQ ID NO: 2655970 - RNA, 20 nt, Escherichia coli CFT073
uaaaugacgggccaagcagg

SEQ ID NO: 2655971 - RNA, 16 nt, Escherichia coli CFT073
uaaaugcaaauuucca

SEQ ID NO: 2655972 - RNA, 15 nt, Escherichia coli CFT073
uaaaugcacccgcca

SEQ ID NO: 2655973 - RNA, 17 nt, Escherichia coli CFT073
uaaaugccgcaaugugc

SEQ ID NO: 2655974 - RNA, 20 nt, Escherichia coli CFT073
uaaaugccgcaaugugcucu

SEQ ID NO: 2655975 - RNA, 14 nt, Escherichia coli CFT073
uaaaugccuggaug

SEQ ID NO: 2655976 - RNA, 21 nt, Escherichia coli CFT073
uaaaugcguagguuaacccag

SEQ ID NO: 2655977 - RNA, 16 nt, Escherichia coli CFT073
uaaaugcuuuauacga

SEQ ID NO: 2655978 - RNA, 22 nt, Escherichia coli CFT073
uaaauggcgaacgggauaaacg

SEQ ID NO: 2655979 - RNA, 19 nt, Escherichia coli CFT073
uaaauggcguaugccggau

SEQ ID NO: 2655980 - RNA, 15 nt, Escherichia coli CFT073
uaaaugucaucccuu

SEQ ID NO: 2655981 - RNA, 21 nt, Escherichia coli CFT073
uaaaugucaugacauucauaa

SEQ ID NO: 2655982 - RNA, 16 nt, Escherichia coli CFT073
uaaauuaauggccuca

SEQ ID NO: 2655983 - RNA, 16 nt, Escherichia coli CFT073
uaaauuaccaccagcg

SEQ ID NO: 2655984 - RNA, 14 nt, Escherichia coli CFT073
uaaauuauagaugc

SEQ ID NO: 2655985 - RNA, 22 nt, Escherichia coli CFT073
uaaauuauagaugcagcauaga

SEQ ID NO: 2655986 - RNA, 16 nt, Escherichia coli CFT073
uaaauuccgcucugua

SEQ ID NO: 2655987 - RNA, 17 nt, Escherichia coli CFT073
uaaauucgccagacagu

SEQ ID NO: 2655988 - RNA, 20 nt, Escherichia coli CFT073
uaaauugcaauuuuuauaug

SEQ ID NO: 2655989 - RNA, 22 nt, Escherichia coli CFT073
uaaauugcugugauuaagcagc

SEQ ID NO: 2655990 - RNA, 20 nt, Escherichia coli CFT073
uaaauuguucauauuaaccu

SEQ ID NO: 2655991 - RNA, 14 nt, Escherichia coli CFT073
uaaauuuaauaucu

SEQ ID NO: 2655992 - RNA, 15 nt, Escherichia coli CFT073
uaaauuucaggcaac

SEQ ID NO: 2655993 - RNA, 19 nt, Escherichia coli CFT073
uaaauuucaggcaacaaaa

SEQ ID NO: 2655994 - RNA, 15 nt, Escherichia coli CFT073
uaaauuuccaccgcu

SEQ ID NO: 2655995 - RNA, 13 nt, Escherichia coli CFT073
uaacaaaaugccg

SEQ ID NO: 2655996 - RNA, 21 nt, Escherichia coli CFT073
uaacaaagggaaacgcggcgu

SEQ ID NO: 2655997 - RNA, 14 nt, Escherichia coli CFT073
uaacaaauacgcuu

SEQ ID NO: 2655998 - RNA, 24 nt, Escherichia coli CFT073
uaacaauaaauucgccagacagug

SEQ ID NO: 2655999 - RNA, 12 nt, Escherichia coli CFT073
uaacaauaagau

SEQ ID NO: 2656000 - RNA, 23 nt, Escherichia coli CFT073
uaacaauagcgaacagacaaaaa

SEQ ID NO: 2656001 - RNA, 20 nt, Escherichia coli CFT073
uaacaauaucuaaaauguca

SEQ ID NO: 2656002 - RNA, 13 nt, Escherichia coli CFT073
uaacaaucaucaa

SEQ ID NO: 2656003 - RNA, 14 nt, Escherichia coli CFT073
uaacaaucaucaac

SEQ ID NO: 2656004 - RNA, 20 nt, Escherichia coli CFT073
uaacaauguugucgccagua

SEQ ID NO: 2656005 - RNA, 22 nt, Escherichia coli CFT073
uaacaauguugucgccaguaau

SEQ ID NO: 2656006 - RNA, 14 nt, Escherichia coli CFT073
uaacaauuuaucag

SEQ ID NO: 2656007 - RNA, 18 nt, Escherichia coli CFT073
uaacaauuuaucagacaa

SEQ ID NO: 2656008 - RNA, 14 nt, Escherichia coli CFT073
uaacacacaauuac

SEQ ID NO: 2656009 - RNA, 18 nt, Escherichia coli CFT073
uaacacagcaauaauaau

SEQ ID NO: 2656010 - RNA, 20 nt, Escherichia coli CFT073
uaacacauaacgccaauuca

SEQ ID NO: 2656011 - RNA, 12 nt, Escherichia coli CFT073
uaacacaugcaa

SEQ ID NO: 2656012 - RNA, 14 nt, Escherichia coli CFT073
uaacaccaccagcg

SEQ ID NO: 2656013 - RNA, 16 nt, Escherichia coli CFT073
uaacaccaguuuccag

SEQ ID NO: 2656014 - RNA, 13 nt, Escherichia coli CFT073
uaacaccaucagu

SEQ ID NO: 2656015 - RNA, 14 nt, Escherichia coli CFT073
uaacaccaucagug

SEQ ID NO: 2656016 - RNA, 16 nt, Escherichia coli CFT073
uaacaccggcgcacug

SEQ ID NO: 2656017 - RNA, 19 nt, Escherichia coli CFT073
uaacacgcucuggcaggcu

SEQ ID NO: 2656018 - RNA, 13 nt, Escherichia coli CFT073
uaacacuucugcc

SEQ ID NO: 2656019 - RNA, 18 nt, Escherichia coli CFT073
uaacacuuucgccugcgg

SEQ ID NO: 2656020 - RNA, 21 nt, Escherichia coli CFT073
uaacagaagguuuauauagua

SEQ ID NO: 2656021 - RNA, 19 nt, Escherichia coli CFT073
uaacagaaugcgcgcgaaa

SEQ ID NO: 2656022 - RNA, 23 nt, Escherichia coli CFT073
uaacagaaugcgcgcgaaaacau

SEQ ID NO: 2656023 - RNA, 16 nt, Escherichia coli CFT073
uaacagcaucgcauca

SEQ ID NO: 2656024 - RNA, 18 nt, Escherichia coli CFT073
uaacagccaugccgccac

SEQ ID NO: 2656025 - RNA, 12 nt, Escherichia coli CFT073
uaacagcgcauu

SEQ ID NO: 2656026 - RNA, 20 nt, Escherichia coli CFT073
uaacagcgccgcgauaaaau

SEQ ID NO: 2656027 - RNA, 22 nt, Escherichia coli CFT073
uaacagcggugcaccugccagc

SEQ ID NO: 2656028 - RNA, 21 nt, Escherichia coli CFT073
uaacaguacgagcaucaucuu

SEQ ID NO: 2656029 - RNA, 15 nt, Escherichia coli CFT073
uaacaguaguuacgc

SEQ ID NO: 2656030 - RNA, 20 nt, Escherichia coli CFT073
uaacagugccgcgcauagca

SEQ ID NO: 2656031 - RNA, 14 nt, Escherichia coli CFT073
uaacaguuccagca

SEQ ID NO: 2656032 - RNA, 17 nt, Escherichia coli CFT073
uaacaguugcaguuauu

SEQ ID NO: 2656033 - RNA, 22 nt, Escherichia coli CFT073
uaacauaccagguaugccaacu

SEQ ID NO: 2656034 - RNA, 17 nt, Escherichia coli CFT073
uaacauaccuaaaagca

SEQ ID NO: 2656035 - RNA, 19 nt, Escherichia coli CFT073
uaacauauccccagggaag

SEQ ID NO: 2656036 - RNA, 17 nt, Escherichia coli CFT073
uaacauauucacccgcg

SEQ ID NO: 2656037 - RNA, 22 nt, Escherichia coli CFT073
uaacaucaauaacaaagggaaa

SEQ ID NO: 2656038 - RNA, 18 nt, Escherichia coli CFT073
uaacaucgcaaaauacac

SEQ ID NO: 2656039 - RNA, 14 nt, Escherichia coli CFT073
uaacaucuuaauag

SEQ ID NO: 2656040 - RNA, 19 nt, Escherichia coli CFT073
uaacaucuuaauagcugcc

SEQ ID NO: 2656041 - RNA, 21 nt, Escherichia coli CFT073
uaacaucuuaauagcugccag

SEQ ID NO: 2656042 - RNA, 16 nt, Escherichia coli CFT073
uaacauggugaaagca

SEQ ID NO: 2656043 - RNA, 17 nt, Escherichia coli CFT073
uaacauuacuaaacauu

SEQ ID NO: 2656044 - RNA, 18 nt, Escherichia coli CFT073
uaacauuacuaaacauuu

SEQ ID NO: 2656045 - RNA, 17 nt, Escherichia coli CFT073
uaacauuggucagagca

SEQ ID NO: 2656046 - RNA, 13 nt, Escherichia coli CFT073
uaacauuugcagc

SEQ ID NO: 2656047 - RNA, 19 nt, Escherichia coli CFT073
uaacauuuuaguuuacauu

SEQ ID NO: 2656048 - RNA, 22 nt, Escherichia coli CFT073
uaaccaaacguggucgccagca

SEQ ID NO: 2656049 - RNA, 21 nt, Escherichia coli CFT073
uaaccaacggcgagccagcgc

SEQ ID NO: 2656050 - RNA, 16 nt, Escherichia coli CFT073
uaaccaaugccaccca

SEQ ID NO: 2656051 - RNA, 19 nt, Escherichia coli CFT073
uaaccacaaacgauccugg

SEQ ID NO: 2656052 - RNA, 15 nt, Escherichia coli CFT073
uaaccaccagcacug

SEQ ID NO: 2656053 - RNA, 19 nt, Escherichia coli CFT073
uaaccaccaguaaauuguu

SEQ ID NO: 2656054 - RNA, 17 nt, Escherichia coli CFT073
uaaccaccguuuguugc

SEQ ID NO: 2656055 - RNA, 18 nt, Escherichia coli CFT073
uaaccaccuccacgccca

SEQ ID NO: 2656056 - RNA, 22 nt, Escherichia coli CFT073
uaaccaccuccacgcccagcgc

SEQ ID NO: 2656057 - RNA, 21 nt, Escherichia coli CFT073
uaaccacgcucagcaaucgca

SEQ ID NO: 2656058 - RNA, 18 nt, Escherichia coli CFT073
uaaccacuucagaaccgu

SEQ ID NO: 2656059 - RNA, 16 nt, Escherichia coli CFT073
uaaccacuucuucuug

SEQ ID NO: 2656060 - RNA, 14 nt, Escherichia coli CFT073
uaaccagaaaccgu

SEQ ID NO: 2656061 - RNA, 18 nt, Escherichia coli CFT073
uaaccagacgauuuuccc

SEQ ID NO: 2656062 - RNA, 21 nt, Escherichia coli CFT073
uaaccagacgccccaguaaac

SEQ ID NO: 2656063 - RNA, 11 nt, Escherichia coli CFT073
uaaccagcacc

SEQ ID NO: 2656064 - RNA, 12 nt, Escherichia coli CFT073
uaaccagcacca

SEQ ID NO: 2656065 - RNA, 14 nt, Escherichia coli CFT073
uaaccagccaaaua

SEQ ID NO: 2656066 - RNA, 18 nt, Escherichia coli CFT073
uaaccagccaaauaaaau

SEQ ID NO: 2656067 - RNA, 20 nt, Escherichia coli CFT073
uaaccagcgcagacaccaga

SEQ ID NO: 2656068 - RNA, 16 nt, Escherichia coli CFT073
uaaccagcguuuccag

SEQ ID NO: 2656069 - RNA, 21 nt, Escherichia coli CFT073
uaaccagcguuuccagcacca

SEQ ID NO: 2656070 - RNA, 12 nt, Escherichia coli CFT073
uaaccaggcaag

SEQ ID NO: 2656071 - RNA, 15 nt, Escherichia coli CFT073
uaaccaggcaguucg

SEQ ID NO: 2656072 - RNA, 17 nt, Escherichia coli CFT073
uaaccaguuuaucaaug

SEQ ID NO: 2656073 - RNA, 21 nt, Escherichia coli CFT073
uaacuccugcgucggaacauc

SEQ ID NO: 2656074 - RNA, 22 nt, Escherichia coli CFT073
uaacuccuucuaaagcaacucc

SEQ ID NO: 2656075 - RNA, 23 nt, Escherichia coli CFT073
uaacuccuucuaaagcaacucca

SEQ ID NO: 2656076 - RNA, 18 nt, Escherichia coli CFT073
uaacucgaauuauucaga

SEQ ID NO: 2656077 - RNA, 15 nt, Escherichia coli CFT073
uaacucgcagcuuug

SEQ ID NO: 2656078 - RNA, 14 nt, Escherichia coli CFT073
uaacucggaaaaug

SEQ ID NO: 2656079 - RNA, 22 nt, Escherichia coli CFT073
uaacucggaaaaugcauucuua

SEQ ID NO: 2656080 - RNA, 17 nt, Escherichia coli CFT073
uaacucugaugacugau

SEQ ID NO: 2656081 - RNA, 21 nt, Escherichia coli CFT073
uaacucugaugacugaugcuu

SEQ ID NO: 2656082 - RNA, 15 nt, Escherichia coli CFT073
uaacucuugccagau

SEQ ID NO: 2656083 - RNA, 20 nt, Escherichia coli CFT073
uaacucuuucaaugcuuuuu

SEQ ID NO: 2656084 - RNA, 20 nt, Escherichia coli CFT073
uaacugaucacguuuuccuu

SEQ ID NO: 2656085 - RNA, 14 nt, Escherichia coli CFT073
uaacugcaugucag

SEQ ID NO: 2656086 - RNA, 13 nt, Escherichia coli CFT073
uaacugcccgcau

SEQ ID NO: 2656087 - RNA, 19 nt, Escherichia coli CFT073
uaacugcgcgguagucaau

SEQ ID NO: 2656088 - RNA, 11 nt, Escherichia coli CFT073
uaacugcucuc

SEQ ID NO: 2656089 - RNA, 15 nt, Escherichia coli CFT073
uaacuggucaucaag

SEQ ID NO: 2656090 - RNA, 20 nt, Escherichia coli CFT073
uaacugguuagcuuuaaucc

SEQ ID NO: 2656091 - RNA, 13 nt, Escherichia coli CFT073
uaacugugccaaa

SEQ ID NO: 2656092 - RNA, 19 nt, Escherichia coli CFT073
uaacuguggcguuauggca

SEQ ID NO: 2656093 - RNA, 23 nt, Escherichia coli CFT073
uaacuguuaaauaacggccuggc

SEQ ID NO: 2656094 - RNA, 18 nt, Escherichia coli CFT073
uaacuuauggcguacuga

SEQ ID NO: 2656095 - RNA, 13 nt, Escherichia coli CFT073
uaacuuccauccc

SEQ ID NO: 2656096 - RNA, 17 nt, Escherichia coli CFT073
uaacuuccccuuucaca

SEQ ID NO: 2656097 - RNA, 13 nt, Escherichia coli CFT073
uaacuuccugcug

SEQ ID NO: 2656098 - RNA, 22 nt, Escherichia coli CFT073
uaacuucuaccugaugcuuuuu

SEQ ID NO: 2656099 - RNA, 23 nt, Escherichia coli CFT073
uaacuucuuuacuggcuuucauu

SEQ ID NO: 2656100 - RNA, 21 nt, Escherichia coli CFT073
uaacuuuaauuuugugcagca

SEQ ID NO: 2656101 - RNA, 17 nt, Escherichia coli CFT073
uaacuuuuaguaaacaa

SEQ ID NO: 2656102 - RNA, 21 nt, Escherichia coli CFT073
uaagaaaaaaggugaguuuug

SEQ ID NO: 2656103 - RNA, 19 nt, Escherichia coli CFT073
uaagaaagauacaaaacau

SEQ ID NO: 2656104 - RNA, 14 nt, Escherichia coli CFT073
uaagaaccacagcc

SEQ ID NO: 2656105 - RNA, 15 nt, Escherichia coli CFT073
uaagaaccacagccc

SEQ ID NO: 2656106 - RNA, 22 nt, Escherichia coli CFT073
uaagaaccagaauuuccagaaa

SEQ ID NO: 2656107 - RNA, 20 nt, Escherichia coli CFT073
uaagaacuccugaaagcgaa

SEQ ID NO: 2656108 - RNA, 17 nt, Escherichia coli CFT073
uaagaaugcuccccaga

SEQ ID NO: 2656109 - RNA, 14 nt, Escherichia coli CFT073
uaagaauuucucag

SEQ ID NO: 2656110 - RNA, 21 nt, Escherichia coli CFT073
uaagacagcgucacaucaggc

SEQ ID NO: 2656111 - RNA, 16 nt, Escherichia coli CFT073
uaagaccaauccagcc

SEQ ID NO: 2656112 - RNA, 22 nt, Escherichia coli CFT073
uaagaccaauccagccggcaaa

SEQ ID NO: 2656113 - RNA, 19 nt, Escherichia coli CFT073
uaagaccgugagcaaugca

SEQ ID NO: 2656114 - RNA, 17 nt, Escherichia coli CFT073
uaagaccugucucuuau

SEQ ID NO: 2656115 - RNA, 22 nt, Escherichia coli CFT073
uaagacgcagauuuuuauuaau

SEQ ID NO: 2656116 - RNA, 18 nt, Escherichia coli CFT073
uaagacgcgucagcgccg

SEQ ID NO: 2656117 - RNA, 21 nt, Escherichia coli CFT073
uaagacgcguggcgucgcauc

SEQ ID NO: 2656118 - RNA, 15 nt, Escherichia coli CFT073
uaagacgcguuagcg

SEQ ID NO: 2656119 - RNA, 19 nt, Escherichia coli CFT073
uaagacuccagcgccagcg

SEQ ID NO: 2656120 - RNA, 17 nt, Escherichia coli CFT073
uaagacuucguuguaac

SEQ ID NO: 2656121 - RNA, 16 nt, Escherichia coli CFT073
uaagagagcaacagca

SEQ ID NO: 2656122 - RNA, 20 nt, Escherichia coli CFT073
uaagagauccaggccagaua

SEQ ID NO: 2656123 - RNA, 17 nt, Escherichia coli CFT073
uaagagaugaauuuaua

SEQ ID NO: 2656124 - RNA, 14 nt, Escherichia coli CFT073
uaagaggcauuuuu

SEQ ID NO: 2656125 - RNA, 16 nt, Escherichia coli CFT073
uaagagguuaaucccu

SEQ ID NO: 2656126 - RNA, 15 nt, Escherichia coli CFT073
uaagaguuucaacau

SEQ ID NO: 2656127 - RNA, 17 nt, Escherichia coli CFT073
uaagaguuucaacauca

SEQ ID NO: 2656128 - RNA, 14 nt, Escherichia coli CFT073
uaagauaaaagcaa

SEQ ID NO: 2656129 - RNA, 22 nt, Escherichia coli CFT073
uaagauagacuguugaaauaca

SEQ ID NO: 2656130 - RNA, 23 nt, Escherichia coli CFT073
uaagauagacuguugaaauacaa

SEQ ID NO: 2656131 - RNA, 18 nt, Escherichia coli CFT073
uaagaucaucggccagau

SEQ ID NO: 2656132 - RNA, 15 nt, Escherichia coli CFT073
uaagaucgugcagca

SEQ ID NO: 2656133 - RNA, 16 nt, Escherichia coli CFT073
uaagaucgugcagcac

SEQ ID NO: 2656134 - RNA, 17 nt, Escherichia coli CFT073
uaagcaaauccuuccgc

SEQ ID NO: 2656135 - RNA, 21 nt, Escherichia coli CFT073
uaagcaacugacuggcucuuu

SEQ ID NO: 2656136 - RNA, 21 nt, Escherichia coli CFT073
uaagcaaucacuuuuuaccgu

SEQ ID NO: 2656137 - RNA, 16 nt, Escherichia coli CFT073
uaagcaauuauucaua

SEQ ID NO: 2656138 - RNA, 20 nt, Escherichia coli CFT073
uaagcacaaagcaauauuau

SEQ ID NO: 2656139 - RNA, 22 nt, Escherichia coli CFT073
uaagcaccgaacaagaaacaga

SEQ ID NO: 2656140 - RNA, 16 nt, Escherichia coli CFT073
uaagcacucuggcgaa

SEQ ID NO: 2656141 - RNA, 22 nt, Escherichia coli CFT073
uaagcagccaucugaugauauu

SEQ ID NO: 2656142 - RNA, 19 nt, Escherichia coli CFT073
uaagcaggguugcagcgga

SEQ ID NO: 2656143 - RNA, 16 nt, Escherichia coli CFT073
uaagcaucgcaacgca

SEQ ID NO: 2656144 - RNA, 14 nt, Escherichia coli CFT073
uaagcauuggcaug

SEQ ID NO: 2656145 - RNA, 11 nt, Escherichia coli CFT073
uaagccagacc

SEQ ID NO: 2656146 - RNA, 17 nt, Escherichia coli CFT073
uaagccauuuaacucac

SEQ ID NO: 2656147 - RNA, 13 nt, Escherichia coli CFT073
uaagcccaguuca

SEQ ID NO: 2656148 - RNA, 22 nt, Escherichia coli CFT073
uaagcccggcauuguuuuuauc

SEQ ID NO: 2656149 - RNA, 13 nt, Escherichia coli CFT073
uaagcccggccug

SEQ ID NO: 2656150 - RNA, 17 nt, Escherichia coli CFT073
uaagcccuuaagaaaac

SEQ ID NO: 2656151 - RNA, 13 nt, Escherichia coli CFT073
uaagccgccgcca

SEQ ID NO: 2656152 - RNA, 14 nt, Escherichia coli CFT073
uaagccgccgccau

SEQ ID NO: 2656153 - RNA, 16 nt, Escherichia coli CFT073
uaagccgcugugugua

SEQ ID NO: 2656154 - RNA, 16 nt, Escherichia coli CFT073
uaagccgguaaucacc

SEQ ID NO: 2656155 - RNA, 13 nt, Escherichia coli CFT073
uaagccgucccua

SEQ ID NO: 2656156 - RNA, 19 nt, Escherichia coli CFT073
uaagccucacgguucauua

SEQ ID NO: 2656157 - RNA, 14 nt, Escherichia coli CFT073
uaagccucuuucag

SEQ ID NO: 2656158 - RNA, 23 nt, Escherichia coli CFT073
uaagccuuccgcugacagcgcgu

SEQ ID NO: 2656159 - RNA, 18 nt, Escherichia coli CFT073
uaagcgaacauccggcuc

SEQ ID NO: 2656160 - RNA, 14 nt, Escherichia coli CFT073
uaagcgaaggugcc

SEQ ID NO: 2656161 - RNA, 18 nt, Escherichia coli CFT073
uaagcgacgggcgacaaa

SEQ ID NO: 2656162 - RNA, 18 nt, Escherichia coli CFT073
uaagcgagaacugccuua

SEQ ID NO: 2656163 - RNA, 22 nt, Escherichia coli CFT073
uaagcgagaacugccuuaaacu

SEQ ID NO: 2656164 - RNA, 22 nt, Escherichia coli CFT073
uaagcgauaacgcuggcagcaa

SEQ ID NO: 2656165 - RNA, 21 nt, Escherichia coli CFT073
uaagcgaucgcuaaagcauuc

SEQ ID NO: 2656166 - RNA, 20 nt, Escherichia coli CFT073
uaagcgcagucaccagcauc

SEQ ID NO: 2656167 - RNA, 18 nt, Escherichia coli CFT073
uaagcgcauaaucaaucg

SEQ ID NO: 2656168 - RNA, 15 nt, Escherichia coli CFT073
uaagcgcaugaacgu

SEQ ID NO: 2656169 - RNA, 22 nt, Escherichia coli CFT073
uaagcgccugauacagccaaau

SEQ ID NO: 2656170 - RNA, 21 nt, Escherichia coli CFT073
uaagcgcguuguucaccucuu

SEQ ID NO: 2656171 - RNA, 21 nt, Escherichia coli CFT073
uaagcggccucgauuggggag

SEQ ID NO: 2656172 - RNA, 19 nt, Escherichia coli CFT073
uaagcguagcgcaucaggc

SEQ ID NO: 2656173 - RNA, 20 nt, Escherichia coli CFT073
uaagcgucguuaaucgccug

SEQ ID NO: 2656174 - RNA, 20 nt, Escherichia coli CFT073
uaagcguuaauggcgauaau

SEQ ID NO: 2656175 - RNA, 22 nt, Escherichia coli CFT073
uaagcguugugcaucaggcaaa

SEQ ID NO: 2656176 - RNA, 15 nt, Escherichia coli CFT073
uaagcguuuucugcc

SEQ ID NO: 2656177 - RNA, 16 nt, Escherichia coli CFT073
uaagcucucagcauau

SEQ ID NO: 2656178 - RNA, 23 nt, Escherichia coli CFT073
uaagcugaauguucuucuucugc

SEQ ID NO: 2656179 - RNA, 20 nt, Escherichia coli CFT073
uaagcugauaacgccacgcc

SEQ ID NO: 2656180 - RNA, 22 nt, Escherichia coli CFT073
uaagcugccgcuccuucaccuu

SEQ ID NO: 2656181 - RNA, 19 nt, Escherichia coli CFT073
uaagcuguacacuucccag

SEQ ID NO: 2656182 - RNA, 21 nt, Escherichia coli CFT073
uaagcuuagucuuauuuaaug

SEQ ID NO: 2656183 - RNA, 17 nt, Escherichia coli CFT073
uaagcuuuuucugcuuc

SEQ ID NO: 2656184 - RNA, 18 nt, Escherichia coli CFT073
uaaggagcaauaaucagu

SEQ ID NO: 2656185 - RNA, 20 nt, Escherichia coli CFT073
uaaggagcaauaaucagugc

SEQ ID NO: 2656186 - RNA, 13 nt, Escherichia coli CFT073
uaaggcaucagcc

SEQ ID NO: 2656187 - RNA, 13 nt, Escherichia coli CFT073
uaaggccaaacac

SEQ ID NO: 2656188 - RNA, 15 nt, Escherichia coli CFT073
uaaggccgccaggca

SEQ ID NO: 2656189 - RNA, 19 nt, Escherichia coli CFT073
uaaggccugguucaucgcu

SEQ ID NO: 2656190 - RNA, 12 nt, Escherichia coli CFT073
uaaggcguucaa

SEQ ID NO: 2656191 - RNA, 20 nt, Escherichia coli CFT073
uaaggcguugauuggcgcag

SEQ ID NO: 2656192 - RNA, 19 nt, Escherichia coli CFT073
uaaggcguuugcgucgcau

SEQ ID NO: 2656193 - RNA, 18 nt, Escherichia coli CFT073
uaaggcucucuuaccagc

SEQ ID NO: 2656194 - RNA, 14 nt, Escherichia coli CFT073
uaaggcuucaauca

SEQ ID NO: 2656195 - RNA, 15 nt, Escherichia coli CFT073
uaagggacaucaggu

SEQ ID NO: 2656196 - RNA, 18 nt, Escherichia coli CFT073
uaagggaucauguaguaa

SEQ ID NO: 2656197 - RNA, 15 nt, Escherichia coli CFT073
uaaggguauagaaac

SEQ ID NO: 2656198 - RNA, 17 nt, Escherichia coli CFT073
uaagguaaugcgcgagc

SEQ ID NO: 2656199 - RNA, 19 nt, Escherichia coli CFT073
uaagguaucgcgaaaaaaa

SEQ ID NO: 2656200 - RNA, 16 nt, Escherichia coli CFT073
uaaggucaccaguuca

SEQ ID NO: 2656201 - RNA, 21 nt, Escherichia coli CFT073
uaagguguucacgccgcaucc

SEQ ID NO: 2656202 - RNA, 18 nt, Escherichia coli CFT073
uaagguucacuuaaucuc

SEQ ID NO: 2656203 - RNA, 11 nt, Escherichia coli CFT073
uaagguuuuuu

SEQ ID NO: 2656204 - RNA, 12 nt, Escherichia coli CFT073
uaaguaaacaaa

SEQ ID NO: 2656205 - RNA, 16 nt, Escherichia coli CFT073
uaaguacuuuccauuu

SEQ ID NO: 2656206 - RNA, 22 nt, Escherichia coli CFT073
uaaguaucugcuaauauuuugu

SEQ ID NO: 2656207 - RNA, 14 nt, Escherichia coli CFT073
uaagucaacaccau

SEQ ID NO: 2656208 - RNA, 16 nt, Escherichia coli CFT073
uaagucacuaauugca

SEQ ID NO: 2656209 - RNA, 14 nt, Escherichia coli CFT073
uaagucagaaagcc

SEQ ID NO: 2656210 - RNA, 18 nt, Escherichia coli CFT073
uaagucugcgucaucggc

SEQ ID NO: 2656211 - RNA, 23 nt, Escherichia coli CFT073
uaagucugcgucaucggcagcau

SEQ ID NO: 2656212 - RNA, 21 nt, Escherichia coli CFT073
uaagucuggcacgaccgccuu

SEQ ID NO: 2656213 - RNA, 17 nt, Escherichia coli CFT073
uaaguggcaauauauuu

SEQ ID NO: 2656214 - RNA, 21 nt, Escherichia coli CFT073
uaaguguauguuggcuuuaua

SEQ ID NO: 2656215 - RNA, 22 nt, Escherichia coli CFT073
uaaguuacuaaaaguaaauaag

SEQ ID NO: 2656216 - RNA, 15 nt, Escherichia coli CFT073
uaaguuauguauucg

SEQ ID NO: 2656217 - RNA, 16 nt, Escherichia coli CFT073
uaaguucaaguaaaac

SEQ ID NO: 2656218 - RNA, 21 nt, Escherichia coli CFT073
uaaguucaaguaaaacagccu

SEQ ID NO: 2656219 - RNA, 19 nt, Escherichia coli CFT073
uaaguucaaguuugcuuca

SEQ ID NO: 2656220 - RNA, 23 nt, Escherichia coli CFT073
uaaguugccgcuuuuuugugcac

SEQ ID NO: 2656221 - RNA, 24 nt, Escherichia coli CFT073
uaaguuucccagcuuauuaacagu

SEQ ID NO: 2656222 - RNA, 15 nt, Escherichia coli CFT073
uaauaaaaaaccgga

SEQ ID NO: 2656223 - RNA, 19 nt, Escherichia coli CFT073
uaauaaaaaccugucugga

SEQ ID NO: 2656224 - RNA, 21 nt, Escherichia coli CFT073
uaauaaaaaccugucuggauu

SEQ ID NO: 2656225 - RNA, 21 nt, Escherichia coli CFT073
uaauaaaaaggugauuuauuu

SEQ ID NO: 2656226 - RNA, 22 nt, Escherichia coli CFT073
uaauaaagcacccuguuugucu

SEQ ID NO: 2656227 - RNA, 16 nt, Escherichia coli CFT073
uaauaaauauuauugu

SEQ ID NO: 2656228 - RNA, 18 nt, Escherichia coli CFT073
uaauaacccgucagcaga

SEQ ID NO: 2656229 - RNA, 18 nt, Escherichia coli CFT073
uaauaagagauccaggcc

SEQ ID NO: 2656230 - RNA, 12 nt, Escherichia coli CFT073
uaauaagagguu

SEQ ID NO: 2656231 - RNA, 23 nt, Escherichia coli CFT073
uaauaagguaauuauuguaagcu

SEQ ID NO: 2656232 - RNA, 19 nt, Escherichia coli CFT073
uaauaagguucauugaacg

SEQ ID NO: 2656233 - RNA, 21 nt, Escherichia coli CFT073
uaauaagguucauugaacgca

SEQ ID NO: 2656234 - RNA, 16 nt, Escherichia coli CFT073
uaauaaguaaacaaac

SEQ ID NO: 2656235 - RNA, 13 nt, Escherichia coli CFT073
uaauaauauaaau

SEQ ID NO: 2656236 - RNA, 22 nt, Escherichia coli CFT073
uaauaaugucucuguugugaag

SEQ ID NO: 2656237 - RNA, 19 nt, Escherichia coli CFT073
uaauaauuaaauuguucau

SEQ ID NO: 2656238 - RNA, 18 nt, Escherichia coli CFT073
uaauaauuauaaaucccu

SEQ ID NO: 2656239 - RNA, 17 nt, Escherichia coli CFT073
uaauaauucaaaaaccu

SEQ ID NO: 2656240 - RNA, 24 nt, Escherichia coli CFT073
uaauacacacaguaaaauauucga

SEQ ID NO: 2656241 - RNA, 18 nt, Escherichia coli CFT073
uaauacaccguccagcgg

SEQ ID NO: 2656242 - RNA, 12 nt, Escherichia coli CFT073
uaauacaggcua

SEQ ID NO: 2656243 - RNA, 21 nt, Escherichia coli CFT073
uaauacaggcuacucccagua

SEQ ID NO: 2656244 - RNA, 13 nt, Escherichia coli CFT073
uaauaccaucggc

SEQ ID NO: 2656245 - RNA, 23 nt, Escherichia coli CFT073
uaauaccgacuucagccagugcu

SEQ ID NO: 2656246 - RNA, 14 nt, Escherichia coli CFT073
uaauaccgccaaca

SEQ ID NO: 2656247 - RNA, 22 nt, Escherichia coli CFT073
uaauaccgcgagauauccacau

SEQ ID NO: 2656248 - RNA, 15 nt, Escherichia coli CFT073
uaauaccugccuggu

SEQ ID NO: 2656249 - RNA, 16 nt, Escherichia coli CFT073
uaauacgcuaaauaaa

SEQ ID NO: 2656250 - RNA, 21 nt, Escherichia coli CFT073
uaauacgcuaaauaaacaaug

SEQ ID NO: 2656251 - RNA, 17 nt, Escherichia coli CFT073
uaauacggcucucaccu

SEQ ID NO: 2656252 - RNA, 16 nt, Escherichia coli CFT073
uaauacguagcaccaa

SEQ ID NO: 2656253 - RNA, 17 nt, Escherichia coli CFT073
uaauacgugaaaucggu

SEQ ID NO: 2656254 - RNA, 18 nt, Escherichia coli CFT073
uaauacguuuuaucaaac

SEQ ID NO: 2656255 - RNA, 23 nt, Escherichia coli CFT073
uaauagagccuuugacuauuuca

SEQ ID NO: 2656256 - RNA, 21 nt, Escherichia coli CFT073
uaauagcucugcuaauaaugu

SEQ ID NO: 2656257 - RNA, 19 nt, Escherichia coli CFT073
uaauagcuuaacuacugcu

SEQ ID NO: 2656258 - RNA, 15 nt, Escherichia coli CFT073
uaauagcuucuucuu

SEQ ID NO: 2656259 - RNA, 14 nt, Escherichia coli CFT073
uaauagguaaacau

SEQ ID NO: 2656260 - RNA, 18 nt, Escherichia coli CFT073
uaauagugguaccaggau

SEQ ID NO: 2656261 - RNA, 23 nt, Escherichia coli CFT073
uaauauaaacgacagcguuucau

SEQ ID NO: 2656262 - RNA, 17 nt, Escherichia coli CFT073
uaauauaaauuaauaag

SEQ ID NO: 2656263 - RNA, 22 nt, Escherichia coli CFT073
uaauauaaggagccuguguaau

SEQ ID NO: 2656264 - RNA, 14 nt, Escherichia coli CFT073
uaauauauauuauc

SEQ ID NO: 2656265 - RNA, 22 nt, Escherichia coli CFT073
uaauauccccagccuaagccau

SEQ ID NO: 2656266 - RNA, 12 nt, Escherichia coli CFT073
uaauaucgcgca

SEQ ID NO: 2656267 - RNA, 19 nt, Escherichia coli CFT073
uaauaucgcgcagaaauuc

SEQ ID NO: 2656268 - RNA, 14 nt, Escherichia coli CFT073
uaauaugcaauuca

SEQ ID NO: 2656269 - RNA, 15 nt, Escherichia coli CFT073
uaauaugcaauucac

SEQ ID NO: 2656270 - RNA, 16 nt, Escherichia coli CFT073
uaauaugcaauucaca

SEQ ID NO: 2656271 - RNA, 17 nt, Escherichia coli CFT073
uaauaugcagacucauu

SEQ ID NO: 2656272 - RNA, 21 nt, Escherichia coli CFT073
uaauaugcagacucauuguau

SEQ ID NO: 2656273 - RNA, 13 nt, Escherichia coli CFT073
uaauauuucauuc

SEQ ID NO: 2656274 - RNA, 15 nt, Escherichia coli CFT073
uaaucaaauaaauaa

SEQ ID NO: 2656275 - RNA, 15 nt, Escherichia coli CFT073
uaaucaacaaacgcu

SEQ ID NO: 2656276 - RNA, 14 nt, Escherichia coli CFT073
uaaucaacaggaac

SEQ ID NO: 2656277 - RNA, 20 nt, Escherichia coli CFT073
uaaucaaccauuaaacguac

SEQ ID NO: 2656278 - RNA, 18 nt, Escherichia coli CFT073
uaaucaacgcgccgccaa

SEQ ID NO: 2656279 - RNA, 19 nt, Escherichia coli CFT073
uaaucaacgcuacguuauu

SEQ ID NO: 2656280 - RNA, 22 nt, Escherichia coli CFT073
uaaucaacguucggugcgcgcu

SEQ ID NO: 2656281 - RNA, 20 nt, Escherichia coli CFT073
uaaucaaucuuuacacacaa

SEQ ID NO: 2656282 - RNA, 14 nt, Escherichia coli CFT073
uaaucaauuuaucg

SEQ ID NO: 2656283 - RNA, 12 nt, Escherichia coli CFT073
uaaucaccagca

SEQ ID NO: 2656284 - RNA, 15 nt, Escherichia coli CFT073
uaaucaccagcaaca

SEQ ID NO: 2656285 - RNA, 11 nt, Escherichia coli CFT073
uaaucacgcug

SEQ ID NO: 2656286 - RNA, 13 nt, Escherichia coli CFT073
uaaucacgcuguu

SEQ ID NO: 2656287 - RNA, 14 nt, Escherichia coli CFT073
uaaucacucuuccc

SEQ ID NO: 2656288 - RNA, 17 nt, Escherichia coli CFT073
uaauguuuccagcaucg

SEQ ID NO: 2656289 - RNA, 19 nt, Escherichia coli CFT073
uaauguuuucaguuaaugc

SEQ ID NO: 2656290 - RNA, 12 nt, Escherichia coli CFT073
uaauguuuugca

SEQ ID NO: 2656291 - RNA, 21 nt, Escherichia coli CFT073
uaauuaaacagcccuuugauu

SEQ ID NO: 2656292 - RNA, 11 nt, Escherichia coli CFT073
uaauuaaacug

SEQ ID NO: 2656293 - RNA, 13 nt, Escherichia coli CFT073
uaauuaagacuga

SEQ ID NO: 2656294 - RNA, 15 nt, Escherichia coli CFT073
uaauuaauaauauaa

SEQ ID NO: 2656295 - RNA, 21 nt, Escherichia coli CFT073
uaauuaaucaucaugcuuaaa

SEQ ID NO: 2656296 - RNA, 19 nt, Escherichia coli CFT073
uaauuaccagcgcaggaac

SEQ ID NO: 2656297 - RNA, 18 nt, Escherichia coli CFT073
uaauuacgccaauuuaag

SEQ ID NO: 2656298 - RNA, 15 nt, Escherichia coli CFT073
uaauuacgcccuuaa

SEQ ID NO: 2656299 - RNA, 20 nt, Escherichia coli CFT073
uaauuagcuuaucaaucucu

SEQ ID NO: 2656300 - RNA, 23 nt, Escherichia coli CFT073
uaauuagugagacucaccaaucg

SEQ ID NO: 2656301 - RNA, 17 nt, Escherichia coli CFT073
uaauuauaaaucccugc

SEQ ID NO: 2656302 - RNA, 18 nt, Escherichia coli CFT073
uaauucaccguucaauuc

SEQ ID NO: 2656303 - RNA, 23 nt, Escherichia coli CFT073
uaauucaccguucaauuccgcaa

SEQ ID NO: 2656304 - RNA, 13 nt, Escherichia coli CFT073
uaauucagcagag

SEQ ID NO: 2656305 - RNA, 20 nt, Escherichia coli CFT073
uaauucagcagagcaauauc

SEQ ID NO: 2656306 - RNA, 14 nt, Escherichia coli CFT073
uaauuccacaccaa

SEQ ID NO: 2656307 - RNA, 18 nt, Escherichia coli CFT073
uaauuccagaauucuauu

SEQ ID NO: 2656308 - RNA, 11 nt, Escherichia coli CFT073
uaauuccagcg

SEQ ID NO: 2656309 - RNA, 21 nt, Escherichia coli CFT073
uaauuccaucuuuaacugcuc

SEQ ID NO: 2656310 - RNA, 19 nt, Escherichia coli CFT073
uaauucccagcaccgcaga

SEQ ID NO: 2656311 - RNA, 20 nt, Escherichia coli CFT073
uaauucccugugccagcggc

SEQ ID NO: 2656312 - RNA, 23 nt, Escherichia coli CFT073
uaauuccucccguuaugaucagc

SEQ ID NO: 2656313 - RNA, 14 nt, Escherichia coli CFT073
uaauucucccugcg

SEQ ID NO: 2656314 - RNA, 23 nt, Escherichia coli CFT073
uaauucuccgcacuccaacucuu

SEQ ID NO: 2656315 - RNA, 16 nt, Escherichia coli CFT073
uaauucuggaucaagu

SEQ ID NO: 2656316 - RNA, 13 nt, Escherichia coli CFT073
uaauucuguccuc

SEQ ID NO: 2656317 - RNA, 13 nt, Escherichia coli CFT073
uaauucuucagca

SEQ ID NO: 2656318 - RNA, 21 nt, Escherichia coli CFT073
uaauugacaagguaguagaaa

SEQ ID NO: 2656319 - RNA, 15 nt, Escherichia coli CFT073
uaauugaccagaucu

SEQ ID NO: 2656320 - RNA, 14 nt, Escherichia coli CFT073
uaauugagcagcaa

SEQ ID NO: 2656321 - RNA, 18 nt, Escherichia coli CFT073
uaauugagcagcaaaaug

SEQ ID NO: 2656322 - RNA, 23 nt, Escherichia coli CFT073
uaauugccagcuugcuuuccagc

SEQ ID NO: 2656323 - RNA, 22 nt, Escherichia coli CFT073
uaauugccauuacuacaaacaa

SEQ ID NO: 2656324 - RNA, 22 nt, Escherichia coli CFT073
uaauugcgcagcggaggcgaua

SEQ ID NO: 2656325 - RNA, 23 nt, Escherichia coli CFT073
uaauuguccaucgcuacaggcua

SEQ ID NO: 2656326 - RNA, 14 nt, Escherichia coli CFT073
uaauuuaaaucaug

SEQ ID NO: 2656327 - RNA, 20 nt, Escherichia coli CFT073
uaauuucaacagauuuugca

SEQ ID NO: 2656328 - RNA, 19 nt, Escherichia coli CFT073
uaauuucacaccaucaaca

SEQ ID NO: 2656329 - RNA, 14 nt, Escherichia coli CFT073
uaauuucagcaucg

SEQ ID NO: 2656330 - RNA, 15 nt, Escherichia coli CFT073
uaauuuccagcagug

SEQ ID NO: 2656331 - RNA, 24 nt, Escherichia coli CFT073
uaauuucggcagcgcgcucgccaa

SEQ ID NO: 2656332 - RNA, 16 nt, Escherichia coli CFT073
uaauuucucgcacguu

SEQ ID NO: 2656333 - RNA, 13 nt, Escherichia coli CFT073
uaauuucuuuuca

SEQ ID NO: 2656334 - RNA, 15 nt, Escherichia coli CFT073
uaauuucuuuucaua

SEQ ID NO: 2656335 - RNA, 22 nt, Escherichia coli CFT073
uaauuugaaaugacgcuuuauu

SEQ ID NO: 2656336 - RNA, 11 nt, Escherichia coli CFT073
uaauuugccag

SEQ ID NO: 2656337 - RNA, 21 nt, Escherichia coli CFT073
uaauuugcguuuucaccacug

SEQ ID NO: 2656338 - RNA, 12 nt, Escherichia coli CFT073
uaauuuuuccag

SEQ ID NO: 2656339 - RNA, 14 nt, Escherichia coli CFT073
uaauuuuuccagca

SEQ ID NO: 2656340 - RNA, 12 nt, Escherichia coli CFT073
uaauuuuuuaau

SEQ ID NO: 2656341 - RNA, 13 nt, Escherichia coli CFT073
uaauuuuuuaaua

SEQ ID NO: 2656342 - RNA, 14 nt, Escherichia coli CFT073
uaauuuuuuaauaa

SEQ ID NO: 2656343 - RNA, 15 nt, Escherichia coli CFT073
uaauuuuuugcgcca

SEQ ID NO: 2656344 - RNA, 17 nt, Escherichia coli CFT073
uaauuuuuuuaaucuau

SEQ ID NO: 2656345 - RNA, 19 nt, Escherichia coli CFT073
uacaaaacauuauugagaa

SEQ ID NO: 2656346 - RNA, 16 nt, Escherichia coli CFT073
uacaaaagcaauaauu

SEQ ID NO: 2656347 - RNA, 13 nt, Escherichia coli CFT073
uacaaaagcaccg

SEQ ID NO: 2656348 - RNA, 18 nt, Escherichia coli CFT073
uacaaaauacaaacgcca

SEQ ID NO: 2656349 - RNA, 19 nt, Escherichia coli CFT073
uacaaaaugacauuaagua

SEQ ID NO: 2656350 - RNA, 21 nt, Escherichia coli CFT073
uacaaaaugacauuaaguaac

SEQ ID NO: 2656351 - RNA, 14 nt, Escherichia coli CFT073
uacaaacaaugcca

SEQ ID NO: 2656352 - RNA, 16 nt, Escherichia coli CFT073
uacaaacaucauccag

SEQ ID NO: 2656353 - RNA, 20 nt, Escherichia coli CFT073
uacaaacauccaucugcuuu

SEQ ID NO: 2656354 - RNA, 22 nt, Escherichia coli CFT073
uacaaacgccauaaacuucauu

SEQ ID NO: 2656355 - RNA, 19 nt, Escherichia coli CFT073
uacaaagccaacagcagcc

SEQ ID NO: 2656356 - RNA, 19 nt, Escherichia coli CFT073
uacaaagggcuaacgugca

SEQ ID NO: 2656357 - RNA, 20 nt, Escherichia coli CFT073
uacaaaucgugcaucuccug

SEQ ID NO: 2656358 - RNA, 12 nt, Escherichia coli CFT073
uacaaauuuagc

SEQ ID NO: 2656359 - RNA, 15 nt, Escherichia coli CFT073
uacaaccgcgaacug

SEQ ID NO: 2656360 - RNA, 23 nt, Escherichia coli CFT073
uacaaccguuucaugccauccgc

SEQ ID NO: 2656361 - RNA, 20 nt, Escherichia coli CFT073
uacaacgcaauauccgccac

SEQ ID NO: 2656362 - RNA, 14 nt, Escherichia coli CFT073
uacaacgcuuuauc

SEQ ID NO: 2656363 - RNA, 17 nt, Escherichia coli CFT073
uacaacguccuuucaug

SEQ ID NO: 2656364 - RNA, 18 nt, Escherichia coli CFT073
uacaacguccuuucaugc

SEQ ID NO: 2656365 - RNA, 19 nt, Escherichia coli CFT073
uacaacucgcuuaagccau

SEQ ID NO: 2656366 - RNA, 20 nt, Escherichia coli CFT073
uacaacucgcuuaagccauc

SEQ ID NO: 2656367 - RNA, 21 nt, Escherichia coli CFT073
uacaacugccgcgccugaauc

SEQ ID NO: 2656368 - RNA, 17 nt, Escherichia coli CFT073
uacaagaaucaugccaa

SEQ ID NO: 2656369 - RNA, 18 nt, Escherichia coli CFT073
uacaagaaucaugccaaa

SEQ ID NO: 2656370 - RNA, 22 nt, Escherichia coli CFT073
uacaagccacaucgccauauug

SEQ ID NO: 2656371 - RNA, 18 nt, Escherichia coli CFT073
uacaaguccugaauuaaa

SEQ ID NO: 2656372 - RNA, 17 nt, Escherichia coli CFT073
uacaauaaaaguuuccu

SEQ ID NO: 2656373 - RNA, 13 nt, Escherichia coli CFT073
uacaauauccagc

SEQ ID NO: 2656374 - RNA, 23 nt, Escherichia coli CFT073
uacaauauccagcgcgcgcagca

SEQ ID NO: 2656375 - RNA, 16 nt, Escherichia coli CFT073
uacaaucaggccaauc

SEQ ID NO: 2656376 - RNA, 18 nt, Escherichia coli CFT073
uacaauccaguaccaggc

SEQ ID NO: 2656377 - RNA, 22 nt, Escherichia coli CFT073
uacaaucccguugaaaaugcug

SEQ ID NO: 2656378 - RNA, 20 nt, Escherichia coli CFT073
uacaaucgucugguuuuccu

SEQ ID NO: 2656379 - RNA, 23 nt, Escherichia coli CFT073
uacacaaccgccggaugcggcgu

SEQ ID NO: 2656380 - RNA, 17 nt, Escherichia coli CFT073
uacacacuuuccaggcg

SEQ ID NO: 2656381 - RNA, 19 nt, Escherichia coli CFT073
uacacagcccaguuuuuca

SEQ ID NO: 2656382 - RNA, 22 nt, Escherichia coli CFT073
uacacagcccaguuuuucagga

SEQ ID NO: 2656383 - RNA, 18 nt, Escherichia coli CFT073
uacaccaaucgucaaugc

SEQ ID NO: 2656384 - RNA, 20 nt, Escherichia coli CFT073
uacaccauuuaaugacaaaa

SEQ ID NO: 2656385 - RNA, 14 nt, Escherichia coli CFT073
uacacccagccccg

SEQ ID NO: 2656386 - RNA, 18 nt, Escherichia coli CFT073
uacaccgcagccgccaca

SEQ ID NO: 2656387 - RNA, 20 nt, Escherichia coli CFT073
uacaccgcagccgccacaau

SEQ ID NO: 2656388 - RNA, 18 nt, Escherichia coli CFT073
uacaccgccguugauuuc

SEQ ID NO: 2656389 - RNA, 17 nt, Escherichia coli CFT073
uacaccgcgaagcagcu

SEQ ID NO: 2656390 - RNA, 18 nt, Escherichia coli CFT073
uacaccgcgaagcagcuc

SEQ ID NO: 2656391 - RNA, 17 nt, Escherichia coli CFT073
uacaccugcuccgccag

SEQ ID NO: 2656392 - RNA, 12 nt, Escherichia coli CFT073
uacaccugcugu

SEQ ID NO: 2656393 - RNA, 13 nt, Escherichia coli CFT073
uacaccugcugug

SEQ ID NO: 2656394 - RNA, 12 nt, Escherichia coli CFT073
uacaccuucauc

SEQ ID NO: 2656395 - RNA, 21 nt, Escherichia coli CFT073
uacaccuuuccccggcagcau

SEQ ID NO: 2656396 - RNA, 17 nt, Escherichia coli CFT073
uaccagccccaucaggu

SEQ ID NO: 2656397 - RNA, 14 nt, Escherichia coli CFT073
uaccagcgccgcca

SEQ ID NO: 2656398 - RNA, 16 nt, Escherichia coli CFT073
uaccagcggacggcug

SEQ ID NO: 2656399 - RNA, 17 nt, Escherichia coli CFT073
uaccagcggccagacgc

SEQ ID NO: 2656400 - RNA, 18 nt, Escherichia coli CFT073
uaccagcguagugauacc

SEQ ID NO: 2656401 - RNA, 14 nt, Escherichia coli CFT073
uaccagcuguuuug

SEQ ID NO: 2656402 - RNA, 17 nt, Escherichia coli CFT073
uaccagcuguuuuggua

SEQ ID NO: 2656403 - RNA, 20 nt, Escherichia coli CFT073
uaccagcuguuuugguaaac

SEQ ID NO: 2656404 - RNA, 19 nt, Escherichia coli CFT073
uaccaggaucagcaaaaug

SEQ ID NO: 2656405 - RNA, 20 nt, Escherichia coli CFT073
uaccaggaucagcaaaaugg

SEQ ID NO: 2656406 - RNA, 20 nt, Escherichia coli CFT073
uaccaggcgaccguuuucac

SEQ ID NO: 2656407 - RNA, 19 nt, Escherichia coli CFT073
uaccaggucgaaguugauu

SEQ ID NO: 2656408 - RNA, 21 nt, Escherichia coli CFT073
uaccaggugugcgcgguaaag

SEQ ID NO: 2656409 - RNA, 13 nt, Escherichia coli CFT073
uaccaguaaccag

SEQ ID NO: 2656410 - RNA, 20 nt, Escherichia coli CFT073
uaccaguagugaaaaaagca

SEQ ID NO: 2656411 - RNA, 15 nt, Escherichia coli CFT073
uaccagucaauaaua

SEQ ID NO: 2656412 - RNA, 12 nt, Escherichia coli CFT073
uaccaguccuac

SEQ ID NO: 2656413 - RNA, 16 nt, Escherichia coli CFT073
uaccaguccuacacac

SEQ ID NO: 2656414 - RNA, 20 nt, Escherichia coli CFT073
uaccaguccuacacacgcca

SEQ ID NO: 2656415 - RNA, 18 nt, Escherichia coli CFT073
uaccagucgauauuacgg

SEQ ID NO: 2656416 - RNA, 15 nt, Escherichia coli CFT073
uaccagugcagcgca

SEQ ID NO: 2656417 - RNA, 16 nt, Escherichia coli CFT073
uaccagugcagcgcau

SEQ ID NO: 2656418 - RNA, 14 nt, Escherichia coli CFT073
uaccagugccagaa

SEQ ID NO: 2656419 - RNA, 21 nt, Escherichia coli CFT073
uaccagugccagaacagaaau

SEQ ID NO: 2656420 - RNA, 21 nt, Escherichia coli CFT073
uaccaguuaaagcucuucuua

SEQ ID NO: 2656421 - RNA, 19 nt, Escherichia coli CFT073
uaccauaagagaugaauuu

SEQ ID NO: 2656422 - RNA, 19 nt, Escherichia coli CFT073
uaccauaucugguuaaaaa

SEQ ID NO: 2656423 - RNA, 16 nt, Escherichia coli CFT073
uaccaucaaccacuac

SEQ ID NO: 2656424 - RNA, 11 nt, Escherichia coli CFT073
uaccaucaggu

SEQ ID NO: 2656425 - RNA, 19 nt, Escherichia coli CFT073
uaccauccacaccaaaaua

SEQ ID NO: 2656426 - RNA, 14 nt, Escherichia coli CFT073
uaccaucgacacca

SEQ ID NO: 2656427 - RNA, 15 nt, Escherichia coli CFT073
uaccaucgacaccau

SEQ ID NO: 2656428 - RNA, 13 nt, Escherichia coli CFT073
uaccaucgcgcac

SEQ ID NO: 2656429 - RNA, 15 nt, Escherichia coli CFT073
uaccaugcaccaacc

SEQ ID NO: 2656430 - RNA, 20 nt, Escherichia coli CFT073
uaccaugcaccaacccuaac

SEQ ID NO: 2656431 - RNA, 21 nt, Escherichia coli CFT073
uaccaugcuaauaaucagcac

SEQ ID NO: 2656432 - RNA, 15 nt, Escherichia coli CFT073
uaccauuaucaccaa

SEQ ID NO: 2656433 - RNA, 15 nt, Escherichia coli CFT073
uaccauucccagacu

SEQ ID NO: 2656434 - RNA, 19 nt, Escherichia coli CFT073
uaccauugaagcaauccau

SEQ ID NO: 2656435 - RNA, 19 nt, Escherichia coli CFT073
uaccauugaucgauaagcc

SEQ ID NO: 2656436 - RNA, 13 nt, Escherichia coli CFT073
uaccauuucuucu

SEQ ID NO: 2656437 - RNA, 14 nt, Escherichia coli CFT073
uaccauuucuucug

SEQ ID NO: 2656438 - RNA, 15 nt, Escherichia coli CFT073
uaccauuucuucugc

SEQ ID NO: 2656439 - RNA, 18 nt, Escherichia coli CFT073
uaccauuucuucugcgcu

SEQ ID NO: 2656440 - RNA, 18 nt, Escherichia coli CFT073
uaccauuugcgcggaucc

SEQ ID NO: 2656441 - RNA, 14 nt, Escherichia coli CFT073
uacccaaaaaauag

SEQ ID NO: 2656442 - RNA, 14 nt, Escherichia coli CFT073
uacccacuguaucg

SEQ ID NO: 2656443 - RNA, 12 nt, Escherichia coli CFT073
uacccagacuuu

SEQ ID NO: 2656444 - RNA, 14 nt, Escherichia coli CFT073
uacccagacuuuuc

SEQ ID NO: 2656445 - RNA, 12 nt, Escherichia coli CFT073
uacccagcaaug

SEQ ID NO: 2656446 - RNA, 15 nt, Escherichia coli CFT073
uacccagcaaugcca

SEQ ID NO: 2656447 - RNA, 19 nt, Escherichia coli CFT073
uacccagcaaugccaggcu

SEQ ID NO: 2656448 - RNA, 12 nt, Escherichia coli CFT073
uacccagcagca

SEQ ID NO: 2656449 - RNA, 17 nt, Escherichia coli CFT073
uacccagcagcagcggu

SEQ ID NO: 2656450 - RNA, 18 nt, Escherichia coli CFT073
uacccagcguguugagga

SEQ ID NO: 2656451 - RNA, 19 nt, Escherichia coli CFT073
uacccagcguguugaggaa

SEQ ID NO: 2656452 - RNA, 22 nt, Escherichia coli CFT073
uacccagcguguugaggaagcg

SEQ ID NO: 2656453 - RNA, 18 nt, Escherichia coli CFT073
uacccaggucgcccgguu

SEQ ID NO: 2656454 - RNA, 23 nt, Escherichia coli CFT073
uacccaggucgcccgguugcagc

SEQ ID NO: 2656455 - RNA, 22 nt, Escherichia coli CFT073
uacccagugaauccagcaugcu

SEQ ID NO: 2656456 - RNA, 15 nt, Escherichia coli CFT073
uaccccaccgccgag

SEQ ID NO: 2656457 - RNA, 22 nt, Escherichia coli CFT073
uaccccauauuggcaacagcca

SEQ ID NO: 2656458 - RNA, 15 nt, Escherichia coli CFT073
uacccccauccacgc

SEQ ID NO: 2656459 - RNA, 17 nt, Escherichia coli CFT073
uaccccugccgccgcaa

SEQ ID NO: 2656460 - RNA, 13 nt, Escherichia coli CFT073
uacccgccaccgg

SEQ ID NO: 2656461 - RNA, 18 nt, Escherichia coli CFT073
uacccgcgcuuuuucgga

SEQ ID NO: 2656462 - RNA, 21 nt, Escherichia coli CFT073
uacccgcucgaaguuuuccuc

SEQ ID NO: 2656463 - RNA, 18 nt, Escherichia coli CFT073
uacccggcacacaaauaa

SEQ ID NO: 2656464 - RNA, 18 nt, Escherichia coli CFT073
uacccgggucaucaccca

SEQ ID NO: 2656465 - RNA, 20 nt, Escherichia coli CFT073
uacccuauuuaaagcacaaa

SEQ ID NO: 2656466 - RNA, 12 nt, Escherichia coli CFT073
uacccucugcac

SEQ ID NO: 2656467 - RNA, 16 nt, Escherichia coli CFT073
uacccucugcaccaga

SEQ ID NO: 2656468 - RNA, 13 nt, Escherichia coli CFT073
uacccugacccag

SEQ ID NO: 2656469 - RNA, 17 nt, Escherichia coli CFT073
uacccugacccagaccg

SEQ ID NO: 2656470 - RNA, 15 nt, Escherichia coli CFT073
uacccugaccgucuu

SEQ ID NO: 2656471 - RNA, 20 nt, Escherichia coli CFT073
uaccgaacaugccgccaacg

SEQ ID NO: 2656472 - RNA, 17 nt, Escherichia coli CFT073
uaccgaagaguaaccaa

SEQ ID NO: 2656473 - RNA, 16 nt, Escherichia coli CFT073
uaccgacgaucaacag

SEQ ID NO: 2656474 - RNA, 17 nt, Escherichia coli CFT073
uaccgacgaucaacaga

SEQ ID NO: 2656475 - RNA, 19 nt, Escherichia coli CFT073
uaccgacgaucaacagaau

SEQ ID NO: 2656476 - RNA, 18 nt, Escherichia coli CFT073
uaccgacgaucgggaaca

SEQ ID NO: 2656477 - RNA, 12 nt, Escherichia coli CFT073
uaccgagcagcc

SEQ ID NO: 2656478 - RNA, 14 nt, Escherichia coli CFT073
uaccgagcagccac

SEQ ID NO: 2656479 - RNA, 16 nt, Escherichia coli CFT073
uaccgaucaguaccag

SEQ ID NO: 2656480 - RNA, 22 nt, Escherichia coli CFT073
uaccgaucgcgguaacagauga

SEQ ID NO: 2656481 - RNA, 16 nt, Escherichia coli CFT073
uaccgauggcaaacaa

SEQ ID NO: 2656482 - RNA, 13 nt, Escherichia coli CFT073
uaccgcaccacca

SEQ ID NO: 2656483 - RNA, 17 nt, Escherichia coli CFT073
uaccgcaccaccagcag

SEQ ID NO: 2656484 - RNA, 19 nt, Escherichia coli CFT073
uaccgcaccuuccggaaua

SEQ ID NO: 2656485 - RNA, 12 nt, Escherichia coli CFT073
uaccgccacagc

SEQ ID NO: 2656486 - RNA, 14 nt, Escherichia coli CFT073
uaccgccacagcag

SEQ ID NO: 2656487 - RNA, 15 nt, Escherichia coli CFT073
uaccgccacagcagc

SEQ ID NO: 2656488 - RNA, 14 nt, Escherichia coli CFT073
uaccgccagaccac

SEQ ID NO: 2656489 - RNA, 13 nt, Escherichia coli CFT073
uaccgccgcacaa

SEQ ID NO: 2656490 - RNA, 17 nt, Escherichia coli CFT073
uaccgccguacgucagc

SEQ ID NO: 2656491 - RNA, 16 nt, Escherichia coli CFT073
uaccgccugcaaauaa

SEQ ID NO: 2656492 - RNA, 13 nt, Escherichia coli CFT073
uaccgcgccaugu

SEQ ID NO: 2656493 - RNA, 17 nt, Escherichia coli CFT073
uaccgcgguucccagcg

SEQ ID NO: 2656494 - RNA, 13 nt, Escherichia coli CFT073
uaccgcgguugau

SEQ ID NO: 2656495 - RNA, 21 nt, Escherichia coli CFT073
uaccgcugcuggcguugucau

SEQ ID NO: 2656496 - RNA, 13 nt, Escherichia coli CFT073
uaccgcuuggcga

SEQ ID NO: 2656497 - RNA, 16 nt, Escherichia coli CFT073
uaccggacuccagaca

SEQ ID NO: 2656498 - RNA, 17 nt, Escherichia coli CFT073
uaccggacuccagacac

SEQ ID NO: 2656499 - RNA, 22 nt, Escherichia coli CFT073
uaccggaucugccauauccagc

SEQ ID NO: 2656500 - RNA, 16 nt, Escherichia coli CFT073
uaccggaugcucacag

SEQ ID NO: 2656501 - RNA, 19 nt, Escherichia coli CFT073
uaccggcaaaaucaaugcc

SEQ ID NO: 2656502 - RNA, 23 nt, Escherichia coli CFT073
uaccggcaacgucagucccaacu

SEQ ID NO: 2656503 - RNA, 13 nt, Escherichia coli CFT073
uaccggcaauggu

SEQ ID NO: 2656504 - RNA, 16 nt, Escherichia coli CFT073
uaccggcaauguuacc

SEQ ID NO: 2656505 - RNA, 22 nt, Escherichia coli CFT073
uacgcggacacuuuccugcucg

SEQ ID NO: 2656506 - RNA, 18 nt, Escherichia coli CFT073
uacgcggccugcacugag

SEQ ID NO: 2656507 - RNA, 21 nt, Escherichia coli CFT073
uacgcguaaaauauugcugcu

SEQ ID NO: 2656508 - RNA, 13 nt, Escherichia coli CFT073
uacgcucauccug

SEQ ID NO: 2656509 - RNA, 12 nt, Escherichia coli CFT073
uacgcucccacg

SEQ ID NO: 2656510 - RNA, 15 nt, Escherichia coli CFT073
uacgcuccgcccauu

SEQ ID NO: 2656511 - RNA, 22 nt, Escherichia coli CFT073
uacgcucugacgacauaauaau

SEQ ID NO: 2656512 - RNA, 13 nt, Escherichia coli CFT073
uacgcugcaaaaa

SEQ ID NO: 2656513 - RNA, 19 nt, Escherichia coli CFT073
uacgcugcggcgaaagcgg

SEQ ID NO: 2656514 - RNA, 20 nt, Escherichia coli CFT073
uacgcugucuuuugaucaaa

SEQ ID NO: 2656515 - RNA, 14 nt, Escherichia coli CFT073
uacgcuguucgcca

SEQ ID NO: 2656516 - RNA, 12 nt, Escherichia coli CFT073
uacgcuucucac

SEQ ID NO: 2656517 - RNA, 13 nt, Escherichia coli CFT073
uacgcuucucucu

SEQ ID NO: 2656518 - RNA, 16 nt, Escherichia coli CFT073
uacgcuuuauccagca

SEQ ID NO: 2656519 - RNA, 21 nt, Escherichia coli CFT073
uacgcuuuuccacucacacag

SEQ ID NO: 2656520 - RNA, 19 nt, Escherichia coli CFT073
uacggaccacgcacagccc

SEQ ID NO: 2656521 - RNA, 20 nt, Escherichia coli CFT073
uacggaccacgcacagcccg

SEQ ID NO: 2656522 - RNA, 16 nt, Escherichia coli CFT073
uacggauagccgcccc

SEQ ID NO: 2656523 - RNA, 15 nt, Escherichia coli CFT073
uacggaucgacagca

SEQ ID NO: 2656524 - RNA, 15 nt, Escherichia coli CFT073
uacggauucaaugca

SEQ ID NO: 2656525 - RNA, 18 nt, Escherichia coli CFT073
uacggcagcaaucgacca

SEQ ID NO: 2656526 - RNA, 19 nt, Escherichia coli CFT073
uacggcgacagcaaaaucu

SEQ ID NO: 2656527 - RNA, 14 nt, Escherichia coli CFT073
uacggcggucuggc

SEQ ID NO: 2656528 - RNA, 17 nt, Escherichia coli CFT073
uacggcguuaacuuguu

SEQ ID NO: 2656529 - RNA, 14 nt, Escherichia coli CFT073
uacgggaggucauc

SEQ ID NO: 2656530 - RNA, 16 nt, Escherichia coli CFT073
uacgggcaaucuccug

SEQ ID NO: 2656531 - RNA, 16 nt, Escherichia coli CFT073
uacgggcgaugguguu

SEQ ID NO: 2656532 - RNA, 19 nt, Escherichia coli CFT073
uacgggucacaaacaucau

SEQ ID NO: 2656533 - RNA, 20 nt, Escherichia coli CFT073
uacgguaagccgcaaccacc

SEQ ID NO: 2656534 - RNA, 13 nt, Escherichia coli CFT073
uacggucgccgua

SEQ ID NO: 2656535 - RNA, 19 nt, Escherichia coli CFT073
uacguaaaaacccgcuucg

SEQ ID NO: 2656536 - RNA, 15 nt, Escherichia coli CFT073
uacguagaucacuga

SEQ ID NO: 2656537 - RNA, 20 nt, Escherichia coli CFT073
uacgucgagcaguugcugaa

SEQ ID NO: 2656538 - RNA, 13 nt, Escherichia coli CFT073
uacgugaaaucgg

SEQ ID NO: 2656539 - RNA, 20 nt, Escherichia coli CFT073
uacgugaacgcgacauaucg

SEQ ID NO: 2656540 - RNA, 22 nt, Escherichia coli CFT073
uacgugaucgucuucaaccgca

SEQ ID NO: 2656541 - RNA, 20 nt, Escherichia coli CFT073
uacguuaucgcgccaucaaa

SEQ ID NO: 2656542 - RNA, 13 nt, Escherichia coli CFT073
uacguuauuuauu

SEQ ID NO: 2656543 - RNA, 18 nt, Escherichia coli CFT073
uacguucgacugcgccuu

SEQ ID NO: 2656544 - RNA, 15 nt, Escherichia coli CFT073
uacguuugcagcaga

SEQ ID NO: 2656545 - RNA, 12 nt, Escherichia coli CFT073
uacuaaaaagcg

SEQ ID NO: 2656546 - RNA, 20 nt, Escherichia coli CFT073
uacuaaaaagugauaaaagu

SEQ ID NO: 2656547 - RNA, 13 nt, Escherichia coli CFT073
uacuaaaaguaaa

SEQ ID NO: 2656548 - RNA, 21 nt, Escherichia coli CFT073
uacuaaauaauuugaacuggu

SEQ ID NO: 2656549 - RNA, 21 nt, Escherichia coli CFT073
uacuaaucucacccauagaua

SEQ ID NO: 2656550 - RNA, 13 nt, Escherichia coli CFT073
uacuaauuaauaa

SEQ ID NO: 2656551 - RNA, 14 nt, Escherichia coli CFT073
uacuaauuaaugcc

SEQ ID NO: 2656552 - RNA, 20 nt, Escherichia coli CFT073
uacuacaaacaaugccagaa

SEQ ID NO: 2656553 - RNA, 22 nt, Escherichia coli CFT073
uacuacaauccugugcuccagu

SEQ ID NO: 2656554 - RNA, 20 nt, Escherichia coli CFT073
uacuacuggagacagauuua

SEQ ID NO: 2656555 - RNA, 12 nt, Escherichia coli CFT073
uacuacuuuguu

SEQ ID NO: 2656556 - RNA, 17 nt, Escherichia coli CFT073
uacuauauaaaccuucu

SEQ ID NO: 2656557 - RNA, 12 nt, Escherichia coli CFT073
uacuauccugaa

SEQ ID NO: 2656558 - RNA, 16 nt, Escherichia coli CFT073
uacuaugauuuuccug

SEQ ID NO: 2656559 - RNA, 21 nt, Escherichia coli CFT073
uacuaugauuuuccugaggag

SEQ ID NO: 2656560 - RNA, 16 nt, Escherichia coli CFT073
uacuauggauauaauu

SEQ ID NO: 2656561 - RNA, 12 nt, Escherichia coli CFT073
uacuauucacca

SEQ ID NO: 2656562 - RNA, 13 nt, Escherichia coli CFT073
uacucaaaaugcc

SEQ ID NO: 2656563 - RNA, 19 nt, Escherichia coli CFT073
uacucaacucacacaacga

SEQ ID NO: 2656564 - RNA, 23 nt, Escherichia coli CFT073
uacucaacuccccgcauuuacuc

SEQ ID NO: 2656565 - RNA, 13 nt, Escherichia coli CFT073
uacucaccguuga

SEQ ID NO: 2656566 - RNA, 14 nt, Escherichia coli CFT073
uacucagcgccugc

SEQ ID NO: 2656567 - RNA, 18 nt, Escherichia coli CFT073
uacucaguccgguauucu

SEQ ID NO: 2656568 - RNA, 20 nt, Escherichia coli CFT073
uacucauaaguuucccagcu

SEQ ID NO: 2656569 - RNA, 11 nt, Escherichia coli CFT073
uacucauccau

SEQ ID NO: 2656570 - RNA, 23 nt, Escherichia coli CFT073
uacucauccaucucgguuuucag

SEQ ID NO: 2656571 - RNA, 14 nt, Escherichia coli CFT073
uacucauccaugca

SEQ ID NO: 2656572 - RNA, 15 nt, Escherichia coli CFT073
uacucaucuuccauu

SEQ ID NO: 2656573 - RNA, 13 nt, Escherichia coli CFT073
uacucauuaaugu

SEQ ID NO: 2656574 - RNA, 15 nt, Escherichia coli CFT073
uacucauuguuauca

SEQ ID NO: 2656575 - RNA, 17 nt, Escherichia coli CFT073
uacuccagccgacgacc

SEQ ID NO: 2656576 - RNA, 21 nt, Escherichia coli CFT073
uacuccgcaccgcgguacagc

SEQ ID NO: 2656577 - RNA, 16 nt, Escherichia coli CFT073
uacucgauaccagccc

SEQ ID NO: 2656578 - RNA, 18 nt, Escherichia coli CFT073
uacucgccugccacaucc

SEQ ID NO: 2656579 - RNA, 20 nt, Escherichia coli CFT073
uacucgcgcaguucgcacac

SEQ ID NO: 2656580 - RNA, 22 nt, Escherichia coli CFT073
uacucgcugauugccccuccgc

SEQ ID NO: 2656581 - RNA, 14 nt, Escherichia coli CFT073
uacucgcuguugau

SEQ ID NO: 2656582 - RNA, 14 nt, Escherichia coli CFT073
uacucgucgcgcac

SEQ ID NO: 2656583 - RNA, 14 nt, Escherichia coli CFT073
uacucuaaauaauu

SEQ ID NO: 2656584 - RNA, 23 nt, Escherichia coli CFT073
uacucuaccuuccuacaagaggu

SEQ ID NO: 2656585 - RNA, 16 nt, Escherichia coli CFT073
uacucuccuccagguu

SEQ ID NO: 2656586 - RNA, 17 nt, Escherichia coli CFT073
uacucucgugccagagc

SEQ ID NO: 2656587 - RNA, 14 nt, Escherichia coli CFT073
uacucucugugcug

SEQ ID NO: 2656588 - RNA, 15 nt, Escherichia coli CFT073
uacucucuuucgcuu

SEQ ID NO: 2656589 - RNA, 19 nt, Escherichia coli CFT073
uacucuuccgguguaucag

SEQ ID NO: 2656590 - RNA, 14 nt, Escherichia coli CFT073
uacucuucguucuu

SEQ ID NO: 2656591 - RNA, 18 nt, Escherichia coli CFT073
uacucuugugccaguucc

SEQ ID NO: 2656592 - RNA, 19 nt, Escherichia coli CFT073
uacucuugugccaguuccg

SEQ ID NO: 2656593 - RNA, 20 nt, Escherichia coli CFT073
uacucuuucaauuugcaggc

SEQ ID NO: 2656594 - RNA, 21 nt, Escherichia coli CFT073
uacucuuucccggcaaucacc

SEQ ID NO: 2656595 - RNA, 23 nt, Escherichia coli CFT073
uacucuuucccggcaaucaccgc

SEQ ID NO: 2656596 - RNA, 19 nt, Escherichia coli CFT073
uacucuuugaacagccaga

SEQ ID NO: 2656597 - RNA, 12 nt, Escherichia coli CFT073
uacugaacuuau

SEQ ID NO: 2656598 - RNA, 13 nt, Escherichia coli CFT073
uacugaaucccug

SEQ ID NO: 2656599 - RNA, 17 nt, Escherichia coli CFT073
uacugaaucccugcgaa

SEQ ID NO: 2656600 - RNA, 20 nt, Escherichia coli CFT073
uacugaaucccugcgaacug

SEQ ID NO: 2656601 - RNA, 11 nt, Escherichia coli CFT073
uacugacauca

SEQ ID NO: 2656602 - RNA, 16 nt, Escherichia coli CFT073
uacugacaucaaaccc

SEQ ID NO: 2656603 - RNA, 22 nt, Escherichia coli CFT073
uacugaccaucagcagcggcac

SEQ ID NO: 2656604 - RNA, 21 nt, Escherichia coli CFT073
uacugaccgucgccuucaacg

SEQ ID NO: 2656605 - RNA, 19 nt, Escherichia coli CFT073
uacugacgaaggugccgga

SEQ ID NO: 2656606 - RNA, 16 nt, Escherichia coli CFT073
uacugagcagaugcgc

SEQ ID NO: 2656607 - RNA, 22 nt, Escherichia coli CFT073
uacugauugacgcguucgcuaa

SEQ ID NO: 2656608 - RNA, 21 nt, Escherichia coli CFT073
uacugcaacguuauccguaca

SEQ ID NO: 2656609 - RNA, 14 nt, Escherichia coli CFT073
uacugcaauuucau

SEQ ID NO: 2656610 - RNA, 15 nt, Escherichia coli CFT073
uacugcaauuucauu

SEQ ID NO: 2656611 - RNA, 15 nt, Escherichia coli CFT073
uacugcacucgccag

SEQ ID NO: 2656612 - RNA, 17 nt, Escherichia coli CFT073
uacugcagccagcguua

SEQ ID NO: 2656613 - RNA, 16 nt, Escherichia coli CFT073
uacugcauggccagac

SEQ ID NO: 2656614 - RNA, 17 nt, Escherichia coli CFT073
uagcaagcgcugugaaa

SEQ ID NO: 2656615 - RNA, 22 nt, Escherichia coli CFT073
uagcaagcgcugugaaacaccu

SEQ ID NO: 2656616 - RNA, 21 nt, Escherichia coli CFT073
uagcaauaaaugccuggauga

SEQ ID NO: 2656617 - RNA, 17 nt, Escherichia coli CFT073
uagcaaugccaucacca

SEQ ID NO: 2656618 - RNA, 23 nt, Escherichia coli CFT073
uagcacaagauuaucgcuucgcu

SEQ ID NO: 2656619 - RNA, 15 nt, Escherichia coli CFT073
uagcacauaaaaugg

SEQ ID NO: 2656620 - RNA, 19 nt, Escherichia coli CFT073
uagcaccucuccacgcauc

SEQ ID NO: 2656621 - RNA, 23 nt, Escherichia coli CFT073
uagcaccucuccacgcaucugca

SEQ ID NO: 2656622 - RNA, 19 nt, Escherichia coli CFT073
uagcacuuuucgucaggau

SEQ ID NO: 2656623 - RNA, 20 nt, Escherichia coli CFT073
uagcagagcguuuaauaaaa

SEQ ID NO: 2656624 - RNA, 16 nt, Escherichia coli CFT073
uagcagcacaccacau

SEQ ID NO: 2656625 - RNA, 13 nt, Escherichia coli CFT073
uagcagcaggaau

SEQ ID NO: 2656626 - RNA, 15 nt, Escherichia coli CFT073
uagcagcuccgccag

SEQ ID NO: 2656627 - RNA, 21 nt, Escherichia coli CFT073
uagcagguaaaacggcagaau

SEQ ID NO: 2656628 - RNA, 20 nt, Escherichia coli CFT073
uagcagguaaucugccauau

SEQ ID NO: 2656629 - RNA, 23 nt, Escherichia coli CFT073
uagcagugauuuauuuuuacucu

SEQ ID NO: 2656630 - RNA, 24 nt, Escherichia coli CFT073
uagcagugauuuauuuuuacucuu

SEQ ID NO: 2656631 - RNA, 14 nt, Escherichia coli CFT073
uagcauccaguucc

SEQ ID NO: 2656632 - RNA, 18 nt, Escherichia coli CFT073
uagcauccccggcaacca

SEQ ID NO: 2656633 - RNA, 18 nt, Escherichia coli CFT073
uagcaugaacauugcugc

SEQ ID NO: 2656634 - RNA, 11 nt, Escherichia coli CFT073
uagccaauucc

SEQ ID NO: 2656635 - RNA, 12 nt, Escherichia coli CFT073
uagccaccaucu

SEQ ID NO: 2656636 - RNA, 14 nt, Escherichia coli CFT073
uagccaccuggcug

SEQ ID NO: 2656637 - RNA, 12 nt, Escherichia coli CFT073
uagccacgccga

SEQ ID NO: 2656638 - RNA, 22 nt, Escherichia coli CFT073
uagccacgucugccacggcaga

SEQ ID NO: 2656639 - RNA, 13 nt, Escherichia coli CFT073
uagccagcagagc

SEQ ID NO: 2656640 - RNA, 23 nt, Escherichia coli CFT073
uagccaggcagauaauagucagc

SEQ ID NO: 2656641 - RNA, 13 nt, Escherichia coli CFT073
uagccauauggcu

SEQ ID NO: 2656642 - RNA, 19 nt, Escherichia coli CFT073
uagccauauggcugcaucc

SEQ ID NO: 2656643 - RNA, 20 nt, Escherichia coli CFT073
uagccaucccuaauauaaac

SEQ ID NO: 2656644 - RNA, 12 nt, Escherichia coli CFT073
uagccaucugcc

SEQ ID NO: 2656645 - RNA, 15 nt, Escherichia coli CFT073
uagccaugaaaaagu

SEQ ID NO: 2656646 - RNA, 18 nt, Escherichia coli CFT073
uagccauuaccaggucga

SEQ ID NO: 2656647 - RNA, 13 nt, Escherichia coli CFT073
uagccauuuuuug

SEQ ID NO: 2656648 - RNA, 17 nt, Escherichia coli CFT073
uagccccggccaguacg

SEQ ID NO: 2656649 - RNA, 12 nt, Escherichia coli CFT073
uagcccggcaau

SEQ ID NO: 2656650 - RNA, 22 nt, Escherichia coli CFT073
uagcccguucuucgccauaaca

SEQ ID NO: 2656651 - RNA, 22 nt, Escherichia coli CFT073
uagcccuaacagggcgcuguug

SEQ ID NO: 2656652 - RNA, 19 nt, Escherichia coli CFT073
uagcccuuuguaggccaga

SEQ ID NO: 2656653 - RNA, 14 nt, Escherichia coli CFT073
uagccgaaaacgcu

SEQ ID NO: 2656654 - RNA, 23 nt, Escherichia coli CFT073
uagccgaccgcaaggaagccuga

SEQ ID NO: 2656655 - RNA, 17 nt, Escherichia coli CFT073
uagccgaugucgcugca

SEQ ID NO: 2656656 - RNA, 17 nt, Escherichia coli CFT073
uagccgcauccggcaua

SEQ ID NO: 2656657 - RNA, 18 nt, Escherichia coli CFT073
uagccgccaaacgccgca

SEQ ID NO: 2656658 - RNA, 22 nt, Escherichia coli CFT073
uagccgccccagacuccagcag

SEQ ID NO: 2656659 - RNA, 13 nt, Escherichia coli CFT073
uagccgcgcaguu

SEQ ID NO: 2656660 - RNA, 18 nt, Escherichia coli CFT073
uagccggagguuuuucaa

SEQ ID NO: 2656661 - RNA, 14 nt, Escherichia coli CFT073
uagccggauaagca

SEQ ID NO: 2656662 - RNA, 13 nt, Escherichia coli CFT073
uagccuccggcca

SEQ ID NO: 2656663 - RNA, 21 nt, Escherichia coli CFT073
uagccuuuuuuaauauuucau

SEQ ID NO: 2656664 - RNA, 15 nt, Escherichia coli CFT073
uagcgaagaauacgc

SEQ ID NO: 2656665 - RNA, 19 nt, Escherichia coli CFT073
uagcgaucucggucaccag

SEQ ID NO: 2656666 - RNA, 18 nt, Escherichia coli CFT073
uagcgaucuguucaucag

SEQ ID NO: 2656667 - RNA, 17 nt, Escherichia coli CFT073
uagcgauuucacgcuca

SEQ ID NO: 2656668 - RNA, 23 nt, Escherichia coli CFT073
uagcgauuucacgcucagcaaca

SEQ ID NO: 2656669 - RNA, 17 nt, Escherichia coli CFT073
uagcgcaauaaccacca

SEQ ID NO: 2656670 - RNA, 18 nt, Escherichia coli CFT073
uagcgcaaucgcuguacu

SEQ ID NO: 2656671 - RNA, 23 nt, Escherichia coli CFT073
uagcgcaaucgcuguacucacca

SEQ ID NO: 2656672 - RNA, 13 nt, Escherichia coli CFT073
uagcgcaccggau

SEQ ID NO: 2656673 - RNA, 14 nt, Escherichia coli CFT073
uagcgcagcgauuc

SEQ ID NO: 2656674 - RNA, 13 nt, Escherichia coli CFT073
uagcgcaucacuu

SEQ ID NO: 2656675 - RNA, 16 nt, Escherichia coli CFT073
uagcgcaugacaugcg

SEQ ID NO: 2656676 - RNA, 12 nt, Escherichia coli CFT073
uagcgccugcug

SEQ ID NO: 2656677 - RNA, 21 nt, Escherichia coli CFT073
uagcggaaaaucgggcgacag

SEQ ID NO: 2656678 - RNA, 19 nt, Escherichia coli CFT073
uagcggaaaucuccagaua

SEQ ID NO: 2656679 - RNA, 13 nt, Escherichia coli CFT073
uagcggagcaauu

SEQ ID NO: 2656680 - RNA, 15 nt, Escherichia coli CFT073
uagcggcaacaaugc

SEQ ID NO: 2656681 - RNA, 23 nt, Escherichia coli CFT073
uagcggcgacuugcucaggagua

SEQ ID NO: 2656682 - RNA, 16 nt, Escherichia coli CFT073
uagcggcggcagauug

SEQ ID NO: 2656683 - RNA, 19 nt, Escherichia coli CFT073
uagcggcguuaaugauauc

SEQ ID NO: 2656684 - RNA, 15 nt, Escherichia coli CFT073
uagcggcugcgcagc

SEQ ID NO: 2656685 - RNA, 14 nt, Escherichia coli CFT073
uagcguaaagccag

SEQ ID NO: 2656686 - RNA, 15 nt, Escherichia coli CFT073
uagcguaaaucaucg

SEQ ID NO: 2656687 - RNA, 22 nt, Escherichia coli CFT073
uagcgucaacuuuagcaaugug

SEQ ID NO: 2656688 - RNA, 16 nt, Escherichia coli CFT073
uagcgugacaccagca

SEQ ID NO: 2656689 - RNA, 18 nt, Escherichia coli CFT073
uagcgugauggccagaua

SEQ ID NO: 2656690 - RNA, 13 nt, Escherichia coli CFT073
uagcgugauuuuu

SEQ ID NO: 2656691 - RNA, 14 nt, Escherichia coli CFT073
uagcgugcaggacg

SEQ ID NO: 2656692 - RNA, 15 nt, Escherichia coli CFT073
uagcguuuuuucauu

SEQ ID NO: 2656693 - RNA, 10 nt, Escherichia coli CFT073
uagcuaauca

SEQ ID NO: 2656694 - RNA, 21 nt, Escherichia coli CFT073
uagcuaaucaucuguugugcc

SEQ ID NO: 2656695 - RNA, 21 nt, Escherichia coli CFT073
uagcuauaaaugaacugggca

SEQ ID NO: 2656696 - RNA, 20 nt, Escherichia coli CFT073
uagcucaauccuacauccag

SEQ ID NO: 2656697 - RNA, 21 nt, Escherichia coli CFT073
uagcucaguugguagagcacg

SEQ ID NO: 2656698 - RNA, 11 nt, Escherichia coli CFT073
uagcugaacgc

SEQ ID NO: 2656699 - RNA, 15 nt, Escherichia coli CFT073
uagcuggaauaauaa

SEQ ID NO: 2656700 - RNA, 19 nt, Escherichia coli CFT073
uagcuguguggcgcuuuuu

SEQ ID NO: 2656701 - RNA, 17 nt, Escherichia coli CFT073
uagcuguuggcaacgca

SEQ ID NO: 2656702 - RNA, 19 nt, Escherichia coli CFT073
uagcuguuggcaacgcaaa

SEQ ID NO: 2656703 - RNA, 14 nt, Escherichia coli CFT073
uagcuuaacggcag

SEQ ID NO: 2656704 - RNA, 20 nt, Escherichia coli CFT073
uagcuuaucaaucucugcaa

SEQ ID NO: 2656705 - RNA, 23 nt, Escherichia coli CFT073
uagcuuaucgcaggcuuccuggc

SEQ ID NO: 2656706 - RNA, 22 nt, Escherichia coli CFT073
uagcuuauucuuauuauauugu

SEQ ID NO: 2656707 - RNA, 15 nt, Escherichia coli CFT073
uagcuucagguaaua

SEQ ID NO: 2656708 - RNA, 20 nt, Escherichia coli CFT073
uagcuugauuucaggauaau

SEQ ID NO: 2656709 - RNA, 13 nt, Escherichia coli CFT073
uagcuuuggugcc

SEQ ID NO: 2656710 - RNA, 19 nt, Escherichia coli CFT073
uaggaccgguuucaaaacu

SEQ ID NO: 2656711 - RNA, 17 nt, Escherichia coli CFT073
uaggagguuuccggguc

SEQ ID NO: 2656712 - RNA, 17 nt, Escherichia coli CFT073
uaggcaaaaaaaugccc

SEQ ID NO: 2656713 - RNA, 15 nt, Escherichia coli CFT073
uaggcaccugaaucu

SEQ ID NO: 2656714 - RNA, 17 nt, Escherichia coli CFT073
uaggcaggcaucaucag

SEQ ID NO: 2656715 - RNA, 20 nt, Escherichia coli CFT073
uaggccagauaagacgcguc

SEQ ID NO: 2656716 - RNA, 17 nt, Escherichia coli CFT073
uaggccaucggcagcau

SEQ ID NO: 2656717 - RNA, 20 nt, Escherichia coli CFT073
uaggccggagaaggcguuca

SEQ ID NO: 2656718 - RNA, 12 nt, Escherichia coli CFT073
uaggccggauaa

SEQ ID NO: 2656719 - RNA, 18 nt, Escherichia coli CFT073
uaggccggauaagacgcg

SEQ ID NO: 2656720 - RNA, 20 nt, Escherichia coli CFT073
uaggccggauaaggcguuca

SEQ ID NO: 2656721 - RNA, 20 nt, Escherichia coli CFT073
uaggccggauaagguguuca

SEQ ID NO: 2656722 - RNA, 12 nt, Escherichia coli CFT073
uauacagcagcc

SEQ ID NO: 2656723 - RNA, 16 nt, Escherichia coli CFT073
uauaccaacaaaaaac

SEQ ID NO: 2656724 - RNA, 21 nt, Escherichia coli CFT073
uauaccauaucugguuaaaaa

SEQ ID NO: 2656725 - RNA, 18 nt, Escherichia coli CFT073
uauaccggcguuucuggc

SEQ ID NO: 2656726 - RNA, 17 nt, Escherichia coli CFT073
uauaccuguuaauucuc

SEQ ID NO: 2656727 - RNA, 21 nt, Escherichia coli CFT073
uauacgggcuuuuuaauuccu

SEQ ID NO: 2656728 - RNA, 14 nt, Escherichia coli CFT073
uauacgucggguua

SEQ ID NO: 2656729 - RNA, 20 nt, Escherichia coli CFT073
uauacgugaaauccccuggc

SEQ ID NO: 2656730 - RNA, 22 nt, Escherichia coli CFT073
uauacguguacguugauggaua

SEQ ID NO: 2656731 - RNA, 16 nt, Escherichia coli CFT073
uauacugaccccauau

SEQ ID NO: 2656732 - RNA, 16 nt, Escherichia coli CFT073
uauagaucaggaaaaa

SEQ ID NO: 2656733 - RNA, 17 nt, Escherichia coli CFT073
uauagaucaggaaaaac

SEQ ID NO: 2656734 - RNA, 17 nt, Escherichia coli CFT073
uauagaucauaucgucc

SEQ ID NO: 2656735 - RNA, 15 nt, Escherichia coli CFT073
uauagcacccgccag

SEQ ID NO: 2656736 - RNA, 18 nt, Escherichia coli CFT073
uauagcacccgccagcgc

SEQ ID NO: 2656737 - RNA, 13 nt, Escherichia coli CFT073
uauagcauagcgu

SEQ ID NO: 2656738 - RNA, 15 nt, Escherichia coli CFT073
uauagcgaagguguu

SEQ ID NO: 2656739 - RNA, 21 nt, Escherichia coli CFT073
uauagcgauuuuucaucacug

SEQ ID NO: 2656740 - RNA, 14 nt, Escherichia coli CFT073
uauagcuuauucuu

SEQ ID NO: 2656741 - RNA, 20 nt, Escherichia coli CFT073
uauaguaagaagcaagguag

SEQ ID NO: 2656742 - RNA, 22 nt, Escherichia coli CFT073
uauauaggugauaaaguacauu

SEQ ID NO: 2656743 - RNA, 15 nt, Escherichia coli CFT073
uauauaguaagaagc

SEQ ID NO: 2656744 - RNA, 13 nt, Escherichia coli CFT073
uauauauaauagu

SEQ ID NO: 2656745 - RNA, 23 nt, Escherichia coli CFT073
uauaucagccugaaugcuuucau

SEQ ID NO: 2656746 - RNA, 20 nt, Escherichia coli CFT073
uauaucgcugauaucaaaau

SEQ ID NO: 2656747 - RNA, 19 nt, Escherichia coli CFT073
uauaucucagauaaaugca

SEQ ID NO: 2656748 - RNA, 22 nt, Escherichia coli CFT073
uauaucucagauaaaugcaaac

SEQ ID NO: 2656749 - RNA, 12 nt, Escherichia coli CFT073
uauaucuucuuu

SEQ ID NO: 2656750 - RNA, 18 nt, Escherichia coli CFT073
uauaugacucauaaaaau

SEQ ID NO: 2656751 - RNA, 19 nt, Escherichia coli CFT073
uauaugagaagacugugau

SEQ ID NO: 2656752 - RNA, 20 nt, Escherichia coli CFT073
uauaugccggauaagacgcg

SEQ ID NO: 2656753 - RNA, 21 nt, Escherichia coli CFT073
uauaugcuuguauuagcgcgc

SEQ ID NO: 2656754 - RNA, 21 nt, Escherichia coli CFT073
uauauuaucccccgauaaaac

SEQ ID NO: 2656755 - RNA, 20 nt, Escherichia coli CFT073
uauauuccccggucagcagc

SEQ ID NO: 2656756 - RNA, 21 nt, Escherichia coli CFT073
uauauuccccggucagcagca

SEQ ID NO: 2656757 - RNA, 16 nt, Escherichia coli CFT073
uauauugcugauuuuc

SEQ ID NO: 2656758 - RNA, 13 nt, Escherichia coli CFT073
uauauuucaucaa

SEQ ID NO: 2656759 - RNA, 17 nt, Escherichia coli CFT073
uaucaaacagaaaaacg

SEQ ID NO: 2656760 - RNA, 16 nt, Escherichia coli CFT073
uaucaaaggucuuaau

SEQ ID NO: 2656761 - RNA, 16 nt, Escherichia coli CFT073
uaucaacaauaaacug

SEQ ID NO: 2656762 - RNA, 20 nt, Escherichia coli CFT073
uaucaacggacgugaaauca

SEQ ID NO: 2656763 - RNA, 20 nt, Escherichia coli CFT073
uaucaaucgcggugauuuua

SEQ ID NO: 2656764 - RNA, 18 nt, Escherichia coli CFT073
uaucaaugacaucugcau

SEQ ID NO: 2656765 - RNA, 22 nt, Escherichia coli CFT073
uaucaauuaacugugccagcgu

SEQ ID NO: 2656766 - RNA, 15 nt, Escherichia coli CFT073
uaucaauuaucuguu

SEQ ID NO: 2656767 - RNA, 16 nt, Escherichia coli CFT073
uaucaauugaugcuuu

SEQ ID NO: 2656768 - RNA, 19 nt, Escherichia coli CFT073
uaucaauugcuucaauaau

SEQ ID NO: 2656769 - RNA, 18 nt, Escherichia coli CFT073
uaucaccaauauaaacau

SEQ ID NO: 2656770 - RNA, 19 nt, Escherichia coli CFT073
uaucaccgacaaacagcga

SEQ ID NO: 2656771 - RNA, 19 nt, Escherichia coli CFT073
uaucaccgaucguuaccgu

SEQ ID NO: 2656772 - RNA, 20 nt, Escherichia coli CFT073
uaucaccguggucgguaaac

SEQ ID NO: 2656773 - RNA, 18 nt, Escherichia coli CFT073
uaucacgauacaccagau

SEQ ID NO: 2656774 - RNA, 22 nt, Escherichia coli CFT073
uaucacgcgcaggcaaauuauu

SEQ ID NO: 2656775 - RNA, 15 nt, Escherichia coli CFT073
uaucacguagccacg

SEQ ID NO: 2656776 - RNA, 16 nt, Escherichia coli CFT073
uaucacguagccacgg

SEQ ID NO: 2656777 - RNA, 14 nt, Escherichia coli CFT073
uaucacuauaaaua

SEQ ID NO: 2656778 - RNA, 19 nt, Escherichia coli CFT073
uaucacuuguaguuacauu

SEQ ID NO: 2656779 - RNA, 17 nt, Escherichia coli CFT073
uaucagaagauuaagag

SEQ ID NO: 2656780 - RNA, 18 nt, Escherichia coli CFT073
uaucagauuggcuucacu

SEQ ID NO: 2656781 - RNA, 21 nt, Escherichia coli CFT073
uaucagcaaauuuggcaucga

SEQ ID NO: 2656782 - RNA, 16 nt, Escherichia coli CFT073
uaucagcaauaaaaaa

SEQ ID NO: 2656783 - RNA, 17 nt, Escherichia coli CFT073
uaucagcagcacaaacg

SEQ ID NO: 2656784 - RNA, 18 nt, Escherichia coli CFT073
uaucagccugcaaacgcu

SEQ ID NO: 2656785 - RNA, 16 nt, Escherichia coli CFT073
uaucagcgagacgugc

SEQ ID NO: 2656786 - RNA, 22 nt, Escherichia coli CFT073
uaucagcgccaccacaaaagcg

SEQ ID NO: 2656787 - RNA, 15 nt, Escherichia coli CFT073
uaucaggccuacaau

SEQ ID NO: 2656788 - RNA, 20 nt, Escherichia coli CFT073
uaucaggccuacgccagaca

SEQ ID NO: 2656789 - RNA, 15 nt, Escherichia coli CFT073
uaucaggccuucagg

SEQ ID NO: 2656790 - RNA, 22 nt, Escherichia coli CFT073
uaucaggucgaaaauaauccug

SEQ ID NO: 2656791 - RNA, 18 nt, Escherichia coli CFT073
uaucaggucuuucugaaa

SEQ ID NO: 2656792 - RNA, 15 nt, Escherichia coli CFT073
uaucagguuuauaug

SEQ ID NO: 2656793 - RNA, 23 nt, Escherichia coli CFT073
uaucaguuguaugucauaaaaau

SEQ ID NO: 2656794 - RNA, 22 nt, Escherichia coli CFT073
uaucaucaagacccggcgcacg

SEQ ID NO: 2656795 - RNA, 16 nt, Escherichia coli CFT073
uaucaucaauaugaau

SEQ ID NO: 2656796 - RNA, 19 nt, Escherichia coli CFT073
uaucaucauccgcaauaac

SEQ ID NO: 2656797 - RNA, 23 nt, Escherichia coli CFT073
uaucaucccagccaaugcaggca

SEQ ID NO: 2656798 - RNA, 20 nt, Escherichia coli CFT073
uaucaucgcggcacacagca

SEQ ID NO: 2656799 - RNA, 13 nt, Escherichia coli CFT073
uaucaugcccgga

SEQ ID NO: 2656800 - RNA, 19 nt, Escherichia coli CFT073
uaucaugcccuuuuuucuu

SEQ ID NO: 2656801 - RNA, 19 nt, Escherichia coli CFT073
uaucaugcucugccagcgu

SEQ ID NO: 2656802 - RNA, 18 nt, Escherichia coli CFT073
uaucauuaacgauaauuu

SEQ ID NO: 2656803 - RNA, 18 nt, Escherichia coli CFT073
uauccaacugugaauccu

SEQ ID NO: 2656804 - RNA, 14 nt, Escherichia coli CFT073
uauccaacuuuucc

SEQ ID NO: 2656805 - RNA, 18 nt, Escherichia coli CFT073
uauccacccgcagccauc

SEQ ID NO: 2656806 - RNA, 19 nt, Escherichia coli CFT073
uauccaccgacacuacaaa

SEQ ID NO: 2656807 - RNA, 21 nt, Escherichia coli CFT073
uauccacucggcacauagacg

SEQ ID NO: 2656808 - RNA, 20 nt, Escherichia coli CFT073
uauccagaccgcgcuugccg

SEQ ID NO: 2656809 - RNA, 22 nt, Escherichia coli CFT073
uauccagaccgcgcuugccgcc

SEQ ID NO: 2656810 - RNA, 14 nt, Escherichia coli CFT073
uauccagcagaucg

SEQ ID NO: 2656811 - RNA, 16 nt, Escherichia coli CFT073
uauccagcagaucgau

SEQ ID NO: 2656812 - RNA, 16 nt, Escherichia coli CFT073
uauccagcagccagag

SEQ ID NO: 2656813 - RNA, 17 nt, Escherichia coli CFT073
uauccagcagccagaga

SEQ ID NO: 2656814 - RNA, 22 nt, Escherichia coli CFT073
uauccagccacggcuccagcaa

SEQ ID NO: 2656815 - RNA, 12 nt, Escherichia coli CFT073
uauccagccagg

SEQ ID NO: 2656816 - RNA, 22 nt, Escherichia coli CFT073
uauccagcgcaguuuuuccuuu

SEQ ID NO: 2656817 - RNA, 12 nt, Escherichia coli CFT073
uauccagcgcau

SEQ ID NO: 2656818 - RNA, 22 nt, Escherichia coli CFT073
uauccagcgcggcgaaggugcc

SEQ ID NO: 2656819 - RNA, 21 nt, Escherichia coli CFT073
uauccaggcuaauccaguccu

SEQ ID NO: 2656820 - RNA, 16 nt, Escherichia coli CFT073
uauccagguuacgcau

SEQ ID NO: 2656821 - RNA, 17 nt, Escherichia coli CFT073
uauccaguucaugacgu

SEQ ID NO: 2656822 - RNA, 15 nt, Escherichia coli CFT073
uauccaucagacuuu

SEQ ID NO: 2656823 - RNA, 23 nt, Escherichia coli CFT073
uauccaucagccaugguuuaauc

SEQ ID NO: 2656824 - RNA, 14 nt, Escherichia coli CFT073
uauccauuaaaacu

SEQ ID NO: 2656825 - RNA, 13 nt, Escherichia coli CFT073
uaucccaaaucgc

SEQ ID NO: 2656826 - RNA, 23 nt, Escherichia coli CFT073
uaucccaacgcaaaaccaagcug

SEQ ID NO: 2656827 - RNA, 13 nt, Escherichia coli CFT073
uaucccaccagcg

SEQ ID NO: 2656828 - RNA, 16 nt, Escherichia coli CFT073
uaucccauuucuccac

SEQ ID NO: 2656829 - RNA, 14 nt, Escherichia coli CFT073
uaugccaucgccag

SEQ ID NO: 2656830 - RNA, 19 nt, Escherichia coli CFT073
uaugcccauguucgcggcu

SEQ ID NO: 2656831 - RNA, 17 nt, Escherichia coli CFT073
uaugccccagcccgcca

SEQ ID NO: 2656832 - RNA, 19 nt, Escherichia coli CFT073
uaugcccucagccuucugu

SEQ ID NO: 2656833 - RNA, 13 nt, Escherichia coli CFT073
uaugcccuggauc

SEQ ID NO: 2656834 - RNA, 18 nt, Escherichia coli CFT073
uaugccggauaagacgcg

SEQ ID NO: 2656835 - RNA, 14 nt, Escherichia coli CFT073
uaugccggauggcu

SEQ ID NO: 2656836 - RNA, 13 nt, Escherichia coli CFT073
uaugccuggcgaa

SEQ ID NO: 2656837 - RNA, 22 nt, Escherichia coli CFT073
uaugcgcaucaaggccaggcag

SEQ ID NO: 2656838 - RNA, 13 nt, Escherichia coli CFT073
uaugcgccagacu

SEQ ID NO: 2656839 - RNA, 20 nt, Escherichia coli CFT073
uaugcgccgcgauuaaccgu

SEQ ID NO: 2656840 - RNA, 17 nt, Escherichia coli CFT073
uaugcgcuaucgccugc

SEQ ID NO: 2656841 - RNA, 18 nt, Escherichia coli CFT073
uaugcgguacugaccauc

SEQ ID NO: 2656842 - RNA, 16 nt, Escherichia coli CFT073
uaugcggugccauuaa

SEQ ID NO: 2656843 - RNA, 15 nt, Escherichia coli CFT073
uaugcugcgccaguu

SEQ ID NO: 2656844 - RNA, 14 nt, Escherichia coli CFT073
uaugcuugcucagu

SEQ ID NO: 2656845 - RNA, 21 nt, Escherichia coli CFT073
uauggaaaaguuguuuuggga

SEQ ID NO: 2656846 - RNA, 20 nt, Escherichia coli CFT073
uauggcccagccuuuccagc

SEQ ID NO: 2656847 - RNA, 21 nt, Escherichia coli CFT073
uauggcccagccuuuccagca

SEQ ID NO: 2656848 - RNA, 17 nt, Escherichia coli CFT073
uauggcugcauccagaa

SEQ ID NO: 2656849 - RNA, 15 nt, Escherichia coli CFT073
uauggcuuuuuucuu

SEQ ID NO: 2656850 - RNA, 20 nt, Escherichia coli CFT073
uaugggauauuuuuuuccua

SEQ ID NO: 2656851 - RNA, 18 nt, Escherichia coli CFT073
uaugggcagcucuaucug

SEQ ID NO: 2656852 - RNA, 15 nt, Escherichia coli CFT073
uaugggcauuucuuu

SEQ ID NO: 2656853 - RNA, 22 nt, Escherichia coli CFT073
uaugguguaagaaugcucccca

SEQ ID NO: 2656854 - RNA, 21 nt, Escherichia coli CFT073
uaugguuucccugauaauguc

SEQ ID NO: 2656855 - RNA, 24 nt, Escherichia coli CFT073
uaugguuucccugauaauguccgg

SEQ ID NO: 2656856 - RNA, 18 nt, Escherichia coli CFT073
uauguauacaaaaucugu

SEQ ID NO: 2656857 - RNA, 18 nt, Escherichia coli CFT073
uaugucauccgguuugua

SEQ ID NO: 2656858 - RNA, 15 nt, Escherichia coli CFT073
uaugucauugaaugu

SEQ ID NO: 2656859 - RNA, 16 nt, Escherichia coli CFT073
uaugucauugccugau

SEQ ID NO: 2656860 - RNA, 23 nt, Escherichia coli CFT073
uaugucccucuuacaccugcucc

SEQ ID NO: 2656861 - RNA, 18 nt, Escherichia coli CFT073
uaugucuggcgagcucca

SEQ ID NO: 2656862 - RNA, 19 nt, Escherichia coli CFT073
uaugugacuggaaaucaaa

SEQ ID NO: 2656863 - RNA, 18 nt, Escherichia coli CFT073
uaugugcuucuagcauga

SEQ ID NO: 2656864 - RNA, 15 nt, Escherichia coli CFT073
uauguguaagaaagg

SEQ ID NO: 2656865 - RNA, 23 nt, Escherichia coli CFT073
uauguuauagaguacuugcuaca

SEQ ID NO: 2656866 - RNA, 22 nt, Escherichia coli CFT073
uauguucaggauauuuauauuu

SEQ ID NO: 2656867 - RNA, 20 nt, Escherichia coli CFT073
uauguuuacgcguuuuucag

SEQ ID NO: 2656868 - RNA, 15 nt, Escherichia coli CFT073
uauguuuauuagccc

SEQ ID NO: 2656869 - RNA, 19 nt, Escherichia coli CFT073
uauguuucauccaggcacu

SEQ ID NO: 2656870 - RNA, 11 nt, Escherichia coli CFT073
uauguuuuguc

SEQ ID NO: 2656871 - RNA, 18 nt, Escherichia coli CFT073
uauguuuuugaauuaacu

SEQ ID NO: 2656872 - RNA, 15 nt, Escherichia coli CFT073
uauuaaaaauccgcu

SEQ ID NO: 2656873 - RNA, 12 nt, Escherichia coli CFT073
uauuaaaccacc

SEQ ID NO: 2656874 - RNA, 24 nt, Escherichia coli CFT073
uauuaaaccacccgcggcgaucug

SEQ ID NO: 2656875 - RNA, 17 nt, Escherichia coli CFT073
uauuaaaccaggaacag

SEQ ID NO: 2656876 - RNA, 19 nt, Escherichia coli CFT073
uauuaaagaaaguaaucua

SEQ ID NO: 2656877 - RNA, 17 nt, Escherichia coli CFT073
uauuaaagcuuuaauuu

SEQ ID NO: 2656878 - RNA, 11 nt, Escherichia coli CFT073
uauuaaauggc

SEQ ID NO: 2656879 - RNA, 13 nt, Escherichia coli CFT073
uauuaaauggccc

SEQ ID NO: 2656880 - RNA, 17 nt, Escherichia coli CFT073
uauuaaauggcccgcgc

SEQ ID NO: 2656881 - RNA, 16 nt, Escherichia coli CFT073
uauuaaccaauaagua

SEQ ID NO: 2656882 - RNA, 20 nt, Escherichia coli CFT073
uauuaacgagucauuguaaa

SEQ ID NO: 2656883 - RNA, 12 nt, Escherichia coli CFT073
uauuaacugugg

SEQ ID NO: 2656884 - RNA, 13 nt, Escherichia coli CFT073
uauuaagcggcac

SEQ ID NO: 2656885 - RNA, 18 nt, Escherichia coli CFT073
uauuaauaccagaauaag

SEQ ID NO: 2656886 - RNA, 13 nt, Escherichia coli CFT073
uauuaauauauau

SEQ ID NO: 2656887 - RNA, 21 nt, Escherichia coli CFT073
uauuaauccauaaccauaauu

SEQ ID NO: 2656888 - RNA, 17 nt, Escherichia coli CFT073
uauuaauuugccagcgu

SEQ ID NO: 2656889 - RNA, 23 nt, Escherichia coli CFT073
uauuaauuuguaugguauaucgu

SEQ ID NO: 2656890 - RNA, 15 nt, Escherichia coli CFT073
uauuacccuauuuaa

SEQ ID NO: 2656891 - RNA, 19 nt, Escherichia coli CFT073
uauuacgggcgauacaccu

SEQ ID NO: 2656892 - RNA, 22 nt, Escherichia coli CFT073
uauuacgggucacaaacaucau

SEQ ID NO: 2656893 - RNA, 23 nt, Escherichia coli CFT073
uauuacuccacuuccugccaguu

SEQ ID NO: 2656894 - RNA, 15 nt, Escherichia coli CFT073
uauuacucuccagac

SEQ ID NO: 2656895 - RNA, 18 nt, Escherichia coli CFT073
uauuacugcgaauuuccu

SEQ ID NO: 2656896 - RNA, 21 nt, Escherichia coli CFT073
uauuacugcgaauuuccugcc

SEQ ID NO: 2656897 - RNA, 19 nt, Escherichia coli CFT073
uauuagcagugauuuauuu

SEQ ID NO: 2656898 - RNA, 14 nt, Escherichia coli CFT073
uauuaguuaaauga

SEQ ID NO: 2656899 - RNA, 13 nt, Escherichia coli CFT073
uauuaucaauuuu

SEQ ID NO: 2656900 - RNA, 22 nt, Escherichia coli CFT073
uauuauccggcaaccaccguuu

SEQ ID NO: 2656901 - RNA, 15 nt, Escherichia coli CFT073
uauuauuaaaccagg

SEQ ID NO: 2656902 - RNA, 16 nt, Escherichia coli CFT073
uauuauucauaaugcc

SEQ ID NO: 2656903 - RNA, 19 nt, Escherichia coli CFT073
uauuauugaugcuuuucaa

SEQ ID NO: 2656904 - RNA, 12 nt, Escherichia coli CFT073
uauucaaaaaca

SEQ ID NO: 2656905 - RNA, 16 nt, Escherichia coli CFT073
uauucaaaaacagauu

SEQ ID NO: 2656906 - RNA, 14 nt, Escherichia coli CFT073
uauucaccacuacc

SEQ ID NO: 2656907 - RNA, 23 nt, Escherichia coli CFT073
uauucacguuuuucauccagcgg

SEQ ID NO: 2656908 - RNA, 21 nt, Escherichia coli CFT073
uauucacuacggucacgccac

SEQ ID NO: 2656909 - RNA, 16 nt, Escherichia coli CFT073
uauucacuacugguug

SEQ ID NO: 2656910 - RNA, 16 nt, Escherichia coli CFT073
uauucacuugccugcu

SEQ ID NO: 2656911 - RNA, 14 nt, Escherichia coli CFT073
uauucagcagcaga

SEQ ID NO: 2656912 - RNA, 18 nt, Escherichia coli CFT073
uauucaggauugaauaau

SEQ ID NO: 2656913 - RNA, 20 nt, Escherichia coli CFT073
uauucaggcacuuucgcgaa

SEQ ID NO: 2656914 - RNA, 23 nt, Escherichia coli CFT073
uauucaguggcauuuagaucuau

SEQ ID NO: 2656915 - RNA, 18 nt, Escherichia coli CFT073
uauucaugcccugcccgc

SEQ ID NO: 2656916 - RNA, 23 nt, Escherichia coli CFT073
uauucaugcccugcccgcugcca

SEQ ID NO: 2656917 - RNA, 13 nt, Escherichia coli CFT073
uauucauguugau

SEQ ID NO: 2656918 - RNA, 18 nt, Escherichia coli CFT073
uauucauuaauaaccauu

SEQ ID NO: 2656919 - RNA, 18 nt, Escherichia coli CFT073
uauucauuguucucccau

SEQ ID NO: 2656920 - RNA, 15 nt, Escherichia coli CFT073
uauuccaguuaucac

SEQ ID NO: 2656921 - RNA, 14 nt, Escherichia coli CFT073
uauuccauccugcu

SEQ ID NO: 2656922 - RNA, 12 nt, Escherichia coli CFT073
uauuccccagac

SEQ ID NO: 2656923 - RNA, 18 nt, Escherichia coli CFT073
uauuccccggucagcagc

SEQ ID NO: 2656924 - RNA, 23 nt, Escherichia coli CFT073
uauucccgcgcuaccacuuccca

SEQ ID NO: 2656925 - RNA, 21 nt, Escherichia coli CFT073
uauucccuugcucugguuccc

SEQ ID NO: 2656926 - RNA, 19 nt, Escherichia coli CFT073
uauuccgagcagcuccgga

SEQ ID NO: 2656927 - RNA, 19 nt, Escherichia coli CFT073
uauuccgcgugaaaugcca

SEQ ID NO: 2656928 - RNA, 21 nt, Escherichia coli CFT073
uauuccugaaucagccaguaa

SEQ ID NO: 2656929 - RNA, 18 nt, Escherichia coli CFT073
uauucgccccuucagaag

SEQ ID NO: 2656930 - RNA, 18 nt, Escherichia coli CFT073
uauucggccuaccaugau

SEQ ID NO: 2656931 - RNA, 15 nt, Escherichia coli CFT073
uauucggcuccagau

SEQ ID NO: 2656932 - RNA, 20 nt, Escherichia coli CFT073
uauucgucgcagcuauccug

SEQ ID NO: 2656933 - RNA, 22 nt, Escherichia coli CFT073
uauucguuaucguaccaggcga

SEQ ID NO: 2656934 - RNA, 22 nt, Escherichia coli CFT073
uauucucgcuccaguuuucuuu

SEQ ID NO: 2656935 - RNA, 15 nt, Escherichia coli CFT073
uauucuuauuauauu

SEQ ID NO: 2656936 - RNA, 21 nt, Escherichia coli CFT073
uauucuuuaagaauagccugg

SEQ ID NO: 2656937 - RNA, 17 nt, Escherichia coli CFT073
ucaaaggucuuaauuuu

SEQ ID NO: 2656938 - RNA, 21 nt, Escherichia coli CFT073
ucaaaggucuuaauuuuggua

SEQ ID NO: 2656939 - RNA, 19 nt, Escherichia coli CFT073
ucaaagucucuguuggcga

SEQ ID NO: 2656940 - RNA, 19 nt, Escherichia coli CFT073
ucaaaguuaccggaagcgc

SEQ ID NO: 2656941 - RNA, 15 nt, Escherichia coli CFT073
ucaaaguuaguaaaa

SEQ ID NO: 2656942 - RNA, 22 nt, Escherichia coli CFT073
ucaaaguuaguaaaacuauugu

SEQ ID NO: 2656943 - RNA, 14 nt, Escherichia coli CFT073
ucaaaguucugcgu

SEQ ID NO: 2656944 - RNA, 13 nt, Escherichia coli CFT073
ucaaaguuuugug

SEQ ID NO: 2656945 - RNA, 18 nt, Escherichia coli CFT073
ucaaaguuuugugcuuug

SEQ ID NO: 2656946 - RNA, 21 nt, Escherichia coli CFT073
ucaaauaaauaaucucuuccg

SEQ ID NO: 2656947 - RNA, 16 nt, Escherichia coli CFT073
ucaaaucaacaaccug

SEQ ID NO: 2656948 - RNA, 16 nt, Escherichia coli CFT073
ucaaaucaccaaacug

SEQ ID NO: 2656949 - RNA, 23 nt, Escherichia coli CFT073
ucaaaucaccauauucagcagca

SEQ ID NO: 2656950 - RNA, 15 nt, Escherichia coli CFT073
ucaaaucauccugcg

SEQ ID NO: 2656951 - RNA, 16 nt, Escherichia coli CFT073
ucaaauccagccagcg

SEQ ID NO: 2656952 - RNA, 19 nt, Escherichia coli CFT073
ucaaaucugccguaacugc

SEQ ID NO: 2656953 - RNA, 20 nt, Escherichia coli CFT073
ucaaaucugccguaacugcg

SEQ ID NO: 2656954 - RNA, 18 nt, Escherichia coli CFT073
ucaaaucuucucacugcc

SEQ ID NO: 2656955 - RNA, 15 nt, Escherichia coli CFT073
ucaaaugcgccugca

SEQ ID NO: 2656956 - RNA, 16 nt, Escherichia coli CFT073
ucaaaugcgccugcau

SEQ ID NO: 2656957 - RNA, 17 nt, Escherichia coli CFT073
ucaaauucaaugacagu

SEQ ID NO: 2656958 - RNA, 13 nt, Escherichia coli CFT073
ucaaauuucauaa

SEQ ID NO: 2656959 - RNA, 16 nt, Escherichia coli CFT073
ucaaauuucuucagcc

SEQ ID NO: 2656960 - RNA, 23 nt, Escherichia coli CFT073
ucaaauuugucgccaacuucaug

SEQ ID NO: 2656961 - RNA, 23 nt, Escherichia coli CFT073
ucaacaaaaccacacuucuucag

SEQ ID NO: 2656962 - RNA, 11 nt, Escherichia coli CFT073
ucaacaaacca

SEQ ID NO: 2656963 - RNA, 13 nt, Escherichia coli CFT073
ucaacaaaccaaa

SEQ ID NO: 2656964 - RNA, 15 nt, Escherichia coli CFT073
ucaacaaacgccaga

SEQ ID NO: 2656965 - RNA, 23 nt, Escherichia coli CFT073
ucaacaaacguucauacgcaaug

SEQ ID NO: 2656966 - RNA, 19 nt, Escherichia coli CFT073
ucaacaacacucucugcag

SEQ ID NO: 2656967 - RNA, 18 nt, Escherichia coli CFT073
ucaacaacgaaaauuacc

SEQ ID NO: 2656968 - RNA, 15 nt, Escherichia coli CFT073
ucaacaagccacgca

SEQ ID NO: 2656969 - RNA, 17 nt, Escherichia coli CFT073
ucaacaauaaaaggugc

SEQ ID NO: 2656970 - RNA, 14 nt, Escherichia coli CFT073
ucaacaauaaacug

SEQ ID NO: 2656971 - RNA, 14 nt, Escherichia coli CFT073
ucaacaauucccag

SEQ ID NO: 2656972 - RNA, 21 nt, Escherichia coli CFT073
ucaacaauucguugauuuugu

SEQ ID NO: 2656973 - RNA, 16 nt, Escherichia coli CFT073
ucaacaauugaagaau

SEQ ID NO: 2656974 - RNA, 18 nt, Escherichia coli CFT073
ucaacaauuugccaggcu

SEQ ID NO: 2656975 - RNA, 15 nt, Escherichia coli CFT073
ucaacacaggccggc

SEQ ID NO: 2656976 - RNA, 15 nt, Escherichia coli CFT073
ucaacacaugcacau

SEQ ID NO: 2656977 - RNA, 19 nt, Escherichia coli CFT073
ucaacaccacgcgguagcg

SEQ ID NO: 2656978 - RNA, 17 nt, Escherichia coli CFT073
ucaacaccgacuucaau

SEQ ID NO: 2656979 - RNA, 17 nt, Escherichia coli CFT073
ucaacaccgaggcaauc

SEQ ID NO: 2656980 - RNA, 16 nt, Escherichia coli CFT073
ucaacaccgugacaaa

SEQ ID NO: 2656981 - RNA, 15 nt, Escherichia coli CFT073
ucaacagauuucgaa

SEQ ID NO: 2656982 - RNA, 15 nt, Escherichia coli CFT073
ucaacagauuuugca

SEQ ID NO: 2656983 - RNA, 17 nt, Escherichia coli CFT073
ucaacagccagaaggug

SEQ ID NO: 2656984 - RNA, 16 nt, Escherichia coli CFT073
ucaacagcguuucuuc

SEQ ID NO: 2656985 - RNA, 15 nt, Escherichia coli CFT073
ucaacaggcgcugau

SEQ ID NO: 2656986 - RNA, 18 nt, Escherichia coli CFT073
ucaacagggcagacauuc

SEQ ID NO: 2656987 - RNA, 21 nt, Escherichia coli CFT073
ucaacaguggcgacaagcaua

SEQ ID NO: 2656988 - RNA, 13 nt, Escherichia coli CFT073
ucaacaguucaug

SEQ ID NO: 2656989 - RNA, 20 nt, Escherichia coli CFT073
ucaacauaacgcaucccguu

SEQ ID NO: 2656990 - RNA, 16 nt, Escherichia coli CFT073
ucaacauacaaauagc

SEQ ID NO: 2656991 - RNA, 14 nt, Escherichia coli CFT073
ucaacauauuacga

SEQ ID NO: 2656992 - RNA, 13 nt, Escherichia coli CFT073
ucaacaucacacc

SEQ ID NO: 2656993 - RNA, 14 nt, Escherichia coli CFT073
ucaacaucacacca

SEQ ID NO: 2656994 - RNA, 17 nt, Escherichia coli CFT073
ucaacaucuucaccaau

SEQ ID NO: 2656995 - RNA, 20 nt, Escherichia coli CFT073
ucaacauguuccugccaguc

SEQ ID NO: 2656996 - RNA, 18 nt, Escherichia coli CFT073
ucaacauuaaagcagcuu

SEQ ID NO: 2656997 - RNA, 22 nt, Escherichia coli CFT073
ucaaccaccucaguacccgcgu

SEQ ID NO: 2656998 - RNA, 21 nt, Escherichia coli CFT073
ucaaccacgccaaccaucggu

SEQ ID NO: 2656999 - RNA, 12 nt, Escherichia coli CFT073
ucaaccacucac

SEQ ID NO: 2657000 - RNA, 20 nt, Escherichia coli CFT073
ucaaccagaucggacuucau

SEQ ID NO: 2657001 - RNA, 18 nt, Escherichia coli CFT073
ucaaccagcacaaagugg

SEQ ID NO: 2657002 - RNA, 11 nt, Escherichia coli CFT073
ucaaccagcag

SEQ ID NO: 2657003 - RNA, 15 nt, Escherichia coli CFT073
ucaaccagcggcgca

SEQ ID NO: 2657004 - RNA, 22 nt, Escherichia coli CFT073
ucaaccagcggcgcauccgcca

SEQ ID NO: 2657005 - RNA, 20 nt, Escherichia coli CFT073
ucaaccaggccuuccggguu

SEQ ID NO: 2657006 - RNA, 23 nt, Escherichia coli CFT073
ucaaccauaucgcauaccaucca

SEQ ID NO: 2657007 - RNA, 13 nt, Escherichia coli CFT073
ucaaccaugguuu

SEQ ID NO: 2657008 - RNA, 16 nt, Escherichia coli CFT073
ucaacccaaccugcca

SEQ ID NO: 2657009 - RNA, 19 nt, Escherichia coli CFT073
ucaacccaaccugccagag

SEQ ID NO: 2657010 - RNA, 20 nt, Escherichia coli CFT073
ucaacccagaaacaggcggc

SEQ ID NO: 2657011 - RNA, 23 nt, Escherichia coli CFT073
ucaacccagaaacaggcggcgcg

SEQ ID NO: 2657012 - RNA, 13 nt, Escherichia coli CFT073
ucaacccauuucg

SEQ ID NO: 2657013 - RNA, 18 nt, Escherichia coli CFT073
ucaacccccaccugcccg

SEQ ID NO: 2657014 - RNA, 17 nt, Escherichia coli CFT073
ucaaccgcaccaaaucc

SEQ ID NO: 2657015 - RNA, 17 nt, Escherichia coli CFT073
ucaaccgccggauagcu

SEQ ID NO: 2657016 - RNA, 18 nt, Escherichia coli CFT073
ucaaccgccggauagcua

SEQ ID NO: 2657017 - RNA, 15 nt, Escherichia coli CFT073
ucaaccgccugaauu

SEQ ID NO: 2657018 - RNA, 15 nt, Escherichia coli CFT073
ucaaccgcgccugac

SEQ ID NO: 2657019 - RNA, 19 nt, Escherichia coli CFT073
ucaaccgguggcaguagcg

SEQ ID NO: 2657020 - RNA, 21 nt, Escherichia coli CFT073
ucaaccgugagguaugaaaau

SEQ ID NO: 2657021 - RNA, 14 nt, Escherichia coli CFT073
ucaaccguuugauu

SEQ ID NO: 2657022 - RNA, 21 nt, Escherichia coli CFT073
ucaaccguuugauugaaaaac

SEQ ID NO: 2657023 - RNA, 20 nt, Escherichia coli CFT073
ucaaccugaucgugccagga

SEQ ID NO: 2657024 - RNA, 14 nt, Escherichia coli CFT073
ucaaccugcacuga

SEQ ID NO: 2657025 - RNA, 13 nt, Escherichia coli CFT073
ucaaccuucuucg

SEQ ID NO: 2657026 - RNA, 17 nt, Escherichia coli CFT073
ucaacgcacuggcgcgc

SEQ ID NO: 2657027 - RNA, 14 nt, Escherichia coli CFT073
ucaacgccaccauc

SEQ ID NO: 2657028 - RNA, 16 nt, Escherichia coli CFT073
ucaacgccaccaucac

SEQ ID NO: 2657029 - RNA, 17 nt, Escherichia coli CFT073
ucaacgcccauacucau

SEQ ID NO: 2657030 - RNA, 16 nt, Escherichia coli CFT073
ucaacgccgcacagcg

SEQ ID NO: 2657031 - RNA, 16 nt, Escherichia coli CFT073
ucaacgccgcgugcca

SEQ ID NO: 2657032 - RNA, 16 nt, Escherichia coli CFT073
ucaacgccgcuaucag

SEQ ID NO: 2657033 - RNA, 20 nt, Escherichia coli CFT073
ucaacgccgggccuguuaau

SEQ ID NO: 2657034 - RNA, 15 nt, Escherichia coli CFT073
ucaacgcgccgccaa

SEQ ID NO: 2657035 - RNA, 23 nt, Escherichia coli CFT073
ucaacgcucaggccgauuucaug

SEQ ID NO: 2657036 - RNA, 14 nt, Escherichia coli CFT073
ucaacgcugccaug

SEQ ID NO: 2657037 - RNA, 22 nt, Escherichia coli CFT073
ucaacggaccaauaaacgccag

SEQ ID NO: 2657038 - RNA, 19 nt, Escherichia coli CFT073
ucaacggauauuguuugcu

SEQ ID NO: 2657039 - RNA, 18 nt, Escherichia coli CFT073
ucaacggcgucagccaca

SEQ ID NO: 2657040 - RNA, 18 nt, Escherichia coli CFT073
ucaacguaguaucguaau

SEQ ID NO: 2657041 - RNA, 16 nt, Escherichia coli CFT073
ucaacgucugcgccuu

SEQ ID NO: 2657042 - RNA, 14 nt, Escherichia coli CFT073
ucaacguguauauc

SEQ ID NO: 2657043 - RNA, 18 nt, Escherichia coli CFT073
ucaacguuaggcggaaac

SEQ ID NO: 2657044 - RNA, 14 nt, Escherichia coli CFT073
ucaacguuauucgc

SEQ ID NO: 2657045 - RNA, 15 nt, Escherichia coli CFT073
ucaacguugaauuuc

SEQ ID NO: 2657046 - RNA, 20 nt, Escherichia coli CFT073
ucaauggcgcugcaaagcug

SEQ ID NO: 2657047 - RNA, 24 nt, Escherichia coli CFT073
ucaauggucuggcgacggcgaauc

SEQ ID NO: 2657048 - RNA, 16 nt, Escherichia coli CFT073
ucaaugguggcaaucu

SEQ ID NO: 2657049 - RNA, 16 nt, Escherichia coli CFT073
ucaaugguguuuucca

SEQ ID NO: 2657050 - RNA, 20 nt, Escherichia coli CFT073
ucaauuaaugccuucaaauc

SEQ ID NO: 2657051 - RNA, 20 nt, Escherichia coli CFT073
ucaauuacgcggcuucaacu

SEQ ID NO: 2657052 - RNA, 16 nt, Escherichia coli CFT073
ucaauuagaauuauua

SEQ ID NO: 2657053 - RNA, 17 nt, Escherichia coli CFT073
ucaauucagaaauaauc

SEQ ID NO: 2657054 - RNA, 14 nt, Escherichia coli CFT073
ucaauuccuggaac

SEQ ID NO: 2657055 - RNA, 13 nt, Escherichia coli CFT073
ucaauuccuucug

SEQ ID NO: 2657056 - RNA, 18 nt, Escherichia coli CFT073
ucaauuccuucugggcgc

SEQ ID NO: 2657057 - RNA, 18 nt, Escherichia coli CFT073
ucaauuccuuugcugcuc

SEQ ID NO: 2657058 - RNA, 20 nt, Escherichia coli CFT073
ucaauuccuuugcugcucua

SEQ ID NO: 2657059 - RNA, 13 nt, Escherichia coli CFT073
ucaauugaacucu

SEQ ID NO: 2657060 - RNA, 18 nt, Escherichia coli CFT073
ucaauugagacaacucau

SEQ ID NO: 2657061 - RNA, 22 nt, Escherichia coli CFT073
ucaauugaugcuuuuugcccuu

SEQ ID NO: 2657062 - RNA, 13 nt, Escherichia coli CFT073
ucaauugcaggaa

SEQ ID NO: 2657063 - RNA, 17 nt, Escherichia coli CFT073
ucaauugcgcaccagcu

SEQ ID NO: 2657064 - RNA, 20 nt, Escherichia coli CFT073
ucaauugcguuaaaaucagc

SEQ ID NO: 2657065 - RNA, 13 nt, Escherichia coli CFT073
ucaauuucuucag

SEQ ID NO: 2657066 - RNA, 15 nt, Escherichia coli CFT073
ucaauuugcaggcua

SEQ ID NO: 2657067 - RNA, 19 nt, Escherichia coli CFT073
ucaauuugcaggcuaaaaa

SEQ ID NO: 2657068 - RNA, 22 nt, Escherichia coli CFT073
ucaauuugcuccgccagugacu

SEQ ID NO: 2657069 - RNA, 18 nt, Escherichia coli CFT073
ucaauuuugaugauauca

SEQ ID NO: 2657070 - RNA, 14 nt, Escherichia coli CFT073
ucaauuuuucagga

SEQ ID NO: 2657071 - RNA, 13 nt, Escherichia coli CFT073
ucacaaaauaagu

SEQ ID NO: 2657072 - RNA, 17 nt, Escherichia coli CFT073
ucacaaaauagaaauuu

SEQ ID NO: 2657073 - RNA, 12 nt, Escherichia coli CFT073
ucacaaacauca

SEQ ID NO: 2657074 - RNA, 20 nt, Escherichia coli CFT073
ucacaaagacgccaucaauu

SEQ ID NO: 2657075 - RNA, 18 nt, Escherichia coli CFT073
ucacaaaucuuauagcga

SEQ ID NO: 2657076 - RNA, 18 nt, Escherichia coli CFT073
ucacaacauugauaagca

SEQ ID NO: 2657077 - RNA, 21 nt, Escherichia coli CFT073
ucacaaucaucgcauccagcg

SEQ ID NO: 2657078 - RNA, 20 nt, Escherichia coli CFT073
ucacaaugccgccaauaaug

SEQ ID NO: 2657079 - RNA, 16 nt, Escherichia coli CFT073
ucacaauguaaaucau

SEQ ID NO: 2657080 - RNA, 15 nt, Escherichia coli CFT073
ucacacaaauauacg

SEQ ID NO: 2657081 - RNA, 12 nt, Escherichia coli CFT073
ucacacacauca

SEQ ID NO: 2657082 - RNA, 13 nt, Escherichia coli CFT073
ucacacacaucaa

SEQ ID NO: 2657083 - RNA, 17 nt, Escherichia coli CFT073
ucacacagugaaucucu

SEQ ID NO: 2657084 - RNA, 17 nt, Escherichia coli CFT073
ucacaccacaacagcca

SEQ ID NO: 2657085 - RNA, 18 nt, Escherichia coli CFT073
ucacaccaucaacaaacg

SEQ ID NO: 2657086 - RNA, 22 nt, Escherichia coli CFT073
ucacaccauccagcaacaacag

SEQ ID NO: 2657087 - RNA, 12 nt, Escherichia coli CFT073
ucacaccaugcc

SEQ ID NO: 2657088 - RNA, 16 nt, Escherichia coli CFT073
ucacaccaugccagaa

SEQ ID NO: 2657089 - RNA, 17 nt, Escherichia coli CFT073
ucacaccgaccaccgca

SEQ ID NO: 2657090 - RNA, 15 nt, Escherichia coli CFT073
ucacacucugccagc

SEQ ID NO: 2657091 - RNA, 22 nt, Escherichia coli CFT073
ucacacugacgcgcagugccug

SEQ ID NO: 2657092 - RNA, 18 nt, Escherichia coli CFT073
ucacacugaugacaggcu

SEQ ID NO: 2657093 - RNA, 14 nt, Escherichia coli CFT073
ucacagaaaaaaca

SEQ ID NO: 2657094 - RNA, 21 nt, Escherichia coli CFT073
ucacagaaaaaacaaacggca

SEQ ID NO: 2657095 - RNA, 16 nt, Escherichia coli CFT073
ucacagaccaaaacuc

SEQ ID NO: 2657096 - RNA, 19 nt, Escherichia coli CFT073
ucacagaggucuuuucucg

SEQ ID NO: 2657097 - RNA, 21 nt, Escherichia coli CFT073
ucacagcuaaucaucaucagc

SEQ ID NO: 2657098 - RNA, 19 nt, Escherichia coli CFT073
ucacagcuauaccgccagg

SEQ ID NO: 2657099 - RNA, 20 nt, Escherichia coli CFT073
ucacaggauggcccaaaugg

SEQ ID NO: 2657100 - RNA, 16 nt, Escherichia coli CFT073
ucacaggcacaccgcc

SEQ ID NO: 2657101 - RNA, 12 nt, Escherichia coli CFT073
ucacaggccauc

SEQ ID NO: 2657102 - RNA, 20 nt, Escherichia coli CFT073
ucacaggucgcaaacggcga

SEQ ID NO: 2657103 - RNA, 15 nt, Escherichia coli CFT073
ucacagucugaauac

SEQ ID NO: 2657104 - RNA, 20 nt, Escherichia coli CFT073
ucacagucugaauaccgcua

SEQ ID NO: 2657105 - RNA, 17 nt, Escherichia coli CFT073
ucacauaacggcccggc

SEQ ID NO: 2657106 - RNA, 14 nt, Escherichia coli CFT073
ucacauaacugccu

SEQ ID NO: 2657107 - RNA, 18 nt, Escherichia coli CFT073
ucacauaaucgaaaacau

SEQ ID NO: 2657108 - RNA, 15 nt, Escherichia coli CFT073
ucacauagauaaagc

SEQ ID NO: 2657109 - RNA, 20 nt, Escherichia coli CFT073
ucacauagcccgguuuguua

SEQ ID NO: 2657110 - RNA, 14 nt, Escherichia coli CFT073
ucacauauucgccg

SEQ ID NO: 2657111 - RNA, 15 nt, Escherichia coli CFT073
ucacauauugcagcu

SEQ ID NO: 2657112 - RNA, 15 nt, Escherichia coli CFT073
ucacaucaaaucccc

SEQ ID NO: 2657113 - RNA, 19 nt, Escherichia coli CFT073
ucacaucaauuacaccauc

SEQ ID NO: 2657114 - RNA, 14 nt, Escherichia coli CFT073
ucacaucaccaaca

SEQ ID NO: 2657115 - RNA, 19 nt, Escherichia coli CFT073
ucacaucaccauaaaucag

SEQ ID NO: 2657116 - RNA, 18 nt, Escherichia coli CFT073
ucacaucagaacagcccc

SEQ ID NO: 2657117 - RNA, 14 nt, Escherichia coli CFT073
ucacaucagaacgu

SEQ ID NO: 2657118 - RNA, 14 nt, Escherichia coli CFT073
ucacaucagcgcau

SEQ ID NO: 2657119 - RNA, 23 nt, Escherichia coli CFT073
ucacaucagcgcauuuaccaggc

SEQ ID NO: 2657120 - RNA, 12 nt, Escherichia coli CFT073
ucacaucauaaa

SEQ ID NO: 2657121 - RNA, 18 nt, Escherichia coli CFT073
ucacauccaguacgccuu

SEQ ID NO: 2657122 - RNA, 16 nt, Escherichia coli CFT073
ucacaucccagcagag

SEQ ID NO: 2657123 - RNA, 12 nt, Escherichia coli CFT073
ucacauccugcc

SEQ ID NO: 2657124 - RNA, 10 nt, Escherichia coli CFT073
ucacaucgcu

SEQ ID NO: 2657125 - RNA, 19 nt, Escherichia coli CFT073
ucacaucguagacauaacc

SEQ ID NO: 2657126 - RNA, 23 nt, Escherichia coli CFT073
ucacaucguugauauuuguuuuu

SEQ ID NO: 2657127 - RNA, 16 nt, Escherichia coli CFT073
ucacaugauaauaaaa

SEQ ID NO: 2657128 - RNA, 18 nt, Escherichia coli CFT073
ucacaugauaauaaaaac

SEQ ID NO: 2657129 - RNA, 16 nt, Escherichia coli CFT073
ucacaugcggcgugcc

SEQ ID NO: 2657130 - RNA, 20 nt, Escherichia coli CFT073
ucacaugcggcgugccuuca

SEQ ID NO: 2657131 - RNA, 21 nt, Escherichia coli CFT073
ucacaugcuggaaccacagcg

SEQ ID NO: 2657132 - RNA, 22 nt, Escherichia coli CFT073
ucacauggagcacuaucaauga

SEQ ID NO: 2657133 - RNA, 17 nt, Escherichia coli CFT073
ucacauuguuaaagccc

SEQ ID NO: 2657134 - RNA, 21 nt, Escherichia coli CFT073
ucacauuguuaaagcccugcu

SEQ ID NO: 2657135 - RNA, 21 nt, Escherichia coli CFT073
ucacauuuuuaagccgcgcau

SEQ ID NO: 2657136 - RNA, 15 nt, Escherichia coli CFT073
ucaccaaacugcucg

SEQ ID NO: 2657137 - RNA, 18 nt, Escherichia coli CFT073
ucaccaaauuguuuugcu

SEQ ID NO: 2657138 - RNA, 13 nt, Escherichia coli CFT073
ucaccaacgauuu

SEQ ID NO: 2657139 - RNA, 21 nt, Escherichia coli CFT073
ucaccaacugcccgaacagca

SEQ ID NO: 2657140 - RNA, 20 nt, Escherichia coli CFT073
ucaccaacuuucacgcgcug

SEQ ID NO: 2657141 - RNA, 20 nt, Escherichia coli CFT073
ucaccaaggaagcuuucgca

SEQ ID NO: 2657142 - RNA, 21 nt, Escherichia coli CFT073
ucaccaaugauaaguuucacu

SEQ ID NO: 2657143 - RNA, 13 nt, Escherichia coli CFT073
ucaccaauuuuaa

SEQ ID NO: 2657144 - RNA, 15 nt, Escherichia coli CFT073
ucaccacaaaugcgc

SEQ ID NO: 2657145 - RNA, 11 nt, Escherichia coli CFT073
ucaccacaccg

SEQ ID NO: 2657146 - RNA, 22 nt, Escherichia coli CFT073
ucaccaccagcggaauaucaga

SEQ ID NO: 2657147 - RNA, 18 nt, Escherichia coli CFT073
ucaccaccaucaaaugcg

SEQ ID NO: 2657148 - RNA, 23 nt, Escherichia coli CFT073
ucaccaccgcaaagaaacgcgcg

SEQ ID NO: 2657149 - RNA, 16 nt, Escherichia coli CFT073
ucaccaccgugaccag

SEQ ID NO: 2657150 - RNA, 22 nt, Escherichia coli CFT073
ucaccacugacgggaaacucug

SEQ ID NO: 2657151 - RNA, 17 nt, Escherichia coli CFT073
ucaccagagauaaaauu

SEQ ID NO: 2657152 - RNA, 22 nt, Escherichia coli CFT073
ucaccagaucgccuaauuucac

SEQ ID NO: 2657153 - RNA, 13 nt, Escherichia coli CFT073
ucaccagcaaaac

SEQ ID NO: 2657154 - RNA, 16 nt, Escherichia coli CFT073
ucacgccgaccagacc

SEQ ID NO: 2657155 - RNA, 11 nt, Escherichia coli CFT073
ucacgccgcau

SEQ ID NO: 2657156 - RNA, 19 nt, Escherichia coli CFT073
ucacgccgcauccggcaua

SEQ ID NO: 2657157 - RNA, 18 nt, Escherichia coli CFT073
ucacgccgcauccggcca

SEQ ID NO: 2657158 - RNA, 15 nt, Escherichia coli CFT073
ucacgccgcaucugg

SEQ ID NO: 2657159 - RNA, 12 nt, Escherichia coli CFT073
ucacgccgccaa

SEQ ID NO: 2657160 - RNA, 19 nt, Escherichia coli CFT073
ucacgcgcgguauuuucaa

SEQ ID NO: 2657161 - RNA, 17 nt, Escherichia coli CFT073
ucacgcucgcaggcggc

SEQ ID NO: 2657162 - RNA, 23 nt, Escherichia coli CFT073
ucacgcuggcaucaaucgcuccc

SEQ ID NO: 2657163 - RNA, 19 nt, Escherichia coli CFT073
ucacggaaucccguaaucc

SEQ ID NO: 2657164 - RNA, 19 nt, Escherichia coli CFT073
ucacggaucaguuuaucca

SEQ ID NO: 2657165 - RNA, 13 nt, Escherichia coli CFT073
ucacggcaccagc

SEQ ID NO: 2657166 - RNA, 14 nt, Escherichia coli CFT073
ucacggcaccagcc

SEQ ID NO: 2657167 - RNA, 17 nt, Escherichia coli CFT073
ucacggcagccugacgc

SEQ ID NO: 2657168 - RNA, 18 nt, Escherichia coli CFT073
ucacggcugcuaauauuu

SEQ ID NO: 2657169 - RNA, 18 nt, Escherichia coli CFT073
ucacggcuguagccagcu

SEQ ID NO: 2657170 - RNA, 18 nt, Escherichia coli CFT073
ucacgggcaaccacagug

SEQ ID NO: 2657171 - RNA, 22 nt, Escherichia coli CFT073
ucacgggcggcggcuuucaggg

SEQ ID NO: 2657172 - RNA, 16 nt, Escherichia coli CFT073
ucacgucaccgcagca

SEQ ID NO: 2657173 - RNA, 19 nt, Escherichia coli CFT073
ucacgucaccgcagcaucg

SEQ ID NO: 2657174 - RNA, 21 nt, Escherichia coli CFT073
ucacgucagggucgugcggca

SEQ ID NO: 2657175 - RNA, 15 nt, Escherichia coli CFT073
ucacgucucaucagg

SEQ ID NO: 2657176 - RNA, 14 nt, Escherichia coli CFT073
ucacguugauggua

SEQ ID NO: 2657177 - RNA, 18 nt, Escherichia coli CFT073
ucacguugcgacaaacca

SEQ ID NO: 2657178 - RNA, 17 nt, Escherichia coli CFT073
ucacguuuuucauccag

SEQ ID NO: 2657179 - RNA, 19 nt, Escherichia coli CFT073
ucacuaaacccgaccacuu

SEQ ID NO: 2657180 - RNA, 21 nt, Escherichia coli CFT073
ucacuaaacccgaccacuucc

SEQ ID NO: 2657181 - RNA, 20 nt, Escherichia coli CFT073
ucacuacaaucaggccaauc

SEQ ID NO: 2657182 - RNA, 23 nt, Escherichia coli CFT073
ucacuacacgaccaugggcaauu

SEQ ID NO: 2657183 - RNA, 19 nt, Escherichia coli CFT073
ucacuaccaccuuuuuaau

SEQ ID NO: 2657184 - RNA, 23 nt, Escherichia coli CFT073
ucacuaccagcgccaccgguuua

SEQ ID NO: 2657185 - RNA, 18 nt, Escherichia coli CFT073
ucacuaccagugccagaa

SEQ ID NO: 2657186 - RNA, 23 nt, Escherichia coli CFT073
ucacuaccugauucgcaccacgu

SEQ ID NO: 2657187 - RNA, 18 nt, Escherichia coli CFT073
ucacuacggcucagcaau

SEQ ID NO: 2657188 - RNA, 22 nt, Escherichia coli CFT073
ucacuacggcucagcaauauag

SEQ ID NO: 2657189 - RNA, 16 nt, Escherichia coli CFT073
ucacuauacuccugau

SEQ ID NO: 2657190 - RNA, 22 nt, Escherichia coli CFT073
ucacuaucguuggcgaauaacc

SEQ ID NO: 2657191 - RNA, 12 nt, Escherichia coli CFT073
ucacuauuaaag

SEQ ID NO: 2657192 - RNA, 12 nt, Escherichia coli CFT073
ucacucaguguu

SEQ ID NO: 2657193 - RNA, 13 nt, Escherichia coli CFT073
ucacucaucagcu

SEQ ID NO: 2657194 - RNA, 14 nt, Escherichia coli CFT073
ucacucaucagcuu

SEQ ID NO: 2657195 - RNA, 17 nt, Escherichia coli CFT073
ucacucaucagcuuacg

SEQ ID NO: 2657196 - RNA, 18 nt, Escherichia coli CFT073
ucacucaucaugcacucc

SEQ ID NO: 2657197 - RNA, 21 nt, Escherichia coli CFT073
ucacuccauugucuuuucgcu

SEQ ID NO: 2657198 - RNA, 17 nt, Escherichia coli CFT073
ucacucggggcuuuucu

SEQ ID NO: 2657199 - RNA, 22 nt, Escherichia coli CFT073
ucacucgugauaaccuguuaau

SEQ ID NO: 2657200 - RNA, 16 nt, Escherichia coli CFT073
ucacucugaaaacgcu

SEQ ID NO: 2657201 - RNA, 23 nt, Escherichia coli CFT073
ucacucuuucccuccucaaauca

SEQ ID NO: 2657202 - RNA, 18 nt, Escherichia coli CFT073
ucacugaaacagauaaaa

SEQ ID NO: 2657203 - RNA, 19 nt, Escherichia coli CFT073
ucacugaaacagauaaaag

SEQ ID NO: 2657204 - RNA, 15 nt, Escherichia coli CFT073
ucacugacaccagca

SEQ ID NO: 2657205 - RNA, 14 nt, Escherichia coli CFT073
ucacugauuaacgu

SEQ ID NO: 2657206 - RNA, 13 nt, Escherichia coli CFT073
ucacugcaaauac

SEQ ID NO: 2657207 - RNA, 14 nt, Escherichia coli CFT073
ucacugccaccauc

SEQ ID NO: 2657208 - RNA, 15 nt, Escherichia coli CFT073
ucacugccaccaucc

SEQ ID NO: 2657209 - RNA, 21 nt, Escherichia coli CFT073
ucacugcgcucuaaaaucauc

SEQ ID NO: 2657210 - RNA, 22 nt, Escherichia coli CFT073
ucacuggaagacgcugauucac

SEQ ID NO: 2657211 - RNA, 22 nt, Escherichia coli CFT073
ucacuggccagcggcgaaaaau

SEQ ID NO: 2657212 - RNA, 17 nt, Escherichia coli CFT073
ucacuggccucuucucu

SEQ ID NO: 2657213 - RNA, 19 nt, Escherichia coli CFT073
ucacuggcgacacgcauca

SEQ ID NO: 2657214 - RNA, 20 nt, Escherichia coli CFT073
ucacuggcgacacgcaucac

SEQ ID NO: 2657215 - RNA, 17 nt, Escherichia coli CFT073
ucacuguaucaggugua

SEQ ID NO: 2657216 - RNA, 18 nt, Escherichia coli CFT073
ucacugucaucgacaaaa

SEQ ID NO: 2657217 - RNA, 22 nt, Escherichia coli CFT073
ucacuguggagcagcgguuucu

SEQ ID NO: 2657218 - RNA, 17 nt, Escherichia coli CFT073
ucacuuacgauuuuaau

SEQ ID NO: 2657219 - RNA, 18 nt, Escherichia coli CFT073
ucacuuacgauuuuaaua

SEQ ID NO: 2657220 - RNA, 20 nt, Escherichia coli CFT073
ucacuuacgauuuuaauagc

SEQ ID NO: 2657221 - RNA, 15 nt, Escherichia coli CFT073
ucacuucaaauuuaa

SEQ ID NO: 2657222 - RNA, 18 nt, Escherichia coli CFT073
ucacuucaaccacauuca

SEQ ID NO: 2657223 - RNA, 21 nt, Escherichia coli CFT073
ucacuucagcgaaaucacgca

SEQ ID NO: 2657224 - RNA, 14 nt, Escherichia coli CFT073
ucacuuccagcagu

SEQ ID NO: 2657225 - RNA, 18 nt, Escherichia coli CFT073
ucacuuccaguacgcgca

SEQ ID NO: 2657226 - RNA, 22 nt, Escherichia coli CFT073
ucacuuccgugguuugcgcauu

SEQ ID NO: 2657227 - RNA, 12 nt, Escherichia coli CFT073
ucacuuccucaa

SEQ ID NO: 2657228 - RNA, 17 nt, Escherichia coli CFT073
ucacuuccugauccgcu

SEQ ID NO: 2657229 - RNA, 17 nt, Escherichia coli CFT073
ucacuucgauccaguga

SEQ ID NO: 2657230 - RNA, 18 nt, Escherichia coli CFT073
ucacuucgauccagugau

SEQ ID NO: 2657231 - RNA, 18 nt, Escherichia coli CFT073
ucacuucgucagaaaugg

SEQ ID NO: 2657232 - RNA, 20 nt, Escherichia coli CFT073
ucacuucuguuugcgccacg

SEQ ID NO: 2657233 - RNA, 17 nt, Escherichia coli CFT073
ucacuugccugcuguga

SEQ ID NO: 2657234 - RNA, 18 nt, Escherichia coli CFT073
ucacuuguaguuacauuu

SEQ ID NO: 2657235 - RNA, 12 nt, Escherichia coli CFT073
ucacuuuaccuu

SEQ ID NO: 2657236 - RNA, 19 nt, Escherichia coli CFT073
ucacuuucagaugcaccug

SEQ ID NO: 2657237 - RNA, 15 nt, Escherichia coli CFT073
ucacuuuccaguuca

SEQ ID NO: 2657238 - RNA, 20 nt, Escherichia coli CFT073
ucacuuucccuggcaugauu

SEQ ID NO: 2657239 - RNA, 18 nt, Escherichia coli CFT073
ucacuuucgagcaauuuu

SEQ ID NO: 2657240 - RNA, 15 nt, Escherichia coli CFT073
ucacuuugauuuaua

SEQ ID NO: 2657241 - RNA, 13 nt, Escherichia coli CFT073
ucacuuugcgcuc

SEQ ID NO: 2657242 - RNA, 12 nt, Escherichia coli CFT073
ucacuuuguagg

SEQ ID NO: 2657243 - RNA, 21 nt, Escherichia coli CFT073
ucacuuuguaggccugauaag

SEQ ID NO: 2657244 - RNA, 15 nt, Escherichia coli CFT073
ucacuuuuauauaau

SEQ ID NO: 2657245 - RNA, 19 nt, Escherichia coli CFT073
ucacuuuuauauaaugaaa

SEQ ID NO: 2657246 - RNA, 14 nt, Escherichia coli CFT073
ucacuuuucuuaau

SEQ ID NO: 2657247 - RNA, 18 nt, Escherichia coli CFT073
ucacuuuucuuaauugca

SEQ ID NO: 2657248 - RNA, 12 nt, Escherichia coli CFT073
ucacuuuucuuc

SEQ ID NO: 2657249 - RNA, 13 nt, Escherichia coli CFT073
ucacuuuucuucu

SEQ ID NO: 2657250 - RNA, 13 nt, Escherichia coli CFT073
ucacuuuugccag

SEQ ID NO: 2657251 - RNA, 14 nt, Escherichia coli CFT073
ucacuuuugccaga

SEQ ID NO: 2657252 - RNA, 14 nt, Escherichia coli CFT073
ucagaaacaaauac

SEQ ID NO: 2657253 - RNA, 20 nt, Escherichia coli CFT073
ucagaaacaaauacaugaug

SEQ ID NO: 2657254 - RNA, 22 nt, Escherichia coli CFT073
ucagaaacgcucauaaauugca

SEQ ID NO: 2657255 - RNA, 20 nt, Escherichia coli CFT073
ucagaaagccgccgacaugu

SEQ ID NO: 2657256 - RNA, 16 nt, Escherichia coli CFT073
ucagaaagcgccagca

SEQ ID NO: 2657257 - RNA, 15 nt, Escherichia coli CFT073
ucagaaauuaaacug

SEQ ID NO: 2657258 - RNA, 13 nt, Escherichia coli CFT073
ucagaauacuggu

SEQ ID NO: 2657259 - RNA, 17 nt, Escherichia coli CFT073
ucagaaucacgccaaca

SEQ ID NO: 2657260 - RNA, 11 nt, Escherichia coli CFT073
ucagaaucaga

SEQ ID NO: 2657261 - RNA, 18 nt, Escherichia coli CFT073
ucagaauccggugccuua

SEQ ID NO: 2657262 - RNA, 22 nt, Escherichia coli CFT073
ucagcaugucuugccucccugc

SEQ ID NO: 2657263 - RNA, 23 nt, Escherichia coli CFT073
ucagcaugucuugccucccugca

SEQ ID NO: 2657264 - RNA, 17 nt, Escherichia coli CFT073
ucagccaaauccagcgc

SEQ ID NO: 2657265 - RNA, 13 nt, Escherichia coli CFT073
ucagccaaucaca

SEQ ID NO: 2657266 - RNA, 13 nt, Escherichia coli CFT073
ucagccacuuccu

SEQ ID NO: 2657267 - RNA, 23 nt, Escherichia coli CFT073
ucagccagacgcgucacgcacug

SEQ ID NO: 2657268 - RNA, 19 nt, Escherichia coli CFT073
ucagccagagaagcgacuu

SEQ ID NO: 2657269 - RNA, 19 nt, Escherichia coli CFT073
ucagccaggguucccggcc

SEQ ID NO: 2657270 - RNA, 10 nt, Escherichia coli CFT073
ucagccaguc

SEQ ID NO: 2657271 - RNA, 20 nt, Escherichia coli CFT073
ucagccagucauaauucaga

SEQ ID NO: 2657272 - RNA, 20 nt, Escherichia coli CFT073
ucagccaugguuuaaucgcc

SEQ ID NO: 2657273 - RNA, 14 nt, Escherichia coli CFT073
ucagccauuuugca

SEQ ID NO: 2657274 - RNA, 15 nt, Escherichia coli CFT073
ucagcccaaagagca

SEQ ID NO: 2657275 - RNA, 19 nt, Escherichia coli CFT073
ucagcccaaagagcaagaa

SEQ ID NO: 2657276 - RNA, 13 nt, Escherichia coli CFT073
ucagccccagcac

SEQ ID NO: 2657277 - RNA, 14 nt, Escherichia coli CFT073
ucagccccaucagc

SEQ ID NO: 2657278 - RNA, 15 nt, Escherichia coli CFT073
ucagccccaucagcg

SEQ ID NO: 2657279 - RNA, 20 nt, Escherichia coli CFT073
ucagcccuucccggugcgca

SEQ ID NO: 2657280 - RNA, 15 nt, Escherichia coli CFT073
ucagccgaaacacac

SEQ ID NO: 2657281 - RNA, 22 nt, Escherichia coli CFT073
ucagccgcccgcgauaaaaauc

SEQ ID NO: 2657282 - RNA, 17 nt, Escherichia coli CFT073
ucagccgcuuuaucuga

SEQ ID NO: 2657283 - RNA, 17 nt, Escherichia coli CFT073
ucagccguauccaggcc

SEQ ID NO: 2657284 - RNA, 17 nt, Escherichia coli CFT073
ucagccuuaaucuucac

SEQ ID NO: 2657285 - RNA, 15 nt, Escherichia coli CFT073
ucagcgaaaaagucc

SEQ ID NO: 2657286 - RNA, 15 nt, Escherichia coli CFT073
ucagcgaaaucacgc

SEQ ID NO: 2657287 - RNA, 16 nt, Escherichia coli CFT073
ucagcgaacaccagca

SEQ ID NO: 2657288 - RNA, 22 nt, Escherichia coli CFT073
ucagcgaacaccagcaguaaac

SEQ ID NO: 2657289 - RNA, 19 nt, Escherichia coli CFT073
ucagcgaguuuuucagucc

SEQ ID NO: 2657290 - RNA, 19 nt, Escherichia coli CFT073
ucagcgaucguuuuuaacc

SEQ ID NO: 2657291 - RNA, 14 nt, Escherichia coli CFT073
ucagcgcaaagaua

SEQ ID NO: 2657292 - RNA, 23 nt, Escherichia coli CFT073
ucagcgcaaagauaaugacuucc

SEQ ID NO: 2657293 - RNA, 16 nt, Escherichia coli CFT073
ucagcgcaccacacau

SEQ ID NO: 2657294 - RNA, 17 nt, Escherichia coli CFT073
ucagcgcaccacacauc

SEQ ID NO: 2657295 - RNA, 16 nt, Escherichia coli CFT073
ucagcgcagcacccag

SEQ ID NO: 2657296 - RNA, 16 nt, Escherichia coli CFT073
ucagcgcagcgcgagu

SEQ ID NO: 2657297 - RNA, 21 nt, Escherichia coli CFT073
ucagcgcaucguagauuucau

SEQ ID NO: 2657298 - RNA, 13 nt, Escherichia coli CFT073
ucagcgccaaccc

SEQ ID NO: 2657299 - RNA, 15 nt, Escherichia coli CFT073
ucagcgccacaucag

SEQ ID NO: 2657300 - RNA, 14 nt, Escherichia coli CFT073
ucagcgccaccaca

SEQ ID NO: 2657301 - RNA, 20 nt, Escherichia coli CFT073
ucagcgccacggaaacauuc

SEQ ID NO: 2657302 - RNA, 13 nt, Escherichia coli CFT073
ucagcgccagcgc

SEQ ID NO: 2657303 - RNA, 15 nt, Escherichia coli CFT073
ucagcgccagcgcga

SEQ ID NO: 2657304 - RNA, 18 nt, Escherichia coli CFT073
ucagcgccagcgcggaag

SEQ ID NO: 2657305 - RNA, 16 nt, Escherichia coli CFT073
ucagcgccaucgccag

SEQ ID NO: 2657306 - RNA, 15 nt, Escherichia coli CFT073
ucagcgccugcugca

SEQ ID NO: 2657307 - RNA, 16 nt, Escherichia coli CFT073
ucagcgcuaccagagc

SEQ ID NO: 2657308 - RNA, 20 nt, Escherichia coli CFT073
ucagcggcacuguuucgcca

SEQ ID NO: 2657309 - RNA, 22 nt, Escherichia coli CFT073
ucagcggcacuguuucgccagg

SEQ ID NO: 2657310 - RNA, 12 nt, Escherichia coli CFT073
ucagcggcagcu

SEQ ID NO: 2657311 - RNA, 16 nt, Escherichia coli CFT073
ucagcggccaguuucg

SEQ ID NO: 2657312 - RNA, 23 nt, Escherichia coli CFT073
ucagcggcggcgcaaccaucagu

SEQ ID NO: 2657313 - RNA, 13 nt, Escherichia coli CFT073
ucagcggcuguuc

SEQ ID NO: 2657314 - RNA, 16 nt, Escherichia coli CFT073
ucagcggugucugcca

SEQ ID NO: 2657315 - RNA, 18 nt, Escherichia coli CFT073
ucagcggugucugccagu

SEQ ID NO: 2657316 - RNA, 12 nt, Escherichia coli CFT073
ucagcgguuuug

SEQ ID NO: 2657317 - RNA, 14 nt, Escherichia coli CFT073
ucagcgguuuugcc

SEQ ID NO: 2657318 - RNA, 21 nt, Escherichia coli CFT073
ucagcguaaaaaaacaaaaac

SEQ ID NO: 2657319 - RNA, 14 nt, Escherichia coli CFT073
ucagcguaacgaug

SEQ ID NO: 2657320 - RNA, 20 nt, Escherichia coli CFT073
ucagcguaauggaaggcuug

SEQ ID NO: 2657321 - RNA, 15 nt, Escherichia coli CFT073
ucagcguauccagca

SEQ ID NO: 2657322 - RNA, 23 nt, Escherichia coli CFT073
ucagcguauccauuaccgccauc

SEQ ID NO: 2657323 - RNA, 15 nt, Escherichia coli CFT073
ucagcguaucccagu

SEQ ID NO: 2657324 - RNA, 16 nt, Escherichia coli CFT073
ucagcguaugcagcca

SEQ ID NO: 2657325 - RNA, 23 nt, Escherichia coli CFT073
ucagcguaugcagccaggccauu

SEQ ID NO: 2657326 - RNA, 20 nt, Escherichia coli CFT073
ucagcgucgcaucuggcaua

SEQ ID NO: 2657327 - RNA, 22 nt, Escherichia coli CFT073
ucagcgucgccaauggaauagc

SEQ ID NO: 2657328 - RNA, 18 nt, Escherichia coli CFT073
ucagcgucgcguuuuucu

SEQ ID NO: 2657329 - RNA, 15 nt, Escherichia coli CFT073
ucagcgucgggaagc

SEQ ID NO: 2657330 - RNA, 16 nt, Escherichia coli CFT073
ucagcgugaggguuuc

SEQ ID NO: 2657331 - RNA, 12 nt, Escherichia coli CFT073
ucagcguggcga

SEQ ID NO: 2657332 - RNA, 18 nt, Escherichia coli CFT073
ucagcguuauagcgcaug

SEQ ID NO: 2657333 - RNA, 19 nt, Escherichia coli CFT073
ucagcguuuucuucaauga

SEQ ID NO: 2657334 - RNA, 17 nt, Escherichia coli CFT073
ucagcuaauggcugcgg

SEQ ID NO: 2657335 - RNA, 15 nt, Escherichia coli CFT073
ucagcuccacaagaa

SEQ ID NO: 2657336 - RNA, 23 nt, Escherichia coli CFT073
ucagcuccacaagaaugccugcc

SEQ ID NO: 2657337 - RNA, 15 nt, Escherichia coli CFT073
ucagcugguaauggc

SEQ ID NO: 2657338 - RNA, 20 nt, Escherichia coli CFT073
ucagcuucagauugcaccac

SEQ ID NO: 2657339 - RNA, 23 nt, Escherichia coli CFT073
ucagcuugagguuggagaucccg

SEQ ID NO: 2657340 - RNA, 12 nt, Escherichia coli CFT073
ucagcuuucaga

SEQ ID NO: 2657341 - RNA, 18 nt, Escherichia coli CFT073
ucagcuuucgcaucagcu

SEQ ID NO: 2657342 - RNA, 14 nt, Escherichia coli CFT073
ucagcuuuuccaua

SEQ ID NO: 2657343 - RNA, 16 nt, Escherichia coli CFT073
ucaggaaauaaauaau

SEQ ID NO: 2657344 - RNA, 20 nt, Escherichia coli CFT073
ucaggaacagcgacagauuc

SEQ ID NO: 2657345 - RNA, 15 nt, Escherichia coli CFT073
ucaggaaccacaacc

SEQ ID NO: 2657346 - RNA, 22 nt, Escherichia coli CFT073
ucaggaaccacaaccacuuugu

SEQ ID NO: 2657347 - RNA, 16 nt, Escherichia coli CFT073
ucaggaacugcauacu

SEQ ID NO: 2657348 - RNA, 20 nt, Escherichia coli CFT073
ucaggaagaagcccaucagu

SEQ ID NO: 2657349 - RNA, 14 nt, Escherichia coli CFT073
ucaggaauaagaca

SEQ ID NO: 2657350 - RNA, 15 nt, Escherichia coli CFT073
ucaggaauggaaaua

SEQ ID NO: 2657351 - RNA, 18 nt, Escherichia coli CFT073
ucaggacgaauacaagaa

SEQ ID NO: 2657352 - RNA, 18 nt, Escherichia coli CFT073
ucaggauaaacuccugca

SEQ ID NO: 2657353 - RNA, 17 nt, Escherichia coli CFT073
ucaggauauuuauauuu

SEQ ID NO: 2657354 - RNA, 21 nt, Escherichia coli CFT073
ucaggaucaccaauaccagca

SEQ ID NO: 2657355 - RNA, 20 nt, Escherichia coli CFT073
ucaggauuaaacuggcacgc

SEQ ID NO: 2657356 - RNA, 20 nt, Escherichia coli CFT073
ucaggcaaacagaauuauca

SEQ ID NO: 2657357 - RNA, 17 nt, Escherichia coli CFT073
ucaggcaacaaaaaacc

SEQ ID NO: 2657358 - RNA, 21 nt, Escherichia coli CFT073
ucaggcaacccgcacaaggcu

SEQ ID NO: 2657359 - RNA, 22 nt, Escherichia coli CFT073
ucaggcaagccgcuaacagcag

SEQ ID NO: 2657360 - RNA, 19 nt, Escherichia coli CFT073
ucaggcacuucuuccgcca

SEQ ID NO: 2657361 - RNA, 22 nt, Escherichia coli CFT073
ucaggcacuucuuccgccagca

SEQ ID NO: 2657362 - RNA, 18 nt, Escherichia coli CFT073
ucaggcagaacaccggca

SEQ ID NO: 2657363 - RNA, 18 nt, Escherichia coli CFT073
ucaggcagauacaaccaa

SEQ ID NO: 2657364 - RNA, 22 nt, Escherichia coli CFT073
ucaggcagauacaaccaaucgc

SEQ ID NO: 2657365 - RNA, 22 nt, Escherichia coli CFT073
ucaggcauuauggcgcaguugc

SEQ ID NO: 2657366 - RNA, 20 nt, Escherichia coli CFT073
ucaggcauucucgaauuaau

SEQ ID NO: 2657367 - RNA, 15 nt, Escherichia coli CFT073
ucaggcauugugucu

SEQ ID NO: 2657368 - RNA, 17 nt, Escherichia coli CFT073
ucaggcauugugucuga

SEQ ID NO: 2657369 - RNA, 12 nt, Escherichia coli CFT073
ucaggccaccuc

SEQ ID NO: 2657370 - RNA, 14 nt, Escherichia coli CFT073
ucauauuuaagccu

SEQ ID NO: 2657371 - RNA, 18 nt, Escherichia coli CFT073
ucaucaaaaucaucauug

SEQ ID NO: 2657372 - RNA, 14 nt, Escherichia coli CFT073
ucaucaacccgcgc

SEQ ID NO: 2657373 - RNA, 21 nt, Escherichia coli CFT073
ucaucaacugacuauccugga

SEQ ID NO: 2657374 - RNA, 22 nt, Escherichia coli CFT073
ucaucaacugacuauccuggac

SEQ ID NO: 2657375 - RNA, 14 nt, Escherichia coli CFT073
ucaucaagcaaggc

SEQ ID NO: 2657376 - RNA, 21 nt, Escherichia coli CFT073
ucaucaaggcugauaacgucc

SEQ ID NO: 2657377 - RNA, 21 nt, Escherichia coli CFT073
ucaucaauacccgguccuuca

SEQ ID NO: 2657378 - RNA, 20 nt, Escherichia coli CFT073
ucaucaauggauucaugaua

SEQ ID NO: 2657379 - RNA, 17 nt, Escherichia coli CFT073
ucaucaauuaaugccuu

SEQ ID NO: 2657380 - RNA, 18 nt, Escherichia coli CFT073
ucaucacaucccagcaga

SEQ ID NO: 2657381 - RNA, 16 nt, Escherichia coli CFT073
ucaucaccaggccaua

SEQ ID NO: 2657382 - RNA, 21 nt, Escherichia coli CFT073
ucaucaccccgcgcucacacc

SEQ ID NO: 2657383 - RNA, 17 nt, Escherichia coli CFT073
ucaucacgcacugcaau

SEQ ID NO: 2657384 - RNA, 19 nt, Escherichia coli CFT073
ucaucacgcgguuacgcac

SEQ ID NO: 2657385 - RNA, 14 nt, Escherichia coli CFT073
ucaucacuugcucc

SEQ ID NO: 2657386 - RNA, 15 nt, Escherichia coli CFT073
ucaucacuugcuccc

SEQ ID NO: 2657387 - RNA, 18 nt, Escherichia coli CFT073
ucaucagcauaaucacca

SEQ ID NO: 2657388 - RNA, 13 nt, Escherichia coli CFT073
ucaucagcaucac

SEQ ID NO: 2657389 - RNA, 19 nt, Escherichia coli CFT073
ucaucagcggcgaagccua

SEQ ID NO: 2657390 - RNA, 18 nt, Escherichia coli CFT073
ucaucaggcuacgcagca

SEQ ID NO: 2657391 - RNA, 21 nt, Escherichia coli CFT073
ucaucagguugaggaacuucc

SEQ ID NO: 2657392 - RNA, 23 nt, Escherichia coli CFT073
ucaucagguuggaucaacaggca

SEQ ID NO: 2657393 - RNA, 19 nt, Escherichia coli CFT073
ucaucaguuccaguucauu

SEQ ID NO: 2657394 - RNA, 20 nt, Escherichia coli CFT073
ucaucauacugauaauaaau

SEQ ID NO: 2657395 - RNA, 16 nt, Escherichia coli CFT073
ucaucauauugucugc

SEQ ID NO: 2657396 - RNA, 12 nt, Escherichia coli CFT073
ucaucaucacga

SEQ ID NO: 2657397 - RNA, 13 nt, Escherichia coli CFT073
ucaucaucacgaa

SEQ ID NO: 2657398 - RNA, 17 nt, Escherichia coli CFT073
ucaucaucacuuuuucc

SEQ ID NO: 2657399 - RNA, 18 nt, Escherichia coli CFT073
ucaucaucacuuuuuccg

SEQ ID NO: 2657400 - RNA, 11 nt, Escherichia coli CFT073
ucaucaucagu

SEQ ID NO: 2657401 - RNA, 17 nt, Escherichia coli CFT073
ucaucaucgcagauuuc

SEQ ID NO: 2657402 - RNA, 21 nt, Escherichia coli CFT073
ucaucaucgcagauuucuucu

SEQ ID NO: 2657403 - RNA, 21 nt, Escherichia coli CFT073
ucaucaucggcaccgccagca

SEQ ID NO: 2657404 - RNA, 17 nt, Escherichia coli CFT073
ucaucaucggcugcgcu

SEQ ID NO: 2657405 - RNA, 19 nt, Escherichia coli CFT073
ucaucaugcacuccgcugu

SEQ ID NO: 2657406 - RNA, 19 nt, Escherichia coli CFT073
ucaucaugggcaagguauu

SEQ ID NO: 2657407 - RNA, 16 nt, Escherichia coli CFT073
ucaucauguggcugga

SEQ ID NO: 2657408 - RNA, 16 nt, Escherichia coli CFT073
ucaucauuaacugcug

SEQ ID NO: 2657409 - RNA, 20 nt, Escherichia coli CFT073
ucaucauugguuaacuccag

SEQ ID NO: 2657410 - RNA, 13 nt, Escherichia coli CFT073
ucauccagcagcg

SEQ ID NO: 2657411 - RNA, 21 nt, Escherichia coli CFT073
ucauccagcugccaggcaccg

SEQ ID NO: 2657412 - RNA, 16 nt, Escherichia coli CFT073
ucauccaggcacuggc

SEQ ID NO: 2657413 - RNA, 23 nt, Escherichia coli CFT073
ucauccaggcacuggccuuuuca

SEQ ID NO: 2657414 - RNA, 20 nt, Escherichia coli CFT073
ucauccaggcuuuaaacccg

SEQ ID NO: 2657415 - RNA, 16 nt, Escherichia coli CFT073
ucauccagggugagga

SEQ ID NO: 2657416 - RNA, 15 nt, Escherichia coli CFT073
ucauccagugccgcc

SEQ ID NO: 2657417 - RNA, 22 nt, Escherichia coli CFT073
ucaucccaguccucaucauccu

SEQ ID NO: 2657418 - RNA, 15 nt, Escherichia coli CFT073
ucauccccacaccug

SEQ ID NO: 2657419 - RNA, 23 nt, Escherichia coli CFT073
ucauccccaucgccgcacuauuu

SEQ ID NO: 2657420 - RNA, 22 nt, Escherichia coli CFT073
ucauccccgcgcggaacaugaa

SEQ ID NO: 2657421 - RNA, 16 nt, Escherichia coli CFT073
ucauccccucuuccau

SEQ ID NO: 2657422 - RNA, 16 nt, Escherichia coli CFT073
ucaucccuacagguaa

SEQ ID NO: 2657423 - RNA, 17 nt, Escherichia coli CFT073
ucaucccuuccugcccu

SEQ ID NO: 2657424 - RNA, 15 nt, Escherichia coli CFT073
ucauccgccaaaaca

SEQ ID NO: 2657425 - RNA, 18 nt, Escherichia coli CFT073
ucauccggcuuucuucug

SEQ ID NO: 2657426 - RNA, 16 nt, Escherichia coli CFT073
ucauccgguaacggac

SEQ ID NO: 2657427 - RNA, 20 nt, Escherichia coli CFT073
ucauccucuucaccgguacg

SEQ ID NO: 2657428 - RNA, 16 nt, Escherichia coli CFT073
ucauccugacaggccc

SEQ ID NO: 2657429 - RNA, 14 nt, Escherichia coli CFT073
ucauccugaugcuu

SEQ ID NO: 2657430 - RNA, 19 nt, Escherichia coli CFT073
ucauccugaugcuucagau

SEQ ID NO: 2657431 - RNA, 11 nt, Escherichia coli CFT073
ucauccugcca

SEQ ID NO: 2657432 - RNA, 22 nt, Escherichia coli CFT073
ucauccuguaugacaaaagaau

SEQ ID NO: 2657433 - RNA, 13 nt, Escherichia coli CFT073
ucauccuguucau

SEQ ID NO: 2657434 - RNA, 12 nt, Escherichia coli CFT073
ucauccuucagu

SEQ ID NO: 2657435 - RNA, 19 nt, Escherichia coli CFT073
ucaucgaacgggugauuuc

SEQ ID NO: 2657436 - RNA, 22 nt, Escherichia coli CFT073
ucaucgaacgggugauuucccc

SEQ ID NO: 2657437 - RNA, 13 nt, Escherichia coli CFT073
ucaucgaauaaau

SEQ ID NO: 2657438 - RNA, 19 nt, Escherichia coli CFT073
ucaucgaauaaauugagcu

SEQ ID NO: 2657439 - RNA, 16 nt, Escherichia coli CFT073
ucaucgacaguaccag

SEQ ID NO: 2657440 - RNA, 17 nt, Escherichia coli CFT073
ucaucgacaucaacgau

SEQ ID NO: 2657441 - RNA, 22 nt, Escherichia coli CFT073
ucaucgacaucaacgaugccuu

SEQ ID NO: 2657442 - RNA, 16 nt, Escherichia coli CFT073
ucaucgacgucagcag

SEQ ID NO: 2657443 - RNA, 17 nt, Escherichia coli CFT073
ucaucgacgucagcaga

SEQ ID NO: 2657444 - RNA, 14 nt, Escherichia coli CFT073
ucaucgagcagcau

SEQ ID NO: 2657445 - RNA, 14 nt, Escherichia coli CFT073
ucaucgaugcugcu

SEQ ID NO: 2657446 - RNA, 22 nt, Escherichia coli CFT073
ucaucgcaaaggacaucccggc

SEQ ID NO: 2657447 - RNA, 13 nt, Escherichia coli CFT073
ucaucgcaaauga

SEQ ID NO: 2657448 - RNA, 21 nt, Escherichia coli CFT073
ucaucgcaaugguucccggac

SEQ ID NO: 2657449 - RNA, 19 nt, Escherichia coli CFT073
ucaucgcagauuucuucug

SEQ ID NO: 2657450 - RNA, 15 nt, Escherichia coli CFT073
ucaucgcaucguaca

SEQ ID NO: 2657451 - RNA, 14 nt, Escherichia coli CFT073
ucaucgccaccgcg

SEQ ID NO: 2657452 - RNA, 16 nt, Escherichia coli CFT073
ucaucgcccacaucau

SEQ ID NO: 2657453 - RNA, 15 nt, Escherichia coli CFT073
ucaucgcccaggcaa

SEQ ID NO: 2657454 - RNA, 20 nt, Escherichia coli CFT073
ucaucgccccgcucacgcag

SEQ ID NO: 2657455 - RNA, 18 nt, Escherichia coli CFT073
ucaucgccgucacgguaa

SEQ ID NO: 2657456 - RNA, 15 nt, Escherichia coli CFT073
ucaucgccuuccagu

SEQ ID NO: 2657457 - RNA, 21 nt, Escherichia coli CFT073
ucaucgcuacaacaugaccuc

SEQ ID NO: 2657458 - RNA, 15 nt, Escherichia coli CFT073
ucaucgcuacaccaa

SEQ ID NO: 2657459 - RNA, 15 nt, Escherichia coli CFT073
ucaucgcugaauuuc

SEQ ID NO: 2657460 - RNA, 22 nt, Escherichia coli CFT073
ucaucgcugaauuucgccgcac

SEQ ID NO: 2657461 - RNA, 22 nt, Escherichia coli CFT073
ucaucgcugacaugugauuuga

SEQ ID NO: 2657462 - RNA, 14 nt, Escherichia coli CFT073
ucaucgcuuaaccc

SEQ ID NO: 2657463 - RNA, 17 nt, Escherichia coli CFT073
ucaucggaaugcacagc

SEQ ID NO: 2657464 - RNA, 19 nt, Escherichia coli CFT073
ucaucggaaugcacagccu

SEQ ID NO: 2657465 - RNA, 22 nt, Escherichia coli CFT073
ucaucggauaagguauagucac

SEQ ID NO: 2657466 - RNA, 16 nt, Escherichia coli CFT073
ucaucggaucauuagu

SEQ ID NO: 2657467 - RNA, 13 nt, Escherichia coli CFT073
ucaucggcaaagg

SEQ ID NO: 2657468 - RNA, 15 nt, Escherichia coli CFT073
ucaucggcagcaucg

SEQ ID NO: 2657469 - RNA, 19 nt, Escherichia coli CFT073
ucaucggcaucuucuucug

SEQ ID NO: 2657470 - RNA, 17 nt, Escherichia coli CFT073
ucaucggccacgcuuuc

SEQ ID NO: 2657471 - RNA, 21 nt, Escherichia coli CFT073
ucaucgggcaucgcaaccaca

SEQ ID NO: 2657472 - RNA, 23 nt, Escherichia coli CFT073
ucaucggguugcugauuuuguug

SEQ ID NO: 2657473 - RNA, 18 nt, Escherichia coli CFT073
ucaucggugguguaaccu

SEQ ID NO: 2657474 - RNA, 15 nt, Escherichia coli CFT073
ucaucguaccgauac

SEQ ID NO: 2657475 - RNA, 18 nt, Escherichia coli CFT073
ucaucguaguaguucauc

SEQ ID NO: 2657476 - RNA, 21 nt, Escherichia coli CFT073
ucaucguaguaguucaucccc

SEQ ID NO: 2657477 - RNA, 23 nt, Escherichia coli CFT073
ucaucguaguaguucauccccuc

SEQ ID NO: 2657478 - RNA, 16 nt, Escherichia coli CFT073
ucauuucauuuggaug

SEQ ID NO: 2657479 - RNA, 22 nt, Escherichia coli CFT073
ucauuucauuuggauggaaaau

SEQ ID NO: 2657480 - RNA, 17 nt, Escherichia coli CFT073
ucauuucgauauagccg

SEQ ID NO: 2657481 - RNA, 11 nt, Escherichia coli CFT073
ucauuucgucg

SEQ ID NO: 2657482 - RNA, 13 nt, Escherichia coli CFT073
ucauuucugcaau

SEQ ID NO: 2657483 - RNA, 24 nt, Escherichia coli CFT073
ucauuuuauugcguaaucuuuuca

SEQ ID NO: 2657484 - RNA, 14 nt, Escherichia coli CFT073
ucauuuucaauucu

SEQ ID NO: 2657485 - RNA, 16 nt, Escherichia coli CFT073
ucauuuucagggcaac

SEQ ID NO: 2657486 - RNA, 12 nt, Escherichia coli CFT073
ucauuuucucuu

SEQ ID NO: 2657487 - RNA, 19 nt, Escherichia coli CFT073
ucauuuucucuuuuagcgu

SEQ ID NO: 2657488 - RNA, 12 nt, Escherichia coli CFT073
ucauuuuguagg

SEQ ID NO: 2657489 - RNA, 17 nt, Escherichia coli CFT073
ucauuuuguaggccuga

SEQ ID NO: 2657490 - RNA, 21 nt, Escherichia coli CFT073
ucauuuuguaggccugauaag

SEQ ID NO: 2657491 - RNA, 16 nt, Escherichia coli CFT073
ucauuuuuaacagugu

SEQ ID NO: 2657492 - RNA, 18 nt, Escherichia coli CFT073
ucauuuuuagugaucacg

SEQ ID NO: 2657493 - RNA, 20 nt, Escherichia coli CFT073
ucauuuuuagugaucacgau

SEQ ID NO: 2657494 - RNA, 22 nt, Escherichia coli CFT073
ucauuuuucgcuaccagcaaag

SEQ ID NO: 2657495 - RNA, 19 nt, Escherichia coli CFT073
ucauuuuugccaucaauca

SEQ ID NO: 2657496 - RNA, 15 nt, Escherichia coli CFT073
ucauuuuuugcaaac

SEQ ID NO: 2657497 - RNA, 18 nt, Escherichia coli CFT073
uccaaaccgacugccugc

SEQ ID NO: 2657498 - RNA, 15 nt, Escherichia coli CFT073
uccaacaauaaaaag

SEQ ID NO: 2657499 - RNA, 21 nt, Escherichia coli CFT073
uccaacauagcuaaaaauaau

SEQ ID NO: 2657500 - RNA, 11 nt, Escherichia coli CFT073
uccaaccagcu

SEQ ID NO: 2657501 - RNA, 17 nt, Escherichia coli CFT073
uccaaccagcuguuccu

SEQ ID NO: 2657502 - RNA, 18 nt, Escherichia coli CFT073
uccaacgaaucuuuaacc

SEQ ID NO: 2657503 - RNA, 21 nt, Escherichia coli CFT073
uccaacuaaacguagcggaaa

SEQ ID NO: 2657504 - RNA, 16 nt, Escherichia coli CFT073
uccaacuccacgaucu

SEQ ID NO: 2657505 - RNA, 16 nt, Escherichia coli CFT073
uccaacucuuuuacca

SEQ ID NO: 2657506 - RNA, 21 nt, Escherichia coli CFT073
uccaacucuuuuaccaccgca

SEQ ID NO: 2657507 - RNA, 20 nt, Escherichia coli CFT073
uccaacuuuucccagcgcga

SEQ ID NO: 2657508 - RNA, 12 nt, Escherichia coli CFT073
uccaagaugggc

SEQ ID NO: 2657509 - RNA, 23 nt, Escherichia coli CFT073
uccaagaugggccagcacguugu

SEQ ID NO: 2657510 - RNA, 16 nt, Escherichia coli CFT073
uccaagcugguggcaa

SEQ ID NO: 2657511 - RNA, 13 nt, Escherichia coli CFT073
uccaauaaaaauc

SEQ ID NO: 2657512 - RNA, 17 nt, Escherichia coli CFT073
uccaauaaaaaucagau

SEQ ID NO: 2657513 - RNA, 19 nt, Escherichia coli CFT073
uccaaucaggcgaauaaau

SEQ ID NO: 2657514 - RNA, 20 nt, Escherichia coli CFT073
uccacaacccgugagucucc

SEQ ID NO: 2657515 - RNA, 15 nt, Escherichia coli CFT073
uccacaagaaugccu

SEQ ID NO: 2657516 - RNA, 17 nt, Escherichia coli CFT073
uccacaauaccaaucgc

SEQ ID NO: 2657517 - RNA, 20 nt, Escherichia coli CFT073
uccacaauaccaaucgcagg

SEQ ID NO: 2657518 - RNA, 23 nt, Escherichia coli CFT073
uccacaauggcauauuccgccac

SEQ ID NO: 2657519 - RNA, 15 nt, Escherichia coli CFT073
uccacaccacuucau

SEQ ID NO: 2657520 - RNA, 19 nt, Escherichia coli CFT073
uccacaccuacgcccgcca

SEQ ID NO: 2657521 - RNA, 21 nt, Escherichia coli CFT073
uccacaccuacgcccgccagu

SEQ ID NO: 2657522 - RNA, 18 nt, Escherichia coli CFT073
uccacaccuuuacugacu

SEQ ID NO: 2657523 - RNA, 13 nt, Escherichia coli CFT073
uccacacugagca

SEQ ID NO: 2657524 - RNA, 18 nt, Escherichia coli CFT073
uccacaguaagccgguaa

SEQ ID NO: 2657525 - RNA, 19 nt, Escherichia coli CFT073
uccacauuuuccaucacga

SEQ ID NO: 2657526 - RNA, 12 nt, Escherichia coli CFT073
uccaccacuucc

SEQ ID NO: 2657527 - RNA, 14 nt, Escherichia coli CFT073
uccaccagaacgac

SEQ ID NO: 2657528 - RNA, 16 nt, Escherichia coli CFT073
uccaccagauggcuuu

SEQ ID NO: 2657529 - RNA, 13 nt, Escherichia coli CFT073
uccaccagcacca

SEQ ID NO: 2657530 - RNA, 15 nt, Escherichia coli CFT073
uccaccagccccaga

SEQ ID NO: 2657531 - RNA, 20 nt, Escherichia coli CFT073
uccaccagccccagaacuca

SEQ ID NO: 2657532 - RNA, 14 nt, Escherichia coli CFT073
uccaccagcggcug

SEQ ID NO: 2657533 - RNA, 17 nt, Escherichia coli CFT073
uccaccaggaacucagc

SEQ ID NO: 2657534 - RNA, 10 nt, Escherichia coli CFT073
uccaccagug

SEQ ID NO: 2657535 - RNA, 13 nt, Escherichia coli CFT073
uccaccaucacgc

SEQ ID NO: 2657536 - RNA, 17 nt, Escherichia coli CFT073
uccacccgcagcaagcg

SEQ ID NO: 2657537 - RNA, 18 nt, Escherichia coli CFT073
uccacccuugauuaacga

SEQ ID NO: 2657538 - RNA, 22 nt, Escherichia coli CFT073
uccaccgcuacguucgcgagga

SEQ ID NO: 2657539 - RNA, 20 nt, Escherichia coli CFT073
uccaccguaagaucgcgcca

SEQ ID NO: 2657540 - RNA, 14 nt, Escherichia coli CFT073
uccaccguauccag

SEQ ID NO: 2657541 - RNA, 15 nt, Escherichia coli CFT073
uccaccgucaaaucc

SEQ ID NO: 2657542 - RNA, 18 nt, Escherichia coli CFT073
uccaccguuggcagauaa

SEQ ID NO: 2657543 - RNA, 20 nt, Escherichia coli CFT073
uccaccugaggggcaaaauc

SEQ ID NO: 2657544 - RNA, 15 nt, Escherichia coli CFT073
uccaccugcggcacc

SEQ ID NO: 2657545 - RNA, 15 nt, Escherichia coli CFT073
uccaccuggccugcg

SEQ ID NO: 2657546 - RNA, 18 nt, Escherichia coli CFT073
uccaccuucuguaacugg

SEQ ID NO: 2657547 - RNA, 17 nt, Escherichia coli CFT073
uccacgacagaacccgg

SEQ ID NO: 2657548 - RNA, 17 nt, Escherichia coli CFT073
uccacgcaucugcacaa

SEQ ID NO: 2657549 - RNA, 18 nt, Escherichia coli CFT073
uccacgccagcguuggua

SEQ ID NO: 2657550 - RNA, 21 nt, Escherichia coli CFT073
uccacgccgcugucuaccagc

SEQ ID NO: 2657551 - RNA, 22 nt, Escherichia coli CFT073
uccacgccguuuuuacccagca

SEQ ID NO: 2657552 - RNA, 17 nt, Escherichia coli CFT073
uccacgccuuuuuucac

SEQ ID NO: 2657553 - RNA, 17 nt, Escherichia coli CFT073
uccacgcgccacgcacg

SEQ ID NO: 2657554 - RNA, 19 nt, Escherichia coli CFT073
uccacgcggguaaguacgc

SEQ ID NO: 2657555 - RNA, 19 nt, Escherichia coli CFT073
uccacgcuauacagcagcc

SEQ ID NO: 2657556 - RNA, 22 nt, Escherichia coli CFT073
uccacgcuaugugcuucaucag

SEQ ID NO: 2657557 - RNA, 20 nt, Escherichia coli CFT073
uccacgcuuugauccgccag

SEQ ID NO: 2657558 - RNA, 21 nt, Escherichia coli CFT073
uccacgcuuugauccgccaga

SEQ ID NO: 2657559 - RNA, 20 nt, Escherichia coli CFT073
uccacggcugcggccaaaaa

SEQ ID NO: 2657560 - RNA, 19 nt, Escherichia coli CFT073
uccacggggacuccacacc

SEQ ID NO: 2657561 - RNA, 15 nt, Escherichia coli CFT073
uccacgguucuccac

SEQ ID NO: 2657562 - RNA, 18 nt, Escherichia coli CFT073
uccacgguucuccacucu

SEQ ID NO: 2657563 - RNA, 13 nt, Escherichia coli CFT073
uccacgucacagg

SEQ ID NO: 2657564 - RNA, 16 nt, Escherichia coli CFT073
uccacguuccagaucu

SEQ ID NO: 2657565 - RNA, 14 nt, Escherichia coli CFT073
uccacguuccccag

SEQ ID NO: 2657566 - RNA, 19 nt, Escherichia coli CFT073
uccacuaacccuucgccag

SEQ ID NO: 2657567 - RNA, 14 nt, Escherichia coli CFT073
uccacucacacagc

SEQ ID NO: 2657568 - RNA, 15 nt, Escherichia coli CFT073
uccacucacacagcu

SEQ ID NO: 2657569 - RNA, 21 nt, Escherichia coli CFT073
uccacuccagucuuuuaaccg

SEQ ID NO: 2657570 - RNA, 17 nt, Escherichia coli CFT073
uccacucugccaggcag

SEQ ID NO: 2657571 - RNA, 13 nt, Escherichia coli CFT073
uccacucuuucag

SEQ ID NO: 2657572 - RNA, 12 nt, Escherichia coli CFT073
uccacugcagaa

SEQ ID NO: 2657573 - RNA, 17 nt, Escherichia coli CFT073
uccacugcucaccgcaa

SEQ ID NO: 2657574 - RNA, 22 nt, Escherichia coli CFT073
uccacugggaguuuuucuacua

SEQ ID NO: 2657575 - RNA, 14 nt, Escherichia coli CFT073
uccacuuccaccac

SEQ ID NO: 2657576 - RNA, 16 nt, Escherichia coli CFT073
uccacuuccaccacuu

SEQ ID NO: 2657577 - RNA, 21 nt, Escherichia coli CFT073
uccacuuccgcgucaaucugc

SEQ ID NO: 2657578 - RNA, 13 nt, Escherichia coli CFT073
uccacuuccugcg

SEQ ID NO: 2657579 - RNA, 16 nt, Escherichia coli CFT073
uccacuuguccgucaa

SEQ ID NO: 2657580 - RNA, 23 nt, Escherichia coli CFT073
uccacuuugcuuucagauucagu

SEQ ID NO: 2657581 - RNA, 20 nt, Escherichia coli CFT073
uccagaaaaaaagcaucugc

SEQ ID NO: 2657582 - RNA, 16 nt, Escherichia coli CFT073
uccagaacugcgagau

SEQ ID NO: 2657583 - RNA, 18 nt, Escherichia coli CFT073
uccagaagcgguuugccg

SEQ ID NO: 2657584 - RNA, 14 nt, Escherichia coli CFT073
uccagaauauguuc

SEQ ID NO: 2657585 - RNA, 17 nt, Escherichia coli CFT073
uccagaauauguucgcu

SEQ ID NO: 2657586 - RNA, 19 nt, Escherichia coli CFT073
uccagaaugccucaaucag

SEQ ID NO: 2657587 - RNA, 23 nt, Escherichia coli CFT073
uccagugaaacgcgacuuaaacc

SEQ ID NO: 2657588 - RNA, 23 nt, Escherichia coli CFT073
uccagugacauacucucuccauu

SEQ ID NO: 2657589 - RNA, 13 nt, Escherichia coli CFT073
uccagugauuguc

SEQ ID NO: 2657590 - RNA, 12 nt, Escherichia coli CFT073
uccagugcacca

SEQ ID NO: 2657591 - RNA, 21 nt, Escherichia coli CFT073
uccagugccggaugauucaca

SEQ ID NO: 2657592 - RNA, 17 nt, Escherichia coli CFT073
uccaguuaacgccgcgc

SEQ ID NO: 2657593 - RNA, 19 nt, Escherichia coli CFT073
uccaguucaaucucuucac

SEQ ID NO: 2657594 - RNA, 16 nt, Escherichia coli CFT073
uccaguuccacuuugc

SEQ ID NO: 2657595 - RNA, 13 nt, Escherichia coli CFT073
uccaguuccaucc

SEQ ID NO: 2657596 - RNA, 17 nt, Escherichia coli CFT073
uccaguuccuucaagcc

SEQ ID NO: 2657597 - RNA, 20 nt, Escherichia coli CFT073
uccaguucuagugcuaccca

SEQ ID NO: 2657598 - RNA, 15 nt, Escherichia coli CFT073
uccaguugaagcugg

SEQ ID NO: 2657599 - RNA, 20 nt, Escherichia coli CFT073
uccaguugaagcuggcagaa

SEQ ID NO: 2657600 - RNA, 10 nt, Escherichia coli CFT073
uccaguugac

SEQ ID NO: 2657601 - RNA, 14 nt, Escherichia coli CFT073
uccaguugcauaca

SEQ ID NO: 2657602 - RNA, 22 nt, Escherichia coli CFT073
uccaguugcgccgcauugagau

SEQ ID NO: 2657603 - RNA, 18 nt, Escherichia coli CFT073
uccaguuguuuuugcaua

SEQ ID NO: 2657604 - RNA, 17 nt, Escherichia coli CFT073
uccaguuuauggaacaa

SEQ ID NO: 2657605 - RNA, 19 nt, Escherichia coli CFT073
uccaguuucacaggauggc

SEQ ID NO: 2657606 - RNA, 17 nt, Escherichia coli CFT073
uccaguuucgagaaauu

SEQ ID NO: 2657607 - RNA, 22 nt, Escherichia coli CFT073
uccaguuuucuuugccacuccu

SEQ ID NO: 2657608 - RNA, 13 nt, Escherichia coli CFT073
uccauaaauuaua

SEQ ID NO: 2657609 - RNA, 19 nt, Escherichia coli CFT073
uccauaaauuauagaugca

SEQ ID NO: 2657610 - RNA, 15 nt, Escherichia coli CFT073
uccauaagacggaac

SEQ ID NO: 2657611 - RNA, 15 nt, Escherichia coli CFT073
uccauaagauugcau

SEQ ID NO: 2657612 - RNA, 16 nt, Escherichia coli CFT073
uccauacgggcaugug

SEQ ID NO: 2657613 - RNA, 18 nt, Escherichia coli CFT073
uccauaguaacgcggcaa

SEQ ID NO: 2657614 - RNA, 20 nt, Escherichia coli CFT073
uccauagucacuaccuguuu

SEQ ID NO: 2657615 - RNA, 19 nt, Escherichia coli CFT073
uccauagugaagugauccg

SEQ ID NO: 2657616 - RNA, 23 nt, Escherichia coli CFT073
uccauaguguguuccucugcucc

SEQ ID NO: 2657617 - RNA, 16 nt, Escherichia coli CFT073
uccauauauaaaauca

SEQ ID NO: 2657618 - RNA, 12 nt, Escherichia coli CFT073
uccauauucagc

SEQ ID NO: 2657619 - RNA, 13 nt, Escherichia coli CFT073
uccauauucagcg

SEQ ID NO: 2657620 - RNA, 17 nt, Escherichia coli CFT073
uccauauuuggcauauu

SEQ ID NO: 2657621 - RNA, 19 nt, Escherichia coli CFT073
uccauauuuuuugaaaaau

SEQ ID NO: 2657622 - RNA, 16 nt, Escherichia coli CFT073
uccaucagauucagca

SEQ ID NO: 2657623 - RNA, 12 nt, Escherichia coli CFT073
uccaucagcguu

SEQ ID NO: 2657624 - RNA, 14 nt, Escherichia coli CFT073
uccauccaccagcc

SEQ ID NO: 2657625 - RNA, 18 nt, Escherichia coli CFT073
uccaucccgcucuguaag

SEQ ID NO: 2657626 - RNA, 19 nt, Escherichia coli CFT073
uccauccgggaucacauca

SEQ ID NO: 2657627 - RNA, 19 nt, Escherichia coli CFT073
uccauccgguacuuuccuu

SEQ ID NO: 2657628 - RNA, 20 nt, Escherichia coli CFT073
uccauccgguacuuuccuuc

SEQ ID NO: 2657629 - RNA, 13 nt, Escherichia coli CFT073
uccaucgcgguaa

SEQ ID NO: 2657630 - RNA, 17 nt, Escherichia coli CFT073
uccaucggcauuaaucu

SEQ ID NO: 2657631 - RNA, 20 nt, Escherichia coli CFT073
uccaucguugaauacauuca

SEQ ID NO: 2657632 - RNA, 17 nt, Escherichia coli CFT073
uccaucucgguuuucag

SEQ ID NO: 2657633 - RNA, 16 nt, Escherichia coli CFT073
uccaugaagcaaugau

SEQ ID NO: 2657634 - RNA, 19 nt, Escherichia coli CFT073
uccaugcacugcaacgccu

SEQ ID NO: 2657635 - RNA, 14 nt, Escherichia coli CFT073
uccaugccaucugc

SEQ ID NO: 2657636 - RNA, 18 nt, Escherichia coli CFT073
uccaugccuucauaauga

SEQ ID NO: 2657637 - RNA, 20 nt, Escherichia coli CFT073
uccaugccuucauaaugaau

SEQ ID NO: 2657638 - RNA, 21 nt, Escherichia coli CFT073
uccaugcugcgggcgaucaua

SEQ ID NO: 2657639 - RNA, 17 nt, Escherichia coli CFT073
uccauggaaucaccgcc

SEQ ID NO: 2657640 - RNA, 16 nt, Escherichia coli CFT073
uccaugugagucagau

SEQ ID NO: 2657641 - RNA, 18 nt, Escherichia coli CFT073
uccauguggcauugguau

SEQ ID NO: 2657642 - RNA, 17 nt, Escherichia coli CFT073
uccauuaaaacugauag

SEQ ID NO: 2657643 - RNA, 15 nt, Escherichia coli CFT073
uccauuaacccgaga

SEQ ID NO: 2657644 - RNA, 22 nt, Escherichia coli CFT073
uccauuacccgagaauuuugcu

SEQ ID NO: 2657645 - RNA, 18 nt, Escherichia coli CFT073
uccauucaaggacaaacc

SEQ ID NO: 2657646 - RNA, 21 nt, Escherichia coli CFT073
uccauucaucacgcacugcaa

SEQ ID NO: 2657647 - RNA, 16 nt, Escherichia coli CFT073
uccauucgcugcugcg

SEQ ID NO: 2657648 - RNA, 20 nt, Escherichia coli CFT073
uccauucgcugcugcggcga

SEQ ID NO: 2657649 - RNA, 15 nt, Escherichia coli CFT073
uccauucuccgcucu

SEQ ID NO: 2657650 - RNA, 22 nt, Escherichia coli CFT073
uccauugaaaucaaaaucaccg

SEQ ID NO: 2657651 - RNA, 15 nt, Escherichia coli CFT073
uccauugagaaaauc

SEQ ID NO: 2657652 - RNA, 22 nt, Escherichia coli CFT073
uccauugcaacuggcugccguu

SEQ ID NO: 2657653 - RNA, 19 nt, Escherichia coli CFT073
uccauugucuccagggcgg

SEQ ID NO: 2657654 - RNA, 18 nt, Escherichia coli CFT073
uccauugucuuuucgcuu

SEQ ID NO: 2657655 - RNA, 14 nt, Escherichia coli CFT073
uccauuguuagcaa

SEQ ID NO: 2657656 - RNA, 15 nt, Escherichia coli CFT073
uccauuuacccacag

SEQ ID NO: 2657657 - RNA, 15 nt, Escherichia coli CFT073
uccauuucauugagu

SEQ ID NO: 2657658 - RNA, 22 nt, Escherichia coli CFT073
ucccaaaagcucggucauugcc

SEQ ID NO: 2657659 - RNA, 12 nt, Escherichia coli CFT073
ucccaaagauca

SEQ ID NO: 2657660 - RNA, 21 nt, Escherichia coli CFT073
ucccaaauaugaaaucucuug

SEQ ID NO: 2657661 - RNA, 13 nt, Escherichia coli CFT073
ucccaacaacagc

SEQ ID NO: 2657662 - RNA, 21 nt, Escherichia coli CFT073
ucccaacgcaaaaccaagcug

SEQ ID NO: 2657663 - RNA, 15 nt, Escherichia coli CFT073
ucccaaugcggcgcu

SEQ ID NO: 2657664 - RNA, 19 nt, Escherichia coli CFT073
ucccacaauguucaaaugu

SEQ ID NO: 2657665 - RNA, 19 nt, Escherichia coli CFT073
ucccacaguuguccauuaa

SEQ ID NO: 2657666 - RNA, 18 nt, Escherichia coli CFT073
ucccacauauguuuaacc

SEQ ID NO: 2657667 - RNA, 23 nt, Escherichia coli CFT073
ucccacaugaauucgacuuucuc

SEQ ID NO: 2657668 - RNA, 16 nt, Escherichia coli CFT073
ucccaccugaaauggu

SEQ ID NO: 2657669 - RNA, 19 nt, Escherichia coli CFT073
ucccacgagagaaccagcc

SEQ ID NO: 2657670 - RNA, 16 nt, Escherichia coli CFT073
ucccacuuuucaguua

SEQ ID NO: 2657671 - RNA, 16 nt, Escherichia coli CFT073
ucccagagaaugaauu

SEQ ID NO: 2657672 - RNA, 17 nt, Escherichia coli CFT073
ucccagagcgggcagac

SEQ ID NO: 2657673 - RNA, 18 nt, Escherichia coli CFT073
ucccagauagcuguccca

SEQ ID NO: 2657674 - RNA, 15 nt, Escherichia coli CFT073
ucccagcaccgcaga

SEQ ID NO: 2657675 - RNA, 13 nt, Escherichia coli CFT073
ucccagcagagau

SEQ ID NO: 2657676 - RNA, 20 nt, Escherichia coli CFT073
ucccagcagagaucuuucac

SEQ ID NO: 2657677 - RNA, 15 nt, Escherichia coli CFT073
ucccagcccagcgcu

SEQ ID NO: 2657678 - RNA, 20 nt, Escherichia coli CFT073
ucccagccggguaagaaaag

SEQ ID NO: 2657679 - RNA, 19 nt, Escherichia coli CFT073
ucccagcgcaguucgucgu

SEQ ID NO: 2657680 - RNA, 12 nt, Escherichia coli CFT073
ucccagcgcauu

SEQ ID NO: 2657681 - RNA, 21 nt, Escherichia coli CFT073
ucccagcuuauuaacagucag

SEQ ID NO: 2657682 - RNA, 17 nt, Escherichia coli CFT073
ucccagcuuuugaccag

SEQ ID NO: 2657683 - RNA, 20 nt, Escherichia coli CFT073
ucccaggcaaaucccaucgg

SEQ ID NO: 2657684 - RNA, 20 nt, Escherichia coli CFT073
ucccaggcuacgccagaucc

SEQ ID NO: 2657685 - RNA, 17 nt, Escherichia coli CFT073
ucccaguagugcuuuca

SEQ ID NO: 2657686 - RNA, 18 nt, Escherichia coli CFT073
ucccagugaauuaaaaac

SEQ ID NO: 2657687 - RNA, 16 nt, Escherichia coli CFT073
ucccagugcagcaucg

SEQ ID NO: 2657688 - RNA, 23 nt, Escherichia coli CFT073
ucccauaaacccggauacgcuca

SEQ ID NO: 2657689 - RNA, 17 nt, Escherichia coli CFT073
ucccauaggaugagguu

SEQ ID NO: 2657690 - RNA, 19 nt, Escherichia coli CFT073
ucccaucuucugaaucaga

SEQ ID NO: 2657691 - RNA, 22 nt, Escherichia coli CFT073
ucccaucuucugaaucagauca

SEQ ID NO: 2657692 - RNA, 13 nt, Escherichia coli CFT073
ucccaugucagac

SEQ ID NO: 2657693 - RNA, 22 nt, Escherichia coli CFT073
ucccaugucagaccaaaacgcg

SEQ ID NO: 2657694 - RNA, 14 nt, Escherichia coli CFT073
ucccauuccacuca

SEQ ID NO: 2657695 - RNA, 17 nt, Escherichia coli CFT073
ucccuccaaccagauau

SEQ ID NO: 2657696 - RNA, 21 nt, Escherichia coli CFT073
ucccugaguuaauuaaauccu

SEQ ID NO: 2657697 - RNA, 15 nt, Escherichia coli CFT073
ucccugaucggccau

SEQ ID NO: 2657698 - RNA, 16 nt, Escherichia coli CFT073
ucccugcaacacccgg

SEQ ID NO: 2657699 - RNA, 19 nt, Escherichia coli CFT073
ucccugcagucaccugccc

SEQ ID NO: 2657700 - RNA, 16 nt, Escherichia coli CFT073
ucccugcauaaucagg

SEQ ID NO: 2657701 - RNA, 11 nt, Escherichia coli CFT073
ucccugcauau

SEQ ID NO: 2657702 - RNA, 16 nt, Escherichia coli CFT073
ucccugccuccaugaa

SEQ ID NO: 2657703 - RNA, 17 nt, Escherichia coli CFT073
ucccugcgcaaggcauu

SEQ ID NO: 2657704 - RNA, 13 nt, Escherichia coli CFT073
ucccuggcacugu

SEQ ID NO: 2657705 - RNA, 15 nt, Escherichia coli CFT073
ucccugguacagcag

SEQ ID NO: 2657706 - RNA, 16 nt, Escherichia coli CFT073
ucccugguacagcaga

SEQ ID NO: 2657707 - RNA, 19 nt, Escherichia coli CFT073
ucccuguaggucggauaag

SEQ ID NO: 2657708 - RNA, 15 nt, Escherichia coli CFT073
ucccuuacccuuacu

SEQ ID NO: 2657709 - RNA, 13 nt, Escherichia coli CFT073
ucccuucaauuau

SEQ ID NO: 2657710 - RNA, 13 nt, Escherichia coli CFT073
ucccuucccagcc

SEQ ID NO: 2657711 - RNA, 15 nt, Escherichia coli CFT073
ucccuucccagccgg

SEQ ID NO: 2657712 - RNA, 12 nt, Escherichia coli CFT073
ucccuuccgcca

SEQ ID NO: 2657713 - RNA, 22 nt, Escherichia coli CFT073
ucccuuccgcuuuuaacaucuu

SEQ ID NO: 2657714 - RNA, 14 nt, Escherichia coli CFT073
ucccuuccggugcg

SEQ ID NO: 2657715 - RNA, 14 nt, Escherichia coli CFT073
ucccuuccugcccu

SEQ ID NO: 2657716 - RNA, 21 nt, Escherichia coli CFT073
ucccuuccugcccuuuuaaua

SEQ ID NO: 2657717 - RNA, 17 nt, Escherichia coli CFT073
ucccuucgagcgggggg

SEQ ID NO: 2657718 - RNA, 18 nt, Escherichia coli CFT073
ucccuucgauauccagau

SEQ ID NO: 2657719 - RNA, 12 nt, Escherichia coli CFT073
ucccuucgccgc

SEQ ID NO: 2657720 - RNA, 22 nt, Escherichia coli CFT073
ucccuugcaguugauccaugcc

SEQ ID NO: 2657721 - RNA, 20 nt, Escherichia coli CFT073
ucccuugccugcaggaaauc

SEQ ID NO: 2657722 - RNA, 14 nt, Escherichia coli CFT073
ucccuugcugguca

SEQ ID NO: 2657723 - RNA, 22 nt, Escherichia coli CFT073
ucccuuucagcaaaccacugau

SEQ ID NO: 2657724 - RNA, 14 nt, Escherichia coli CFT073
ucccuuucagguca

SEQ ID NO: 2657725 - RNA, 14 nt, Escherichia coli CFT073
ucccuuucgauaag

SEQ ID NO: 2657726 - RNA, 20 nt, Escherichia coli CFT073
ucccuuucuuauuuuucucu

SEQ ID NO: 2657727 - RNA, 22 nt, Escherichia coli CFT073
ucccuuucuuauuuuucucuac

SEQ ID NO: 2657728 - RNA, 13 nt, Escherichia coli CFT073
ucccuuugccugc

SEQ ID NO: 2657729 - RNA, 20 nt, Escherichia coli CFT073
uccgaaauuacuggauaacc

SEQ ID NO: 2657730 - RNA, 21 nt, Escherichia coli CFT073
uccgaacgcugacaaacugcg

SEQ ID NO: 2657731 - RNA, 17 nt, Escherichia coli CFT073
uccgaaguucauccaua

SEQ ID NO: 2657732 - RNA, 21 nt, Escherichia coli CFT073
uccgaaguucauccauaccac

SEQ ID NO: 2657733 - RNA, 18 nt, Escherichia coli CFT073
uccgacaaauguguucag

SEQ ID NO: 2657734 - RNA, 22 nt, Escherichia coli CFT073
uccgacaaauguguucagcgac

SEQ ID NO: 2657735 - RNA, 12 nt, Escherichia coli CFT073
uccgacaccagc

SEQ ID NO: 2657736 - RNA, 18 nt, Escherichia coli CFT073
uccgacaucccgccagcc

SEQ ID NO: 2657737 - RNA, 20 nt, Escherichia coli CFT073
uccgacauuucugcugccua

SEQ ID NO: 2657738 - RNA, 14 nt, Escherichia coli CFT073
uccgaccaaagaau

SEQ ID NO: 2657739 - RNA, 21 nt, Escherichia coli CFT073
uccgaccgcccuuuuucuuau

SEQ ID NO: 2657740 - RNA, 17 nt, Escherichia coli CFT073
uccgacggcgagcguuc

SEQ ID NO: 2657741 - RNA, 15 nt, Escherichia coli CFT073
uccgacguuacgcgc

SEQ ID NO: 2657742 - RNA, 20 nt, Escherichia coli CFT073
uccgagaaucgacaccaguu

SEQ ID NO: 2657743 - RNA, 14 nt, Escherichia coli CFT073
uccgagcggcacca

SEQ ID NO: 2657744 - RNA, 15 nt, Escherichia coli CFT073
uccgagguuaauauu

SEQ ID NO: 2657745 - RNA, 18 nt, Escherichia coli CFT073
uccgaguagcucaccagc

SEQ ID NO: 2657746 - RNA, 19 nt, Escherichia coli CFT073
uccgaguagcucaccagca

SEQ ID NO: 2657747 - RNA, 13 nt, Escherichia coli CFT073
uccgaucccugcg

SEQ ID NO: 2657748 - RNA, 13 nt, Escherichia coli CFT073
uccgauccucacu

SEQ ID NO: 2657749 - RNA, 22 nt, Escherichia coli CFT073
uccgauuguuccugcucaucag

SEQ ID NO: 2657750 - RNA, 17 nt, Escherichia coli CFT073
uccgauuuguucucuuc

SEQ ID NO: 2657751 - RNA, 22 nt, Escherichia coli CFT073
uccgauuuguucucuucugcuu

SEQ ID NO: 2657752 - RNA, 20 nt, Escherichia coli CFT073
uccgcaauacaucaaagcgu

SEQ ID NO: 2657753 - RNA, 12 nt, Escherichia coli CFT073
uccgcaaucaaa

SEQ ID NO: 2657754 - RNA, 23 nt, Escherichia coli CFT073
uccgcaaucaaaugacugguuuu

SEQ ID NO: 2657755 - RNA, 14 nt, Escherichia coli CFT073
uccgcacagcaguu

SEQ ID NO: 2657756 - RNA, 18 nt, Escherichia coli CFT073
uccgcaccaacuccacuu

SEQ ID NO: 2657757 - RNA, 15 nt, Escherichia coli CFT073
uccgcaccgcgguac

SEQ ID NO: 2657758 - RNA, 20 nt, Escherichia coli CFT073
uccgcacuugaguaauuaau

SEQ ID NO: 2657759 - RNA, 21 nt, Escherichia coli CFT073
uccgcacuuucuccggcagcu

SEQ ID NO: 2657760 - RNA, 17 nt, Escherichia coli CFT073
uccgcaggggauggaug

SEQ ID NO: 2657761 - RNA, 23 nt, Escherichia coli CFT073
uccgcaggugacgcuggcagcag

SEQ ID NO: 2657762 - RNA, 14 nt, Escherichia coli CFT073
uccgcauuggcaua

SEQ ID NO: 2657763 - RNA, 20 nt, Escherichia coli CFT073
uccgccaaauggauaagaaa

SEQ ID NO: 2657764 - RNA, 14 nt, Escherichia coli CFT073
uccgccacacucuc

SEQ ID NO: 2657765 - RNA, 13 nt, Escherichia coli CFT073
uccgccaccugcg

SEQ ID NO: 2657766 - RNA, 18 nt, Escherichia coli CFT073
uccgccagaauacccgaa

SEQ ID NO: 2657767 - RNA, 23 nt, Escherichia coli CFT073
uccgccagaauccggugauugcu

SEQ ID NO: 2657768 - RNA, 19 nt, Escherichia coli CFT073
uccgccagacaauccagcg

SEQ ID NO: 2657769 - RNA, 15 nt, Escherichia coli CFT073
uccgccagaccaauc

SEQ ID NO: 2657770 - RNA, 13 nt, Escherichia coli CFT073
uccgccagcagcu

SEQ ID NO: 2657771 - RNA, 13 nt, Escherichia coli CFT073
uccgccagcgcca

SEQ ID NO: 2657772 - RNA, 13 nt, Escherichia coli CFT073
uccgccagcgccu

SEQ ID NO: 2657773 - RNA, 16 nt, Escherichia coli CFT073
uccgccaggacaucag

SEQ ID NO: 2657774 - RNA, 16 nt, Escherichia coli CFT073
uccgccaguuuguagc

SEQ ID NO: 2657775 - RNA, 18 nt, Escherichia coli CFT073
uccgccauucagauugau

SEQ ID NO: 2657776 - RNA, 14 nt, Escherichia coli CFT073
uccgcccacaccag

SEQ ID NO: 2657777 - RNA, 17 nt, Escherichia coli CFT073
uccgccgauggugcagc

SEQ ID NO: 2657778 - RNA, 22 nt, Escherichia coli CFT073
uccgccgcauauuccaccacuu

SEQ ID NO: 2657779 - RNA, 11 nt, Escherichia coli CFT073
uccgccgccag

SEQ ID NO: 2657780 - RNA, 17 nt, Escherichia coli CFT073
uccgcgauuaucccaua

SEQ ID NO: 2657781 - RNA, 16 nt, Escherichia coli CFT073
uccgcgcacaggcggc

SEQ ID NO: 2657782 - RNA, 20 nt, Escherichia coli CFT073
uccgcgcgaacagucagcac

SEQ ID NO: 2657783 - RNA, 13 nt, Escherichia coli CFT073
uccgcgcgcaccg

SEQ ID NO: 2657784 - RNA, 16 nt, Escherichia coli CFT073
uccgcguaguugcgcu

SEQ ID NO: 2657785 - RNA, 18 nt, Escherichia coli CFT073
uccgcgucauugacgcug

SEQ ID NO: 2657786 - RNA, 14 nt, Escherichia coli CFT073
uccgcgugacgcug

SEQ ID NO: 2657787 - RNA, 15 nt, Escherichia coli CFT073
uccgcgugacgcugg

SEQ ID NO: 2657788 - RNA, 13 nt, Escherichia coli CFT073
uccgcuaugugua

SEQ ID NO: 2657789 - RNA, 18 nt, Escherichia coli CFT073
uccgcuauguguaagaaa

SEQ ID NO: 2657790 - RNA, 19 nt, Escherichia coli CFT073
uccgcuauugaccagcgcc

SEQ ID NO: 2657791 - RNA, 20 nt, Escherichia coli CFT073
uccgcucaucaccgcaaagu

SEQ ID NO: 2657792 - RNA, 23 nt, Escherichia coli CFT073
uccgcucggucacugacaccagc

SEQ ID NO: 2657793 - RNA, 12 nt, Escherichia coli CFT073
uccgcucugccc

SEQ ID NO: 2657794 - RNA, 13 nt, Escherichia coli CFT073
uccgcucuuucac

SEQ ID NO: 2657795 - RNA, 11 nt, Escherichia coli CFT073
uccgcuggugc

SEQ ID NO: 2657796 - RNA, 20 nt, Escherichia coli CFT073
uccgcuguuauugucggcag

SEQ ID NO: 2657797 - RNA, 14 nt, Escherichia coli CFT073
uccgcuuaccuguu

SEQ ID NO: 2657798 - RNA, 15 nt, Escherichia coli CFT073
uccgcuuaccuguuu

SEQ ID NO: 2657799 - RNA, 20 nt, Escherichia coli CFT073
uccgcuuaucaggccuacaa

SEQ ID NO: 2657800 - RNA, 13 nt, Escherichia coli CFT073
uccgcuucaaucu

SEQ ID NO: 2657801 - RNA, 17 nt, Escherichia coli CFT073
uccgcuuuuaacaucuu

SEQ ID NO: 2657802 - RNA, 15 nt, Escherichia coli CFT073
uccggaaaagccugu

SEQ ID NO: 2657803 - RNA, 15 nt, Escherichia coli CFT073
uccggaaccaccaga

SEQ ID NO: 2657804 - RNA, 21 nt, Escherichia coli CFT073
uccucguuucgcccugccuuu

SEQ ID NO: 2657805 - RNA, 19 nt, Escherichia coli CFT073
uccucuaaaccccaaccac

SEQ ID NO: 2657806 - RNA, 18 nt, Escherichia coli CFT073
uccucuguaaacuccuuu

SEQ ID NO: 2657807 - RNA, 19 nt, Escherichia coli CFT073
uccugaaagcgaaccauag

SEQ ID NO: 2657808 - RNA, 15 nt, Escherichia coli CFT073
uccugaaauuccuga

SEQ ID NO: 2657809 - RNA, 16 nt, Escherichia coli CFT073
uccugaacagaaaucu

SEQ ID NO: 2657810 - RNA, 14 nt, Escherichia coli CFT073
uccugaacuuucuc

SEQ ID NO: 2657811 - RNA, 15 nt, Escherichia coli CFT073
uccugaacuuucucu

SEQ ID NO: 2657812 - RNA, 15 nt, Escherichia coli CFT073
uccugaagaugcugc

SEQ ID NO: 2657813 - RNA, 22 nt, Escherichia coli CFT073
uccugacggugauacagcaaaa

SEQ ID NO: 2657814 - RNA, 23 nt, Escherichia coli CFT073
uccugacggugauacagcaaaau

SEQ ID NO: 2657815 - RNA, 19 nt, Escherichia coli CFT073
uccugacuuaccuccuguc

SEQ ID NO: 2657816 - RNA, 15 nt, Escherichia coli CFT073
uccugagaggaugau

SEQ ID NO: 2657817 - RNA, 23 nt, Escherichia coli CFT073
uccugagcagcaaccacuugcag

SEQ ID NO: 2657818 - RNA, 16 nt, Escherichia coli CFT073
uccugagcucgugcau

SEQ ID NO: 2657819 - RNA, 22 nt, Escherichia coli CFT073
uccugaguuaaucgccgcauaa

SEQ ID NO: 2657820 - RNA, 19 nt, Escherichia coli CFT073
uccugauaaccuuccagcu

SEQ ID NO: 2657821 - RNA, 13 nt, Escherichia coli CFT073
uccugaucaagcu

SEQ ID NO: 2657822 - RNA, 17 nt, Escherichia coli CFT073
uccugauccugcaacaa

SEQ ID NO: 2657823 - RNA, 15 nt, Escherichia coli CFT073
uccugaugcuucaga

SEQ ID NO: 2657824 - RNA, 14 nt, Escherichia coli CFT073
uccugauggucggc

SEQ ID NO: 2657825 - RNA, 12 nt, Escherichia coli CFT073
uccugauuccag

SEQ ID NO: 2657826 - RNA, 14 nt, Escherichia coli CFT073
uccugcaaauucaa

SEQ ID NO: 2657827 - RNA, 16 nt, Escherichia coli CFT073
uccugcaacaacacca

SEQ ID NO: 2657828 - RNA, 14 nt, Escherichia coli CFT073
uccugcaagccaac

SEQ ID NO: 2657829 - RNA, 21 nt, Escherichia coli CFT073
uccugcacggucacaucgcug

SEQ ID NO: 2657830 - RNA, 15 nt, Escherichia coli CFT073
uccugcacuucaaau

SEQ ID NO: 2657831 - RNA, 20 nt, Escherichia coli CFT073
uccugcacuucaaauuucau

SEQ ID NO: 2657832 - RNA, 19 nt, Escherichia coli CFT073
uccugcagaaaauccagcg

SEQ ID NO: 2657833 - RNA, 20 nt, Escherichia coli CFT073
uccugcagaaaauccagcgu

SEQ ID NO: 2657834 - RNA, 22 nt, Escherichia coli CFT073
uccugcagaaaauccagcgucg

SEQ ID NO: 2657835 - RNA, 15 nt, Escherichia coli CFT073
uccugcagcguugcc

SEQ ID NO: 2657836 - RNA, 14 nt, Escherichia coli CFT073
uccugcauaccauu

SEQ ID NO: 2657837 - RNA, 16 nt, Escherichia coli CFT073
uccugcauuagccagg

SEQ ID NO: 2657838 - RNA, 19 nt, Escherichia coli CFT073
uccugcauuagccaggcac

SEQ ID NO: 2657839 - RNA, 20 nt, Escherichia coli CFT073
uccugcauugcuucccaugu

SEQ ID NO: 2657840 - RNA, 13 nt, Escherichia coli CFT073
uccugccagcguu

SEQ ID NO: 2657841 - RNA, 21 nt, Escherichia coli CFT073
uccugcccgacgacgucgcug

SEQ ID NO: 2657842 - RNA, 13 nt, Escherichia coli CFT073
uccugcgccagcc

SEQ ID NO: 2657843 - RNA, 15 nt, Escherichia coli CFT073
uccugcgccagcguu

SEQ ID NO: 2657844 - RNA, 14 nt, Escherichia coli CFT073
uccugcgcuuccag

SEQ ID NO: 2657845 - RNA, 18 nt, Escherichia coli CFT073
uccugcgcuuucugcuuc

SEQ ID NO: 2657846 - RNA, 23 nt, Escherichia coli CFT073
uccugcggcagacgcucgccauu

SEQ ID NO: 2657847 - RNA, 18 nt, Escherichia coli CFT073
uccugcggugcgguugau

SEQ ID NO: 2657848 - RNA, 22 nt, Escherichia coli CFT073
uccugcgguugaaacacagcgc

SEQ ID NO: 2657849 - RNA, 20 nt, Escherichia coli CFT073
uccugcgguuugucaucauu

SEQ ID NO: 2657850 - RNA, 15 nt, Escherichia coli CFT073
uccugcgucccuacu

SEQ ID NO: 2657851 - RNA, 15 nt, Escherichia coli CFT073
uccugcuacaccauu

SEQ ID NO: 2657852 - RNA, 18 nt, Escherichia coli CFT073
uccugcucaaguaauaaa

SEQ ID NO: 2657853 - RNA, 21 nt, Escherichia coli CFT073
uccugcuucaggugcgcaaua

SEQ ID NO: 2657854 - RNA, 19 nt, Escherichia coli CFT073
uccuggcgguugauaauga

SEQ ID NO: 2657855 - RNA, 20 nt, Escherichia coli CFT073
uccuggcgguugauaaugau

SEQ ID NO: 2657856 - RNA, 21 nt, Escherichia coli CFT073
uccuggcuggcgcuacugaag

SEQ ID NO: 2657857 - RNA, 21 nt, Escherichia coli CFT073
uccuggcuguuacucaacuga

SEQ ID NO: 2657858 - RNA, 17 nt, Escherichia coli CFT073
uccugggccagcaccau

SEQ ID NO: 2657859 - RNA, 18 nt, Escherichia coli CFT073
uccuggggauucaucacc

SEQ ID NO: 2657860 - RNA, 18 nt, Escherichia coli CFT073
uccuggggucaucagcau

SEQ ID NO: 2657861 - RNA, 15 nt, Escherichia coli CFT073
uccuggguauaaaac

SEQ ID NO: 2657862 - RNA, 15 nt, Escherichia coli CFT073
uccuggucaaagugg

SEQ ID NO: 2657863 - RNA, 20 nt, Escherichia coli CFT073
uccuggucacguaagcgccg

SEQ ID NO: 2657864 - RNA, 17 nt, Escherichia coli CFT073
uccuggucaggaaugga

SEQ ID NO: 2657865 - RNA, 13 nt, Escherichia coli CFT073
uccuggugaaagu

SEQ ID NO: 2657866 - RNA, 14 nt, Escherichia coli CFT073
uccuguaacgcagg

SEQ ID NO: 2657867 - RNA, 18 nt, Escherichia coli CFT073
uccuguaacgcaggaugu

SEQ ID NO: 2657868 - RNA, 20 nt, Escherichia coli CFT073
uccuguagauauucuuccag

SEQ ID NO: 2657869 - RNA, 17 nt, Escherichia coli CFT073
uccuguagcggaaaauc

SEQ ID NO: 2657870 - RNA, 21 nt, Escherichia coli CFT073
uccugucuaaccgccugccuu

SEQ ID NO: 2657871 - RNA, 20 nt, Escherichia coli CFT073
uccuguggacgcagcucaua

SEQ ID NO: 2657872 - RNA, 17 nt, Escherichia coli CFT073
uccuguuccauggugua

SEQ ID NO: 2657873 - RNA, 21 nt, Escherichia coli CFT073
uccuguuccggcagaaaccag

SEQ ID NO: 2657874 - RNA, 22 nt, Escherichia coli CFT073
uccuguugauguguugucagcg

SEQ ID NO: 2657875 - RNA, 17 nt, Escherichia coli CFT073
uccuguugcguuaagcc

SEQ ID NO: 2657876 - RNA, 17 nt, Escherichia coli CFT073
uccuguuuauggcguua

SEQ ID NO: 2657877 - RNA, 17 nt, Escherichia coli CFT073
uccuuaugcagcggaau

SEQ ID NO: 2657878 - RNA, 22 nt, Escherichia coli CFT073
uccuuaugcagcggaauaaucu

SEQ ID NO: 2657879 - RNA, 21 nt, Escherichia coli CFT073
uccuuaugcugcuuacauagu

SEQ ID NO: 2657880 - RNA, 19 nt, Escherichia coli CFT073
uccuuauugggugccagaa

SEQ ID NO: 2657881 - RNA, 13 nt, Escherichia coli CFT073
uccuucaacccgc

SEQ ID NO: 2657882 - RNA, 17 nt, Escherichia coli CFT073
uccuucacauccaucgc

SEQ ID NO: 2657883 - RNA, 12 nt, Escherichia coli CFT073
uccuuccagcuc

SEQ ID NO: 2657884 - RNA, 16 nt, Escherichia coli CFT073
uccuuccagcuccagc

SEQ ID NO: 2657885 - RNA, 16 nt, Escherichia coli CFT073
uccuucuccguguacg

SEQ ID NO: 2657886 - RNA, 23 nt, Escherichia coli CFT073
uccuucuugcucgaagaguucca

SEQ ID NO: 2657887 - RNA, 18 nt, Escherichia coli CFT073
uccuugcguacaccaaca

SEQ ID NO: 2657888 - RNA, 22 nt, Escherichia coli CFT073
uccuuuagaagcacuaccuugc

SEQ ID NO: 2657889 - RNA, 12 nt, Escherichia coli CFT073
uccuuuauaacu

SEQ ID NO: 2657890 - RNA, 17 nt, Escherichia coli CFT073
uccuuuccuuaagccag

SEQ ID NO: 2657891 - RNA, 21 nt, Escherichia coli CFT073
uccuuuguacaggauauauuu

SEQ ID NO: 2657892 - RNA, 12 nt, Escherichia coli CFT073
uccuuuguacca

SEQ ID NO: 2657893 - RNA, 23 nt, Escherichia coli CFT073
uccuuuucgcauguaacugccuu

SEQ ID NO: 2657894 - RNA, 24 nt, Escherichia coli CFT073
uccuuuucgcauguaacugccuuu

SEQ ID NO: 2657895 - RNA, 16 nt, Escherichia coli CFT073
uccuuuuggugccgga

SEQ ID NO: 2657896 - RNA, 15 nt, Escherichia coli CFT073
ucgaaaucaaaguac

SEQ ID NO: 2657897 - RNA, 17 nt, Escherichia coli CFT073
ucgaaaucaacauguuc

SEQ ID NO: 2657898 - RNA, 21 nt, Escherichia coli CFT073
ucgaaaucauucgcagcugca

SEQ ID NO: 2657899 - RNA, 17 nt, Escherichia coli CFT073
ucgaaccucggaaugcc

SEQ ID NO: 2657900 - RNA, 14 nt, Escherichia coli CFT073
ucgaacgccgccag

SEQ ID NO: 2657901 - RNA, 15 nt, Escherichia coli CFT073
ucgaacgccgccagu

SEQ ID NO: 2657902 - RNA, 22 nt, Escherichia coli CFT073
ucgaacgccgccaguacgcgcc

SEQ ID NO: 2657903 - RNA, 18 nt, Escherichia coli CFT073
ucgaacgguaacaggaaa

SEQ ID NO: 2657904 - RNA, 20 nt, Escherichia coli CFT073
ucgaacgguaacaggaaaca

SEQ ID NO: 2657905 - RNA, 23 nt, Escherichia coli CFT073
ucgaacguccagccggggaucag

SEQ ID NO: 2657906 - RNA, 12 nt, Escherichia coli CFT073
ucgaagaaaaac

SEQ ID NO: 2657907 - RNA, 21 nt, Escherichia coli CFT073
ucgaagacaucaucgugacca

SEQ ID NO: 2657908 - RNA, 12 nt, Escherichia coli CFT073
ucgaagccccau

SEQ ID NO: 2657909 - RNA, 19 nt, Escherichia coli CFT073
ucgaagccccauuuugaug

SEQ ID NO: 2657910 - RNA, 13 nt, Escherichia coli CFT073
ucgaaguuuuccu

SEQ ID NO: 2657911 - RNA, 14 nt, Escherichia coli CFT073
ucgaaguuuuccuc

SEQ ID NO: 2657912 - RNA, 19 nt, Escherichia coli CFT073
ucgauuuagaacugaucaa

SEQ ID NO: 2657913 - RNA, 21 nt, Escherichia coli CFT073
ucgauuuuauaaagggaugcc

SEQ ID NO: 2657914 - RNA, 18 nt, Escherichia coli CFT073
ucgauuuugcaauaaugg

SEQ ID NO: 2657915 - RNA, 23 nt, Escherichia coli CFT073
ucgauuuugcaauaauggaaccu

SEQ ID NO: 2657916 - RNA, 14 nt, Escherichia coli CFT073
ucgauuuuuuccag

SEQ ID NO: 2657917 - RNA, 16 nt, Escherichia coli CFT073
ucgcaaaacucaccuu

SEQ ID NO: 2657918 - RNA, 19 nt, Escherichia coli CFT073
ucgcaaacacccgacgugc

SEQ ID NO: 2657919 - RNA, 15 nt, Escherichia coli CFT073
ucgcaaauccacuca

SEQ ID NO: 2657920 - RNA, 12 nt, Escherichia coli CFT073
ucgcaaccagcc

SEQ ID NO: 2657921 - RNA, 16 nt, Escherichia coli CFT073
ucgcaacgcaucuuuu

SEQ ID NO: 2657922 - RNA, 20 nt, Escherichia coli CFT073
ucgcaagacgaaaaaugaau

SEQ ID NO: 2657923 - RNA, 21 nt, Escherichia coli CFT073
ucgcaauaaucaucucuccuu

SEQ ID NO: 2657924 - RNA, 20 nt, Escherichia coli CFT073
ucgcaauacccugacccaga

SEQ ID NO: 2657925 - RNA, 15 nt, Escherichia coli CFT073
ucgcaaucaccuuac

SEQ ID NO: 2657926 - RNA, 17 nt, Escherichia coli CFT073
ucgcaauucuucauucc

SEQ ID NO: 2657927 - RNA, 13 nt, Escherichia coli CFT073
ucgcacccgccau

SEQ ID NO: 2657928 - RNA, 21 nt, Escherichia coli CFT073
ucgcacgccacgccgaaccau

SEQ ID NO: 2657929 - RNA, 18 nt, Escherichia coli CFT073
ucgcacguugccagcaac

SEQ ID NO: 2657930 - RNA, 18 nt, Escherichia coli CFT073
ucgcacugguuugcaggc

SEQ ID NO: 2657931 - RNA, 21 nt, Escherichia coli CFT073
ucgcacuguguuggguucacu

SEQ ID NO: 2657932 - RNA, 21 nt, Escherichia coli CFT073
ucgcagaaauaccccgccagc

SEQ ID NO: 2657933 - RNA, 15 nt, Escherichia coli CFT073
ucgcagacaaggcga

SEQ ID NO: 2657934 - RNA, 22 nt, Escherichia coli CFT073
ucgcagagaucauacagaugcu

SEQ ID NO: 2657935 - RNA, 15 nt, Escherichia coli CFT073
ucgcagggacgcgca

SEQ ID NO: 2657936 - RNA, 22 nt, Escherichia coli CFT073
ucgcagggaucauccacccgca

SEQ ID NO: 2657937 - RNA, 15 nt, Escherichia coli CFT073
ucgcauaccauccag

SEQ ID NO: 2657938 - RNA, 16 nt, Escherichia coli CFT073
ucgcauaccauccagg

SEQ ID NO: 2657939 - RNA, 19 nt, Escherichia coli CFT073
ucgcauauuucaacgacgc

SEQ ID NO: 2657940 - RNA, 23 nt, Escherichia coli CFT073
ucgcaucaaaguuaauagucaag

SEQ ID NO: 2657941 - RNA, 17 nt, Escherichia coli CFT073
ucgcaucagacaccggc

SEQ ID NO: 2657942 - RNA, 19 nt, Escherichia coli CFT073
ucgcaucaggcaacccgca

SEQ ID NO: 2657943 - RNA, 20 nt, Escherichia coli CFT073
ucgcaucaggcaacccgcac

SEQ ID NO: 2657944 - RNA, 15 nt, Escherichia coli CFT073
ucgcaucaggcauua

SEQ ID NO: 2657945 - RNA, 21 nt, Escherichia coli CFT073
ucgcaucaggccuacaugcca

SEQ ID NO: 2657946 - RNA, 12 nt, Escherichia coli CFT073
ucgcaucauccg

SEQ ID NO: 2657947 - RNA, 14 nt, Escherichia coli CFT073
ucgcauccggcauc

SEQ ID NO: 2657948 - RNA, 16 nt, Escherichia coli CFT073
ucgcauccggcaucaa

SEQ ID NO: 2657949 - RNA, 19 nt, Escherichia coli CFT073
ucgcauccggcauuaucac

SEQ ID NO: 2657950 - RNA, 17 nt, Escherichia coli CFT073
ucgcaucuggcaccggu

SEQ ID NO: 2657951 - RNA, 16 nt, Escherichia coli CFT073
ucgcaucuggucagau

SEQ ID NO: 2657952 - RNA, 14 nt, Escherichia coli CFT073
ucgcaugccagcgc

SEQ ID NO: 2657953 - RNA, 15 nt, Escherichia coli CFT073
ucgcauuauccuuua

SEQ ID NO: 2657954 - RNA, 18 nt, Escherichia coli CFT073
ucgcauuuaaccgccgag

SEQ ID NO: 2657955 - RNA, 17 nt, Escherichia coli CFT073
ucgccaaauggcaggca

SEQ ID NO: 2657956 - RNA, 20 nt, Escherichia coli CFT073
ucgccaaaugucaccagccg

SEQ ID NO: 2657957 - RNA, 21 nt, Escherichia coli CFT073
ucgccaaauuuggugcucagu

SEQ ID NO: 2657958 - RNA, 16 nt, Escherichia coli CFT073
ucgccaacgccugcgg

SEQ ID NO: 2657959 - RNA, 19 nt, Escherichia coli CFT073
ucgccaagaagaacgccgg

SEQ ID NO: 2657960 - RNA, 23 nt, Escherichia coli CFT073
ucgccaaguucgaacgccgccag

SEQ ID NO: 2657961 - RNA, 16 nt, Escherichia coli CFT073
ucgccacauugcugca

SEQ ID NO: 2657962 - RNA, 19 nt, Escherichia coli CFT073
ucgccacauugcugcacau

SEQ ID NO: 2657963 - RNA, 22 nt, Escherichia coli CFT073
ucgccacauugcugcacauccg

SEQ ID NO: 2657964 - RNA, 20 nt, Escherichia coli CFT073
ucgccaccaacuuaucggga

SEQ ID NO: 2657965 - RNA, 13 nt, Escherichia coli CFT073
ucgccaccggcac

SEQ ID NO: 2657966 - RNA, 19 nt, Escherichia coli CFT073
ucgccacgccaagaaacug

SEQ ID NO: 2657967 - RNA, 20 nt, Escherichia coli CFT073
ucgccacgucguuccccauc

SEQ ID NO: 2657968 - RNA, 17 nt, Escherichia coli CFT073
ucgccacguugaagcgc

SEQ ID NO: 2657969 - RNA, 16 nt, Escherichia coli CFT073
ucgccacugcgccacg

SEQ ID NO: 2657970 - RNA, 14 nt, Escherichia coli CFT073
ucgccagaaaccau

SEQ ID NO: 2657971 - RNA, 17 nt, Escherichia coli CFT073
ucgccagaaaguaaauu

SEQ ID NO: 2657972 - RNA, 13 nt, Escherichia coli CFT073
ucgccagaaauca

SEQ ID NO: 2657973 - RNA, 21 nt, Escherichia coli CFT073
ucgccagacucaccagcaucg

SEQ ID NO: 2657974 - RNA, 15 nt, Escherichia coli CFT073
ucgccagagucagca

SEQ ID NO: 2657975 - RNA, 17 nt, Escherichia coli CFT073
ucgccagagucagcacg

SEQ ID NO: 2657976 - RNA, 14 nt, Escherichia coli CFT073
ucgccagcagccau

SEQ ID NO: 2657977 - RNA, 13 nt, Escherichia coli CFT073
ucgccagcagggc

SEQ ID NO: 2657978 - RNA, 13 nt, Escherichia coli CFT073
ucgccagcgcuuc

SEQ ID NO: 2657979 - RNA, 13 nt, Escherichia coli CFT073
ucgccagcggcag

SEQ ID NO: 2657980 - RNA, 15 nt, Escherichia coli CFT073
ucgccagcggcagcu

SEQ ID NO: 2657981 - RNA, 16 nt, Escherichia coli CFT073
ucgccagcuugcagcc

SEQ ID NO: 2657982 - RNA, 15 nt, Escherichia coli CFT073
ucgccaguaauccac

SEQ ID NO: 2657983 - RNA, 16 nt, Escherichia coli CFT073
ucgccaguaccagcag

SEQ ID NO: 2657984 - RNA, 22 nt, Escherichia coli CFT073
ucgccaguaccgucgucauguu

SEQ ID NO: 2657985 - RNA, 15 nt, Escherichia coli CFT073
ucgccagucccuuuc

SEQ ID NO: 2657986 - RNA, 16 nt, Escherichia coli CFT073
ucgccagucccuuuca

SEQ ID NO: 2657987 - RNA, 14 nt, Escherichia coli CFT073
ucgccaguccuuca

SEQ ID NO: 2657988 - RNA, 22 nt, Escherichia coli CFT073
ucgccagugacgaccuuuucca

SEQ ID NO: 2657989 - RNA, 21 nt, Escherichia coli CFT073
ucgccagugcguugugcgcca

SEQ ID NO: 2657990 - RNA, 17 nt, Escherichia coli CFT073
ucgccaguguucuuccg

SEQ ID NO: 2657991 - RNA, 15 nt, Escherichia coli CFT073
ucgccaguucaguca

SEQ ID NO: 2657992 - RNA, 17 nt, Escherichia coli CFT073
ucgccaguucagucagg

SEQ ID NO: 2657993 - RNA, 16 nt, Escherichia coli CFT073
ucgccauaaaacagca

SEQ ID NO: 2657994 - RNA, 18 nt, Escherichia coli CFT073
ucgccauaaacaccagca

SEQ ID NO: 2657995 - RNA, 15 nt, Escherichia coli CFT073
ucgccaucaaaucac

SEQ ID NO: 2657996 - RNA, 19 nt, Escherichia coli CFT073
ucgccaucaauaaccagcg

SEQ ID NO: 2657997 - RNA, 15 nt, Escherichia coli CFT073
ucgccaucacacccu

SEQ ID NO: 2657998 - RNA, 23 nt, Escherichia coli CFT073
ucgccaucguuaaaaaacagugc

SEQ ID NO: 2657999 - RNA, 23 nt, Escherichia coli CFT073
ucgccaucuucggcgaaaaucau

SEQ ID NO: 2658000 - RNA, 17 nt, Escherichia coli CFT073
ucgccaugaacgcgaag

SEQ ID NO: 2658001 - RNA, 19 nt, Escherichia coli CFT073
ucgccaugcgguaaguuuu

SEQ ID NO: 2658002 - RNA, 15 nt, Escherichia coli CFT073
ucgccauuaaacaac

SEQ ID NO: 2658003 - RNA, 23 nt, Escherichia coli CFT073
ucgccauuaacaacgucguuuuc

SEQ ID NO: 2658004 - RNA, 19 nt, Escherichia coli CFT073
ucgccauuaccaccaccuu

SEQ ID NO: 2658005 - RNA, 22 nt, Escherichia coli CFT073
ucgccauuccuggggucaucag

SEQ ID NO: 2658006 - RNA, 16 nt, Escherichia coli CFT073
ucgccauugcugguga

SEQ ID NO: 2658007 - RNA, 19 nt, Escherichia coli CFT073
ucgccauuuuucagacguu

SEQ ID NO: 2658008 - RNA, 17 nt, Escherichia coli CFT073
ucgcccacaccacgcca

SEQ ID NO: 2658009 - RNA, 16 nt, Escherichia coli CFT073
ucgcccacaccagaug

SEQ ID NO: 2658010 - RNA, 20 nt, Escherichia coli CFT073
ucgcccagccaucgacacca

SEQ ID NO: 2658011 - RNA, 22 nt, Escherichia coli CFT073
ucgcccaguugaugaccagugc

SEQ ID NO: 2658012 - RNA, 12 nt, Escherichia coli CFT073
ucgcccccucuc

SEQ ID NO: 2658013 - RNA, 20 nt, Escherichia coli CFT073
ucgccccggcaagaaauacc

SEQ ID NO: 2658014 - RNA, 14 nt, Escherichia coli CFT073
ucgccccggucauc

SEQ ID NO: 2658015 - RNA, 22 nt, Escherichia coli CFT073
ucgcccgaccaucgccagcuca

SEQ ID NO: 2658016 - RNA, 22 nt, Escherichia coli CFT073
ucgcccgcuggcgacggcuacg

SEQ ID NO: 2658017 - RNA, 14 nt, Escherichia coli CFT073
ucgcccggauuaca

SEQ ID NO: 2658018 - RNA, 15 nt, Escherichia coli CFT073
ucgcccguucauccg

SEQ ID NO: 2658019 - RNA, 16 nt, Escherichia coli CFT073
ucgcccguuucaauga

SEQ ID NO: 2658020 - RNA, 18 nt, Escherichia coli CFT073
ucgggugcgacaggagcc

SEQ ID NO: 2658021 - RNA, 17 nt, Escherichia coli CFT073
ucgggugguaugcccca

SEQ ID NO: 2658022 - RNA, 13 nt, Escherichia coli CFT073
ucggguuaccgga

SEQ ID NO: 2658023 - RNA, 20 nt, Escherichia coli CFT073
ucgguaaagaaaauaccgaa

SEQ ID NO: 2658024 - RNA, 16 nt, Escherichia coli CFT073
ucgguaaauugcccca

SEQ ID NO: 2658025 - RNA, 17 nt, Escherichia coli CFT073
ucgguacguacaaugga

SEQ ID NO: 2658026 - RNA, 22 nt, Escherichia coli CFT073
ucgguauagccguagcuggcaa

SEQ ID NO: 2658027 - RNA, 16 nt, Escherichia coli CFT073
ucgguaucaauaccag

SEQ ID NO: 2658028 - RNA, 11 nt, Escherichia coli CFT073
ucggucacagu

SEQ ID NO: 2658029 - RNA, 19 nt, Escherichia coli CFT073
ucggucacugacaccagca

SEQ ID NO: 2658030 - RNA, 14 nt, Escherichia coli CFT073
ucggucagcacgcg

SEQ ID NO: 2658031 - RNA, 13 nt, Escherichia coli CFT073
ucggucagcgcaa

SEQ ID NO: 2658032 - RNA, 17 nt, Escherichia coli CFT073
ucggucagcguaaugga

SEQ ID NO: 2658033 - RNA, 16 nt, Escherichia coli CFT073
ucggucaguaagaggc

SEQ ID NO: 2658034 - RNA, 22 nt, Escherichia coli CFT073
ucgguccgccacauaccacggc

SEQ ID NO: 2658035 - RNA, 12 nt, Escherichia coli CFT073
ucggugauaaau

SEQ ID NO: 2658036 - RNA, 16 nt, Escherichia coli CFT073
ucggugauauacgcca

SEQ ID NO: 2658037 - RNA, 16 nt, Escherichia coli CFT073
ucggugaucagcguca

SEQ ID NO: 2658038 - RNA, 15 nt, Escherichia coli CFT073
ucgguggugccgaca

SEQ ID NO: 2658039 - RNA, 17 nt, Escherichia coli CFT073
ucgguguagacagcauc

SEQ ID NO: 2658040 - RNA, 20 nt, Escherichia coli CFT073
ucggugucaucgacaucaac

SEQ ID NO: 2658041 - RNA, 16 nt, Escherichia coli CFT073
ucgguguccacuuccg

SEQ ID NO: 2658042 - RNA, 16 nt, Escherichia coli CFT073
ucgguguuaaaacgca

SEQ ID NO: 2658043 - RNA, 13 nt, Escherichia coli CFT073
ucgguuaacggca

SEQ ID NO: 2658044 - RNA, 16 nt, Escherichia coli CFT073
ucgguuacuauccuga

SEQ ID NO: 2658045 - RNA, 23 nt, Escherichia coli CFT073
ucgguuacuauccugaaagcuga

SEQ ID NO: 2658046 - RNA, 21 nt, Escherichia coli CFT073
ucgguucaaccaucagcguac

SEQ ID NO: 2658047 - RNA, 18 nt, Escherichia coli CFT073
ucgguuguuuuaauaucu

SEQ ID NO: 2658048 - RNA, 16 nt, Escherichia coli CFT073
ucgguuuugcgccauc

SEQ ID NO: 2658049 - RNA, 22 nt, Escherichia coli CFT073
ucguaacggcauuguucugcaa

SEQ ID NO: 2658050 - RNA, 23 nt, Escherichia coli CFT073
ucguaacggcauuguucugcaaa

SEQ ID NO: 2658051 - RNA, 16 nt, Escherichia coli CFT073
ucguaacggccaggcg

SEQ ID NO: 2658052 - RNA, 14 nt, Escherichia coli CFT073
ucguaagccugaua

SEQ ID NO: 2658053 - RNA, 12 nt, Escherichia coli CFT073
ucguaauacccu

SEQ ID NO: 2658054 - RNA, 18 nt, Escherichia coli CFT073
ucguaaucucuuuccauu

SEQ ID NO: 2658055 - RNA, 15 nt, Escherichia coli CFT073
ucguaaugaauguuu

SEQ ID NO: 2658056 - RNA, 14 nt, Escherichia coli CFT073
ucguaauuuuucgg

SEQ ID NO: 2658057 - RNA, 20 nt, Escherichia coli CFT073
ucguacagucacccgcugcg

SEQ ID NO: 2658058 - RNA, 13 nt, Escherichia coli CFT073
ucguaccagcgaa

SEQ ID NO: 2658059 - RNA, 14 nt, Escherichia coli CFT073
ucguagccaccauc

SEQ ID NO: 2658060 - RNA, 23 nt, Escherichia coli CFT073
ucguagccccagucuuccugcgg

SEQ ID NO: 2658061 - RNA, 17 nt, Escherichia coli CFT073
ucguagcguuuuuucau

SEQ ID NO: 2658062 - RNA, 16 nt, Escherichia coli CFT073
ucguaggccugauaag

SEQ ID NO: 2658063 - RNA, 22 nt, Escherichia coli CFT073
ucguagguuuugucgaacaggu

SEQ ID NO: 2658064 - RNA, 20 nt, Escherichia coli CFT073
ucguauccagcguuauaaaa

SEQ ID NO: 2658065 - RNA, 22 nt, Escherichia coli CFT073
ucguauccagcguuauaaaaca

SEQ ID NO: 2658066 - RNA, 13 nt, Escherichia coli CFT073
ucguauuccaucu

SEQ ID NO: 2658067 - RNA, 13 nt, Escherichia coli CFT073
ucguauuuaaaac

SEQ ID NO: 2658068 - RNA, 15 nt, Escherichia coli CFT073
ucguauuuaaaaccg

SEQ ID NO: 2658069 - RNA, 23 nt, Escherichia coli CFT073
ucguauuucagaccuguugccca

SEQ ID NO: 2658070 - RNA, 15 nt, Escherichia coli CFT073
ucgucaacguaauga

SEQ ID NO: 2658071 - RNA, 22 nt, Escherichia coli CFT073
ucgucacgauuggguaacgcac

SEQ ID NO: 2658072 - RNA, 21 nt, Escherichia coli CFT073
ucgucacgcgcgccaagcccg

SEQ ID NO: 2658073 - RNA, 18 nt, Escherichia coli CFT073
ucgucacggcgacggcug

SEQ ID NO: 2658074 - RNA, 20 nt, Escherichia coli CFT073
ucgucacgucgucaggcaau

SEQ ID NO: 2658075 - RNA, 15 nt, Escherichia coli CFT073
ucgucacucacgcug

SEQ ID NO: 2658076 - RNA, 14 nt, Escherichia coli CFT073
ucgucagaaauggu

SEQ ID NO: 2658077 - RNA, 19 nt, Escherichia coli CFT073
ucgucaggaucagccauuu

SEQ ID NO: 2658078 - RNA, 23 nt, Escherichia coli CFT073
ucgucaggaucagccauuuugca

SEQ ID NO: 2658079 - RNA, 16 nt, Escherichia coli CFT073
ucgucaggauuaaacu

SEQ ID NO: 2658080 - RNA, 19 nt, Escherichia coli CFT073
ucgucaggggcauuuucca

SEQ ID NO: 2658081 - RNA, 21 nt, Escherichia coli CFT073
ucgucaggggcauuuuccagu

SEQ ID NO: 2658082 - RNA, 19 nt, Escherichia coli CFT073
ucgucaguagcgcaauaac

SEQ ID NO: 2658083 - RNA, 20 nt, Escherichia coli CFT073
ucgucaguucggcaucaucg

SEQ ID NO: 2658084 - RNA, 14 nt, Escherichia coli CFT073
ucgucaguuuauac

SEQ ID NO: 2658085 - RNA, 23 nt, Escherichia coli CFT073
ucgucauaagcgauaccgguacg

SEQ ID NO: 2658086 - RNA, 19 nt, Escherichia coli CFT073
ucgucaucagcgccaaccc

SEQ ID NO: 2658087 - RNA, 15 nt, Escherichia coli CFT073
ucgucaucagcucca

SEQ ID NO: 2658088 - RNA, 13 nt, Escherichia coli CFT073
ucgucaucccagu

SEQ ID NO: 2658089 - RNA, 15 nt, Escherichia coli CFT073
ucgucaucccagucc

SEQ ID NO: 2658090 - RNA, 18 nt, Escherichia coli CFT073
ucguccagauguucuuca

SEQ ID NO: 2658091 - RNA, 20 nt, Escherichia coli CFT073
ucguccagauguucuucaau

SEQ ID NO: 2658092 - RNA, 13 nt, Escherichia coli CFT073
ucguccagcugcc

SEQ ID NO: 2658093 - RNA, 14 nt, Escherichia coli CFT073
ucguccagcugccu

SEQ ID NO: 2658094 - RNA, 15 nt, Escherichia coli CFT073
ucguccagcugccug

SEQ ID NO: 2658095 - RNA, 16 nt, Escherichia coli CFT073
ucgucccaaaagcucg

SEQ ID NO: 2658096 - RNA, 17 nt, Escherichia coli CFT073
ucgucccaauggauauc

SEQ ID NO: 2658097 - RNA, 17 nt, Escherichia coli CFT073
ucguccggacuggcauu

SEQ ID NO: 2658098 - RNA, 22 nt, Escherichia coli CFT073
ucguccggcuggguagcuuccu

SEQ ID NO: 2658099 - RNA, 18 nt, Escherichia coli CFT073
ucgucgcagacaaggcga

SEQ ID NO: 2658100 - RNA, 14 nt, Escherichia coli CFT073
ucgucgccaaugcg

SEQ ID NO: 2658101 - RNA, 15 nt, Escherichia coli CFT073
ucgucgcgcacgccc

SEQ ID NO: 2658102 - RNA, 14 nt, Escherichia coli CFT073
ucgucgguuuucuu

SEQ ID NO: 2658103 - RNA, 16 nt, Escherichia coli CFT073
ucgucguacugaccgu

SEQ ID NO: 2658104 - RNA, 15 nt, Escherichia coli CFT073
ucgucugguucgcca

SEQ ID NO: 2658105 - RNA, 15 nt, Escherichia coli CFT073
ucgucugguuuuccu

SEQ ID NO: 2658106 - RNA, 16 nt, Escherichia coli CFT073
ucgugaaacucaacgu

SEQ ID NO: 2658107 - RNA, 16 nt, Escherichia coli CFT073
ucgugaaauucacgca

SEQ ID NO: 2658108 - RNA, 19 nt, Escherichia coli CFT073
ucgugacugccgccagcau

SEQ ID NO: 2658109 - RNA, 16 nt, Escherichia coli CFT073
ucgugaugcccugaug

SEQ ID NO: 2658110 - RNA, 13 nt, Escherichia coli CFT073
ucgugauuaaacu

SEQ ID NO: 2658111 - RNA, 22 nt, Escherichia coli CFT073
ucgugauuaaacuucaccagca

SEQ ID NO: 2658112 - RNA, 13 nt, Escherichia coli CFT073
ucgugcaccaauu

SEQ ID NO: 2658113 - RNA, 21 nt, Escherichia coli CFT073
ucgugcaccaauugccggaug

SEQ ID NO: 2658114 - RNA, 13 nt, Escherichia coli CFT073
ucgugcaccgccu

SEQ ID NO: 2658115 - RNA, 10 nt, Escherichia coli CFT073
ucgugcagaa

SEQ ID NO: 2658116 - RNA, 13 nt, Escherichia coli CFT073
ucgugccgccagu

SEQ ID NO: 2658117 - RNA, 18 nt, Escherichia coli CFT073
ucgugcggguaaccagcc

SEQ ID NO: 2658118 - RNA, 20 nt, Escherichia coli CFT073
ucgugcggguaaccagccaa

SEQ ID NO: 2658119 - RNA, 17 nt, Escherichia coli CFT073
ucgugcgguaucaccac

SEQ ID NO: 2658120 - RNA, 12 nt, Escherichia coli CFT073
ucgugcucgcuu

SEQ ID NO: 2658121 - RNA, 15 nt, Escherichia coli CFT073
ucgugcucuggcagg

SEQ ID NO: 2658122 - RNA, 20 nt, Escherichia coli CFT073
ucgugcuggauuugugucag

SEQ ID NO: 2658123 - RNA, 21 nt, Escherichia coli CFT073
ucgugcuggauuugugucaga

SEQ ID NO: 2658124 - RNA, 21 nt, Escherichia coli CFT073
ucguggaaaccgagauaaaug

SEQ ID NO: 2658125 - RNA, 19 nt, Escherichia coli CFT073
ucguggccaugaccaccgc

SEQ ID NO: 2658126 - RNA, 15 nt, Escherichia coli CFT073
ucguggcccgccagc

SEQ ID NO: 2658127 - RNA, 18 nt, Escherichia coli CFT073
ucguggguucaucgagca

SEQ ID NO: 2658128 - RNA, 22 nt, Escherichia coli CFT073
ucguggguucaucgagcagcau

SEQ ID NO: 2658129 - RNA, 12 nt, Escherichia coli CFT073
ucuccccggagg

SEQ ID NO: 2658130 - RNA, 14 nt, Escherichia coli CFT073
ucucccgccugcug

SEQ ID NO: 2658131 - RNA, 15 nt, Escherichia coli CFT073
ucucccucagguaua

SEQ ID NO: 2658132 - RNA, 16 nt, Escherichia coli CFT073
ucuccgcccagcguac

SEQ ID NO: 2658133 - RNA, 19 nt, Escherichia coli CFT073
ucuccgcggucagcgcaau

SEQ ID NO: 2658134 - RNA, 20 nt, Escherichia coli CFT073
ucuccgcguucaauacgcag

SEQ ID NO: 2658135 - RNA, 20 nt, Escherichia coli CFT073
ucuccgcucuucaucuucca

SEQ ID NO: 2658136 - RNA, 12 nt, Escherichia coli CFT073
ucuccggcagcu

SEQ ID NO: 2658137 - RNA, 15 nt, Escherichia coli CFT073
ucuccggccuacaaa

SEQ ID NO: 2658138 - RNA, 11 nt, Escherichia coli CFT073
ucuccggcguu

SEQ ID NO: 2658139 - RNA, 23 nt, Escherichia coli CFT073
ucuccgggggcgauuucagauca

SEQ ID NO: 2658140 - RNA, 21 nt, Escherichia coli CFT073
ucuccgugggcuaacacugcc

SEQ ID NO: 2658141 - RNA, 15 nt, Escherichia coli CFT073
ucuccucaacgaugc

SEQ ID NO: 2658142 - RNA, 22 nt, Escherichia coli CFT073
ucuccuccagcgcuuccagaau

SEQ ID NO: 2658143 - RNA, 14 nt, Escherichia coli CFT073
ucuccugcggcgac

SEQ ID NO: 2658144 - RNA, 18 nt, Escherichia coli CFT073
ucuccuguugugaugcaa

SEQ ID NO: 2658145 - RNA, 17 nt, Escherichia coli CFT073
ucuccuuuaccacucuc

SEQ ID NO: 2658146 - RNA, 24 nt, Escherichia coli CFT073
ucuccuuuauagugugcaaucacu

SEQ ID NO: 2658147 - RNA, 14 nt, Escherichia coli CFT073
ucucgaaacgcuuu

SEQ ID NO: 2658148 - RNA, 18 nt, Escherichia coli CFT073
ucucgaauuaauggugau

SEQ ID NO: 2658149 - RNA, 18 nt, Escherichia coli CFT073
ucucgcaaaacgucgcca

SEQ ID NO: 2658150 - RNA, 20 nt, Escherichia coli CFT073
ucucgcacguuggcagugcc

SEQ ID NO: 2658151 - RNA, 19 nt, Escherichia coli CFT073
ucucgccaguguucuuccg

SEQ ID NO: 2658152 - RNA, 16 nt, Escherichia coli CFT073
ucucgcccgucuucca

SEQ ID NO: 2658153 - RNA, 17 nt, Escherichia coli CFT073
ucucgcccgucuuccag

SEQ ID NO: 2658154 - RNA, 17 nt, Escherichia coli CFT073
ucucgccguggcuguug

SEQ ID NO: 2658155 - RNA, 18 nt, Escherichia coli CFT073
ucucgcguuacuaccggc

SEQ ID NO: 2658156 - RNA, 21 nt, Escherichia coli CFT073
ucucgcucgagagagaaaaua

SEQ ID NO: 2658157 - RNA, 20 nt, Escherichia coli CFT073
ucucgcugaucuuauugguu

SEQ ID NO: 2658158 - RNA, 15 nt, Escherichia coli CFT073
ucucggcgcggcccu

SEQ ID NO: 2658159 - RNA, 17 nt, Escherichia coli CFT073
ucucgggaaggcccuuu

SEQ ID NO: 2658160 - RNA, 17 nt, Escherichia coli CFT073
ucucgguagagaaaacc

SEQ ID NO: 2658161 - RNA, 22 nt, Escherichia coli CFT073
ucucgguuuucagguuaucgga

SEQ ID NO: 2658162 - RNA, 19 nt, Escherichia coli CFT073
ucucguccaacaguuccag

SEQ ID NO: 2658163 - RNA, 19 nt, Escherichia coli CFT073
ucucgugaaauucacgcag

SEQ ID NO: 2658164 - RNA, 13 nt, Escherichia coli CFT073
ucucgugccgcca

SEQ ID NO: 2658165 - RNA, 16 nt, Escherichia coli CFT073
ucucguuucaguuuua

SEQ ID NO: 2658166 - RNA, 22 nt, Escherichia coli CFT073
ucucuaacaaccucauaccaua

SEQ ID NO: 2658167 - RNA, 22 nt, Escherichia coli CFT073
ucucuaagucuuucugugcaau

SEQ ID NO: 2658168 - RNA, 20 nt, Escherichia coli CFT073
ucucuauuacccuauuuaaa

SEQ ID NO: 2658169 - RNA, 22 nt, Escherichia coli CFT073
ucucucgaaaaaccugacgcug

SEQ ID NO: 2658170 - RNA, 23 nt, Escherichia coli CFT073
ucucucuguagaacaccugucuu

SEQ ID NO: 2658171 - RNA, 16 nt, Escherichia coli CFT073
ucucugaaaauuaacg

SEQ ID NO: 2658172 - RNA, 16 nt, Escherichia coli CFT073
ucucugacauaaaaaa

SEQ ID NO: 2658173 - RNA, 20 nt, Escherichia coli CFT073
ucucugauacucaacucaca

SEQ ID NO: 2658174 - RNA, 20 nt, Escherichia coli CFT073
ucucugcaaauuaugccuga

SEQ ID NO: 2658175 - RNA, 21 nt, Escherichia coli CFT073
ucucugcaaauuaugccugau

SEQ ID NO: 2658176 - RNA, 14 nt, Escherichia coli CFT073
ucucugcaacgucu

SEQ ID NO: 2658177 - RNA, 22 nt, Escherichia coli CFT073
ucucugcaagagauaaagcugu

SEQ ID NO: 2658178 - RNA, 12 nt, Escherichia coli CFT073
ucucugccgccg

SEQ ID NO: 2658179 - RNA, 22 nt, Escherichia coli CFT073
ucucugcgcuauccagcgcaua

SEQ ID NO: 2658180 - RNA, 16 nt, Escherichia coli CFT073
ucucugguacgccugc

SEQ ID NO: 2658181 - RNA, 21 nt, Escherichia coli CFT073
ucucugucugccuuucgguga

SEQ ID NO: 2658182 - RNA, 13 nt, Escherichia coli CFT073
ucucuuaucaucc

SEQ ID NO: 2658183 - RNA, 15 nt, Escherichia coli CFT073
ucucuucaccugccu

SEQ ID NO: 2658184 - RNA, 14 nt, Escherichia coli CFT073
ucucuucagccaac

SEQ ID NO: 2658185 - RNA, 19 nt, Escherichia coli CFT073
ucucuuccaguucguagcc

SEQ ID NO: 2658186 - RNA, 15 nt, Escherichia coli CFT073
ucucuuccggcuccc

SEQ ID NO: 2658187 - RNA, 13 nt, Escherichia coli CFT073
ucucuucugcuuu

SEQ ID NO: 2658188 - RNA, 20 nt, Escherichia coli CFT073
ucucuuuauguaauaaaccu

SEQ ID NO: 2658189 - RNA, 23 nt, Escherichia coli CFT073
ucucuuuauguaauaaaccugcu

SEQ ID NO: 2658190 - RNA, 13 nt, Escherichia coli CFT073
ucucuuuauuuga

SEQ ID NO: 2658191 - RNA, 14 nt, Escherichia coli CFT073
ucucuuuauuugau

SEQ ID NO: 2658192 - RNA, 15 nt, Escherichia coli CFT073
ucucuuucaccagcg

SEQ ID NO: 2658193 - RNA, 21 nt, Escherichia coli CFT073
ucucuuuccauucuuucccag

SEQ ID NO: 2658194 - RNA, 14 nt, Escherichia coli CFT073
ucugaaaccaccau

SEQ ID NO: 2658195 - RNA, 19 nt, Escherichia coli CFT073
ucugaaagcagacuuuuug

SEQ ID NO: 2658196 - RNA, 13 nt, Escherichia coli CFT073
ucugaauaaacgg

SEQ ID NO: 2658197 - RNA, 19 nt, Escherichia coli CFT073
ucugaauaucaucacccug

SEQ ID NO: 2658198 - RNA, 23 nt, Escherichia coli CFT073
ucugaauaucaucacccugcgau

SEQ ID NO: 2658199 - RNA, 21 nt, Escherichia coli CFT073
ucugaauauucggcuccagau

SEQ ID NO: 2658200 - RNA, 13 nt, Escherichia coli CFT073
ucugaaugccagu

SEQ ID NO: 2658201 - RNA, 22 nt, Escherichia coli CFT073
ucugaauugaauagauauagcc

SEQ ID NO: 2658202 - RNA, 22 nt, Escherichia coli CFT073
ucugaauuuuaaguaugggauc

SEQ ID NO: 2658203 - RNA, 22 nt, Escherichia coli CFT073
ucugacaccccgguaaagcgca

SEQ ID NO: 2658204 - RNA, 18 nt, Escherichia coli CFT073
ucugacacugccacuuuu

SEQ ID NO: 2658205 - RNA, 23 nt, Escherichia coli CFT073
ucugacauagccacucaccgccg

SEQ ID NO: 2658206 - RNA, 16 nt, Escherichia coli CFT073
ucugaccagccagcau

SEQ ID NO: 2658207 - RNA, 15 nt, Escherichia coli CFT073
ucugacgaugguguu

SEQ ID NO: 2658208 - RNA, 19 nt, Escherichia coli CFT073
ucugacgcgcauacucucc

SEQ ID NO: 2658209 - RNA, 18 nt, Escherichia coli CFT073
ucugacgcugaauacgca

SEQ ID NO: 2658210 - RNA, 23 nt, Escherichia coli CFT073
ucugagcaggcggcuucgcaucc

SEQ ID NO: 2658211 - RNA, 20 nt, Escherichia coli CFT073
ucugagcaucacauaaucga

SEQ ID NO: 2658212 - RNA, 15 nt, Escherichia coli CFT073
ucugagcgaagcgca

SEQ ID NO: 2658213 - RNA, 17 nt, Escherichia coli CFT073
ucugauagaacauguca

SEQ ID NO: 2658214 - RNA, 18 nt, Escherichia coli CFT073
ucugauauuaauuuguau

SEQ ID NO: 2658215 - RNA, 14 nt, Escherichia coli CFT073
ucugauauucagga

SEQ ID NO: 2658216 - RNA, 17 nt, Escherichia coli CFT073
ucugauauuuuauugau

SEQ ID NO: 2658217 - RNA, 23 nt, Escherichia coli CFT073
ucugaugacugauauccagccag

SEQ ID NO: 2658218 - RNA, 21 nt, Escherichia coli CFT073
ucugaugcgacgcggcagcgu

SEQ ID NO: 2658219 - RNA, 19 nt, Escherichia coli CFT073
ucugauguugaaugugacc

SEQ ID NO: 2658220 - RNA, 19 nt, Escherichia coli CFT073
ucugauucccugccugaca

SEQ ID NO: 2658221 - RNA, 13 nt, Escherichia coli CFT073
ucugauucuuccc

SEQ ID NO: 2658222 - RNA, 22 nt, Escherichia coli CFT073
ucugcaaaauaccaauaaucaa

SEQ ID NO: 2658223 - RNA, 14 nt, Escherichia coli CFT073
ucugcaaacaagaa

SEQ ID NO: 2658224 - RNA, 18 nt, Escherichia coli CFT073
ucugcaaauuaugccuga

SEQ ID NO: 2658225 - RNA, 17 nt, Escherichia coli CFT073
ucugcaaccagaaaguc

SEQ ID NO: 2658226 - RNA, 19 nt, Escherichia coli CFT073
ucugcaccuuuaaccccag

SEQ ID NO: 2658227 - RNA, 15 nt, Escherichia coli CFT073
ucugcacgcgauggc

SEQ ID NO: 2658228 - RNA, 19 nt, Escherichia coli CFT073
ucugcacuaacccucuguc

SEQ ID NO: 2658229 - RNA, 23 nt, Escherichia coli CFT073
ucugcacugcucauuaauauacu

SEQ ID NO: 2658230 - RNA, 18 nt, Escherichia coli CFT073
ucugcagcgcggcgagag

SEQ ID NO: 2658231 - RNA, 23 nt, Escherichia coli CFT073
ucugcagcuuuaacgaucacggc

SEQ ID NO: 2658232 - RNA, 16 nt, Escherichia coli CFT073
ucugcagggcaauagc

SEQ ID NO: 2658233 - RNA, 21 nt, Escherichia coli CFT073
ucugcagggcaauagccagcg

SEQ ID NO: 2658234 - RNA, 15 nt, Escherichia coli CFT073
ucugcaucccggcag

SEQ ID NO: 2658235 - RNA, 11 nt, Escherichia coli CFT073
ucugcauugcg

SEQ ID NO: 2658236 - RNA, 24 nt, Escherichia coli CFT073
ucugugacguuguccagcuuaauu

SEQ ID NO: 2658237 - RNA, 15 nt, Escherichia coli CFT073
ucuguggcagggcag

SEQ ID NO: 2658238 - RNA, 22 nt, Escherichia coli CFT073
ucugugggacacauaaccaggu

SEQ ID NO: 2658239 - RNA, 17 nt, Escherichia coli CFT073
ucugugucugauauuuu

SEQ ID NO: 2658240 - RNA, 19 nt, Escherichia coli CFT073
ucuguucagugauggcaca

SEQ ID NO: 2658241 - RNA, 13 nt, Escherichia coli CFT073
ucuguucaugcaa

SEQ ID NO: 2658242 - RNA, 18 nt, Escherichia coli CFT073
ucuguuccauaaucgccu

SEQ ID NO: 2658243 - RNA, 13 nt, Escherichia coli CFT073
ucuguucuuucaa

SEQ ID NO: 2658244 - RNA, 19 nt, Escherichia coli CFT073
ucuguugccagcaguucaa

SEQ ID NO: 2658245 - RNA, 19 nt, Escherichia coli CFT073
ucuguugccgcuacaucac

SEQ ID NO: 2658246 - RNA, 21 nt, Escherichia coli CFT073
ucuuaacgucggguauauaaa

SEQ ID NO: 2658247 - RNA, 13 nt, Escherichia coli CFT073
ucuuaagauauaa

SEQ ID NO: 2658248 - RNA, 20 nt, Escherichia coli CFT073
ucuuaaggcauauaugaaua

SEQ ID NO: 2658249 - RNA, 20 nt, Escherichia coli CFT073
ucuuaagguucacuuaaucu

SEQ ID NO: 2658250 - RNA, 16 nt, Escherichia coli CFT073
ucuuaagguuuuuucc

SEQ ID NO: 2658251 - RNA, 18 nt, Escherichia coli CFT073
ucuuaagguuuuuuccuu

SEQ ID NO: 2658252 - RNA, 17 nt, Escherichia coli CFT073
ucuuaauagcuucuucu

SEQ ID NO: 2658253 - RNA, 20 nt, Escherichia coli CFT073
ucuuaauagcuucuucuuua

SEQ ID NO: 2658254 - RNA, 13 nt, Escherichia coli CFT073
ucuuacauucugu

SEQ ID NO: 2658255 - RNA, 14 nt, Escherichia coli CFT073
ucuuacauucuguc

SEQ ID NO: 2658256 - RNA, 18 nt, Escherichia coli CFT073
ucuuaccaccuuccucuu

SEQ ID NO: 2658257 - RNA, 13 nt, Escherichia coli CFT073
ucuuaccucuuga

SEQ ID NO: 2658258 - RNA, 21 nt, Escherichia coli CFT073
ucuuacuauauaaaccuucug

SEQ ID NO: 2658259 - RNA, 12 nt, Escherichia coli CFT073
ucuuaucaccaa

SEQ ID NO: 2658260 - RNA, 10 nt, Escherichia coli CFT073
ucuuaucagg

SEQ ID NO: 2658261 - RNA, 17 nt, Escherichia coli CFT073
ucuuaucaggccuacaa

SEQ ID NO: 2658262 - RNA, 23 nt, Escherichia coli CFT073
ucuuaucaggccuacaaucccgu

SEQ ID NO: 2658263 - RNA, 21 nt, Escherichia coli CFT073
ucuuaucaggccuacaggugc

SEQ ID NO: 2658264 - RNA, 17 nt, Escherichia coli CFT073
ucuuaucaggccuacau

SEQ ID NO: 2658265 - RNA, 13 nt, Escherichia coli CFT073
ucuuauccggccu

SEQ ID NO: 2658266 - RNA, 17 nt, Escherichia coli CFT073
ucuuaucuaacaaucuu

SEQ ID NO: 2658267 - RNA, 14 nt, Escherichia coli CFT073
ucuuaucuggccua

SEQ ID NO: 2658268 - RNA, 20 nt, Escherichia coli CFT073
ucuuauuauauugucuuaaa

SEQ ID NO: 2658269 - RNA, 18 nt, Escherichia coli CFT073
ucuuauugaaagaucaca

SEQ ID NO: 2658270 - RNA, 16 nt, Escherichia coli CFT073
ucuuauugaguaaauu

SEQ ID NO: 2658271 - RNA, 16 nt, Escherichia coli CFT073
ucuuauuuaauguaaa

SEQ ID NO: 2658272 - RNA, 22 nt, Escherichia coli CFT073
ucuuauuuuuugcgcauaacau

SEQ ID NO: 2658273 - RNA, 23 nt, Escherichia coli CFT073
ucuucaaaccacugcgccaacgu

SEQ ID NO: 2658274 - RNA, 16 nt, Escherichia coli CFT073
ucuucaaacugaagau

SEQ ID NO: 2658275 - RNA, 14 nt, Escherichia coli CFT073
ucuucaaacuggcg

SEQ ID NO: 2658276 - RNA, 12 nt, Escherichia coli CFT073
ucuucaaagcca

SEQ ID NO: 2658277 - RNA, 13 nt, Escherichia coli CFT073
ucuucaaauaaac

SEQ ID NO: 2658278 - RNA, 14 nt, Escherichia coli CFT073
ucuucaaauaaacg

SEQ ID NO: 2658279 - RNA, 12 nt, Escherichia coli CFT073
ucuucaacacca

SEQ ID NO: 2658280 - RNA, 19 nt, Escherichia coli CFT073
ucuucaacaccaacugccu

SEQ ID NO: 2658281 - RNA, 22 nt, Escherichia coli CFT073
ucuucaaggcagagucaucucu

SEQ ID NO: 2658282 - RNA, 19 nt, Escherichia coli CFT073
ucuucaauggcaucacgca

SEQ ID NO: 2658283 - RNA, 13 nt, Escherichia coli CFT073
ucuucacaucaau

SEQ ID NO: 2658284 - RNA, 21 nt, Escherichia coli CFT073
ucuucacaucaauauuccagu

SEQ ID NO: 2658285 - RNA, 14 nt, Escherichia coli CFT073
ucuucacaucauca

SEQ ID NO: 2658286 - RNA, 15 nt, Escherichia coli CFT073
ucuucacaucaucau

SEQ ID NO: 2658287 - RNA, 19 nt, Escherichia coli CFT073
ucuucaccaaaugccugcu

SEQ ID NO: 2658288 - RNA, 22 nt, Escherichia coli CFT073
ucuucaccguccauccacagag

SEQ ID NO: 2658289 - RNA, 15 nt, Escherichia coli CFT073
ucuucaccugccugc

SEQ ID NO: 2658290 - RNA, 23 nt, Escherichia coli CFT073
ucuucacgacccggcguuuucag

SEQ ID NO: 2658291 - RNA, 22 nt, Escherichia coli CFT073
ucuucacgauaaaucagauugu

SEQ ID NO: 2658292 - RNA, 15 nt, Escherichia coli CFT073
ucuucacgcccgccc

SEQ ID NO: 2658293 - RNA, 18 nt, Escherichia coli CFT073
ucuucacgcgcagaucgu

SEQ ID NO: 2658294 - RNA, 23 nt, Escherichia coli CFT073
ucuucacugaauaccguaaaacu

SEQ ID NO: 2658295 - RNA, 16 nt, Escherichia coli CFT073
ucuucagcaaucucuu

SEQ ID NO: 2658296 - RNA, 12 nt, Escherichia coli CFT073
ucuucagcuuuc

SEQ ID NO: 2658297 - RNA, 16 nt, Escherichia coli CFT073
ucuucagcuuucacca

SEQ ID NO: 2658298 - RNA, 21 nt, Escherichia coli CFT073
ucuucaggaguagaaauaacc

SEQ ID NO: 2658299 - RNA, 22 nt, Escherichia coli CFT073
ucuucaggccaauucacuucac

SEQ ID NO: 2658300 - RNA, 13 nt, Escherichia coli CFT073
ucuucaucaccga

SEQ ID NO: 2658301 - RNA, 19 nt, Escherichia coli CFT073
ucuucaucgcgcaaaauuu

SEQ ID NO: 2658302 - RNA, 21 nt, Escherichia coli CFT073
ucuucaucgcgcaaaauuucu

SEQ ID NO: 2658303 - RNA, 18 nt, Escherichia coli CFT073
ucuucauuaaaccagugc

SEQ ID NO: 2658304 - RNA, 15 nt, Escherichia coli CFT073
ucuucauuaccuuca

SEQ ID NO: 2658305 - RNA, 20 nt, Escherichia coli CFT073
ucuuccacaauaccaaucgc

SEQ ID NO: 2658306 - RNA, 15 nt, Escherichia coli CFT073
ucuuccagaaugccu

SEQ ID NO: 2658307 - RNA, 21 nt, Escherichia coli CFT073
ucuuccagcagcggcagauca

SEQ ID NO: 2658308 - RNA, 14 nt, Escherichia coli CFT073
ucuuccagcaucag

SEQ ID NO: 2658309 - RNA, 23 nt, Escherichia coli CFT073
ucuuccagcgcaaggaaauaacg

SEQ ID NO: 2658310 - RNA, 14 nt, Escherichia coli CFT073
ucuuccagcgcauc

SEQ ID NO: 2658311 - RNA, 13 nt, Escherichia coli CFT073
ucuuccagcggca

SEQ ID NO: 2658312 - RNA, 14 nt, Escherichia coli CFT073
ucuuccagcggcau

SEQ ID NO: 2658313 - RNA, 16 nt, Escherichia coli CFT073
ucuuccagcggccaga

SEQ ID NO: 2658314 - RNA, 19 nt, Escherichia coli CFT073
ucuuccagcgucuccagac

SEQ ID NO: 2658315 - RNA, 17 nt, Escherichia coli CFT073
ucuuccagcucuuccga

SEQ ID NO: 2658316 - RNA, 18 nt, Escherichia coli CFT073
ucuuccaguaaaccaacc

SEQ ID NO: 2658317 - RNA, 20 nt, Escherichia coli CFT073
ucuuccaguggcauuuucug

SEQ ID NO: 2658318 - RNA, 23 nt, Escherichia coli CFT073
ucuuccaguuucgccaguuuuuc

SEQ ID NO: 2658319 - RNA, 15 nt, Escherichia coli CFT073
ucuuccaucacaaag

SEQ ID NO: 2658320 - RNA, 12 nt, Escherichia coli CFT073
ucuuccauucuc

SEQ ID NO: 2658321 - RNA, 22 nt, Escherichia coli CFT073
ucuuccauugcuuugguaaaug

SEQ ID NO: 2658322 - RNA, 23 nt, Escherichia coli CFT073
ucuucccgagacaucccuuuauu

SEQ ID NO: 2658323 - RNA, 19 nt, Escherichia coli CFT073
ucuucccgaggcauuccuu

SEQ ID NO: 2658324 - RNA, 22 nt, Escherichia coli CFT073
ucuucccgaggcauuccuuuac

SEQ ID NO: 2658325 - RNA, 23 nt, Escherichia coli CFT073
ucuucccgaggcauuccuuuacu

SEQ ID NO: 2658326 - RNA, 13 nt, Escherichia coli CFT073
ucuucccgcagcc

SEQ ID NO: 2658327 - RNA, 15 nt, Escherichia coli CFT073
ucuucccgccuguca

SEQ ID NO: 2658328 - RNA, 15 nt, Escherichia coli CFT073
ucuucccgcgccagc

SEQ ID NO: 2658329 - RNA, 13 nt, Escherichia coli CFT073
ucuucccuuucug

SEQ ID NO: 2658330 - RNA, 14 nt, Escherichia coli CFT073
ucuuccgccagcau

SEQ ID NO: 2658331 - RNA, 14 nt, Escherichia coli CFT073
ucuuccgcuucaau

SEQ ID NO: 2658332 - RNA, 19 nt, Escherichia coli CFT073
ucuuccggcaccauuccac

SEQ ID NO: 2658333 - RNA, 17 nt, Escherichia coli CFT073
ucuuccgggaaaacauc

SEQ ID NO: 2658334 - RNA, 17 nt, Escherichia coli CFT073
ucuuccgggcaacaauc

SEQ ID NO: 2658335 - RNA, 20 nt, Escherichia coli CFT073
ucuuccgggcaacaaucgcu

SEQ ID NO: 2658336 - RNA, 22 nt, Escherichia coli CFT073
ucuuccgggcuauacacccuuc

SEQ ID NO: 2658337 - RNA, 23 nt, Escherichia coli CFT073
ucuuccggguagcgcggcagcgg

SEQ ID NO: 2658338 - RNA, 14 nt, Escherichia coli CFT073
ucuuccgucaaggu

SEQ ID NO: 2658339 - RNA, 18 nt, Escherichia coli CFT073
ucuuccgucgccagaaag

SEQ ID NO: 2658340 - RNA, 13 nt, Escherichia coli CFT073
ucuuccucgccag

SEQ ID NO: 2658341 - RNA, 19 nt, Escherichia coli CFT073
ucuuccugccagcacuuug

SEQ ID NO: 2658342 - RNA, 13 nt, Escherichia coli CFT073
ucuucgaaaugcu

SEQ ID NO: 2658343 - RNA, 14 nt, Escherichia coli CFT073
ucuucgaagaaaaa

SEQ ID NO: 2658344 - RNA, 17 nt, Escherichia coli CFT073
ucuuugcgguuaaagca

SEQ ID NO: 2658345 - RNA, 17 nt, Escherichia coli CFT073
ucuuugcguuuggcauc

SEQ ID NO: 2658346 - RNA, 18 nt, Escherichia coli CFT073
ucuuugcuaaaacgugaa

SEQ ID NO: 2658347 - RNA, 19 nt, Escherichia coli CFT073
ucuuugcugccuucgcagu

SEQ ID NO: 2658348 - RNA, 15 nt, Escherichia coli CFT073
ucuuuguaggccuga

SEQ ID NO: 2658349 - RNA, 19 nt, Escherichia coli CFT073
ucuuuguaggccugauaag

SEQ ID NO: 2658350 - RNA, 20 nt, Escherichia coli CFT073
ucuuugugacaaacuaacca

SEQ ID NO: 2658351 - RNA, 18 nt, Escherichia coli CFT073
ucuuuuaaaucauccuga

SEQ ID NO: 2658352 - RNA, 19 nt, Escherichia coli CFT073
ucuuuuaccaccgcaaaac

SEQ ID NO: 2658353 - RNA, 14 nt, Escherichia coli CFT073
ucuuuuauuauaau

SEQ ID NO: 2658354 - RNA, 14 nt, Escherichia coli CFT073
ucuuuucacgcaau

SEQ ID NO: 2658355 - RNA, 14 nt, Escherichia coli CFT073
ucuuuugcagcagc

SEQ ID NO: 2658356 - RNA, 21 nt, Escherichia coli CFT073
ucuuuuugauaagauuccuuc

SEQ ID NO: 2658357 - RNA, 14 nt, Escherichia coli CFT073
ucuuuuuugagaau

SEQ ID NO: 2658358 - RNA, 13 nt, Escherichia coli CFT073
ucuuuuuuucauu

SEQ ID NO: 2658359 - RNA, 16 nt, Escherichia coli CFT073
ucuuuuuuuucacaug

SEQ ID NO: 2658360 - RNA, 14 nt, Escherichia coli CFT073
ugaaaaaagcaaga

SEQ ID NO: 2658361 - RNA, 14 nt, Escherichia coli CFT073
ugaaaaaccaaucu

SEQ ID NO: 2658362 - RNA, 12 nt, Escherichia coli CFT073
ugaaaaauaaaa

SEQ ID NO: 2658363 - RNA, 14 nt, Escherichia coli CFT073
ugaaaaaucuccag

SEQ ID NO: 2658364 - RNA, 15 nt, Escherichia coli CFT073
ugaaaaaucuccagc

SEQ ID NO: 2658365 - RNA, 16 nt, Escherichia coli CFT073
ugaaaaccauaaugau

SEQ ID NO: 2658366 - RNA, 22 nt, Escherichia coli CFT073
ugaaaacccuauuuuuggaggu

SEQ ID NO: 2658367 - RNA, 15 nt, Escherichia coli CFT073
ugaaaacgcauacca

SEQ ID NO: 2658368 - RNA, 21 nt, Escherichia coli CFT073
ugaaaagaguucaucggauaa

SEQ ID NO: 2658369 - RNA, 16 nt, Escherichia coli CFT073
ugaaaaggcuaaaauu

SEQ ID NO: 2658370 - RNA, 18 nt, Escherichia coli CFT073
ugaaaaggucgccugucu

SEQ ID NO: 2658371 - RNA, 20 nt, Escherichia coli CFT073
ugaaaagguuacucccggau

SEQ ID NO: 2658372 - RNA, 13 nt, Escherichia coli CFT073
ugaaaauauuccc

SEQ ID NO: 2658373 - RNA, 13 nt, Escherichia coli CFT073
ugaaaaugcuggu

SEQ ID NO: 2658374 - RNA, 14 nt, Escherichia coli CFT073
ugaaaaugcugguu

SEQ ID NO: 2658375 - RNA, 15 nt, Escherichia coli CFT073
ugaaaauucaauaaa

SEQ ID NO: 2658376 - RNA, 14 nt, Escherichia coli CFT073
ugaaacaaaucacu

SEQ ID NO: 2658377 - RNA, 13 nt, Escherichia coli CFT073
ugaaacagaaggu

SEQ ID NO: 2658378 - RNA, 12 nt, Escherichia coli CFT073
ugaaacaguaag

SEQ ID NO: 2658379 - RNA, 23 nt, Escherichia coli CFT073
ugaaaccaccauuuuuauuugcc

SEQ ID NO: 2658380 - RNA, 23 nt, Escherichia coli CFT073
ugaaaccgaauccuuuggacuca

SEQ ID NO: 2658381 - RNA, 22 nt, Escherichia coli CFT073
ugaaaccgguuuguaggccgga

SEQ ID NO: 2658382 - RNA, 14 nt, Escherichia coli CFT073
ugaaacgaaaucuu

SEQ ID NO: 2658383 - RNA, 21 nt, Escherichia coli CFT073
ugaaacgauggcguaaccaau

SEQ ID NO: 2658384 - RNA, 19 nt, Escherichia coli CFT073
ugaaacgcaaauacugacu

SEQ ID NO: 2658385 - RNA, 22 nt, Escherichia coli CFT073
ugaaacgccugaugacgcagau

SEQ ID NO: 2658386 - RNA, 19 nt, Escherichia coli CFT073
ugaaacgcggcguaaccac

SEQ ID NO: 2658387 - RNA, 21 nt, Escherichia coli CFT073
ugaaacgcggcguaaccaccc

SEQ ID NO: 2658388 - RNA, 19 nt, Escherichia coli CFT073
ugaaacucgaccaguagcu

SEQ ID NO: 2658389 - RNA, 15 nt, Escherichia coli CFT073
ugaaacucgaugaca

SEQ ID NO: 2658390 - RNA, 12 nt, Escherichia coli CFT073
ugaaacuuucca

SEQ ID NO: 2658391 - RNA, 14 nt, Escherichia coli CFT073
ugaaagagaucaaa

SEQ ID NO: 2658392 - RNA, 20 nt, Escherichia coli CFT073
ugaaagagccaucauucugc

SEQ ID NO: 2658393 - RNA, 16 nt, Escherichia coli CFT073
ugaaagagucgccagc

SEQ ID NO: 2658394 - RNA, 13 nt, Escherichia coli CFT073
ugaaagaucacaa

SEQ ID NO: 2658395 - RNA, 22 nt, Escherichia coli CFT073
ugaaagaucacaauguaaauca

SEQ ID NO: 2658396 - RNA, 21 nt, Escherichia coli CFT073
ugaaagaugcuggauauagag

SEQ ID NO: 2658397 - RNA, 12 nt, Escherichia coli CFT073
ugaaagcaaaaa

SEQ ID NO: 2658398 - RNA, 15 nt, Escherichia coli CFT073
ugaaagcaaaaaaag

SEQ ID NO: 2658399 - RNA, 16 nt, Escherichia coli CFT073
ugaaagcaaaaaaaga

SEQ ID NO: 2658400 - RNA, 19 nt, Escherichia coli CFT073
ugaaagcaaaaaaagaauc

SEQ ID NO: 2658401 - RNA, 14 nt, Escherichia coli CFT073
ugaaagcaaaaaag

SEQ ID NO: 2658402 - RNA, 17 nt, Escherichia coli CFT073
ugaaagcucauaacgga

SEQ ID NO: 2658403 - RNA, 19 nt, Escherichia coli CFT073
ugaaagcugagaaaaugua

SEQ ID NO: 2658404 - RNA, 22 nt, Escherichia coli CFT073
ugaaaggcacucauuuucucuu

SEQ ID NO: 2658405 - RNA, 18 nt, Escherichia coli CFT073
ugaaaggucaucaucacu

SEQ ID NO: 2658406 - RNA, 18 nt, Escherichia coli CFT073
ugaaagugcuguaaagca

SEQ ID NO: 2658407 - RNA, 13 nt, Escherichia coli CFT073
ugaaaguuggcga

SEQ ID NO: 2658408 - RNA, 19 nt, Escherichia coli CFT073
ugaaaguuggcguucacug

SEQ ID NO: 2658409 - RNA, 16 nt, Escherichia coli CFT073
ugaaaguuguccauug

SEQ ID NO: 2658410 - RNA, 20 nt, Escherichia coli CFT073
ugaaaguuuaacuaccgugu

SEQ ID NO: 2658411 - RNA, 11 nt, Escherichia coli CFT073
ugaaauaaacc

SEQ ID NO: 2658412 - RNA, 15 nt, Escherichia coli CFT073
ugaaauaaugcagcg

SEQ ID NO: 2658413 - RNA, 22 nt, Escherichia coli CFT073
ugaaauaccacucagcuuaaga

SEQ ID NO: 2658414 - RNA, 14 nt, Escherichia coli CFT073
ugaaauaguugcau

SEQ ID NO: 2658415 - RNA, 15 nt, Escherichia coli CFT073
ugaaauauuucuuua

SEQ ID NO: 2658416 - RNA, 23 nt, Escherichia coli CFT073
ugaaaucaaaaucaccgaugaca

SEQ ID NO: 2658417 - RNA, 18 nt, Escherichia coli CFT073
ugaaaucaacguuaccaa

SEQ ID NO: 2658418 - RNA, 16 nt, Escherichia coli CFT073
ugaaaucgaacagguu

SEQ ID NO: 2658419 - RNA, 19 nt, Escherichia coli CFT073
ugaaaugauuacucccuug

SEQ ID NO: 2658420 - RNA, 13 nt, Escherichia coli CFT073
ugaaaugcggcga

SEQ ID NO: 2658421 - RNA, 23 nt, Escherichia coli CFT073
ugaaauguaggguuacgcgcagu

SEQ ID NO: 2658422 - RNA, 20 nt, Escherichia coli CFT073
ugaaauguugccggauggca

SEQ ID NO: 2658423 - RNA, 19 nt, Escherichia coli CFT073
ugaaauuacuuuccaucuu

SEQ ID NO: 2658424 - RNA, 21 nt, Escherichia coli CFT073
ugaaauucagugaacuguggu

SEQ ID NO: 2658425 - RNA, 15 nt, Escherichia coli CFT073
ugaaauuguaggccu

SEQ ID NO: 2658426 - RNA, 19 nt, Escherichia coli CFT073
ugaaauugugauaaaaauc

SEQ ID NO: 2658427 - RNA, 15 nt, Escherichia coli CFT073
ugaaauuucugccuc

SEQ ID NO: 2658428 - RNA, 12 nt, Escherichia coli CFT073
ugaacaaaacau

SEQ ID NO: 2658429 - RNA, 17 nt, Escherichia coli CFT073
ugaacaaaacauacuuu

SEQ ID NO: 2658430 - RNA, 17 nt, Escherichia coli CFT073
ugaacaaaagcuggcag

SEQ ID NO: 2658431 - RNA, 13 nt, Escherichia coli CFT073
ugaacaacaguuu

SEQ ID NO: 2658432 - RNA, 13 nt, Escherichia coli CFT073
ugaacaagcaaga

SEQ ID NO: 2658433 - RNA, 13 nt, Escherichia coli CFT073
ugaacaauuucag

SEQ ID NO: 2658434 - RNA, 22 nt, Escherichia coli CFT073
ugaacaccagaaccagcaacca

SEQ ID NO: 2658435 - RNA, 16 nt, Escherichia coli CFT073
ugaacaccuuauccgg

SEQ ID NO: 2658436 - RNA, 20 nt, Escherichia coli CFT073
ugaacaccuuauccggccua

SEQ ID NO: 2658437 - RNA, 18 nt, Escherichia coli CFT073
ugaacacguuuucucaag

SEQ ID NO: 2658438 - RNA, 12 nt, Escherichia coli CFT073
ugaacagccaga

SEQ ID NO: 2658439 - RNA, 20 nt, Escherichia coli CFT073
ugaacagccagaagcccgga

SEQ ID NO: 2658440 - RNA, 22 nt, Escherichia coli CFT073
ugaacaucaagcggcgcaugca

SEQ ID NO: 2658441 - RNA, 13 nt, Escherichia coli CFT073
ugaacaucgccau

SEQ ID NO: 2658442 - RNA, 12 nt, Escherichia coli CFT073
ugaacauugaca

SEQ ID NO: 2658443 - RNA, 14 nt, Escherichia coli CFT073
ugaacauugacagu

SEQ ID NO: 2658444 - RNA, 16 nt, Escherichia coli CFT073
ugaacauugcugcuga

SEQ ID NO: 2658445 - RNA, 13 nt, Escherichia coli CFT073
ugaacauuuucuu

SEQ ID NO: 2658446 - RNA, 18 nt, Escherichia coli CFT073
ugaacauuuucuucugcc

SEQ ID NO: 2658447 - RNA, 13 nt, Escherichia coli CFT073
ugaaccgccaacc

SEQ ID NO: 2658448 - RNA, 21 nt, Escherichia coli CFT073
ugaaccgugucgccaucaaag

SEQ ID NO: 2658449 - RNA, 22 nt, Escherichia coli CFT073
ugaaccucacagaggucuuuuc

SEQ ID NO: 2658450 - RNA, 22 nt, Escherichia coli CFT073
ugaacgagaaaagccaaccugc

SEQ ID NO: 2658451 - RNA, 16 nt, Escherichia coli CFT073
ugaacgcaaaugguga

SEQ ID NO: 2658452 - RNA, 18 nt, Escherichia coli CFT073
ugaacgcaggccgcccaa

SEQ ID NO: 2658453 - RNA, 14 nt, Escherichia coli CFT073
ugaaucgccacgcc

SEQ ID NO: 2658454 - RNA, 23 nt, Escherichia coli CFT073
ugaaucgcuauuaacccgcaaca

SEQ ID NO: 2658455 - RNA, 18 nt, Escherichia coli CFT073
ugaaucggacgugauucc

SEQ ID NO: 2658456 - RNA, 20 nt, Escherichia coli CFT073
ugaaucggacgugauuccag

SEQ ID NO: 2658457 - RNA, 23 nt, Escherichia coli CFT073
ugaaucgguggcggcaguugccc

SEQ ID NO: 2658458 - RNA, 14 nt, Escherichia coli CFT073
ugaaucguuugucc

SEQ ID NO: 2658459 - RNA, 13 nt, Escherichia coli CFT073
ugaaucucaggca

SEQ ID NO: 2658460 - RNA, 15 nt, Escherichia coli CFT073
ugaaucucaggcaaa

SEQ ID NO: 2658461 - RNA, 13 nt, Escherichia coli CFT073
ugaaucugagcau

SEQ ID NO: 2658462 - RNA, 13 nt, Escherichia coli CFT073
ugaaugaaaacga

SEQ ID NO: 2658463 - RNA, 14 nt, Escherichia coli CFT073
ugaaugaaaacgaa

SEQ ID NO: 2658464 - RNA, 22 nt, Escherichia coli CFT073
ugaaugacuguccacgacagaa

SEQ ID NO: 2658465 - RNA, 18 nt, Escherichia coli CFT073
ugaaugcaacugcccagg

SEQ ID NO: 2658466 - RNA, 22 nt, Escherichia coli CFT073
ugaaugccaaauccggcaaaua

SEQ ID NO: 2658467 - RNA, 20 nt, Escherichia coli CFT073
ugaauggcgucuucuucaaa

SEQ ID NO: 2658468 - RNA, 17 nt, Escherichia coli CFT073
ugaaugguuucgcccac

SEQ ID NO: 2658469 - RNA, 16 nt, Escherichia coli CFT073
ugaaugucggcggcga

SEQ ID NO: 2658470 - RNA, 22 nt, Escherichia coli CFT073
ugaaugugaccgacccggcauc

SEQ ID NO: 2658471 - RNA, 18 nt, Escherichia coli CFT073
ugaauguucaauaagcuu

SEQ ID NO: 2658472 - RNA, 15 nt, Escherichia coli CFT073
ugaauguugcgcggu

SEQ ID NO: 2658473 - RNA, 14 nt, Escherichia coli CFT073
ugaauuaaaaacag

SEQ ID NO: 2658474 - RNA, 15 nt, Escherichia coli CFT073
ugaauuaaaaacagu

SEQ ID NO: 2658475 - RNA, 14 nt, Escherichia coli CFT073
ugaauuaaaaugug

SEQ ID NO: 2658476 - RNA, 21 nt, Escherichia coli CFT073
ugaauuaaacacgggguuaaa

SEQ ID NO: 2658477 - RNA, 19 nt, Escherichia coli CFT073
ugaauuaacuuaucaagaa

SEQ ID NO: 2658478 - RNA, 14 nt, Escherichia coli CFT073
ugaauuaaugccuc

SEQ ID NO: 2658479 - RNA, 21 nt, Escherichia coli CFT073
ugaauuaucuauauuuauuca

SEQ ID NO: 2658480 - RNA, 18 nt, Escherichia coli CFT073
ugaauugccagcaucaga

SEQ ID NO: 2658481 - RNA, 18 nt, Escherichia coli CFT073
ugaauuguccagaucuuu

SEQ ID NO: 2658482 - RNA, 14 nt, Escherichia coli CFT073
ugaauugugauggu

SEQ ID NO: 2658483 - RNA, 19 nt, Escherichia coli CFT073
ugaauuuaaugcacuuaua

SEQ ID NO: 2658484 - RNA, 20 nt, Escherichia coli CFT073
ugaauuuaauugguuuugca

SEQ ID NO: 2658485 - RNA, 23 nt, Escherichia coli CFT073
ugaauuuaauugguuuugcaggc

SEQ ID NO: 2658486 - RNA, 16 nt, Escherichia coli CFT073
ugaauuuauaaucauc

SEQ ID NO: 2658487 - RNA, 17 nt, Escherichia coli CFT073
ugaauuuaucuuucagc

SEQ ID NO: 2658488 - RNA, 19 nt, Escherichia coli CFT073
ugaauuucaaaucaccaaa

SEQ ID NO: 2658489 - RNA, 12 nt, Escherichia coli CFT073
ugaauuucacuu

SEQ ID NO: 2658490 - RNA, 22 nt, Escherichia coli CFT073
ugaauuuccugcgcuuucugcu

SEQ ID NO: 2658491 - RNA, 13 nt, Escherichia coli CFT073
ugaauuucgccgc

SEQ ID NO: 2658492 - RNA, 15 nt, Escherichia coli CFT073
ugaauuugcgauacu

SEQ ID NO: 2658493 - RNA, 18 nt, Escherichia coli CFT073
ugaauuugugaacagccu

SEQ ID NO: 2658494 - RNA, 20 nt, Escherichia coli CFT073
ugaauuuuaauauguugacu

SEQ ID NO: 2658495 - RNA, 21 nt, Escherichia coli CFT073
ugaauuuucgcccgcuggcga

SEQ ID NO: 2658496 - RNA, 15 nt, Escherichia coli CFT073
ugaauuuugaaggaa

SEQ ID NO: 2658497 - RNA, 19 nt, Escherichia coli CFT073
ugaauuuugaaggaaaaau

SEQ ID NO: 2658498 - RNA, 19 nt, Escherichia coli CFT073
ugaauuuuuacuucuucac

SEQ ID NO: 2658499 - RNA, 19 nt, Escherichia coli CFT073
ugacaaaaaagccaauuac

SEQ ID NO: 2658500 - RNA, 21 nt, Escherichia coli CFT073
ugacaaaaauaccauuaguca

SEQ ID NO: 2658501 - RNA, 22 nt, Escherichia coli CFT073
ugacaaaaucaauauaaacagc

SEQ ID NO: 2658502 - RNA, 23 nt, Escherichia coli CFT073
ugacaaacgcaaaacugccugau

SEQ ID NO: 2658503 - RNA, 23 nt, Escherichia coli CFT073
ugacaaacgcaaaauugccugau

SEQ ID NO: 2658504 - RNA, 23 nt, Escherichia coli CFT073
ugacaaacguauaauugccugau

SEQ ID NO: 2658505 - RNA, 13 nt, Escherichia coli CFT073
ugacaaacucacc

SEQ ID NO: 2658506 - RNA, 14 nt, Escherichia coli CFT073
ugacaaacucaccu

SEQ ID NO: 2658507 - RNA, 15 nt, Escherichia coli CFT073
ugacaacaacaucac

SEQ ID NO: 2658508 - RNA, 21 nt, Escherichia coli CFT073
ugacaauccuucccugcagua

SEQ ID NO: 2658509 - RNA, 19 nt, Escherichia coli CFT073
ugacaaucgccagugauug

SEQ ID NO: 2658510 - RNA, 15 nt, Escherichia coli CFT073
ugacaaucgccgcca

SEQ ID NO: 2658511 - RNA, 14 nt, Escherichia coli CFT073
ugacaauuacaaaa

SEQ ID NO: 2658512 - RNA, 14 nt, Escherichia coli CFT073
ugacaccaagcacc

SEQ ID NO: 2658513 - RNA, 11 nt, Escherichia coli CFT073
ugacaccagca

SEQ ID NO: 2658514 - RNA, 12 nt, Escherichia coli CFT073
ugacaccagcau

SEQ ID NO: 2658515 - RNA, 16 nt, Escherichia coli CFT073
ugacaccagcauaaua

SEQ ID NO: 2658516 - RNA, 20 nt, Escherichia coli CFT073
ugacaccgcuguugcuucca

SEQ ID NO: 2658517 - RNA, 20 nt, Escherichia coli CFT073
ugacacggaacaacggcaaa

SEQ ID NO: 2658518 - RNA, 22 nt, Escherichia coli CFT073
ugacacggaacaacggcaaaca

SEQ ID NO: 2658519 - RNA, 17 nt, Escherichia coli CFT073
ugacacgggaaaccaac

SEQ ID NO: 2658520 - RNA, 21 nt, Escherichia coli CFT073
ugacacuaacagcaguacgcc

SEQ ID NO: 2658521 - RNA, 22 nt, Escherichia coli CFT073
ugacacuaacagcaguacgcca

SEQ ID NO: 2658522 - RNA, 16 nt, Escherichia coli CFT073
ugacacuauucgccag

SEQ ID NO: 2658523 - RNA, 20 nt, Escherichia coli CFT073
ugacacuauucgccagcacg

SEQ ID NO: 2658524 - RNA, 19 nt, Escherichia coli CFT073
ugacacugccacuuuuucc

SEQ ID NO: 2658525 - RNA, 23 nt, Escherichia coli CFT073
ugacacugucaccuuuuaccgua

SEQ ID NO: 2658526 - RNA, 12 nt, Escherichia coli CFT073
ugacacuucuuc

SEQ ID NO: 2658527 - RNA, 14 nt, Escherichia coli CFT073
ugacagaaucagca

SEQ ID NO: 2658528 - RNA, 15 nt, Escherichia coli CFT073
ugacagaaucagcag

SEQ ID NO: 2658529 - RNA, 17 nt, Escherichia coli CFT073
ugacagaaucagcagcg

SEQ ID NO: 2658530 - RNA, 18 nt, Escherichia coli CFT073
ugacagaaucagcagcgu

SEQ ID NO: 2658531 - RNA, 23 nt, Escherichia coli CFT073
ugacagaaucagcagcguuccca

SEQ ID NO: 2658532 - RNA, 21 nt, Escherichia coli CFT073
ugacagaccgccaguaucuuc

SEQ ID NO: 2658533 - RNA, 20 nt, Escherichia coli CFT073
ugacagacugcuuugaugug

SEQ ID NO: 2658534 - RNA, 19 nt, Escherichia coli CFT073
ugacagaggauauucugcg

SEQ ID NO: 2658535 - RNA, 17 nt, Escherichia coli CFT073
ugacagauuugauuauc

SEQ ID NO: 2658536 - RNA, 23 nt, Escherichia coli CFT073
ugacagccccugugccagcucgu

SEQ ID NO: 2658537 - RNA, 15 nt, Escherichia coli CFT073
ugacagcucacgcgc

SEQ ID NO: 2658538 - RNA, 14 nt, Escherichia coli CFT073
ugacagcuccuccg

SEQ ID NO: 2658539 - RNA, 15 nt, Escherichia coli CFT073
ugacaggccccccuc

SEQ ID NO: 2658540 - RNA, 17 nt, Escherichia coli CFT073
ugacaggcgggaagaac

SEQ ID NO: 2658541 - RNA, 16 nt, Escherichia coli CFT073
ugacagggugagcagg

SEQ ID NO: 2658542 - RNA, 14 nt, Escherichia coli CFT073
ugacaguugucagc

SEQ ID NO: 2658543 - RNA, 22 nt, Escherichia coli CFT073
ugacauaaccgagaauuuccag

SEQ ID NO: 2658544 - RNA, 14 nt, Escherichia coli CFT073
ugacauaaugcaaa

SEQ ID NO: 2658545 - RNA, 16 nt, Escherichia coli CFT073
ugacauacucucucca

SEQ ID NO: 2658546 - RNA, 17 nt, Escherichia coli CFT073
ugacauagagauaacug

SEQ ID NO: 2658547 - RNA, 21 nt, Escherichia coli CFT073
ugacauauaaccggcaacaga

SEQ ID NO: 2658548 - RNA, 13 nt, Escherichia coli CFT073
ugacaucaauacg

SEQ ID NO: 2658549 - RNA, 16 nt, Escherichia coli CFT073
ugacauccauauccag

SEQ ID NO: 2658550 - RNA, 13 nt, Escherichia coli CFT073
ugacauccccauc

SEQ ID NO: 2658551 - RNA, 23 nt, Escherichia coli CFT073
ugacaucgcuuaguuaaaccagc

SEQ ID NO: 2658552 - RNA, 23 nt, Escherichia coli CFT073
ugacaucgucaggggcauuuucc

SEQ ID NO: 2658553 - RNA, 14 nt, Escherichia coli CFT073
ugacaucuccagcg

SEQ ID NO: 2658554 - RNA, 17 nt, Escherichia coli CFT073
ugacaucuccagcgcau

SEQ ID NO: 2658555 - RNA, 19 nt, Escherichia coli CFT073
ugacaugaaugucauacca

SEQ ID NO: 2658556 - RNA, 23 nt, Escherichia coli CFT073
ugacaugaaugucauaccacaua

SEQ ID NO: 2658557 - RNA, 20 nt, Escherichia coli CFT073
ugacauggcaauagcuucuu

SEQ ID NO: 2658558 - RNA, 18 nt, Escherichia coli CFT073
ugacauguuaaccaacca

SEQ ID NO: 2658559 - RNA, 20 nt, Escherichia coli CFT073
ugacauuaaguguccgccaa

SEQ ID NO: 2658560 - RNA, 21 nt, Escherichia coli CFT073
ugacauuaaguguccgccaau

SEQ ID NO: 2658561 - RNA, 14 nt, Escherichia coli CFT073
ugacugaagaaauc

SEQ ID NO: 2658562 - RNA, 15 nt, Escherichia coli CFT073
ugacugaaucaggaa

SEQ ID NO: 2658563 - RNA, 20 nt, Escherichia coli CFT073
ugacugacuucaacaggaaa

SEQ ID NO: 2658564 - RNA, 16 nt, Escherichia coli CFT073
ugacugauauccagcc

SEQ ID NO: 2658565 - RNA, 18 nt, Escherichia coli CFT073
ugacugaugcuuuccgcc

SEQ ID NO: 2658566 - RNA, 15 nt, Escherichia coli CFT073
ugacugcuguaagcc

SEQ ID NO: 2658567 - RNA, 13 nt, Escherichia coli CFT073
ugacugcuuuuuc

SEQ ID NO: 2658568 - RNA, 16 nt, Escherichia coli CFT073
ugacugcuuuuucaau

SEQ ID NO: 2658569 - RNA, 18 nt, Escherichia coli CFT073
ugacugcuuuuucaauuu

SEQ ID NO: 2658570 - RNA, 17 nt, Escherichia coli CFT073
ugacuggcagaaugaag

SEQ ID NO: 2658571 - RNA, 21 nt, Escherichia coli CFT073
ugacuggcagaaugaaguaaa

SEQ ID NO: 2658572 - RNA, 16 nt, Escherichia coli CFT073
ugacugucgcuauuca

SEQ ID NO: 2658573 - RNA, 17 nt, Escherichia coli CFT073
ugacuguuuuuccagcu

SEQ ID NO: 2658574 - RNA, 13 nt, Escherichia coli CFT073
ugacuuaaaucuc

SEQ ID NO: 2658575 - RNA, 17 nt, Escherichia coli CFT073
ugacuuaccuccugucu

SEQ ID NO: 2658576 - RNA, 17 nt, Escherichia coli CFT073
ugacuuacuuccugucu

SEQ ID NO: 2658577 - RNA, 19 nt, Escherichia coli CFT073
ugacuucaaucugagcgaa

SEQ ID NO: 2658578 - RNA, 14 nt, Escherichia coli CFT073
ugacuuccacuucc

SEQ ID NO: 2658579 - RNA, 15 nt, Escherichia coli CFT073
ugacuuccgccacca

SEQ ID NO: 2658580 - RNA, 12 nt, Escherichia coli CFT073
ugacuucgccga

SEQ ID NO: 2658581 - RNA, 17 nt, Escherichia coli CFT073
ugacuugcucaaucugg

SEQ ID NO: 2658582 - RNA, 19 nt, Escherichia coli CFT073
ugacuuggcuuucucuucc

SEQ ID NO: 2658583 - RNA, 17 nt, Escherichia coli CFT073
ugacuuuaccugccuga

SEQ ID NO: 2658584 - RNA, 20 nt, Escherichia coli CFT073
ugacuuucuuuucccugugg

SEQ ID NO: 2658585 - RNA, 20 nt, Escherichia coli CFT073
ugacuuuguaccuggccguu

SEQ ID NO: 2658586 - RNA, 10 nt, Escherichia coli CFT073
ugagaaaaag

SEQ ID NO: 2658587 - RNA, 23 nt, Escherichia coli CFT073
ugagaaaacuaucugaaaaugaa

SEQ ID NO: 2658588 - RNA, 21 nt, Escherichia coli CFT073
ugagaaaauguauuucaucau

SEQ ID NO: 2658589 - RNA, 12 nt, Escherichia coli CFT073
ugagaaacgccg

SEQ ID NO: 2658590 - RNA, 21 nt, Escherichia coli CFT073
ugagaaauuagcgucaccauc

SEQ ID NO: 2658591 - RNA, 20 nt, Escherichia coli CFT073
ugagaacaagauugccugau

SEQ ID NO: 2658592 - RNA, 21 nt, Escherichia coli CFT073
ugagaacacgaccugccagag

SEQ ID NO: 2658593 - RNA, 19 nt, Escherichia coli CFT073
ugagaacauaaacacccac

SEQ ID NO: 2658594 - RNA, 17 nt, Escherichia coli CFT073
ugagaaccgcacagguu

SEQ ID NO: 2658595 - RNA, 16 nt, Escherichia coli CFT073
ugagaagcgcagcgca

SEQ ID NO: 2658596 - RNA, 20 nt, Escherichia coli CFT073
ugagaccagaccauacagug

SEQ ID NO: 2658597 - RNA, 20 nt, Escherichia coli CFT073
ugagacgcggcacuccgcca

SEQ ID NO: 2658598 - RNA, 19 nt, Escherichia coli CFT073
ugagacgguuaaaaacagc

SEQ ID NO: 2658599 - RNA, 14 nt, Escherichia coli CFT073
ugagagcaaccagc

SEQ ID NO: 2658600 - RNA, 21 nt, Escherichia coli CFT073
ugagaggacaaauaaggaaaa

SEQ ID NO: 2658601 - RNA, 14 nt, Escherichia coli CFT073
ugagauaauuuaua

SEQ ID NO: 2658602 - RNA, 14 nt, Escherichia coli CFT073
ugagauacauuggu

SEQ ID NO: 2658603 - RNA, 14 nt, Escherichia coli CFT073
ugagauccagcgag

SEQ ID NO: 2658604 - RNA, 15 nt, Escherichia coli CFT073
ugagauccgucaggc

SEQ ID NO: 2658605 - RNA, 15 nt, Escherichia coli CFT073
ugagaugguuuugcu

SEQ ID NO: 2658606 - RNA, 21 nt, Escherichia coli CFT073
ugagaugguuuugcuuuauua

SEQ ID NO: 2658607 - RNA, 20 nt, Escherichia coli CFT073
ugagauucaacaucucuauu

SEQ ID NO: 2658608 - RNA, 18 nt, Escherichia coli CFT073
ugagauuguuggucacaa

SEQ ID NO: 2658609 - RNA, 15 nt, Escherichia coli CFT073
ugagauuucaccaau

SEQ ID NO: 2658610 - RNA, 23 nt, Escherichia coli CFT073
ugagcaaacagucgcccgaccau

SEQ ID NO: 2658611 - RNA, 13 nt, Escherichia coli CFT073
ugagcaaacaguu

SEQ ID NO: 2658612 - RNA, 20 nt, Escherichia coli CFT073
ugagcaaacaguucugcagc

SEQ ID NO: 2658613 - RNA, 21 nt, Escherichia coli CFT073
ugagcaaacaguucugcagcg

SEQ ID NO: 2658614 - RNA, 23 nt, Escherichia coli CFT073
ugagcaacguugaacgcggaucg

SEQ ID NO: 2658615 - RNA, 17 nt, Escherichia coli CFT073
ugagcaagagcaccgcu

SEQ ID NO: 2658616 - RNA, 13 nt, Escherichia coli CFT073
ugagcacauauuc

SEQ ID NO: 2658617 - RNA, 23 nt, Escherichia coli CFT073
ugagcaccacacgacgcgccagc

SEQ ID NO: 2658618 - RNA, 23 nt, Escherichia coli CFT073
ugagcagcgauaucugccgagau

SEQ ID NO: 2658619 - RNA, 16 nt, Escherichia coli CFT073
ugagcagguugaggug

SEQ ID NO: 2658620 - RNA, 17 nt, Escherichia coli CFT073
ugagcaguccccacauc

SEQ ID NO: 2658621 - RNA, 23 nt, Escherichia coli CFT073
ugagcauaucaccucuguucagg

SEQ ID NO: 2658622 - RNA, 20 nt, Escherichia coli CFT073
ugagcaugguaacgccccac

SEQ ID NO: 2658623 - RNA, 15 nt, Escherichia coli CFT073
ugagccaaaaugcuu

SEQ ID NO: 2658624 - RNA, 19 nt, Escherichia coli CFT073
ugagccaggacgauaaacc

SEQ ID NO: 2658625 - RNA, 23 nt, Escherichia coli CFT073
ugagcccacuguuugaucugcug

SEQ ID NO: 2658626 - RNA, 19 nt, Escherichia coli CFT073
ugagccgcuugugccacca

SEQ ID NO: 2658627 - RNA, 21 nt, Escherichia coli CFT073
ugagccggaguugcagauuug

SEQ ID NO: 2658628 - RNA, 23 nt, Escherichia coli CFT073
ugagccguaauccguaugacaaa

SEQ ID NO: 2658629 - RNA, 16 nt, Escherichia coli CFT073
ugagcgauaaacaagu

SEQ ID NO: 2658630 - RNA, 13 nt, Escherichia coli CFT073
ugagcgaugaagu

SEQ ID NO: 2658631 - RNA, 14 nt, Escherichia coli CFT073
ugagcgcacauugc

SEQ ID NO: 2658632 - RNA, 16 nt, Escherichia coli CFT073
ugagcgguacaccaaa

SEQ ID NO: 2658633 - RNA, 22 nt, Escherichia coli CFT073
ugagcgugagguuaucgcccug

SEQ ID NO: 2658634 - RNA, 22 nt, Escherichia coli CFT073
ugagcuauguuugaaccagaua

SEQ ID NO: 2658635 - RNA, 12 nt, Escherichia coli CFT073
ugagcuccagug

SEQ ID NO: 2658636 - RNA, 16 nt, Escherichia coli CFT073
ugagcugucugucaaa

SEQ ID NO: 2658637 - RNA, 14 nt, Escherichia coli CFT073
ugagcuucuucaaa

SEQ ID NO: 2658638 - RNA, 20 nt, Escherichia coli CFT073
ugagcuucuucaaaaaaguc

SEQ ID NO: 2658639 - RNA, 14 nt, Escherichia coli CFT073
ugagcuuuggcggc

SEQ ID NO: 2658640 - RNA, 22 nt, Escherichia coli CFT073
ugaggaucaccaguccaucggc

SEQ ID NO: 2658641 - RNA, 22 nt, Escherichia coli CFT073
ugaggaucgggcagugcucgua

SEQ ID NO: 2658642 - RNA, 14 nt, Escherichia coli CFT073
ugaggaugcgaguc

SEQ ID NO: 2658643 - RNA, 12 nt, Escherichia coli CFT073
ugaggcaaguaa

SEQ ID NO: 2658644 - RNA, 23 nt, Escherichia coli CFT073
ugaggcacgacacaaugccauau

SEQ ID NO: 2658645 - RNA, 20 nt, Escherichia coli CFT073
ugaggccggaugccgcugcu

SEQ ID NO: 2658646 - RNA, 16 nt, Escherichia coli CFT073
ugaggguauccaggcc

SEQ ID NO: 2658647 - RNA, 23 nt, Escherichia coli CFT073
ugaggguguuggaacccgcagcc

SEQ ID NO: 2658648 - RNA, 18 nt, Escherichia coli CFT073
ugagguaacucucaugcu

SEQ ID NO: 2658649 - RNA, 13 nt, Escherichia coli CFT073
ugagguaaucacu

SEQ ID NO: 2658650 - RNA, 21 nt, Escherichia coli CFT073
ugaggucugaccguucgcccc

SEQ ID NO: 2658651 - RNA, 13 nt, Escherichia coli CFT073
ugaggugcaggaa

SEQ ID NO: 2658652 - RNA, 20 nt, Escherichia coli CFT073
ugagguggccgagaggcuga

SEQ ID NO: 2658653 - RNA, 14 nt, Escherichia coli CFT073
ugagguuucccgcc

SEQ ID NO: 2658654 - RNA, 19 nt, Escherichia coli CFT073
ugaguaaaacugcauuuuu

SEQ ID NO: 2658655 - RNA, 21 nt, Escherichia coli CFT073
ugaguaagugccccgucuuug

SEQ ID NO: 2658656 - RNA, 17 nt, Escherichia coli CFT073
ugaguaccgagaaaauc

SEQ ID NO: 2658657 - RNA, 22 nt, Escherichia coli CFT073
ugaguacgcauccccagcgcaa

SEQ ID NO: 2658658 - RNA, 17 nt, Escherichia coli CFT073
ugaguagaccagacgac

SEQ ID NO: 2658659 - RNA, 19 nt, Escherichia coli CFT073
ugaguauauuucaggccaa

SEQ ID NO: 2658660 - RNA, 16 nt, Escherichia coli CFT073
ugaguaucgaaaacau

SEQ ID NO: 2658661 - RNA, 21 nt, Escherichia coli CFT073
ugaguaucgaaaacaucaaaa

SEQ ID NO: 2658662 - RNA, 13 nt, Escherichia coli CFT073
ugaguauuaaaug

SEQ ID NO: 2658663 - RNA, 15 nt, Escherichia coli CFT073
ugaguauuaaauguc

SEQ ID NO: 2658664 - RNA, 15 nt, Escherichia coli CFT073
ugagugaggcguggc

SEQ ID NO: 2658665 - RNA, 21 nt, Escherichia coli CFT073
ugagugauuccguucaguaau

SEQ ID NO: 2658666 - RNA, 21 nt, Escherichia coli CFT073
ugagugccagauugaagcaga

SEQ ID NO: 2658667 - RNA, 15 nt, Escherichia coli CFT073
ugagugcgaaacaga

SEQ ID NO: 2658668 - RNA, 12 nt, Escherichia coli CFT073
ugaguggcgcga

SEQ ID NO: 2658669 - RNA, 22 nt, Escherichia coli CFT073
ugaugacaaacgcaaaacugcc

SEQ ID NO: 2658670 - RNA, 15 nt, Escherichia coli CFT073
ugaugacgcagaucc

SEQ ID NO: 2658671 - RNA, 19 nt, Escherichia coli CFT073
ugaugacugauauccagcc

SEQ ID NO: 2658672 - RNA, 21 nt, Escherichia coli CFT073
ugaugacuugccuccagcgac

SEQ ID NO: 2658673 - RNA, 16 nt, Escherichia coli CFT073
ugaugaguaucuuauu

SEQ ID NO: 2658674 - RNA, 17 nt, Escherichia coli CFT073
ugaugauaucacuggug

SEQ ID NO: 2658675 - RNA, 21 nt, Escherichia coli CFT073
ugaugaugggcgagguugucu

SEQ ID NO: 2658676 - RNA, 14 nt, Escherichia coli CFT073
ugaugauugaccau

SEQ ID NO: 2658677 - RNA, 13 nt, Escherichia coli CFT073
ugaugauuuugcg

SEQ ID NO: 2658678 - RNA, 14 nt, Escherichia coli CFT073
ugaugcaccaccug

SEQ ID NO: 2658679 - RNA, 19 nt, Escherichia coli CFT073
ugaugcaggcaguaaacug

SEQ ID NO: 2658680 - RNA, 23 nt, Escherichia coli CFT073
ugaugcauacggcgauaaggcgu

SEQ ID NO: 2658681 - RNA, 14 nt, Escherichia coli CFT073
ugaugcaucaacau

SEQ ID NO: 2658682 - RNA, 14 nt, Escherichia coli CFT073
ugaugcauccggca

SEQ ID NO: 2658683 - RNA, 14 nt, Escherichia coli CFT073
ugaugccaaaaugc

SEQ ID NO: 2658684 - RNA, 14 nt, Escherichia coli CFT073
ugaugccacuggau

SEQ ID NO: 2658685 - RNA, 17 nt, Escherichia coli CFT073
ugaugccagcacucugu

SEQ ID NO: 2658686 - RNA, 19 nt, Escherichia coli CFT073
ugaugccagcacucugugc

SEQ ID NO: 2658687 - RNA, 22 nt, Escherichia coli CFT073
ugaugcccggucgcuccggcua

SEQ ID NO: 2658688 - RNA, 18 nt, Escherichia coli CFT073
ugaugccgcauccggcuu

SEQ ID NO: 2658689 - RNA, 15 nt, Escherichia coli CFT073
ugaugccggaugcgg

SEQ ID NO: 2658690 - RNA, 14 nt, Escherichia coli CFT073
ugaugccgucuuua

SEQ ID NO: 2658691 - RNA, 12 nt, Escherichia coli CFT073
ugaugccuggca

SEQ ID NO: 2658692 - RNA, 16 nt, Escherichia coli CFT073
ugaugccuucaguuuc

SEQ ID NO: 2658693 - RNA, 15 nt, Escherichia coli CFT073
ugaugcgacgcggca

SEQ ID NO: 2658694 - RNA, 18 nt, Escherichia coli CFT073
ugaugcgacgcggcagcg

SEQ ID NO: 2658695 - RNA, 19 nt, Escherichia coli CFT073
ugaugcgacgcuggcgcgu

SEQ ID NO: 2658696 - RNA, 21 nt, Escherichia coli CFT073
ugaugcgacgcuuuacgcguc

SEQ ID NO: 2658697 - RNA, 14 nt, Escherichia coli CFT073
ugaugcgacuuguc

SEQ ID NO: 2658698 - RNA, 19 nt, Escherichia coli CFT073
ugaugcgcgagguaacaau

SEQ ID NO: 2658699 - RNA, 19 nt, Escherichia coli CFT073
ugaugcgcuaugcuuauca

SEQ ID NO: 2658700 - RNA, 14 nt, Escherichia coli CFT073
ugaugcgcuuauca

SEQ ID NO: 2658701 - RNA, 19 nt, Escherichia coli CFT073
ugaugcgcuucgcuuauca

SEQ ID NO: 2658702 - RNA, 14 nt, Escherichia coli CFT073
ugaugcggcaucug

SEQ ID NO: 2658703 - RNA, 18 nt, Escherichia coli CFT073
ugaugcggcgcuuucagc

SEQ ID NO: 2658704 - RNA, 21 nt, Escherichia coli CFT073
ugaugcgguaacuccggcaua

SEQ ID NO: 2658705 - RNA, 16 nt, Escherichia coli CFT073
ugaugcgucuuaucag

SEQ ID NO: 2658706 - RNA, 15 nt, Escherichia coli CFT073
ugaugcguucuucaa

SEQ ID NO: 2658707 - RNA, 15 nt, Escherichia coli CFT073
ugaugcuccgccagc

SEQ ID NO: 2658708 - RNA, 18 nt, Escherichia coli CFT073
ugaugcuccgccagcgcc

SEQ ID NO: 2658709 - RNA, 20 nt, Escherichia coli CFT073
ugaugcuccgccagcgccac

SEQ ID NO: 2658710 - RNA, 18 nt, Escherichia coli CFT073
ugaugcucucccaaauau

SEQ ID NO: 2658711 - RNA, 16 nt, Escherichia coli CFT073
ugaugcucuugaaaug

SEQ ID NO: 2658712 - RNA, 16 nt, Escherichia coli CFT073
ugaugcuuuucaaaca

SEQ ID NO: 2658713 - RNA, 19 nt, Escherichia coli CFT073
ugauggaacauucgccgcu

SEQ ID NO: 2658714 - RNA, 21 nt, Escherichia coli CFT073
ugauggacauucuccggcagg

SEQ ID NO: 2658715 - RNA, 12 nt, Escherichia coli CFT073
ugauggcaaaau

SEQ ID NO: 2658716 - RNA, 17 nt, Escherichia coli CFT073
ugauggcaaaauccaga

SEQ ID NO: 2658717 - RNA, 17 nt, Escherichia coli CFT073
ugauggcaaaugcaaca

SEQ ID NO: 2658718 - RNA, 21 nt, Escherichia coli CFT073
ugauggcgauacugccgccca

SEQ ID NO: 2658719 - RNA, 23 nt, Escherichia coli CFT073
ugauggcgccaguuauucauugc

SEQ ID NO: 2658720 - RNA, 22 nt, Escherichia coli CFT073
ugauggcuugcucguuuucaau

SEQ ID NO: 2658721 - RNA, 15 nt, Escherichia coli CFT073
ugauggguuacgcga

SEQ ID NO: 2658722 - RNA, 19 nt, Escherichia coli CFT073
ugaugguaaaauaucacuc

SEQ ID NO: 2658723 - RNA, 21 nt, Escherichia coli CFT073
ugaugguaacgcgccaggauc

SEQ ID NO: 2658724 - RNA, 20 nt, Escherichia coli CFT073
ugauguaaaaaagccggaug

SEQ ID NO: 2658725 - RNA, 17 nt, Escherichia coli CFT073
ugauguacucaauugcu

SEQ ID NO: 2658726 - RNA, 15 nt, Escherichia coli CFT073
ugauguccuuuauaa

SEQ ID NO: 2658727 - RNA, 21 nt, Escherichia coli CFT073
ugauguccuuuauaacugucu

SEQ ID NO: 2658728 - RNA, 20 nt, Escherichia coli CFT073
ugaugucugucagucugcuu

SEQ ID NO: 2658729 - RNA, 21 nt, Escherichia coli CFT073
ugaugugacgcugucuuauca

SEQ ID NO: 2658730 - RNA, 12 nt, Escherichia coli CFT073
ugaugugccauu

SEQ ID NO: 2658731 - RNA, 16 nt, Escherichia coli CFT073
ugaugugcuucagcuu

SEQ ID NO: 2658732 - RNA, 13 nt, Escherichia coli CFT073
ugauguguuguca

SEQ ID NO: 2658733 - RNA, 17 nt, Escherichia coli CFT073
ugauguucaacuuucuc

SEQ ID NO: 2658734 - RNA, 23 nt, Escherichia coli CFT073
ugauguuugcgacaaacuuccag

SEQ ID NO: 2658735 - RNA, 13 nt, Escherichia coli CFT073
ugauuaaacuuca

SEQ ID NO: 2658736 - RNA, 20 nt, Escherichia coli CFT073
ugauuaaauucaggccgucg

SEQ ID NO: 2658737 - RNA, 21 nt, Escherichia coli CFT073
ugauuaacgcuuguaaaugaa

SEQ ID NO: 2658738 - RNA, 23 nt, Escherichia coli CFT073
ugauuaacgcuuguaaaugaacu

SEQ ID NO: 2658739 - RNA, 20 nt, Escherichia coli CFT073
ugauuacacaaguccagcac

SEQ ID NO: 2658740 - RNA, 17 nt, Escherichia coli CFT073
ugauuaccagcaucacc

SEQ ID NO: 2658741 - RNA, 17 nt, Escherichia coli CFT073
ugauuacccacgccaac

SEQ ID NO: 2658742 - RNA, 18 nt, Escherichia coli CFT073
ugauuaccgcaaacucau

SEQ ID NO: 2658743 - RNA, 20 nt, Escherichia coli CFT073
ugauuaccuaccaacgcacc

SEQ ID NO: 2658744 - RNA, 20 nt, Escherichia coli CFT073
ugauuacucucuuucgcuug

SEQ ID NO: 2658745 - RNA, 18 nt, Escherichia coli CFT073
ugauuagucuuuaucugc

SEQ ID NO: 2658746 - RNA, 16 nt, Escherichia coli CFT073
ugauuaucaugcccuu

SEQ ID NO: 2658747 - RNA, 23 nt, Escherichia coli CFT073
ugauuaucaugcccuuuuuucuu

SEQ ID NO: 2658748 - RNA, 15 nt, Escherichia coli CFT073
ugauuauccucugua

SEQ ID NO: 2658749 - RNA, 17 nt, Escherichia coli CFT073
ugauuauccucuguaaa

SEQ ID NO: 2658750 - RNA, 19 nt, Escherichia coli CFT073
ugauuauuuaggugccaac

SEQ ID NO: 2658751 - RNA, 19 nt, Escherichia coli CFT073
ugauuauuucccucguuuu

SEQ ID NO: 2658752 - RNA, 15 nt, Escherichia coli CFT073
ugauucacauccugc

SEQ ID NO: 2658753 - RNA, 17 nt, Escherichia coli CFT073
ugauucacauccugcca

SEQ ID NO: 2658754 - RNA, 18 nt, Escherichia coli CFT073
ugauucacauccugccag

SEQ ID NO: 2658755 - RNA, 19 nt, Escherichia coli CFT073
ugauucacauccugccagu

SEQ ID NO: 2658756 - RNA, 22 nt, Escherichia coli CFT073
ugauucacgcugacaacuccug

SEQ ID NO: 2658757 - RNA, 18 nt, Escherichia coli CFT073
ugauucauaaacaauaca

SEQ ID NO: 2658758 - RNA, 19 nt, Escherichia coli CFT073
ugauucaucucuucuuccg

SEQ ID NO: 2658759 - RNA, 19 nt, Escherichia coli CFT073
ugauucauggcauuuucuc

SEQ ID NO: 2658760 - RNA, 14 nt, Escherichia coli CFT073
ugauuccgcagaua

SEQ ID NO: 2658761 - RNA, 15 nt, Escherichia coli CFT073
ugauuccgcagauau

SEQ ID NO: 2658762 - RNA, 22 nt, Escherichia coli CFT073
ugauuccgggccaccaugccca

SEQ ID NO: 2658763 - RNA, 21 nt, Escherichia coli CFT073
ugauuccguucaguaaucaac

SEQ ID NO: 2658764 - RNA, 19 nt, Escherichia coli CFT073
ugauucgacuaucuuauaa

SEQ ID NO: 2658765 - RNA, 11 nt, Escherichia coli CFT073
ugauucuuccc

SEQ ID NO: 2658766 - RNA, 16 nt, Escherichia coli CFT073
ugauugaagaaaucag

SEQ ID NO: 2658767 - RNA, 15 nt, Escherichia coli CFT073
ugauugaccgccagc

SEQ ID NO: 2658768 - RNA, 17 nt, Escherichia coli CFT073
ugauugaccgccagcgc

SEQ ID NO: 2658769 - RNA, 15 nt, Escherichia coli CFT073
ugauugauuuuucca

SEQ ID NO: 2658770 - RNA, 15 nt, Escherichia coli CFT073
ugauugccggaugcg

SEQ ID NO: 2658771 - RNA, 15 nt, Escherichia coli CFT073
ugauugccuuccacc

SEQ ID NO: 2658772 - RNA, 19 nt, Escherichia coli CFT073
ugauugcggucagcgcagc

SEQ ID NO: 2658773 - RNA, 22 nt, Escherichia coli CFT073
ugauuggcgcgaaccaucaccu

SEQ ID NO: 2658774 - RNA, 15 nt, Escherichia coli CFT073
ugauuguaggccgga

SEQ ID NO: 2658775 - RNA, 17 nt, Escherichia coli CFT073
ugauuguuuuaaauauu

SEQ ID NO: 2658776 - RNA, 23 nt, Escherichia coli CFT073
ugauuuacuuucuugccacuggc

SEQ ID NO: 2658777 - RNA, 17 nt, Escherichia coli CFT073
ugcaccugcguugccgc

SEQ ID NO: 2658778 - RNA, 18 nt, Escherichia coli CFT073
ugcaccugcguugccgca

SEQ ID NO: 2658779 - RNA, 19 nt, Escherichia coli CFT073
ugcaccuuguuucagcacg

SEQ ID NO: 2658780 - RNA, 21 nt, Escherichia coli CFT073
ugcaccuuguuucagcacgau

SEQ ID NO: 2658781 - RNA, 15 nt, Escherichia coli CFT073
ugcaccuuuaacccc

SEQ ID NO: 2658782 - RNA, 14 nt, Escherichia coli CFT073
ugcacgaugccuca

SEQ ID NO: 2658783 - RNA, 22 nt, Escherichia coli CFT073
ugcacgaugccucaucacaaaa

SEQ ID NO: 2658784 - RNA, 14 nt, Escherichia coli CFT073
ugcacgaugcugcg

SEQ ID NO: 2658785 - RNA, 23 nt, Escherichia coli CFT073
ugcacgcccugauaaaucaccug

SEQ ID NO: 2658786 - RNA, 19 nt, Escherichia coli CFT073
ugcacgcgaccgucuuuau

SEQ ID NO: 2658787 - RNA, 20 nt, Escherichia coli CFT073
ugcacgcgaccgucuuuauc

SEQ ID NO: 2658788 - RNA, 22 nt, Escherichia coli CFT073
ugcacgcgauggcuuuccaccu

SEQ ID NO: 2658789 - RNA, 14 nt, Escherichia coli CFT073
ugcacgcugccugg

SEQ ID NO: 2658790 - RNA, 17 nt, Escherichia coli CFT073
ugcacgguuuuuccagc

SEQ ID NO: 2658791 - RNA, 18 nt, Escherichia coli CFT073
ugcacgguuuuuccagcu

SEQ ID NO: 2658792 - RNA, 22 nt, Escherichia coli CFT073
ugcacguuaucagacaccagcc

SEQ ID NO: 2658793 - RNA, 22 nt, Escherichia coli CFT073
ugcacguugcuuauugccggau

SEQ ID NO: 2658794 - RNA, 24 nt, Escherichia coli CFT073
ugcacguuuugcuggugcaggcga

SEQ ID NO: 2658795 - RNA, 22 nt, Escherichia coli CFT073
ugcacuacgcagggauauuuca

SEQ ID NO: 2658796 - RNA, 20 nt, Escherichia coli CFT073
ugcacucagguaacagggaa

SEQ ID NO: 2658797 - RNA, 13 nt, Escherichia coli CFT073
ugcacucauagcc

SEQ ID NO: 2658798 - RNA, 13 nt, Escherichia coli CFT073
ugcacuccgccgc

SEQ ID NO: 2658799 - RNA, 17 nt, Escherichia coli CFT073
ugcacuccgccgcacaa

SEQ ID NO: 2658800 - RNA, 15 nt, Escherichia coli CFT073
ugcacugcaacgccu

SEQ ID NO: 2658801 - RNA, 18 nt, Escherichia coli CFT073
ugcacugcucauuaauau

SEQ ID NO: 2658802 - RNA, 21 nt, Escherichia coli CFT073
ugcacugucccaaaaugucgg

SEQ ID NO: 2658803 - RNA, 15 nt, Escherichia coli CFT073
ugcacuucaaauuuc

SEQ ID NO: 2658804 - RNA, 23 nt, Escherichia coli CFT073
ugcacuucuucacaucaauauuc

SEQ ID NO: 2658805 - RNA, 16 nt, Escherichia coli CFT073
ugcagaaaauccagcg

SEQ ID NO: 2658806 - RNA, 17 nt, Escherichia coli CFT073
ugcagaaaaucuuucag

SEQ ID NO: 2658807 - RNA, 21 nt, Escherichia coli CFT073
ugcagaacggugagcgugcgg

SEQ ID NO: 2658808 - RNA, 21 nt, Escherichia coli CFT073
ugcagaacguccgguuaaauc

SEQ ID NO: 2658809 - RNA, 17 nt, Escherichia coli CFT073
ugcagaaguugugaaac

SEQ ID NO: 2658810 - RNA, 14 nt, Escherichia coli CFT073
ugcagaaucaaucu

SEQ ID NO: 2658811 - RNA, 22 nt, Escherichia coli CFT073
ugcagaaucaaucucagcgaua

SEQ ID NO: 2658812 - RNA, 19 nt, Escherichia coli CFT073
ugcagaauugcagaggcuc

SEQ ID NO: 2658813 - RNA, 14 nt, Escherichia coli CFT073
ugcagacccgccac

SEQ ID NO: 2658814 - RNA, 21 nt, Escherichia coli CFT073
ugcagaccgguggucggcucg

SEQ ID NO: 2658815 - RNA, 21 nt, Escherichia coli CFT073
ugcagacguagaaaaucaccc

SEQ ID NO: 2658816 - RNA, 13 nt, Escherichia coli CFT073
ugcagacugaagc

SEQ ID NO: 2658817 - RNA, 18 nt, Escherichia coli CFT073
ugcagagagucacgcagc

SEQ ID NO: 2658818 - RNA, 23 nt, Escherichia coli CFT073
ugcagagagucacgcagcaucag

SEQ ID NO: 2658819 - RNA, 19 nt, Escherichia coli CFT073
ugcagagcauccagcagcc

SEQ ID NO: 2658820 - RNA, 15 nt, Escherichia coli CFT073
ugcagagucaucagu

SEQ ID NO: 2658821 - RNA, 17 nt, Escherichia coli CFT073
ugcagauaccaccagcg

SEQ ID NO: 2658822 - RNA, 13 nt, Escherichia coli CFT073
ugcagaucaccaa

SEQ ID NO: 2658823 - RNA, 14 nt, Escherichia coli CFT073
ugcagaucgccaga

SEQ ID NO: 2658824 - RNA, 21 nt, Escherichia coli CFT073
ugcagaucgccagagucagca

SEQ ID NO: 2658825 - RNA, 18 nt, Escherichia coli CFT073
ugcagauggcauccagcg

SEQ ID NO: 2658826 - RNA, 12 nt, Escherichia coli CFT073
ugcagcaaagac

SEQ ID NO: 2658827 - RNA, 13 nt, Escherichia coli CFT073
ugcagcaaccaga

SEQ ID NO: 2658828 - RNA, 13 nt, Escherichia coli CFT073
ugcagcaacucug

SEQ ID NO: 2658829 - RNA, 22 nt, Escherichia coli CFT073
ugcagcaacucugcuaacucau

SEQ ID NO: 2658830 - RNA, 20 nt, Escherichia coli CFT073
ugcagcacacgauuccaacg

SEQ ID NO: 2658831 - RNA, 18 nt, Escherichia coli CFT073
ugcagcaccgccgccagg

SEQ ID NO: 2658832 - RNA, 21 nt, Escherichia coli CFT073
ugcagcacgcuggacguggug

SEQ ID NO: 2658833 - RNA, 20 nt, Escherichia coli CFT073
ugcagcacggagagacguug

SEQ ID NO: 2658834 - RNA, 20 nt, Escherichia coli CFT073
ugcagcacucgauuccaaua

SEQ ID NO: 2658835 - RNA, 14 nt, Escherichia coli CFT073
ugcagcacugauaa

SEQ ID NO: 2658836 - RNA, 15 nt, Escherichia coli CFT073
ugcagcacuugcagc

SEQ ID NO: 2658837 - RNA, 16 nt, Escherichia coli CFT073
ugcagcagacgcugca

SEQ ID NO: 2658838 - RNA, 11 nt, Escherichia coli CFT073
ugcagcagcaa

SEQ ID NO: 2658839 - RNA, 13 nt, Escherichia coli CFT073
ugcagcagcuucg

SEQ ID NO: 2658840 - RNA, 21 nt, Escherichia coli CFT073
ugcagcaggcgagcugccagu

SEQ ID NO: 2658841 - RNA, 16 nt, Escherichia coli CFT073
ugcagcauauucgccg

SEQ ID NO: 2658842 - RNA, 22 nt, Escherichia coli CFT073
ugcagcauauucgccguuccca

SEQ ID NO: 2658843 - RNA, 18 nt, Escherichia coli CFT073
ugcagcaucgcuguuuuu

SEQ ID NO: 2658844 - RNA, 16 nt, Escherichia coli CFT073
ugcagcaucgggauag

SEQ ID NO: 2658845 - RNA, 23 nt, Escherichia coli CFT073
ugcagcaugauuucaucaucagg

SEQ ID NO: 2658846 - RNA, 23 nt, Escherichia coli CFT073
ugcagcauggguaaagcccaucg

SEQ ID NO: 2658847 - RNA, 14 nt, Escherichia coli CFT073
ugcagccacugcug

SEQ ID NO: 2658848 - RNA, 16 nt, Escherichia coli CFT073
ugcagccacugcugcg

SEQ ID NO: 2658849 - RNA, 16 nt, Escherichia coli CFT073
ugcagccauuuuacuc

SEQ ID NO: 2658850 - RNA, 12 nt, Escherichia coli CFT073
ugcagccgccau

SEQ ID NO: 2658851 - RNA, 14 nt, Escherichia coli CFT073
ugcagccuucauuc

SEQ ID NO: 2658852 - RNA, 21 nt, Escherichia coli CFT073
ugcagcgcagaccauaaaugc

SEQ ID NO: 2658853 - RNA, 17 nt, Escherichia coli CFT073
ugcagcggccaguagcu

SEQ ID NO: 2658854 - RNA, 17 nt, Escherichia coli CFT073
ugcagcggguuaauuuc

SEQ ID NO: 2658855 - RNA, 21 nt, Escherichia coli CFT073
ugcagcggucacauguuccag

SEQ ID NO: 2658856 - RNA, 19 nt, Escherichia coli CFT073
ugcagcgucugcuguucca

SEQ ID NO: 2658857 - RNA, 15 nt, Escherichia coli CFT073
ugcagcgugccuggg

SEQ ID NO: 2658858 - RNA, 22 nt, Escherichia coli CFT073
ugcagcguugcccccugaagca

SEQ ID NO: 2658859 - RNA, 15 nt, Escherichia coli CFT073
ugcagcuccccacac

SEQ ID NO: 2658860 - RNA, 18 nt, Escherichia coli CFT073
ugcagcuccccacaccac

SEQ ID NO: 2658861 - RNA, 13 nt, Escherichia coli CFT073
ugcagcugcucga

SEQ ID NO: 2658862 - RNA, 22 nt, Escherichia coli CFT073
ugcagcuucgccauuucgucgu

SEQ ID NO: 2658863 - RNA, 18 nt, Escherichia coli CFT073
ugcagcuucuucuccagc

SEQ ID NO: 2658864 - RNA, 21 nt, Escherichia coli CFT073
ugcagcuucuucuccagcugc

SEQ ID NO: 2658865 - RNA, 23 nt, Escherichia coli CFT073
ugcaggaaaucaaugccaccaga

SEQ ID NO: 2658866 - RNA, 23 nt, Escherichia coli CFT073
ugcaggaacaggcgauuuaaucc

SEQ ID NO: 2658867 - RNA, 14 nt, Escherichia coli CFT073
ugcaggaagcucug

SEQ ID NO: 2658868 - RNA, 21 nt, Escherichia coli CFT073
ugcaggaagguuuuaaucgcu

SEQ ID NO: 2658869 - RNA, 16 nt, Escherichia coli CFT073
ugcaggaauggcuggg

SEQ ID NO: 2658870 - RNA, 18 nt, Escherichia coli CFT073
ugcaggagaccaaaccau

SEQ ID NO: 2658871 - RNA, 22 nt, Escherichia coli CFT073
ugcaggagcgauuaugaaacaa

SEQ ID NO: 2658872 - RNA, 13 nt, Escherichia coli CFT073
ugcaggcaccagc

SEQ ID NO: 2658873 - RNA, 20 nt, Escherichia coli CFT073
ugcaggccggauaaggcguu

SEQ ID NO: 2658874 - RNA, 20 nt, Escherichia coli CFT073
ugcaggccugauaagcguag

SEQ ID NO: 2658875 - RNA, 17 nt, Escherichia coli CFT073
ugcaggcgcucaccauu

SEQ ID NO: 2658876 - RNA, 17 nt, Escherichia coli CFT073
ugcaggcggcucaucac

SEQ ID NO: 2658877 - RNA, 15 nt, Escherichia coli CFT073
ugcaggcuaaaaacg

SEQ ID NO: 2658878 - RNA, 16 nt, Escherichia coli CFT073
ugcaggcuauuucugg

SEQ ID NO: 2658879 - RNA, 15 nt, Escherichia coli CFT073
ugcaggcucaggcug

SEQ ID NO: 2658880 - RNA, 14 nt, Escherichia coli CFT073
ugcagggauggcuc

SEQ ID NO: 2658881 - RNA, 21 nt, Escherichia coli CFT073
ugcagggcaaacuccgagaga

SEQ ID NO: 2658882 - RNA, 18 nt, Escherichia coli CFT073
ugcagggcaauagccagc

SEQ ID NO: 2658883 - RNA, 21 nt, Escherichia coli CFT073
ugcagggcaauagccagcgcc

SEQ ID NO: 2658884 - RNA, 22 nt, Escherichia coli CFT073
ugcagggcuuuuuaaugcaaua

SEQ ID NO: 2658885 - RNA, 18 nt, Escherichia coli CFT073
ugccacucuccugguugu

SEQ ID NO: 2658886 - RNA, 20 nt, Escherichia coli CFT073
ugccacuggauguugcauua

SEQ ID NO: 2658887 - RNA, 11 nt, Escherichia coli CFT073
ugccacuucau

SEQ ID NO: 2658888 - RNA, 20 nt, Escherichia coli CFT073
ugccacuucguaaccggccu

SEQ ID NO: 2658889 - RNA, 15 nt, Escherichia coli CFT073
ugccacuucuuccag

SEQ ID NO: 2658890 - RNA, 12 nt, Escherichia coli CFT073
ugccagaaacau

SEQ ID NO: 2658891 - RNA, 18 nt, Escherichia coli CFT073
ugccagaaaccagccacg

SEQ ID NO: 2658892 - RNA, 13 nt, Escherichia coli CFT073
ugccagaacagaa

SEQ ID NO: 2658893 - RNA, 15 nt, Escherichia coli CFT073
ugccagacaaaccac

SEQ ID NO: 2658894 - RNA, 18 nt, Escherichia coli CFT073
ugccagaccgaacagcau

SEQ ID NO: 2658895 - RNA, 16 nt, Escherichia coli CFT073
ugccagagcacugcau

SEQ ID NO: 2658896 - RNA, 23 nt, Escherichia coli CFT073
ugccagagcacugcauucggcga

SEQ ID NO: 2658897 - RNA, 20 nt, Escherichia coli CFT073
ugccagaguuccugcauauc

SEQ ID NO: 2658898 - RNA, 21 nt, Escherichia coli CFT073
ugccagauaaauauuauuggc

SEQ ID NO: 2658899 - RNA, 16 nt, Escherichia coli CFT073
ugccagauaauggcug

SEQ ID NO: 2658900 - RNA, 19 nt, Escherichia coli CFT073
ugccagauggcauccagag

SEQ ID NO: 2658901 - RNA, 14 nt, Escherichia coli CFT073
ugccagauucucca

SEQ ID NO: 2658902 - RNA, 20 nt, Escherichia coli CFT073
ugccagauuuaacggcagca

SEQ ID NO: 2658903 - RNA, 19 nt, Escherichia coli CFT073
ugccagcaacuguaacgca

SEQ ID NO: 2658904 - RNA, 19 nt, Escherichia coli CFT073
ugccagcaagcgcaccgau

SEQ ID NO: 2658905 - RNA, 13 nt, Escherichia coli CFT073
ugccagcacagau

SEQ ID NO: 2658906 - RNA, 19 nt, Escherichia coli CFT073
ugccagcacagaucgcacu

SEQ ID NO: 2658907 - RNA, 23 nt, Escherichia coli CFT073
ugccagcaccaaacuggaauagc

SEQ ID NO: 2658908 - RNA, 12 nt, Escherichia coli CFT073
ugccagcaccac

SEQ ID NO: 2658909 - RNA, 13 nt, Escherichia coli CFT073
ugccagcaccauc

SEQ ID NO: 2658910 - RNA, 16 nt, Escherichia coli CFT073
ugccagcacugccagc

SEQ ID NO: 2658911 - RNA, 14 nt, Escherichia coli CFT073
ugccagcagacgcc

SEQ ID NO: 2658912 - RNA, 11 nt, Escherichia coli CFT073
ugccagcagag

SEQ ID NO: 2658913 - RNA, 15 nt, Escherichia coli CFT073
ugccagcagcaacca

SEQ ID NO: 2658914 - RNA, 13 nt, Escherichia coli CFT073
ugccagcagcacc

SEQ ID NO: 2658915 - RNA, 14 nt, Escherichia coli CFT073
ugccagcagcaccc

SEQ ID NO: 2658916 - RNA, 16 nt, Escherichia coli CFT073
ugccagcagcacccga

SEQ ID NO: 2658917 - RNA, 24 nt, Escherichia coli CFT073
ugccagcauaaucaccaucagcag

SEQ ID NO: 2658918 - RNA, 20 nt, Escherichia coli CFT073
ugccagcauaccgccgagga

SEQ ID NO: 2658919 - RNA, 20 nt, Escherichia coli CFT073
ugccagccacacugcggcca

SEQ ID NO: 2658920 - RNA, 23 nt, Escherichia coli CFT073
ugccagccacacugcggccagca

SEQ ID NO: 2658921 - RNA, 18 nt, Escherichia coli CFT073
ugccagccacaggccggu

SEQ ID NO: 2658922 - RNA, 20 nt, Escherichia coli CFT073
ugccagccauaccuggugca

SEQ ID NO: 2658923 - RNA, 12 nt, Escherichia coli CFT073
ugccagccccuc

SEQ ID NO: 2658924 - RNA, 18 nt, Escherichia coli CFT073
ugccagccccucagcggu

SEQ ID NO: 2658925 - RNA, 17 nt, Escherichia coli CFT073
ugccagccgucgucgcg

SEQ ID NO: 2658926 - RNA, 22 nt, Escherichia coli CFT073
ugccagccuucgggcuggcauu

SEQ ID NO: 2658927 - RNA, 21 nt, Escherichia coli CFT073
ugccagcgacugugaaguauu

SEQ ID NO: 2658928 - RNA, 19 nt, Escherichia coli CFT073
ugccagcguaaauccugac

SEQ ID NO: 2658929 - RNA, 23 nt, Escherichia coli CFT073
ugccagcguaccaugauccugca

SEQ ID NO: 2658930 - RNA, 19 nt, Escherichia coli CFT073
ugccagcguauaacacacc

SEQ ID NO: 2658931 - RNA, 13 nt, Escherichia coli CFT073
ugccagcugcuca

SEQ ID NO: 2658932 - RNA, 19 nt, Escherichia coli CFT073
ugccagcuugcuuuccagc

SEQ ID NO: 2658933 - RNA, 15 nt, Escherichia coli CFT073
ugccaggaccauuca

SEQ ID NO: 2658934 - RNA, 19 nt, Escherichia coli CFT073
ugccaggaccgcugaaaua

SEQ ID NO: 2658935 - RNA, 19 nt, Escherichia coli CFT073
ugccaggcagcgauuaacu

SEQ ID NO: 2658936 - RNA, 16 nt, Escherichia coli CFT073
ugccaggcccaauaau

SEQ ID NO: 2658937 - RNA, 23 nt, Escherichia coli CFT073
ugccaggccgauagacacugccg

SEQ ID NO: 2658938 - RNA, 15 nt, Escherichia coli CFT073
ugccaggcuccagau

SEQ ID NO: 2658939 - RNA, 17 nt, Escherichia coli CFT073
ugccaggcuccagauaa

SEQ ID NO: 2658940 - RNA, 23 nt, Escherichia coli CFT073
ugccaggcuggcagaugcgucuu

SEQ ID NO: 2658941 - RNA, 14 nt, Escherichia coli CFT073
ugccagggugcagg

SEQ ID NO: 2658942 - RNA, 11 nt, Escherichia coli CFT073
ugccagguaac

SEQ ID NO: 2658943 - RNA, 20 nt, Escherichia coli CFT073
ugccagguagcguuucaccu

SEQ ID NO: 2658944 - RNA, 16 nt, Escherichia coli CFT073
ugccaggucgcuugcc

SEQ ID NO: 2658945 - RNA, 18 nt, Escherichia coli CFT073
ugccaggucgcuugccgc

SEQ ID NO: 2658946 - RNA, 22 nt, Escherichia coli CFT073
ugccaggucgcuugccgccagu

SEQ ID NO: 2658947 - RNA, 19 nt, Escherichia coli CFT073
ugccaggugaucccccugg

SEQ ID NO: 2658948 - RNA, 17 nt, Escherichia coli CFT073
ugccaggugcagcccau

SEQ ID NO: 2658949 - RNA, 23 nt, Escherichia coli CFT073
ugccaguaagcaguccagcgccu

SEQ ID NO: 2658950 - RNA, 21 nt, Escherichia coli CFT073
ugccaguaaugcgcaggguaa

SEQ ID NO: 2658951 - RNA, 14 nt, Escherichia coli CFT073
ugccaguaauucca

SEQ ID NO: 2658952 - RNA, 20 nt, Escherichia coli CFT073
ugccaguaauuccacaccaa

SEQ ID NO: 2658953 - RNA, 17 nt, Escherichia coli CFT073
ugccagucacugugacg

SEQ ID NO: 2658954 - RNA, 21 nt, Escherichia coli CFT073
ugccagucagcuccacaagaa

SEQ ID NO: 2658955 - RNA, 19 nt, Escherichia coli CFT073
ugccagucgguagugccgu

SEQ ID NO: 2658956 - RNA, 18 nt, Escherichia coli CFT073
ugccagucuuccgccgga

SEQ ID NO: 2658957 - RNA, 15 nt, Escherichia coli CFT073
ugccagugcaaaaaa

SEQ ID NO: 2658958 - RNA, 15 nt, Escherichia coli CFT073
ugccaguuuacccag

SEQ ID NO: 2658959 - RNA, 14 nt, Escherichia coli CFT073
ugccaguuuauuuc

SEQ ID NO: 2658960 - RNA, 19 nt, Escherichia coli CFT073
ugccaguuucuuuuaacaa

SEQ ID NO: 2658961 - RNA, 18 nt, Escherichia coli CFT073
ugccauacgccggauggg

SEQ ID NO: 2658962 - RNA, 21 nt, Escherichia coli CFT073
ugccauagcgggcaaucagcg

SEQ ID NO: 2658963 - RNA, 16 nt, Escherichia coli CFT073
ugccauauaacgggcu

SEQ ID NO: 2658964 - RNA, 23 nt, Escherichia coli CFT073
ugccauauaacguccaguugaag

SEQ ID NO: 2658965 - RNA, 23 nt, Escherichia coli CFT073
ugccauauuugcuuucagcgagu

SEQ ID NO: 2658966 - RNA, 15 nt, Escherichia coli CFT073
ugccaucaauaauca

SEQ ID NO: 2658967 - RNA, 21 nt, Escherichia coli CFT073
ugccaucaaucacuuugcgcu

SEQ ID NO: 2658968 - RNA, 13 nt, Escherichia coli CFT073
ugccaucaccaac

SEQ ID NO: 2658969 - RNA, 23 nt, Escherichia coli CFT073
ugccaucacggcagccugacgcc

SEQ ID NO: 2658970 - RNA, 17 nt, Escherichia coli CFT073
ugccauccccauucgga

SEQ ID NO: 2658971 - RNA, 19 nt, Escherichia coli CFT073
ugccaucgacgaaauggug

SEQ ID NO: 2658972 - RNA, 17 nt, Escherichia coli CFT073
ugccaucgacuucucgc

SEQ ID NO: 2658973 - RNA, 18 nt, Escherichia coli CFT073
ugccaucgcaugacgcaa

SEQ ID NO: 2658974 - RNA, 17 nt, Escherichia coli CFT073
ugccaucgccacaccag

SEQ ID NO: 2658975 - RNA, 21 nt, Escherichia coli CFT073
ugccaucgugcuucacuucag

SEQ ID NO: 2658976 - RNA, 16 nt, Escherichia coli CFT073
ugccaucucacuuuga

SEQ ID NO: 2658977 - RNA, 18 nt, Escherichia coli CFT073
ugccaucucacuuugaga

SEQ ID NO: 2658978 - RNA, 20 nt, Escherichia coli CFT073
ugccaucucggauaaggcuu

SEQ ID NO: 2658979 - RNA, 14 nt, Escherichia coli CFT073
ugccaucucugcaa

SEQ ID NO: 2658980 - RNA, 19 nt, Escherichia coli CFT073
ugccaugaucguuaaaucc

SEQ ID NO: 2658981 - RNA, 18 nt, Escherichia coli CFT073
ugccaugcacgcaaaaac

SEQ ID NO: 2658982 - RNA, 13 nt, Escherichia coli CFT073
ugccaugcauauc

SEQ ID NO: 2658983 - RNA, 15 nt, Escherichia coli CFT073
ugccaugccaaacag

SEQ ID NO: 2658984 - RNA, 16 nt, Escherichia coli CFT073
ugccauguucaucaag

SEQ ID NO: 2658985 - RNA, 15 nt, Escherichia coli CFT073
ugccauguuuuccuu

SEQ ID NO: 2658986 - RNA, 14 nt, Escherichia coli CFT073
ugccauuaaaccaa

SEQ ID NO: 2658987 - RNA, 23 nt, Escherichia coli CFT073
ugccauuaaaccaacaaaacuca

SEQ ID NO: 2658988 - RNA, 15 nt, Escherichia coli CFT073
ugccauuaacuccac

SEQ ID NO: 2658989 - RNA, 15 nt, Escherichia coli CFT073
ugccauuaaugucgg

SEQ ID NO: 2658990 - RNA, 15 nt, Escherichia coli CFT073
ugccauucacuucau

SEQ ID NO: 2658991 - RNA, 16 nt, Escherichia coli CFT073
ugccauucacuucaua

SEQ ID NO: 2658992 - RNA, 13 nt, Escherichia coli CFT073
ugccauucaguuu

SEQ ID NO: 2658993 - RNA, 21 nt, Escherichia coli CFT073
ugccgggugauuucaaaauua

SEQ ID NO: 2658994 - RNA, 24 nt, Escherichia coli CFT073
ugccgggugcgaugcauccggcac

SEQ ID NO: 2658995 - RNA, 21 nt, Escherichia coli CFT073
ugccggguuuaagcccggcau

SEQ ID NO: 2658996 - RNA, 14 nt, Escherichia coli CFT073
ugccgguaaugcug

SEQ ID NO: 2658997 - RNA, 19 nt, Escherichia coli CFT073
ugccggucagacagcgauu

SEQ ID NO: 2658998 - RNA, 19 nt, Escherichia coli CFT073
ugccggugaugagcagguu

SEQ ID NO: 2658999 - RNA, 23 nt, Escherichia coli CFT073
ugccggugggaugaagcaacugg

SEQ ID NO: 2659000 - RNA, 16 nt, Escherichia coli CFT073
ugccgguuucacguug

SEQ ID NO: 2659001 - RNA, 14 nt, Escherichia coli CFT073
ugccguaaucgccu

SEQ ID NO: 2659002 - RNA, 14 nt, Escherichia coli CFT073
ugccguacaggcag

SEQ ID NO: 2659003 - RNA, 14 nt, Escherichia coli CFT073
ugccguagcggcga

SEQ ID NO: 2659004 - RNA, 14 nt, Escherichia coli CFT073
ugccguauaacgcg

SEQ ID NO: 2659005 - RNA, 21 nt, Escherichia coli CFT073
ugccgucaauuuuaagcagau

SEQ ID NO: 2659006 - RNA, 14 nt, Escherichia coli CFT073
ugccgucaccagca

SEQ ID NO: 2659007 - RNA, 21 nt, Escherichia coli CFT073
ugccgucugggcaaaaucauc

SEQ ID NO: 2659008 - RNA, 23 nt, Escherichia coli CFT073
ugccgucuucguuuugcuguucc

SEQ ID NO: 2659009 - RNA, 14 nt, Escherichia coli CFT073
ugccguuaauaaua

SEQ ID NO: 2659010 - RNA, 19 nt, Escherichia coli CFT073
ugccguuauacaucgcuuu

SEQ ID NO: 2659011 - RNA, 12 nt, Escherichia coli CFT073
ugccguucccag

SEQ ID NO: 2659012 - RNA, 22 nt, Escherichia coli CFT073
ugccguuggcggcgugacgcca

SEQ ID NO: 2659013 - RNA, 19 nt, Escherichia coli CFT073
ugccguugugcugauguca

SEQ ID NO: 2659014 - RNA, 23 nt, Escherichia coli CFT073
ugccguuuccugggccagcacca

SEQ ID NO: 2659015 - RNA, 18 nt, Escherichia coli CFT073
ugccguuugcugcaugau

SEQ ID NO: 2659016 - RNA, 22 nt, Escherichia coli CFT073
ugccguuuguaggccugauaag

SEQ ID NO: 2659017 - RNA, 13 nt, Escherichia coli CFT073
ugccguuuuaccu

SEQ ID NO: 2659018 - RNA, 24 nt, Escherichia coli CFT073
ugccuaaagugcugggcuggguga

SEQ ID NO: 2659019 - RNA, 21 nt, Escherichia coli CFT073
ugccuacagagcugauuuccg

SEQ ID NO: 2659020 - RNA, 13 nt, Escherichia coli CFT073
ugccuauuuugua

SEQ ID NO: 2659021 - RNA, 17 nt, Escherichia coli CFT073
ugccucacgcaaauucu

SEQ ID NO: 2659022 - RNA, 20 nt, Escherichia coli CFT073
ugccucacgcaaauucuucg

SEQ ID NO: 2659023 - RNA, 24 nt, Escherichia coli CFT073
ugccucaggcaacggugacuggcu

SEQ ID NO: 2659024 - RNA, 13 nt, Escherichia coli CFT073
ugccucccauuca

SEQ ID NO: 2659025 - RNA, 12 nt, Escherichia coli CFT073
ugccucgcccac

SEQ ID NO: 2659026 - RNA, 22 nt, Escherichia coli CFT073
ugccucuccccagcggaaaaua

SEQ ID NO: 2659027 - RNA, 11 nt, Escherichia coli CFT073
ugccugaaaaa

SEQ ID NO: 2659028 - RNA, 16 nt, Escherichia coli CFT073
ugccugaaauuuaucu

SEQ ID NO: 2659029 - RNA, 12 nt, Escherichia coli CFT073
ugccugacagac

SEQ ID NO: 2659030 - RNA, 23 nt, Escherichia coli CFT073
ugccugacgaaugguuucacgcu

SEQ ID NO: 2659031 - RNA, 16 nt, Escherichia coli CFT073
ugccugacgaugcguc

SEQ ID NO: 2659032 - RNA, 17 nt, Escherichia coli CFT073
ugccugaugcgacgcug

SEQ ID NO: 2659033 - RNA, 17 nt, Escherichia coli CFT073
ugccugauggccugcuc

SEQ ID NO: 2659034 - RNA, 12 nt, Escherichia coli CFT073
ugccugauuacg

SEQ ID NO: 2659035 - RNA, 20 nt, Escherichia coli CFT073
ugccugauucagcaacucgu

SEQ ID NO: 2659036 - RNA, 13 nt, Escherichia coli CFT073
ugccugcacucag

SEQ ID NO: 2659037 - RNA, 17 nt, Escherichia coli CFT073
ugccugccagcuugcga

SEQ ID NO: 2659038 - RNA, 16 nt, Escherichia coli CFT073
ugccugccaugccaaa

SEQ ID NO: 2659039 - RNA, 15 nt, Escherichia coli CFT073
ugccugcggaucaag

SEQ ID NO: 2659040 - RNA, 23 nt, Escherichia coli CFT073
ugccugcgugcauaucgcuguug

SEQ ID NO: 2659041 - RNA, 19 nt, Escherichia coli CFT073
ugccugcuauuuaccgcua

SEQ ID NO: 2659042 - RNA, 20 nt, Escherichia coli CFT073
ugccugcugugccagcucca

SEQ ID NO: 2659043 - RNA, 16 nt, Escherichia coli CFT073
ugccuggcgaauugcc

SEQ ID NO: 2659044 - RNA, 15 nt, Escherichia coli CFT073
ugccugguuucucuc

SEQ ID NO: 2659045 - RNA, 20 nt, Escherichia coli CFT073
ugccugguuucucuccgugu

SEQ ID NO: 2659046 - RNA, 21 nt, Escherichia coli CFT073
ugccuguccucuucagcauca

SEQ ID NO: 2659047 - RNA, 22 nt, Escherichia coli CFT073
ugccugugcaaccuuuuccauu

SEQ ID NO: 2659048 - RNA, 14 nt, Escherichia coli CFT073
ugccuguucgccgc

SEQ ID NO: 2659049 - RNA, 16 nt, Escherichia coli CFT073
ugccuguucgccgccg

SEQ ID NO: 2659050 - RNA, 15 nt, Escherichia coli CFT073
ugccuuaccgcuugg

SEQ ID NO: 2659051 - RNA, 15 nt, Escherichia coli CFT073
ugccuucaaaucgcc

SEQ ID NO: 2659052 - RNA, 18 nt, Escherichia coli CFT073
ugccuucacaggccgcca

SEQ ID NO: 2659053 - RNA, 20 nt, Escherichia coli CFT073
ugccuucaguuuccagcaaa

SEQ ID NO: 2659054 - RNA, 16 nt, Escherichia coli CFT073
ugccuucgaagguaaa

SEQ ID NO: 2659055 - RNA, 22 nt, Escherichia coli CFT073
ugccuugaguuuuucaucccuc

SEQ ID NO: 2659056 - RNA, 21 nt, Escherichia coli CFT073
ugccuugauauguauuauaag

SEQ ID NO: 2659057 - RNA, 12 nt, Escherichia coli CFT073
ugccuugccagg

SEQ ID NO: 2659058 - RNA, 16 nt, Escherichia coli CFT073
ugccuugcgauauccc

SEQ ID NO: 2659059 - RNA, 13 nt, Escherichia coli CFT073
ugccuugcucuuc

SEQ ID NO: 2659060 - RNA, 18 nt, Escherichia coli CFT073
ugccuugugggccugaaa

SEQ ID NO: 2659061 - RNA, 17 nt, Escherichia coli CFT073
ugccuugugggcuauaa

SEQ ID NO: 2659062 - RNA, 23 nt, Escherichia coli CFT073
ugccuuuaccgccacagcagccu

SEQ ID NO: 2659063 - RNA, 11 nt, Escherichia coli CFT073
ugccuuucaug

SEQ ID NO: 2659064 - RNA, 15 nt, Escherichia coli CFT073
ugccuuucccuuucu

SEQ ID NO: 2659065 - RNA, 16 nt, Escherichia coli CFT073
ugccuuucuuuguucu

SEQ ID NO: 2659066 - RNA, 20 nt, Escherichia coli CFT073
ugccuuucuuuguucuucug

SEQ ID NO: 2659067 - RNA, 22 nt, Escherichia coli CFT073
ugcgaaaacgauguuugcugcg

SEQ ID NO: 2659068 - RNA, 17 nt, Escherichia coli CFT073
ugcgaaacagaaauaga

SEQ ID NO: 2659069 - RNA, 11 nt, Escherichia coli CFT073
ugcgaaacgga

SEQ ID NO: 2659070 - RNA, 13 nt, Escherichia coli CFT073
ugcgaagcuuugc

SEQ ID NO: 2659071 - RNA, 15 nt, Escherichia coli CFT073
ugcgaaguuuuuccg

SEQ ID NO: 2659072 - RNA, 20 nt, Escherichia coli CFT073
ugcgaauagcgucuacuaac

SEQ ID NO: 2659073 - RNA, 20 nt, Escherichia coli CFT073
ugcgacaaacauugcugcca

SEQ ID NO: 2659074 - RNA, 14 nt, Escherichia coli CFT073
ugcgacaagcucau

SEQ ID NO: 2659075 - RNA, 13 nt, Escherichia coli CFT073
ugcgacaccagca

SEQ ID NO: 2659076 - RNA, 14 nt, Escherichia coli CFT073
ugcgacaccagcau

SEQ ID NO: 2659077 - RNA, 16 nt, Escherichia coli CFT073
ugcgacagauucgcgg

SEQ ID NO: 2659078 - RNA, 14 nt, Escherichia coli CFT073
ugcgacagccaucc

SEQ ID NO: 2659079 - RNA, 20 nt, Escherichia coli CFT073
ugcgacaguaagcccaccac

SEQ ID NO: 2659080 - RNA, 20 nt, Escherichia coli CFT073
ugcgacauaaacguauuaug

SEQ ID NO: 2659081 - RNA, 18 nt, Escherichia coli CFT073
ugcgacaugcgaucccau

SEQ ID NO: 2659082 - RNA, 15 nt, Escherichia coli CFT073
ugcgaccaaacugcu

SEQ ID NO: 2659083 - RNA, 14 nt, Escherichia coli CFT073
ugcgaccagcagcg

SEQ ID NO: 2659084 - RNA, 21 nt, Escherichia coli CFT073
ugcgaccagcagcguuuugua

SEQ ID NO: 2659085 - RNA, 16 nt, Escherichia coli CFT073
ugcgaccguacaacca

SEQ ID NO: 2659086 - RNA, 15 nt, Escherichia coli CFT073
ugcgacgcgauccgc

SEQ ID NO: 2659087 - RNA, 18 nt, Escherichia coli CFT073
ugcgacgcgggccgcguc

SEQ ID NO: 2659088 - RNA, 23 nt, Escherichia coli CFT073
ugcgacgcugguugcgucuuauc

SEQ ID NO: 2659089 - RNA, 22 nt, Escherichia coli CFT073
ugcgacgcugucgcgucuuauc

SEQ ID NO: 2659090 - RNA, 23 nt, Escherichia coli CFT073
ugcgacgcuugaugcgucuuauc

SEQ ID NO: 2659091 - RNA, 19 nt, Escherichia coli CFT073
ugcgacgcuugccgcgucu

SEQ ID NO: 2659092 - RNA, 23 nt, Escherichia coli CFT073
ugcgacgcuugccgcgucuuauc

SEQ ID NO: 2659093 - RNA, 18 nt, Escherichia coli CFT073
ugcgacggacgcccgccg

SEQ ID NO: 2659094 - RNA, 22 nt, Escherichia coli CFT073
ugcgacggacgcccgccgacca

SEQ ID NO: 2659095 - RNA, 20 nt, Escherichia coli CFT073
ugcgacuucauucagacagg

SEQ ID NO: 2659096 - RNA, 21 nt, Escherichia coli CFT073
ugcgagaacgacguaccguca

SEQ ID NO: 2659097 - RNA, 21 nt, Escherichia coli CFT073
ugcgagacggcggaaagggcc

SEQ ID NO: 2659098 - RNA, 14 nt, Escherichia coli CFT073
ugcgagcucaauau

SEQ ID NO: 2659099 - RNA, 17 nt, Escherichia coli CFT073
ugcgagguuauccgcca

SEQ ID NO: 2659100 - RNA, 15 nt, Escherichia coli CFT073
ugcgaguaaucaggc

SEQ ID NO: 2659101 - RNA, 16 nt, Escherichia coli CFT073
ugcggcauaaacgccu

SEQ ID NO: 2659102 - RNA, 20 nt, Escherichia coli CFT073
ugcggcauaaacgccuuauc

SEQ ID NO: 2659103 - RNA, 16 nt, Escherichia coli CFT073
ugcggcaucauacacg

SEQ ID NO: 2659104 - RNA, 17 nt, Escherichia coli CFT073
ugcggcaucuucuccac

SEQ ID NO: 2659105 - RNA, 16 nt, Escherichia coli CFT073
ugcggcauuucgccga

SEQ ID NO: 2659106 - RNA, 22 nt, Escherichia coli CFT073
ugcggccaaaaaggggaaaaau

SEQ ID NO: 2659107 - RNA, 22 nt, Escherichia coli CFT073
ugcggcgaaaacgccucauccg

SEQ ID NO: 2659108 - RNA, 21 nt, Escherichia coli CFT073
ugcggcgagaacgccuuaucc

SEQ ID NO: 2659109 - RNA, 18 nt, Escherichia coli CFT073
ugcggcgaugaccgccac

SEQ ID NO: 2659110 - RNA, 18 nt, Escherichia coli CFT073
ugcggcgcaccagcaggc

SEQ ID NO: 2659111 - RNA, 20 nt, Escherichia coli CFT073
ugcggcgcgagcgccuuauc

SEQ ID NO: 2659112 - RNA, 21 nt, Escherichia coli CFT073
ugcggcgcgagcgccuuaucc

SEQ ID NO: 2659113 - RNA, 18 nt, Escherichia coli CFT073
ugcggcggugcuugcuca

SEQ ID NO: 2659114 - RNA, 14 nt, Escherichia coli CFT073
ugcggcguaccaau

SEQ ID NO: 2659115 - RNA, 20 nt, Escherichia coli CFT073
ugcggcgugaacgccuucuc

SEQ ID NO: 2659116 - RNA, 15 nt, Escherichia coli CFT073
ugcggcgugauaaaa

SEQ ID NO: 2659117 - RNA, 12 nt, Escherichia coli CFT073
ugcggcucgucc

SEQ ID NO: 2659118 - RNA, 13 nt, Escherichia coli CFT073
ugcggcugcaucu

SEQ ID NO: 2659119 - RNA, 15 nt, Escherichia coli CFT073
ugcggcuucaacuga

SEQ ID NO: 2659120 - RNA, 22 nt, Escherichia coli CFT073
ugcgggagcgcuuuuuccugcc

SEQ ID NO: 2659121 - RNA, 15 nt, Escherichia coli CFT073
ugcgggaguggcgaa

SEQ ID NO: 2659122 - RNA, 18 nt, Escherichia coli CFT073
ugcgggaguugaucgcca

SEQ ID NO: 2659123 - RNA, 21 nt, Escherichia coli CFT073
ugcgggaguugcuccacugcu

SEQ ID NO: 2659124 - RNA, 13 nt, Escherichia coli CFT073
ugcgggccaaaga

SEQ ID NO: 2659125 - RNA, 19 nt, Escherichia coli CFT073
ugcgggcgaucauauccag

SEQ ID NO: 2659126 - RNA, 15 nt, Escherichia coli CFT073
ugcggguaaccagcc

SEQ ID NO: 2659127 - RNA, 21 nt, Escherichia coli CFT073
ugcggguaggcaccugaaucu

SEQ ID NO: 2659128 - RNA, 22 nt, Escherichia coli CFT073
ugcggguucuggcgcagcgcag

SEQ ID NO: 2659129 - RNA, 20 nt, Escherichia coli CFT073
ugcggguugcucucgccagc

SEQ ID NO: 2659130 - RNA, 18 nt, Escherichia coli CFT073
ugcgguaacaggauggca

SEQ ID NO: 2659131 - RNA, 22 nt, Escherichia coli CFT073
ugcgguaacuccggcauaauaa

SEQ ID NO: 2659132 - RNA, 17 nt, Escherichia coli CFT073
ugcgguagcgggcgcaa

SEQ ID NO: 2659133 - RNA, 14 nt, Escherichia coli CFT073
ugcgguaucaccac

SEQ ID NO: 2659134 - RNA, 13 nt, Escherichia coli CFT073
ugcggucacgcug

SEQ ID NO: 2659135 - RNA, 17 nt, Escherichia coli CFT073
ugcggucagcgcagcaa

SEQ ID NO: 2659136 - RNA, 16 nt, Escherichia coli CFT073
ugcggucgcugccgcc

SEQ ID NO: 2659137 - RNA, 19 nt, Escherichia coli CFT073
ugcggucuggcagcuaaug

SEQ ID NO: 2659138 - RNA, 15 nt, Escherichia coli CFT073
ugcggugacagagga

SEQ ID NO: 2659139 - RNA, 15 nt, Escherichia coli CFT073
ugcggugcagcagcu

SEQ ID NO: 2659140 - RNA, 16 nt, Escherichia coli CFT073
ugcgguguaaaccagc

SEQ ID NO: 2659141 - RNA, 16 nt, Escherichia coli CFT073
ugcgguuucagcucac

SEQ ID NO: 2659142 - RNA, 16 nt, Escherichia coli CFT073
ugcgguuugucaucau

SEQ ID NO: 2659143 - RNA, 16 nt, Escherichia coli CFT073
ugcgguuuugucggca

SEQ ID NO: 2659144 - RNA, 14 nt, Escherichia coli CFT073
ugcguaaucuuuuc

SEQ ID NO: 2659145 - RNA, 14 nt, Escherichia coli CFT073
ugcguacaccaaca

SEQ ID NO: 2659146 - RNA, 15 nt, Escherichia coli CFT073
ugcguacaccaacau

SEQ ID NO: 2659147 - RNA, 20 nt, Escherichia coli CFT073
ugcguagucugaccucuucu

SEQ ID NO: 2659148 - RNA, 21 nt, Escherichia coli CFT073
ugcguagucugaccucuucua

SEQ ID NO: 2659149 - RNA, 12 nt, Escherichia coli CFT073
ugcgucaacgcc

SEQ ID NO: 2659150 - RNA, 23 nt, Escherichia coli CFT073
ugcgucaagcgguaaccauccau

SEQ ID NO: 2659151 - RNA, 18 nt, Escherichia coli CFT073
ugcgucacguaggcuuca

SEQ ID NO: 2659152 - RNA, 14 nt, Escherichia coli CFT073
ugcgucaucggcag

SEQ ID NO: 2659153 - RNA, 16 nt, Escherichia coli CFT073
ugcgucgcacucucaa

SEQ ID NO: 2659154 - RNA, 17 nt, Escherichia coli CFT073
ugcgucgcauccggcaa

SEQ ID NO: 2659155 - RNA, 22 nt, Escherichia coli CFT073
ugcgucgcauccggcaauucuc

SEQ ID NO: 2659156 - RNA, 17 nt, Escherichia coli CFT073
ugcgucggaacaucgau

SEQ ID NO: 2659157 - RNA, 17 nt, Escherichia coli CFT073
ugcgucuuaucaggccu

SEQ ID NO: 2659158 - RNA, 20 nt, Escherichia coli CFT073
ugcgucuuaucaggccuaca

SEQ ID NO: 2659159 - RNA, 12 nt, Escherichia coli CFT073
ugcgucuuccac

SEQ ID NO: 2659160 - RNA, 17 nt, Escherichia coli CFT073
ugcgugcaguuccugcu

SEQ ID NO: 2659161 - RNA, 13 nt, Escherichia coli CFT073
ugcgugcuggcug

SEQ ID NO: 2659162 - RNA, 21 nt, Escherichia coli CFT073
ugcguggcagauuaggauuaa

SEQ ID NO: 2659163 - RNA, 19 nt, Escherichia coli CFT073
ugcguggcaucaaacaccg

SEQ ID NO: 2659164 - RNA, 20 nt, Escherichia coli CFT073
ugcguuaagacuuuuuucau

SEQ ID NO: 2659165 - RNA, 18 nt, Escherichia coli CFT073
ugcguuaauauugugugc

SEQ ID NO: 2659166 - RNA, 21 nt, Escherichia coli CFT073
ugcguuacacagaguuugccg

SEQ ID NO: 2659167 - RNA, 19 nt, Escherichia coli CFT073
ugcguuacccacaguuuca

SEQ ID NO: 2659168 - RNA, 22 nt, Escherichia coli CFT073
ugcguuagaaaacgccugcucc

SEQ ID NO: 2659169 - RNA, 15 nt, Escherichia coli CFT073
ugcguuauagcgauu

SEQ ID NO: 2659170 - RNA, 13 nt, Escherichia coli CFT073
ugcguuauuuuca

SEQ ID NO: 2659171 - RNA, 21 nt, Escherichia coli CFT073
ugcguuccagcauguuauuca

SEQ ID NO: 2659172 - RNA, 13 nt, Escherichia coli CFT073
ugcguucgcacca

SEQ ID NO: 2659173 - RNA, 21 nt, Escherichia coli CFT073
ugcguugacucgguaaaauca

SEQ ID NO: 2659174 - RNA, 17 nt, Escherichia coli CFT073
ugcguugagaaacgccg

SEQ ID NO: 2659175 - RNA, 22 nt, Escherichia coli CFT073
ugcguugcagcaaauaaaacug

SEQ ID NO: 2659176 - RNA, 22 nt, Escherichia coli CFT073
ugcguuguagcuuuuuccucag

SEQ ID NO: 2659177 - RNA, 22 nt, Escherichia coli CFT073
ugcguugucaucgaauaaauug

SEQ ID NO: 2659178 - RNA, 13 nt, Escherichia coli CFT073
ugcguuuuuucac

SEQ ID NO: 2659179 - RNA, 18 nt, Escherichia coli CFT073
ugcuaaaugucaucccuu

SEQ ID NO: 2659180 - RNA, 22 nt, Escherichia coli CFT073
ugcuaaccaacaauacaaaaua

SEQ ID NO: 2659181 - RNA, 17 nt, Escherichia coli CFT073
ugcuaauugcaccaucc

SEQ ID NO: 2659182 - RNA, 21 nt, Escherichia coli CFT073
ugcuacaggguaaaaagaggu

SEQ ID NO: 2659183 - RNA, 14 nt, Escherichia coli CFT073
ugcuacccacuucc

SEQ ID NO: 2659184 - RNA, 18 nt, Escherichia coli CFT073
ugcuacugcuucaaaguu

SEQ ID NO: 2659185 - RNA, 13 nt, Escherichia coli CFT073
ugcuagauaagca

SEQ ID NO: 2659186 - RNA, 22 nt, Escherichia coli CFT073
ugcuaucggcgauguagcgcug

SEQ ID NO: 2659187 - RNA, 17 nt, Escherichia coli CFT073
ugcuaugcauacacaga

SEQ ID NO: 2659188 - RNA, 17 nt, Escherichia coli CFT073
ugcuauuuaacaauucu

SEQ ID NO: 2659189 - RNA, 14 nt, Escherichia coli CFT073
ugcucaacaauaaa

SEQ ID NO: 2659190 - RNA, 15 nt, Escherichia coli CFT073
ugcucacaccaugcc

SEQ ID NO: 2659191 - RNA, 18 nt, Escherichia coli CFT073
ugcucagaaucacgccaa

SEQ ID NO: 2659192 - RNA, 12 nt, Escherichia coli CFT073
ugcucaggcaga

SEQ ID NO: 2659193 - RNA, 18 nt, Escherichia coli CFT073
ugcucauagaccauugca

SEQ ID NO: 2659194 - RNA, 23 nt, Escherichia coli CFT073
ugcucauagaccauugcaucauc

SEQ ID NO: 2659195 - RNA, 20 nt, Escherichia coli CFT073
ugcucauagcggcugcgcag

SEQ ID NO: 2659196 - RNA, 23 nt, Escherichia coli CFT073
ugcucaucagcgguaaaacgccc

SEQ ID NO: 2659197 - RNA, 16 nt, Escherichia coli CFT073
ugcucauuacaguagc

SEQ ID NO: 2659198 - RNA, 19 nt, Escherichia coli CFT073
ugcucauuacaguagcuau

SEQ ID NO: 2659199 - RNA, 18 nt, Escherichia coli CFT073
ugcucauuagcccggcaa

SEQ ID NO: 2659200 - RNA, 13 nt, Escherichia coli CFT073
ugcucauuccgcc

SEQ ID NO: 2659201 - RNA, 14 nt, Escherichia coli CFT073
ugcuccacgccagc

SEQ ID NO: 2659202 - RNA, 13 nt, Escherichia coli CFT073
ugcuccacugcuc

SEQ ID NO: 2659203 - RNA, 13 nt, Escherichia coli CFT073
ugcuccagcagau

SEQ ID NO: 2659204 - RNA, 17 nt, Escherichia coli CFT073
ugcuccagcagauggca

SEQ ID NO: 2659205 - RNA, 17 nt, Escherichia coli CFT073
ugcuccagcagcucaau

SEQ ID NO: 2659206 - RNA, 23 nt, Escherichia coli CFT073
ugcuccagcagcucaaucgccuc

SEQ ID NO: 2659207 - RNA, 20 nt, Escherichia coli CFT073
ugcuccagcguaccugccgc

SEQ ID NO: 2659208 - RNA, 14 nt, Escherichia coli CFT073
ugcuccaucauccg

SEQ ID NO: 2659209 - RNA, 20 nt, Escherichia coli CFT073
ugcuucuaucgcauuauccu

SEQ ID NO: 2659210 - RNA, 20 nt, Escherichia coli CFT073
ugcuugagcuaauuauuacu

SEQ ID NO: 2659211 - RNA, 22 nt, Escherichia coli CFT073
ugcuugaugcgcugacuguuag

SEQ ID NO: 2659212 - RNA, 15 nt, Escherichia coli CFT073
ugcuugccagagcag

SEQ ID NO: 2659213 - RNA, 14 nt, Escherichia coli CFT073
ugcuuguaaaacag

SEQ ID NO: 2659214 - RNA, 22 nt, Escherichia coli CFT073
ugcuugucaggccggaauaacu

SEQ ID NO: 2659215 - RNA, 19 nt, Escherichia coli CFT073
ugcuuuaaaugucauacua

SEQ ID NO: 2659216 - RNA, 15 nt, Escherichia coli CFT073
ugcuuuaaguucagc

SEQ ID NO: 2659217 - RNA, 15 nt, Escherichia coli CFT073
ugcuuuaaucagcac

SEQ ID NO: 2659218 - RNA, 15 nt, Escherichia coli CFT073
ugcuuucucaacaaa

SEQ ID NO: 2659219 - RNA, 15 nt, Escherichia coli CFT073
ugcuuugaugugcaa

SEQ ID NO: 2659220 - RNA, 16 nt, Escherichia coli CFT073
ugcuuuggcuuucuga

SEQ ID NO: 2659221 - RNA, 21 nt, Escherichia coli CFT073
ugcuuuuaaaugcccgacaaa

SEQ ID NO: 2659222 - RNA, 12 nt, Escherichia coli CFT073
ugcuuuuauuca

SEQ ID NO: 2659223 - RNA, 17 nt, Escherichia coli CFT073
ugcuuuucccuuucaga

SEQ ID NO: 2659224 - RNA, 18 nt, Escherichia coli CFT073
ugcuuuucccuuucagau

SEQ ID NO: 2659225 - RNA, 21 nt, Escherichia coli CFT073
ugcuuuuuccugagucagcag

SEQ ID NO: 2659226 - RNA, 12 nt, Escherichia coli CFT073
ugcuuuuucgcg

SEQ ID NO: 2659227 - RNA, 22 nt, Escherichia coli CFT073
ugcuuuuugugggccugauaag

SEQ ID NO: 2659228 - RNA, 20 nt, Escherichia coli CFT073
uggaaaacagcgccugcaaa

SEQ ID NO: 2659229 - RNA, 22 nt, Escherichia coli CFT073
uggaaaacagcgccugcaaaau

SEQ ID NO: 2659230 - RNA, 22 nt, Escherichia coli CFT073
uggaaaaccgcacucacgcgcc

SEQ ID NO: 2659231 - RNA, 21 nt, Escherichia coli CFT073
uggaaacagcaccauccgccc

SEQ ID NO: 2659232 - RNA, 16 nt, Escherichia coli CFT073
uggaaaccgagauaaa

SEQ ID NO: 2659233 - RNA, 14 nt, Escherichia coli CFT073
uggaaaucaaauac

SEQ ID NO: 2659234 - RNA, 16 nt, Escherichia coli CFT073
uggaaaucaaauacau

SEQ ID NO: 2659235 - RNA, 21 nt, Escherichia coli CFT073
uggaaaucacccagcgaagca

SEQ ID NO: 2659236 - RNA, 23 nt, Escherichia coli CFT073
uggaaaucacccagcgaagcaaa

SEQ ID NO: 2659237 - RNA, 20 nt, Escherichia coli CFT073
uggaaauugucguuauugau

SEQ ID NO: 2659238 - RNA, 23 nt, Escherichia coli CFT073
uggaacaaaauuuucagcgugcc

SEQ ID NO: 2659239 - RNA, 21 nt, Escherichia coli CFT073
uggaacaagucagcgcgaaau

SEQ ID NO: 2659240 - RNA, 23 nt, Escherichia coli CFT073
uggaacacuuugccgucugccac

SEQ ID NO: 2659241 - RNA, 13 nt, Escherichia coli CFT073
uggaacagcugca

SEQ ID NO: 2659242 - RNA, 13 nt, Escherichia coli CFT073
uggaacaucagga

SEQ ID NO: 2659243 - RNA, 16 nt, Escherichia coli CFT073
uggaacauccuuuccu

SEQ ID NO: 2659244 - RNA, 18 nt, Escherichia coli CFT073
uggaacauccuuuccuua

SEQ ID NO: 2659245 - RNA, 19 nt, Escherichia coli CFT073
uggaaccucgcgaaugcuu

SEQ ID NO: 2659246 - RNA, 19 nt, Escherichia coli CFT073
uggaacgauauuaucgaaa

SEQ ID NO: 2659247 - RNA, 19 nt, Escherichia coli CFT073
uggaaguuccggcaccguu

SEQ ID NO: 2659248 - RNA, 17 nt, Escherichia coli CFT073
uggaauacuggugcgau

SEQ ID NO: 2659249 - RNA, 14 nt, Escherichia coli CFT073
uggaauaguaaaag

SEQ ID NO: 2659250 - RNA, 16 nt, Escherichia coli CFT073
uggaaucacucaucau

SEQ ID NO: 2659251 - RNA, 17 nt, Escherichia coli CFT073
uggaaugaccgcuaaua

SEQ ID NO: 2659252 - RNA, 16 nt, Escherichia coli CFT073
uggaauggucaauggu

SEQ ID NO: 2659253 - RNA, 15 nt, Escherichia coli CFT073
uggacaauccgcgag

SEQ ID NO: 2659254 - RNA, 19 nt, Escherichia coli CFT073
uggacccgaugaucaaaaa

SEQ ID NO: 2659255 - RNA, 20 nt, Escherichia coli CFT073
uggacgacagcaacaucguu

SEQ ID NO: 2659256 - RNA, 17 nt, Escherichia coli CFT073
uggacgauuucacccag

SEQ ID NO: 2659257 - RNA, 19 nt, Escherichia coli CFT073
uggacgcaaaaacgcguug

SEQ ID NO: 2659258 - RNA, 21 nt, Escherichia coli CFT073
uggacgcagaccgaagucaaa

SEQ ID NO: 2659259 - RNA, 13 nt, Escherichia coli CFT073
uggacgucgauaa

SEQ ID NO: 2659260 - RNA, 14 nt, Escherichia coli CFT073
uggacgucgauaaa

SEQ ID NO: 2659261 - RNA, 16 nt, Escherichia coli CFT073
uggacgucgauaaaca

SEQ ID NO: 2659262 - RNA, 16 nt, Escherichia coli CFT073
uggacuuccccugcca

SEQ ID NO: 2659263 - RNA, 20 nt, Escherichia coli CFT073
uggacuucuuuauaacccug

SEQ ID NO: 2659264 - RNA, 18 nt, Escherichia coli CFT073
uggagaaauauaaagaau

SEQ ID NO: 2659265 - RNA, 15 nt, Escherichia coli CFT073
uggagacagauuuau

SEQ ID NO: 2659266 - RNA, 18 nt, Escherichia coli CFT073
uggagaguugcaccagca

SEQ ID NO: 2659267 - RNA, 22 nt, Escherichia coli CFT073
uggagaguugcaccagcaauaa

SEQ ID NO: 2659268 - RNA, 13 nt, Escherichia coli CFT073
uggagcaggaaua

SEQ ID NO: 2659269 - RNA, 16 nt, Escherichia coli CFT073
uggagccaucaccauc

SEQ ID NO: 2659270 - RNA, 21 nt, Escherichia coli CFT073
uggagccgcuggcauacaguu

SEQ ID NO: 2659271 - RNA, 19 nt, Escherichia coli CFT073
uggagcgugauaugcccac

SEQ ID NO: 2659272 - RNA, 19 nt, Escherichia coli CFT073
uggagcuuuaaacacgauu

SEQ ID NO: 2659273 - RNA, 20 nt, Escherichia coli CFT073
uggaggccgagcuaauaauc

SEQ ID NO: 2659274 - RNA, 17 nt, Escherichia coli CFT073
uggaguaaaucagagga

SEQ ID NO: 2659275 - RNA, 22 nt, Escherichia coli CFT073
uggaguaguugaucgccccgga

SEQ ID NO: 2659276 - RNA, 14 nt, Escherichia coli CFT073
uggaguggcccagg

SEQ ID NO: 2659277 - RNA, 20 nt, Escherichia coli CFT073
uggagugguucgguccgcga

SEQ ID NO: 2659278 - RNA, 22 nt, Escherichia coli CFT073
uggauaagaaagauacaaaaca

SEQ ID NO: 2659279 - RNA, 23 nt, Escherichia coli CFT073
uggauaagaaagauacaaaacau

SEQ ID NO: 2659280 - RNA, 20 nt, Escherichia coli CFT073
uggauaauccaucccgcucu

SEQ ID NO: 2659281 - RNA, 22 nt, Escherichia coli CFT073
uggauaaugggaauuggcguca

SEQ ID NO: 2659282 - RNA, 21 nt, Escherichia coli CFT073
uggauauaauucaucacgcca

SEQ ID NO: 2659283 - RNA, 17 nt, Escherichia coli CFT073
uggauauaauuuuuuua

SEQ ID NO: 2659284 - RNA, 14 nt, Escherichia coli CFT073
uggauaucaaugua

SEQ ID NO: 2659285 - RNA, 18 nt, Escherichia coli CFT073
uggauaugaucugcacag

SEQ ID NO: 2659286 - RNA, 21 nt, Escherichia coli CFT073
uggauauggaaaaacagcaaa

SEQ ID NO: 2659287 - RNA, 21 nt, Escherichia coli CFT073
uggauauggaacggaugcagc

SEQ ID NO: 2659288 - RNA, 20 nt, Escherichia coli CFT073
uggauauugccggaugugau

SEQ ID NO: 2659289 - RNA, 23 nt, Escherichia coli CFT073
uggaucaaggauugcagcacuga

SEQ ID NO: 2659290 - RNA, 15 nt, Escherichia coli CFT073
uggaucaccaucgga

SEQ ID NO: 2659291 - RNA, 13 nt, Escherichia coli CFT073
uggaucagaagag

SEQ ID NO: 2659292 - RNA, 17 nt, Escherichia coli CFT073
uggaucagcguuucuuc

SEQ ID NO: 2659293 - RNA, 19 nt, Escherichia coli CFT073
uggaucagcguuucuucca

SEQ ID NO: 2659294 - RNA, 20 nt, Escherichia coli CFT073
uggauccccgcagcaaacag

SEQ ID NO: 2659295 - RNA, 12 nt, Escherichia coli CFT073
uggaucgaacuc

SEQ ID NO: 2659296 - RNA, 18 nt, Escherichia coli CFT073
uggaucgagauugucggc

SEQ ID NO: 2659297 - RNA, 20 nt, Escherichia coli CFT073
uggaucgcggcuauucacca

SEQ ID NO: 2659298 - RNA, 14 nt, Escherichia coli CFT073
uggaucuuccccuu

SEQ ID NO: 2659299 - RNA, 11 nt, Escherichia coli CFT073
uggaugaaaug

SEQ ID NO: 2659300 - RNA, 18 nt, Escherichia coli CFT073
uggaugaucccuucgcug

SEQ ID NO: 2659301 - RNA, 13 nt, Escherichia coli CFT073
uggaugaucgcgg

SEQ ID NO: 2659302 - RNA, 20 nt, Escherichia coli CFT073
uggaugcgauguucccccag

SEQ ID NO: 2659303 - RNA, 21 nt, Escherichia coli CFT073
uggaugcgccauaccaugcac

SEQ ID NO: 2659304 - RNA, 17 nt, Escherichia coli CFT073
uggauguuucaugaagc

SEQ ID NO: 2659305 - RNA, 20 nt, Escherichia coli CFT073
uggauugcuauuuaacaauu

SEQ ID NO: 2659306 - RNA, 21 nt, Escherichia coli CFT073
uggauuuaccguuaagcugga

SEQ ID NO: 2659307 - RNA, 21 nt, Escherichia coli CFT073
uggauuuuuguuucacacuga

SEQ ID NO: 2659308 - RNA, 22 nt, Escherichia coli CFT073
uggauuuuuguuucacacugac

SEQ ID NO: 2659309 - RNA, 23 nt, Escherichia coli CFT073
uggauuuuuguuucacacugaca

SEQ ID NO: 2659310 - RNA, 12 nt, Escherichia coli CFT073
uggcaaaaacaa

SEQ ID NO: 2659311 - RNA, 18 nt, Escherichia coli CFT073
uggcaaaaauaaggcgga

SEQ ID NO: 2659312 - RNA, 19 nt, Escherichia coli CFT073
uggcaaaaauaaggcggau

SEQ ID NO: 2659313 - RNA, 13 nt, Escherichia coli CFT073
uggcaaaaccaaa

SEQ ID NO: 2659314 - RNA, 14 nt, Escherichia coli CFT073
uggcaaaagaagca

SEQ ID NO: 2659315 - RNA, 14 nt, Escherichia coli CFT073
uggcaaaaucaaaa

SEQ ID NO: 2659316 - RNA, 19 nt, Escherichia coli CFT073
uggccugcuuuugccagcg

SEQ ID NO: 2659317 - RNA, 11 nt, Escherichia coli CFT073
uggccuggccc

SEQ ID NO: 2659318 - RNA, 16 nt, Escherichia coli CFT073
uggccuggugaguggc

SEQ ID NO: 2659319 - RNA, 16 nt, Escherichia coli CFT073
uggccuuaauuggcca

SEQ ID NO: 2659320 - RNA, 13 nt, Escherichia coli CFT073
uggccuucuucau

SEQ ID NO: 2659321 - RNA, 14 nt, Escherichia coli CFT073
uggccuucuucauc

SEQ ID NO: 2659322 - RNA, 17 nt, Escherichia coli CFT073
uggccuuuaacacgcaa

SEQ ID NO: 2659323 - RNA, 14 nt, Escherichia coli CFT073
uggccuuugcgaug

SEQ ID NO: 2659324 - RNA, 13 nt, Escherichia coli CFT073
uggcgaaucguau

SEQ ID NO: 2659325 - RNA, 21 nt, Escherichia coli CFT073
uggcgaauuaacaccaccagc

SEQ ID NO: 2659326 - RNA, 18 nt, Escherichia coli CFT073
uggcgacguaccagcguc

SEQ ID NO: 2659327 - RNA, 15 nt, Escherichia coli CFT073
uggcgacugccagcc

SEQ ID NO: 2659328 - RNA, 12 nt, Escherichia coli CFT073
uggcgagagccg

SEQ ID NO: 2659329 - RNA, 15 nt, Escherichia coli CFT073
uggcgagcagcaaua

SEQ ID NO: 2659330 - RNA, 13 nt, Escherichia coli CFT073
uggcgaguauugc

SEQ ID NO: 2659331 - RNA, 19 nt, Escherichia coli CFT073
uggcgaguauugcuuugcu

SEQ ID NO: 2659332 - RNA, 14 nt, Escherichia coli CFT073
uggcgauaccccaa

SEQ ID NO: 2659333 - RNA, 16 nt, Escherichia coli CFT073
uggcgauacucugcca

SEQ ID NO: 2659334 - RNA, 20 nt, Escherichia coli CFT073
uggcgauacugccgcccauc

SEQ ID NO: 2659335 - RNA, 19 nt, Escherichia coli CFT073
uggcgauauugccgcgaua

SEQ ID NO: 2659336 - RNA, 16 nt, Escherichia coli CFT073
uggcgauggaagaggu

SEQ ID NO: 2659337 - RNA, 18 nt, Escherichia coli CFT073
uggcgauguaauucagcc

SEQ ID NO: 2659338 - RNA, 19 nt, Escherichia coli CFT073
uggcgauguaauucagcca

SEQ ID NO: 2659339 - RNA, 23 nt, Escherichia coli CFT073
uggcgauguaauucagccauucg

SEQ ID NO: 2659340 - RNA, 22 nt, Escherichia coli CFT073
uggcgauuauccaugccacagu

SEQ ID NO: 2659341 - RNA, 18 nt, Escherichia coli CFT073
uggcgauucagcaacauc

SEQ ID NO: 2659342 - RNA, 23 nt, Escherichia coli CFT073
uggcgauugcuguuggcguugca

SEQ ID NO: 2659343 - RNA, 23 nt, Escherichia coli CFT073
uggcgcagcacgacucuccccug

SEQ ID NO: 2659344 - RNA, 14 nt, Escherichia coli CFT073
uggcgcagcaguuc

SEQ ID NO: 2659345 - RNA, 19 nt, Escherichia coli CFT073
uggcgcagcgcagcgccaa

SEQ ID NO: 2659346 - RNA, 18 nt, Escherichia coli CFT073
uggcgcaggggcagaaac

SEQ ID NO: 2659347 - RNA, 13 nt, Escherichia coli CFT073
uggcgcauccagc

SEQ ID NO: 2659348 - RNA, 19 nt, Escherichia coli CFT073
uggcgcauuaacucacugg

SEQ ID NO: 2659349 - RNA, 17 nt, Escherichia coli CFT073
uggcgccaguuauucau

SEQ ID NO: 2659350 - RNA, 16 nt, Escherichia coli CFT073
uggcgccccacuucau

SEQ ID NO: 2659351 - RNA, 21 nt, Escherichia coli CFT073
uggcgcgaaaacaacuggcaa

SEQ ID NO: 2659352 - RNA, 16 nt, Escherichia coli CFT073
uggcgcguccggcguc

SEQ ID NO: 2659353 - RNA, 18 nt, Escherichia coli CFT073
uggcgcgucuuaucaggc

SEQ ID NO: 2659354 - RNA, 16 nt, Escherichia coli CFT073
uggcgcuaucaauacu

SEQ ID NO: 2659355 - RNA, 19 nt, Escherichia coli CFT073
uggcgcuaugugccauugc

SEQ ID NO: 2659356 - RNA, 20 nt, Escherichia coli CFT073
uggcgcugauaaaucccgcc

SEQ ID NO: 2659357 - RNA, 12 nt, Escherichia coli CFT073
uggcgcugcuca

SEQ ID NO: 2659358 - RNA, 16 nt, Escherichia coli CFT073
uggcgcugcucaggcg

SEQ ID NO: 2659359 - RNA, 20 nt, Escherichia coli CFT073
uggcgcuggcgaucguccag

SEQ ID NO: 2659360 - RNA, 18 nt, Escherichia coli CFT073
uggcggaaauaacgcuga

SEQ ID NO: 2659361 - RNA, 21 nt, Escherichia coli CFT073
uggcggaacggcguugcugcc

SEQ ID NO: 2659362 - RNA, 16 nt, Escherichia coli CFT073
uggcggaauaccgaca

SEQ ID NO: 2659363 - RNA, 20 nt, Escherichia coli CFT073
uggcggaauaccgacaucac

SEQ ID NO: 2659364 - RNA, 12 nt, Escherichia coli CFT073
uggcggccaaaa

SEQ ID NO: 2659365 - RNA, 19 nt, Escherichia coli CFT073
uggcggccugaugcggcgu

SEQ ID NO: 2659366 - RNA, 13 nt, Escherichia coli CFT073
uggcggcgcgaua

SEQ ID NO: 2659367 - RNA, 13 nt, Escherichia coli CFT073
uggcggcuggcac

SEQ ID NO: 2659368 - RNA, 18 nt, Escherichia coli CFT073
uggcggcuggcacuggca

SEQ ID NO: 2659369 - RNA, 15 nt, Escherichia coli CFT073
uggcgggaucgccgg

SEQ ID NO: 2659370 - RNA, 16 nt, Escherichia coli CFT073
uggcggggaucacucc

SEQ ID NO: 2659371 - RNA, 14 nt, Escherichia coli CFT073
uggcgguaacgcgc

SEQ ID NO: 2659372 - RNA, 20 nt, Escherichia coli CFT073
uggcgguauuugauaccagu

SEQ ID NO: 2659373 - RNA, 13 nt, Escherichia coli CFT073
uggcguacagcug

SEQ ID NO: 2659374 - RNA, 14 nt, Escherichia coli CFT073
uggcguacagcugg

SEQ ID NO: 2659375 - RNA, 16 nt, Escherichia coli CFT073
uggcguacccaucaac

SEQ ID NO: 2659376 - RNA, 16 nt, Escherichia coli CFT073
uggcguaucuccagua

SEQ ID NO: 2659377 - RNA, 17 nt, Escherichia coli CFT073
uggcgucacaggccuca

SEQ ID NO: 2659378 - RNA, 14 nt, Escherichia coli CFT073
uggcgucacgccga

SEQ ID NO: 2659379 - RNA, 21 nt, Escherichia coli CFT073
uggcgucacgccgaccagacc

SEQ ID NO: 2659380 - RNA, 20 nt, Escherichia coli CFT073
uggcgucuaagguaaaacaa

SEQ ID NO: 2659381 - RNA, 20 nt, Escherichia coli CFT073
uggcguguucagaucaucaa

SEQ ID NO: 2659382 - RNA, 16 nt, Escherichia coli CFT073
uggcguucacugccgu

SEQ ID NO: 2659383 - RNA, 16 nt, Escherichia coli CFT073
uggcguuuaaucgccu

SEQ ID NO: 2659384 - RNA, 15 nt, Escherichia coli CFT073
uggcguuugccaccu

SEQ ID NO: 2659385 - RNA, 15 nt, Escherichia coli CFT073
uggcuacucagcugg

SEQ ID NO: 2659386 - RNA, 17 nt, Escherichia coli CFT073
uggcuaucggcaaaaau

SEQ ID NO: 2659387 - RNA, 18 nt, Escherichia coli CFT073
uggcucagauugaacgcu

SEQ ID NO: 2659388 - RNA, 15 nt, Escherichia coli CFT073
uggcucagccagacg

SEQ ID NO: 2659389 - RNA, 22 nt, Escherichia coli CFT073
uggcucauuaguuaauucaugu

SEQ ID NO: 2659390 - RNA, 16 nt, Escherichia coli CFT073
uggcuccuguuugcau

SEQ ID NO: 2659391 - RNA, 13 nt, Escherichia coli CFT073
uggcucucaucca

SEQ ID NO: 2659392 - RNA, 19 nt, Escherichia coli CFT073
uggcucugaauaaagcguu

SEQ ID NO: 2659393 - RNA, 21 nt, Escherichia coli CFT073
uggcugaccgucgcagccagc

SEQ ID NO: 2659394 - RNA, 23 nt, Escherichia coli CFT073
uggcugagcaaacaguucugcag

SEQ ID NO: 2659395 - RNA, 17 nt, Escherichia coli CFT073
uggcugagugauacgua

SEQ ID NO: 2659396 - RNA, 16 nt, Escherichia coli CFT073
uggcugauaaucauac

SEQ ID NO: 2659397 - RNA, 16 nt, Escherichia coli CFT073
uggcugaugcuggcac

SEQ ID NO: 2659398 - RNA, 14 nt, Escherichia coli CFT073
uggcugauuaacgu

SEQ ID NO: 2659399 - RNA, 14 nt, Escherichia coli CFT073
uggcugcaguggua

SEQ ID NO: 2659400 - RNA, 16 nt, Escherichia coli CFT073
uggcugcauccagaaa

SEQ ID NO: 2659401 - RNA, 21 nt, Escherichia coli CFT073
uggcugccgagcaaaucgcgg

SEQ ID NO: 2659402 - RNA, 19 nt, Escherichia coli CFT073
uggcugcgcgaaaacccuc

SEQ ID NO: 2659403 - RNA, 20 nt, Escherichia coli CFT073
uggcugcgcgaaaacccucg

SEQ ID NO: 2659404 - RNA, 21 nt, Escherichia coli CFT073
uggcuggcccuuuuuuugucu

SEQ ID NO: 2659405 - RNA, 21 nt, Escherichia coli CFT073
uggcugugaauuacugcugcg

SEQ ID NO: 2659406 - RNA, 16 nt, Escherichia coli CFT073
uggcugugcguuaccc

SEQ ID NO: 2659407 - RNA, 19 nt, Escherichia coli CFT073
uggcuguuuucagcaccag

SEQ ID NO: 2659408 - RNA, 16 nt, Escherichia coli CFT073
uggcuuaucuuccugu

SEQ ID NO: 2659409 - RNA, 15 nt, Escherichia coli CFT073
uggcuucaucccggu

SEQ ID NO: 2659410 - RNA, 17 nt, Escherichia coli CFT073
uggcuucgagaaugaag

SEQ ID NO: 2659411 - RNA, 19 nt, Escherichia coli CFT073
uggcuucgauaccguccac

SEQ ID NO: 2659412 - RNA, 15 nt, Escherichia coli CFT073
uggcuuuccaccugc

SEQ ID NO: 2659413 - RNA, 17 nt, Escherichia coli CFT073
uggcuuuccaccugcaa

SEQ ID NO: 2659414 - RNA, 14 nt, Escherichia coli CFT073
uggcuuuccgggag

SEQ ID NO: 2659415 - RNA, 16 nt, Escherichia coli CFT073
uggcuuuccgggagca

SEQ ID NO: 2659416 - RNA, 17 nt, Escherichia coli CFT073
uggcuuugcccuuucug

SEQ ID NO: 2659417 - RNA, 15 nt, Escherichia coli CFT073
uggcuuuugccgccc

SEQ ID NO: 2659418 - RNA, 16 nt, Escherichia coli CFT073
ugggaaauggcugguc

SEQ ID NO: 2659419 - RNA, 19 nt, Escherichia coli CFT073
ugggaauuugcuccgccac

SEQ ID NO: 2659420 - RNA, 20 nt, Escherichia coli CFT073
ugggaccaccgcgcuaaggc

SEQ ID NO: 2659421 - RNA, 19 nt, Escherichia coli CFT073
ugggauauaaacucgccaa

SEQ ID NO: 2659422 - RNA, 15 nt, Escherichia coli CFT073
ugggauguugauuaa

SEQ ID NO: 2659423 - RNA, 20 nt, Escherichia coli CFT073
ugggauuaaggcuuccagcg

SEQ ID NO: 2659424 - RNA, 21 nt, Escherichia coli CFT073
ugggauuuauuuaccgcuacu

SEQ ID NO: 2659425 - RNA, 16 nt, Escherichia coli CFT073
ugguuaaauugaaauu

SEQ ID NO: 2659426 - RNA, 13 nt, Escherichia coli CFT073
ugguuaaauuuaa

SEQ ID NO: 2659427 - RNA, 23 nt, Escherichia coli CFT073
ugguuaacguucgaucacccggc

SEQ ID NO: 2659428 - RNA, 16 nt, Escherichia coli CFT073
ugguuaaguugaaaac

SEQ ID NO: 2659429 - RNA, 13 nt, Escherichia coli CFT073
ugguuacaucaac

SEQ ID NO: 2659430 - RNA, 18 nt, Escherichia coli CFT073
ugguuacaucaacaagca

SEQ ID NO: 2659431 - RNA, 14 nt, Escherichia coli CFT073
ugguuaccaucaac

SEQ ID NO: 2659432 - RNA, 15 nt, Escherichia coli CFT073
ugguuaccaucaacc

SEQ ID NO: 2659433 - RNA, 19 nt, Escherichia coli CFT073
ugguuacgcaagccaggua

SEQ ID NO: 2659434 - RNA, 22 nt, Escherichia coli CFT073
ugguuagcaaccgccgcugcuu

SEQ ID NO: 2659435 - RNA, 21 nt, Escherichia coli CFT073
ugguuagcaaggaugccauuu

SEQ ID NO: 2659436 - RNA, 21 nt, Escherichia coli CFT073
ugguuagccgcguacauugcu

SEQ ID NO: 2659437 - RNA, 19 nt, Escherichia coli CFT073
ugguuagccggauaagcaa

SEQ ID NO: 2659438 - RNA, 19 nt, Escherichia coli CFT073
ugguuagccucuacaguau

SEQ ID NO: 2659439 - RNA, 19 nt, Escherichia coli CFT073
ugguuauccagcaaccagg

SEQ ID NO: 2659440 - RNA, 20 nt, Escherichia coli CFT073
ugguuauccagcaaccaggu

SEQ ID NO: 2659441 - RNA, 21 nt, Escherichia coli CFT073
ugguuauccagcaaccaggua

SEQ ID NO: 2659442 - RNA, 19 nt, Escherichia coli CFT073
ugguuaucucgaauuguca

SEQ ID NO: 2659443 - RNA, 19 nt, Escherichia coli CFT073
ugguuaucuuccaccacca

SEQ ID NO: 2659444 - RNA, 17 nt, Escherichia coli CFT073
ugguuauuucacuucaa

SEQ ID NO: 2659445 - RNA, 22 nt, Escherichia coli CFT073
ugguuauuucacuucaaccaca

SEQ ID NO: 2659446 - RNA, 19 nt, Escherichia coli CFT073
ugguucaggcguuucuuca

SEQ ID NO: 2659447 - RNA, 15 nt, Escherichia coli CFT073
ugguuccacucugcc

SEQ ID NO: 2659448 - RNA, 15 nt, Escherichia coli CFT073
ugguuccauucaagg

SEQ ID NO: 2659449 - RNA, 17 nt, Escherichia coli CFT073
ugguucccgaugcuguu

SEQ ID NO: 2659450 - RNA, 18 nt, Escherichia coli CFT073
ugguucccugaccugcca

SEQ ID NO: 2659451 - RNA, 22 nt, Escherichia coli CFT073
ugguucggcaaaaucuuccaga

SEQ ID NO: 2659452 - RNA, 19 nt, Escherichia coli CFT073
ugguucgugcaacuuucaa

SEQ ID NO: 2659453 - RNA, 15 nt, Escherichia coli CFT073
ugguugaaauaaacc

SEQ ID NO: 2659454 - RNA, 20 nt, Escherichia coli CFT073
ugguugaaauaaaccaguaa

SEQ ID NO: 2659455 - RNA, 13 nt, Escherichia coli CFT073
ugguugaacacau

SEQ ID NO: 2659456 - RNA, 23 nt, Escherichia coli CFT073
ugguugaucaauucgagcaucau

SEQ ID NO: 2659457 - RNA, 14 nt, Escherichia coli CFT073
ugguugcaugauga

SEQ ID NO: 2659458 - RNA, 13 nt, Escherichia coli CFT073
ugguuucaaccug

SEQ ID NO: 2659459 - RNA, 14 nt, Escherichia coli CFT073
ugguuucaaccugc

SEQ ID NO: 2659460 - RNA, 17 nt, Escherichia coli CFT073
ugguuucacccaguccc

SEQ ID NO: 2659461 - RNA, 19 nt, Escherichia coli CFT073
ugguuuccagcaucgacca

SEQ ID NO: 2659462 - RNA, 21 nt, Escherichia coli CFT073
ugguuuggaucuguugcuggc

SEQ ID NO: 2659463 - RNA, 17 nt, Escherichia coli CFT073
ugguuuucaauuaucac

SEQ ID NO: 2659464 - RNA, 16 nt, Escherichia coli CFT073
ugguuuugguaaagca

SEQ ID NO: 2659465 - RNA, 23 nt, Escherichia coli CFT073
ugguuuugguaaagcaauaaacc

SEQ ID NO: 2659466 - RNA, 15 nt, Escherichia coli CFT073
ugguuuuguaggcug

SEQ ID NO: 2659467 - RNA, 18 nt, Escherichia coli CFT073
uguaaaaaagcgucgccg

SEQ ID NO: 2659468 - RNA, 19 nt, Escherichia coli CFT073
uguaaaacagccaaugcau

SEQ ID NO: 2659469 - RNA, 19 nt, Escherichia coli CFT073
uguaaaaguugcaguccgc

SEQ ID NO: 2659470 - RNA, 12 nt, Escherichia coli CFT073
uguaaacaacau

SEQ ID NO: 2659471 - RNA, 16 nt, Escherichia coli CFT073
uguaaaccaaagccac

SEQ ID NO: 2659472 - RNA, 20 nt, Escherichia coli CFT073
uguaaaguaacgaauaaucc

SEQ ID NO: 2659473 - RNA, 14 nt, Escherichia coli CFT073
uguaaagucacauu

SEQ ID NO: 2659474 - RNA, 15 nt, Escherichia coli CFT073
uguaaauaauugaau

SEQ ID NO: 2659475 - RNA, 17 nt, Escherichia coli CFT073
uguaaauaauugaauaa

SEQ ID NO: 2659476 - RNA, 11 nt, Escherichia coli CFT073
uguaaauauug

SEQ ID NO: 2659477 - RNA, 13 nt, Escherichia coli CFT073
uguaaauauuggu

SEQ ID NO: 2659478 - RNA, 14 nt, Escherichia coli CFT073
uguaaaugaacuca

SEQ ID NO: 2659479 - RNA, 16 nt, Escherichia coli CFT073
uguaaaugcaaauuuc

SEQ ID NO: 2659480 - RNA, 13 nt, Escherichia coli CFT073
uguaaaugcugcu

SEQ ID NO: 2659481 - RNA, 19 nt, Escherichia coli CFT073
uguaaaugcugcuccagcg

SEQ ID NO: 2659482 - RNA, 20 nt, Escherichia coli CFT073
uguaacaccuguaaagucac

SEQ ID NO: 2659483 - RNA, 22 nt, Escherichia coli CFT073
uguaacaguugcaguuauuaua

SEQ ID NO: 2659484 - RNA, 19 nt, Escherichia coli CFT073
uguaaccguuuguuuuuua

SEQ ID NO: 2659485 - RNA, 16 nt, Escherichia coli CFT073
uguaaccuuuucccga

SEQ ID NO: 2659486 - RNA, 20 nt, Escherichia coli CFT073
uguaacgaguacaaaaauaa

SEQ ID NO: 2659487 - RNA, 21 nt, Escherichia coli CFT073
uguaacgcgcuaccaaccaga

SEQ ID NO: 2659488 - RNA, 17 nt, Escherichia coli CFT073
uguaacggcgguacgac

SEQ ID NO: 2659489 - RNA, 16 nt, Escherichia coli CFT073
uguaacgucgcaucug

SEQ ID NO: 2659490 - RNA, 20 nt, Escherichia coli CFT073
uguaacucgucgucacucac

SEQ ID NO: 2659491 - RNA, 19 nt, Escherichia coli CFT073
uguaacuuuguaaggaguu

SEQ ID NO: 2659492 - RNA, 20 nt, Escherichia coli CFT073
uguaagaccugucucuuaua

SEQ ID NO: 2659493 - RNA, 17 nt, Escherichia coli CFT073
uguaagcagggccaaac

SEQ ID NO: 2659494 - RNA, 22 nt, Escherichia coli CFT073
uguaagccaagcgccgccucag

SEQ ID NO: 2659495 - RNA, 15 nt, Escherichia coli CFT073
uguaagccgccgcca

SEQ ID NO: 2659496 - RNA, 16 nt, Escherichia coli CFT073
uguaagucugaaucag

SEQ ID NO: 2659497 - RNA, 14 nt, Escherichia coli CFT073
uguaauaaaccugc

SEQ ID NO: 2659498 - RNA, 14 nt, Escherichia coli CFT073
uguaauaacgcuua

SEQ ID NO: 2659499 - RNA, 13 nt, Escherichia coli CFT073
uguaauaagaggu

SEQ ID NO: 2659500 - RNA, 21 nt, Escherichia coli CFT073
uguaauacaaacucacugcca

SEQ ID NO: 2659501 - RNA, 19 nt, Escherichia coli CFT073
uguaaucaacuccgccagc

SEQ ID NO: 2659502 - RNA, 21 nt, Escherichia coli CFT073
uguaaucacgcucaacuuccu

SEQ ID NO: 2659503 - RNA, 14 nt, Escherichia coli CFT073
uguaauccauugca

SEQ ID NO: 2659504 - RNA, 12 nt, Escherichia coli CFT073
uguaauccugcc

SEQ ID NO: 2659505 - RNA, 13 nt, Escherichia coli CFT073
uguaauccugcca

SEQ ID NO: 2659506 - RNA, 22 nt, Escherichia coli CFT073
uguaaucgccuuuuuucaccgg

SEQ ID NO: 2659507 - RNA, 14 nt, Escherichia coli CFT073
uguaaugacaacau

SEQ ID NO: 2659508 - RNA, 16 nt, Escherichia coli CFT073
uguaaugacaacauuu

SEQ ID NO: 2659509 - RNA, 17 nt, Escherichia coli CFT073
uguaaugccuuuuccag

SEQ ID NO: 2659510 - RNA, 22 nt, Escherichia coli CFT073
uguaauuaaauuaucaacuauc

SEQ ID NO: 2659511 - RNA, 15 nt, Escherichia coli CFT073
uguaauuacgcagcg

SEQ ID NO: 2659512 - RNA, 19 nt, Escherichia coli CFT073
uguaauuugcguuuucacc

SEQ ID NO: 2659513 - RNA, 13 nt, Escherichia coli CFT073
uguacaacacagu

SEQ ID NO: 2659514 - RNA, 14 nt, Escherichia coli CFT073
uguacaacacagua

SEQ ID NO: 2659515 - RNA, 20 nt, Escherichia coli CFT073
uguacaggauauauuucauc

SEQ ID NO: 2659516 - RNA, 18 nt, Escherichia coli CFT073
uguacauccuuguacaug

SEQ ID NO: 2659517 - RNA, 15 nt, Escherichia coli CFT073
uguacaugcugcuuu

SEQ ID NO: 2659518 - RNA, 14 nt, Escherichia coli CFT073
uguaccaaaaucau

SEQ ID NO: 2659519 - RNA, 21 nt, Escherichia coli CFT073
uguaccaccagaaucgccagc

SEQ ID NO: 2659520 - RNA, 16 nt, Escherichia coli CFT073
uguaccacccugcuca

SEQ ID NO: 2659521 - RNA, 14 nt, Escherichia coli CFT073
uguaccagacugac

SEQ ID NO: 2659522 - RNA, 20 nt, Escherichia coli CFT073
uguaccagguggguacugua

SEQ ID NO: 2659523 - RNA, 20 nt, Escherichia coli CFT073
uguaccugguugauucaugg

SEQ ID NO: 2659524 - RNA, 19 nt, Escherichia coli CFT073
uguacggagcggauacccc

SEQ ID NO: 2659525 - RNA, 15 nt, Escherichia coli CFT073
uguacggcuccgccc

SEQ ID NO: 2659526 - RNA, 17 nt, Escherichia coli CFT073
uguacucaauugcuucg

SEQ ID NO: 2659527 - RNA, 18 nt, Escherichia coli CFT073
uguacucaccaacgcaga

SEQ ID NO: 2659528 - RNA, 20 nt, Escherichia coli CFT073
uguacuuaaaacucacccug

SEQ ID NO: 2659529 - RNA, 22 nt, Escherichia coli CFT073
uguacuuccggacguucagcca

SEQ ID NO: 2659530 - RNA, 15 nt, Escherichia coli CFT073
uguacuuuaaaauaa

SEQ ID NO: 2659531 - RNA, 16 nt, Escherichia coli CFT073
uguacuuuaaaauaag

SEQ ID NO: 2659532 - RNA, 20 nt, Escherichia coli CFT073
uguagaccugauaagacgcg

SEQ ID NO: 2659533 - RNA, 23 nt, Escherichia coli CFT073
ugucgcgaugaugcgacgcgauc

SEQ ID NO: 2659534 - RNA, 14 nt, Escherichia coli CFT073
ugucgcgcaaagua

SEQ ID NO: 2659535 - RNA, 23 nt, Escherichia coli CFT073
ugucgcgcacucuacucccugcu

SEQ ID NO: 2659536 - RNA, 16 nt, Escherichia coli CFT073
ugucgcgucaaucacu

SEQ ID NO: 2659537 - RNA, 16 nt, Escherichia coli CFT073
ugucgcuggucgaugg

SEQ ID NO: 2659538 - RNA, 15 nt, Escherichia coli CFT073
ugucgcuucacgcag

SEQ ID NO: 2659539 - RNA, 13 nt, Escherichia coli CFT073
ugucggcacugac

SEQ ID NO: 2659540 - RNA, 20 nt, Escherichia coli CFT073
ugucggcacugaccaccacc

SEQ ID NO: 2659541 - RNA, 18 nt, Escherichia coli CFT073
ugucggcauaaagcugcg

SEQ ID NO: 2659542 - RNA, 20 nt, Escherichia coli CFT073
ugucggcaugauaagacgcg

SEQ ID NO: 2659543 - RNA, 17 nt, Escherichia coli CFT073
ugucggcccgcauuauu

SEQ ID NO: 2659544 - RNA, 20 nt, Escherichia coli CFT073
ugucggcccgcauuauucag

SEQ ID NO: 2659545 - RNA, 23 nt, Escherichia coli CFT073
ugucgggcaggagcugagugcga

SEQ ID NO: 2659546 - RNA, 17 nt, Escherichia coli CFT073
ugucgguaauugcgccg

SEQ ID NO: 2659547 - RNA, 15 nt, Escherichia coli CFT073
ugucgguguagacag

SEQ ID NO: 2659548 - RNA, 16 nt, Escherichia coli CFT073
ugucguacauagcguu

SEQ ID NO: 2659549 - RNA, 21 nt, Escherichia coli CFT073
ugucgucgauaauaucggccu

SEQ ID NO: 2659550 - RNA, 17 nt, Escherichia coli CFT073
ugucgucgguaucaaua

SEQ ID NO: 2659551 - RNA, 18 nt, Escherichia coli CFT073
ugucgucgguuuucuugu

SEQ ID NO: 2659552 - RNA, 14 nt, Escherichia coli CFT073
ugucuaaccgccug

SEQ ID NO: 2659553 - RNA, 20 nt, Escherichia coli CFT073
ugucuccagggcggaaauag

SEQ ID NO: 2659554 - RNA, 11 nt, Escherichia coli CFT073
ugucucugcaa

SEQ ID NO: 2659555 - RNA, 12 nt, Escherichia coli CFT073
ugucucuuuuuu

SEQ ID NO: 2659556 - RNA, 15 nt, Escherichia coli CFT073
ugucucuuuuuucag

SEQ ID NO: 2659557 - RNA, 13 nt, Escherichia coli CFT073
ugucugcaagagg

SEQ ID NO: 2659558 - RNA, 14 nt, Escherichia coli CFT073
ugucugccauauaa

SEQ ID NO: 2659559 - RNA, 22 nt, Escherichia coli CFT073
ugucuggcgaauuuauaaaacg

SEQ ID NO: 2659560 - RNA, 16 nt, Escherichia coli CFT073
ugucuguaauguccau

SEQ ID NO: 2659561 - RNA, 13 nt, Escherichia coli CFT073
ugucuucccggcu

SEQ ID NO: 2659562 - RNA, 12 nt, Escherichia coli CFT073
ugucuuccugcg

SEQ ID NO: 2659563 - RNA, 19 nt, Escherichia coli CFT073
ugucuucguugugaauacc

SEQ ID NO: 2659564 - RNA, 16 nt, Escherichia coli CFT073
ugucuugccucccugc

SEQ ID NO: 2659565 - RNA, 23 nt, Escherichia coli CFT073
ugucuuuaaauugcguaaagccu

SEQ ID NO: 2659566 - RNA, 22 nt, Escherichia coli CFT073
ugucuuuaucgacauaaaucau

SEQ ID NO: 2659567 - RNA, 14 nt, Escherichia coli CFT073
ugucuuuuauuaua

SEQ ID NO: 2659568 - RNA, 23 nt, Escherichia coli CFT073
ugucuuuugaucugcuaaacgua

SEQ ID NO: 2659569 - RNA, 18 nt, Escherichia coli CFT073
ugugaaauaaaaucagca

SEQ ID NO: 2659570 - RNA, 15 nt, Escherichia coli CFT073
ugugaacucaggcug

SEQ ID NO: 2659571 - RNA, 23 nt, Escherichia coli CFT073
ugugaacucaggcugccagauca

SEQ ID NO: 2659572 - RNA, 13 nt, Escherichia coli CFT073
ugugaagaauaaa

SEQ ID NO: 2659573 - RNA, 22 nt, Escherichia coli CFT073
ugugaagcaccugcguugcuca

SEQ ID NO: 2659574 - RNA, 20 nt, Escherichia coli CFT073
ugugaagcaugaguaacccg

SEQ ID NO: 2659575 - RNA, 19 nt, Escherichia coli CFT073
ugugaauaauugugcaauu

SEQ ID NO: 2659576 - RNA, 23 nt, Escherichia coli CFT073
ugugaaugaucagcgguuuugcc

SEQ ID NO: 2659577 - RNA, 20 nt, Escherichia coli CFT073
ugugaauguucaauaagcuu

SEQ ID NO: 2659578 - RNA, 20 nt, Escherichia coli CFT073
ugugaauuguccagaucuuu

SEQ ID NO: 2659579 - RNA, 14 nt, Escherichia coli CFT073
ugugacaacaacau

SEQ ID NO: 2659580 - RNA, 15 nt, Escherichia coli CFT073
ugugacaacaacauc

SEQ ID NO: 2659581 - RNA, 13 nt, Escherichia coli CFT073
ugugacacuucuu

SEQ ID NO: 2659582 - RNA, 14 nt, Escherichia coli CFT073
ugugacauccagau

SEQ ID NO: 2659583 - RNA, 19 nt, Escherichia coli CFT073
ugugacauccagaucacgc

SEQ ID NO: 2659584 - RNA, 17 nt, Escherichia coli CFT073
ugugaccgcugcugccg

SEQ ID NO: 2659585 - RNA, 13 nt, Escherichia coli CFT073
ugugacguugucc

SEQ ID NO: 2659586 - RNA, 18 nt, Escherichia coli CFT073
ugugaucauaucccggcu

SEQ ID NO: 2659587 - RNA, 18 nt, Escherichia coli CFT073
ugugaucgaauauaucag

SEQ ID NO: 2659588 - RNA, 18 nt, Escherichia coli CFT073
ugugauuucugacuuccc

SEQ ID NO: 2659589 - RNA, 19 nt, Escherichia coli CFT073
ugugauuugucauaugcaa

SEQ ID NO: 2659590 - RNA, 14 nt, Escherichia coli CFT073
ugugcaaaaaaauu

SEQ ID NO: 2659591 - RNA, 14 nt, Escherichia coli CFT073
ugugcaaugaaaaa

SEQ ID NO: 2659592 - RNA, 21 nt, Escherichia coli CFT073
ugugcaauguggugaaaugcc

SEQ ID NO: 2659593 - RNA, 23 nt, Escherichia coli CFT073
ugugcacagcauccgaacgcuga

SEQ ID NO: 2659594 - RNA, 12 nt, Escherichia coli CFT073
ugugcaccgccc

SEQ ID NO: 2659595 - RNA, 19 nt, Escherichia coli CFT073
ugugcacgugccagauguu

SEQ ID NO: 2659596 - RNA, 20 nt, Escherichia coli CFT073
ugugcaucaggcaaacuuca

SEQ ID NO: 2659597 - RNA, 17 nt, Escherichia coli CFT073
ugugccacauccagcgg

SEQ ID NO: 2659598 - RNA, 13 nt, Escherichia coli CFT073
ugugccaguuuca

SEQ ID NO: 2659599 - RNA, 21 nt, Escherichia coli CFT073
ugugccaucgccacaccagua

SEQ ID NO: 2659600 - RNA, 17 nt, Escherichia coli CFT073
ugugccauucuugucag

SEQ ID NO: 2659601 - RNA, 17 nt, Escherichia coli CFT073
ugugccgaauccaauaa

SEQ ID NO: 2659602 - RNA, 14 nt, Escherichia coli CFT073
ugugccuuccaucc

SEQ ID NO: 2659603 - RNA, 17 nt, Escherichia coli CFT073
ugugcgaucgagauuca

SEQ ID NO: 2659604 - RNA, 15 nt, Escherichia coli CFT073
ugugcggcgcauuca

SEQ ID NO: 2659605 - RNA, 22 nt, Escherichia coli CFT073
ugugcgguccaugcgaagaccg

SEQ ID NO: 2659606 - RNA, 23 nt, Escherichia coli CFT073
ugugcuacugcuucaaaguuuug

SEQ ID NO: 2659607 - RNA, 13 nt, Escherichia coli CFT073
ugugcuccaucag

SEQ ID NO: 2659608 - RNA, 16 nt, Escherichia coli CFT073
ugugcugcauuauccu

SEQ ID NO: 2659609 - RNA, 20 nt, Escherichia coli CFT073
ugugcuuguaaaacagccaa

SEQ ID NO: 2659610 - RNA, 23 nt, Escherichia coli CFT073
ugugcuuuguuugcaauaugguu

SEQ ID NO: 2659611 - RNA, 17 nt, Escherichia coli CFT073
uguggaaauuccagcgg

SEQ ID NO: 2659612 - RNA, 22 nt, Escherichia coli CFT073
uguggaggccgagcuaauaauc

SEQ ID NO: 2659613 - RNA, 18 nt, Escherichia coli CFT073
uguggauaucugggaugc

SEQ ID NO: 2659614 - RNA, 17 nt, Escherichia coli CFT073
uguggaucgauuucaau

SEQ ID NO: 2659615 - RNA, 18 nt, Escherichia coli CFT073
uguggcagguaauccgca

SEQ ID NO: 2659616 - RNA, 20 nt, Escherichia coli CFT073
uguggcguaaacgccuuauc

SEQ ID NO: 2659617 - RNA, 21 nt, Escherichia coli CFT073
uguggcguguuguaaaacgcg

SEQ ID NO: 2659618 - RNA, 17 nt, Escherichia coli CFT073
ugugggauuccagcgcc

SEQ ID NO: 2659619 - RNA, 13 nt, Escherichia coli CFT073
ugugggccggaua

SEQ ID NO: 2659620 - RNA, 20 nt, Escherichia coli CFT073
ugugggccugauaagaugcg

SEQ ID NO: 2659621 - RNA, 18 nt, Escherichia coli CFT073
uguggggauuuccaacga

SEQ ID NO: 2659622 - RNA, 20 nt, Escherichia coli CFT073
ugugggucaccgcaaaaccg

SEQ ID NO: 2659623 - RNA, 13 nt, Escherichia coli CFT073
ugugguaaaaccu

SEQ ID NO: 2659624 - RNA, 13 nt, Escherichia coli CFT073
ugugguaaauuaa

SEQ ID NO: 2659625 - RNA, 21 nt, Escherichia coli CFT073
ugugguauaugcguugcgguc

SEQ ID NO: 2659626 - RNA, 20 nt, Escherichia coli CFT073
uguggucuuuaauaacacga

SEQ ID NO: 2659627 - RNA, 19 nt, Escherichia coli CFT073
uguguaaugcggcugacaa

SEQ ID NO: 2659628 - RNA, 15 nt, Escherichia coli CFT073
ugugucagugucaga

SEQ ID NO: 2659629 - RNA, 17 nt, Escherichia coli CFT073
ugugucugauauuuuau

SEQ ID NO: 2659630 - RNA, 12 nt, Escherichia coli CFT073
ugugugaaaguc

SEQ ID NO: 2659631 - RNA, 17 nt, Escherichia coli CFT073
ugugugacacuucuucg

SEQ ID NO: 2659632 - RNA, 16 nt, Escherichia coli CFT073
ugugugcuggccauca

SEQ ID NO: 2659633 - RNA, 22 nt, Escherichia coli CFT073
uguguugagcgaugaaguaaca

SEQ ID NO: 2659634 - RNA, 15 nt, Escherichia coli CFT073
uguguuuaugagguu

SEQ ID NO: 2659635 - RNA, 23 nt, Escherichia coli CFT073
uguguuuuuacgcaggcuggagc

SEQ ID NO: 2659636 - RNA, 19 nt, Escherichia coli CFT073
uguuaaaacgcacgcuguc

SEQ ID NO: 2659637 - RNA, 21 nt, Escherichia coli CFT073
uguuaaagcccugcucgcgca

SEQ ID NO: 2659638 - RNA, 19 nt, Escherichia coli CFT073
uguuaaauugccugugaag

SEQ ID NO: 2659639 - RNA, 20 nt, Escherichia coli CFT073
uguuaaugcgaaugaaagau

SEQ ID NO: 2659640 - RNA, 17 nt, Escherichia coli CFT073
uguuaauucucccugcg

SEQ ID NO: 2659641 - RNA, 21 nt, Escherichia coli CFT073
uguuaauuucucgcacguugg

SEQ ID NO: 2659642 - RNA, 14 nt, Escherichia coli CFT073
uguuaccaacacug

SEQ ID NO: 2659643 - RNA, 21 nt, Escherichia coli CFT073
uguuaccgggcuacaacgcac

SEQ ID NO: 2659644 - RNA, 18 nt, Escherichia coli CFT073
uguuaccuacgcuugcug

SEQ ID NO: 2659645 - RNA, 22 nt, Escherichia coli CFT073
uguuacuacagaggguuuuuua

SEQ ID NO: 2659646 - RNA, 13 nt, Escherichia coli CFT073
uguuaggaucacg

SEQ ID NO: 2659647 - RNA, 22 nt, Escherichia coli CFT073
uguuauauucacuugccugcug

SEQ ID NO: 2659648 - RNA, 16 nt, Escherichia coli CFT073
uguuaucagcaauaaa

SEQ ID NO: 2659649 - RNA, 12 nt, Escherichia coli CFT073
uguuaugcacac

SEQ ID NO: 2659650 - RNA, 14 nt, Escherichia coli CFT073
uguuaugcgaaaua

SEQ ID NO: 2659651 - RNA, 22 nt, Escherichia coli CFT073
uguuauucacagagauaaucag

SEQ ID NO: 2659652 - RNA, 13 nt, Escherichia coli CFT073
uguuauucagaau

SEQ ID NO: 2659653 - RNA, 12 nt, Escherichia coli CFT073
uguucaacaauu

SEQ ID NO: 2659654 - RNA, 15 nt, Escherichia coli CFT073
uguucaacaauucgu

SEQ ID NO: 2659655 - RNA, 20 nt, Escherichia coli CFT073
uguucaccacugaauaacau

SEQ ID NO: 2659656 - RNA, 18 nt, Escherichia coli CFT073
uguucacgaccaucaacc

SEQ ID NO: 2659657 - RNA, 20 nt, Escherichia coli CFT073
uguucacgaccaucaaccuu

SEQ ID NO: 2659658 - RNA, 15 nt, Escherichia coli CFT073
uguucacgccgcauc

SEQ ID NO: 2659659 - RNA, 14 nt, Escherichia coli CFT073
uguucacucaucag

SEQ ID NO: 2659660 - RNA, 18 nt, Escherichia coli CFT073
uguucagcgggcagggca

SEQ ID NO: 2659661 - RNA, 22 nt, Escherichia coli CFT073
uguucagcgggcagggcaucaa

SEQ ID NO: 2659662 - RNA, 21 nt, Escherichia coli CFT073
uguuccacucuuucagcacca

SEQ ID NO: 2659663 - RNA, 15 nt, Escherichia coli CFT073
uguuccagcaucaca

SEQ ID NO: 2659664 - RNA, 12 nt, Escherichia coli CFT073
uguuccaguacg

SEQ ID NO: 2659665 - RNA, 12 nt, Escherichia coli CFT073
uguuccagugcg

SEQ ID NO: 2659666 - RNA, 18 nt, Escherichia coli CFT073
uguuccaguugauacagg

SEQ ID NO: 2659667 - RNA, 20 nt, Escherichia coli CFT073
uguuccauugagaaaaucca

SEQ ID NO: 2659668 - RNA, 18 nt, Escherichia coli CFT073
uguucccgcgccucaggc

SEQ ID NO: 2659669 - RNA, 18 nt, Escherichia coli CFT073
uguucccggcauuuugcu

SEQ ID NO: 2659670 - RNA, 19 nt, Escherichia coli CFT073
uguuccggcguggcauuaa

SEQ ID NO: 2659671 - RNA, 13 nt, Escherichia coli CFT073
uguuccgucagcc

SEQ ID NO: 2659672 - RNA, 12 nt, Escherichia coli CFT073
uguuccucugcc

SEQ ID NO: 2659673 - RNA, 12 nt, Escherichia coli CFT073
uguuccucugcu

SEQ ID NO: 2659674 - RNA, 23 nt, Escherichia coli CFT073
uguucgauaaccaucccuucacc

SEQ ID NO: 2659675 - RNA, 18 nt, Escherichia coli CFT073
uguucgcauccggcacaa

SEQ ID NO: 2659676 - RNA, 14 nt, Escherichia coli CFT073
uguucgccagugca

SEQ ID NO: 2659677 - RNA, 23 nt, Escherichia coli CFT073
uguucgccgcagguagcagcagc

SEQ ID NO: 2659678 - RNA, 22 nt, Escherichia coli CFT073
uguucgcgucuuaucaggccua

SEQ ID NO: 2659679 - RNA, 14 nt, Escherichia coli CFT073
uguucguuauuggg

SEQ ID NO: 2659680 - RNA, 15 nt, Escherichia coli CFT073
uguucucuucauuac

SEQ ID NO: 2659681 - RNA, 14 nt, Escherichia coli CFT073
uguucucuucugcu

SEQ ID NO: 2659682 - RNA, 19 nt, Escherichia coli CFT073
uguucugcgccugguuuug

SEQ ID NO: 2659683 - RNA, 22 nt, Escherichia coli CFT073
uguucuggccguacccagcggu

SEQ ID NO: 2659684 - RNA, 14 nt, Escherichia coli CFT073
uguucuucaauggu

SEQ ID NO: 2659685 - RNA, 16 nt, Escherichia coli CFT073
uguucuucuguuaaau

SEQ ID NO: 2659686 - RNA, 17 nt, Escherichia coli CFT073
uguugaaauacaaacac

SEQ ID NO: 2659687 - RNA, 19 nt, Escherichia coli CFT073
uguugaagaugcgguuuuc

SEQ ID NO: 2659688 - RNA, 18 nt, Escherichia coli CFT073
uguugacucuugucacug

SEQ ID NO: 2659689 - RNA, 22 nt, Escherichia coli CFT073
uguugauaaucaacaggaacau

SEQ ID NO: 2659690 - RNA, 20 nt, Escherichia coli CFT073
uguugaugacgaccgccuuc

SEQ ID NO: 2659691 - RNA, 14 nt, Escherichia coli CFT073
uguugauucauuug

SEQ ID NO: 2659692 - RNA, 13 nt, Escherichia coli CFT073
uguugauugcguu

SEQ ID NO: 2659693 - RNA, 17 nt, Escherichia coli CFT073
uguugauuuaacagcaa

SEQ ID NO: 2659694 - RNA, 19 nt, Escherichia coli CFT073
uguugcaccaucaggcaua

SEQ ID NO: 2659695 - RNA, 21 nt, Escherichia coli CFT073
uguugcagaugcucuucaaaa

SEQ ID NO: 2659696 - RNA, 15 nt, Escherichia coli CFT073
uguugcaggaacaga

SEQ ID NO: 2659697 - RNA, 16 nt, Escherichia coli CFT073
uguugcaggaacagaa

SEQ ID NO: 2659698 - RNA, 17 nt, Escherichia coli CFT073
uguugcaguacucgcac

SEQ ID NO: 2659699 - RNA, 18 nt, Escherichia coli CFT073
uguugccuguuucauagu

SEQ ID NO: 2659700 - RNA, 18 nt, Escherichia coli CFT073
uguugcgcugaaacuuca

SEQ ID NO: 2659701 - RNA, 13 nt, Escherichia coli CFT073
uguugcuggcgag

SEQ ID NO: 2659702 - RNA, 21 nt, Escherichia coli CFT073
uguuggcuaucuauugcugaa

SEQ ID NO: 2659703 - RNA, 12 nt, Escherichia coli CFT073
uguuggcuuccu

SEQ ID NO: 2659704 - RNA, 12 nt, Escherichia coli CFT073
uguuggugccag

SEQ ID NO: 2659705 - RNA, 15 nt, Escherichia coli CFT073
uguugguuugugacu

SEQ ID NO: 2659706 - RNA, 16 nt, Escherichia coli CFT073
uguuguaaaacgcgcc

SEQ ID NO: 2659707 - RNA, 21 nt, Escherichia coli CFT073
uguuguauccuguuuuuaagu

SEQ ID NO: 2659708 - RNA, 13 nt, Escherichia coli CFT073
uguuguauucaga

SEQ ID NO: 2659709 - RNA, 11 nt, Escherichia coli CFT073
uguugucccag

SEQ ID NO: 2659710 - RNA, 15 nt, Escherichia coli CFT073
uguugucgccaguaa

SEQ ID NO: 2659711 - RNA, 18 nt, Escherichia coli CFT073
uguugugaauauugccgc

SEQ ID NO: 2659712 - RNA, 23 nt, Escherichia coli CFT073
uguugugccacauccagcggcag

SEQ ID NO: 2659713 - RNA, 13 nt, Escherichia coli CFT073
uguugugccagac

SEQ ID NO: 2659714 - RNA, 15 nt, Escherichia coli CFT073
uguuguggauaucug

SEQ ID NO: 2659715 - RNA, 17 nt, Escherichia coli CFT073
uguuuacagcagccagc

SEQ ID NO: 2659716 - RNA, 19 nt, Escherichia coli CFT073
uguuuaccggugccagcaa

SEQ ID NO: 2659717 - RNA, 14 nt, Escherichia coli CFT073
uguuuauaagccau

SEQ ID NO: 2659718 - RNA, 19 nt, Escherichia coli CFT073
uguuuauuaucaauuuuag

SEQ ID NO: 2659719 - RNA, 16 nt, Escherichia coli CFT073
uguuuauucacauaga

SEQ ID NO: 2659720 - RNA, 13 nt, Escherichia coli CFT073
uguuucagcgcau

SEQ ID NO: 2659721 - RNA, 22 nt, Escherichia coli CFT073
uguuucauaguuuuaccuuucu

SEQ ID NO: 2659722 - RNA, 16 nt, Escherichia coli CFT073
uguuucauaucaccgu

SEQ ID NO: 2659723 - RNA, 22 nt, Escherichia coli CFT073
uguuucauccaggcacuggccu

SEQ ID NO: 2659724 - RNA, 18 nt, Escherichia coli CFT073
uguuucaucucaucaaug

SEQ ID NO: 2659725 - RNA, 21 nt, Escherichia coli CFT073
uguuuccgacgguuugccuuc

SEQ ID NO: 2659726 - RNA, 20 nt, Escherichia coli CFT073
uguuucgcggcaaacugcau

SEQ ID NO: 2659727 - RNA, 13 nt, Escherichia coli CFT073
uguuucguucaaa

SEQ ID NO: 2659728 - RNA, 17 nt, Escherichia coli CFT073
uguuucuuacgguuuuc

SEQ ID NO: 2659729 - RNA, 18 nt, Escherichia coli CFT073
uguuugcaguaaaccaca

SEQ ID NO: 2659730 - RNA, 19 nt, Escherichia coli CFT073
uguuugcgacaaacuucca

SEQ ID NO: 2659731 - RNA, 14 nt, Escherichia coli CFT073
uguuuuaagguuuc

SEQ ID NO: 2659732 - RNA, 14 nt, Escherichia coli CFT073
uguuuucaguagca

SEQ ID NO: 2659733 - RNA, 13 nt, Escherichia coli CFT073
uguuuuccagcac

SEQ ID NO: 2659734 - RNA, 17 nt, Escherichia coli CFT073
uguuuugcaucaacugc

SEQ ID NO: 2659735 - RNA, 18 nt, Escherichia coli CFT073
uguuuuguccgauuucgc

SEQ ID NO: 2659736 - RNA, 22 nt, Escherichia coli CFT073
uguuuuuaaaccaacuucauac

SEQ ID NO: 2659737 - RNA, 13 nt, Escherichia coli CFT073
uguuuuuauuaaa

SEQ ID NO: 2659738 - RNA, 14 nt, Escherichia coli CFT073
uguuuuucaggaaa

SEQ ID NO: 2659739 - RNA, 15 nt, Escherichia coli CFT073
uguuuuucucugccg

SEQ ID NO: 2659740 - RNA, 15 nt, Escherichia coli CFT073
uguuuuuuuuaucac

SEQ ID NO: 2659741 - RNA, 16 nt, Escherichia coli CFT073
uuaaaaaaagaacaac

SEQ ID NO: 2659742 - RNA, 18 nt, Escherichia coli CFT073
uuaaaaaaagaacaacca

SEQ ID NO: 2659743 - RNA, 20 nt, Escherichia coli CFT073
uuaaaauaagcacaaagcaa

SEQ ID NO: 2659744 - RNA, 11 nt, Escherichia coli CFT073
uuaaaauauaa

SEQ ID NO: 2659745 - RNA, 17 nt, Escherichia coli CFT073
uuaaaauauaagguucu

SEQ ID NO: 2659746 - RNA, 22 nt, Escherichia coli CFT073
uuaaaaugaauaacuuccugua

SEQ ID NO: 2659747 - RNA, 19 nt, Escherichia coli CFT073
uuaaaauguguacuucucu

SEQ ID NO: 2659748 - RNA, 13 nt, Escherichia coli CFT073
uuaaaauugauaa

SEQ ID NO: 2659749 - RNA, 16 nt, Escherichia coli CFT073
uuaaaauuucacauau

SEQ ID NO: 2659750 - RNA, 16 nt, Escherichia coli CFT073
uuaaucuauauauguu

SEQ ID NO: 2659751 - RNA, 22 nt, Escherichia coli CFT073
uuaaucugcccguagcccauca

SEQ ID NO: 2659752 - RNA, 13 nt, Escherichia coli CFT073
uuaaucugguauc

SEQ ID NO: 2659753 - RNA, 22 nt, Escherichia coli CFT073
uuaaucuguugaaaaaaggcuu

SEQ ID NO: 2659754 - RNA, 17 nt, Escherichia coli CFT073
uuaaucuuccagaucac

SEQ ID NO: 2659755 - RNA, 21 nt, Escherichia coli CFT073
uuaaugacaauuacaaaauga

SEQ ID NO: 2659756 - RNA, 15 nt, Escherichia coli CFT073
uuaaugagauaauca

SEQ ID NO: 2659757 - RNA, 17 nt, Escherichia coli CFT073
uuaaugagauaaucaaa

SEQ ID NO: 2659758 - RNA, 16 nt, Escherichia coli CFT073
uuaaugauuuccagga

SEQ ID NO: 2659759 - RNA, 21 nt, Escherichia coli CFT073
uuaaugcacggcagauaaaca

SEQ ID NO: 2659760 - RNA, 15 nt, Escherichia coli CFT073
uuaaugcccaucagu

SEQ ID NO: 2659761 - RNA, 22 nt, Escherichia coli CFT073
uuaaugcccaucucuucuucaa

SEQ ID NO: 2659762 - RNA, 13 nt, Escherichia coli CFT073
uuaaugcgcuuuu

SEQ ID NO: 2659763 - RNA, 20 nt, Escherichia coli CFT073
uuaaugcuucgcacuguguu

SEQ ID NO: 2659764 - RNA, 20 nt, Escherichia coli CFT073
uuaauggcgauaaucgaacc

SEQ ID NO: 2659765 - RNA, 15 nt, Escherichia coli CFT073
uuaauguaaauauug

SEQ ID NO: 2659766 - RNA, 17 nt, Escherichia coli CFT073
uuaaugugucugaaagc

SEQ ID NO: 2659767 - RNA, 15 nt, Escherichia coli CFT073
uuaauucucccugcg

SEQ ID NO: 2659768 - RNA, 19 nt, Escherichia coli CFT073
uuaauucuguccuccauga

SEQ ID NO: 2659769 - RNA, 23 nt, Escherichia coli CFT073
uuaauugcccaaagccaaucugu

SEQ ID NO: 2659770 - RNA, 19 nt, Escherichia coli CFT073
uuaauugccucuucugaua

SEQ ID NO: 2659771 - RNA, 23 nt, Escherichia coli CFT073
uuaauuuucguuccaggacuggc

SEQ ID NO: 2659772 - RNA, 15 nt, Escherichia coli CFT073
uuaauuuuuuaauaa

SEQ ID NO: 2659773 - RNA, 18 nt, Escherichia coli CFT073
uuaauuuuuuaauaaaaa

SEQ ID NO: 2659774 - RNA, 10 nt, Escherichia coli CFT073
uuacaaaaag

SEQ ID NO: 2659775 - RNA, 15 nt, Escherichia coli CFT073
uuacaaaaugacauu

SEQ ID NO: 2659776 - RNA, 13 nt, Escherichia coli CFT073
uuacaaccacaua

SEQ ID NO: 2659777 - RNA, 22 nt, Escherichia coli CFT073
uuacaagaaucaugccaaaaau

SEQ ID NO: 2659778 - RNA, 14 nt, Escherichia coli CFT073
uuacaauaaccauu

SEQ ID NO: 2659779 - RNA, 20 nt, Escherichia coli CFT073
uuacaaucgucugguuuucc

SEQ ID NO: 2659780 - RNA, 23 nt, Escherichia coli CFT073
uuacaaucgucugguuuuccuua

SEQ ID NO: 2659781 - RNA, 13 nt, Escherichia coli CFT073
uuacacugaaaaa

SEQ ID NO: 2659782 - RNA, 14 nt, Escherichia coli CFT073
uuacagagcgauua

SEQ ID NO: 2659783 - RNA, 22 nt, Escherichia coli CFT073
uuacagauucucgccguugcug

SEQ ID NO: 2659784 - RNA, 14 nt, Escherichia coli CFT073
uuacagauuuccca

SEQ ID NO: 2659785 - RNA, 21 nt, Escherichia coli CFT073
uuacagcaacgggcugaagaa

SEQ ID NO: 2659786 - RNA, 15 nt, Escherichia coli CFT073
uuacagccgggugag

SEQ ID NO: 2659787 - RNA, 14 nt, Escherichia coli CFT073
uuacagcucucacu

SEQ ID NO: 2659788 - RNA, 24 nt, Escherichia coli CFT073
uuacaggauuacuuaacuuccauc

SEQ ID NO: 2659789 - RNA, 21 nt, Escherichia coli CFT073
uuacaguagcuauaaaccugc

SEQ ID NO: 2659790 - RNA, 21 nt, Escherichia coli CFT073
uuacauaguucuucaacacca

SEQ ID NO: 2659791 - RNA, 12 nt, Escherichia coli CFT073
uuacauauauua

SEQ ID NO: 2659792 - RNA, 20 nt, Escherichia coli CFT073
uuacauauauuacucauuaa

SEQ ID NO: 2659793 - RNA, 15 nt, Escherichia coli CFT073
uuacaucaucagaaa

SEQ ID NO: 2659794 - RNA, 22 nt, Escherichia coli CFT073
uuacaucaucagaaaugccagu

SEQ ID NO: 2659795 - RNA, 16 nt, Escherichia coli CFT073
uuacaucgauuucgcu

SEQ ID NO: 2659796 - RNA, 22 nt, Escherichia coli CFT073
uuaccaaauaaacgaaucugca

SEQ ID NO: 2659797 - RNA, 18 nt, Escherichia coli CFT073
uuaccaaauugguaaaau

SEQ ID NO: 2659798 - RNA, 17 nt, Escherichia coli CFT073
uuaccaaccgcaauugc

SEQ ID NO: 2659799 - RNA, 15 nt, Escherichia coli CFT073
uuaccaagaaagaua

SEQ ID NO: 2659800 - RNA, 21 nt, Escherichia coli CFT073
uuaccaaugcugcaccccaca

SEQ ID NO: 2659801 - RNA, 17 nt, Escherichia coli CFT073
uuaccacgauauguuca

SEQ ID NO: 2659802 - RNA, 16 nt, Escherichia coli CFT073
uuaccagagaaaagau

SEQ ID NO: 2659803 - RNA, 17 nt, Escherichia coli CFT073
uuaccagagaaaagaua

SEQ ID NO: 2659804 - RNA, 19 nt, Escherichia coli CFT073
uuaccagagucuuugcuug

SEQ ID NO: 2659805 - RNA, 13 nt, Escherichia coli CFT073
uuaccagcgcagg

SEQ ID NO: 2659806 - RNA, 17 nt, Escherichia coli CFT073
uuaccagcgccgccacu

SEQ ID NO: 2659807 - RNA, 16 nt, Escherichia coli CFT073
uuaccaguacaccaau

SEQ ID NO: 2659808 - RNA, 15 nt, Escherichia coli CFT073
uuaccaucacuuugc

SEQ ID NO: 2659809 - RNA, 14 nt, Escherichia coli CFT073
uuacccaacucuuu

SEQ ID NO: 2659810 - RNA, 12 nt, Escherichia coli CFT073
uuacccaaucgc

SEQ ID NO: 2659811 - RNA, 13 nt, Escherichia coli CFT073
uuacccacuguau

SEQ ID NO: 2659812 - RNA, 13 nt, Escherichia coli CFT073
uuacccagauaau

SEQ ID NO: 2659813 - RNA, 15 nt, Escherichia coli CFT073
uuacccagcagcagc

SEQ ID NO: 2659814 - RNA, 12 nt, Escherichia coli CFT073
uuaccccaucca

SEQ ID NO: 2659815 - RNA, 17 nt, Escherichia coli CFT073
uuacccggacacucggc

SEQ ID NO: 2659816 - RNA, 15 nt, Escherichia coli CFT073
uuacccggccccugg

SEQ ID NO: 2659817 - RNA, 12 nt, Escherichia coli CFT073
uuacccggugcc

SEQ ID NO: 2659818 - RNA, 18 nt, Escherichia coli CFT073
uuacccggugccgccguc

SEQ ID NO: 2659819 - RNA, 22 nt, Escherichia coli CFT073
uuacccguugguuugauagcaa

SEQ ID NO: 2659820 - RNA, 14 nt, Escherichia coli CFT073
uuacccuuacucac

SEQ ID NO: 2659821 - RNA, 17 nt, Escherichia coli CFT073
uuaccgaauccagcaag

SEQ ID NO: 2659822 - RNA, 14 nt, Escherichia coli CFT073
uuaccgaauccugg

SEQ ID NO: 2659823 - RNA, 21 nt, Escherichia coli CFT073
uuaccgaguccgccauuauua

SEQ ID NO: 2659824 - RNA, 12 nt, Escherichia coli CFT073
uuaccgccaacg

SEQ ID NO: 2659825 - RNA, 11 nt, Escherichia coli CFT073
uuaccgcccau

SEQ ID NO: 2659826 - RNA, 22 nt, Escherichia coli CFT073
uuaccgcugucgaucagagaac

SEQ ID NO: 2659827 - RNA, 20 nt, Escherichia coli CFT073
uuaccgcuuggcgauacccc

SEQ ID NO: 2659828 - RNA, 21 nt, Escherichia coli CFT073
uuaccgggcuacaacgcacca

SEQ ID NO: 2659829 - RNA, 17 nt, Escherichia coli CFT073
uuaccggugccagcaac

SEQ ID NO: 2659830 - RNA, 19 nt, Escherichia coli CFT073
uuaccggugccagcaacug

SEQ ID NO: 2659831 - RNA, 20 nt, Escherichia coli CFT073
uuaccguaacaggugauaau

SEQ ID NO: 2659832 - RNA, 17 nt, Escherichia coli CFT073
uuaccguaggccagcgg

SEQ ID NO: 2659833 - RNA, 15 nt, Escherichia coli CFT073
uuaccuccgcuuugu

SEQ ID NO: 2659834 - RNA, 15 nt, Escherichia coli CFT073
uuaccugucgcuuug

SEQ ID NO: 2659835 - RNA, 21 nt, Escherichia coli CFT073
uuaccuuuugacugaagguaa

SEQ ID NO: 2659836 - RNA, 12 nt, Escherichia coli CFT073
uuacgaaagcgc

SEQ ID NO: 2659837 - RNA, 19 nt, Escherichia coli CFT073
uuacgagugcgcucuucaa

SEQ ID NO: 2659838 - RNA, 19 nt, Escherichia coli CFT073
uuacgauccaccaccgcaa

SEQ ID NO: 2659839 - RNA, 20 nt, Escherichia coli CFT073
uuacgaucgagauugauccc

SEQ ID NO: 2659840 - RNA, 16 nt, Escherichia coli CFT073
uuacgcaagccaggua

SEQ ID NO: 2659841 - RNA, 23 nt, Escherichia coli CFT073
uuacgcaccggaaauugcugccg

SEQ ID NO: 2659842 - RNA, 23 nt, Escherichia coli CFT073
uuacgcaucaccccuuccugaac

SEQ ID NO: 2659843 - RNA, 14 nt, Escherichia coli CFT073
uuacgcccggacua

SEQ ID NO: 2659844 - RNA, 16 nt, Escherichia coli CFT073
uuacgccgagcgccag

SEQ ID NO: 2659845 - RNA, 22 nt, Escherichia coli CFT073
uuacgccgcaucaggccgccag

SEQ ID NO: 2659846 - RNA, 21 nt, Escherichia coli CFT073
uuacgccgcauccgacaucaa

SEQ ID NO: 2659847 - RNA, 21 nt, Escherichia coli CFT073
uuacgccggaaaguuaauuaa

SEQ ID NO: 2659848 - RNA, 17 nt, Escherichia coli CFT073
uuacgccggugauuaaa

SEQ ID NO: 2659849 - RNA, 18 nt, Escherichia coli CFT073
uuacgcguccuuguaacg

SEQ ID NO: 2659850 - RNA, 13 nt, Escherichia coli CFT073
uuacgcucccacg

SEQ ID NO: 2659851 - RNA, 17 nt, Escherichia coli CFT073
uuacgcucccacggaau

SEQ ID NO: 2659852 - RNA, 16 nt, Escherichia coli CFT073
uuacgcucuuccacgc

SEQ ID NO: 2659853 - RNA, 18 nt, Escherichia coli CFT073
uuacgcugauuggcccca

SEQ ID NO: 2659854 - RNA, 19 nt, Escherichia coli CFT073
uuacggauguacucaucca

SEQ ID NO: 2659855 - RNA, 14 nt, Escherichia coli CFT073
uuacggauuucccg

SEQ ID NO: 2659856 - RNA, 19 nt, Escherichia coli CFT073
uuacggccauggaacaucc

SEQ ID NO: 2659857 - RNA, 18 nt, Escherichia coli CFT073
uuacguccaucacaauca

SEQ ID NO: 2659858 - RNA, 12 nt, Escherichia coli CFT073
uuaucgcuauca

SEQ ID NO: 2659859 - RNA, 22 nt, Escherichia coli CFT073
uuaucgcuucgcuaacauuuua

SEQ ID NO: 2659860 - RNA, 15 nt, Escherichia coli CFT073
uuaucuacuacccag

SEQ ID NO: 2659861 - RNA, 19 nt, Escherichia coli CFT073
uuaucuccauccgggauca

SEQ ID NO: 2659862 - RNA, 18 nt, Escherichia coli CFT073
uuaucuggcuaaaacuga

SEQ ID NO: 2659863 - RNA, 21 nt, Escherichia coli CFT073
uuaucuguaauuaaauuauca

SEQ ID NO: 2659864 - RNA, 14 nt, Escherichia coli CFT073
uuaucuucaccaaa

SEQ ID NO: 2659865 - RNA, 21 nt, Escherichia coli CFT073
uuaucuuugauugaagaaauc

SEQ ID NO: 2659866 - RNA, 21 nt, Escherichia coli CFT073
uuaugaauauucuguucaugc

SEQ ID NO: 2659867 - RNA, 13 nt, Escherichia coli CFT073
uuaugaggaugca

SEQ ID NO: 2659868 - RNA, 13 nt, Escherichia coli CFT073
uuaugauccagcu

SEQ ID NO: 2659869 - RNA, 14 nt, Escherichia coli CFT073
uuaugauccagcuu

SEQ ID NO: 2659870 - RNA, 21 nt, Escherichia coli CFT073
uuaugaugcacuucagggcgc

SEQ ID NO: 2659871 - RNA, 23 nt, Escherichia coli CFT073
uuaugcaauagcgccugcugcug

SEQ ID NO: 2659872 - RNA, 13 nt, Escherichia coli CFT073
uuaugcacacgcg

SEQ ID NO: 2659873 - RNA, 22 nt, Escherichia coli CFT073
uuaugcacacgcggagccaguu

SEQ ID NO: 2659874 - RNA, 19 nt, Escherichia coli CFT073
uuaugcaccgacaauccag

SEQ ID NO: 2659875 - RNA, 20 nt, Escherichia coli CFT073
uuaugcaccgacaauccagu

SEQ ID NO: 2659876 - RNA, 19 nt, Escherichia coli CFT073
uuaugcagagcauccagca

SEQ ID NO: 2659877 - RNA, 15 nt, Escherichia coli CFT073
uuaugcccucagccu

SEQ ID NO: 2659878 - RNA, 23 nt, Escherichia coli CFT073
uuaugccgaucaucauccagcac

SEQ ID NO: 2659879 - RNA, 14 nt, Escherichia coli CFT073
uuaugccuggcgaa

SEQ ID NO: 2659880 - RNA, 13 nt, Escherichia coli CFT073
uuaugcgaugaaa

SEQ ID NO: 2659881 - RNA, 17 nt, Escherichia coli CFT073
uuaugcguagccaggcu

SEQ ID NO: 2659882 - RNA, 17 nt, Escherichia coli CFT073
uuaugcgucaacgccgc

SEQ ID NO: 2659883 - RNA, 13 nt, Escherichia coli CFT073
uuauggagaaaac

SEQ ID NO: 2659884 - RNA, 17 nt, Escherichia coli CFT073
uuauggcgcaguugccg

SEQ ID NO: 2659885 - RNA, 21 nt, Escherichia coli CFT073
uuauggcgcaguugccggaug

SEQ ID NO: 2659886 - RNA, 16 nt, Escherichia coli CFT073
uuauggugacaaacac

SEQ ID NO: 2659887 - RNA, 23 nt, Escherichia coli CFT073
uuauguaaagacuucauuaucga

SEQ ID NO: 2659888 - RNA, 11 nt, Escherichia coli CFT073
uuaugucagua

SEQ ID NO: 2659889 - RNA, 15 nt, Escherichia coli CFT073
uuaugucauugaaug

SEQ ID NO: 2659890 - RNA, 15 nt, Escherichia coli CFT073
uuaugucgcauccug

SEQ ID NO: 2659891 - RNA, 24 nt, Escherichia coli CFT073
uuaugucgcauccugcacuguccc

SEQ ID NO: 2659892 - RNA, 17 nt, Escherichia coli CFT073
uuauuaaagguauuauu

SEQ ID NO: 2659893 - RNA, 15 nt, Escherichia coli CFT073
uuauuaccaucgguu

SEQ ID NO: 2659894 - RNA, 17 nt, Escherichia coli CFT073
uuauuacuauggauaua

SEQ ID NO: 2659895 - RNA, 18 nt, Escherichia coli CFT073
uuauuacugcgaauuucc

SEQ ID NO: 2659896 - RNA, 22 nt, Escherichia coli CFT073
uuauuaucuggcaagccugaaa

SEQ ID NO: 2659897 - RNA, 21 nt, Escherichia coli CFT073
uuauucacagagauaaucaga

SEQ ID NO: 2659898 - RNA, 16 nt, Escherichia coli CFT073
uuauucacauagauaa

SEQ ID NO: 2659899 - RNA, 13 nt, Escherichia coli CFT073
uuauucagaaaac

SEQ ID NO: 2659900 - RNA, 23 nt, Escherichia coli CFT073
uuauucccgcgcuaccacuuccc

SEQ ID NO: 2659901 - RNA, 20 nt, Escherichia coli CFT073
uuauucccgggcguaacuca

SEQ ID NO: 2659902 - RNA, 23 nt, Escherichia coli CFT073
uuauucuuuuuugauuccaguaa

SEQ ID NO: 2659903 - RNA, 22 nt, Escherichia coli CFT073
uuauugauuguuuuaaauauug

SEQ ID NO: 2659904 - RNA, 17 nt, Escherichia coli CFT073
uuauugcugaaaauugu

SEQ ID NO: 2659905 - RNA, 14 nt, Escherichia coli CFT073
uuauugcugcacca

SEQ ID NO: 2659906 - RNA, 16 nt, Escherichia coli CFT073
uuauugugcacaggua

SEQ ID NO: 2659907 - RNA, 14 nt, Escherichia coli CFT073
uuauuuaaacugaa

SEQ ID NO: 2659908 - RNA, 14 nt, Escherichia coli CFT073
uuauuuagauaaac

SEQ ID NO: 2659909 - RNA, 19 nt, Escherichia coli CFT073
uuauuugacauuuuuucau

SEQ ID NO: 2659910 - RNA, 11 nt, Escherichia coli CFT073
uuauuuuaaau

SEQ ID NO: 2659911 - RNA, 23 nt, Escherichia coli CFT073
uuauuuuaccauauaaacauauc

SEQ ID NO: 2659912 - RNA, 11 nt, Escherichia coli CFT073
uucaaaaacag

SEQ ID NO: 2659913 - RNA, 17 nt, Escherichia coli CFT073
uucaaaaaccugaccua

SEQ ID NO: 2659914 - RNA, 16 nt, Escherichia coli CFT073
uucaaaauuuaacauu

SEQ ID NO: 2659915 - RNA, 12 nt, Escherichia coli CFT073
uucaaacacgau

SEQ ID NO: 2659916 - RNA, 19 nt, Escherichia coli CFT073
uucaaacgccacagcaauu

SEQ ID NO: 2659917 - RNA, 16 nt, Escherichia coli CFT073
uucaaacggcguuuuu

SEQ ID NO: 2659918 - RNA, 12 nt, Escherichia coli CFT073
uucaaagcgauu

SEQ ID NO: 2659919 - RNA, 19 nt, Escherichia coli CFT073
uucaaaucaccaaacugcu

SEQ ID NO: 2659920 - RNA, 16 nt, Escherichia coli CFT073
uucaaaucgaaaucaa

SEQ ID NO: 2659921 - RNA, 22 nt, Escherichia coli CFT073
uucaaauugcucgaagacauau

SEQ ID NO: 2659922 - RNA, 14 nt, Escherichia coli CFT073
uucaacaagccacg

SEQ ID NO: 2659923 - RNA, 18 nt, Escherichia coli CFT073
uucaacacacugaauaaa

SEQ ID NO: 2659924 - RNA, 16 nt, Escherichia coli CFT073
uucaacacaugcacau

SEQ ID NO: 2659925 - RNA, 13 nt, Escherichia coli CFT073
uucaacagauuuc

SEQ ID NO: 2659926 - RNA, 16 nt, Escherichia coli CFT073
uucaacaguaaacucg

SEQ ID NO: 2659927 - RNA, 16 nt, Escherichia coli CFT073
uucaacaucauuuccc

SEQ ID NO: 2659928 - RNA, 19 nt, Escherichia coli CFT073
uucaacaucauuucccacg

SEQ ID NO: 2659929 - RNA, 17 nt, Escherichia coli CFT073
uucaaccaccggcacca

SEQ ID NO: 2659930 - RNA, 12 nt, Escherichia coli CFT073
uucaaccgcagc

SEQ ID NO: 2659931 - RNA, 12 nt, Escherichia coli CFT073
uucaaccgcagu

SEQ ID NO: 2659932 - RNA, 13 nt, Escherichia coli CFT073
uucaaccggaucg

SEQ ID NO: 2659933 - RNA, 12 nt, Escherichia coli CFT073
uucaaccucaaa

SEQ ID NO: 2659934 - RNA, 16 nt, Escherichia coli CFT073
uucaaccucuguucag

SEQ ID NO: 2659935 - RNA, 17 nt, Escherichia coli CFT073
uucaacgacauaugcgu

SEQ ID NO: 2659936 - RNA, 23 nt, Escherichia coli CFT073
uucaacgcugcggcgugcaggaa

SEQ ID NO: 2659937 - RNA, 22 nt, Escherichia coli CFT073
uucaacgugagauaguaaaccu

SEQ ID NO: 2659938 - RNA, 18 nt, Escherichia coli CFT073
uucaacucaucaaaaaaa

SEQ ID NO: 2659939 - RNA, 13 nt, Escherichia coli CFT073
uucaacucccacc

SEQ ID NO: 2659940 - RNA, 20 nt, Escherichia coli CFT073
uucaacuuaagucuccauuu

SEQ ID NO: 2659941 - RNA, 13 nt, Escherichia coli CFT073
uucaacuucagca

SEQ ID NO: 2659942 - RNA, 19 nt, Escherichia coli CFT073
uucaacuucccaaagauca

SEQ ID NO: 2659943 - RNA, 19 nt, Escherichia coli CFT073
uucaacuucugcugugacu

SEQ ID NO: 2659944 - RNA, 22 nt, Escherichia coli CFT073
uucaagacgaauaccuucuucc

SEQ ID NO: 2659945 - RNA, 23 nt, Escherichia coli CFT073
uucaagacgaauaccuucuuccu

SEQ ID NO: 2659946 - RNA, 14 nt, Escherichia coli CFT073
uucaaggauguguu

SEQ ID NO: 2659947 - RNA, 21 nt, Escherichia coli CFT073
uucaauaaugucuuagcgugc

SEQ ID NO: 2659948 - RNA, 23 nt, Escherichia coli CFT073
uucaauaauuccgcccucgauau

SEQ ID NO: 2659949 - RNA, 14 nt, Escherichia coli CFT073
uucaauacgcauca

SEQ ID NO: 2659950 - RNA, 17 nt, Escherichia coli CFT073
uucaauacgcucgaaca

SEQ ID NO: 2659951 - RNA, 20 nt, Escherichia coli CFT073
uucaauccgucccaauucuu

SEQ ID NO: 2659952 - RNA, 13 nt, Escherichia coli CFT073
uucaaucugguga

SEQ ID NO: 2659953 - RNA, 19 nt, Escherichia coli CFT073
uucaaugacaguaucacca

SEQ ID NO: 2659954 - RNA, 20 nt, Escherichia coli CFT073
uucaaugacaguaucaccaa

SEQ ID NO: 2659955 - RNA, 20 nt, Escherichia coli CFT073
uucaaugauaaaggucauca

SEQ ID NO: 2659956 - RNA, 22 nt, Escherichia coli CFT073
uucaaugauaaaggucaucaca

SEQ ID NO: 2659957 - RNA, 22 nt, Escherichia coli CFT073
uucaaugaucgucauaucauca

SEQ ID NO: 2659958 - RNA, 21 nt, Escherichia coli CFT073
uucaaugcaauuuaucgcagg

SEQ ID NO: 2659959 - RNA, 23 nt, Escherichia coli CFT073
uucaaugcccacugcacaguguu

SEQ ID NO: 2659960 - RNA, 14 nt, Escherichia coli CFT073
uucaaugccccaca

SEQ ID NO: 2659961 - RNA, 17 nt, Escherichia coli CFT073
uucaaugccccacagag

SEQ ID NO: 2659962 - RNA, 20 nt, Escherichia coli CFT073
uucaaugccuuucuuuguuc

SEQ ID NO: 2659963 - RNA, 16 nt, Escherichia coli CFT073
uucaauggcgucaaca

SEQ ID NO: 2659964 - RNA, 13 nt, Escherichia coli CFT073
uucacaaaaacag

SEQ ID NO: 2659965 - RNA, 15 nt, Escherichia coli CFT073
uucacaaaaacagua

SEQ ID NO: 2659966 - RNA, 16 nt, Escherichia coli CFT073
uucaggugaccaaaga

SEQ ID NO: 2659967 - RNA, 22 nt, Escherichia coli CFT073
uucagguuacgcccuuccccca

SEQ ID NO: 2659968 - RNA, 16 nt, Escherichia coli CFT073
uucagguuguuuucug

SEQ ID NO: 2659969 - RNA, 18 nt, Escherichia coli CFT073
uucaguaaauacugcgca

SEQ ID NO: 2659970 - RNA, 14 nt, Escherichia coli CFT073
uucaguaaucaacg

SEQ ID NO: 2659971 - RNA, 21 nt, Escherichia coli CFT073
uucaguaccagcaccugaauc

SEQ ID NO: 2659972 - RNA, 21 nt, Escherichia coli CFT073
uucaguacguucacgcagcuc

SEQ ID NO: 2659973 - RNA, 15 nt, Escherichia coli CFT073
uucaguacguuuuua

SEQ ID NO: 2659974 - RNA, 15 nt, Escherichia coli CFT073
uucaguccacaucuc

SEQ ID NO: 2659975 - RNA, 13 nt, Escherichia coli CFT073
uucagucgaucgg

SEQ ID NO: 2659976 - RNA, 14 nt, Escherichia coli CFT073
uucagucuuaaaaa

SEQ ID NO: 2659977 - RNA, 20 nt, Escherichia coli CFT073
uucagugaaucucaggcaaa

SEQ ID NO: 2659978 - RNA, 22 nt, Escherichia coli CFT073
uucagugaccgaaccuguuuuc

SEQ ID NO: 2659979 - RNA, 18 nt, Escherichia coli CFT073
uucagugcguuacacaga

SEQ ID NO: 2659980 - RNA, 13 nt, Escherichia coli CFT073
uucaguucaucua

SEQ ID NO: 2659981 - RNA, 18 nt, Escherichia coli CFT073
uucaguucaucuacuacu

SEQ ID NO: 2659982 - RNA, 19 nt, Escherichia coli CFT073
uucaguucgccuuccagca

SEQ ID NO: 2659983 - RNA, 19 nt, Escherichia coli CFT073
uucaguucgucacaguuaa

SEQ ID NO: 2659984 - RNA, 11 nt, Escherichia coli CFT073
uucaguucugg

SEQ ID NO: 2659985 - RNA, 16 nt, Escherichia coli CFT073
uucaguuuccagcaaa

SEQ ID NO: 2659986 - RNA, 18 nt, Escherichia coli CFT073
uucauagcacauccugau

SEQ ID NO: 2659987 - RNA, 16 nt, Escherichia coli CFT073
uucauauccgucauau

SEQ ID NO: 2659988 - RNA, 13 nt, Escherichia coli CFT073
uucauaucugcca

SEQ ID NO: 2659989 - RNA, 18 nt, Escherichia coli CFT073
uucauaugauaggcuuca

SEQ ID NO: 2659990 - RNA, 15 nt, Escherichia coli CFT073
uucauauuaaccucu

SEQ ID NO: 2659991 - RNA, 22 nt, Escherichia coli CFT073
uucaucaagcugugccugaaua

SEQ ID NO: 2659992 - RNA, 16 nt, Escherichia coli CFT073
uucaucacgcacugca

SEQ ID NO: 2659993 - RNA, 20 nt, Escherichia coli CFT073
uucaucagcguuuccgcugg

SEQ ID NO: 2659994 - RNA, 13 nt, Escherichia coli CFT073
uucaucaucaggc

SEQ ID NO: 2659995 - RNA, 18 nt, Escherichia coli CFT073
uucaucauuucauuugga

SEQ ID NO: 2659996 - RNA, 11 nt, Escherichia coli CFT073
uucauccagca

SEQ ID NO: 2659997 - RNA, 11 nt, Escherichia coli CFT073
uucauccagcu

SEQ ID NO: 2659998 - RNA, 16 nt, Escherichia coli CFT073
uucauccccucuucca

SEQ ID NO: 2659999 - RNA, 14 nt, Escherichia coli CFT073
uucaucccugaaau

SEQ ID NO: 2660000 - RNA, 16 nt, Escherichia coli CFT073
uucauccgauccucac

SEQ ID NO: 2660001 - RNA, 20 nt, Escherichia coli CFT073
uucauccggcuguuccagca

SEQ ID NO: 2660002 - RNA, 19 nt, Escherichia coli CFT073
uucauccuggcacagcagu

SEQ ID NO: 2660003 - RNA, 19 nt, Escherichia coli CFT073
uucauccuguaugacaaaa

SEQ ID NO: 2660004 - RNA, 22 nt, Escherichia coli CFT073
uucauccuguaugacaaaagaa

SEQ ID NO: 2660005 - RNA, 23 nt, Escherichia coli CFT073
uucaucgaacgggugauuucccc

SEQ ID NO: 2660006 - RNA, 14 nt, Escherichia coli CFT073
uucaucgagcagca

SEQ ID NO: 2660007 - RNA, 15 nt, Escherichia coli CFT073
uucaucgauccccug

SEQ ID NO: 2660008 - RNA, 19 nt, Escherichia coli CFT073
uucaucgccuucuugaacc

SEQ ID NO: 2660009 - RNA, 18 nt, Escherichia coli CFT073
uucaucgcgcaaaauuuc

SEQ ID NO: 2660010 - RNA, 21 nt, Escherichia coli CFT073
uucaucgcgcaaaauuucuau

SEQ ID NO: 2660011 - RNA, 22 nt, Escherichia coli CFT073
uucaucgcggucagcugcuguu

SEQ ID NO: 2660012 - RNA, 17 nt, Escherichia coli CFT073
uucaucggaaugcacag

SEQ ID NO: 2660013 - RNA, 20 nt, Escherichia coli CFT073
uucaucguaguaguucaucc

SEQ ID NO: 2660014 - RNA, 22 nt, Escherichia coli CFT073
uucaucguaguaguucaucccc

SEQ ID NO: 2660015 - RNA, 17 nt, Escherichia coli CFT073
uucaucgucagcuccau

SEQ ID NO: 2660016 - RNA, 15 nt, Escherichia coli CFT073
uucaucucaucaaug

SEQ ID NO: 2660017 - RNA, 15 nt, Escherichia coli CFT073
uucaucucuucuucc

SEQ ID NO: 2660018 - RNA, 17 nt, Escherichia coli CFT073
uucaucuucaacggcca

SEQ ID NO: 2660019 - RNA, 13 nt, Escherichia coli CFT073
uucaucuucaguc

SEQ ID NO: 2660020 - RNA, 13 nt, Escherichia coli CFT073
uucaucuuccagc

SEQ ID NO: 2660021 - RNA, 14 nt, Escherichia coli CFT073
uucaucuuuauaga

SEQ ID NO: 2660022 - RNA, 14 nt, Escherichia coli CFT073
uucaucuuuaucaa

SEQ ID NO: 2660023 - RNA, 20 nt, Escherichia coli CFT073
uucaucuuuauucauaauca

SEQ ID NO: 2660024 - RNA, 17 nt, Escherichia coli CFT073
uucaugaauaaaaaaac

SEQ ID NO: 2660025 - RNA, 12 nt, Escherichia coli CFT073
uucaugaauaac

SEQ ID NO: 2660026 - RNA, 16 nt, Escherichia coli CFT073
uucaugauacuccaca

SEQ ID NO: 2660027 - RNA, 21 nt, Escherichia coli CFT073
uucaugauacuccacaucauu

SEQ ID NO: 2660028 - RNA, 22 nt, Escherichia coli CFT073
uucaugcacucguaacauggcg

SEQ ID NO: 2660029 - RNA, 15 nt, Escherichia coli CFT073
uucaugccauccgca

SEQ ID NO: 2660030 - RNA, 16 nt, Escherichia coli CFT073
uucaugccauccgcau

SEQ ID NO: 2660031 - RNA, 15 nt, Escherichia coli CFT073
uucaugcccgccgac

SEQ ID NO: 2660032 - RNA, 22 nt, Escherichia coli CFT073
uucaugcucaccaauccaggca

SEQ ID NO: 2660033 - RNA, 14 nt, Escherichia coli CFT073
uucaugcuccagca

SEQ ID NO: 2660034 - RNA, 18 nt, Escherichia coli CFT073
uucaugggugccggauac

SEQ ID NO: 2660035 - RNA, 23 nt, Escherichia coli CFT073
uucaugucgguuacuauccugaa

SEQ ID NO: 2660036 - RNA, 15 nt, Escherichia coli CFT073
uucauuaaagccgcc

SEQ ID NO: 2660037 - RNA, 14 nt, Escherichia coli CFT073
uucauuaacccguu

SEQ ID NO: 2660038 - RNA, 20 nt, Escherichia coli CFT073
uucauuaacccguuuacaua

SEQ ID NO: 2660039 - RNA, 16 nt, Escherichia coli CFT073
uucauuacaccaauac

SEQ ID NO: 2660040 - RNA, 15 nt, Escherichia coli CFT073
uucauuaucuucuuu

SEQ ID NO: 2660041 - RNA, 13 nt, Escherichia coli CFT073
uucauuauucauu

SEQ ID NO: 2660042 - RNA, 15 nt, Escherichia coli CFT073
uucauucaggccaaa

SEQ ID NO: 2660043 - RNA, 14 nt, Escherichia coli CFT073
uucauucauccgcc

SEQ ID NO: 2660044 - RNA, 12 nt, Escherichia coli CFT073
uucauuccuuga

SEQ ID NO: 2660045 - RNA, 23 nt, Escherichia coli CFT073
uucauugccggaggcgcugguaa

SEQ ID NO: 2660046 - RNA, 22 nt, Escherichia coli CFT073
uucauugcguaaccaaauauca

SEQ ID NO: 2660047 - RNA, 18 nt, Escherichia coli CFT073
uucauuguaaauaauuga

SEQ ID NO: 2660048 - RNA, 16 nt, Escherichia coli CFT073
uucauuguguaucagg

SEQ ID NO: 2660049 - RNA, 13 nt, Escherichia coli CFT073
uucauuuacauca

SEQ ID NO: 2660050 - RNA, 22 nt, Escherichia coli CFT073
uucauuuggcguaguugcugcg

SEQ ID NO: 2660051 - RNA, 20 nt, Escherichia coli CFT073
uucauuugucucaaaacuga

SEQ ID NO: 2660052 - RNA, 22 nt, Escherichia coli CFT073
uucauuuuguaggccugauaag

SEQ ID NO: 2660053 - RNA, 19 nt, Escherichia coli CFT073
uucauuuuuaggauaaauc

SEQ ID NO: 2660054 - RNA, 13 nt, Escherichia coli CFT073
uuccaacaggcga

SEQ ID NO: 2660055 - RNA, 12 nt, Escherichia coli CFT073
uuccaacgaauc

SEQ ID NO: 2660056 - RNA, 15 nt, Escherichia coli CFT073
uuccaacgaaucuuu

SEQ ID NO: 2660057 - RNA, 14 nt, Escherichia coli CFT073
uuccaacgccacca

SEQ ID NO: 2660058 - RNA, 20 nt, Escherichia coli CFT073
uuccaagauuaaaggcacca

SEQ ID NO: 2660059 - RNA, 14 nt, Escherichia coli CFT073
uuccaauaaauccc

SEQ ID NO: 2660060 - RNA, 13 nt, Escherichia coli CFT073
uuccaauauuaaa

SEQ ID NO: 2660061 - RNA, 17 nt, Escherichia coli CFT073
uuccacauaaaguagcc

SEQ ID NO: 2660062 - RNA, 19 nt, Escherichia coli CFT073
uuccacauuuuccaucacg

SEQ ID NO: 2660063 - RNA, 20 nt, Escherichia coli CFT073
uuccaccagcggcugaauau

SEQ ID NO: 2660064 - RNA, 13 nt, Escherichia coli CFT073
uuccaccugcaac

SEQ ID NO: 2660065 - RNA, 17 nt, Escherichia coli CFT073
uuccacgcuauacagca

SEQ ID NO: 2660066 - RNA, 18 nt, Escherichia coli CFT073
uuccacggaauauuucac

SEQ ID NO: 2660067 - RNA, 22 nt, Escherichia coli CFT073
uuccacggaauauuucaccggu

SEQ ID NO: 2660068 - RNA, 17 nt, Escherichia coli CFT073
uuccacgucacaggcca

SEQ ID NO: 2660069 - RNA, 14 nt, Escherichia coli CFT073
uuccacucuuucag

SEQ ID NO: 2660070 - RNA, 21 nt, Escherichia coli CFT073
uuccacuuucacgcccauaac

SEQ ID NO: 2660071 - RNA, 14 nt, Escherichia coli CFT073
uuccagacggguca

SEQ ID NO: 2660072 - RNA, 17 nt, Escherichia coli CFT073
uuccagaucaccgcaga

SEQ ID NO: 2660073 - RNA, 23 nt, Escherichia coli CFT073
uuccagaucaccgcagaagcgau

SEQ ID NO: 2660074 - RNA, 17 nt, Escherichia coli CFT073
uuccagauguggugcca

SEQ ID NO: 2660075 - RNA, 22 nt, Escherichia coli CFT073
uuccgcaacgucagugacugcu

SEQ ID NO: 2660076 - RNA, 20 nt, Escherichia coli CFT073
uuccgcaccugccagcgccg

SEQ ID NO: 2660077 - RNA, 23 nt, Escherichia coli CFT073
uuccgcaccugccagcgccgaca

SEQ ID NO: 2660078 - RNA, 21 nt, Escherichia coli CFT073
uuccgccacauccguccgcaa

SEQ ID NO: 2660079 - RNA, 19 nt, Escherichia coli CFT073
uuccgccgucaucaucggc

SEQ ID NO: 2660080 - RNA, 18 nt, Escherichia coli CFT073
uuccgcgaccugauccau

SEQ ID NO: 2660081 - RNA, 19 nt, Escherichia coli CFT073
uuccgcgucaaucugcccg

SEQ ID NO: 2660082 - RNA, 17 nt, Escherichia coli CFT073
uuccgcuuacugguuuu

SEQ ID NO: 2660083 - RNA, 22 nt, Escherichia coli CFT073
uuccggaguaaugaaaccgaau

SEQ ID NO: 2660084 - RNA, 17 nt, Escherichia coli CFT073
uuccggauacgguuuuu

SEQ ID NO: 2660085 - RNA, 22 nt, Escherichia coli CFT073
uuccggaucgccaaagcggcag

SEQ ID NO: 2660086 - RNA, 13 nt, Escherichia coli CFT073
uuccggcagcuuc

SEQ ID NO: 2660087 - RNA, 18 nt, Escherichia coli CFT073
uuccggcagcuucacgga

SEQ ID NO: 2660088 - RNA, 17 nt, Escherichia coli CFT073
uuccggcguccaccugc

SEQ ID NO: 2660089 - RNA, 21 nt, Escherichia coli CFT073
uuccggcguuucgccaucguu

SEQ ID NO: 2660090 - RNA, 13 nt, Escherichia coli CFT073
uuccggcuacgcc

SEQ ID NO: 2660091 - RNA, 21 nt, Escherichia coli CFT073
uuccggcuuaaugcacggcag

SEQ ID NO: 2660092 - RNA, 16 nt, Escherichia coli CFT073
uuccgggcuauacacc

SEQ ID NO: 2660093 - RNA, 17 nt, Escherichia coli CFT073
uuccggguuuucaacug

SEQ ID NO: 2660094 - RNA, 22 nt, Escherichia coli CFT073
uuccggugcuuuauacaaauga

SEQ ID NO: 2660095 - RNA, 20 nt, Escherichia coli CFT073
uuccgguuugcguugccuga

SEQ ID NO: 2660096 - RNA, 22 nt, Escherichia coli CFT073
uuccguagcguuuuuucauuuc

SEQ ID NO: 2660097 - RNA, 16 nt, Escherichia coli CFT073
uuccgucagccgcccg

SEQ ID NO: 2660098 - RNA, 15 nt, Escherichia coli CFT073
uuccgucagcggcag

SEQ ID NO: 2660099 - RNA, 15 nt, Escherichia coli CFT073
uuccuacaagagguc

SEQ ID NO: 2660100 - RNA, 15 nt, Escherichia coli CFT073
uuccucaacaucuuc

SEQ ID NO: 2660101 - RNA, 23 nt, Escherichia coli CFT073
uuccucaucgucaaaugaauaac

SEQ ID NO: 2660102 - RNA, 15 nt, Escherichia coli CFT073
uuccucguuucgccc

SEQ ID NO: 2660103 - RNA, 22 nt, Escherichia coli CFT073
uuccugaacguguguuucgaua

SEQ ID NO: 2660104 - RNA, 18 nt, Escherichia coli CFT073
uuccugaaucagccagua

SEQ ID NO: 2660105 - RNA, 14 nt, Escherichia coli CFT073
uuccugaaugguga

SEQ ID NO: 2660106 - RNA, 14 nt, Escherichia coli CFT073
uuccugacccagca

SEQ ID NO: 2660107 - RNA, 20 nt, Escherichia coli CFT073
uuccugagucagcagcgcca

SEQ ID NO: 2660108 - RNA, 21 nt, Escherichia coli CFT073
uuccugauaaccuuccagcuu

SEQ ID NO: 2660109 - RNA, 14 nt, Escherichia coli CFT073
uuccugauccgcuu

SEQ ID NO: 2660110 - RNA, 20 nt, Escherichia coli CFT073
uuccugaugaaaaaucucca

SEQ ID NO: 2660111 - RNA, 14 nt, Escherichia coli CFT073
uuccugaugcgguu

SEQ ID NO: 2660112 - RNA, 21 nt, Escherichia coli CFT073
uuccugcaucgccugauucaa

SEQ ID NO: 2660113 - RNA, 13 nt, Escherichia coli CFT073
uuccugccagcgu

SEQ ID NO: 2660114 - RNA, 20 nt, Escherichia coli CFT073
uuccugcgccagcguuugcg

SEQ ID NO: 2660115 - RNA, 23 nt, Escherichia coli CFT073
uuccugcggcagacgcucgccau

SEQ ID NO: 2660116 - RNA, 23 nt, Escherichia coli CFT073
uuccugcguaacuguucgaggua

SEQ ID NO: 2660117 - RNA, 11 nt, Escherichia coli CFT073
uuccugcucgg

SEQ ID NO: 2660118 - RNA, 13 nt, Escherichia coli CFT073
uuccuggaacugg

SEQ ID NO: 2660119 - RNA, 21 nt, Escherichia coli CFT073
uuccuguauuugaauuucaaa

SEQ ID NO: 2660120 - RNA, 17 nt, Escherichia coli CFT073
uuccuguuucacgccca

SEQ ID NO: 2660121 - RNA, 18 nt, Escherichia coli CFT073
uuccuuaugcugcuuaca

SEQ ID NO: 2660122 - RNA, 13 nt, Escherichia coli CFT073
uuccuucaacccg

SEQ ID NO: 2660123 - RNA, 15 nt, Escherichia coli CFT073
uuccuucacauccau

SEQ ID NO: 2660124 - RNA, 18 nt, Escherichia coli CFT073
uuccuucgcgugacaaaa

SEQ ID NO: 2660125 - RNA, 16 nt, Escherichia coli CFT073
uuccuucgggaagccu

SEQ ID NO: 2660126 - RNA, 17 nt, Escherichia coli CFT073
uuccuucgggaagccuu

SEQ ID NO: 2660127 - RNA, 17 nt, Escherichia coli CFT073
uuccuuguuuaaggaaa

SEQ ID NO: 2660128 - RNA, 23 nt, Escherichia coli CFT073
uuccuuguuuaaggaaaaacgaa

SEQ ID NO: 2660129 - RNA, 18 nt, Escherichia coli CFT073
uuccuuuacuuugcaaug

SEQ ID NO: 2660130 - RNA, 20 nt, Escherichia coli CFT073
uuccuuuucgcauguaacug

SEQ ID NO: 2660131 - RNA, 13 nt, Escherichia coli CFT073
uucgaagaaaaac

SEQ ID NO: 2660132 - RNA, 19 nt, Escherichia coli CFT073
uucgaagaaaaacuggaug

SEQ ID NO: 2660133 - RNA, 14 nt, Escherichia coli CFT073
uucgaagguaaaag

SEQ ID NO: 2660134 - RNA, 15 nt, Escherichia coli CFT073
uucgaauccuucccc

SEQ ID NO: 2660135 - RNA, 17 nt, Escherichia coli CFT073
uucgacaauaaucaacg

SEQ ID NO: 2660136 - RNA, 16 nt, Escherichia coli CFT073
uucgacagcaccccga

SEQ ID NO: 2660137 - RNA, 14 nt, Escherichia coli CFT073
uucgaccacaccuu

SEQ ID NO: 2660138 - RNA, 20 nt, Escherichia coli CFT073
uucgaccaggucgccagugg

SEQ ID NO: 2660139 - RNA, 21 nt, Escherichia coli CFT073
uucgaccauugcguguuacgu

SEQ ID NO: 2660140 - RNA, 19 nt, Escherichia coli CFT073
uucgacgcgugcagaguca

SEQ ID NO: 2660141 - RNA, 17 nt, Escherichia coli CFT073
uucgacggcaccaaaaa

SEQ ID NO: 2660142 - RNA, 12 nt, Escherichia coli CFT073
uucgacuucauc

SEQ ID NO: 2660143 - RNA, 14 nt, Escherichia coli CFT073
uucgacuuccacca

SEQ ID NO: 2660144 - RNA, 16 nt, Escherichia coli CFT073
uucgagagaauuaacc

SEQ ID NO: 2660145 - RNA, 16 nt, Escherichia coli CFT073
uucgagcaauuuuccu

SEQ ID NO: 2660146 - RNA, 15 nt, Escherichia coli CFT073
uucgagguaauccag

SEQ ID NO: 2660147 - RNA, 22 nt, Escherichia coli CFT073
uucgagugucacuggccagcgg

SEQ ID NO: 2660148 - RNA, 17 nt, Escherichia coli CFT073
uucgauaaacucaauca

SEQ ID NO: 2660149 - RNA, 23 nt, Escherichia coli CFT073
uucgauaaacucaaucaggcuau

SEQ ID NO: 2660150 - RNA, 15 nt, Escherichia coli CFT073
uucgauaaaggccau

SEQ ID NO: 2660151 - RNA, 14 nt, Escherichia coli CFT073
uucgauaaucaaau

SEQ ID NO: 2660152 - RNA, 19 nt, Escherichia coli CFT073
uucgaugaugccggaauca

SEQ ID NO: 2660153 - RNA, 23 nt, Escherichia coli CFT073
uucgaugaugccggaaucaacca

SEQ ID NO: 2660154 - RNA, 20 nt, Escherichia coli CFT073
uucgaugcguaccauuucuu

SEQ ID NO: 2660155 - RNA, 21 nt, Escherichia coli CFT073
uucgaugcguaccauuucuuc

SEQ ID NO: 2660156 - RNA, 20 nt, Escherichia coli CFT073
uucgauggucauauccagca

SEQ ID NO: 2660157 - RNA, 16 nt, Escherichia coli CFT073
uucgauggugaugagc

SEQ ID NO: 2660158 - RNA, 16 nt, Escherichia coli CFT073
uucgauguggcucagc

SEQ ID NO: 2660159 - RNA, 14 nt, Escherichia coli CFT073
uucgauugcacaaa

SEQ ID NO: 2660160 - RNA, 15 nt, Escherichia coli CFT073
uucgcaaaaaaccau

SEQ ID NO: 2660161 - RNA, 19 nt, Escherichia coli CFT073
uucgcaaaaaaccaucccu

SEQ ID NO: 2660162 - RNA, 21 nt, Escherichia coli CFT073
uucgcaauaaucaucucuccu

SEQ ID NO: 2660163 - RNA, 19 nt, Escherichia coli CFT073
uucgcacgguucgccauca

SEQ ID NO: 2660164 - RNA, 13 nt, Escherichia coli CFT073
uucgcagcugcag

SEQ ID NO: 2660165 - RNA, 14 nt, Escherichia coli CFT073
uucgcaucgcuuuu

SEQ ID NO: 2660166 - RNA, 14 nt, Escherichia coli CFT073
uucgccacaaagcu

SEQ ID NO: 2660167 - RNA, 12 nt, Escherichia coli CFT073
uucgccacagcg

SEQ ID NO: 2660168 - RNA, 20 nt, Escherichia coli CFT073
uucgccagaauauugccauu

SEQ ID NO: 2660169 - RNA, 9 nt, Escherichia coli CFT073
uucgccagc

SEQ ID NO: 2660170 - RNA, 16 nt, Escherichia coli CFT073
uucgccagcacggcgc

SEQ ID NO: 2660171 - RNA, 13 nt, Escherichia coli CFT073
uucgccagcucca

SEQ ID NO: 2660172 - RNA, 12 nt, Escherichia coli CFT073
uucgccagucuc

SEQ ID NO: 2660173 - RNA, 13 nt, Escherichia coli CFT073
uucgccaucccug

SEQ ID NO: 2660174 - RNA, 19 nt, Escherichia coli CFT073
uucgcccauuaacaaccga

SEQ ID NO: 2660175 - RNA, 13 nt, Escherichia coli CFT073
uucgcccgccgcu

SEQ ID NO: 2660176 - RNA, 16 nt, Escherichia coli CFT073
uucgcccgccgcuaac

SEQ ID NO: 2660177 - RNA, 16 nt, Escherichia coli CFT073
uucgcccguucuuccu

SEQ ID NO: 2660178 - RNA, 23 nt, Escherichia coli CFT073
uucgccgcagcaucgucaucauu

SEQ ID NO: 2660179 - RNA, 14 nt, Escherichia coli CFT073
uucgccgcaucguc

SEQ ID NO: 2660180 - RNA, 21 nt, Escherichia coli CFT073
uucgccgcccagucccguacc

SEQ ID NO: 2660181 - RNA, 21 nt, Escherichia coli CFT073
uucgccgccgcauaucaucaa

SEQ ID NO: 2660182 - RNA, 23 nt, Escherichia coli CFT073
uucgccguguucuuacccacugu

SEQ ID NO: 2660183 - RNA, 21 nt, Escherichia coli CFT073
uucucgucaauacgacagcua

SEQ ID NO: 2660184 - RNA, 22 nt, Escherichia coli CFT073
uucucgugcuucgaaacagaaa

SEQ ID NO: 2660185 - RNA, 23 nt, Escherichia coli CFT073
uucucgugcuucgaaacagaaau

SEQ ID NO: 2660186 - RNA, 17 nt, Escherichia coli CFT073
uucucguuggguugcca

SEQ ID NO: 2660187 - RNA, 19 nt, Escherichia coli CFT073
uucucguuggguugccagc

SEQ ID NO: 2660188 - RNA, 19 nt, Escherichia coli CFT073
uucucucauccgccaaaac

SEQ ID NO: 2660189 - RNA, 19 nt, Escherichia coli CFT073
uucucucgcucaugccagg

SEQ ID NO: 2660190 - RNA, 23 nt, Escherichia coli CFT073
uucucugacgcucucaacgcccu

SEQ ID NO: 2660191 - RNA, 14 nt, Escherichia coli CFT073
uucucuucugcuuu

SEQ ID NO: 2660192 - RNA, 16 nt, Escherichia coli CFT073
uucucuuucacuccau

SEQ ID NO: 2660193 - RNA, 14 nt, Escherichia coli CFT073
uucucuuucagcgc

SEQ ID NO: 2660194 - RNA, 14 nt, Escherichia coli CFT073
uucucuuuccagca

SEQ ID NO: 2660195 - RNA, 20 nt, Escherichia coli CFT073
uucucuuugggcucacccau

SEQ ID NO: 2660196 - RNA, 19 nt, Escherichia coli CFT073
uucugacacugccacuuuu

SEQ ID NO: 2660197 - RNA, 21 nt, Escherichia coli CFT073
uucugacacugccacuuuuuc

SEQ ID NO: 2660198 - RNA, 23 nt, Escherichia coli CFT073
uucugacacugccacuuuuuccc

SEQ ID NO: 2660199 - RNA, 16 nt, Escherichia coli CFT073
uucugaccaaacugcg

SEQ ID NO: 2660200 - RNA, 19 nt, Escherichia coli CFT073
uucugagcccacuguuuga

SEQ ID NO: 2660201 - RNA, 12 nt, Escherichia coli CFT073
uucugauugguu

SEQ ID NO: 2660202 - RNA, 14 nt, Escherichia coli CFT073
uucugcaaccagaa

SEQ ID NO: 2660203 - RNA, 18 nt, Escherichia coli CFT073
uucugcacacacacgccc

SEQ ID NO: 2660204 - RNA, 12 nt, Escherichia coli CFT073
uucugcauugcg

SEQ ID NO: 2660205 - RNA, 18 nt, Escherichia coli CFT073
uucugccagacaaaacug

SEQ ID NO: 2660206 - RNA, 12 nt, Escherichia coli CFT073
uucugccagcgu

SEQ ID NO: 2660207 - RNA, 17 nt, Escherichia coli CFT073
uucugccaggcuggcag

SEQ ID NO: 2660208 - RNA, 22 nt, Escherichia coli CFT073
uucugccggaauaaucagaugu

SEQ ID NO: 2660209 - RNA, 16 nt, Escherichia coli CFT073
uucugcgccugguuuu

SEQ ID NO: 2660210 - RNA, 17 nt, Escherichia coli CFT073
uucugcgcgaaauuauc

SEQ ID NO: 2660211 - RNA, 20 nt, Escherichia coli CFT073
uucugcgguugugcaaaaaa

SEQ ID NO: 2660212 - RNA, 21 nt, Escherichia coli CFT073
uucugcgguugugcaaaaaaa

SEQ ID NO: 2660213 - RNA, 22 nt, Escherichia coli CFT073
uucugcguuagaaaacgccugc

SEQ ID NO: 2660214 - RNA, 15 nt, Escherichia coli CFT073
uucugcugcuuuauc

SEQ ID NO: 2660215 - RNA, 20 nt, Escherichia coli CFT073
uucugcuguucuucugccga

SEQ ID NO: 2660216 - RNA, 22 nt, Escherichia coli CFT073
uucugcuucauguugcagaugc

SEQ ID NO: 2660217 - RNA, 22 nt, Escherichia coli CFT073
uucugcuucgccaucuccauca

SEQ ID NO: 2660218 - RNA, 16 nt, Escherichia coli CFT073
uucuggaguaaugcau

SEQ ID NO: 2660219 - RNA, 14 nt, Escherichia coli CFT073
uucuggaugccauc

SEQ ID NO: 2660220 - RNA, 23 nt, Escherichia coli CFT073
uucuggcauccagcguucuauca

SEQ ID NO: 2660221 - RNA, 20 nt, Escherichia coli CFT073
uucuggccaugcggcgagga

SEQ ID NO: 2660222 - RNA, 18 nt, Escherichia coli CFT073
uucuggcuugcugccccc

SEQ ID NO: 2660223 - RNA, 14 nt, Escherichia coli CFT073
uucuggugaugcau

SEQ ID NO: 2660224 - RNA, 14 nt, Escherichia coli CFT073
uucuguagucccgg

SEQ ID NO: 2660225 - RNA, 13 nt, Escherichia coli CFT073
uucuguccugaaa

SEQ ID NO: 2660226 - RNA, 17 nt, Escherichia coli CFT073
uucugucgagcaucacu

SEQ ID NO: 2660227 - RNA, 20 nt, Escherichia coli CFT073
uucugucgauaaacucaugg

SEQ ID NO: 2660228 - RNA, 20 nt, Escherichia coli CFT073
uucuguuauauauuacccuu

SEQ ID NO: 2660229 - RNA, 16 nt, Escherichia coli CFT073
uucuguugccagcagu

SEQ ID NO: 2660230 - RNA, 17 nt, Escherichia coli CFT073
uucuuaaaaugaugcua

SEQ ID NO: 2660231 - RNA, 16 nt, Escherichia coli CFT073
uucuuaagauaagaau

SEQ ID NO: 2660232 - RNA, 20 nt, Escherichia coli CFT073
uucuuagucccaaacagcag

SEQ ID NO: 2660233 - RNA, 13 nt, Escherichia coli CFT073
uucuucaaaaaag

SEQ ID NO: 2660234 - RNA, 17 nt, Escherichia coli CFT073
uucuucaacaauugaag

SEQ ID NO: 2660235 - RNA, 19 nt, Escherichia coli CFT073
uucuucaaguguggccgcc

SEQ ID NO: 2660236 - RNA, 21 nt, Escherichia coli CFT073
uucuucaauuuccgucgcaug

SEQ ID NO: 2660237 - RNA, 12 nt, Escherichia coli CFT073
uucuucacugac

SEQ ID NO: 2660238 - RNA, 22 nt, Escherichia coli CFT073
uucuucagcguccgggaaaucc

SEQ ID NO: 2660239 - RNA, 22 nt, Escherichia coli CFT073
uucuucaggccagccugaucca

SEQ ID NO: 2660240 - RNA, 15 nt, Escherichia coli CFT073
uucuucaugcgucaa

SEQ ID NO: 2660241 - RNA, 21 nt, Escherichia coli CFT073
uucuucaugcgucaaaugcag

SEQ ID NO: 2660242 - RNA, 16 nt, Escherichia coli CFT073
uucuucauuccaguca

SEQ ID NO: 2660243 - RNA, 13 nt, Escherichia coli CFT073
uucuuccagcuuu

SEQ ID NO: 2660244 - RNA, 14 nt, Escherichia coli CFT073
uucuucccagaccc

SEQ ID NO: 2660245 - RNA, 22 nt, Escherichia coli CFT073
uucuuccggcagcaaauucacc

SEQ ID NO: 2660246 - RNA, 15 nt, Escherichia coli CFT073
uucuuccggcagcca

SEQ ID NO: 2660247 - RNA, 22 nt, Escherichia coli CFT073
uucuuccugccagcacuuugua

SEQ ID NO: 2660248 - RNA, 21 nt, Escherichia coli CFT073
uucuucgcgccauccagcuca

SEQ ID NO: 2660249 - RNA, 15 nt, Escherichia coli CFT073
uucuucuaauugugc

SEQ ID NO: 2660250 - RNA, 15 nt, Escherichia coli CFT073
uucuucugaauauca

SEQ ID NO: 2660251 - RNA, 16 nt, Escherichia coli CFT073
uucuucuucugacuca

SEQ ID NO: 2660252 - RNA, 17 nt, Escherichia coli CFT073
uucuucuuguucaucau

SEQ ID NO: 2660253 - RNA, 20 nt, Escherichia coli CFT073
uucuugaacauugacaguaa

SEQ ID NO: 2660254 - RNA, 22 nt, Escherichia coli CFT073
uucuugacuaucacucccucau

SEQ ID NO: 2660255 - RNA, 16 nt, Escherichia coli CFT073
uucuugcgucacaaau

SEQ ID NO: 2660256 - RNA, 20 nt, Escherichia coli CFT073
uucuuggcacccagcgcuuu

SEQ ID NO: 2660257 - RNA, 22 nt, Escherichia coli CFT073
uucuuguaacgaguacaaaaau

SEQ ID NO: 2660258 - RNA, 13 nt, Escherichia coli CFT073
uucuuguuuggca

SEQ ID NO: 2660259 - RNA, 11 nt, Escherichia coli CFT073
uucuuuaaaac

SEQ ID NO: 2660260 - RNA, 20 nt, Escherichia coli CFT073
uucuuuaguugagcuuuuuc

SEQ ID NO: 2660261 - RNA, 14 nt, Escherichia coli CFT073
uucuuucaccucuu

SEQ ID NO: 2660262 - RNA, 22 nt, Escherichia coli CFT073
uucuuucaggugaccaaagaag

SEQ ID NO: 2660263 - RNA, 19 nt, Escherichia coli CFT073
uucuuucggugcaucguga

SEQ ID NO: 2660264 - RNA, 17 nt, Escherichia coli CFT073
uucuuucucgccuuucu

SEQ ID NO: 2660265 - RNA, 21 nt, Escherichia coli CFT073
uucuuugaaugacgaucaacc

SEQ ID NO: 2660266 - RNA, 12 nt, Escherichia coli CFT073
uucuuuucccug

SEQ ID NO: 2660267 - RNA, 14 nt, Escherichia coli CFT073
uucuuuugcugccu

SEQ ID NO: 2660268 - RNA, 11 nt, Escherichia coli CFT073
uucuuuuucaa

SEQ ID NO: 2660269 - RNA, 13 nt, Escherichia coli CFT073
uugaaaaaaggcu

SEQ ID NO: 2660270 - RNA, 23 nt, Escherichia coli CFT073
uugaaacgaaaucuuguuuuuuu

SEQ ID NO: 2660271 - RNA, 23 nt, Escherichia coli CFT073
uugaaacgaguggugucgucaaa

SEQ ID NO: 2660272 - RNA, 19 nt, Escherichia coli CFT073
uugaaagagccgauaaaca

SEQ ID NO: 2660273 - RNA, 14 nt, Escherichia coli CFT073
uugaaauaaaauca

SEQ ID NO: 2660274 - RNA, 13 nt, Escherichia coli CFT073
uugaaauaaacca

SEQ ID NO: 2660275 - RNA, 22 nt, Escherichia coli CFT073
uugaaauaauauugcuuauccc

SEQ ID NO: 2660276 - RNA, 12 nt, Escherichia coli CFT073
uugaaauacaaa

SEQ ID NO: 2660277 - RNA, 12 nt, Escherichia coli CFT073
uugaaaucaaaa

SEQ ID NO: 2660278 - RNA, 17 nt, Escherichia coli CFT073
uugaaaucgaacagguu

SEQ ID NO: 2660279 - RNA, 17 nt, Escherichia coli CFT073
uugaaaugauuacuccc

SEQ ID NO: 2660280 - RNA, 16 nt, Escherichia coli CFT073
uugaacagaccacauu

SEQ ID NO: 2660281 - RNA, 18 nt, Escherichia coli CFT073
uugaacauugacaguaaa

SEQ ID NO: 2660282 - RNA, 14 nt, Escherichia coli CFT073
uugaacccggcauc

SEQ ID NO: 2660283 - RNA, 13 nt, Escherichia coli CFT073
uugaagcaaucca

SEQ ID NO: 2660284 - RNA, 21 nt, Escherichia coli CFT073
uugaagcccaguaccgccagu

SEQ ID NO: 2660285 - RNA, 15 nt, Escherichia coli CFT073
uugaagcugaacagu

SEQ ID NO: 2660286 - RNA, 22 nt, Escherichia coli CFT073
uugaagcuguaucaccggcauu

SEQ ID NO: 2660287 - RNA, 19 nt, Escherichia coli CFT073
uugaaggaauuaaucccuu

SEQ ID NO: 2660288 - RNA, 20 nt, Escherichia coli CFT073
uugaaggaauuaaucccuua

SEQ ID NO: 2660289 - RNA, 22 nt, Escherichia coli CFT073
uugaauaacggccccagagcua

SEQ ID NO: 2660290 - RNA, 18 nt, Escherichia coli CFT073
uugaaugguaucggcauc

SEQ ID NO: 2660291 - RNA, 12 nt, Escherichia coli CFT073
uugcaggcuauu

SEQ ID NO: 2660292 - RNA, 22 nt, Escherichia coli CFT073
uugcagggaggcaagacaugcu

SEQ ID NO: 2660293 - RNA, 19 nt, Escherichia coli CFT073
uugcaggucguccugcaaa

SEQ ID NO: 2660294 - RNA, 16 nt, Escherichia coli CFT073
uugcagguucugcucg

SEQ ID NO: 2660295 - RNA, 22 nt, Escherichia coli CFT073
uugcagucucaugcgucaugag

SEQ ID NO: 2660296 - RNA, 15 nt, Escherichia coli CFT073
uugcaguugauccau

SEQ ID NO: 2660297 - RNA, 15 nt, Escherichia coli CFT073
uugcauaucaauuag

SEQ ID NO: 2660298 - RNA, 13 nt, Escherichia coli CFT073
uugcauccaacuu

SEQ ID NO: 2660299 - RNA, 20 nt, Escherichia coli CFT073
uugcauccgauuguuccugc

SEQ ID NO: 2660300 - RNA, 21 nt, Escherichia coli CFT073
uugcaucgccaugaugagcgc

SEQ ID NO: 2660301 - RNA, 16 nt, Escherichia coli CFT073
uugcauuucugacgau

SEQ ID NO: 2660302 - RNA, 13 nt, Escherichia coli CFT073
uugccaaggucgg

SEQ ID NO: 2660303 - RNA, 22 nt, Escherichia coli CFT073
uugccaccgggagauccagcau

SEQ ID NO: 2660304 - RNA, 21 nt, Escherichia coli CFT073
uugccaccgguacaaacauca

SEQ ID NO: 2660305 - RNA, 23 nt, Escherichia coli CFT073
uugccaccgguacaaacaucauc

SEQ ID NO: 2660306 - RNA, 14 nt, Escherichia coli CFT073
uugccagaacugcu

SEQ ID NO: 2660307 - RNA, 21 nt, Escherichia coli CFT073
uugccagagcagcaacaagcc

SEQ ID NO: 2660308 - RNA, 13 nt, Escherichia coli CFT073
uugccagcagggc

SEQ ID NO: 2660309 - RNA, 13 nt, Escherichia coli CFT073
uugccagcagggu

SEQ ID NO: 2660310 - RNA, 19 nt, Escherichia coli CFT073
uugccagcccuaaaaacag

SEQ ID NO: 2660311 - RNA, 12 nt, Escherichia coli CFT073
uugccagcgcca

SEQ ID NO: 2660312 - RNA, 20 nt, Escherichia coli CFT073
uugccaggucgcuugccgcc

SEQ ID NO: 2660313 - RNA, 12 nt, Escherichia coli CFT073
uugccaggugcc

SEQ ID NO: 2660314 - RNA, 11 nt, Escherichia coli CFT073
uugccaguacc

SEQ ID NO: 2660315 - RNA, 21 nt, Escherichia coli CFT073
uugccauaaaaacgauaaaua

SEQ ID NO: 2660316 - RNA, 21 nt, Escherichia coli CFT073
uugccaugcauauccaggcua

SEQ ID NO: 2660317 - RNA, 17 nt, Escherichia coli CFT073
uugccauguuuuccuuu

SEQ ID NO: 2660318 - RNA, 18 nt, Escherichia coli CFT073
uugccauuacuacaaaca

SEQ ID NO: 2660319 - RNA, 23 nt, Escherichia coli CFT073
uugccauuccacaaaaaccacua

SEQ ID NO: 2660320 - RNA, 19 nt, Escherichia coli CFT073
uugcccaagaugccagaau

SEQ ID NO: 2660321 - RNA, 13 nt, Escherichia coli CFT073
uugcccauacccg

SEQ ID NO: 2660322 - RNA, 19 nt, Escherichia coli CFT073
uugccccagaauuuucccu

SEQ ID NO: 2660323 - RNA, 18 nt, Escherichia coli CFT073
uugcccccagucgccagu

SEQ ID NO: 2660324 - RNA, 21 nt, Escherichia coli CFT073
uugcccccagucgccaguaau

SEQ ID NO: 2660325 - RNA, 21 nt, Escherichia coli CFT073
uugcccccugaagcaguuuca

SEQ ID NO: 2660326 - RNA, 17 nt, Escherichia coli CFT073
uugccccucuaacucuu

SEQ ID NO: 2660327 - RNA, 15 nt, Escherichia coli CFT073
uugcccgcagaucca

SEQ ID NO: 2660328 - RNA, 20 nt, Escherichia coli CFT073
uugcccgcgcguuaacuccc

SEQ ID NO: 2660329 - RNA, 22 nt, Escherichia coli CFT073
uugcccgguuucgccgcggcgc

SEQ ID NO: 2660330 - RNA, 16 nt, Escherichia coli CFT073
uugcccugaucaccca

SEQ ID NO: 2660331 - RNA, 15 nt, Escherichia coli CFT073
uugccgacgcuccug

SEQ ID NO: 2660332 - RNA, 16 nt, Escherichia coli CFT073
uugccgacgcuccuga

SEQ ID NO: 2660333 - RNA, 23 nt, Escherichia coli CFT073
uugccgagaagauuuuuugccag

SEQ ID NO: 2660334 - RNA, 16 nt, Escherichia coli CFT073
uugccgaugauuccca

SEQ ID NO: 2660335 - RNA, 18 nt, Escherichia coli CFT073
uugccgaugauucccagu

SEQ ID NO: 2660336 - RNA, 21 nt, Escherichia coli CFT073
uugccgccacugugcgcguua

SEQ ID NO: 2660337 - RNA, 18 nt, Escherichia coli CFT073
uugccgcgcucuuuaaag

SEQ ID NO: 2660338 - RNA, 22 nt, Escherichia coli CFT073
uugccgcugggccaucaggcga

SEQ ID NO: 2660339 - RNA, 18 nt, Escherichia coli CFT073
uugccgcuuuuaugugca

SEQ ID NO: 2660340 - RNA, 17 nt, Escherichia coli CFT073
uugccggacgcugagca

SEQ ID NO: 2660341 - RNA, 21 nt, Escherichia coli CFT073
uugccggacgucaggccgcca

SEQ ID NO: 2660342 - RNA, 19 nt, Escherichia coli CFT073
uugccggaugcgacauaga

SEQ ID NO: 2660343 - RNA, 22 nt, Escherichia coli CFT073
uugccggaugcgacgcaaacgc

SEQ ID NO: 2660344 - RNA, 17 nt, Escherichia coli CFT073
uugccggaugugaugca

SEQ ID NO: 2660345 - RNA, 14 nt, Escherichia coli CFT073
uugccggucuuucu

SEQ ID NO: 2660346 - RNA, 17 nt, Escherichia coli CFT073
uugccguacucuucaau

SEQ ID NO: 2660347 - RNA, 14 nt, Escherichia coli CFT073
uugccgucugccac

SEQ ID NO: 2660348 - RNA, 15 nt, Escherichia coli CFT073
uugccgucugccacu

SEQ ID NO: 2660349 - RNA, 14 nt, Escherichia coli CFT073
uugccugaaaaaug

SEQ ID NO: 2660350 - RNA, 19 nt, Escherichia coli CFT073
uugccugaucgcgcaaaca

SEQ ID NO: 2660351 - RNA, 10 nt, Escherichia coli CFT073
uugccugaug

SEQ ID NO: 2660352 - RNA, 14 nt, Escherichia coli CFT073
uugccuggggagag

SEQ ID NO: 2660353 - RNA, 18 nt, Escherichia coli CFT073
uugccugugcaaccuuuu

SEQ ID NO: 2660354 - RNA, 19 nt, Escherichia coli CFT073
uugccugugcaaccuuuuc

SEQ ID NO: 2660355 - RNA, 21 nt, Escherichia coli CFT073
uugccuguuguggguaacguu

SEQ ID NO: 2660356 - RNA, 17 nt, Escherichia coli CFT073
uugccuugaugaaaaaa

SEQ ID NO: 2660357 - RNA, 13 nt, Escherichia coli CFT073
uugcgaaaaauaa

SEQ ID NO: 2660358 - RNA, 14 nt, Escherichia coli CFT073
uugcgaacucacca

SEQ ID NO: 2660359 - RNA, 22 nt, Escherichia coli CFT073
uugcgaauccgcggaugauucc

SEQ ID NO: 2660360 - RNA, 13 nt, Escherichia coli CFT073
uugcgacagccau

SEQ ID NO: 2660361 - RNA, 14 nt, Escherichia coli CFT073
uugcgacugaacca

SEQ ID NO: 2660362 - RNA, 18 nt, Escherichia coli CFT073
uugcgacugaaccagcgc

SEQ ID NO: 2660363 - RNA, 20 nt, Escherichia coli CFT073
uugcgaguggcgcgccugua

SEQ ID NO: 2660364 - RNA, 23 nt, Escherichia coli CFT073
uugcgaguggcgcgccuguaagc

SEQ ID NO: 2660365 - RNA, 14 nt, Escherichia coli CFT073
uugcgauaucccau

SEQ ID NO: 2660366 - RNA, 15 nt, Escherichia coli CFT073
uugcgcaacuuuuuc

SEQ ID NO: 2660367 - RNA, 15 nt, Escherichia coli CFT073
uugcgcauucagaau

SEQ ID NO: 2660368 - RNA, 15 nt, Escherichia coli CFT073
uugcgcauucuacuu

SEQ ID NO: 2660369 - RNA, 16 nt, Escherichia coli CFT073
uugcgccaaucccguc

SEQ ID NO: 2660370 - RNA, 15 nt, Escherichia coli CFT073
uugcgccacgcucug

SEQ ID NO: 2660371 - RNA, 19 nt, Escherichia coli CFT073
uugcgccaucaugaucaga

SEQ ID NO: 2660372 - RNA, 16 nt, Escherichia coli CFT073
uugcgcccauggcacu

SEQ ID NO: 2660373 - RNA, 17 nt, Escherichia coli CFT073
uugcgccgaacaacagu

SEQ ID NO: 2660374 - RNA, 20 nt, Escherichia coli CFT073
uugcgccguacaaguccuga

SEQ ID NO: 2660375 - RNA, 18 nt, Escherichia coli CFT073
uugcgcgguguugauaca

SEQ ID NO: 2660376 - RNA, 15 nt, Escherichia coli CFT073
uugcgcguuggcaag

SEQ ID NO: 2660377 - RNA, 16 nt, Escherichia coli CFT073
uugcgcucaauaauca

SEQ ID NO: 2660378 - RNA, 13 nt, Escherichia coli CFT073
uugcgcuguuacu

SEQ ID NO: 2660379 - RNA, 19 nt, Escherichia coli CFT073
uugcggaaacugucaauaa

SEQ ID NO: 2660380 - RNA, 20 nt, Escherichia coli CFT073
uugcggaauaugcugaauua

SEQ ID NO: 2660381 - RNA, 14 nt, Escherichia coli CFT073
uugcggcagaacgu

SEQ ID NO: 2660382 - RNA, 14 nt, Escherichia coli CFT073
uugcggcagcaaug

SEQ ID NO: 2660383 - RNA, 23 nt, Escherichia coli CFT073
uugcggcguauauugguaggcug

SEQ ID NO: 2660384 - RNA, 18 nt, Escherichia coli CFT073
uugcgggccaaagaccag

SEQ ID NO: 2660385 - RNA, 20 nt, Escherichia coli CFT073
uugcgggcgagauuuuacuu

SEQ ID NO: 2660386 - RNA, 22 nt, Escherichia coli CFT073
uugcgguaacggcagaucggua

SEQ ID NO: 2660387 - RNA, 20 nt, Escherichia coli CFT073
uugcggugcagcagcuucgu

SEQ ID NO: 2660388 - RNA, 13 nt, Escherichia coli CFT073
uugcgguuaaagc

SEQ ID NO: 2660389 - RNA, 15 nt, Escherichia coli CFT073
uugcgguuucaacug

SEQ ID NO: 2660390 - RNA, 15 nt, Escherichia coli CFT073
uugcguaaaaccugc

SEQ ID NO: 2660391 - RNA, 12 nt, Escherichia coli CFT073
uugcguaacuga

SEQ ID NO: 2660392 - RNA, 18 nt, Escherichia coli CFT073
uugcguacaccaacauca

SEQ ID NO: 2660393 - RNA, 20 nt, Escherichia coli CFT073
uugcguacaccaacaucacg

SEQ ID NO: 2660394 - RNA, 21 nt, Escherichia coli CFT073
uugcgucgaaaccacaguuca

SEQ ID NO: 2660395 - RNA, 15 nt, Escherichia coli CFT073
uugcgucuuaucagg

SEQ ID NO: 2660396 - RNA, 19 nt, Escherichia coli CFT073
uugcgucuuaucaggccua

SEQ ID NO: 2660397 - RNA, 23 nt, Escherichia coli CFT073
uugcgugaaaguuugugccgccg

SEQ ID NO: 2660398 - RNA, 15 nt, Escherichia coli CFT073
uugcgugacgccugc

SEQ ID NO: 2660399 - RNA, 13 nt, Escherichia coli CFT073
uuguacugcucgc

SEQ ID NO: 2660400 - RNA, 15 nt, Escherichia coli CFT073
uuguacugucuaaug

SEQ ID NO: 2660401 - RNA, 20 nt, Escherichia coli CFT073
uuguacugucuaaugauuca

SEQ ID NO: 2660402 - RNA, 15 nt, Escherichia coli CFT073
uuguacuuuaaaaua

SEQ ID NO: 2660403 - RNA, 15 nt, Escherichia coli CFT073
uuguacuuuccagcc

SEQ ID NO: 2660404 - RNA, 19 nt, Escherichia coli CFT073
uuguagacaugguaaaacc

SEQ ID NO: 2660405 - RNA, 13 nt, Escherichia coli CFT073
uuguagaccagga

SEQ ID NO: 2660406 - RNA, 19 nt, Escherichia coli CFT073
uuguagccacgucugccac

SEQ ID NO: 2660407 - RNA, 20 nt, Escherichia coli CFT073
uuguaggccagauaaaacac

SEQ ID NO: 2660408 - RNA, 20 nt, Escherichia coli CFT073
uuguaggccggauaaggcgu

SEQ ID NO: 2660409 - RNA, 17 nt, Escherichia coli CFT073
uuguaggccugauaaga

SEQ ID NO: 2660410 - RNA, 20 nt, Escherichia coli CFT073
uuguaggccugauaaggcau

SEQ ID NO: 2660411 - RNA, 20 nt, Escherichia coli CFT073
uuguaggucggauaaggcgu

SEQ ID NO: 2660412 - RNA, 19 nt, Escherichia coli CFT073
uuguagugauccugcauac

SEQ ID NO: 2660413 - RNA, 22 nt, Escherichia coli CFT073
uuguagugcgcgccaguaauca

SEQ ID NO: 2660414 - RNA, 16 nt, Escherichia coli CFT073
uuguauaacaugguga

SEQ ID NO: 2660415 - RNA, 12 nt, Escherichia coli CFT073
uuguaucaccac

SEQ ID NO: 2660416 - RNA, 15 nt, Escherichia coli CFT073
uuguaucccuuuuca

SEQ ID NO: 2660417 - RNA, 23 nt, Escherichia coli CFT073
uuguaugucggugcauuuucuau

SEQ ID NO: 2660418 - RNA, 18 nt, Escherichia coli CFT073
uuguauucagacguccac

SEQ ID NO: 2660419 - RNA, 15 nt, Escherichia coli CFT073
uugucagcaugucuu

SEQ ID NO: 2660420 - RNA, 22 nt, Escherichia coli CFT073
uugucagcaugucuugccuccc

SEQ ID NO: 2660421 - RNA, 20 nt, Escherichia coli CFT073
uugucagcccuuuuggcaca

SEQ ID NO: 2660422 - RNA, 15 nt, Escherichia coli CFT073
uugucaggaucacca

SEQ ID NO: 2660423 - RNA, 16 nt, Escherichia coli CFT073
uugucauaaccaaugu

SEQ ID NO: 2660424 - RNA, 14 nt, Escherichia coli CFT073
uugucaucagucuu

SEQ ID NO: 2660425 - RNA, 22 nt, Escherichia coli CFT073
uugucaucgaauaaauugagcu

SEQ ID NO: 2660426 - RNA, 23 nt, Escherichia coli CFT073
uugucauuguuauaauguuggcu

SEQ ID NO: 2660427 - RNA, 16 nt, Escherichia coli CFT073
uuguccaccguuguga

SEQ ID NO: 2660428 - RNA, 20 nt, Escherichia coli CFT073
uuguccaccguugugaaaau

SEQ ID NO: 2660429 - RNA, 16 nt, Escherichia coli CFT073
uuguccagaucuuucg

SEQ ID NO: 2660430 - RNA, 15 nt, Escherichia coli CFT073
uuguccgccagaaag

SEQ ID NO: 2660431 - RNA, 15 nt, Escherichia coli CFT073
uuguccgucugaaaa

SEQ ID NO: 2660432 - RNA, 19 nt, Escherichia coli CFT073
uugucgaugggggagguca

SEQ ID NO: 2660433 - RNA, 18 nt, Escherichia coli CFT073
uugucggcgugaacgcgc

SEQ ID NO: 2660434 - RNA, 23 nt, Escherichia coli CFT073
uugucgggcaggagcugagugcg

SEQ ID NO: 2660435 - RNA, 14 nt, Escherichia coli CFT073
uugucgggcaggcu

SEQ ID NO: 2660436 - RNA, 16 nt, Escherichia coli CFT073
uugucgguaauuucac

SEQ ID NO: 2660437 - RNA, 14 nt, Escherichia coli CFT073
uugucuccagggcg

SEQ ID NO: 2660438 - RNA, 16 nt, Escherichia coli CFT073
uugucugaacguucug

SEQ ID NO: 2660439 - RNA, 15 nt, Escherichia coli CFT073
uugucugccauuagc

SEQ ID NO: 2660440 - RNA, 23 nt, Escherichia coli CFT073
uugucuggcauaaaagggcagca

SEQ ID NO: 2660441 - RNA, 14 nt, Escherichia coli CFT073
uugugaaaauaacg

SEQ ID NO: 2660442 - RNA, 13 nt, Escherichia coli CFT073
uugugaagugcaa

SEQ ID NO: 2660443 - RNA, 14 nt, Escherichia coli CFT073
uugugaaguucaug

SEQ ID NO: 2660444 - RNA, 13 nt, Escherichia coli CFT073
uugugaugccacu

SEQ ID NO: 2660445 - RNA, 14 nt, Escherichia coli CFT073
uugugaugccacuu

SEQ ID NO: 2660446 - RNA, 17 nt, Escherichia coli CFT073
uugugauuuuagccaua

SEQ ID NO: 2660447 - RNA, 14 nt, Escherichia coli CFT073
uugugcaaaaaaau

SEQ ID NO: 2660448 - RNA, 19 nt, Escherichia coli CFT073
uugugcaaaaaaauuucau

SEQ ID NO: 2660449 - RNA, 16 nt, Escherichia coli CFT073
uugugcagcacacgau

SEQ ID NO: 2660450 - RNA, 20 nt, Escherichia coli CFT073
uugugccacauccagcggca

SEQ ID NO: 2660451 - RNA, 12 nt, Escherichia coli CFT073
uugugccagacc

SEQ ID NO: 2660452 - RNA, 19 nt, Escherichia coli CFT073
uugugccaucgccacacca

SEQ ID NO: 2660453 - RNA, 13 nt, Escherichia coli CFT073
uugugcccuucca

SEQ ID NO: 2660454 - RNA, 19 nt, Escherichia coli CFT073
uugugcgccacauccggca

SEQ ID NO: 2660455 - RNA, 21 nt, Escherichia coli CFT073
uugugcgccaguucauccaga

SEQ ID NO: 2660456 - RNA, 22 nt, Escherichia coli CFT073
uugugcgguccaugcgaagacc

SEQ ID NO: 2660457 - RNA, 22 nt, Escherichia coli CFT073
uugugcuacugcuucaaaguuu

SEQ ID NO: 2660458 - RNA, 14 nt, Escherichia coli CFT073
uuguggcucgccau

SEQ ID NO: 2660459 - RNA, 12 nt, Escherichia coli CFT073
uugugggccuga

SEQ ID NO: 2660460 - RNA, 21 nt, Escherichia coli CFT073
uugugguccgcauucguucau

SEQ ID NO: 2660461 - RNA, 12 nt, Escherichia coli CFT073
uugugguuuucu

SEQ ID NO: 2660462 - RNA, 23 nt, Escherichia coli CFT073
uuguguaguuaaaaaaugcagca

SEQ ID NO: 2660463 - RNA, 23 nt, Escherichia coli CFT073
uuguguaucaggucgaaaauaau

SEQ ID NO: 2660464 - RNA, 17 nt, Escherichia coli CFT073
uuguuaacucuggggaa

SEQ ID NO: 2660465 - RNA, 15 nt, Escherichia coli CFT073
uuguuagcaugcuga

SEQ ID NO: 2660466 - RNA, 16 nt, Escherichia coli CFT073
uuguuagccacaucca

SEQ ID NO: 2660467 - RNA, 17 nt, Escherichia coli CFT073
uuguuauaacucuuccc

SEQ ID NO: 2660468 - RNA, 12 nt, Escherichia coli CFT073
uuguuauccauc

SEQ ID NO: 2660469 - RNA, 22 nt, Escherichia coli CFT073
uuguucaaaggcagaaacggcu

SEQ ID NO: 2660470 - RNA, 17 nt, Escherichia coli CFT073
uuguucacaccaucauc

SEQ ID NO: 2660471 - RNA, 15 nt, Escherichia coli CFT073
uuguugcaggaacag

SEQ ID NO: 2660472 - RNA, 13 nt, Escherichia coli CFT073
uuguugccggaug

SEQ ID NO: 2660473 - RNA, 18 nt, Escherichia coli CFT073
uuguuggcgcugcugggc

SEQ ID NO: 2660474 - RNA, 21 nt, Escherichia coli CFT073
uuguugugggcaggaaaauca

SEQ ID NO: 2660475 - RNA, 20 nt, Escherichia coli CFT073
uuguuuaaucaacuguggaa

SEQ ID NO: 2660476 - RNA, 21 nt, Escherichia coli CFT073
uuguuuacuaaaaguuauuaa

SEQ ID NO: 2660477 - RNA, 22 nt, Escherichia coli CFT073
uuguuuacuaaaaguuauuaaa

SEQ ID NO: 2660478 - RNA, 16 nt, Escherichia coli CFT073
uuguuuaugccagaug

SEQ ID NO: 2660479 - RNA, 20 nt, Escherichia coli CFT073
uuguuucccccacugugcac

SEQ ID NO: 2660480 - RNA, 14 nt, Escherichia coli CFT073
uuuaaaaaaauuaa

SEQ ID NO: 2660481 - RNA, 23 nt, Escherichia coli CFT073
uuuaaaagcuuaugcuguacuuu

SEQ ID NO: 2660482 - RNA, 19 nt, Escherichia coli CFT073
uuuaaaaucuuugaaauaa

SEQ ID NO: 2660483 - RNA, 12 nt, Escherichia coli CFT073
uuuaaacagaau

SEQ ID NO: 2660484 - RNA, 21 nt, Escherichia coli CFT073
uuuaaacggcauaaauuucag

SEQ ID NO: 2660485 - RNA, 13 nt, Escherichia coli CFT073
uuuaaauaacaua

SEQ ID NO: 2660486 - RNA, 20 nt, Escherichia coli CFT073
uuuaaauauuguuuuuauug

SEQ ID NO: 2660487 - RNA, 15 nt, Escherichia coli CFT073
uuuaaaugcacagga

SEQ ID NO: 2660488 - RNA, 20 nt, Escherichia coli CFT073
uuuaacaauucuccaaacgu

SEQ ID NO: 2660489 - RNA, 17 nt, Escherichia coli CFT073
uuuaacaauuuaucaga

SEQ ID NO: 2660490 - RNA, 12 nt, Escherichia coli CFT073
uuuaacaucauu

SEQ ID NO: 2660491 - RNA, 11 nt, Escherichia coli CFT073
uuuaacauuac

SEQ ID NO: 2660492 - RNA, 11 nt, Escherichia coli CFT073
uuuaaccaaca

SEQ ID NO: 2660493 - RNA, 15 nt, Escherichia coli CFT073
uuuaaccugcauacc

SEQ ID NO: 2660494 - RNA, 12 nt, Escherichia coli CFT073
uuuaacgcauca

SEQ ID NO: 2660495 - RNA, 16 nt, Escherichia coli CFT073
uuuaacuaucaggucu

SEQ ID NO: 2660496 - RNA, 19 nt, Escherichia coli CFT073
uuuaauaaaaaggugauuu

SEQ ID NO: 2660497 - RNA, 15 nt, Escherichia coli CFT073
uuuaauacaaucugg

SEQ ID NO: 2660498 - RNA, 20 nt, Escherichia coli CFT073
uuuaauauccggugcauuca

SEQ ID NO: 2660499 - RNA, 21 nt, Escherichia coli CFT073
uuuaaucuauauauguuuuuu

SEQ ID NO: 2660500 - RNA, 16 nt, Escherichia coli CFT073
uuuaaugccaaucuuc

SEQ ID NO: 2660501 - RNA, 21 nt, Escherichia coli CFT073
uuuaauggccucguggaaacc

SEQ ID NO: 2660502 - RNA, 19 nt, Escherichia coli CFT073
uuuacaauauccagcgcgc

SEQ ID NO: 2660503 - RNA, 11 nt, Escherichia coli CFT073
uuuacauaaau

SEQ ID NO: 2660504 - RNA, 13 nt, Escherichia coli CFT073
uuuacaucaucag

SEQ ID NO: 2660505 - RNA, 19 nt, Escherichia coli CFT073
uuuacaucaucagaaaugc

SEQ ID NO: 2660506 - RNA, 16 nt, Escherichia coli CFT073
uuuacauuaauuuuca

SEQ ID NO: 2660507 - RNA, 19 nt, Escherichia coli CFT073
uuuacauuaauuuucaauu

SEQ ID NO: 2660508 - RNA, 14 nt, Escherichia coli CFT073
uuucagcaccagau

SEQ ID NO: 2660509 - RNA, 19 nt, Escherichia coli CFT073
uuucagcaccagauaauga

SEQ ID NO: 2660510 - RNA, 23 nt, Escherichia coli CFT073
uuucagcgccgcgcuauuuuccu

SEQ ID NO: 2660511 - RNA, 18 nt, Escherichia coli CFT073
uuucagcggcguguuauu

SEQ ID NO: 2660512 - RNA, 14 nt, Escherichia coli CFT073
uuucagcucacggc

SEQ ID NO: 2660513 - RNA, 20 nt, Escherichia coli CFT073
uuucaggcaacaaaaaaccc

SEQ ID NO: 2660514 - RNA, 15 nt, Escherichia coli CFT073
uuucaggucaguuuu

SEQ ID NO: 2660515 - RNA, 18 nt, Escherichia coli CFT073
uuucaguggguuaugaaa

SEQ ID NO: 2660516 - RNA, 14 nt, Escherichia coli CFT073
uuucaguuggcagc

SEQ ID NO: 2660517 - RNA, 15 nt, Escherichia coli CFT073
uuucaguuugccgcu

SEQ ID NO: 2660518 - RNA, 13 nt, Escherichia coli CFT073
uuucaguuugcug

SEQ ID NO: 2660519 - RNA, 19 nt, Escherichia coli CFT073
uuucauaucugccagauaa

SEQ ID NO: 2660520 - RNA, 16 nt, Escherichia coli CFT073
uuucaucaucaggcau

SEQ ID NO: 2660521 - RNA, 15 nt, Escherichia coli CFT073
uuucaucccucucau

SEQ ID NO: 2660522 - RNA, 14 nt, Escherichia coli CFT073
uuucauccugccau

SEQ ID NO: 2660523 - RNA, 15 nt, Escherichia coli CFT073
uuucauccuucauua

SEQ ID NO: 2660524 - RNA, 19 nt, Escherichia coli CFT073
uuucauccuucauuacccu

SEQ ID NO: 2660525 - RNA, 16 nt, Escherichia coli CFT073
uuucaucgauccccug

SEQ ID NO: 2660526 - RNA, 20 nt, Escherichia coli CFT073
uuucaucgauccccugcccg

SEQ ID NO: 2660527 - RNA, 22 nt, Escherichia coli CFT073
uuucaucgcccaggcaaguagc

SEQ ID NO: 2660528 - RNA, 12 nt, Escherichia coli CFT073
uuucaugaauaa

SEQ ID NO: 2660529 - RNA, 16 nt, Escherichia coli CFT073
uuucaugcuauuccuu

SEQ ID NO: 2660530 - RNA, 16 nt, Escherichia coli CFT073
uuucaugcucaccaau

SEQ ID NO: 2660531 - RNA, 24 nt, Escherichia coli CFT073
uuucaugcucaccaauccaggcaa

SEQ ID NO: 2660532 - RNA, 16 nt, Escherichia coli CFT073
uuucauguaacgcugc

SEQ ID NO: 2660533 - RNA, 14 nt, Escherichia coli CFT073
uuucauuauucauu

SEQ ID NO: 2660534 - RNA, 17 nt, Escherichia coli CFT073
uuucauucagcguauca

SEQ ID NO: 2660535 - RNA, 16 nt, Escherichia coli CFT073
uuucauuccaguaagg

SEQ ID NO: 2660536 - RNA, 15 nt, Escherichia coli CFT073
uuucauuuaagccac

SEQ ID NO: 2660537 - RNA, 16 nt, Escherichia coli CFT073
uuucauuuaagccacu

SEQ ID NO: 2660538 - RNA, 21 nt, Escherichia coli CFT073
uuucauuuggauggaaaauuu

SEQ ID NO: 2660539 - RNA, 22 nt, Escherichia coli CFT073
uuuccacgcuauacagcagcca

SEQ ID NO: 2660540 - RNA, 17 nt, Escherichia coli CFT073
uuuccacucacacagcu

SEQ ID NO: 2660541 - RNA, 12 nt, Escherichia coli CFT073
uuuccacuggau

SEQ ID NO: 2660542 - RNA, 10 nt, Escherichia coli CFT073
uuuccagaac

SEQ ID NO: 2660543 - RNA, 22 nt, Escherichia coli CFT073
uuuccagacugaugugcuccau

SEQ ID NO: 2660544 - RNA, 17 nt, Escherichia coli CFT073
uuuccagaucggcuuca

SEQ ID NO: 2660545 - RNA, 22 nt, Escherichia coli CFT073
uuuccagcacauauucacgggc

SEQ ID NO: 2660546 - RNA, 12 nt, Escherichia coli CFT073
uuuccagcacca

SEQ ID NO: 2660547 - RNA, 21 nt, Escherichia coli CFT073
uuuccagcucaaccagauucg

SEQ ID NO: 2660548 - RNA, 23 nt, Escherichia coli CFT073
uuuccagggccaguacacaaucc

SEQ ID NO: 2660549 - RNA, 14 nt, Escherichia coli CFT073
uuuccaguucuagu

SEQ ID NO: 2660550 - RNA, 21 nt, Escherichia coli CFT073
uuuccauccgguacuuuccuu

SEQ ID NO: 2660551 - RNA, 20 nt, Escherichia coli CFT073
uuuccaucuccagcugcucg

SEQ ID NO: 2660552 - RNA, 14 nt, Escherichia coli CFT073
uuucccaacaguuu

SEQ ID NO: 2660553 - RNA, 21 nt, Escherichia coli CFT073
uuucccaacgugaccaguacc

SEQ ID NO: 2660554 - RNA, 21 nt, Escherichia coli CFT073
uuucccagcaagaaccaugca

SEQ ID NO: 2660555 - RNA, 23 nt, Escherichia coli CFT073
uuucccagcgcgaaagauaaggu

SEQ ID NO: 2660556 - RNA, 13 nt, Escherichia coli CFT073
uuuccccaauuca

SEQ ID NO: 2660557 - RNA, 13 nt, Escherichia coli CFT073
uuuccccaucgga

SEQ ID NO: 2660558 - RNA, 14 nt, Escherichia coli CFT073
uuucccccacagcu

SEQ ID NO: 2660559 - RNA, 23 nt, Escherichia coli CFT073
uuucccccacagcucugcuguca

SEQ ID NO: 2660560 - RNA, 18 nt, Escherichia coli CFT073
uuuccccuaacucuuuca

SEQ ID NO: 2660561 - RNA, 17 nt, Escherichia coli CFT073
uuucccgacacacugcg

SEQ ID NO: 2660562 - RNA, 22 nt, Escherichia coli CFT073
uuucccgauaaccuucuucauu

SEQ ID NO: 2660563 - RNA, 19 nt, Escherichia coli CFT073
uuucccgggcgagcaaugu

SEQ ID NO: 2660564 - RNA, 16 nt, Escherichia coli CFT073
uuucccgguuaucacc

SEQ ID NO: 2660565 - RNA, 18 nt, Escherichia coli CFT073
uuucccugacuugcgaac

SEQ ID NO: 2660566 - RNA, 22 nt, Escherichia coli CFT073
uuucccuucacucugcugccac

SEQ ID NO: 2660567 - RNA, 20 nt, Escherichia coli CFT073
uuucccuucgauuugccgga

SEQ ID NO: 2660568 - RNA, 18 nt, Escherichia coli CFT073
uuuccgcacguuuuucca

SEQ ID NO: 2660569 - RNA, 20 nt, Escherichia coli CFT073
uuuccgcacguuuuuccagu

SEQ ID NO: 2660570 - RNA, 19 nt, Escherichia coli CFT073
uuuccgccauucagauuga

SEQ ID NO: 2660571 - RNA, 21 nt, Escherichia coli CFT073
uuuccgcgaauuaugcagccu

SEQ ID NO: 2660572 - RNA, 22 nt, Escherichia coli CFT073
uuuccgcuggccgguuugccau

SEQ ID NO: 2660573 - RNA, 21 nt, Escherichia coli CFT073
uuuccggaaaaaucaaaaacu

SEQ ID NO: 2660574 - RNA, 23 nt, Escherichia coli CFT073
uuuccggaucgccaaagcggcag

SEQ ID NO: 2660575 - RNA, 18 nt, Escherichia coli CFT073
uuuccggcagaagcaguc

SEQ ID NO: 2660576 - RNA, 20 nt, Escherichia coli CFT073
uuuccggugccaucuccagu

SEQ ID NO: 2660577 - RNA, 16 nt, Escherichia coli CFT073
uuuccguaucugucag

SEQ ID NO: 2660578 - RNA, 14 nt, Escherichia coli CFT073
uuuccgucagcggc

SEQ ID NO: 2660579 - RNA, 15 nt, Escherichia coli CFT073
uuuccgucagcggca

SEQ ID NO: 2660580 - RNA, 19 nt, Escherichia coli CFT073
uuuccguugugcgauccac

SEQ ID NO: 2660581 - RNA, 20 nt, Escherichia coli CFT073
uuuccucaacaucuucacca

SEQ ID NO: 2660582 - RNA, 19 nt, Escherichia coli CFT073
uuuccugcacaaugccuuu

SEQ ID NO: 2660583 - RNA, 20 nt, Escherichia coli CFT073
uuuccugccagaccuuauca

SEQ ID NO: 2660584 - RNA, 20 nt, Escherichia coli CFT073
uuuccugcucggcaaacugc

SEQ ID NO: 2660585 - RNA, 18 nt, Escherichia coli CFT073
uuuccugggccagcacca

SEQ ID NO: 2660586 - RNA, 18 nt, Escherichia coli CFT073
uuuccuguuucacgccca

SEQ ID NO: 2660587 - RNA, 23 nt, Escherichia coli CFT073
uuuccuuccuccccgguagccau

SEQ ID NO: 2660588 - RNA, 20 nt, Escherichia coli CFT073
uuuccuucgggaucaaccgc

SEQ ID NO: 2660589 - RNA, 12 nt, Escherichia coli CFT073
uuuccuuuucgc

SEQ ID NO: 2660590 - RNA, 22 nt, Escherichia coli CFT073
uuucgaggauccaugacaucuc

SEQ ID NO: 2660591 - RNA, 14 nt, Escherichia coli CFT073
uuucgauaaucaaa

SEQ ID NO: 2660592 - RNA, 15 nt, Escherichia coli CFT073
uuucgauaaucauca

SEQ ID NO: 2660593 - RNA, 14 nt, Escherichia coli CFT073
uuucgauauguucc

SEQ ID NO: 2660594 - RNA, 13 nt, Escherichia coli CFT073
uuucgauugcaca

SEQ ID NO: 2660595 - RNA, 15 nt, Escherichia coli CFT073
uuucgauuuguucug

SEQ ID NO: 2660596 - RNA, 17 nt, Escherichia coli CFT073
uuucgauuuuuuccagc

SEQ ID NO: 2660597 - RNA, 12 nt, Escherichia coli CFT073
uuucgcaaacca

SEQ ID NO: 2660598 - RNA, 15 nt, Escherichia coli CFT073
uuucgcaaaccaaac

SEQ ID NO: 2660599 - RNA, 20 nt, Escherichia coli CFT073
uuucgccaccggcaaucugc

SEQ ID NO: 2660600 - RNA, 14 nt, Escherichia coli CFT073
uuucgccugcaaau

SEQ ID NO: 2660601 - RNA, 17 nt, Escherichia coli CFT073
uuucgcggcauaacaga

SEQ ID NO: 2660602 - RNA, 16 nt, Escherichia coli CFT073
uuucgcgucaaucaca

SEQ ID NO: 2660603 - RNA, 18 nt, Escherichia coli CFT073
uuucgcgucaaucacacu

SEQ ID NO: 2660604 - RNA, 21 nt, Escherichia coli CFT073
uuucgcgucaaucacacugac

SEQ ID NO: 2660605 - RNA, 16 nt, Escherichia coli CFT073
uuucgcugauuuguua

SEQ ID NO: 2660606 - RNA, 16 nt, Escherichia coli CFT073
uuucgcugucgguacu

SEQ ID NO: 2660607 - RNA, 17 nt, Escherichia coli CFT073
uuucgcuuuacucccgu

SEQ ID NO: 2660608 - RNA, 20 nt, Escherichia coli CFT073
uuucgcuuucaauuccugga

SEQ ID NO: 2660609 - RNA, 15 nt, Escherichia coli CFT073
uuucguaccagugca

SEQ ID NO: 2660610 - RNA, 17 nt, Escherichia coli CFT073
uuucgucgcaucacaga

SEQ ID NO: 2660611 - RNA, 15 nt, Escherichia coli CFT073
uuucgucguacugac

SEQ ID NO: 2660612 - RNA, 22 nt, Escherichia coli CFT073
uuucuaaaaagaggccggugcu

SEQ ID NO: 2660613 - RNA, 13 nt, Escherichia coli CFT073
uuucuaccagguu

SEQ ID NO: 2660614 - RNA, 20 nt, Escherichia coli CFT073
uuucuacguuaucgcgccau

SEQ ID NO: 2660615 - RNA, 13 nt, Escherichia coli CFT073
uuucuacuucuuu

SEQ ID NO: 2660616 - RNA, 20 nt, Escherichia coli CFT073
uuugcgcggcauuacgcccg

SEQ ID NO: 2660617 - RNA, 20 nt, Escherichia coli CFT073
uuugcgcuccaucagauuca

SEQ ID NO: 2660618 - RNA, 18 nt, Escherichia coli CFT073
uuugcgcucgcugaugga

SEQ ID NO: 2660619 - RNA, 18 nt, Escherichia coli CFT073
uuugcggcgcuucuuuag

SEQ ID NO: 2660620 - RNA, 21 nt, Escherichia coli CFT073
uuugcgguaacguaauucgga

SEQ ID NO: 2660621 - RNA, 22 nt, Escherichia coli CFT073
uuugcguaacguaauccugcgg

SEQ ID NO: 2660622 - RNA, 14 nt, Escherichia coli CFT073
uuugcgucgcaucc

SEQ ID NO: 2660623 - RNA, 13 nt, Escherichia coli CFT073
uuugcuccagaaa

SEQ ID NO: 2660624 - RNA, 17 nt, Escherichia coli CFT073
uuugcuccgccagugac

SEQ ID NO: 2660625 - RNA, 18 nt, Escherichia coli CFT073
uuugcucuucuuucauca

SEQ ID NO: 2660626 - RNA, 22 nt, Escherichia coli CFT073
uuugcugaauuggguucuuucc

SEQ ID NO: 2660627 - RNA, 13 nt, Escherichia coli CFT073
uuugcugcuggca

SEQ ID NO: 2660628 - RNA, 17 nt, Escherichia coli CFT073
uuugcuggcaccgugaa

SEQ ID NO: 2660629 - RNA, 16 nt, Escherichia coli CFT073
uuugcuggucuguucc

SEQ ID NO: 2660630 - RNA, 16 nt, Escherichia coli CFT073
uuugcugguggcauuu

SEQ ID NO: 2660631 - RNA, 14 nt, Escherichia coli CFT073
uuugcuuuguaaag

SEQ ID NO: 2660632 - RNA, 15 nt, Escherichia coli CFT073
uuuggacaugcccgu

SEQ ID NO: 2660633 - RNA, 17 nt, Escherichia coli CFT073
uuuggauggaaaauuuu

SEQ ID NO: 2660634 - RNA, 22 nt, Escherichia coli CFT073
uuuggauggaaaauuuuuucag

SEQ ID NO: 2660635 - RNA, 19 nt, Escherichia coli CFT073
uuuggcaccguuagugauu

SEQ ID NO: 2660636 - RNA, 20 nt, Escherichia coli CFT073
uuuggcaccguuagugauuu

SEQ ID NO: 2660637 - RNA, 12 nt, Escherichia coli CFT073
uuuggcaccuuc

SEQ ID NO: 2660638 - RNA, 20 nt, Escherichia coli CFT073
uuuggcaggcaaccauauuu

SEQ ID NO: 2660639 - RNA, 14 nt, Escherichia coli CFT073
uuuggcaucggcaa

SEQ ID NO: 2660640 - RNA, 11 nt, Escherichia coli CFT073
uuuggcaucuu

SEQ ID NO: 2660641 - RNA, 22 nt, Escherichia coli CFT073
uuuggcgaaauagccgaaaacg

SEQ ID NO: 2660642 - RNA, 19 nt, Escherichia coli CFT073
uuuggcggccuucuuccag

SEQ ID NO: 2660643 - RNA, 18 nt, Escherichia coli CFT073
uuuggucuggcaaaaaua

SEQ ID NO: 2660644 - RNA, 23 nt, Escherichia coli CFT073
uuugguuaacugaauauuccagu

SEQ ID NO: 2660645 - RNA, 22 nt, Escherichia coli CFT073
uuugguuauccagcaaccaggu

SEQ ID NO: 2660646 - RNA, 14 nt, Escherichia coli CFT073
uuugguuucacuaa

SEQ ID NO: 2660647 - RNA, 18 nt, Escherichia coli CFT073
uuuguaaggaguuuuguc

SEQ ID NO: 2660648 - RNA, 19 nt, Escherichia coli CFT073
uuuguaccagacgcgggca

SEQ ID NO: 2660649 - RNA, 19 nt, Escherichia coli CFT073
uuuguaccguacagauaca

SEQ ID NO: 2660650 - RNA, 12 nt, Escherichia coli CFT073
uuuguaggccug

SEQ ID NO: 2660651 - RNA, 17 nt, Escherichia coli CFT073
uuuguaggccugauaag

SEQ ID NO: 2660652 - RNA, 23 nt, Escherichia coli CFT073
uuuguauucaguucaucuacuac

SEQ ID NO: 2660653 - RNA, 18 nt, Escherichia coli CFT073
uuugucauaugcaaugca

SEQ ID NO: 2660654 - RNA, 19 nt, Escherichia coli CFT073
uuugucauaugcaaugcau

SEQ ID NO: 2660655 - RNA, 21 nt, Escherichia coli CFT073
uuugucauuccuuaugcugcu

SEQ ID NO: 2660656 - RNA, 23 nt, Escherichia coli CFT073
uuuguccagugcaacuuuacuaa

SEQ ID NO: 2660657 - RNA, 16 nt, Escherichia coli CFT073
uuugucgaacagguua

SEQ ID NO: 2660658 - RNA, 20 nt, Escherichia coli CFT073
uuugucgaugggggagguca

SEQ ID NO: 2660659 - RNA, 20 nt, Escherichia coli CFT073
uuugucgccaacuucaugac

SEQ ID NO: 2660660 - RNA, 21 nt, Escherichia coli CFT073
uuugucgccaacuucaugacc

SEQ ID NO: 2660661 - RNA, 23 nt, Escherichia coli CFT073
uuugucgccaucguuaaaaaaca

SEQ ID NO: 2660662 - RNA, 22 nt, Escherichia coli CFT073
uuugugaacagccugugccuga

SEQ ID NO: 2660663 - RNA, 21 nt, Escherichia coli CFT073
uuugugaagaauaaauuuggg

SEQ ID NO: 2660664 - RNA, 20 nt, Escherichia coli CFT073
uuugugccagagcacugcau

SEQ ID NO: 2660665 - RNA, 14 nt, Escherichia coli CFT073
uuugugcggaauua

SEQ ID NO: 2660666 - RNA, 22 nt, Escherichia coli CFT073
uuuguggcccuugcgcaaugag

SEQ ID NO: 2660667 - RNA, 17 nt, Escherichia coli CFT073
uuugugggccugauaag

SEQ ID NO: 2660668 - RNA, 12 nt, Escherichia coli CFT073
uuuguuauucac

SEQ ID NO: 2660669 - RNA, 20 nt, Escherichia coli CFT073
uuuguugagauaauuuauaa

SEQ ID NO: 2660670 - RNA, 16 nt, Escherichia coli CFT073
uuuguugagcuggaag

SEQ ID NO: 2660671 - RNA, 14 nt, Escherichia coli CFT073
uuuguugccggaug

SEQ ID NO: 2660672 - RNA, 18 nt, Escherichia coli CFT073
uuuguugcgucgaaacca

SEQ ID NO: 2660673 - RNA, 19 nt, Escherichia coli CFT073
uuuguugugggcaggaaaa

SEQ ID NO: 2660674 - RNA, 23 nt, Escherichia coli CFT073
uuuguugugggcaggaaaaucag

SEQ ID NO: 2660675 - RNA, 16 nt, Escherichia coli CFT073
uuuguuguuuaccaac

SEQ ID NO: 2660676 - RNA, 13 nt, Escherichia coli CFT073
uuuguuucacacu

SEQ ID NO: 2660677 - RNA, 14 nt, Escherichia coli CFT073
uuuguuuucaucca

SEQ ID NO: 2660678 - RNA, 14 nt, Escherichia coli CFT073
uuuguuuuucagga

SEQ ID NO: 2660679 - RNA, 20 nt, Escherichia coli CFT073
uuuuaaaaacagaguagaaa

SEQ ID NO: 2660680 - RNA, 13 nt, Escherichia coli CFT073
uuuuaaauauugu

SEQ ID NO: 2660681 - RNA, 21 nt, Escherichia coli CFT073
uuuuaaaugcccgacaaaaau

SEQ ID NO: 2660682 - RNA, 13 nt, Escherichia coli CFT073
uuuuaaauugaag

SEQ ID NO: 2660683 - RNA, 20 nt, Escherichia coli CFT073
uuuuaacacacaauuaccuu

SEQ ID NO: 2660684 - RNA, 18 nt, Escherichia coli CFT073
uuuuaacgcagagugcgc

SEQ ID NO: 2660685 - RNA, 13 nt, Escherichia coli CFT073
uuuuaacgccucg

SEQ ID NO: 2660686 - RNA, 23 nt, Escherichia coli CFT073
uuuuaagauccaguugaccugcg

SEQ ID NO: 2660687 - RNA, 20 nt, Escherichia coli CFT073
uuuuaauacaaucuggauau

SEQ ID NO: 2660688 - RNA, 14 nt, Escherichia coli CFT073
uuuuaauauuucau

SEQ ID NO: 2660689 - RNA, 18 nt, Escherichia coli CFT073
uuuuacaggaaaaacuuu

SEQ ID NO: 2660690 - RNA, 17 nt, Escherichia coli CFT073
uuuuaccaccgcaaaac

SEQ ID NO: 2660691 - RNA, 14 nt, Escherichia coli CFT073
uuuuaccauauaaa

SEQ ID NO: 2660692 - RNA, 22 nt, Escherichia coli CFT073
uuuuaccauauaaacauaucac

SEQ ID NO: 2660693 - RNA, 12 nt, Escherichia coli CFT073
uuuuacccaacu

SEQ ID NO: 2660694 - RNA, 20 nt, Escherichia coli CFT073
uuuuacccagcagcagcggu

SEQ ID NO: 2660695 - RNA, 18 nt, Escherichia coli CFT073
uuuuacgcgggcagugcg

SEQ ID NO: 2660696 - RNA, 18 nt, Escherichia coli CFT073
uuuuacucuucuuuaauu

SEQ ID NO: 2660697 - RNA, 20 nt, Escherichia coli CFT073
uuuuacugguugauuuuaaa

SEQ ID NO: 2660698 - RNA, 14 nt, Escherichia coli CFT073
uuuuagacuuuguc

SEQ ID NO: 2660699 - RNA, 14 nt, Escherichia coli CFT073
uuuuagauuguuuu

SEQ ID NO: 2660700 - RNA, 17 nt, Escherichia coli CFT073
uuuuagauuguuuucaa

SEQ ID NO: 2660701 - RNA, 14 nt, Escherichia coli CFT073
uuuuaggauaaauc

SEQ ID NO: 2660702 - RNA, 23 nt, Escherichia coli CFT073
uuuuauacaagggaaauaagaaa

SEQ ID NO: 2660703 - RNA, 13 nt, Escherichia coli CFT073
uuuuauauucaug

SEQ ID NO: 2660704 - RNA, 21 nt, Escherichia coli CFT073
uuuuaucccggcaaaaaacac

SEQ ID NO: 2660705 - RNA, 18 nt, Escherichia coli CFT073
uuuuauccucuucaagcu

SEQ ID NO: 2660706 - RNA, 23 nt, Escherichia coli CFT073
uuuuauggaucuuugacugaaau

SEQ ID NO: 2660707 - RNA, 12 nt, Escherichia coli CFT073
uuuuauuaaaua

SEQ ID NO: 2660708 - RNA, 16 nt, Escherichia coli CFT073
uuuuauuaaauauuau

SEQ ID NO: 2660709 - RNA, 15 nt, Escherichia coli CFT073
uuuuauucgacucug

SEQ ID NO: 2660710 - RNA, 19 nt, Escherichia coli CFT073
uuuuauugcguaaucuuuu

SEQ ID NO: 2660711 - RNA, 19 nt, Escherichia coli CFT073
uuuuauugcugcaccagca

SEQ ID NO: 2660712 - RNA, 20 nt, Escherichia coli CFT073
uuuuauuuagauaaacggaa

SEQ ID NO: 2660713 - RNA, 15 nt, Escherichia coli CFT073
uuuucaaaugcgccu

SEQ ID NO: 2660714 - RNA, 19 nt, Escherichia coli CFT073
uuuucaacgugucuuuuac

SEQ ID NO: 2660715 - RNA, 21 nt, Escherichia coli CFT073
uuuucaacgugucuuuuaccg

SEQ ID NO: 2660716 - RNA, 14 nt, Escherichia coli CFT073
uuuucaacucauca

SEQ ID NO: 2660717 - RNA, 16 nt, Escherichia coli CFT073
uuuucaaugcauauca

SEQ ID NO: 2660718 - RNA, 18 nt, Escherichia coli CFT073
uuuucacaguaauuuccu

SEQ ID NO: 2660719 - RNA, 16 nt, Escherichia coli CFT073
uuuucaccaucgccau

SEQ ID NO: 2660720 - RNA, 20 nt, Escherichia coli CFT073
uuuucagaaggauaauuaau

SEQ ID NO: 2660721 - RNA, 17 nt, Escherichia coli CFT073
uuuucagcaauuuuaau

SEQ ID NO: 2660722 - RNA, 14 nt, Escherichia coli CFT073
uuuucagcaucuca

SEQ ID NO: 2660723 - RNA, 11 nt, Escherichia coli CFT073
uuuucagcgaa

SEQ ID NO: 2660724 - RNA, 13 nt, Escherichia coli CFT073
gccaccacucaaa

SEQ ID NO: 2660725 - RNA, 15 nt, Escherichia coli CFT073
gccaccagaaccgcc

SEQ ID NO: 2660726 - RNA, 19 nt, Escherichia coli CFT073
gccaccagcacaccgucag

SEQ ID NO: 2660727 - RNA, 12 nt, Escherichia coli CFT073
gccaccagcgcc

SEQ ID NO: 2660728 - RNA, 16 nt, Escherichia coli CFT073
gccaccagcgccacca

SEQ ID NO: 2660729 - RNA, 11 nt, Escherichia coli CFT073
gccaccagcgu

SEQ ID NO: 2660730 - RNA, 17 nt, Escherichia coli CFT073
gccaccaggaaaaagau

SEQ ID NO: 2660731 - RNA, 19 nt, Escherichia coli CFT073
gccaccaguaacgcucccu

SEQ ID NO: 2660732 - RNA, 18 nt, Escherichia coli CFT073
gccaccagugcaggcacc

SEQ ID NO: 2660733 - RNA, 13 nt, Escherichia coli CFT073
gccaccagugccg

SEQ ID NO: 2660734 - RNA, 15 nt, Escherichia coli CFT073
gccaccauucccugg

SEQ ID NO: 2660735 - RNA, 14 nt, Escherichia coli CFT073
gccacccagcgagg

SEQ ID NO: 2660736 - RNA, 21 nt, Escherichia coli CFT073
gccaccgaacaaaacagcgag

SEQ ID NO: 2660737 - RNA, 23 nt, Escherichia coli CFT073
gccaccgcaucgcucacggcggc

SEQ ID NO: 2660738 - RNA, 18 nt, Escherichia coli CFT073
gccaccgccagaagaacc

SEQ ID NO: 2660739 - RNA, 20 nt, Escherichia coli CFT073
gccaccgccagaagaaccgc

SEQ ID NO: 2660740 - RNA, 13 nt, Escherichia coli CFT073
gccaccgcgggca

SEQ ID NO: 2660741 - RNA, 18 nt, Escherichia coli CFT073
gccaccggcaaucugcug

SEQ ID NO: 2660742 - RNA, 19 nt, Escherichia coli CFT073
gccaccguccagaucaucc

SEQ ID NO: 2660743 - RNA, 21 nt, Escherichia coli CFT073
gccaccguguauuucugguca

SEQ ID NO: 2660744 - RNA, 16 nt, Escherichia coli CFT073
gccaccguguucauga

SEQ ID NO: 2660745 - RNA, 23 nt, Escherichia coli CFT073
gccaccguguucaugaccgugau

SEQ ID NO: 2660746 - RNA, 17 nt, Escherichia coli CFT073
gccaccucgcaacaaug

SEQ ID NO: 2660747 - RNA, 13 nt, Escherichia coli CFT073
gccaccucuuuca

SEQ ID NO: 2660748 - RNA, 22 nt, Escherichia coli CFT073
gccaccuuucuguuccauaauc

SEQ ID NO: 2660749 - RNA, 19 nt, Escherichia coli CFT073
gccacgaaacugcuggcuu

SEQ ID NO: 2660750 - RNA, 18 nt, Escherichia coli CFT073
gccacgacgucgggcgga

SEQ ID NO: 2660751 - RNA, 16 nt, Escherichia coli CFT073
gccacgaugcacagcu

SEQ ID NO: 2660752 - RNA, 13 nt, Escherichia coli CFT073
gccacgcaaacuu

SEQ ID NO: 2660753 - RNA, 15 nt, Escherichia coli CFT073
gccacgccaaaaagc

SEQ ID NO: 2660754 - RNA, 15 nt, Escherichia coli CFT073
gccacgccaaccacc

SEQ ID NO: 2660755 - RNA, 16 nt, Escherichia coli CFT073
gccacgccaaccaccg

SEQ ID NO: 2660756 - RNA, 14 nt, Escherichia coli CFT073
gccacgccaccagc

SEQ ID NO: 2660757 - RNA, 15 nt, Escherichia coli CFT073
gccacgccacgcugc

SEQ ID NO: 2660758 - RNA, 14 nt, Escherichia coli CFT073
gccacgcgacauaa

SEQ ID NO: 2660759 - RNA, 13 nt, Escherichia coli CFT073
gccacgcguucgg

SEQ ID NO: 2660760 - RNA, 21 nt, Escherichia coli CFT073
gccacgcguucggaccaaugc

SEQ ID NO: 2660761 - RNA, 20 nt, Escherichia coli CFT073
gccacgcucuggugagugac

SEQ ID NO: 2660762 - RNA, 17 nt, Escherichia coli CFT073
gccacgcugccgcgcag

SEQ ID NO: 2660763 - RNA, 14 nt, Escherichia coli CFT073
gccacgcugcgcuu

SEQ ID NO: 2660764 - RNA, 17 nt, Escherichia coli CFT073
gccacggaaacauucaa

SEQ ID NO: 2660765 - RNA, 21 nt, Escherichia coli CFT073
gccacggaauaaaccguggca

SEQ ID NO: 2660766 - RNA, 13 nt, Escherichia coli CFT073
gccacggcagaau

SEQ ID NO: 2660767 - RNA, 17 nt, Escherichia coli CFT073
gccacggcaugaaagcg

SEQ ID NO: 2660768 - RNA, 19 nt, Escherichia coli CFT073
gccacgguaucaagcccgc

SEQ ID NO: 2660769 - RNA, 21 nt, Escherichia coli CFT073
gccacgguaucaagcccgccg

SEQ ID NO: 2660770 - RNA, 13 nt, Escherichia coli CFT073
gccacgguccgcc

SEQ ID NO: 2660771 - RNA, 21 nt, Escherichia coli CFT073
gccacggugguuccacucugc

SEQ ID NO: 2660772 - RNA, 13 nt, Escherichia coli CFT073
gccacgucaucag

SEQ ID NO: 2660773 - RNA, 14 nt, Escherichia coli CFT073
gccacuacccgcau

SEQ ID NO: 2660774 - RNA, 14 nt, Escherichia coli CFT073
gccacuaucgccau

SEQ ID NO: 2660775 - RNA, 23 nt, Escherichia coli CFT073
gccacucacuaccagugccagaa

SEQ ID NO: 2660776 - RNA, 15 nt, Escherichia coli CFT073
gccacucaggcaaag

SEQ ID NO: 2660777 - RNA, 22 nt, Escherichia coli CFT073
gccacucaggcaaagcuguuuc

SEQ ID NO: 2660778 - RNA, 16 nt, Escherichia coli CFT073
gccacuccacugcgca

SEQ ID NO: 2660779 - RNA, 21 nt, Escherichia coli CFT073
gccacuccacugcgcauaauc

SEQ ID NO: 2660780 - RNA, 19 nt, Escherichia coli CFT073
gccacuccucgcgcgucca

SEQ ID NO: 2660781 - RNA, 17 nt, Escherichia coli CFT073
gccacucgauaccagau

SEQ ID NO: 2660782 - RNA, 22 nt, Escherichia coli CFT073
gccacucugacggcgcauccga

SEQ ID NO: 2660783 - RNA, 16 nt, Escherichia coli CFT073
gccacugcaaaucacc

SEQ ID NO: 2660784 - RNA, 16 nt, Escherichia coli CFT073
gccacugccagcaaaa

SEQ ID NO: 2660785 - RNA, 16 nt, Escherichia coli CFT073
gccacuggcggaugcg

SEQ ID NO: 2660786 - RNA, 13 nt, Escherichia coli CFT073
gccacuggcuggg

SEQ ID NO: 2660787 - RNA, 14 nt, Escherichia coli CFT073
gccacuucaaccag

SEQ ID NO: 2660788 - RNA, 19 nt, Escherichia coli CFT073
gccacuucaaccagcggcg

SEQ ID NO: 2660789 - RNA, 21 nt, Escherichia coli CFT073
gccacuucaaccagcggcgca

SEQ ID NO: 2660790 - RNA, 15 nt, Escherichia coli CFT073
gccacuucauuuaug

SEQ ID NO: 2660791 - RNA, 18 nt, Escherichia coli CFT073
gccacuucuggcggcggc

SEQ ID NO: 2660792 - RNA, 19 nt, Escherichia coli CFT073
gccacuucuggcggcggca

SEQ ID NO: 2660793 - RNA, 21 nt, Escherichia coli CFT073
gccacuucuuccagcggcagg

SEQ ID NO: 2660794 - RNA, 17 nt, Escherichia coli CFT073
gccacuuuaugauccag

SEQ ID NO: 2660795 - RNA, 14 nt, Escherichia coli CFT073
gccacuuucacgcc

SEQ ID NO: 2660796 - RNA, 21 nt, Escherichia coli CFT073
gccacuuuucggcaaccgcau

SEQ ID NO: 2660797 - RNA, 14 nt, Escherichia coli CFT073
gccagaaaaccugg

SEQ ID NO: 2660798 - RNA, 17 nt, Escherichia coli CFT073
gccagaaacaucggcag

SEQ ID NO: 2660799 - RNA, 17 nt, Escherichia coli CFT073
gccagaaagacgguuaa

SEQ ID NO: 2660800 - RNA, 17 nt, Escherichia coli CFT073
gccagaaaguggcacac

SEQ ID NO: 2660801 - RNA, 12 nt, Escherichia coli CFT073
gccagaaaucag

SEQ ID NO: 2660802 - RNA, 22 nt, Escherichia coli CFT073
gccagaacacgcucccagcagu

SEQ ID NO: 2660803 - RNA, 19 nt, Escherichia coli CFT073
gccagaaccgagcacaccu

SEQ ID NO: 2660804 - RNA, 23 nt, Escherichia coli CFT073
gccagaaccgcuucuucgacguu

SEQ ID NO: 2660805 - RNA, 20 nt, Escherichia coli CFT073
gccagaacugcugcgccagc

SEQ ID NO: 2660806 - RNA, 15 nt, Escherichia coli CFT073
gccagaagaaccgcc

SEQ ID NO: 2660807 - RNA, 20 nt, Escherichia coli CFT073
gccagaagaaccgccaccuc

SEQ ID NO: 2660808 - RNA, 13 nt, Escherichia coli CFT073
gccagaagcagaa

SEQ ID NO: 2660809 - RNA, 19 nt, Escherichia coli CFT073
gccagaagcagaaugaaug

SEQ ID NO: 2660810 - RNA, 17 nt, Escherichia coli CFT073
gccagaagcccggaucg

SEQ ID NO: 2660811 - RNA, 21 nt, Escherichia coli CFT073
gccagaauaacgugaucgaac

SEQ ID NO: 2660812 - RNA, 19 nt, Escherichia coli CFT073
gccagaauaagucucccgc

SEQ ID NO: 2660813 - RNA, 21 nt, Escherichia coli CFT073
gccagaauaaucggcgucauu

SEQ ID NO: 2660814 - RNA, 22 nt, Escherichia coli CFT073
gccagaauacccgaagcgccaa

SEQ ID NO: 2660815 - RNA, 20 nt, Escherichia coli CFT073
gcuugcgauguucuucacca

SEQ ID NO: 2660816 - RNA, 16 nt, Escherichia coli CFT073
gcuugcgcgcaaucag

SEQ ID NO: 2660817 - RNA, 18 nt, Escherichia coli CFT073
gcuugcgcgcaaucagca

SEQ ID NO: 2660818 - RNA, 20 nt, Escherichia coli CFT073
gcuugcgcgcaaucagcacc

SEQ ID NO: 2660819 - RNA, 14 nt, Escherichia coli CFT073
gcuugcgcggcagc

SEQ ID NO: 2660820 - RNA, 15 nt, Escherichia coli CFT073
gcuugcggccagcac

SEQ ID NO: 2660821 - RNA, 16 nt, Escherichia coli CFT073
gcuugcggccagcaca

SEQ ID NO: 2660822 - RNA, 14 nt, Escherichia coli CFT073
gcuugcucaaguug

SEQ ID NO: 2660823 - RNA, 15 nt, Escherichia coli CFT073
gcuugcucaguguca

SEQ ID NO: 2660824 - RNA, 14 nt, Escherichia coli CFT073
gcuugucauuacca

SEQ ID NO: 2660825 - RNA, 21 nt, Escherichia coli CFT073
gcuugucauuaccacaacaaa

SEQ ID NO: 2660826 - RNA, 19 nt, Escherichia coli CFT073
gcuugucgccgguuaaucu

SEQ ID NO: 2660827 - RNA, 16 nt, Escherichia coli CFT073
gcuuguggaacgcuga

SEQ ID NO: 2660828 - RNA, 20 nt, Escherichia coli CFT073
gcuuguuaauaaagugcgcu

SEQ ID NO: 2660829 - RNA, 17 nt, Escherichia coli CFT073
gcuuguuucauuacucg

SEQ ID NO: 2660830 - RNA, 21 nt, Escherichia coli CFT073
gcuuuaaaacauaucaugaaa

SEQ ID NO: 2660831 - RNA, 15 nt, Escherichia coli CFT073
gcuuuaaaagcuuau

SEQ ID NO: 2660832 - RNA, 19 nt, Escherichia coli CFT073
gcuuuaaaauuauccagcg

SEQ ID NO: 2660833 - RNA, 17 nt, Escherichia coli CFT073
gcuuuaaaugucauacu

SEQ ID NO: 2660834 - RNA, 15 nt, Escherichia coli CFT073
gcuuuaacgcccuga

SEQ ID NO: 2660835 - RNA, 14 nt, Escherichia coli CFT073
gcuuuaaucagcac

SEQ ID NO: 2660836 - RNA, 20 nt, Escherichia coli CFT073
gcuuuaccaccgucaauaaa

SEQ ID NO: 2660837 - RNA, 14 nt, Escherichia coli CFT073
gcuuuaccaucgcg

SEQ ID NO: 2660838 - RNA, 21 nt, Escherichia coli CFT073
gcuuuacccugguuagcaacc

SEQ ID NO: 2660839 - RNA, 13 nt, Escherichia coli CFT073
gcuuuacgugcca

SEQ ID NO: 2660840 - RNA, 20 nt, Escherichia coli CFT073
gcuuuacuccuaauggagaa

SEQ ID NO: 2660841 - RNA, 18 nt, Escherichia coli CFT073
gcuuuacuguacaauccu

SEQ ID NO: 2660842 - RNA, 17 nt, Escherichia coli CFT073
gcuuuagaaucggugau

SEQ ID NO: 2660843 - RNA, 21 nt, Escherichia coli CFT073
gcuuuagggggggcucuuucc

SEQ ID NO: 2660844 - RNA, 18 nt, Escherichia coli CFT073
gcuuuaucaucggucagc

SEQ ID NO: 2660845 - RNA, 23 nt, Escherichia coli CFT073
gcuuuauccugcccgcuccagcu

SEQ ID NO: 2660846 - RNA, 12 nt, Escherichia coli CFT073
gcuuuauucaug

SEQ ID NO: 2660847 - RNA, 18 nt, Escherichia coli CFT073
gcuuucaaaucagcgaau

SEQ ID NO: 2660848 - RNA, 16 nt, Escherichia coli CFT073
gcuuucaacguagccu

SEQ ID NO: 2660849 - RNA, 16 nt, Escherichia coli CFT073
gcuuucaaugccugau

SEQ ID NO: 2660850 - RNA, 14 nt, Escherichia coli CFT073
gcuuucaauuccug

SEQ ID NO: 2660851 - RNA, 17 nt, Escherichia coli CFT073
gcuuucaccgccugauc

SEQ ID NO: 2660852 - RNA, 21 nt, Escherichia coli CFT073
gcuuucacgucagggucgugc

SEQ ID NO: 2660853 - RNA, 21 nt, Escherichia coli CFT073
gcuuucacucaguguuggaug

SEQ ID NO: 2660854 - RNA, 22 nt, Escherichia coli CFT073
gcuuucacuugacuaagcguuu

SEQ ID NO: 2660855 - RNA, 20 nt, Escherichia coli CFT073
gcuuucagcacuuaucucuu

SEQ ID NO: 2660856 - RNA, 23 nt, Escherichia coli CFT073
gcuuucagcacuuaucucuuccg

SEQ ID NO: 2660857 - RNA, 19 nt, Escherichia coli CFT073
gcuuucaucacuugaucca

SEQ ID NO: 2660858 - RNA, 15 nt, Escherichia coli CFT073
gcuuucauucagaac

SEQ ID NO: 2660859 - RNA, 16 nt, Escherichia coli CFT073
gcuuuccagagagaca

SEQ ID NO: 2660860 - RNA, 13 nt, Escherichia coli CFT073
gcuuuccagcugu

SEQ ID NO: 2660861 - RNA, 21 nt, Escherichia coli CFT073
gcuuuccagcuguaccagcaa

SEQ ID NO: 2660862 - RNA, 17 nt, Escherichia coli CFT073
gcuuuccggaaaaauca

SEQ ID NO: 2660863 - RNA, 21 nt, Escherichia coli CFT073
gcuuuccggaaaaaucaaaaa

SEQ ID NO: 2660864 - RNA, 19 nt, Escherichia coli CFT073
gcuuuccgucagcggcagc

SEQ ID NO: 2660865 - RNA, 15 nt, Escherichia coli CFT073
gcuuuccugaucaau

SEQ ID NO: 2660866 - RNA, 13 nt, Escherichia coli CFT073
gcuuucgaccagc

SEQ ID NO: 2660867 - RNA, 22 nt, Escherichia coli CFT073
gcuuucgcaauaaucaucucuc

SEQ ID NO: 2660868 - RNA, 13 nt, Escherichia coli CFT073
gcuuucgcauuua

SEQ ID NO: 2660869 - RNA, 16 nt, Escherichia coli CFT073
gcuuucucaacaaaua

SEQ ID NO: 2660870 - RNA, 18 nt, Escherichia coli CFT073
gcuuucuccagcuuuucg

SEQ ID NO: 2660871 - RNA, 14 nt, Escherichia coli CFT073
gcuuucucuuccag

SEQ ID NO: 2660872 - RNA, 20 nt, Escherichia coli CFT073
gcuuucugcaaccagaaagu

SEQ ID NO: 2660873 - RNA, 21 nt, Escherichia coli CFT073
gcuuucugcaaccagaaaguc

SEQ ID NO: 2660874 - RNA, 11 nt, Escherichia coli CFT073
gcuuucugcug

SEQ ID NO: 2660875 - RNA, 23 nt, Escherichia coli CFT073
gcuuucuucucagauauaaacgg

SEQ ID NO: 2660876 - RNA, 23 nt, Escherichia coli CFT073
gcuuucuucuggguugccugaug

SEQ ID NO: 2660877 - RNA, 20 nt, Escherichia coli CFT073
gcuuucuuugcuuuguaaag

SEQ ID NO: 2660878 - RNA, 19 nt, Escherichia coli CFT073
gcuuugaaacgcacgcuga

SEQ ID NO: 2660879 - RNA, 14 nt, Escherichia coli CFT073
gcuuugaccucccg

SEQ ID NO: 2660880 - RNA, 16 nt, Escherichia coli CFT073
gcuuugauccgccaga

SEQ ID NO: 2660881 - RNA, 19 nt, Escherichia coli CFT073
gcuuugcugugaagcaccu

SEQ ID NO: 2660882 - RNA, 17 nt, Escherichia coli CFT073
gcuuugcuguuuccagu

SEQ ID NO: 2660883 - RNA, 15 nt, Escherichia coli CFT073
gcuuugucauuaaau

SEQ ID NO: 2660884 - RNA, 21 nt, Escherichia coli CFT073
gcuuugucauuaaauccgcca

SEQ ID NO: 2660885 - RNA, 16 nt, Escherichia coli CFT073
gcuuugugcuucaguu

SEQ ID NO: 2660886 - RNA, 18 nt, Escherichia coli CFT073
gcuuuguuuaugccagau

SEQ ID NO: 2660887 - RNA, 22 nt, Escherichia coli CFT073
gcuuuuaaaugcccgacaaaaa

SEQ ID NO: 2660888 - RNA, 20 nt, Escherichia coli CFT073
gcuuuuaauucacuucuguu

SEQ ID NO: 2660889 - RNA, 15 nt, Escherichia coli CFT073
gcuuuuaccaucgcg

SEQ ID NO: 2660890 - RNA, 20 nt, Escherichia coli CFT073
gcuuuuacggcuuuggcggu

SEQ ID NO: 2660891 - RNA, 22 nt, Escherichia coli CFT073
gcuuuuacggcuuuggcgguuu

SEQ ID NO: 2660892 - RNA, 14 nt, Escherichia coli CFT073
gcuuuuagcgacaa

SEQ ID NO: 2660893 - RNA, 23 nt, Escherichia coli CFT073
gcuuuuagcgacaaaucuuucac

SEQ ID NO: 2660894 - RNA, 16 nt, Escherichia coli CFT073
gcuuuuccccaucgga

SEQ ID NO: 2660895 - RNA, 21 nt, Escherichia coli CFT073
gcuuuucgcccaggucuccca

SEQ ID NO: 2660896 - RNA, 12 nt, Escherichia coli CFT073
gcuuuugcaaac

SEQ ID NO: 2660897 - RNA, 22 nt, Escherichia coli CFT073
gcuuuugcgccaucgacauggc

SEQ ID NO: 2660898 - RNA, 17 nt, Escherichia coli CFT073
gcuuuugcggucgccuu

SEQ ID NO: 2660899 - RNA, 15 nt, Escherichia coli CFT073
gcuuuuggcgcguuc

SEQ ID NO: 2660900 - RNA, 23 nt, Escherichia coli CFT073
gcuuuuggcucaucaauacgucc

SEQ ID NO: 2660901 - RNA, 19 nt, Escherichia coli CFT073
gcuuuuggugcccagggua

SEQ ID NO: 2660902 - RNA, 20 nt, Escherichia coli CFT073
gcuuuugguuuuucaaccac

SEQ ID NO: 2660903 - RNA, 20 nt, Escherichia coli CFT073
gcuuuuuauguuagccgccu

SEQ ID NO: 2660904 - RNA, 20 nt, Escherichia coli CFT073
gcuuuuucgcgauagccgcu

SEQ ID NO: 2660905 - RNA, 16 nt, Escherichia coli CFT073
gcuuuuucugcacaca

SEQ ID NO: 2660906 - RNA, 17 nt, Escherichia coli CFT073
gcuuuuugaauuguuuu

SEQ ID NO: 2660907 - RNA, 13 nt, Escherichia coli CFT073
gcuuuuugauacu

SEQ ID NO: 2660908 - RNA, 19 nt, Escherichia coli CFT073
gcuuuuuuaauguggcugg

SEQ ID NO: 2660909 - RNA, 17 nt, Escherichia coli CFT073
gcuuuuuuacaucauca

SEQ ID NO: 2660910 - RNA, 18 nt, Escherichia coli CFT073
gcuuuuuuacaucaucag

SEQ ID NO: 2660911 - RNA, 17 nt, Escherichia coli CFT073
gcuuuuuuacgccugca

SEQ ID NO: 2660912 - RNA, 22 nt, Escherichia coli CFT073
gcuuuuuuagguacaaagccaa

SEQ ID NO: 2660913 - RNA, 14 nt, Escherichia coli CFT073
gcuuuuuuaugcac

SEQ ID NO: 2660914 - RNA, 15 nt, Escherichia coli CFT073
gcuuuuuucaucucu

SEQ ID NO: 2660915 - RNA, 18 nt, Escherichia coli CFT073
gcuuuuuucucaacaggc

SEQ ID NO: 2660916 - RNA, 18 nt, Escherichia coli CFT073
gcuuuuuugauuacagcu

SEQ ID NO: 2660917 - RNA, 19 nt, Escherichia coli CFT073
gcuuuuuugucaccuuuuc

SEQ ID NO: 2660918 - RNA, 14 nt, Escherichia coli CFT073
gcuuuuuuguuugu

SEQ ID NO: 2660919 - RNA, 15 nt, Escherichia coli CFT073
ggaaaaagaucagcg

SEQ ID NO: 2660920 - RNA, 24 nt, Escherichia coli CFT073
ggaaaaaguacuuuaccuggaacu

SEQ ID NO: 2660921 - RNA, 13 nt, Escherichia coli CFT073
ggaaaacaaccgc

SEQ ID NO: 2660922 - RNA, 16 nt, Escherichia coli CFT073
ggaaaacaaccgccau

SEQ ID NO: 2660923 - RNA, 12 nt, Escherichia coli CFT073
ggaaaacaccga

SEQ ID NO: 2660924 - RNA, 15 nt, Escherichia coli CFT073
ggaaaacgugccacu

SEQ ID NO: 2660925 - RNA, 13 nt, Escherichia coli CFT073
ggaaaagcaacaa

SEQ ID NO: 2660926 - RNA, 15 nt, Escherichia coli CFT073
ggaaaaggccacggu

SEQ ID NO: 2660927 - RNA, 16 nt, Escherichia coli CFT073
ggaaaauaucaccaau

SEQ ID NO: 2660928 - RNA, 16 nt, Escherichia coli CFT073
ggaaaaugaucaauaa

SEQ ID NO: 2660929 - RNA, 20 nt, Escherichia coli CFT073
ggaaaauuuuuucagauaaa

SEQ ID NO: 2660930 - RNA, 17 nt, Escherichia coli CFT073
ggaaacagccacccauc

SEQ ID NO: 2660931 - RNA, 14 nt, Escherichia coli CFT073
ggaaaccaacucca

SEQ ID NO: 2660932 - RNA, 14 nt, Escherichia coli CFT073
ggaaacccaacgca

SEQ ID NO: 2660933 - RNA, 16 nt, Escherichia coli CFT073
ggaaaccggcaucccg

SEQ ID NO: 2660934 - RNA, 15 nt, Escherichia coli CFT073
ggaaaccggcgaaaa

SEQ ID NO: 2660935 - RNA, 19 nt, Escherichia coli CFT073
ggaaacgagccauaaaauc

SEQ ID NO: 2660936 - RNA, 21 nt, Escherichia coli CFT073
ggaaacucugcuggcggaaca

SEQ ID NO: 2660937 - RNA, 18 nt, Escherichia coli CFT073
ggaaagcaagaccaacac

SEQ ID NO: 2660938 - RNA, 18 nt, Escherichia coli CFT073
ggaaagcagauaacccag

SEQ ID NO: 2660939 - RNA, 20 nt, Escherichia coli CFT073
ggaaagcaguuuauaaaauu

SEQ ID NO: 2660940 - RNA, 14 nt, Escherichia coli CFT073
ggaaauaacgcuga

SEQ ID NO: 2660941 - RNA, 22 nt, Escherichia coli CFT073
ggaaauaaucgggaauacagaa

SEQ ID NO: 2660942 - RNA, 13 nt, Escherichia coli CFT073
ggaaauacccugg

SEQ ID NO: 2660943 - RNA, 20 nt, Escherichia coli CFT073
ggaaauacccuggcguuuga

SEQ ID NO: 2660944 - RNA, 17 nt, Escherichia coli CFT073
ggaaauagauuuucaga

SEQ ID NO: 2660945 - RNA, 18 nt, Escherichia coli CFT073
ggaaauagcggguuuguu

SEQ ID NO: 2660946 - RNA, 12 nt, Escherichia coli CFT073
ggaaaucaaaua

SEQ ID NO: 2660947 - RNA, 17 nt, Escherichia coli CFT073
ggaaaucaccaccagca

SEQ ID NO: 2660948 - RNA, 12 nt, Escherichia coli CFT073
ggaaaucaucca

SEQ ID NO: 2660949 - RNA, 17 nt, Escherichia coli CFT073
ggaaaucauccagcacg

SEQ ID NO: 2660950 - RNA, 16 nt, Escherichia coli CFT073
ggaaauccaggucaga

SEQ ID NO: 2660951 - RNA, 13 nt, Escherichia coli CFT073
ggaaauccgggcu

SEQ ID NO: 2660952 - RNA, 22 nt, Escherichia coli CFT073
ggaaauuaccgcaccaccagca

SEQ ID NO: 2660953 - RNA, 19 nt, Escherichia coli CFT073
ggaaauuauggaucaccau

SEQ ID NO: 2660954 - RNA, 18 nt, Escherichia coli CFT073
ggaaauuuugcugauacu

SEQ ID NO: 2660955 - RNA, 11 nt, Escherichia coli CFT073
ggaacaagcca

SEQ ID NO: 2660956 - RNA, 18 nt, Escherichia coli CFT073
ggaacaauccucccuuac

SEQ ID NO: 2660957 - RNA, 22 nt, Escherichia coli CFT073
ggaacaaucuugcaaaggcugu

SEQ ID NO: 2660958 - RNA, 19 nt, Escherichia coli CFT073
ggaacauaucaaaaagcug

SEQ ID NO: 2660959 - RNA, 18 nt, Escherichia coli CFT073
ggaacauccggcaaauua

SEQ ID NO: 2660960 - RNA, 15 nt, Escherichia coli CFT073
ggaacauccuuuccu

SEQ ID NO: 2660961 - RNA, 15 nt, Escherichia coli CFT073
ggaaccgaucagauu

SEQ ID NO: 2660962 - RNA, 18 nt, Escherichia coli CFT073
ggaaccgcaggcugauaa

SEQ ID NO: 2660963 - RNA, 23 nt, Escherichia coli CFT073
ggaaccgucguacagucacccgc

SEQ ID NO: 2660964 - RNA, 15 nt, Escherichia coli CFT073
ggaaccuaacgcugu

SEQ ID NO: 2660965 - RNA, 15 nt, Escherichia coli CFT073
ggaaccugacggcgc

SEQ ID NO: 2660966 - RNA, 18 nt, Escherichia coli CFT073
ggaaccugugacagcagc

SEQ ID NO: 2660967 - RNA, 21 nt, Escherichia coli CFT073
ggaacgcacuauacaaccaga

SEQ ID NO: 2660968 - RNA, 23 nt, Escherichia coli CFT073
ggaacgccuaacucuugccagau

SEQ ID NO: 2660969 - RNA, 18 nt, Escherichia coli CFT073
ggaacggauagagcgcug

SEQ ID NO: 2660970 - RNA, 17 nt, Escherichia coli CFT073
ggaacggggguuuuacu

SEQ ID NO: 2660971 - RNA, 21 nt, Escherichia coli CFT073
ggaacucagcgugccaucaaa

SEQ ID NO: 2660972 - RNA, 14 nt, Escherichia coli CFT073
ggaacucuuucuga

SEQ ID NO: 2660973 - RNA, 17 nt, Escherichia coli CFT073
ggaacugcaaggagagc

SEQ ID NO: 2660974 - RNA, 12 nt, Escherichia coli CFT073
ggaacugcaggc

SEQ ID NO: 2660975 - RNA, 19 nt, Escherichia coli CFT073
ggaacuuaguaggccugau

SEQ ID NO: 2660976 - RNA, 14 nt, Escherichia coli CFT073
ggaacuuccagccu

SEQ ID NO: 2660977 - RNA, 18 nt, Escherichia coli CFT073
ggaacuuuuuucauccag

SEQ ID NO: 2660978 - RNA, 18 nt, Escherichia coli CFT073
ggaagaaaacauuuuaaa

SEQ ID NO: 2660979 - RNA, 18 nt, Escherichia coli CFT073
ggaagaaacgcuuaaagc

SEQ ID NO: 2660980 - RNA, 19 nt, Escherichia coli CFT073
ggaagaacaucacugcaaa

SEQ ID NO: 2660981 - RNA, 16 nt, Escherichia coli CFT073
ggaagacguagcaagc

SEQ ID NO: 2660982 - RNA, 17 nt, Escherichia coli CFT073
ggaagacguagcaagca

SEQ ID NO: 2660983 - RNA, 18 nt, Escherichia coli CFT073
ggaagacguagcaagcau

SEQ ID NO: 2660984 - RNA, 14 nt, Escherichia coli CFT073
ggaagcaauaagca

SEQ ID NO: 2660985 - RNA, 17 nt, Escherichia coli CFT073
ggaagcaggucaccaga

SEQ ID NO: 2660986 - RNA, 16 nt, Escherichia coli CFT073
ggaagccggucauauu

SEQ ID NO: 2660987 - RNA, 18 nt, Escherichia coli CFT073
ggaagcgcaacagcgcgc

SEQ ID NO: 2660988 - RNA, 22 nt, Escherichia coli CFT073
ggaagcuuaucacagaggaaga

SEQ ID NO: 2660989 - RNA, 23 nt, Escherichia coli CFT073
ggaaggaucgauggugaaguggc

SEQ ID NO: 2660990 - RNA, 16 nt, Escherichia coli CFT073
ggaaggcccuuucccu

SEQ ID NO: 2660991 - RNA, 20 nt, Escherichia coli CFT073
ggaagguuuuaaucgcuauc

SEQ ID NO: 2660992 - RNA, 10 nt, Escherichia coli CFT073
ggaaguagau

SEQ ID NO: 2660993 - RNA, 14 nt, Escherichia coli CFT073
ggaagugaucuuuc

SEQ ID NO: 2660994 - RNA, 14 nt, Escherichia coli CFT073
ggaauaaaaagcga

SEQ ID NO: 2660995 - RNA, 15 nt, Escherichia coli CFT073
ggaauaaaagccagg

SEQ ID NO: 2660996 - RNA, 11 nt, Escherichia coli CFT073
ggaauaaacgc

SEQ ID NO: 2660997 - RNA, 20 nt, Escherichia coli CFT073
ggaauaaaugucacgucauc

SEQ ID NO: 2660998 - RNA, 14 nt, Escherichia coli CFT073
ggaauaauaauguc

SEQ ID NO: 2660999 - RNA, 22 nt, Escherichia coli CFT073
ggaauaaucuguaccuucugca

SEQ ID NO: 2661000 - RNA, 18 nt, Escherichia coli CFT073
ggaauaauuucccgccga

SEQ ID NO: 2661001 - RNA, 20 nt, Escherichia coli CFT073
ggaauaccacuuucagcaag

SEQ ID NO: 2661002 - RNA, 12 nt, Escherichia coli CFT073
ggaauagcucag

SEQ ID NO: 2661003 - RNA, 22 nt, Escherichia coli CFT073
ggaauauaaguacuaaauaauu

SEQ ID NO: 2661004 - RNA, 16 nt, Escherichia coli CFT073
ggaauaucaccacuga

SEQ ID NO: 2661005 - RNA, 22 nt, Escherichia coli CFT073
ggaauaucgcuggccuccagca

SEQ ID NO: 2661006 - RNA, 18 nt, Escherichia coli CFT073
ggaauaucuucccgccgc

SEQ ID NO: 2661007 - RNA, 18 nt, Escherichia coli CFT073
ggaaucaaugugcuuuca

SEQ ID NO: 2661008 - RNA, 13 nt, Escherichia coli CFT073
ggaaucacucauc

SEQ ID NO: 2661009 - RNA, 17 nt, Escherichia coli CFT073
ggaaucagaauccggug

SEQ ID NO: 2661010 - RNA, 14 nt, Escherichia coli CFT073
ggaaucccaucgca

SEQ ID NO: 2661011 - RNA, 15 nt, Escherichia coli CFT073
ggaaucccaucgcag

SEQ ID NO: 2661012 - RNA, 19 nt, Escherichia coli CFT073
ggaaucccaucgcagaaac

SEQ ID NO: 2661013 - RNA, 16 nt, Escherichia coli CFT073
ggaauccgggucugua

SEQ ID NO: 2661014 - RNA, 18 nt, Escherichia coli CFT073
ggaauccgggucuguaaa

SEQ ID NO: 2661015 - RNA, 21 nt, Escherichia coli CFT073
ggaaucgauaacugcucuccc

SEQ ID NO: 2661016 - RNA, 19 nt, Escherichia coli CFT073
ggaaucgauuuucucacca

SEQ ID NO: 2661017 - RNA, 20 nt, Escherichia coli CFT073
ggaaugacgggcaggcagaa

SEQ ID NO: 2661018 - RNA, 18 nt, Escherichia coli CFT073
ggaaugcagucacgccag

SEQ ID NO: 2661019 - RNA, 17 nt, Escherichia coli CFT073
ggaaugccggaaucaga

SEQ ID NO: 2661020 - RNA, 15 nt, Escherichia coli CFT073
ggaauggucaccaca

SEQ ID NO: 2661021 - RNA, 18 nt, Escherichia coli CFT073
ggaauggucaccacaaau

SEQ ID NO: 2661022 - RNA, 23 nt, Escherichia coli CFT073
ggaauuaucaguaccaaagccuc

SEQ ID NO: 2661023 - RNA, 15 nt, Escherichia coli CFT073
ggaauucagcguggc

SEQ ID NO: 2661024 - RNA, 17 nt, Escherichia coli CFT073
ggaauugcgcaacagag

SEQ ID NO: 2661025 - RNA, 16 nt, Escherichia coli CFT073
ggaauuucuuucagca

SEQ ID NO: 2661026 - RNA, 16 nt, Escherichia coli CFT073
ggaauuugcuccgcca

SEQ ID NO: 2661027 - RNA, 17 nt, Escherichia coli CFT073
ggaauuugcuccgccac

SEQ ID NO: 2661028 - RNA, 13 nt, Escherichia coli CFT073
ggaauuugcugcu

SEQ ID NO: 2661029 - RNA, 23 nt, Escherichia coli CFT073
ggacaaaagccccaggcgauauu

SEQ ID NO: 2661030 - RNA, 20 nt, Escherichia coli CFT073
ggacaaauaaggaaaacugg

SEQ ID NO: 2661031 - RNA, 20 nt, Escherichia coli CFT073
ggacaaucacauccggaucg

SEQ ID NO: 2661032 - RNA, 22 nt, Escherichia coli CFT073
ggacaugauuaccgcaaacuca

SEQ ID NO: 2661033 - RNA, 16 nt, Escherichia coli CFT073
ggacauucuccggcag

SEQ ID NO: 2661034 - RNA, 16 nt, Escherichia coli CFT073
ggaccaaagaaugaca

SEQ ID NO: 2661035 - RNA, 14 nt, Escherichia coli CFT073
ggaccacgcacagc

SEQ ID NO: 2661036 - RNA, 10 nt, Escherichia coli CFT073
ggaccacgga

SEQ ID NO: 2661037 - RNA, 21 nt, Escherichia coli CFT073
ggaccaucuuccagcugcacg

SEQ ID NO: 2661038 - RNA, 18 nt, Escherichia coli CFT073
ggacgacggcaucgccau

SEQ ID NO: 2661039 - RNA, 19 nt, Escherichia coli CFT073
ggacgauaaaccaggccaa

SEQ ID NO: 2661040 - RNA, 20 nt, Escherichia coli CFT073
ggacgauuucacccagcguu

SEQ ID NO: 2661041 - RNA, 13 nt, Escherichia coli CFT073
ggacgcccgccga

SEQ ID NO: 2661042 - RNA, 14 nt, Escherichia coli CFT073
ggacggcucacuuu

SEQ ID NO: 2661043 - RNA, 17 nt, Escherichia coli CFT073
ggacggucuaccaguuu

SEQ ID NO: 2661044 - RNA, 22 nt, Escherichia coli CFT073
ggacgucgauaaacaucgccau

SEQ ID NO: 2661045 - RNA, 12 nt, Escherichia coli CFT073
ggacuaaagaca

SEQ ID NO: 2661046 - RNA, 20 nt, Escherichia coli CFT073
ggacucggacaaauccacug

SEQ ID NO: 2661047 - RNA, 18 nt, Escherichia coli CFT073
ggacuggccgggcacauu

SEQ ID NO: 2661048 - RNA, 18 nt, Escherichia coli CFT073
ggacuguagauauucagu

SEQ ID NO: 2661049 - RNA, 20 nt, Escherichia coli CFT073
ggacuguucaccacugaaua

SEQ ID NO: 2661050 - RNA, 13 nt, Escherichia coli CFT073
ggacuucaugcgc

SEQ ID NO: 2661051 - RNA, 22 nt, Escherichia coli CFT073
ggagaaaauccgccaaccgcug

SEQ ID NO: 2661052 - RNA, 13 nt, Escherichia coli CFT073
ggagaaacgacgc

SEQ ID NO: 2661053 - RNA, 18 nt, Escherichia coli CFT073
ggagaaauauaaagaaug

SEQ ID NO: 2661054 - RNA, 21 nt, Escherichia coli CFT073
ggagaaauauaaagaaugaaa

SEQ ID NO: 2661055 - RNA, 14 nt, Escherichia coli CFT073
ggagaauagcgcca

SEQ ID NO: 2661056 - RNA, 16 nt, Escherichia coli CFT073
ggagacauuacgucca

SEQ ID NO: 2661057 - RNA, 19 nt, Escherichia coli CFT073
ggagagcaacaucaacaga

SEQ ID NO: 2661058 - RNA, 22 nt, Escherichia coli CFT073
ggagagcgccgggcaaaugcuc

SEQ ID NO: 2661059 - RNA, 20 nt, Escherichia coli CFT073
ggagagggggcgauagaaua

SEQ ID NO: 2661060 - RNA, 19 nt, Escherichia coli CFT073
ggagaguugcaccagcaau

SEQ ID NO: 2661061 - RNA, 18 nt, Escherichia coli CFT073
ggagaguuuucaugaaua

SEQ ID NO: 2661062 - RNA, 15 nt, Escherichia coli CFT073
ggagauauuccccag

SEQ ID NO: 2661063 - RNA, 23 nt, Escherichia coli CFT073
ggagauauugcugcgugucggac

SEQ ID NO: 2661064 - RNA, 13 nt, Escherichia coli CFT073
ggagaucccguga

SEQ ID NO: 2661065 - RNA, 10 nt, Escherichia coli CFT073
ggagcaccug

SEQ ID NO: 2661066 - RNA, 12 nt, Escherichia coli CFT073
ggagcacggagg

SEQ ID NO: 2661067 - RNA, 17 nt, Escherichia coli CFT073
ggagcaguauugauaga

SEQ ID NO: 2661068 - RNA, 14 nt, Escherichia coli CFT073
ggagccaguuggcg

SEQ ID NO: 2661069 - RNA, 23 nt, Escherichia coli CFT073
ggagccauugcccgaugcgcaag

SEQ ID NO: 2661070 - RNA, 20 nt, Escherichia coli CFT073
ggagccugauccauacucuu

SEQ ID NO: 2661071 - RNA, 17 nt, Escherichia coli CFT073
ggagcgauuaugaaaca

SEQ ID NO: 2661072 - RNA, 21 nt, Escherichia coli CFT073
ggagcgauuaugaaacaagaa

SEQ ID NO: 2661073 - RNA, 19 nt, Escherichia coli CFT073
ggagcgcuuuuuccugccg

SEQ ID NO: 2661074 - RNA, 19 nt, Escherichia coli CFT073
ggagcguccugcucgccac

SEQ ID NO: 2661075 - RNA, 19 nt, Escherichia coli CFT073
ggagcugccaggccgcauc

SEQ ID NO: 2661076 - RNA, 19 nt, Escherichia coli CFT073
ggagcuuacauaaguaagu

SEQ ID NO: 2661077 - RNA, 17 nt, Escherichia coli CFT073
ggaggaaaguccgggcu

SEQ ID NO: 2661078 - RNA, 21 nt, Escherichia coli CFT073
ggaggagagugcaaugaaaaa

SEQ ID NO: 2661079 - RNA, 15 nt, Escherichia coli CFT073
ggaggagugcgccag

SEQ ID NO: 2661080 - RNA, 16 nt, Escherichia coli CFT073
ggaggcauagcguucg

SEQ ID NO: 2661081 - RNA, 19 nt, Escherichia coli CFT073
ggagggguuuuugccagca

SEQ ID NO: 2661082 - RNA, 18 nt, Escherichia coli CFT073
ggaggguucucccucccg

SEQ ID NO: 2661083 - RNA, 22 nt, Escherichia coli CFT073
ggaggugaaaaccguccggcug

SEQ ID NO: 2661084 - RNA, 14 nt, Escherichia coli CFT073
ggaguaaacggcag

SEQ ID NO: 2661085 - RNA, 18 nt, Escherichia coli CFT073
ggaguaacaaaugugcca

SEQ ID NO: 2661086 - RNA, 16 nt, Escherichia coli CFT073
ggaguaagaauaaaac

SEQ ID NO: 2661087 - RNA, 20 nt, Escherichia coli CFT073
ggaguagauaauaaaacgcg

SEQ ID NO: 2661088 - RNA, 17 nt, Escherichia coli CFT073
ggaguauggcccagccu

SEQ ID NO: 2661089 - RNA, 14 nt, Escherichia coli CFT073
ggagucagggagaa

SEQ ID NO: 2661090 - RNA, 11 nt, Escherichia coli CFT073
ggagugcagca

SEQ ID NO: 2661091 - RNA, 12 nt, Escherichia coli CFT073
ggagugcagcac

SEQ ID NO: 2661092 - RNA, 20 nt, Escherichia coli CFT073
ggaguggggcggugaugcgg

SEQ ID NO: 2661093 - RNA, 15 nt, Escherichia coli CFT073
ggaguugaucgccag

SEQ ID NO: 2661094 - RNA, 20 nt, Escherichia coli CFT073
ggauaaagcccccacaacau

SEQ ID NO: 2661095 - RNA, 21 nt, Escherichia coli CFT073
ggauaaagcccccacaacauu

SEQ ID NO: 2661096 - RNA, 18 nt, Escherichia coli CFT073
ggauaaaucuccauuuca

SEQ ID NO: 2661097 - RNA, 16 nt, Escherichia coli CFT073
ggauaagacgcgccag

SEQ ID NO: 2661098 - RNA, 16 nt, Escherichia coli CFT073
ggauaagacgcgucag

SEQ ID NO: 2661099 - RNA, 18 nt, Escherichia coli CFT073
ggauaaggcguuugaacu

SEQ ID NO: 2661100 - RNA, 17 nt, Escherichia coli CFT073
ggauaauccggaaaagc

SEQ ID NO: 2661101 - RNA, 19 nt, Escherichia coli CFT073
ggauaaucggcaauacuuu

SEQ ID NO: 2661102 - RNA, 15 nt, Escherichia coli CFT073
ggauaccccagcugg

SEQ ID NO: 2661103 - RNA, 18 nt, Escherichia coli CFT073
ggauacgcugacgugcug

SEQ ID NO: 2661104 - RNA, 20 nt, Escherichia coli CFT073
ggauacgcugacgugcugca

SEQ ID NO: 2661105 - RNA, 17 nt, Escherichia coli CFT073
ggauacgcuuuauccag

SEQ ID NO: 2661106 - RNA, 22 nt, Escherichia coli CFT073
ggauacgguuuuuugaacagac

SEQ ID NO: 2661107 - RNA, 15 nt, Escherichia coli CFT073
ggauauaaaaauaac

SEQ ID NO: 2661108 - RNA, 21 nt, Escherichia coli CFT073
ggauauaaacucgccaaacca

SEQ ID NO: 2661109 - RNA, 17 nt, Escherichia coli CFT073
ggauauaauuuuuuuaa

SEQ ID NO: 2661110 - RNA, 17 nt, Escherichia coli CFT073
ggauauacgcuuucagc

SEQ ID NO: 2661111 - RNA, 18 nt, Escherichia coli CFT073
ggauauagcguaaagcca

SEQ ID NO: 2661112 - RNA, 20 nt, Escherichia coli CFT073
ggauauaugucaccagcauu

SEQ ID NO: 2661113 - RNA, 21 nt, Escherichia coli CFT073
ggauaucaacguuauucgcuu

SEQ ID NO: 2661114 - RNA, 20 nt, Escherichia coli CFT073
ggauauccaccgucaaaucc

SEQ ID NO: 2661115 - RNA, 17 nt, Escherichia coli CFT073
ggauaucuaaugccauu

SEQ ID NO: 2661116 - RNA, 16 nt, Escherichia coli CFT073
ggauaugaucugcaca

SEQ ID NO: 2661117 - RNA, 20 nt, Escherichia coli CFT073
ggauauuacugacgccgaca

SEQ ID NO: 2661118 - RNA, 23 nt, Escherichia coli CFT073
ggauauugccggaugugaugcau

SEQ ID NO: 2661119 - RNA, 17 nt, Escherichia coli CFT073
ggauauuuuccagcaac

SEQ ID NO: 2661120 - RNA, 20 nt, Escherichia coli CFT073
ggaucaaagucaucaacguu

SEQ ID NO: 2661121 - RNA, 20 nt, Escherichia coli CFT073
ggaucacaucauaaauaaga

SEQ ID NO: 2661122 - RNA, 14 nt, Escherichia coli CFT073
ggaucacaucgccg

SEQ ID NO: 2661123 - RNA, 21 nt, Escherichia coli CFT073
ggaucaccaauaccagcauca

SEQ ID NO: 2661124 - RNA, 17 nt, Escherichia coli CFT073
ggaucacuccccgccgu

SEQ ID NO: 2661125 - RNA, 22 nt, Escherichia coli CFT073
ggaucagaaugcgcucuuccgg

SEQ ID NO: 2661126 - RNA, 15 nt, Escherichia coli CFT073
ggaucagaccgccaa

SEQ ID NO: 2661127 - RNA, 21 nt, Escherichia coli CFT073
ggaucagaccgccaaucagca

SEQ ID NO: 2661128 - RNA, 22 nt, Escherichia coli CFT073
ggaucaggcagugaauuucuac

SEQ ID NO: 2661129 - RNA, 19 nt, Escherichia coli CFT073
ggaucagguguuacgccgc

SEQ ID NO: 2661130 - RNA, 15 nt, Escherichia coli CFT073
ggauccccagccgcc

SEQ ID NO: 2661131 - RNA, 13 nt, Escherichia coli CFT073
ggauccccugccc

SEQ ID NO: 2661132 - RNA, 14 nt, Escherichia coli CFT073
ggauccccugcccg

SEQ ID NO: 2661133 - RNA, 23 nt, Escherichia coli CFT073
ggaucccuuuguaagcagggcca

SEQ ID NO: 2661134 - RNA, 14 nt, Escherichia coli CFT073
ggauccgcucugcc

SEQ ID NO: 2661135 - RNA, 14 nt, Escherichia coli CFT073
ggauccggcagagg

SEQ ID NO: 2661136 - RNA, 15 nt, Escherichia coli CFT073
ggaucgaccgguucg

SEQ ID NO: 2661137 - RNA, 17 nt, Escherichia coli CFT073
ggaucgacucggugcgc

SEQ ID NO: 2661138 - RNA, 16 nt, Escherichia coli CFT073
ggaucgauaucaccaa

SEQ ID NO: 2661139 - RNA, 23 nt, Escherichia coli CFT073
ggaucgccggaauaucaccacug

SEQ ID NO: 2661140 - RNA, 21 nt, Escherichia coli CFT073
ggaucguucacgugagagaaa

SEQ ID NO: 2661141 - RNA, 19 nt, Escherichia coli CFT073
ggaucguugagcagcagau

SEQ ID NO: 2661142 - RNA, 22 nt, Escherichia coli CFT073
ggaucuccacaagcauauggau

SEQ ID NO: 2661143 - RNA, 21 nt, Escherichia coli CFT073
ggaucugauuuucuuccagua

SEQ ID NO: 2661144 - RNA, 23 nt, Escherichia coli CFT073
ggaucugauuuucuuccaguagc

SEQ ID NO: 2661145 - RNA, 13 nt, Escherichia coli CFT073
ggaucuggauaaa

SEQ ID NO: 2661146 - RNA, 15 nt, Escherichia coli CFT073
ggaucuuccagcgca

SEQ ID NO: 2661147 - RNA, 20 nt, Escherichia coli CFT073
ggaucuuccaguucuuccgc

SEQ ID NO: 2661148 - RNA, 12 nt, Escherichia coli CFT073
ggaugacccagc

SEQ ID NO: 2661149 - RNA, 17 nt, Escherichia coli CFT073
ggaugacccagcgccag

SEQ ID NO: 2661150 - RNA, 14 nt, Escherichia coli CFT073
ggaugaccgacaga

SEQ ID NO: 2661151 - RNA, 14 nt, Escherichia coli CFT073
ggaugacgccucag

SEQ ID NO: 2661152 - RNA, 14 nt, Escherichia coli CFT073
ggaugagcgcgagg

SEQ ID NO: 2661153 - RNA, 16 nt, Escherichia coli CFT073
ggaugagucggcguau

SEQ ID NO: 2661154 - RNA, 11 nt, Escherichia coli CFT073
ggaugauucac

SEQ ID NO: 2661155 - RNA, 14 nt, Escherichia coli CFT073
ggaugauuccgcag

SEQ ID NO: 2661156 - RNA, 16 nt, Escherichia coli CFT073
ggaugccaucgcauga

SEQ ID NO: 2661157 - RNA, 16 nt, Escherichia coli CFT073
ggaugcccccagacgc

SEQ ID NO: 2661158 - RNA, 12 nt, Escherichia coli CFT073
ggaugccccggg

SEQ ID NO: 2661159 - RNA, 17 nt, Escherichia coli CFT073
ggaugccguuaauaaua

SEQ ID NO: 2661160 - RNA, 22 nt, Escherichia coli CFT073
ggaugccguuaauaauaaacug

SEQ ID NO: 2661161 - RNA, 23 nt, Escherichia coli CFT073
ggaugccguuaauaauaaacugc

SEQ ID NO: 2661162 - RNA, 16 nt, Escherichia coli CFT073
ggaugccucuccuguu

SEQ ID NO: 2661163 - RNA, 15 nt, Escherichia coli CFT073
ggaugccugaugcga

SEQ ID NO: 2661164 - RNA, 16 nt, Escherichia coli CFT073
ggaugcgaccagcguc

SEQ ID NO: 2661165 - RNA, 20 nt, Escherichia coli CFT073
ggaugcgagucaggccagga

SEQ ID NO: 2661166 - RNA, 19 nt, Escherichia coli CFT073
ggaugcgauguucccccag

SEQ ID NO: 2661167 - RNA, 23 nt, Escherichia coli CFT073
ggaugcggcgaaaacgccucauc

SEQ ID NO: 2661168 - RNA, 11 nt, Escherichia coli CFT073
ggaugcggcgc

SEQ ID NO: 2661169 - RNA, 18 nt, Escherichia coli CFT073
ggaugcggcgcgagcgcc

SEQ ID NO: 2661170 - RNA, 14 nt, Escherichia coli CFT073
ggaugcggcgcuga

SEQ ID NO: 2661171 - RNA, 22 nt, Escherichia coli CFT073
ggauggcgaugcugcguugaaa

SEQ ID NO: 2661172 - RNA, 19 nt, Escherichia coli CFT073
ggauggcgcucugcuagau

SEQ ID NO: 2661173 - RNA, 16 nt, Escherichia coli CFT073
ggauggcgcugcugca

SEQ ID NO: 2661174 - RNA, 12 nt, Escherichia coli CFT073
ggauggcggcuu

SEQ ID NO: 2661175 - RNA, 20 nt, Escherichia coli CFT073
ggaugggcugccagcucauc

SEQ ID NO: 2661176 - RNA, 18 nt, Escherichia coli CFT073
ggaugguguucacucauc

SEQ ID NO: 2661177 - RNA, 17 nt, Escherichia coli CFT073
ggauguucgcauccggc

SEQ ID NO: 2661178 - RNA, 14 nt, Escherichia coli CFT073
ggauguuugcagua

SEQ ID NO: 2661179 - RNA, 18 nt, Escherichia coli CFT073
ggauuaagucuaaugaca

SEQ ID NO: 2661180 - RNA, 14 nt, Escherichia coli CFT073
ggauuaauuaccag

SEQ ID NO: 2661181 - RNA, 20 nt, Escherichia coli CFT073
ggauuagaacuaaaggcugu

SEQ ID NO: 2661182 - RNA, 18 nt, Escherichia coli CFT073
ggauuauccagccaggcg

SEQ ID NO: 2661183 - RNA, 18 nt, Escherichia coli CFT073
ggauucacguugauggua

SEQ ID NO: 2661184 - RNA, 20 nt, Escherichia coli CFT073
ggauuccagcgccgccagaa

SEQ ID NO: 2661185 - RNA, 21 nt, Escherichia coli CFT073
ggauuccagcgccgccagaag

SEQ ID NO: 2661186 - RNA, 15 nt, Escherichia coli CFT073
ggauucucuuuguua

SEQ ID NO: 2661187 - RNA, 17 nt, Escherichia coli CFT073
ggauuuaccuugcucau

SEQ ID NO: 2661188 - RNA, 16 nt, Escherichia coli CFT073
ggauuuacuaaaacuu

SEQ ID NO: 2661189 - RNA, 19 nt, Escherichia coli CFT073
ggauuuccggcaucgccag

SEQ ID NO: 2661190 - RNA, 16 nt, Escherichia coli CFT073
ggauuuguaauuucag

SEQ ID NO: 2661191 - RNA, 13 nt, Escherichia coli CFT073
ggauuuuacccac

SEQ ID NO: 2661192 - RNA, 23 nt, Escherichia coli CFT073
ggauuuucuacgcugaucgacga

SEQ ID NO: 2661193 - RNA, 18 nt, Escherichia coli CFT073
ggauuuuuaugacgcugg

SEQ ID NO: 2661194 - RNA, 20 nt, Escherichia coli CFT073
ggcaaaaauaaggcggaugg

SEQ ID NO: 2661195 - RNA, 17 nt, Escherichia coli CFT073
ggcaaaacggugcaggc

SEQ ID NO: 2661196 - RNA, 20 nt, Escherichia coli CFT073
ggcaaaagaugucggaugcg

SEQ ID NO: 2661197 - RNA, 15 nt, Escherichia coli CFT073
ggcaaaaucaucaca

SEQ ID NO: 2661198 - RNA, 23 nt, Escherichia coli CFT073
ggcaaaaucaucacucccuuucu

SEQ ID NO: 2661199 - RNA, 17 nt, Escherichia coli CFT073
ggcaaaauccagaaaaa

SEQ ID NO: 2661200 - RNA, 20 nt, Escherichia coli CFT073
ggcaaaauccagaaaaaaag

SEQ ID NO: 2661201 - RNA, 13 nt, Escherichia coli CFT073
ggcaaaauccuuc

SEQ ID NO: 2661202 - RNA, 13 nt, Escherichia coli CFT073
ggcaaacgcccuu

SEQ ID NO: 2661203 - RNA, 20 nt, Escherichia coli CFT073
ggcaaagcugucaccaauca

SEQ ID NO: 2661204 - RNA, 20 nt, Escherichia coli CFT073
ggcaaaggucugauguugaa

SEQ ID NO: 2661205 - RNA, 13 nt, Escherichia coli CFT073
ggcaaagucuuca

SEQ ID NO: 2661206 - RNA, 20 nt, Escherichia coli CFT073
ggcaaauuaagaagcggcua

SEQ ID NO: 2661207 - RNA, 15 nt, Escherichia coli CFT073
ggcaacaaaagcgag

SEQ ID NO: 2661208 - RNA, 22 nt, Escherichia coli CFT073
ggcaacaaucgcucacaacaau

SEQ ID NO: 2661209 - RNA, 12 nt, Escherichia coli CFT073
ggcaacagcagc

SEQ ID NO: 2661210 - RNA, 12 nt, Escherichia coli CFT073
ggcaacagccau

SEQ ID NO: 2661211 - RNA, 23 nt, Escherichia coli CFT073
ggcaacaucaaaucacagcaccu

SEQ ID NO: 2661212 - RNA, 13 nt, Escherichia coli CFT073
ggcaacaucgcca

SEQ ID NO: 2661213 - RNA, 17 nt, Escherichia coli CFT073
ggcaaccagcagcauca

SEQ ID NO: 2661214 - RNA, 19 nt, Escherichia coli CFT073
ggcaacccagaagaaagcc

SEQ ID NO: 2661215 - RNA, 18 nt, Escherichia coli CFT073
ggcaaccgguagcuggug

SEQ ID NO: 2661216 - RNA, 14 nt, Escherichia coli CFT073
ggcaaccucuggug

SEQ ID NO: 2661217 - RNA, 20 nt, Escherichia coli CFT073
ggcaacgaccgcgagcaaaa

SEQ ID NO: 2661218 - RNA, 12 nt, Escherichia coli CFT073
ggcaacguucca

SEQ ID NO: 2661219 - RNA, 12 nt, Escherichia coli CFT073
ggcaacugcugc

SEQ ID NO: 2661220 - RNA, 19 nt, Escherichia coli CFT073
ggcaagaaacgcuccacca

SEQ ID NO: 2661221 - RNA, 15 nt, Escherichia coli CFT073
ggcaagaauuacuuc

SEQ ID NO: 2661222 - RNA, 14 nt, Escherichia coli CFT073
ggcaagauacugca

SEQ ID NO: 2661223 - RNA, 23 nt, Escherichia coli CFT073
ggcaagauuugcaucacuccagu

SEQ ID NO: 2661224 - RNA, 21 nt, Escherichia coli CFT073
ggcaagccgcuaacagcagca

SEQ ID NO: 2661225 - RNA, 15 nt, Escherichia coli CFT073
ggcaagccuaccggc

SEQ ID NO: 2661226 - RNA, 14 nt, Escherichia coli CFT073
ggcaaggccaauac

SEQ ID NO: 2661227 - RNA, 15 nt, Escherichia coli CFT073
ggcaaguagcgccag

SEQ ID NO: 2661228 - RNA, 14 nt, Escherichia coli CFT073
ggcaaguucuuuug

SEQ ID NO: 2661229 - RNA, 22 nt, Escherichia coli CFT073
ggcaauaaucucaauauccgga

SEQ ID NO: 2661230 - RNA, 15 nt, Escherichia coli CFT073
ggcaauacuuugcag

SEQ ID NO: 2661231 - RNA, 18 nt, Escherichia coli CFT073
ggcaauagagacaaagua

SEQ ID NO: 2661232 - RNA, 11 nt, Escherichia coli CFT073
ggcaaucaaca

SEQ ID NO: 2661233 - RNA, 21 nt, Escherichia coli CFT073
ggcaaucaacgccugaugcga

SEQ ID NO: 2661234 - RNA, 17 nt, Escherichia coli CFT073
ggcaaucacauccacca

SEQ ID NO: 2661235 - RNA, 21 nt, Escherichia coli CFT073
ggcaaucacauccaccagcgc

SEQ ID NO: 2661236 - RNA, 23 nt, Escherichia coli CFT073
ggcaaucacauccaccagcgccu

SEQ ID NO: 2661237 - RNA, 17 nt, Escherichia coli CFT073
ggcaaucauucccagac

SEQ ID NO: 2661238 - RNA, 17 nt, Escherichia coli CFT073
ggcaauccccgccagca

SEQ ID NO: 2661239 - RNA, 20 nt, Escherichia coli CFT073
ggcaauccccgccagcacga

SEQ ID NO: 2661240 - RNA, 14 nt, Escherichia coli CFT073
ggcaaucgcgccag

SEQ ID NO: 2661241 - RNA, 18 nt, Escherichia coli CFT073
ggcaaucugaauccccgg

SEQ ID NO: 2661242 - RNA, 17 nt, Escherichia coli CFT073
ggcaaucuuuaccgguc

SEQ ID NO: 2661243 - RNA, 21 nt, Escherichia coli CFT073
ggcaaucuuuaccggucagga

SEQ ID NO: 2661244 - RNA, 17 nt, Escherichia coli CFT073
ggcaaugacaucgcccu

SEQ ID NO: 2661245 - RNA, 16 nt, Escherichia coli CFT073
ggcaaugauauuaaug

SEQ ID NO: 2661246 - RNA, 14 nt, Escherichia coli CFT073
ggcaaugccccaga

SEQ ID NO: 2661247 - RNA, 13 nt, Escherichia coli CFT073
ggcaaugcccggu

SEQ ID NO: 2661248 - RNA, 22 nt, Escherichia coli CFT073
ggcaaugcgaucccgacaauca

SEQ ID NO: 2661249 - RNA, 21 nt, Escherichia coli CFT073
ggcaaugcgcacggaguaaca

SEQ ID NO: 2661250 - RNA, 13 nt, Escherichia coli CFT073
ggcaaugcgccga

SEQ ID NO: 2661251 - RNA, 16 nt, Escherichia coli CFT073
ggcaaugcguagcugg

SEQ ID NO: 2661252 - RNA, 15 nt, Escherichia coli CFT073
ggcaaugcugucggu

SEQ ID NO: 2661253 - RNA, 14 nt, Escherichia coli CFT073
ggcaaugggcaacg

SEQ ID NO: 2661254 - RNA, 15 nt, Escherichia coli CFT073
ggcaauggugaacug

SEQ ID NO: 2661255 - RNA, 23 nt, Escherichia coli CFT073
ggcaaugguguccaaaugcagca

SEQ ID NO: 2661256 - RNA, 14 nt, Escherichia coli CFT073
ggcaauuaaaaauu

SEQ ID NO: 2661257 - RNA, 23 nt, Escherichia coli CFT073
ggcaauuagcuggaauaauaacu

SEQ ID NO: 2661258 - RNA, 21 nt, Escherichia coli CFT073
ggcaauucaauuaauucuccg

SEQ ID NO: 2661259 - RNA, 15 nt, Escherichia coli CFT073
ggcaauuccgucguu

SEQ ID NO: 2661260 - RNA, 19 nt, Escherichia coli CFT073
ggcaauucucacugauuac

SEQ ID NO: 2661261 - RNA, 20 nt, Escherichia coli CFT073
ggcaauucuuuccguuuuca

SEQ ID NO: 2661262 - RNA, 17 nt, Escherichia coli CFT073
ggcaauuuaccgccgau

SEQ ID NO: 2661263 - RNA, 18 nt, Escherichia coli CFT073
ggcaauuucagugcugac

SEQ ID NO: 2661264 - RNA, 22 nt, Escherichia coli CFT073
ggcaauuuugcugugcuuuaca

SEQ ID NO: 2661265 - RNA, 16 nt, Escherichia coli CFT073
ggcacacaaauaauuc

SEQ ID NO: 2661266 - RNA, 15 nt, Escherichia coli CFT073
ggcacaccaacuuca

SEQ ID NO: 2661267 - RNA, 15 nt, Escherichia coli CFT073
ggcacagccagcgca

SEQ ID NO: 2661268 - RNA, 19 nt, Escherichia coli CFT073
ggcacagcuuucggguggc

SEQ ID NO: 2661269 - RNA, 19 nt, Escherichia coli CFT073
ggcacagucgcgacgcuga

SEQ ID NO: 2661270 - RNA, 19 nt, Escherichia coli CFT073
ggcacauaauugagcagca

SEQ ID NO: 2661271 - RNA, 16 nt, Escherichia coli CFT073
ggcacauagacgguga

SEQ ID NO: 2661272 - RNA, 20 nt, Escherichia coli CFT073
ggcacauccagauuuuucag

SEQ ID NO: 2661273 - RNA, 19 nt, Escherichia coli CFT073
ggcacauuucauucacgcc

SEQ ID NO: 2661274 - RNA, 16 nt, Escherichia coli CFT073
ggcaccaaucaccgcc

SEQ ID NO: 2661275 - RNA, 18 nt, Escherichia coli CFT073
ggcaccacauucugcauu

SEQ ID NO: 2661276 - RNA, 12 nt, Escherichia coli CFT073
ggcacccaucgc

SEQ ID NO: 2661277 - RNA, 14 nt, Escherichia coli CFT073
ggcacccaucgcca

SEQ ID NO: 2661278 - RNA, 20 nt, Escherichia coli CFT073
ggcaccgccaaagauaaaau

SEQ ID NO: 2661279 - RNA, 12 nt, Escherichia coli CFT073
ggcaccgccagc

SEQ ID NO: 2661280 - RNA, 19 nt, Escherichia coli CFT073
ggcacgaaagguuccaaua

SEQ ID NO: 2661281 - RNA, 13 nt, Escherichia coli CFT073
ggcacgacacaau

SEQ ID NO: 2661282 - RNA, 18 nt, Escherichia coli CFT073
ggcacgacacaaugccau

SEQ ID NO: 2661283 - RNA, 13 nt, Escherichia coli CFT073
ggcacgaccagga

SEQ ID NO: 2661284 - RNA, 15 nt, Escherichia coli CFT073
ggcacgaucaagaga

SEQ ID NO: 2661285 - RNA, 13 nt, Escherichia coli CFT073
ggcacgcccgcgc

SEQ ID NO: 2661286 - RNA, 17 nt, Escherichia coli CFT073
ggcacguaucaacauca

SEQ ID NO: 2661287 - RNA, 17 nt, Escherichia coli CFT073
ggcacuagucccuccgc

SEQ ID NO: 2661288 - RNA, 16 nt, Escherichia coli CFT073
ggcacucaaucgccaa

SEQ ID NO: 2661289 - RNA, 17 nt, Escherichia coli CFT073
ggcacucaaucgccaaa

SEQ ID NO: 2661290 - RNA, 17 nt, Escherichia coli CFT073
ggcacucgcugaccggu

SEQ ID NO: 2661291 - RNA, 18 nt, Escherichia coli CFT073
ggcacucuccggcagacc

SEQ ID NO: 2661292 - RNA, 16 nt, Escherichia coli CFT073
ggcacucuuccagacc

SEQ ID NO: 2661293 - RNA, 19 nt, Escherichia coli CFT073
ggcacucuuggcaccgccu

SEQ ID NO: 2661294 - RNA, 17 nt, Escherichia coli CFT073
ggcacucuuuuaauaua

SEQ ID NO: 2661295 - RNA, 21 nt, Escherichia coli CFT073
ggcacugacgcgcuuuucacc

SEQ ID NO: 2661296 - RNA, 19 nt, Escherichia coli CFT073
ggcacugcggaagcuaccg

SEQ ID NO: 2661297 - RNA, 19 nt, Escherichia coli CFT073
ggcacuggauuauuacugg

SEQ ID NO: 2661298 - RNA, 20 nt, Escherichia coli CFT073
ggcacuggguucaucuucca

SEQ ID NO: 2661299 - RNA, 22 nt, Escherichia coli CFT073
ggcacuguagaccaguccggcu

SEQ ID NO: 2661300 - RNA, 17 nt, Escherichia coli CFT073
ggcacuguagcucgccu

SEQ ID NO: 2661301 - RNA, 15 nt, Escherichia coli CFT073
ggcacuugucaccaa

SEQ ID NO: 2661302 - RNA, 16 nt, Escherichia coli CFT073
ggcacuuuuucaucag

SEQ ID NO: 2661303 - RNA, 12 nt, Escherichia coli CFT073
ggcagaacggug

SEQ ID NO: 2661304 - RNA, 14 nt, Escherichia coli CFT073
ggcagaacggugcg

SEQ ID NO: 2661305 - RNA, 15 nt, Escherichia coli CFT073
ggcagaagcagcagg

SEQ ID NO: 2661306 - RNA, 21 nt, Escherichia coli CFT073
ggcagaauaacggcugauaac

SEQ ID NO: 2661307 - RNA, 22 nt, Escherichia coli CFT073
ggcagaauacuucacaugauaa

SEQ ID NO: 2661308 - RNA, 16 nt, Escherichia coli CFT073
ggcagaaugaaguaaa

SEQ ID NO: 2661309 - RNA, 22 nt, Escherichia coli CFT073
ggcagaaugguaacaccagagu

SEQ ID NO: 2661310 - RNA, 15 nt, Escherichia coli CFT073
ggcagacaaaacaua

SEQ ID NO: 2661311 - RNA, 13 nt, Escherichia coli CFT073
ggcagacagcgcc

SEQ ID NO: 2661312 - RNA, 13 nt, Escherichia coli CFT073
ggcagaccagagc

SEQ ID NO: 2661313 - RNA, 14 nt, Escherichia coli CFT073
ggcagacuuuuccu

SEQ ID NO: 2661314 - RNA, 14 nt, Escherichia coli CFT073
ggcagagaucgccg

SEQ ID NO: 2661315 - RNA, 15 nt, Escherichia coli CFT073
ggcagagccaaauaa

SEQ ID NO: 2661316 - RNA, 15 nt, Escherichia coli CFT073
ggcagauccaccaga

SEQ ID NO: 2661317 - RNA, 20 nt, Escherichia coli CFT073
ggcagauccaguuacccagc

SEQ ID NO: 2661318 - RNA, 14 nt, Escherichia coli CFT073
ggcagaugggcugg

SEQ ID NO: 2661319 - RNA, 22 nt, Escherichia coli CFT073
ggcagcaaggcuauucagcagu

SEQ ID NO: 2661320 - RNA, 18 nt, Escherichia coli CFT073
ggcagcaaucgaccaggc

SEQ ID NO: 2661321 - RNA, 17 nt, Escherichia coli CFT073
ggcagcaauggcacugu

SEQ ID NO: 2661322 - RNA, 22 nt, Escherichia coli CFT073
ggcagcacaaucacgucauauu

SEQ ID NO: 2661323 - RNA, 22 nt, Escherichia coli CFT073
ggcagcagcacccgcggcugca

SEQ ID NO: 2661324 - RNA, 16 nt, Escherichia coli CFT073
ggcagccagauggcug

SEQ ID NO: 2661325 - RNA, 17 nt, Escherichia coli CFT073
ggcagccagguggcaga

SEQ ID NO: 2661326 - RNA, 22 nt, Escherichia coli CFT073
ggcagccaguucgagaaaaaua

SEQ ID NO: 2661327 - RNA, 13 nt, Escherichia coli CFT073
ggcagccauuugu

SEQ ID NO: 2661328 - RNA, 22 nt, Escherichia coli CFT073
ggcagccuuucacaucagaaca

SEQ ID NO: 2661329 - RNA, 17 nt, Escherichia coli CFT073
ggcagcgggauuuccgg

SEQ ID NO: 2661330 - RNA, 14 nt, Escherichia coli CFT073
ggcagcgugccagg

SEQ ID NO: 2661331 - RNA, 14 nt, Escherichia coli CFT073
ggcagcuccagcag

SEQ ID NO: 2661332 - RNA, 20 nt, Escherichia coli CFT073
ggcagcucuuucucgcucag

SEQ ID NO: 2661333 - RNA, 10 nt, Escherichia coli CFT073
ggcaggaaaa

SEQ ID NO: 2661334 - RNA, 20 nt, Escherichia coli CFT073
ggcaggaaaauagguguaaa

SEQ ID NO: 2661335 - RNA, 14 nt, Escherichia coli CFT073
ggcaggaaaucgag

SEQ ID NO: 2661336 - RNA, 19 nt, Escherichia coli CFT073
ggcaggcaaaguaggccgu

SEQ ID NO: 2661337 - RNA, 15 nt, Escherichia coli CFT073
ggcaggccccgucag

SEQ ID NO: 2661338 - RNA, 20 nt, Escherichia coli CFT073
ggcaggccccgucagcaaaa

SEQ ID NO: 2661339 - RNA, 15 nt, Escherichia coli CFT073
ggcaggccuaacaca

SEQ ID NO: 2661340 - RNA, 22 nt, Escherichia coli CFT073
ggcaggcuucaacacaggccgg

SEQ ID NO: 2661341 - RNA, 22 nt, Escherichia coli CFT073
ggcaggguggugacaccaugcc

SEQ ID NO: 2661342 - RNA, 13 nt, Escherichia coli CFT073
ggcaggucaucgu

SEQ ID NO: 2661343 - RNA, 22 nt, Escherichia coli CFT073
ggcaggugacaccaccgcccgg

SEQ ID NO: 2661344 - RNA, 19 nt, Escherichia coli CFT073
ggcagguuuaaccaucagg

SEQ ID NO: 2661345 - RNA, 22 nt, Escherichia coli CFT073
ggcaguaaaucaauauccacug

SEQ ID NO: 2661346 - RNA, 18 nt, Escherichia coli CFT073
ggcaguaauauggcgacu

SEQ ID NO: 2661347 - RNA, 15 nt, Escherichia coli CFT073
ggcaguauuaccaga

SEQ ID NO: 2661348 - RNA, 23 nt, Escherichia coli CFT073
ggcagucacuuccugauccgcuu

SEQ ID NO: 2661349 - RNA, 16 nt, Escherichia coli CFT073
ggcagugacagcccca

SEQ ID NO: 2661350 - RNA, 22 nt, Escherichia coli CFT073
ggcagugcuuucauuucagcgu

SEQ ID NO: 2661351 - RNA, 20 nt, Escherichia coli CFT073
ggcaguggcuaagcaggcug

SEQ ID NO: 2661352 - RNA, 15 nt, Escherichia coli CFT073
ggcaguuaccagggc

SEQ ID NO: 2661353 - RNA, 15 nt, Escherichia coli CFT073
ggcaguuuauccagc

SEQ ID NO: 2661354 - RNA, 18 nt, Escherichia coli CFT073
ggcauaaaagggcagcag

SEQ ID NO: 2661355 - RNA, 20 nt, Escherichia coli CFT073
ggcauaaacaagugcacuuu

SEQ ID NO: 2661356 - RNA, 18 nt, Escherichia coli CFT073
ggcauaaacgccuuaucc

SEQ ID NO: 2661357 - RNA, 21 nt, Escherichia coli CFT073
ggcauaaacgccuuauccggc

SEQ ID NO: 2661358 - RNA, 16 nt, Escherichia coli CFT073
ggcauaagccgucccu

SEQ ID NO: 2661359 - RNA, 21 nt, Escherichia coli CFT073
ggcauaauacaugcgaacuuu

SEQ ID NO: 2661360 - RNA, 17 nt, Escherichia coli CFT073
ggcauacagcgacagac

SEQ ID NO: 2661361 - RNA, 19 nt, Escherichia coli CFT073
ggcauacaucaacgcgcaa

SEQ ID NO: 2661362 - RNA, 13 nt, Escherichia coli CFT073
ggcauacauuuau

SEQ ID NO: 2661363 - RNA, 20 nt, Escherichia coli CFT073
ggcauacuccggcggcagca

SEQ ID NO: 2661364 - RNA, 21 nt, Escherichia coli CFT073
ggcauacuccggcggcagcag

SEQ ID NO: 2661365 - RNA, 21 nt, Escherichia coli CFT073
ggcauagccaccuggcugcgu

SEQ ID NO: 2661366 - RNA, 15 nt, Escherichia coli CFT073
ggcauauaccgucag

SEQ ID NO: 2661367 - RNA, 12 nt, Escherichia coli CFT073
ggcauauagccg

SEQ ID NO: 2661368 - RNA, 17 nt, Escherichia coli CFT073
ggcauauucaccgucag

SEQ ID NO: 2661369 - RNA, 14 nt, Escherichia coli CFT073
ggcauauuccgcca

SEQ ID NO: 2661370 - RNA, 15 nt, Escherichia coli CFT073
ggcauauuccgccac

SEQ ID NO: 2661371 - RNA, 20 nt, Escherichia coli CFT073
ggcauauuccgccaccugcg

SEQ ID NO: 2661372 - RNA, 20 nt, Escherichia coli CFT073
ggcauauugacgucgcuaag

SEQ ID NO: 2661373 - RNA, 14 nt, Escherichia coli CFT073
ggcaucaacgggug

SEQ ID NO: 2661374 - RNA, 13 nt, Escherichia coli CFT073
ggcaucaggcugg

SEQ ID NO: 2661375 - RNA, 20 nt, Escherichia coli CFT073
ggcauccaagcugguggcaa

SEQ ID NO: 2661376 - RNA, 19 nt, Escherichia coli CFT073
ggcauccagaccgcuguaa

SEQ ID NO: 2661377 - RNA, 16 nt, Escherichia coli CFT073
ggcauccagagaucgc

SEQ ID NO: 2661378 - RNA, 20 nt, Escherichia coli CFT073
ggcauccagagaucgcguag

SEQ ID NO: 2661379 - RNA, 23 nt, Escherichia coli CFT073
ggcaucgccagaacuacccgguu

SEQ ID NO: 2661380 - RNA, 20 nt, Escherichia coli CFT073
ggcaucgccagcgcggcggc

SEQ ID NO: 2661381 - RNA, 20 nt, Escherichia coli CFT073
ggcaucgccuucgcaaaaaa

SEQ ID NO: 2661382 - RNA, 13 nt, Escherichia coli CFT073
ggcaucgcgacag

SEQ ID NO: 2661383 - RNA, 17 nt, Escherichia coli CFT073
ggcaucgcuucacgcgg

SEQ ID NO: 2661384 - RNA, 12 nt, Escherichia coli CFT073
ggcaucgugcac

SEQ ID NO: 2661385 - RNA, 18 nt, Escherichia coli CFT073
ggcaucugauacggucag

SEQ ID NO: 2661386 - RNA, 16 nt, Escherichia coli CFT073
ggcaucuggugccagc

SEQ ID NO: 2661387 - RNA, 19 nt, Escherichia coli CFT073
ggcaucuggugccagcgcc

SEQ ID NO: 2661388 - RNA, 18 nt, Escherichia coli CFT073
ggcaucuucuucuggcuc

SEQ ID NO: 2661389 - RNA, 19 nt, Escherichia coli CFT073
ggcaugaacaaagcucacu

SEQ ID NO: 2661390 - RNA, 21 nt, Escherichia coli CFT073
ggcaugaacaaaucgcacguu

SEQ ID NO: 2661391 - RNA, 12 nt, Escherichia coli CFT073
ggcaugaaucau

SEQ ID NO: 2661392 - RNA, 14 nt, Escherichia coli CFT073
ggcaugaaugguca

SEQ ID NO: 2661393 - RNA, 17 nt, Escherichia coli CFT073
ggcaugaauggucauaa

SEQ ID NO: 2661394 - RNA, 19 nt, Escherichia coli CFT073
ggcaugaccguuugccccg

SEQ ID NO: 2661395 - RNA, 19 nt, Escherichia coli CFT073
ggcaugagggugacaucaa

SEQ ID NO: 2661396 - RNA, 17 nt, Escherichia coli CFT073
ggcauggggucaggugg

SEQ ID NO: 2661397 - RNA, 22 nt, Escherichia coli CFT073
ggcauggggucaggugggacca

SEQ ID NO: 2661398 - RNA, 15 nt, Escherichia coli CFT073
ggcauguuaugaaua

SEQ ID NO: 2661399 - RNA, 19 nt, Escherichia coli CFT073
ggcauuaauuaguaggccg

SEQ ID NO: 2661400 - RNA, 13 nt, Escherichia coli CFT073
ggcauuacgcccg

SEQ ID NO: 2661401 - RNA, 19 nt, Escherichia coli CFT073
ggcauuauuuacgcgucag

SEQ ID NO: 2661402 - RNA, 18 nt, Escherichia coli CFT073
ggcauucagauaauaggu

SEQ ID NO: 2661403 - RNA, 22 nt, Escherichia coli CFT073
ggcauugaugaacggcggucag

SEQ ID NO: 2661404 - RNA, 17 nt, Escherichia coli CFT073
ggcauuggcaaucacau

SEQ ID NO: 2661405 - RNA, 17 nt, Escherichia coli CFT073
ggcauugggugcuugag

SEQ ID NO: 2661406 - RNA, 20 nt, Escherichia coli CFT073
ggcauuguaggccagauaaa

SEQ ID NO: 2661407 - RNA, 21 nt, Escherichia coli CFT073
ggcauuguuuuuaucccggca

SEQ ID NO: 2661408 - RNA, 19 nt, Escherichia coli CFT073
ggcauuuccacuggcaaca

SEQ ID NO: 2661409 - RNA, 14 nt, Escherichia coli CFT073
ggcauuuccagacc

SEQ ID NO: 2661410 - RNA, 22 nt, Escherichia coli CFT073
ggcauuuccagaccuaaaaauu

SEQ ID NO: 2661411 - RNA, 14 nt, Escherichia coli CFT073
ggcauuuccgccaa

SEQ ID NO: 2661412 - RNA, 13 nt, Escherichia coli CFT073
ggcauuuuuugca

SEQ ID NO: 2661413 - RNA, 15 nt, Escherichia coli CFT073
ggccaaaaccacagu

SEQ ID NO: 2661414 - RNA, 22 nt, Escherichia coli CFT073
ggccaaaaccacagugacccgc

SEQ ID NO: 2661415 - RNA, 19 nt, Escherichia coli CFT073
ggccaaaaccuuucaccuc

SEQ ID NO: 2661416 - RNA, 15 nt, Escherichia coli CFT073
ggccaaagaccagga

SEQ ID NO: 2661417 - RNA, 15 nt, Escherichia coli CFT073
ggccaaagccgccga

SEQ ID NO: 2661418 - RNA, 17 nt, Escherichia coli CFT073
ggccaaagccgccgagc

SEQ ID NO: 2661419 - RNA, 14 nt, Escherichia coli CFT073
ggccaaagcguuca

SEQ ID NO: 2661420 - RNA, 22 nt, Escherichia coli CFT073
ggccaaaguuccgggauauaaa

SEQ ID NO: 2661421 - RNA, 18 nt, Escherichia coli CFT073
ggccaaauaccggcgucc

SEQ ID NO: 2661422 - RNA, 14 nt, Escherichia coli CFT073
ggccaaaucgccau

SEQ ID NO: 2661423 - RNA, 15 nt, Escherichia coli CFT073
ggccaacaaaaaauu

SEQ ID NO: 2661424 - RNA, 13 nt, Escherichia coli CFT073
ggccaauuggcug

SEQ ID NO: 2661425 - RNA, 16 nt, Escherichia coli CFT073
ggccaauuggcuggcc

SEQ ID NO: 2661426 - RNA, 16 nt, Escherichia coli CFT073
ggccaauuuggcugcc

SEQ ID NO: 2661427 - RNA, 14 nt, Escherichia coli CFT073
ggccacagcgccag

SEQ ID NO: 2661428 - RNA, 16 nt, Escherichia coli CFT073
ggccacgaaucagcac

SEQ ID NO: 2661429 - RNA, 19 nt, Escherichia coli CFT073
ggccacgcauaacgcguaa

SEQ ID NO: 2661430 - RNA, 13 nt, Escherichia coli CFT073
ggccacggcgacc

SEQ ID NO: 2661431 - RNA, 18 nt, Escherichia coli CFT073
ggccagauaaaacacauc

SEQ ID NO: 2661432 - RNA, 23 nt, Escherichia coli CFT073
ggccagauacugccgaccagagc

SEQ ID NO: 2661433 - RNA, 15 nt, Escherichia coli CFT073
ggccagcaaucccca

SEQ ID NO: 2661434 - RNA, 17 nt, Escherichia coli CFT073
ggccagcaauccccaga

SEQ ID NO: 2661435 - RNA, 11 nt, Escherichia coli CFT073
ggccagcagcu

SEQ ID NO: 2661436 - RNA, 17 nt, Escherichia coli CFT073
ggccagccagaagaaaa

SEQ ID NO: 2661437 - RNA, 12 nt, Escherichia coli CFT073
ggccagccgccg

SEQ ID NO: 2661438 - RNA, 17 nt, Escherichia coli CFT073
ggccagcguuuugcucu

SEQ ID NO: 2661439 - RNA, 17 nt, Escherichia coli CFT073
ggccagguuuucuuuca

SEQ ID NO: 2661440 - RNA, 19 nt, Escherichia coli CFT073
ggccaguguuuaucaucuc

SEQ ID NO: 2661441 - RNA, 16 nt, Escherichia coli CFT073
ggccaguuccacuucu

SEQ ID NO: 2661442 - RNA, 19 nt, Escherichia coli CFT073
ggccaguuucggacgcggc

SEQ ID NO: 2661443 - RNA, 22 nt, Escherichia coli CFT073
ggccauaaucaaauaaauaauc

SEQ ID NO: 2661444 - RNA, 18 nt, Escherichia coli CFT073
ggccauacccgccagugc

SEQ ID NO: 2661445 - RNA, 14 nt, Escherichia coli CFT073
ggccauagauuaaa

SEQ ID NO: 2661446 - RNA, 14 nt, Escherichia coli CFT073
ggccaucagcagcg

SEQ ID NO: 2661447 - RNA, 20 nt, Escherichia coli CFT073
ggccaucagcagcggagaaa

SEQ ID NO: 2661448 - RNA, 12 nt, Escherichia coli CFT073
ggccaucggcag

SEQ ID NO: 2661449 - RNA, 14 nt, Escherichia coli CFT073
ggccaucggcagcg

SEQ ID NO: 2661450 - RNA, 18 nt, Escherichia coli CFT073
ggccaugaccaccgcagc

SEQ ID NO: 2661451 - RNA, 16 nt, Escherichia coli CFT073
ggccaugauuaccagc

SEQ ID NO: 2661452 - RNA, 17 nt, Escherichia coli CFT073
ggccaugauuaccagca

SEQ ID NO: 2661453 - RNA, 19 nt, Escherichia coli CFT073
ggccaugauuaccagcauc

SEQ ID NO: 2661454 - RNA, 15 nt, Escherichia coli CFT073
ggccaugcggcgagg

SEQ ID NO: 2661455 - RNA, 16 nt, Escherichia coli CFT073
ggccaugcggcgagga

SEQ ID NO: 2661456 - RNA, 17 nt, Escherichia coli CFT073
ggccauugaauauuuuu

SEQ ID NO: 2661457 - RNA, 19 nt, Escherichia coli CFT073
ggccauuugcucuaccagc

SEQ ID NO: 2661458 - RNA, 14 nt, Escherichia coli CFT073
ggcccagccgugaa

SEQ ID NO: 2661459 - RNA, 12 nt, Escherichia coli CFT073
ggcccaucaucu

SEQ ID NO: 2661460 - RNA, 17 nt, Escherichia coli CFT073
ggcccauugccagcgcu

SEQ ID NO: 2661461 - RNA, 18 nt, Escherichia coli CFT073
ggcccgacgaugaccgca

SEQ ID NO: 2661462 - RNA, 11 nt, Escherichia coli CFT073
ggcccgccagc

SEQ ID NO: 2661463 - RNA, 12 nt, Escherichia coli CFT073
ggcccgcgcagc

SEQ ID NO: 2661464 - RNA, 23 nt, Escherichia coli CFT073
ggcccgcguaagcgggaucaggu

SEQ ID NO: 2661465 - RNA, 20 nt, Escherichia coli CFT073
ggcccgcgucgcaucaggca

SEQ ID NO: 2661466 - RNA, 24 nt, Escherichia coli CFT073
ggcccgucacgcagucagcacugg

SEQ ID NO: 2661467 - RNA, 14 nt, Escherichia coli CFT073
ggccgagauauuga

SEQ ID NO: 2661468 - RNA, 16 nt, Escherichia coli CFT073
ggccgagcuaauaauc

SEQ ID NO: 2661469 - RNA, 23 nt, Escherichia coli CFT073
ggccgaguagccagcugccugcc

SEQ ID NO: 2661470 - RNA, 21 nt, Escherichia coli CFT073
ggccgcaaaccagcgcauggc

SEQ ID NO: 2661471 - RNA, 21 nt, Escherichia coli CFT073
ggccgcaggcuguuaccccug

SEQ ID NO: 2661472 - RNA, 16 nt, Escherichia coli CFT073
ggccgcaugugccccc

SEQ ID NO: 2661473 - RNA, 12 nt, Escherichia coli CFT073
ggccgccagcac

SEQ ID NO: 2661474 - RNA, 22 nt, Escherichia coli CFT073
ggccgccagugauuuuugcuga

SEQ ID NO: 2661475 - RNA, 14 nt, Escherichia coli CFT073
ggccgcgcaggugg

SEQ ID NO: 2661476 - RNA, 15 nt, Escherichia coli CFT073
ggccgcgcagguggu

SEQ ID NO: 2661477 - RNA, 22 nt, Escherichia coli CFT073
ggccgcuccaaggucuccgccc

SEQ ID NO: 2661478 - RNA, 20 nt, Escherichia coli CFT073
ggccgcucugaaagcggccu

SEQ ID NO: 2661479 - RNA, 21 nt, Escherichia coli CFT073
ggccgcucugaaagcggccuu

SEQ ID NO: 2661480 - RNA, 21 nt, Escherichia coli CFT073
ggccgcuuucagagcggccuu

SEQ ID NO: 2661481 - RNA, 20 nt, Escherichia coli CFT073
ggccggauaaggcgcgucaa

SEQ ID NO: 2661482 - RNA, 16 nt, Escherichia coli CFT073
ggccggauaaggcguu

SEQ ID NO: 2661483 - RNA, 22 nt, Escherichia coli CFT073
ggccgguaacgcuuucucacca

SEQ ID NO: 2661484 - RNA, 16 nt, Escherichia coli CFT073
ggccguacagcccagg

SEQ ID NO: 2661485 - RNA, 22 nt, Escherichia coli CFT073
ggccguuuucguuacuccgcca

SEQ ID NO: 2661486 - RNA, 13 nt, Escherichia coli CFT073
ggccuaacacaug

SEQ ID NO: 2661487 - RNA, 16 nt, Escherichia coli CFT073
ggccuacaaaacauua

SEQ ID NO: 2661488 - RNA, 20 nt, Escherichia coli CFT073
ggccuacaaguccguugaaa

SEQ ID NO: 2661489 - RNA, 20 nt, Escherichia coli CFT073
ggccuacaaucccguugaaa

SEQ ID NO: 2661490 - RNA, 18 nt, Escherichia coli CFT073
ggccuacauauucauccc

SEQ ID NO: 2661491 - RNA, 19 nt, Escherichia coli CFT073
ggccuacaugauuucugca

SEQ ID NO: 2661492 - RNA, 14 nt, Escherichia coli CFT073
ggccuacgggaaca

SEQ ID NO: 2661493 - RNA, 20 nt, Escherichia coli CFT073
ggccuacgugauuccugcaa

SEQ ID NO: 2661494 - RNA, 22 nt, Escherichia coli CFT073
ggccucaagcuuacugagcaga

SEQ ID NO: 2661495 - RNA, 16 nt, Escherichia coli CFT073
ggccucuccucgcgag

SEQ ID NO: 2661496 - RNA, 20 nt, Escherichia coli CFT073
ggccucugccagcugcucau

SEQ ID NO: 2661497 - RNA, 13 nt, Escherichia coli CFT073
ggccugaacaagc

SEQ ID NO: 2661498 - RNA, 15 nt, Escherichia coli CFT073
ggccugaacaagcaa

SEQ ID NO: 2661499 - RNA, 18 nt, Escherichia coli CFT073
ggccugaauacacaucag

SEQ ID NO: 2661500 - RNA, 12 nt, Escherichia coli CFT073
ggccugauaaga

SEQ ID NO: 2661501 - RNA, 18 nt, Escherichia coli CFT073
ggccugauaagacgcggc

SEQ ID NO: 2661502 - RNA, 19 nt, Escherichia coli CFT073
ggccugauaagacgcguaa

SEQ ID NO: 2661503 - RNA, 19 nt, Escherichia coli CFT073
ggccugauaagacgcguua

SEQ ID NO: 2661504 - RNA, 20 nt, Escherichia coli CFT073
ggccugauauaucaccuucc

SEQ ID NO: 2661505 - RNA, 23 nt, Escherichia coli CFT073
ggccugaugagcggagcacauca

SEQ ID NO: 2661506 - RNA, 21 nt, Escherichia coli CFT073
ggccugaugcggcguaaacgc

SEQ ID NO: 2661507 - RNA, 16 nt, Escherichia coli CFT073
ggccugauuaaacgcc

SEQ ID NO: 2661508 - RNA, 20 nt, Escherichia coli CFT073
ggccugauuaagaucgugca

SEQ ID NO: 2661509 - RNA, 13 nt, Escherichia coli CFT073
ggccugcgaccag

SEQ ID NO: 2661510 - RNA, 21 nt, Escherichia coli CFT073
ggccugcugaauuuccugcgc

SEQ ID NO: 2661511 - RNA, 18 nt, Escherichia coli CFT073
ggccugcuuuguucagcc

SEQ ID NO: 2661512 - RNA, 18 nt, Escherichia coli CFT073
ggccugcuuuugccagcg

SEQ ID NO: 2661513 - RNA, 20 nt, Escherichia coli CFT073
ggccugcuuuugccagcgug

SEQ ID NO: 2661514 - RNA, 19 nt, Escherichia coli CFT073
ggccuuaaccgccgccaga

SEQ ID NO: 2661515 - RNA, 18 nt, Escherichia coli CFT073
ggccuuaauuggccaccg

SEQ ID NO: 2661516 - RNA, 17 nt, Escherichia coli CFT073
ggccuucuucuuucaga

SEQ ID NO: 2661517 - RNA, 15 nt, Escherichia coli CFT073
ggccuuuaacacgca

SEQ ID NO: 2661518 - RNA, 22 nt, Escherichia coli CFT073
ggcgaaaaaccuaauacucugg

SEQ ID NO: 2661519 - RNA, 16 nt, Escherichia coli CFT073
ggcgaaacaauccagc

SEQ ID NO: 2661520 - RNA, 15 nt, Escherichia coli CFT073
ggcgaaagcgucagc

SEQ ID NO: 2661521 - RNA, 16 nt, Escherichia coli CFT073
ggcgaacgagauaaug

SEQ ID NO: 2661522 - RNA, 24 nt, Escherichia coli CFT073
ggcgaacucugacgauucucccac

SEQ ID NO: 2661523 - RNA, 21 nt, Escherichia coli CFT073
ggcgaagacaaaaccaacgca

SEQ ID NO: 2661524 - RNA, 16 nt, Escherichia coli CFT073
ggcgaagagagcgcca

SEQ ID NO: 2661525 - RNA, 13 nt, Escherichia coli CFT073
ggcgaagugcaga

SEQ ID NO: 2661526 - RNA, 19 nt, Escherichia coli CFT073
ggcgaaguucgguaggccg

SEQ ID NO: 2661527 - RNA, 23 nt, Escherichia coli CFT073
ggcgaaucaacuccagaauaccg

SEQ ID NO: 2661528 - RNA, 20 nt, Escherichia coli CFT073
ggcgaaucguauuaucgaca

SEQ ID NO: 2661529 - RNA, 16 nt, Escherichia coli CFT073
ggcgaauggcguugcc

SEQ ID NO: 2661530 - RNA, 15 nt, Escherichia coli CFT073
ggcgaauuccugacu

SEQ ID NO: 2661531 - RNA, 13 nt, Escherichia coli CFT073
ggcgacaaagugg

SEQ ID NO: 2661532 - RNA, 20 nt, Escherichia coli CFT073
ggcgacaaaguugaagccga

SEQ ID NO: 2661533 - RNA, 21 nt, Escherichia coli CFT073
gccgaagccguuggucaucau

SEQ ID NO: 2661534 - RNA, 22 nt, Escherichia coli CFT073
gccgaagccguuggucaucauc

SEQ ID NO: 2661535 - RNA, 22 nt, Escherichia coli CFT073
gccgaagugguuccacgcccgc

SEQ ID NO: 2661536 - RNA, 14 nt, Escherichia coli CFT073
gccgacaaacagcg

SEQ ID NO: 2661537 - RNA, 20 nt, Escherichia coli CFT073
gccgacaauaaacgcgcagg

SEQ ID NO: 2661538 - RNA, 21 nt, Escherichia coli CFT073
gccgacaauaccacaaacgcc

SEQ ID NO: 2661539 - RNA, 15 nt, Escherichia coli CFT073
gccgacaaucucuuc

SEQ ID NO: 2661540 - RNA, 14 nt, Escherichia coli CFT073
gccgacaucgccac

SEQ ID NO: 2661541 - RNA, 19 nt, Escherichia coli CFT073
gccgacauuaucaccgaca

SEQ ID NO: 2661542 - RNA, 13 nt, Escherichia coli CFT073
gccgaccagaccg

SEQ ID NO: 2661543 - RNA, 13 nt, Escherichia coli CFT073
gccgaccagagcc

SEQ ID NO: 2661544 - RNA, 13 nt, Escherichia coli CFT073
gccgaccagcacc

SEQ ID NO: 2661545 - RNA, 14 nt, Escherichia coli CFT073
gccgaccagcaccg

SEQ ID NO: 2661546 - RNA, 22 nt, Escherichia coli CFT073
gccgaccagcaccgccagcagc

SEQ ID NO: 2661547 - RNA, 13 nt, Escherichia coli CFT073
gccgacggucagg

SEQ ID NO: 2661548 - RNA, 21 nt, Escherichia coli CFT073
gccgacucacuugcagucggc

SEQ ID NO: 2661549 - RNA, 18 nt, Escherichia coli CFT073
gccgacuggcaucuguua

SEQ ID NO: 2661550 - RNA, 23 nt, Escherichia coli CFT073
gccgagaagauuuuuugccagca

SEQ ID NO: 2661551 - RNA, 21 nt, Escherichia coli CFT073
gccgagaauaaaacaagcagc

SEQ ID NO: 2661552 - RNA, 19 nt, Escherichia coli CFT073
gccgagauauagccccaug

SEQ ID NO: 2661553 - RNA, 17 nt, Escherichia coli CFT073
gccgagaucaacagcau

SEQ ID NO: 2661554 - RNA, 14 nt, Escherichia coli CFT073
gccgagcagcuguu

SEQ ID NO: 2661555 - RNA, 17 nt, Escherichia coli CFT073
gccgagcagcuguuuca

SEQ ID NO: 2661556 - RNA, 11 nt, Escherichia coli CFT073
gccgagcgcca

SEQ ID NO: 2661557 - RNA, 13 nt, Escherichia coli CFT073
gccgagcgccagc

SEQ ID NO: 2661558 - RNA, 23 nt, Escherichia coli CFT073
gccgagcuaauaaucaucgcaau

SEQ ID NO: 2661559 - RNA, 16 nt, Escherichia coli CFT073
gccgaggauacagccg

SEQ ID NO: 2661560 - RNA, 16 nt, Escherichia coli CFT073
gccgaggcauucagcc

SEQ ID NO: 2661561 - RNA, 22 nt, Escherichia coli CFT073
gccgaggccgaguagccagcug

SEQ ID NO: 2661562 - RNA, 16 nt, Escherichia coli CFT073
gccgaguaaaaaaaca

SEQ ID NO: 2661563 - RNA, 13 nt, Escherichia coli CFT073
gccgaguagccag

SEQ ID NO: 2661564 - RNA, 18 nt, Escherichia coli CFT073
gccgaguagccagcugcc

SEQ ID NO: 2661565 - RNA, 22 nt, Escherichia coli CFT073
gccgagucgguuuuauugacau

SEQ ID NO: 2661566 - RNA, 22 nt, Escherichia coli CFT073
gccgauaaaggucgacaguagc

SEQ ID NO: 2661567 - RNA, 17 nt, Escherichia coli CFT073
gccgauaaaugccacca

SEQ ID NO: 2661568 - RNA, 16 nt, Escherichia coli CFT073
gccgaucaucauccag

SEQ ID NO: 2661569 - RNA, 14 nt, Escherichia coli CFT073
gccgauccgcguca

SEQ ID NO: 2661570 - RNA, 15 nt, Escherichia coli CFT073
gccgaucgucgcuca

SEQ ID NO: 2661571 - RNA, 16 nt, Escherichia coli CFT073
gccgauggcccgcgua

SEQ ID NO: 2661572 - RNA, 18 nt, Escherichia coli CFT073
gccgaugggcgccauuuu

SEQ ID NO: 2661573 - RNA, 20 nt, Escherichia coli CFT073
gccgauggugcuaagccccu

SEQ ID NO: 2661574 - RNA, 18 nt, Escherichia coli CFT073
gccgaugucauggcugac

SEQ ID NO: 2661575 - RNA, 15 nt, Escherichia coli CFT073
gccgaugucgcugca

SEQ ID NO: 2661576 - RNA, 16 nt, Escherichia coli CFT073
gccgauuaaucuucca

SEQ ID NO: 2661577 - RNA, 15 nt, Escherichia coli CFT073
gccgauuucaaccac

SEQ ID NO: 2661578 - RNA, 21 nt, Escherichia coli CFT073
gccgauuucaugaagcugaca

SEQ ID NO: 2661579 - RNA, 18 nt, Escherichia coli CFT073
gccgauuuuauggcggaa

SEQ ID NO: 2661580 - RNA, 14 nt, Escherichia coli CFT073
gccgcaaaacccag

SEQ ID NO: 2661581 - RNA, 16 nt, Escherichia coli CFT073
gccgcaaaccagcgca

SEQ ID NO: 2661582 - RNA, 15 nt, Escherichia coli CFT073
gccgcaaacgacacu

SEQ ID NO: 2661583 - RNA, 17 nt, Escherichia coli CFT073
gccgcaacuaccagcag

SEQ ID NO: 2661584 - RNA, 18 nt, Escherichia coli CFT073
gccgcaacuaccagcagu

SEQ ID NO: 2661585 - RNA, 16 nt, Escherichia coli CFT073
gccgcaaucagccgga

SEQ ID NO: 2661586 - RNA, 20 nt, Escherichia coli CFT073
gccgcaaucagcguuucgcc

SEQ ID NO: 2661587 - RNA, 18 nt, Escherichia coli CFT073
gccgcaauggccguuccg

SEQ ID NO: 2661588 - RNA, 18 nt, Escherichia coli CFT073
gccgcacaagucagcaac

SEQ ID NO: 2661589 - RNA, 21 nt, Escherichia coli CFT073
gccgcacauuucccggccacg

SEQ ID NO: 2661590 - RNA, 23 nt, Escherichia coli CFT073
gccgcagcggcgguuucuuuauc

SEQ ID NO: 2661591 - RNA, 17 nt, Escherichia coli CFT073
gccgcagguagcagcag

SEQ ID NO: 2661592 - RNA, 15 nt, Escherichia coli CFT073
gccgcauagagaaag

SEQ ID NO: 2661593 - RNA, 16 nt, Escherichia coli CFT073
gccgcauauuccacca

SEQ ID NO: 2661594 - RNA, 14 nt, Escherichia coli CFT073
gccgcaucauccuc

SEQ ID NO: 2661595 - RNA, 15 nt, Escherichia coli CFT073
gccgcauccgacaaa

SEQ ID NO: 2661596 - RNA, 15 nt, Escherichia coli CFT073
gccgcauccgacacu

SEQ ID NO: 2661597 - RNA, 14 nt, Escherichia coli CFT073
gccgcauccgacau

SEQ ID NO: 2661598 - RNA, 22 nt, Escherichia coli CFT073
gccgcauccgacaucaacgccu

SEQ ID NO: 2661599 - RNA, 18 nt, Escherichia coli CFT073
gccgcauccggcauaaac

SEQ ID NO: 2661600 - RNA, 13 nt, Escherichia coli CFT073
gccgcauccggcc

SEQ ID NO: 2661601 - RNA, 22 nt, Escherichia coli CFT073
gccgcauccggccaucaguauu

SEQ ID NO: 2661602 - RNA, 13 nt, Escherichia coli CFT073
gccgcaucuggca

SEQ ID NO: 2661603 - RNA, 19 nt, Escherichia coli CFT073
gccgcauggaaccaguuca

SEQ ID NO: 2661604 - RNA, 20 nt, Escherichia coli CFT073
gccgcauggaaccaguucac

SEQ ID NO: 2661605 - RNA, 12 nt, Escherichia coli CFT073
gccgcauugccc

SEQ ID NO: 2661606 - RNA, 16 nt, Escherichia coli CFT073
gccgcauugguaaaac

SEQ ID NO: 2661607 - RNA, 22 nt, Escherichia coli CFT073
gccgcauuuuguuggacaugug

SEQ ID NO: 2661608 - RNA, 22 nt, Escherichia coli CFT073
gccgcauuuuuucuucaguuca

SEQ ID NO: 2661609 - RNA, 19 nt, Escherichia coli CFT073
gccgccaaacgccgcaugu

SEQ ID NO: 2661610 - RNA, 16 nt, Escherichia coli CFT073
gccgccaaacugugca

SEQ ID NO: 2661611 - RNA, 19 nt, Escherichia coli CFT073
gccgccaaacugugcaccg

SEQ ID NO: 2661612 - RNA, 14 nt, Escherichia coli CFT073
gccgccaauaauga

SEQ ID NO: 2661613 - RNA, 13 nt, Escherichia coli CFT073
gccgccaccgcca

SEQ ID NO: 2661614 - RNA, 22 nt, Escherichia coli CFT073
gccgccacuucuggcggcggca

SEQ ID NO: 2661615 - RNA, 21 nt, Escherichia coli CFT073
gccgccacuugagccgccacc

SEQ ID NO: 2661616 - RNA, 13 nt, Escherichia coli CFT073
gccgccagcuucg

SEQ ID NO: 2661617 - RNA, 18 nt, Escherichia coli CFT073
gccgccaguacgcgcccg

SEQ ID NO: 2661618 - RNA, 15 nt, Escherichia coli CFT073
gccgccaucaccagu

SEQ ID NO: 2661619 - RNA, 13 nt, Escherichia coli CFT073
gccgccaucaucg

SEQ ID NO: 2661620 - RNA, 13 nt, Escherichia coli CFT073
gccgccauccuga

SEQ ID NO: 2661621 - RNA, 21 nt, Escherichia coli CFT073
gccgccauccugaaucaccug

SEQ ID NO: 2661622 - RNA, 13 nt, Escherichia coli CFT073
gccgccaugccau

SEQ ID NO: 2661623 - RNA, 14 nt, Escherichia coli CFT073
gccgccauuccagc

SEQ ID NO: 2661624 - RNA, 17 nt, Escherichia coli CFT073
gccgcccacaacagcau

SEQ ID NO: 2661625 - RNA, 16 nt, Escherichia coli CFT073
gccgcccagcagcaca

SEQ ID NO: 2661626 - RNA, 11 nt, Escherichia coli CFT073
gccgcccagcg

SEQ ID NO: 2661627 - RNA, 13 nt, Escherichia coli CFT073
gccgcccagcgaa

SEQ ID NO: 2661628 - RNA, 14 nt, Escherichia coli CFT073
gccgcccagcgaac

SEQ ID NO: 2661629 - RNA, 21 nt, Escherichia coli CFT073
gccgcccagcgaaccgccaau

SEQ ID NO: 2661630 - RNA, 21 nt, Escherichia coli CFT073
gccgcccaucgcgacggcaga

SEQ ID NO: 2661631 - RNA, 18 nt, Escherichia coli CFT073
gccgccccagacuccagc

SEQ ID NO: 2661632 - RNA, 19 nt, Escherichia coli CFT073
gccgcccccacugccgccu

SEQ ID NO: 2661633 - RNA, 22 nt, Escherichia coli CFT073
gccgccgagcaaaccacaggcc

SEQ ID NO: 2661634 - RNA, 19 nt, Escherichia coli CFT073
gccgccgcaaacaucggcu

SEQ ID NO: 2661635 - RNA, 13 nt, Escherichia coli CFT073
gccgccgcaaccg

SEQ ID NO: 2661636 - RNA, 13 nt, Escherichia coli CFT073
gccgccgcagaca

SEQ ID NO: 2661637 - RNA, 15 nt, Escherichia coli CFT073
gccgccgccagcgcc

SEQ ID NO: 2661638 - RNA, 14 nt, Escherichia coli CFT073
gccgccgcggacaa

SEQ ID NO: 2661639 - RNA, 17 nt, Escherichia coli CFT073
gccgccgcuuuuaaggu

SEQ ID NO: 2661640 - RNA, 19 nt, Escherichia coli CFT073
gccgccgucagacgcgcgg

SEQ ID NO: 2661641 - RNA, 20 nt, Escherichia coli CFT073
gccgccuaacgacaaaucau

SEQ ID NO: 2661642 - RNA, 21 nt, Escherichia coli CFT073
gccgccucugccgcaauggcc

SEQ ID NO: 2661643 - RNA, 13 nt, Escherichia coli CFT073
gccgccugcgcca

SEQ ID NO: 2661644 - RNA, 15 nt, Escherichia coli CFT073
gccgccugcgccagu

SEQ ID NO: 2661645 - RNA, 23 nt, Escherichia coli CFT073
gccgccuggcuaagcaucgcaau

SEQ ID NO: 2661646 - RNA, 20 nt, Escherichia coli CFT073
gccgccuucguagccgcaua

SEQ ID NO: 2661647 - RNA, 18 nt, Escherichia coli CFT073
gccgccuuuuacgcauuc

SEQ ID NO: 2661648 - RNA, 22 nt, Escherichia coli CFT073
gccgcgaaccagaccagcaaua

SEQ ID NO: 2661649 - RNA, 13 nt, Escherichia coli CFT073
gccgcgauagcaa

SEQ ID NO: 2661650 - RNA, 17 nt, Escherichia coli CFT073
gccgcgaucucgucagc

SEQ ID NO: 2661651 - RNA, 18 nt, Escherichia coli CFT073
gccgcgaugauagggcug

SEQ ID NO: 2661652 - RNA, 22 nt, Escherichia coli CFT073
gccgcgcaauugcugaaacgcu

SEQ ID NO: 2661653 - RNA, 17 nt, Escherichia coli CFT073
gccgcgcauagcuggcg

SEQ ID NO: 2661654 - RNA, 14 nt, Escherichia coli CFT073
gccgcgcccgcuaa

SEQ ID NO: 2661655 - RNA, 17 nt, Escherichia coli CFT073
gccgcgcccuaacaggc

SEQ ID NO: 2661656 - RNA, 16 nt, Escherichia coli CFT073
gccgcgcggguggugc

SEQ ID NO: 2661657 - RNA, 14 nt, Escherichia coli CFT073
gccgcgcuccauca

SEQ ID NO: 2661658 - RNA, 14 nt, Escherichia coli CFT073
gccgcggcgcagcu

SEQ ID NO: 2661659 - RNA, 14 nt, Escherichia coli CFT073
gccgcggcgcggcg

SEQ ID NO: 2661660 - RNA, 20 nt, Escherichia coli CFT073
gccgcggcucaggcgcacgc

SEQ ID NO: 2661661 - RNA, 20 nt, Escherichia coli CFT073
gccgcgguaucaaacacagg

SEQ ID NO: 2661662 - RNA, 17 nt, Escherichia coli CFT073
gccgcgucgggcaucag

SEQ ID NO: 2661663 - RNA, 14 nt, Escherichia coli CFT073
gccgcgucuuaucc

SEQ ID NO: 2661664 - RNA, 18 nt, Escherichia coli CFT073
gccgcgucuuauccggca

SEQ ID NO: 2661665 - RNA, 18 nt, Escherichia coli CFT073
gccgcgucuuauccggcc

SEQ ID NO: 2661666 - RNA, 13 nt, Escherichia coli CFT073
gccgcgugcaaua

SEQ ID NO: 2661667 - RNA, 14 nt, Escherichia coli CFT073
gccgcgugccacca

SEQ ID NO: 2661668 - RNA, 18 nt, Escherichia coli CFT073
gccgcgugcgcuggacgc

SEQ ID NO: 2661669 - RNA, 19 nt, Escherichia coli CFT073
gccgcguguuuccgggccg

SEQ ID NO: 2661670 - RNA, 17 nt, Escherichia coli CFT073
gccgcguucgccagcgu

SEQ ID NO: 2661671 - RNA, 16 nt, Escherichia coli CFT073
gccgcuaaauaccagc

SEQ ID NO: 2661672 - RNA, 14 nt, Escherichia coli CFT073
gccgcuaacagcag

SEQ ID NO: 2661673 - RNA, 15 nt, Escherichia coli CFT073
gccgcuaacagcagc

SEQ ID NO: 2661674 - RNA, 16 nt, Escherichia coli CFT073
gccgcuaacuuccugc

SEQ ID NO: 2661675 - RNA, 18 nt, Escherichia coli CFT073
gccgcuccaaggucuccg

SEQ ID NO: 2661676 - RNA, 17 nt, Escherichia coli CFT073
gccgcucccggcauaac

SEQ ID NO: 2661677 - RNA, 15 nt, Escherichia coli CFT073
gccgcuccggcagca

SEQ ID NO: 2661678 - RNA, 17 nt, Escherichia coli CFT073
gccgcuccggcagcagc

SEQ ID NO: 2661679 - RNA, 15 nt, Escherichia coli CFT073
gccgcugcgauuuca

SEQ ID NO: 2661680 - RNA, 20 nt, Escherichia coli CFT073
gccgcugcgauuucagcgcc

SEQ ID NO: 2661681 - RNA, 14 nt, Escherichia coli CFT073
gccgcuggcgcagc

SEQ ID NO: 2661682 - RNA, 17 nt, Escherichia coli CFT073
gccgcugggccaucagg

SEQ ID NO: 2661683 - RNA, 17 nt, Escherichia coli CFT073
gccgcuguaauaccagc

SEQ ID NO: 2661684 - RNA, 12 nt, Escherichia coli CFT073
gccgcuguggca

SEQ ID NO: 2661685 - RNA, 20 nt, Escherichia coli CFT073
gccgcuguguguaggccagc

SEQ ID NO: 2661686 - RNA, 13 nt, Escherichia coli CFT073
gccgcuuaaauuu

SEQ ID NO: 2661687 - RNA, 19 nt, Escherichia coli CFT073
gccgcuuauccccagaaug

SEQ ID NO: 2661688 - RNA, 17 nt, Escherichia coli CFT073
gccgcuucccgcagacc

SEQ ID NO: 2661689 - RNA, 20 nt, Escherichia coli CFT073
gccgcuuucagagcggccuu

SEQ ID NO: 2661690 - RNA, 20 nt, Escherichia coli CFT073
gccgcuuuuaugugcaauuu

SEQ ID NO: 2661691 - RNA, 19 nt, Escherichia coli CFT073
gccgcuuuuggcucaucaa

SEQ ID NO: 2661692 - RNA, 22 nt, Escherichia coli CFT073
gccgcuuuuuccaggcuggcag

SEQ ID NO: 2661693 - RNA, 24 nt, Escherichia coli CFT073
gccgcuuuuucguaccagugcagc

SEQ ID NO: 2661694 - RNA, 15 nt, Escherichia coli CFT073
gccgcuuuuucugca

SEQ ID NO: 2661695 - RNA, 22 nt, Escherichia coli CFT073
gccggaaacauaaauaguggca

SEQ ID NO: 2661696 - RNA, 15 nt, Escherichia coli CFT073
gccggaaagcagcau

SEQ ID NO: 2661697 - RNA, 20 nt, Escherichia coli CFT073
gccggaacauccacuaaccc

SEQ ID NO: 2661698 - RNA, 15 nt, Escherichia coli CFT073
gccggaacgccgcug

SEQ ID NO: 2661699 - RNA, 17 nt, Escherichia coli CFT073
gccggaacgccgcuggu

SEQ ID NO: 2661700 - RNA, 18 nt, Escherichia coli CFT073
gccggaacgccgcuggug

SEQ ID NO: 2661701 - RNA, 19 nt, Escherichia coli CFT073
gccggaauaucaccacuga

SEQ ID NO: 2661702 - RNA, 15 nt, Escherichia coli CFT073
gccggaaucagaauc

SEQ ID NO: 2661703 - RNA, 17 nt, Escherichia coli CFT073
gccggaaucagaauccg

SEQ ID NO: 2661704 - RNA, 17 nt, Escherichia coli CFT073
gccggaaugucuuccuu

SEQ ID NO: 2661705 - RNA, 22 nt, Escherichia coli CFT073
gccggaauuucuuucagcaguu

SEQ ID NO: 2661706 - RNA, 20 nt, Escherichia coli CFT073
gccggaccaucuuccagcug

SEQ ID NO: 2661707 - RNA, 22 nt, Escherichia coli CFT073
gccggacgauuuauuuuucugg

SEQ ID NO: 2661708 - RNA, 14 nt, Escherichia coli CFT073
gccggacgcaccuu

SEQ ID NO: 2661709 - RNA, 13 nt, Escherichia coli CFT073
gccggacgucagg

SEQ ID NO: 2661710 - RNA, 15 nt, Escherichia coli CFT073
gccggagagcaauuu

SEQ ID NO: 2661711 - RNA, 21 nt, Escherichia coli CFT073
gccggaggaguauggcccagc

SEQ ID NO: 2661712 - RNA, 18 nt, Escherichia coli CFT073
gccggaggcaaguuuccu

SEQ ID NO: 2661713 - RNA, 23 nt, Escherichia coli CFT073
gccggaggcaaguuuccuccggc

SEQ ID NO: 2661714 - RNA, 14 nt, Escherichia coli CFT073
gccggaggcgcugg

SEQ ID NO: 2661715 - RNA, 16 nt, Escherichia coli CFT073
gccggauaagauacgc

SEQ ID NO: 2661716 - RNA, 18 nt, Escherichia coli CFT073
gccggauaagaugcgcca

SEQ ID NO: 2661717 - RNA, 21 nt, Escherichia coli CFT073
gccggauaaggcgcgucaagc

SEQ ID NO: 2661718 - RNA, 19 nt, Escherichia coli CFT073
gccggauaaggcguucacg

SEQ ID NO: 2661719 - RNA, 18 nt, Escherichia coli CFT073
gccggauaauuccccggc

SEQ ID NO: 2661720 - RNA, 18 nt, Escherichia coli CFT073
gccggauacgcuuuaucc

SEQ ID NO: 2661721 - RNA, 21 nt, Escherichia coli CFT073
gccggauacgcuuuauccagc

SEQ ID NO: 2661722 - RNA, 12 nt, Escherichia coli CFT073
gccuaccgcauc

SEQ ID NO: 2661723 - RNA, 13 nt, Escherichia coli CFT073
gccuaccgccugc

SEQ ID NO: 2661724 - RNA, 16 nt, Escherichia coli CFT073
gccuaccgccugcaua

SEQ ID NO: 2661725 - RNA, 15 nt, Escherichia coli CFT073
gccuacggcauucug

SEQ ID NO: 2661726 - RNA, 18 nt, Escherichia coli CFT073
gccuacgggaacagugcu

SEQ ID NO: 2661727 - RNA, 18 nt, Escherichia coli CFT073
gccuacgggacuguucau

SEQ ID NO: 2661728 - RNA, 22 nt, Escherichia coli CFT073
gccuacuaccaguagugaaaaa

SEQ ID NO: 2661729 - RNA, 22 nt, Escherichia coli CFT073
gccuauaaacguucccggaaca

SEQ ID NO: 2661730 - RNA, 14 nt, Escherichia coli CFT073
gccuauuauccggc

SEQ ID NO: 2661731 - RNA, 13 nt, Escherichia coli CFT073
gccuauugcucua

SEQ ID NO: 2661732 - RNA, 17 nt, Escherichia coli CFT073
gccucaaaauaaggcug

SEQ ID NO: 2661733 - RNA, 13 nt, Escherichia coli CFT073
gccucaacgccua

SEQ ID NO: 2661734 - RNA, 22 nt, Escherichia coli CFT073
gccucacagagcgcuuauacac

SEQ ID NO: 2661735 - RNA, 13 nt, Escherichia coli CFT073
gccucacgccagc

SEQ ID NO: 2661736 - RNA, 13 nt, Escherichia coli CFT073
gccucacuuugau

SEQ ID NO: 2661737 - RNA, 23 nt, Escherichia coli CFT073
gccucagccgaaacacacaaagc

SEQ ID NO: 2661738 - RNA, 14 nt, Escherichia coli CFT073
gccucaguggcugc

SEQ ID NO: 2661739 - RNA, 23 nt, Escherichia coli CFT073
gccucaguggcugcguuucaugu

SEQ ID NO: 2661740 - RNA, 21 nt, Escherichia coli CFT073
gccucaguuucgacaccuuca

SEQ ID NO: 2661741 - RNA, 12 nt, Escherichia coli CFT073
gccucaucaucg

SEQ ID NO: 2661742 - RNA, 13 nt, Escherichia coli CFT073
gccucaugugaug

SEQ ID NO: 2661743 - RNA, 16 nt, Escherichia coli CFT073
gccucaugugauggua

SEQ ID NO: 2661744 - RNA, 22 nt, Escherichia coli CFT073
gccucccauucaucgccaccgc

SEQ ID NO: 2661745 - RNA, 17 nt, Escherichia coli CFT073
gccuccccagcacgcuu

SEQ ID NO: 2661746 - RNA, 14 nt, Escherichia coli CFT073
gccucccugccucc

SEQ ID NO: 2661747 - RNA, 22 nt, Escherichia coli CFT073
gccucgauauuuaugccgguga

SEQ ID NO: 2661748 - RNA, 12 nt, Escherichia coli CFT073
gccucgcagcgg

SEQ ID NO: 2661749 - RNA, 16 nt, Escherichia coli CFT073
gccucgccgaaacgcu

SEQ ID NO: 2661750 - RNA, 17 nt, Escherichia coli CFT073
gccucgccgaaacgcuu

SEQ ID NO: 2661751 - RNA, 12 nt, Escherichia coli CFT073
gccucgccgagc

SEQ ID NO: 2661752 - RNA, 22 nt, Escherichia coli CFT073
gccucgucccuuugccugccgc

SEQ ID NO: 2661753 - RNA, 23 nt, Escherichia coli CFT073
gccucgucccuuugccugccgcc

SEQ ID NO: 2661754 - RNA, 15 nt, Escherichia coli CFT073
gccucugccgcaaug

SEQ ID NO: 2661755 - RNA, 16 nt, Escherichia coli CFT073
gccucugucagaaaug

SEQ ID NO: 2661756 - RNA, 13 nt, Escherichia coli CFT073
gccucuuccagua

SEQ ID NO: 2661757 - RNA, 16 nt, Escherichia coli CFT073
gccucuucuaaaucgu

SEQ ID NO: 2661758 - RNA, 22 nt, Escherichia coli CFT073
gccucuucucucgcucaugcca

SEQ ID NO: 2661759 - RNA, 17 nt, Escherichia coli CFT073
gccucuucuuuugccug

SEQ ID NO: 2661760 - RNA, 13 nt, Escherichia coli CFT073
gccucuuuauaaa

SEQ ID NO: 2661761 - RNA, 20 nt, Escherichia coli CFT073
gccucuuuauuuccugcgca

SEQ ID NO: 2661762 - RNA, 14 nt, Escherichia coli CFT073
gccucuuucauccg

SEQ ID NO: 2661763 - RNA, 15 nt, Escherichia coli CFT073
gccucuuucauccga

SEQ ID NO: 2661764 - RNA, 14 nt, Escherichia coli CFT073
gccucuuugccaug

SEQ ID NO: 2661765 - RNA, 20 nt, Escherichia coli CFT073
gccucuuugcgguuaaagca

SEQ ID NO: 2661766 - RNA, 11 nt, Escherichia coli CFT073
gccugaaaaau

SEQ ID NO: 2661767 - RNA, 14 nt, Escherichia coli CFT073
gccugaaaaaugag

SEQ ID NO: 2661768 - RNA, 18 nt, Escherichia coli CFT073
gccugaaauaaugcagcg

SEQ ID NO: 2661769 - RNA, 23 nt, Escherichia coli CFT073
gccugaaauugcaaacgcguuaa

SEQ ID NO: 2661770 - RNA, 20 nt, Escherichia coli CFT073
gccugaacaccagaaccagc

SEQ ID NO: 2661771 - RNA, 22 nt, Escherichia coli CFT073
gccugaacaccagaaccagcaa

SEQ ID NO: 2661772 - RNA, 14 nt, Escherichia coli CFT073
gccugaauaaacgc

SEQ ID NO: 2661773 - RNA, 13 nt, Escherichia coli CFT073
gccugaauaauca

SEQ ID NO: 2661774 - RNA, 15 nt, Escherichia coli CFT073
gccugaauacacauc

SEQ ID NO: 2661775 - RNA, 16 nt, Escherichia coli CFT073
gccugaauauccagau

SEQ ID NO: 2661776 - RNA, 22 nt, Escherichia coli CFT073
gccugaaugcuuucauauucca

SEQ ID NO: 2661777 - RNA, 21 nt, Escherichia coli CFT073
gccugacggaaaucauccagc

SEQ ID NO: 2661778 - RNA, 15 nt, Escherichia coli CFT073
gccugacggacgcgc

SEQ ID NO: 2661779 - RNA, 14 nt, Escherichia coli CFT073
gccugaggcgucag

SEQ ID NO: 2661780 - RNA, 15 nt, Escherichia coli CFT073
gccugaggcgucagc

SEQ ID NO: 2661781 - RNA, 19 nt, Escherichia coli CFT073
gccugauaaaacgcgcagc

SEQ ID NO: 2661782 - RNA, 20 nt, Escherichia coli CFT073
gccugauaagacgcgccagc

SEQ ID NO: 2661783 - RNA, 20 nt, Escherichia coli CFT073
gccugauaagacgcggcagc

SEQ ID NO: 2661784 - RNA, 22 nt, Escherichia coli CFT073
gccugauaagaugcguuaagcg

SEQ ID NO: 2661785 - RNA, 13 nt, Escherichia coli CFT073
gccugauaaggca

SEQ ID NO: 2661786 - RNA, 22 nt, Escherichia coli CFT073
gccugauacagccaaaucauca

SEQ ID NO: 2661787 - RNA, 21 nt, Escherichia coli CFT073
gccugauaccccauauuggca

SEQ ID NO: 2661788 - RNA, 21 nt, Escherichia coli CFT073
gccugauagcccgcacaaagc

SEQ ID NO: 2661789 - RNA, 16 nt, Escherichia coli CFT073
gccugaucagcgaagc

SEQ ID NO: 2661790 - RNA, 23 nt, Escherichia coli CFT073
gccugaucagcgaagcgcaucag

SEQ ID NO: 2661791 - RNA, 17 nt, Escherichia coli CFT073
gccugaugcgacgcuga

SEQ ID NO: 2661792 - RNA, 19 nt, Escherichia coli CFT073
gccugaugcgacgcuggcg

SEQ ID NO: 2661793 - RNA, 21 nt, Escherichia coli CFT073
gccugaugcgacgcugguugc

SEQ ID NO: 2661794 - RNA, 22 nt, Escherichia coli CFT073
gccugaugcgacgcuugccgcg

SEQ ID NO: 2661795 - RNA, 12 nt, Escherichia coli CFT073
gccugaugcgcu

SEQ ID NO: 2661796 - RNA, 18 nt, Escherichia coli CFT073
gccugauguagcgugauu

SEQ ID NO: 2661797 - RNA, 16 nt, Escherichia coli CFT073
gccugaugugacgcug

SEQ ID NO: 2661798 - RNA, 22 nt, Escherichia coli CFT073
gccugaugugcuccgcucauca

SEQ ID NO: 2661799 - RNA, 16 nt, Escherichia coli CFT073
gccugauguugauaaa

SEQ ID NO: 2661800 - RNA, 14 nt, Escherichia coli CFT073
gccugauucagcaa

SEQ ID NO: 2661801 - RNA, 20 nt, Escherichia coli CFT073
gccugcaaaaccaauuaaau

SEQ ID NO: 2661802 - RNA, 14 nt, Escherichia coli CFT073
gccugcaaaauaau

SEQ ID NO: 2661803 - RNA, 14 nt, Escherichia coli CFT073
gccugcaaauaaau

SEQ ID NO: 2661804 - RNA, 16 nt, Escherichia coli CFT073
gccugcaacuggcaau

SEQ ID NO: 2661805 - RNA, 19 nt, Escherichia coli CFT073
gccugcaagcgucgcgcca

SEQ ID NO: 2661806 - RNA, 21 nt, Escherichia coli CFT073
gccugcaagcgucgcgccauu

SEQ ID NO: 2661807 - RNA, 22 nt, Escherichia coli CFT073
gccugcaauuuaccuuuccagu

SEQ ID NO: 2661808 - RNA, 19 nt, Escherichia coli CFT073
gccugcacaaagcgccaga

SEQ ID NO: 2661809 - RNA, 21 nt, Escherichia coli CFT073
gccugcacaaagcgccagaau

SEQ ID NO: 2661810 - RNA, 13 nt, Escherichia coli CFT073
gccugcacgaccg

SEQ ID NO: 2661811 - RNA, 22 nt, Escherichia coli CFT073
gccugcacgaccggguuuucaa

SEQ ID NO: 2661812 - RNA, 12 nt, Escherichia coli CFT073
gccugcacucag

SEQ ID NO: 2661813 - RNA, 13 nt, Escherichia coli CFT073
gccugcacugcag

SEQ ID NO: 2661814 - RNA, 19 nt, Escherichia coli CFT073
gccugcagaggccgccgca

SEQ ID NO: 2661815 - RNA, 22 nt, Escherichia coli CFT073
gccugcagcugcucauuacagu

SEQ ID NO: 2661816 - RNA, 21 nt, Escherichia coli CFT073
gccugcaggaaaucaaugcca

SEQ ID NO: 2661817 - RNA, 17 nt, Escherichia coli CFT073
gccugcagucagccagc

SEQ ID NO: 2661818 - RNA, 19 nt, Escherichia coli CFT073
gccugcauaaaggcaaaac

SEQ ID NO: 2661819 - RNA, 16 nt, Escherichia coli CFT073
gccugccacauccccu

SEQ ID NO: 2661820 - RNA, 18 nt, Escherichia coli CFT073
gccugccauugcgggcug

SEQ ID NO: 2661821 - RNA, 21 nt, Escherichia coli CFT073
gccugcccgugggcaggccag

SEQ ID NO: 2661822 - RNA, 22 nt, Escherichia coli CFT073
gccugcccgugggcaggccagg

SEQ ID NO: 2661823 - RNA, 16 nt, Escherichia coli CFT073
gccugccgcauccggc

SEQ ID NO: 2661824 - RNA, 15 nt, Escherichia coli CFT073
gccugcgccaucccc

SEQ ID NO: 2661825 - RNA, 16 nt, Escherichia coli CFT073
gccugcggccagcagc

SEQ ID NO: 2661826 - RNA, 16 nt, Escherichia coli CFT073
gccugcggcgcaugca

SEQ ID NO: 2661827 - RNA, 14 nt, Escherichia coli CFT073
gccugcggcugaua

SEQ ID NO: 2661828 - RNA, 19 nt, Escherichia coli CFT073
gccugcggggagauguaau

SEQ ID NO: 2661829 - RNA, 17 nt, Escherichia coli CFT073
gccugcgugcauaucgc

SEQ ID NO: 2661830 - RNA, 20 nt, Escherichia coli CFT073
gcgaaaaagcguucaucuga

SEQ ID NO: 2661831 - RNA, 13 nt, Escherichia coli CFT073
gcgaaaaaugaug

SEQ ID NO: 2661832 - RNA, 19 nt, Escherichia coli CFT073
gcgaaaacaauuacgccga

SEQ ID NO: 2661833 - RNA, 18 nt, Escherichia coli CFT073
gcgaaaacgcugaccguc

SEQ ID NO: 2661834 - RNA, 12 nt, Escherichia coli CFT073
gcgaaaaucaau

SEQ ID NO: 2661835 - RNA, 15 nt, Escherichia coli CFT073
gcgaaaaucagccau

SEQ ID NO: 2661836 - RNA, 17 nt, Escherichia coli CFT073
gcgaaaaucauuuaucu

SEQ ID NO: 2661837 - RNA, 15 nt, Escherichia coli CFT073
gcgaaacagcgcccc

SEQ ID NO: 2661838 - RNA, 14 nt, Escherichia coli CFT073
gcgaaaccagcagc

SEQ ID NO: 2661839 - RNA, 15 nt, Escherichia coli CFT073
gcgaaaccagcagcc

SEQ ID NO: 2661840 - RNA, 20 nt, Escherichia coli CFT073
gcgaaaccagcagccaucgc

SEQ ID NO: 2661841 - RNA, 20 nt, Escherichia coli CFT073
gcgaaaccugaauccacugg

SEQ ID NO: 2661842 - RNA, 17 nt, Escherichia coli CFT073
gcgaaaccuuacgccau

SEQ ID NO: 2661843 - RNA, 22 nt, Escherichia coli CFT073
gcgaaacugacaggucaucgca

SEQ ID NO: 2661844 - RNA, 14 nt, Escherichia coli CFT073
gcgaaagcgucagc

SEQ ID NO: 2661845 - RNA, 12 nt, Escherichia coli CFT073
gcgaaauaauca

SEQ ID NO: 2661846 - RNA, 14 nt, Escherichia coli CFT073
gcgaaauagcgcca

SEQ ID NO: 2661847 - RNA, 20 nt, Escherichia coli CFT073
gcgaacacgccuuugacguu

SEQ ID NO: 2661848 - RNA, 21 nt, Escherichia coli CFT073
gcgaacagccgcgguaaugga

SEQ ID NO: 2661849 - RNA, 23 nt, Escherichia coli CFT073
gcgaacagcgucgcaucaggcac

SEQ ID NO: 2661850 - RNA, 13 nt, Escherichia coli CFT073
gcgaacagguagu

SEQ ID NO: 2661851 - RNA, 21 nt, Escherichia coli CFT073
gcgaacauaaggaugcgggcg

SEQ ID NO: 2661852 - RNA, 22 nt, Escherichia coli CFT073
gcgaacaucgagugcggcgagc

SEQ ID NO: 2661853 - RNA, 14 nt, Escherichia coli CFT073
gcgaaccagagaca

SEQ ID NO: 2661854 - RNA, 21 nt, Escherichia coli CFT073
gcgaaccauaguauuuaucca

SEQ ID NO: 2661855 - RNA, 16 nt, Escherichia coli CFT073
gcgaaccgucugaagg

SEQ ID NO: 2661856 - RNA, 23 nt, Escherichia coli CFT073
gcgaaccuugcgcgguguugaua

SEQ ID NO: 2661857 - RNA, 19 nt, Escherichia coli CFT073
gcgaacgacauccgccagc

SEQ ID NO: 2661858 - RNA, 15 nt, Escherichia coli CFT073
gcgaacgggauaaac

SEQ ID NO: 2661859 - RNA, 18 nt, Escherichia coli CFT073
gcgaacggggcugccagc

SEQ ID NO: 2661860 - RNA, 16 nt, Escherichia coli CFT073
gcgaagcggcacugcu

SEQ ID NO: 2661861 - RNA, 15 nt, Escherichia coli CFT073
gcgaagcuggucagc

SEQ ID NO: 2661862 - RNA, 21 nt, Escherichia coli CFT073
gcgaagcuggucagcaucguc

SEQ ID NO: 2661863 - RNA, 22 nt, Escherichia coli CFT073
gcgaagcuggucagcaucguca

SEQ ID NO: 2661864 - RNA, 14 nt, Escherichia coli CFT073
gcgaaggccagcac

SEQ ID NO: 2661865 - RNA, 13 nt, Escherichia coli CFT073
gcgaagucacaaa

SEQ ID NO: 2661866 - RNA, 18 nt, Escherichia coli CFT073
gcgaaguucgguaggccg

SEQ ID NO: 2661867 - RNA, 15 nt, Escherichia coli CFT073
gcgaauaccccagcg

SEQ ID NO: 2661868 - RNA, 12 nt, Escherichia coli CFT073
gcgaauacggcu

SEQ ID NO: 2661869 - RNA, 22 nt, Escherichia coli CFT073
gcgaauacggcuaaaucguuca

SEQ ID NO: 2661870 - RNA, 18 nt, Escherichia coli CFT073
gcgaauacguuucagcca

SEQ ID NO: 2661871 - RNA, 14 nt, Escherichia coli CFT073
gcgaauagcgucua

SEQ ID NO: 2661872 - RNA, 19 nt, Escherichia coli CFT073
gcgaauaugcugggcgcgu

SEQ ID NO: 2661873 - RNA, 13 nt, Escherichia coli CFT073
gcgaaucaaccgc

SEQ ID NO: 2661874 - RNA, 12 nt, Escherichia coli CFT073
gcgaaucaggua

SEQ ID NO: 2661875 - RNA, 16 nt, Escherichia coli CFT073
gcgaaucgccguuccg

SEQ ID NO: 2661876 - RNA, 15 nt, Escherichia coli CFT073
gcgaaucgccuguac

SEQ ID NO: 2661877 - RNA, 16 nt, Escherichia coli CFT073
gcgaaucuaaaucagg

SEQ ID NO: 2661878 - RNA, 18 nt, Escherichia coli CFT073
gcgaaucuucauagucuc

SEQ ID NO: 2661879 - RNA, 18 nt, Escherichia coli CFT073
gcgaaugacaugcccggu

SEQ ID NO: 2661880 - RNA, 19 nt, Escherichia coli CFT073
gcgaaugguaaucagcgac

SEQ ID NO: 2661881 - RNA, 20 nt, Escherichia coli CFT073
gcgaauucauguucgguaaa

SEQ ID NO: 2661882 - RNA, 21 nt, Escherichia coli CFT073
gcgaauucauguucgguaaac

SEQ ID NO: 2661883 - RNA, 12 nt, Escherichia coli CFT073
gcgaauuccagu

SEQ ID NO: 2661884 - RNA, 19 nt, Escherichia coli CFT073
gcgaauugcguuaacgcug

SEQ ID NO: 2661885 - RNA, 22 nt, Escherichia coli CFT073
gcgaauuuauuugugauugaug

SEQ ID NO: 2661886 - RNA, 16 nt, Escherichia coli CFT073
gcgaauuuccugccag

SEQ ID NO: 2661887 - RNA, 14 nt, Escherichia coli CFT073
gcgacaaacauugc

SEQ ID NO: 2661888 - RNA, 22 nt, Escherichia coli CFT073
gcgacaaagccucuauggaagu

SEQ ID NO: 2661889 - RNA, 16 nt, Escherichia coli CFT073
gcgacaaagcucaccu

SEQ ID NO: 2661890 - RNA, 14 nt, Escherichia coli CFT073
gcgacaaauguugc

SEQ ID NO: 2661891 - RNA, 14 nt, Escherichia coli CFT073
gcgacaacggguuu

SEQ ID NO: 2661892 - RNA, 23 nt, Escherichia coli CFT073
gcgacaacggguuuggccgggaa

SEQ ID NO: 2661893 - RNA, 19 nt, Escherichia coli CFT073
gcgacaauaaucaccacac

SEQ ID NO: 2661894 - RNA, 14 nt, Escherichia coli CFT073
gcgacaaucccugc

SEQ ID NO: 2661895 - RNA, 15 nt, Escherichia coli CFT073
gcgacaaucccugca

SEQ ID NO: 2661896 - RNA, 18 nt, Escherichia coli CFT073
gcgacacaaucaaauccu

SEQ ID NO: 2661897 - RNA, 13 nt, Escherichia coli CFT073
gcgacaccagcau

SEQ ID NO: 2661898 - RNA, 12 nt, Escherichia coli CFT073
gcgacaccagcc

SEQ ID NO: 2661899 - RNA, 14 nt, Escherichia coli CFT073
gcgacacgcaucac

SEQ ID NO: 2661900 - RNA, 16 nt, Escherichia coli CFT073
gcgacagauucagcgc

SEQ ID NO: 2661901 - RNA, 16 nt, Escherichia coli CFT073
gcgacagauucgcggg

SEQ ID NO: 2661902 - RNA, 20 nt, Escherichia coli CFT073
gcgacagauucgcggguaag

SEQ ID NO: 2661903 - RNA, 14 nt, Escherichia coli CFT073
gcgacagccagccc

SEQ ID NO: 2661904 - RNA, 22 nt, Escherichia coli CFT073
gcgacagccagcccaucgcuag

SEQ ID NO: 2661905 - RNA, 15 nt, Escherichia coli CFT073
gcgacagcugcgacc

SEQ ID NO: 2661906 - RNA, 15 nt, Escherichia coli CFT073
gcgacaggaaccaaa

SEQ ID NO: 2661907 - RNA, 22 nt, Escherichia coli CFT073
gcgacaggaaccaaaugccgga

SEQ ID NO: 2661908 - RNA, 18 nt, Escherichia coli CFT073
gcgacauaaacguauuau

SEQ ID NO: 2661909 - RNA, 17 nt, Escherichia coli CFT073
gcgacauacuuaaauaa

SEQ ID NO: 2661910 - RNA, 20 nt, Escherichia coli CFT073
gcgacauaucauuuugcugc

SEQ ID NO: 2661911 - RNA, 15 nt, Escherichia coli CFT073
gcgacauaucgccag

SEQ ID NO: 2661912 - RNA, 16 nt, Escherichia coli CFT073
gcgacaucgucuccag

SEQ ID NO: 2661913 - RNA, 15 nt, Escherichia coli CFT073
gcgaccaaacugcuc

SEQ ID NO: 2661914 - RNA, 12 nt, Escherichia coli CFT073
gcgaccaaucac

SEQ ID NO: 2661915 - RNA, 13 nt, Escherichia coli CFT073
gcgaccagcaaua

SEQ ID NO: 2661916 - RNA, 17 nt, Escherichia coli CFT073
gcgaccaguggcgggac

SEQ ID NO: 2661917 - RNA, 20 nt, Escherichia coli CFT073
gcgacccguuuacggcuaaa

SEQ ID NO: 2661918 - RNA, 12 nt, Escherichia coli CFT073
gcgaccgccaug

SEQ ID NO: 2661919 - RNA, 23 nt, Escherichia coli CFT073
gcgaccgucuuuauccagcacca

SEQ ID NO: 2661920 - RNA, 16 nt, Escherichia coli CFT073
gcgaccguucgccagg

SEQ ID NO: 2661921 - RNA, 16 nt, Escherichia coli CFT073
gcgaccguuugccaga

SEQ ID NO: 2661922 - RNA, 15 nt, Escherichia coli CFT073
gcgaccguuuucacc

SEQ ID NO: 2661923 - RNA, 20 nt, Escherichia coli CFT073
gcgaccuacacaccuucucc

SEQ ID NO: 2661924 - RNA, 19 nt, Escherichia coli CFT073
gcgaccugugccgccgccc

SEQ ID NO: 2661925 - RNA, 15 nt, Escherichia coli CFT073
gcgaccuguuuugcc

SEQ ID NO: 2661926 - RNA, 19 nt, Escherichia coli CFT073
gcgacgaccacccaccgca

SEQ ID NO: 2661927 - RNA, 21 nt, Escherichia coli CFT073
gcgacgaccacccaccgcagc

SEQ ID NO: 2661928 - RNA, 13 nt, Escherichia coli CFT073
gcgacgacuggcg

SEQ ID NO: 2661929 - RNA, 17 nt, Escherichia coli CFT073
gcgacgacuggcgcggc

SEQ ID NO: 2661930 - RNA, 18 nt, Escherichia coli CFT073
gcgacgauuaagccgccu

SEQ ID NO: 2661931 - RNA, 18 nt, Escherichia coli CFT073
gcgacgcaaacgccuuau

SEQ ID NO: 2661932 - RNA, 14 nt, Escherichia coli CFT073
gcgacgccauugcu

SEQ ID NO: 2661933 - RNA, 14 nt, Escherichia coli CFT073
gcgacgcgcuggca

SEQ ID NO: 2661934 - RNA, 13 nt, Escherichia coli CFT073
gcgacgcggcagc

SEQ ID NO: 2661935 - RNA, 21 nt, Escherichia coli CFT073
gcgacgcgggccgcgucuuau

SEQ ID NO: 2661936 - RNA, 21 nt, Escherichia coli CFT073
gcgacgcuagccgcgucuuau

SEQ ID NO: 2661937 - RNA, 20 nt, Escherichia coli CFT073
gcgacgcugaagcgucuuau

SEQ ID NO: 2661938 - RNA, 20 nt, Escherichia coli CFT073
gcgacgcugacgcgucuuau

SEQ ID NO: 2661939 - RNA, 17 nt, Escherichia coli CFT073
gcgcaaacccucuauac

SEQ ID NO: 2661940 - RNA, 17 nt, Escherichia coli CFT073
gcgcaaaggccagcaau

SEQ ID NO: 2661941 - RNA, 19 nt, Escherichia coli CFT073
gcgcaaaguaaagcgcguc

SEQ ID NO: 2661942 - RNA, 18 nt, Escherichia coli CFT073
gcgcaaauccacguucca

SEQ ID NO: 2661943 - RNA, 15 nt, Escherichia coli CFT073
gcgcaaauugcuggu

SEQ ID NO: 2661944 - RNA, 13 nt, Escherichia coli CFT073
gcgcaacacccug

SEQ ID NO: 2661945 - RNA, 14 nt, Escherichia coli CFT073
gcgcaacagcgcgc

SEQ ID NO: 2661946 - RNA, 22 nt, Escherichia coli CFT073
gcgcaaccacaacgcacuggcg

SEQ ID NO: 2661947 - RNA, 16 nt, Escherichia coli CFT073
gcgcaaccaucaguac

SEQ ID NO: 2661948 - RNA, 14 nt, Escherichia coli CFT073
gcgcaacccccaca

SEQ ID NO: 2661949 - RNA, 17 nt, Escherichia coli CFT073
gcgcaacguaucaucgc

SEQ ID NO: 2661950 - RNA, 19 nt, Escherichia coli CFT073
gcgcaacugcgccgcgagc

SEQ ID NO: 2661951 - RNA, 22 nt, Escherichia coli CFT073
gcgcaacuuuacucauccccug

SEQ ID NO: 2661952 - RNA, 15 nt, Escherichia coli CFT073
gcgcaacuuuuucuu

SEQ ID NO: 2661953 - RNA, 17 nt, Escherichia coli CFT073
gcgcaauagugacagau

SEQ ID NO: 2661954 - RNA, 20 nt, Escherichia coli CFT073
gcgcaauaugcggugccauu

SEQ ID NO: 2661955 - RNA, 16 nt, Escherichia coli CFT073
gcgcaauauguuuccg

SEQ ID NO: 2661956 - RNA, 21 nt, Escherichia coli CFT073
gcgcaaucguaugaucauccg

SEQ ID NO: 2661957 - RNA, 22 nt, Escherichia coli CFT073
gcgcaaucguaugaucauccgc

SEQ ID NO: 2661958 - RNA, 10 nt, Escherichia coli CFT073
gcgcaaugac

SEQ ID NO: 2661959 - RNA, 18 nt, Escherichia coli CFT073
gcgcaaugacgucuucca

SEQ ID NO: 2661960 - RNA, 19 nt, Escherichia coli CFT073
gcgcaaugauaucgcuggc

SEQ ID NO: 2661961 - RNA, 13 nt, Escherichia coli CFT073
gcgcaaugcguuu

SEQ ID NO: 2661962 - RNA, 14 nt, Escherichia coli CFT073
gcgcaauguugcug

SEQ ID NO: 2661963 - RNA, 17 nt, Escherichia coli CFT073
gcgcaauucgcgucggc

SEQ ID NO: 2661964 - RNA, 13 nt, Escherichia coli CFT073
gcgcacaggcggc

SEQ ID NO: 2661965 - RNA, 13 nt, Escherichia coli CFT073
gcgcacaucagga

SEQ ID NO: 2661966 - RNA, 15 nt, Escherichia coli CFT073
gcgcacaugcuggau

SEQ ID NO: 2661967 - RNA, 23 nt, Escherichia coli CFT073
gcgcaccaaccacugcucugacc

SEQ ID NO: 2661968 - RNA, 12 nt, Escherichia coli CFT073
gcgcaccaacgg

SEQ ID NO: 2661969 - RNA, 15 nt, Escherichia coli CFT073
gcgcaccagcaggcc

SEQ ID NO: 2661970 - RNA, 14 nt, Escherichia coli CFT073
gcgcaccguccagc

SEQ ID NO: 2661971 - RNA, 14 nt, Escherichia coli CFT073
gcgcaccuuuacca

SEQ ID NO: 2661972 - RNA, 16 nt, Escherichia coli CFT073
gcgcacgccaacaaaa

SEQ ID NO: 2661973 - RNA, 16 nt, Escherichia coli CFT073
gcgcacgcccaucagc

SEQ ID NO: 2661974 - RNA, 17 nt, Escherichia coli CFT073
gcgcacucuacucccug

SEQ ID NO: 2661975 - RNA, 19 nt, Escherichia coli CFT073
gcgcacucuacucccugcu

SEQ ID NO: 2661976 - RNA, 23 nt, Escherichia coli CFT073
gcgcacugcgcgauaaucccaac

SEQ ID NO: 2661977 - RNA, 13 nt, Escherichia coli CFT073
gcgcacuggcgcu

SEQ ID NO: 2661978 - RNA, 12 nt, Escherichia coli CFT073
gcgcacuuugcu

SEQ ID NO: 2661979 - RNA, 18 nt, Escherichia coli CFT073
gcgcagaagcauaccgau

SEQ ID NO: 2661980 - RNA, 16 nt, Escherichia coli CFT073
gcgcagaucauccggc

SEQ ID NO: 2661981 - RNA, 19 nt, Escherichia coli CFT073
gcgcagauuagccgguaaa

SEQ ID NO: 2661982 - RNA, 13 nt, Escherichia coli CFT073
gcgcagcacccag

SEQ ID NO: 2661983 - RNA, 16 nt, Escherichia coli CFT073
gcgcagcacggugcgg

SEQ ID NO: 2661984 - RNA, 20 nt, Escherichia coli CFT073
gcgcagcacuugcagccgaa

SEQ ID NO: 2661985 - RNA, 16 nt, Escherichia coli CFT073
gcgcagcaucggcgca

SEQ ID NO: 2661986 - RNA, 16 nt, Escherichia coli CFT073
gcgcagcgcagcgcca

SEQ ID NO: 2661987 - RNA, 15 nt, Escherichia coli CFT073
gcgcagcgcgcgaau

SEQ ID NO: 2661988 - RNA, 15 nt, Escherichia coli CFT073
gcgcagcggugagcc

SEQ ID NO: 2661989 - RNA, 22 nt, Escherichia coli CFT073
gcgcagcucuuuauccagcagc

SEQ ID NO: 2661990 - RNA, 14 nt, Escherichia coli CFT073
gcgcagcuuccggc

SEQ ID NO: 2661991 - RNA, 23 nt, Escherichia coli CFT073
gcgcagcuuccggccagcaugcc

SEQ ID NO: 2661992 - RNA, 20 nt, Escherichia coli CFT073
gcgcagcuuugugcuucagu

SEQ ID NO: 2661993 - RNA, 13 nt, Escherichia coli CFT073
gcgcaggagcggc

SEQ ID NO: 2661994 - RNA, 17 nt, Escherichia coli CFT073
gcgcaggagcggcggag

SEQ ID NO: 2661995 - RNA, 14 nt, Escherichia coli CFT073
gcgcaggcgcugaa

SEQ ID NO: 2661996 - RNA, 21 nt, Escherichia coli CFT073
gcgcaggguuugcaucgccau

SEQ ID NO: 2661997 - RNA, 23 nt, Escherichia coli CFT073
gcgcaggguuugcaucgccauga

SEQ ID NO: 2661998 - RNA, 19 nt, Escherichia coli CFT073
gcgcagguacugguaagca

SEQ ID NO: 2661999 - RNA, 13 nt, Escherichia coli CFT073
gcgcagucaccag

SEQ ID NO: 2662000 - RNA, 20 nt, Escherichia coli CFT073
gcgcagucaccagcaucagc

SEQ ID NO: 2662001 - RNA, 22 nt, Escherichia coli CFT073
gcgcagugccugccaugccaaa

SEQ ID NO: 2662002 - RNA, 13 nt, Escherichia coli CFT073
gcgcaguguaaac

SEQ ID NO: 2662003 - RNA, 16 nt, Escherichia coli CFT073
gcgcaguucgcacacc

SEQ ID NO: 2662004 - RNA, 19 nt, Escherichia coli CFT073
gcgcaguucgcacaccgcu

SEQ ID NO: 2662005 - RNA, 23 nt, Escherichia coli CFT073
gcgcaguucgucguuugacaaug

SEQ ID NO: 2662006 - RNA, 15 nt, Escherichia coli CFT073
gcgcaguugugcaau

SEQ ID NO: 2662007 - RNA, 16 nt, Escherichia coli CFT073
gcgcaguuuaugcagu

SEQ ID NO: 2662008 - RNA, 15 nt, Escherichia coli CFT073
gcgcauaacauucag

SEQ ID NO: 2662009 - RNA, 23 nt, Escherichia coli CFT073
gcgcauaagaccgugagcaaugc

SEQ ID NO: 2662010 - RNA, 23 nt, Escherichia coli CFT073
gcgcauaccaaaaucuaccagcg

SEQ ID NO: 2662011 - RNA, 21 nt, Escherichia coli CFT073
gcgcauagccuccggccacga

SEQ ID NO: 2662012 - RNA, 12 nt, Escherichia coli CFT073
gcgcauauugcc

SEQ ID NO: 2662013 - RNA, 19 nt, Escherichia coli CFT073
gcgcaucaaggccaggcag

SEQ ID NO: 2662014 - RNA, 19 nt, Escherichia coli CFT073
gcgcauccaguuccuucaa

SEQ ID NO: 2662015 - RNA, 15 nt, Escherichia coli CFT073
gcgcauccgccagca

SEQ ID NO: 2662016 - RNA, 12 nt, Escherichia coli CFT073
gcgcaucgccag

SEQ ID NO: 2662017 - RNA, 21 nt, Escherichia coli CFT073
gcgcaucgggcgauucgaugu

SEQ ID NO: 2662018 - RNA, 23 nt, Escherichia coli CFT073
gcgcaucguagauuucauccggc

SEQ ID NO: 2662019 - RNA, 21 nt, Escherichia coli CFT073
gcgcaucugggauuuuguuua

SEQ ID NO: 2662020 - RNA, 17 nt, Escherichia coli CFT073
gcgcaucuuauccggcc

SEQ ID NO: 2662021 - RNA, 18 nt, Escherichia coli CFT073
gcgcaucuuauccggccu

SEQ ID NO: 2662022 - RNA, 14 nt, Escherichia coli CFT073
gcgcaugcaggcau

SEQ ID NO: 2662023 - RNA, 13 nt, Escherichia coli CFT073
gcgcauggcggca

SEQ ID NO: 2662024 - RNA, 22 nt, Escherichia coli CFT073
gcgcaugguagaaaucuaucgc

SEQ ID NO: 2662025 - RNA, 16 nt, Escherichia coli CFT073
gcgcauguuggcgcgg

SEQ ID NO: 2662026 - RNA, 17 nt, Escherichia coli CFT073
gcgcauguuggcgcggu

SEQ ID NO: 2662027 - RNA, 23 nt, Escherichia coli CFT073
gcgcauuaaauaccaagccaagc

SEQ ID NO: 2662028 - RNA, 18 nt, Escherichia coli CFT073
gcgcauuaacucacuggc

SEQ ID NO: 2662029 - RNA, 16 nt, Escherichia coli CFT073
gcgcauuaccucaaua

SEQ ID NO: 2662030 - RNA, 13 nt, Escherichia coli CFT073
gcgcauucaccag

SEQ ID NO: 2662031 - RNA, 17 nt, Escherichia coli CFT073
gcgcauucgaucaccgc

SEQ ID NO: 2662032 - RNA, 20 nt, Escherichia coli CFT073
gcgcauucgaucaccgcaga

SEQ ID NO: 2662033 - RNA, 12 nt, Escherichia coli CFT073
gcgcauugacga

SEQ ID NO: 2662034 - RNA, 13 nt, Escherichia coli CFT073
gcgcauuguuucu

SEQ ID NO: 2662035 - RNA, 18 nt, Escherichia coli CFT073
gcgcauuuccaagauuaa

SEQ ID NO: 2662036 - RNA, 18 nt, Escherichia coli CFT073
gcgcauuucccagcaaga

SEQ ID NO: 2662037 - RNA, 19 nt, Escherichia coli CFT073
gcgcauuucccagcaagaa

SEQ ID NO: 2662038 - RNA, 19 nt, Escherichia coli CFT073
gcgcauuugcggcagagca

SEQ ID NO: 2662039 - RNA, 13 nt, Escherichia coli CFT073
gcgccaaacauuu

SEQ ID NO: 2662040 - RNA, 17 nt, Escherichia coli CFT073
gcgccaacgucugccug

SEQ ID NO: 2662041 - RNA, 19 nt, Escherichia coli CFT073
gcgccaagcccguguuucu

SEQ ID NO: 2662042 - RNA, 23 nt, Escherichia coli CFT073
gcgccaauacccguccacacggc

SEQ ID NO: 2662043 - RNA, 17 nt, Escherichia coli CFT073
gcgccaaucagcgcagc

SEQ ID NO: 2662044 - RNA, 18 nt, Escherichia coli CFT073
gcgccaaucagcgcagca

SEQ ID NO: 2662045 - RNA, 21 nt, Escherichia coli CFT073
gcgccaaucagcgcagcaccc

SEQ ID NO: 2662046 - RNA, 13 nt, Escherichia coli CFT073
gcgccaaucgaca

SEQ ID NO: 2662047 - RNA, 13 nt, Escherichia coli CFT073
gcgccaaucggca

SEQ ID NO: 2662048 - RNA, 13 nt, Escherichia coli CFT073
gcgcgcaaugacg

SEQ ID NO: 2662049 - RNA, 21 nt, Escherichia coli CFT073
gcgcgcagguaguuaucugcc

SEQ ID NO: 2662050 - RNA, 17 nt, Escherichia coli CFT073
gcgcgccuggcgugccc

SEQ ID NO: 2662051 - RNA, 21 nt, Escherichia coli CFT073
gcgcgcgaauauggcggcggc

SEQ ID NO: 2662052 - RNA, 13 nt, Escherichia coli CFT073
gcgcgcgguggcg

SEQ ID NO: 2662053 - RNA, 22 nt, Escherichia coli CFT073
gcgcgcgguggcguacagcugg

SEQ ID NO: 2662054 - RNA, 23 nt, Escherichia coli CFT073
gcgcgcuaacggagaauccagcc

SEQ ID NO: 2662055 - RNA, 22 nt, Escherichia coli CFT073
gcgcgcuaugcaacaacuggcg

SEQ ID NO: 2662056 - RNA, 22 nt, Escherichia coli CFT073
gcgcgcugcgucuuccacuuca

SEQ ID NO: 2662057 - RNA, 18 nt, Escherichia coli CFT073
gcgcggauccacaccuga

SEQ ID NO: 2662058 - RNA, 17 nt, Escherichia coli CFT073
gcgcggauuucggcggc

SEQ ID NO: 2662059 - RNA, 18 nt, Escherichia coli CFT073
gcgcggauuucggcggcu

SEQ ID NO: 2662060 - RNA, 14 nt, Escherichia coli CFT073
gcgcggcagcggga

SEQ ID NO: 2662061 - RNA, 14 nt, Escherichia coli CFT073
gcgcggcagcuuca

SEQ ID NO: 2662062 - RNA, 17 nt, Escherichia coli CFT073
gcgcggcauuacgcccg

SEQ ID NO: 2662063 - RNA, 14 nt, Escherichia coli CFT073
gcgcggcccacuuc

SEQ ID NO: 2662064 - RNA, 11 nt, Escherichia coli CFT073
gcgcggcgcaa

SEQ ID NO: 2662065 - RNA, 15 nt, Escherichia coli CFT073
gcgcggcggguuaac

SEQ ID NO: 2662066 - RNA, 13 nt, Escherichia coli CFT073
gcgcggcuggcac

SEQ ID NO: 2662067 - RNA, 21 nt, Escherichia coli CFT073
gcgcggucauaaaauccguaa

SEQ ID NO: 2662068 - RNA, 12 nt, Escherichia coli CFT073
gcgcggucgauc

SEQ ID NO: 2662069 - RNA, 17 nt, Escherichia coli CFT073
gcgcgucaagcgucgca

SEQ ID NO: 2662070 - RNA, 14 nt, Escherichia coli CFT073
gcgcgucaccaccu

SEQ ID NO: 2662071 - RNA, 18 nt, Escherichia coli CFT073
gcgcgucaucggcgcggu

SEQ ID NO: 2662072 - RNA, 13 nt, Escherichia coli CFT073
gcgcgucuuaucc

SEQ ID NO: 2662073 - RNA, 18 nt, Escherichia coli CFT073
gcgcgucuuauccgaccu

SEQ ID NO: 2662074 - RNA, 16 nt, Escherichia coli CFT073
gcgcgucuuguacuuc

SEQ ID NO: 2662075 - RNA, 13 nt, Escherichia coli CFT073
gcgcgugcuggga

SEQ ID NO: 2662076 - RNA, 13 nt, Escherichia coli CFT073
gcgcguuaacucc

SEQ ID NO: 2662077 - RNA, 14 nt, Escherichia coli CFT073
gcgcguuacuggca

SEQ ID NO: 2662078 - RNA, 21 nt, Escherichia coli CFT073
gcgcguuauuuguugccggau

SEQ ID NO: 2662079 - RNA, 16 nt, Escherichia coli CFT073
gcgcguuguucaugcc

SEQ ID NO: 2662080 - RNA, 14 nt, Escherichia coli CFT073
gcgcguuucugcgc

SEQ ID NO: 2662081 - RNA, 17 nt, Escherichia coli CFT073
gcgcguuuuauccggcc

SEQ ID NO: 2662082 - RNA, 17 nt, Escherichia coli CFT073
gcgcguuuucaaccgga

SEQ ID NO: 2662083 - RNA, 13 nt, Escherichia coli CFT073
gcgcuaccagagc

SEQ ID NO: 2662084 - RNA, 16 nt, Escherichia coli CFT073
gcgcuaccagagccgc

SEQ ID NO: 2662085 - RNA, 21 nt, Escherichia coli CFT073
gcgcuaccaucgacaccaucg

SEQ ID NO: 2662086 - RNA, 20 nt, Escherichia coli CFT073
gcgcuacgcuuaucaggccu

SEQ ID NO: 2662087 - RNA, 20 nt, Escherichia coli CFT073
gcgcuacgcuugucaggccu

SEQ ID NO: 2662088 - RNA, 17 nt, Escherichia coli CFT073
gcgcuauaucgcugaua

SEQ ID NO: 2662089 - RNA, 14 nt, Escherichia coli CFT073
gcgcuaucgccugc

SEQ ID NO: 2662090 - RNA, 15 nt, Escherichia coli CFT073
gcgcuauugccguaa

SEQ ID NO: 2662091 - RNA, 22 nt, Escherichia coli CFT073
gcgcucaauauaacgaucggcg

SEQ ID NO: 2662092 - RNA, 22 nt, Escherichia coli CFT073
gcgcuccaucagauucagcagc

SEQ ID NO: 2662093 - RNA, 14 nt, Escherichia coli CFT073
gcgcucccgcagga

SEQ ID NO: 2662094 - RNA, 23 nt, Escherichia coli CFT073
gcgcucccgcaggagcgccgaau

SEQ ID NO: 2662095 - RNA, 14 nt, Escherichia coli CFT073
gcgcuccggcacuu

SEQ ID NO: 2662096 - RNA, 13 nt, Escherichia coli CFT073
gcgcuccuguucc

SEQ ID NO: 2662097 - RNA, 19 nt, Escherichia coli CFT073
gcgcucgcgccgcauccga

SEQ ID NO: 2662098 - RNA, 13 nt, Escherichia coli CFT073
gcgcucuucuuca

SEQ ID NO: 2662099 - RNA, 23 nt, Escherichia coli CFT073
gcgcugaaaccgugcaucuguug

SEQ ID NO: 2662100 - RNA, 15 nt, Escherichia coli CFT073
gcgcugaaucccgca

SEQ ID NO: 2662101 - RNA, 13 nt, Escherichia coli CFT073
gcgcugaccacuu

SEQ ID NO: 2662102 - RNA, 12 nt, Escherichia coli CFT073
gcgcugaccuuc

SEQ ID NO: 2662103 - RNA, 15 nt, Escherichia coli CFT073
gcgcugacgcgucuu

SEQ ID NO: 2662104 - RNA, 17 nt, Escherichia coli CFT073
gcgcugacucuacugaa

SEQ ID NO: 2662105 - RNA, 23 nt, Escherichia coli CFT073
gcgcugaugugauaaugccggau

SEQ ID NO: 2662106 - RNA, 18 nt, Escherichia coli CFT073
gcgcugauuaccuuccug

SEQ ID NO: 2662107 - RNA, 16 nt, Escherichia coli CFT073
gcgcugauucuuccca

SEQ ID NO: 2662108 - RNA, 22 nt, Escherichia coli CFT073
gcgcugcaaagcugauaaucau

SEQ ID NO: 2662109 - RNA, 15 nt, Escherichia coli CFT073
gcgcugcaccagguu

SEQ ID NO: 2662110 - RNA, 13 nt, Escherichia coli CFT073
gcgcugcggccug

SEQ ID NO: 2662111 - RNA, 12 nt, Escherichia coli CFT073
gcgcugcucagg

SEQ ID NO: 2662112 - RNA, 16 nt, Escherichia coli CFT073
gcgcugcucaggcgac

SEQ ID NO: 2662113 - RNA, 23 nt, Escherichia coli CFT073
gcgcugcuguagcaguuccagca

SEQ ID NO: 2662114 - RNA, 17 nt, Escherichia coli CFT073
gcgcuggcaaaucaaau

SEQ ID NO: 2662115 - RNA, 19 nt, Escherichia coli CFT073
gcgcugggcuucaccacca

SEQ ID NO: 2662116 - RNA, 22 nt, Escherichia coli CFT073
gcgcugguaacaucgccagaga

SEQ ID NO: 2662117 - RNA, 18 nt, Escherichia coli CFT073
gcgcugguaaucaccacc

SEQ ID NO: 2662118 - RNA, 20 nt, Escherichia coli CFT073
gcgcugguaaucaccaccca

SEQ ID NO: 2662119 - RNA, 22 nt, Escherichia coli CFT073
gcgcuguaauuucacaccauca

SEQ ID NO: 2662120 - RNA, 17 nt, Escherichia coli CFT073
gcgcuuaacgauuugag

SEQ ID NO: 2662121 - RNA, 20 nt, Escherichia coli CFT073
gcgcuuaaucaauugcagga

SEQ ID NO: 2662122 - RNA, 22 nt, Escherichia coli CFT073
gcgcuuaaucaauugcaggaag

SEQ ID NO: 2662123 - RNA, 14 nt, Escherichia coli CFT073
gcgcuuaucgccag

SEQ ID NO: 2662124 - RNA, 17 nt, Escherichia coli CFT073
gcgcuuccggcagcuuc

SEQ ID NO: 2662125 - RNA, 23 nt, Escherichia coli CFT073
gcgcuucgcuuaccaugccaacg

SEQ ID NO: 2662126 - RNA, 18 nt, Escherichia coli CFT073
gcgcuucguugaucagcg

SEQ ID NO: 2662127 - RNA, 15 nt, Escherichia coli CFT073
gcgcuucucaggccu

SEQ ID NO: 2662128 - RNA, 14 nt, Escherichia coli CFT073
gcgcuucuuccagc

SEQ ID NO: 2662129 - RNA, 16 nt, Escherichia coli CFT073
gcgcuugcgcggcagc

SEQ ID NO: 2662130 - RNA, 17 nt, Escherichia coli CFT073
gcgcuugcggccagcac

SEQ ID NO: 2662131 - RNA, 12 nt, Escherichia coli CFT073
gcgcuuguugau

SEQ ID NO: 2662132 - RNA, 14 nt, Escherichia coli CFT073
gcgcuuucagcacg

SEQ ID NO: 2662133 - RNA, 20 nt, Escherichia coli CFT073
gcgcuuucagcacgacauaa

SEQ ID NO: 2662134 - RNA, 13 nt, Escherichia coli CFT073
gcgcuuucugcuu

SEQ ID NO: 2662135 - RNA, 18 nt, Escherichia coli CFT073
gcgcuuugaaacgcacgc

SEQ ID NO: 2662136 - RNA, 21 nt, Escherichia coli CFT073
gcgcuuugaugcguucuucaa

SEQ ID NO: 2662137 - RNA, 22 nt, Escherichia coli CFT073
gcgcuuuuacugcacucgccag

SEQ ID NO: 2662138 - RNA, 13 nt, Escherichia coli CFT073
gcgcuuuugcauc

SEQ ID NO: 2662139 - RNA, 16 nt, Escherichia coli CFT073
gcgcuuuuuccugccg

SEQ ID NO: 2662140 - RNA, 19 nt, Escherichia coli CFT073
gcgcuuuuuccugccgcua

SEQ ID NO: 2662141 - RNA, 18 nt, Escherichia coli CFT073
gcggaaaaucgggcgaca

SEQ ID NO: 2662142 - RNA, 19 nt, Escherichia coli CFT073
gcggaaacagcggcugcuu

SEQ ID NO: 2662143 - RNA, 21 nt, Escherichia coli CFT073
gcggaaacuuaaucgccaguu

SEQ ID NO: 2662144 - RNA, 16 nt, Escherichia coli CFT073
gcggaaaucuccagau

SEQ ID NO: 2662145 - RNA, 16 nt, Escherichia coli CFT073
gcggaaaugcagaggc

SEQ ID NO: 2662146 - RNA, 14 nt, Escherichia coli CFT073
gcggaaccgcaggc

SEQ ID NO: 2662147 - RNA, 16 nt, Escherichia coli CFT073
gcggaagaccugacug

SEQ ID NO: 2662148 - RNA, 12 nt, Escherichia coli CFT073
gcggaauaucag

SEQ ID NO: 2662149 - RNA, 21 nt, Escherichia coli CFT073
gcggaaucaccggcaaaacca

SEQ ID NO: 2662150 - RNA, 23 nt, Escherichia coli CFT073
gcggaaugcagucacgccaguaa

SEQ ID NO: 2662151 - RNA, 21 nt, Escherichia coli CFT073
gcggaauuaaccgcccaccgc

SEQ ID NO: 2662152 - RNA, 15 nt, Escherichia coli CFT073
gcggacacuuuccug

SEQ ID NO: 2662153 - RNA, 18 nt, Escherichia coli CFT073
gcggaccccgcgcucgcg

SEQ ID NO: 2662154 - RNA, 22 nt, Escherichia coli CFT073
gcggaccuuuugccgcccaguc

SEQ ID NO: 2662155 - RNA, 15 nt, Escherichia coli CFT073
gcggacgucuguuua

SEQ ID NO: 2662156 - RNA, 20 nt, Escherichia coli CFT073
gcggacuucauugacgccaa

SEQ ID NO: 2662157 - RNA, 13 nt, Escherichia coli CFT073
gcggcugauaauc

SEQ ID NO: 2662158 - RNA, 17 nt, Escherichia coli CFT073
gcggcugcgccuguggu

SEQ ID NO: 2662159 - RNA, 13 nt, Escherichia coli CFT073
gcggcugcguaau

SEQ ID NO: 2662160 - RNA, 19 nt, Escherichia coli CFT073
gcggcugcguaauucgcca

SEQ ID NO: 2662161 - RNA, 16 nt, Escherichia coli CFT073
gcggcuggcacuggca

SEQ ID NO: 2662162 - RNA, 12 nt, Escherichia coli CFT073
gcggcuggcgca

SEQ ID NO: 2662163 - RNA, 12 nt, Escherichia coli CFT073
gcggcuucaacu

SEQ ID NO: 2662164 - RNA, 18 nt, Escherichia coli CFT073
gcggcuucaucuuuauca

SEQ ID NO: 2662165 - RNA, 19 nt, Escherichia coli CFT073
gcggcuucaucuuuaucaa

SEQ ID NO: 2662166 - RNA, 14 nt, Escherichia coli CFT073
gcggcuucugccag

SEQ ID NO: 2662167 - RNA, 15 nt, Escherichia coli CFT073
gcggcuugcaccagc

SEQ ID NO: 2662168 - RNA, 18 nt, Escherichia coli CFT073
gcggcuugcaccagcagc

SEQ ID NO: 2662169 - RNA, 20 nt, Escherichia coli CFT073
gcggcuuguacgccgccgca

SEQ ID NO: 2662170 - RNA, 14 nt, Escherichia coli CFT073
gcggcuuucagggc

SEQ ID NO: 2662171 - RNA, 22 nt, Escherichia coli CFT073
gcggcuuugucauaaccaaugu

SEQ ID NO: 2662172 - RNA, 18 nt, Escherichia coli CFT073
gcgggaaaacauacacau

SEQ ID NO: 2662173 - RNA, 17 nt, Escherichia coli CFT073
gcgggaauagcucaguu

SEQ ID NO: 2662174 - RNA, 16 nt, Escherichia coli CFT073
gcgggacaacaaacgc

SEQ ID NO: 2662175 - RNA, 14 nt, Escherichia coli CFT073
gcgggacauauuga

SEQ ID NO: 2662176 - RNA, 20 nt, Escherichia coli CFT073
gcgggauaaucgcgccgcga

SEQ ID NO: 2662177 - RNA, 21 nt, Escherichia coli CFT073
gcgggauguaucgcccuuacc

SEQ ID NO: 2662178 - RNA, 13 nt, Escherichia coli CFT073
gcgggcaaacgga

SEQ ID NO: 2662179 - RNA, 18 nt, Escherichia coli CFT073
gcgggcaacguuccagca

SEQ ID NO: 2662180 - RNA, 17 nt, Escherichia coli CFT073
gcgggcaaucggcugca

SEQ ID NO: 2662181 - RNA, 16 nt, Escherichia coli CFT073
gcgggccgcgucgggc

SEQ ID NO: 2662182 - RNA, 19 nt, Escherichia coli CFT073
gcgggcgaucauauccagc

SEQ ID NO: 2662183 - RNA, 20 nt, Escherichia coli CFT073
gcgggcgaucauauccagca

SEQ ID NO: 2662184 - RNA, 14 nt, Escherichia coli CFT073
gcgggcgcaaugcc

SEQ ID NO: 2662185 - RNA, 20 nt, Escherichia coli CFT073
gcgggcgcaaugcccgcagu

SEQ ID NO: 2662186 - RNA, 23 nt, Escherichia coli CFT073
gcgggcgguaagccggagcuggc

SEQ ID NO: 2662187 - RNA, 13 nt, Escherichia coli CFT073
gcgggcuaaacuc

SEQ ID NO: 2662188 - RNA, 20 nt, Escherichia coli CFT073
gcgggcuggcguacccauca

SEQ ID NO: 2662189 - RNA, 16 nt, Escherichia coli CFT073
gcggggauaugguggu

SEQ ID NO: 2662190 - RNA, 21 nt, Escherichia coli CFT073
gcggggaucacuccccgccgu

SEQ ID NO: 2662191 - RNA, 22 nt, Escherichia coli CFT073
gcggggaugaauauguaggccg

SEQ ID NO: 2662192 - RNA, 16 nt, Escherichia coli CFT073
gcggggcuaccgccag

SEQ ID NO: 2662193 - RNA, 20 nt, Escherichia coli CFT073
gcggggcuaccgccagacca

SEQ ID NO: 2662194 - RNA, 21 nt, Escherichia coli CFT073
gcgggguaaucgccagcaaaa

SEQ ID NO: 2662195 - RNA, 16 nt, Escherichia coli CFT073
gcggguaaaaccauuu

SEQ ID NO: 2662196 - RNA, 23 nt, Escherichia coli CFT073
gcggguaaaaccauuuugcuggc

SEQ ID NO: 2662197 - RNA, 14 nt, Escherichia coli CFT073
gcgggugcgcaggc

SEQ ID NO: 2662198 - RNA, 13 nt, Escherichia coli CFT073
gcggguucaguga

SEQ ID NO: 2662199 - RNA, 15 nt, Escherichia coli CFT073
gcggguuuaccacgg

SEQ ID NO: 2662200 - RNA, 13 nt, Escherichia coli CFT073
gcggguuuugaau

SEQ ID NO: 2662201 - RNA, 16 nt, Escherichia coli CFT073
gcggguuuuucccuuc

SEQ ID NO: 2662202 - RNA, 15 nt, Escherichia coli CFT073
gcgguaaaaugguca

SEQ ID NO: 2662203 - RNA, 16 nt, Escherichia coli CFT073
gcgguaaaauggucag

SEQ ID NO: 2662204 - RNA, 15 nt, Escherichia coli CFT073
gcgguaaaccguuau

SEQ ID NO: 2662205 - RNA, 23 nt, Escherichia coli CFT073
gcgguaaagaacugagcgccguc

SEQ ID NO: 2662206 - RNA, 20 nt, Escherichia coli CFT073
gcgguaaauuuuuugaucaa

SEQ ID NO: 2662207 - RNA, 19 nt, Escherichia coli CFT073
gcgguaacacgcugcucau

SEQ ID NO: 2662208 - RNA, 14 nt, Escherichia coli CFT073
gcgguaacgccauc

SEQ ID NO: 2662209 - RNA, 22 nt, Escherichia coli CFT073
gcgguaagaguaaagcccgcca

SEQ ID NO: 2662210 - RNA, 16 nt, Escherichia coli CFT073
gcgguaauaaacgccc

SEQ ID NO: 2662211 - RNA, 16 nt, Escherichia coli CFT073
gcgguacucgcgcagu

SEQ ID NO: 2662212 - RNA, 18 nt, Escherichia coli CFT073
gcgguacugaccaucagc

SEQ ID NO: 2662213 - RNA, 23 nt, Escherichia coli CFT073
gcgguacuucucaccgguaaagu

SEQ ID NO: 2662214 - RNA, 15 nt, Escherichia coli CFT073
gcgguagauggcgga

SEQ ID NO: 2662215 - RNA, 15 nt, Escherichia coli CFT073
gcgguaucaccaccc

SEQ ID NO: 2662216 - RNA, 16 nt, Escherichia coli CFT073
gcgguaucaccaccca

SEQ ID NO: 2662217 - RNA, 15 nt, Escherichia coli CFT073
gcgguaugguaaagc

SEQ ID NO: 2662218 - RNA, 15 nt, Escherichia coli CFT073
gcgguauuugauacc

SEQ ID NO: 2662219 - RNA, 16 nt, Escherichia coli CFT073
gcggucaaaagcugca

SEQ ID NO: 2662220 - RNA, 14 nt, Escherichia coli CFT073
gcggucaaugguca

SEQ ID NO: 2662221 - RNA, 23 nt, Escherichia coli CFT073
gcggucaccggaacuuucaccac

SEQ ID NO: 2662222 - RNA, 18 nt, Escherichia coli CFT073
gcggucagcgcaauguug

SEQ ID NO: 2662223 - RNA, 14 nt, Escherichia coli CFT073
gcggucagcgcagc

SEQ ID NO: 2662224 - RNA, 14 nt, Escherichia coli CFT073
gcggucagcugcug

SEQ ID NO: 2662225 - RNA, 20 nt, Escherichia coli CFT073
gcggucaucauauugucugc

SEQ ID NO: 2662226 - RNA, 16 nt, Escherichia coli CFT073
gcggucauguaccguu

SEQ ID NO: 2662227 - RNA, 22 nt, Escherichia coli CFT073
gcggucgagaaagggccccgag

SEQ ID NO: 2662228 - RNA, 17 nt, Escherichia coli CFT073
gcggucgcugccgccau

SEQ ID NO: 2662229 - RNA, 23 nt, Escherichia coli CFT073
gcggucugccaacuuugccguga

SEQ ID NO: 2662230 - RNA, 21 nt, Escherichia coli CFT073
gcggucuggcagcuaaugcca

SEQ ID NO: 2662231 - RNA, 14 nt, Escherichia coli CFT073
gcggugagcguuuc

SEQ ID NO: 2662232 - RNA, 16 nt, Escherichia coli CFT073
gcggugaucaaaacgg

SEQ ID NO: 2662233 - RNA, 15 nt, Escherichia coli CFT073
gcggugauuuccgcc

SEQ ID NO: 2662234 - RNA, 18 nt, Escherichia coli CFT073
gcggugcaccugccagca

SEQ ID NO: 2662235 - RNA, 13 nt, Escherichia coli CFT073
gcggugccgcgaa

SEQ ID NO: 2662236 - RNA, 17 nt, Escherichia coli CFT073
gcgguguaaaccagcuc

SEQ ID NO: 2662237 - RNA, 15 nt, Escherichia coli CFT073
gcgguguaggccuga

SEQ ID NO: 2662238 - RNA, 14 nt, Escherichia coli CFT073
gcggugucgccaga

SEQ ID NO: 2662239 - RNA, 22 nt, Escherichia coli CFT073
gcggugucggaacgguaggccg

SEQ ID NO: 2662240 - RNA, 18 nt, Escherichia coli CFT073
gcgguguuuucagguuac

SEQ ID NO: 2662241 - RNA, 23 nt, Escherichia coli CFT073
gcgguuacgccgcauccgacauc

SEQ ID NO: 2662242 - RNA, 13 nt, Escherichia coli CFT073
gcgguuagcggcu

SEQ ID NO: 2662243 - RNA, 17 nt, Escherichia coli CFT073
gcgguucacgcgccaga

SEQ ID NO: 2662244 - RNA, 22 nt, Escherichia coli CFT073
gcgguucuccuggcauaaacac

SEQ ID NO: 2662245 - RNA, 23 nt, Escherichia coli CFT073
gcgguucuucaucuucaucaucu

SEQ ID NO: 2662246 - RNA, 15 nt, Escherichia coli CFT073
gcgguuguagccacg

SEQ ID NO: 2662247 - RNA, 19 nt, Escherichia coli CFT073
gcgguuuauacggcguuuc

SEQ ID NO: 2662248 - RNA, 16 nt, Escherichia coli CFT073
gcgguuucuuuauccg

SEQ ID NO: 2662249 - RNA, 22 nt, Escherichia coli CFT073
gcgguuugaguucaccgccauu

SEQ ID NO: 2662250 - RNA, 23 nt, Escherichia coli CFT073
gcguaaaaaaacaaaaaccggag

SEQ ID NO: 2662251 - RNA, 22 nt, Escherichia coli CFT073
gcguaaacgccuuaucaggcca

SEQ ID NO: 2662252 - RNA, 22 nt, Escherichia coli CFT073
gcguaaccaaugccacccagcg

SEQ ID NO: 2662253 - RNA, 12 nt, Escherichia coli CFT073
gcguaaccaccc

SEQ ID NO: 2662254 - RNA, 15 nt, Escherichia coli CFT073
gcguaacgcaccagg

SEQ ID NO: 2662255 - RNA, 18 nt, Escherichia coli CFT073
gcguaaguacaguauuca

SEQ ID NO: 2662256 - RNA, 15 nt, Escherichia coli CFT073
gcguaauauccagcg

SEQ ID NO: 2662257 - RNA, 13 nt, Escherichia coli CFT073
gcguaaucgccga

SEQ ID NO: 2662258 - RNA, 20 nt, Escherichia coli CFT073
gcguaaucgccgaaccagug

SEQ ID NO: 2662259 - RNA, 15 nt, Escherichia coli CFT073
gcguacaaucgccac

SEQ ID NO: 2662260 - RNA, 15 nt, Escherichia coli CFT073
gcguacaccaacauc

SEQ ID NO: 2662261 - RNA, 18 nt, Escherichia coli CFT073
gcguaccaguggcggcau

SEQ ID NO: 2662262 - RNA, 19 nt, Escherichia coli CFT073
gcguaccaugauccugcaa

SEQ ID NO: 2662263 - RNA, 16 nt, Escherichia coli CFT073
gcguaccauuucuucu

SEQ ID NO: 2662264 - RNA, 16 nt, Escherichia coli CFT073
gcguacccaucaacaa

SEQ ID NO: 2662265 - RNA, 20 nt, Escherichia coli CFT073
gcguguuaaugcccaucagu

SEQ ID NO: 2662266 - RNA, 13 nt, Escherichia coli CFT073
gcguguuccagag

SEQ ID NO: 2662267 - RNA, 13 nt, Escherichia coli CFT073
gcguguuccagcg

SEQ ID NO: 2662268 - RNA, 22 nt, Escherichia coli CFT073
gcguguugcuccacgccagcgu

SEQ ID NO: 2662269 - RNA, 20 nt, Escherichia coli CFT073
gcguguuguaaaacgcgccc

SEQ ID NO: 2662270 - RNA, 20 nt, Escherichia coli CFT073
gcguuaaacuggaaaaccgc

SEQ ID NO: 2662271 - RNA, 12 nt, Escherichia coli CFT073
gcguuaacgcug

SEQ ID NO: 2662272 - RNA, 14 nt, Escherichia coli CFT073
gcguuaacuuguug

SEQ ID NO: 2662273 - RNA, 23 nt, Escherichia coli CFT073
gcguuaacuuguugcgccguuuc

SEQ ID NO: 2662274 - RNA, 20 nt, Escherichia coli CFT073
gcguuaagccaucccagaca

SEQ ID NO: 2662275 - RNA, 18 nt, Escherichia coli CFT073
gcguuacgccaucuguuu

SEQ ID NO: 2662276 - RNA, 17 nt, Escherichia coli CFT073
gcguuacuaccggcgug

SEQ ID NO: 2662277 - RNA, 15 nt, Escherichia coli CFT073
gcguucaaucugucc

SEQ ID NO: 2662278 - RNA, 22 nt, Escherichia coli CFT073
gcguucaaucuguccuuccagu

SEQ ID NO: 2662279 - RNA, 19 nt, Escherichia coli CFT073
gcguucaccuaacagcauc

SEQ ID NO: 2662280 - RNA, 20 nt, Escherichia coli CFT073
gcguucacgccgcauccggc

SEQ ID NO: 2662281 - RNA, 22 nt, Escherichia coli CFT073
gcguucacgccgcauccggcca

SEQ ID NO: 2662282 - RNA, 21 nt, Escherichia coli CFT073
gcguucacugccguacaggca

SEQ ID NO: 2662283 - RNA, 21 nt, Escherichia coli CFT073
gcguucaucaguuccaguuca

SEQ ID NO: 2662284 - RNA, 20 nt, Escherichia coli CFT073
gcguuccacgucacaggcca

SEQ ID NO: 2662285 - RNA, 11 nt, Escherichia coli CFT073
gcguuccccag

SEQ ID NO: 2662286 - RNA, 13 nt, Escherichia coli CFT073
gcguuccccagaa

SEQ ID NO: 2662287 - RNA, 15 nt, Escherichia coli CFT073
gcguuccccagaagc

SEQ ID NO: 2662288 - RNA, 23 nt, Escherichia coli CFT073
gcguuccggcggcacagccagcg

SEQ ID NO: 2662289 - RNA, 15 nt, Escherichia coli CFT073
gcguuccugccgcga

SEQ ID NO: 2662290 - RNA, 21 nt, Escherichia coli CFT073
gcguucgauagcgcgccagcc

SEQ ID NO: 2662291 - RNA, 17 nt, Escherichia coli CFT073
gcguucgcaccaccgga

SEQ ID NO: 2662292 - RNA, 22 nt, Escherichia coli CFT073
gcguucgcgccgcauccggcau

SEQ ID NO: 2662293 - RNA, 23 nt, Escherichia coli CFT073
gcguucgguauuaauuugccagc

SEQ ID NO: 2662294 - RNA, 15 nt, Escherichia coli CFT073
gcguucucgccaaac

SEQ ID NO: 2662295 - RNA, 16 nt, Escherichia coli CFT073
gcguucugucagcacg

SEQ ID NO: 2662296 - RNA, 22 nt, Escherichia coli CFT073
gcguucugucgauaaacucaug

SEQ ID NO: 2662297 - RNA, 13 nt, Escherichia coli CFT073
gcguucuguggca

SEQ ID NO: 2662298 - RNA, 13 nt, Escherichia coli CFT073
gcguugcagagag

SEQ ID NO: 2662299 - RNA, 22 nt, Escherichia coli CFT073
gcguugccugaauacacugcug

SEQ ID NO: 2662300 - RNA, 21 nt, Escherichia coli CFT073
gcguugcggugagucuggaag

SEQ ID NO: 2662301 - RNA, 15 nt, Escherichia coli CFT073
gcguugcuggcguga

SEQ ID NO: 2662302 - RNA, 15 nt, Escherichia coli CFT073
gcguuguccgccaga

SEQ ID NO: 2662303 - RNA, 18 nt, Escherichia coli CFT073
gcguuuacagagccgccg

SEQ ID NO: 2662304 - RNA, 22 nt, Escherichia coli CFT073
gcguuuacgccgcauccggcau

SEQ ID NO: 2662305 - RNA, 19 nt, Escherichia coli CFT073
gcguuuagcaguucaucaa

SEQ ID NO: 2662306 - RNA, 13 nt, Escherichia coli CFT073
gcguuuaucaaua

SEQ ID NO: 2662307 - RNA, 18 nt, Escherichia coli CFT073
gcguuuaucgacagacgc

SEQ ID NO: 2662308 - RNA, 14 nt, Escherichia coli CFT073
gcguuuauucugga

SEQ ID NO: 2662309 - RNA, 18 nt, Escherichia coli CFT073
gcguuucaaaaacaaaga

SEQ ID NO: 2662310 - RNA, 16 nt, Escherichia coli CFT073
gcguuucaaguguaca

SEQ ID NO: 2662311 - RNA, 15 nt, Escherichia coli CFT073
gcguuucauuagcca

SEQ ID NO: 2662312 - RNA, 20 nt, Escherichia coli CFT073
gcguuucugcgcuucugcca

SEQ ID NO: 2662313 - RNA, 17 nt, Escherichia coli CFT073
gcguuugaugcgagugu

SEQ ID NO: 2662314 - RNA, 18 nt, Escherichia coli CFT073
gcguuugcgacaguaagc

SEQ ID NO: 2662315 - RNA, 13 nt, Escherichia coli CFT073
gcguuuggugcga

SEQ ID NO: 2662316 - RNA, 18 nt, Escherichia coli CFT073
gcguuuguccgccagaaa

SEQ ID NO: 2662317 - RNA, 22 nt, Escherichia coli CFT073
gcguuuuagccgcauccggcau

SEQ ID NO: 2662318 - RNA, 15 nt, Escherichia coli CFT073
gcguuuucagaucca

SEQ ID NO: 2662319 - RNA, 20 nt, Escherichia coli CFT073
gcguuuuguagagcagcacg

SEQ ID NO: 2662320 - RNA, 17 nt, Escherichia coli CFT073
gcguuuuuaucuucaca

SEQ ID NO: 2662321 - RNA, 20 nt, Escherichia coli CFT073
gcguuuuuggcaucggcaaa

SEQ ID NO: 2662322 - RNA, 20 nt, Escherichia coli CFT073
gcguuuuuugaucaguaauu

SEQ ID NO: 2662323 - RNA, 22 nt, Escherichia coli CFT073
gcuaaaaaucccgccaucggcg

SEQ ID NO: 2662324 - RNA, 14 nt, Escherichia coli CFT073
gcuaaaccgcugcc

SEQ ID NO: 2662325 - RNA, 15 nt, Escherichia coli CFT073
gcuaaaccgcugccu

SEQ ID NO: 2662326 - RNA, 16 nt, Escherichia coli CFT073
gcuaaaggcaacaucu

SEQ ID NO: 2662327 - RNA, 19 nt, Escherichia coli CFT073
gcuaaaguacguaaaacaa

SEQ ID NO: 2662328 - RNA, 16 nt, Escherichia coli CFT073
gcuaaauacugaccgu

SEQ ID NO: 2662329 - RNA, 22 nt, Escherichia coli CFT073
gcuaaauugccggaugcggggc

SEQ ID NO: 2662330 - RNA, 19 nt, Escherichia coli CFT073
gcuaacaauucacacucug

SEQ ID NO: 2662331 - RNA, 21 nt, Escherichia coli CFT073
gcuaacacuuucgccugcggc

SEQ ID NO: 2662332 - RNA, 20 nt, Escherichia coli CFT073
gcuaacaguuugccaaacca

SEQ ID NO: 2662333 - RNA, 18 nt, Escherichia coli CFT073
gcuaacaugguuaaaauc

SEQ ID NO: 2662334 - RNA, 21 nt, Escherichia coli CFT073
gcuaacaugguuaaaaucucc

SEQ ID NO: 2662335 - RNA, 16 nt, Escherichia coli CFT073
gcuaaccaaacuucag

SEQ ID NO: 2662336 - RNA, 21 nt, Escherichia coli CFT073
gcuaacggagaauccagcccc

SEQ ID NO: 2662337 - RNA, 12 nt, Escherichia coli CFT073
gcuaacgugcag

SEQ ID NO: 2662338 - RNA, 14 nt, Escherichia coli CFT073
gcuaacuccugauu

SEQ ID NO: 2662339 - RNA, 14 nt, Escherichia coli CFT073
gcuaacuccuucgu

SEQ ID NO: 2662340 - RNA, 15 nt, Escherichia coli CFT073
gcuaagauaccccag

SEQ ID NO: 2662341 - RNA, 21 nt, Escherichia coli CFT073
gcuaagccccugagcgaauac

SEQ ID NO: 2662342 - RNA, 23 nt, Escherichia coli CFT073
gcuaagccccugagcgaauaccc

SEQ ID NO: 2662343 - RNA, 21 nt, Escherichia coli CFT073
gcuaagcgcgcggccucaucu

SEQ ID NO: 2662344 - RNA, 13 nt, Escherichia coli CFT073
gcuaaggaaaucg

SEQ ID NO: 2662345 - RNA, 12 nt, Escherichia coli CFT073
gcuaauaaacag

SEQ ID NO: 2662346 - RNA, 19 nt, Escherichia coli CFT073
gcuaauaccggaugccaga

SEQ ID NO: 2662347 - RNA, 22 nt, Escherichia coli CFT073
gcuaauacgaugcaaccgagcg

SEQ ID NO: 2662348 - RNA, 14 nt, Escherichia coli CFT073
gcuaauagcgcagc

SEQ ID NO: 2662349 - RNA, 13 nt, Escherichia coli CFT073
gcuaauauuuucg

SEQ ID NO: 2662350 - RNA, 21 nt, Escherichia coli CFT073
gcuaaucgucaucagcgccaa

SEQ ID NO: 2662351 - RNA, 19 nt, Escherichia coli CFT073
gcuaaucgucaucgacagc

SEQ ID NO: 2662352 - RNA, 18 nt, Escherichia coli CFT073
gcuaaucucuucaccaua

SEQ ID NO: 2662353 - RNA, 20 nt, Escherichia coli CFT073
gcuaaugcgacccacgcccc

SEQ ID NO: 2662354 - RNA, 15 nt, Escherichia coli CFT073
gcuaauugcaccauc

SEQ ID NO: 2662355 - RNA, 14 nt, Escherichia coli CFT073
gcuacaacaugacc

SEQ ID NO: 2662356 - RNA, 14 nt, Escherichia coli CFT073
gcuacaccgaucac

SEQ ID NO: 2662357 - RNA, 18 nt, Escherichia coli CFT073
gcuacaccgucauuagcg

SEQ ID NO: 2662358 - RNA, 20 nt, Escherichia coli CFT073
gcuacacuuucugcaaacaa

SEQ ID NO: 2662359 - RNA, 17 nt, Escherichia coli CFT073
gcuacaggguaaaaaga

SEQ ID NO: 2662360 - RNA, 13 nt, Escherichia coli CFT073
gcuacauaacgca

SEQ ID NO: 2662361 - RNA, 21 nt, Escherichia coli CFT073
gcuacaucauuuuuuaauuca

SEQ ID NO: 2662362 - RNA, 12 nt, Escherichia coli CFT073
gcuaccaaccag

SEQ ID NO: 2662363 - RNA, 14 nt, Escherichia coli CFT073
gcuaccacuuccca

SEQ ID NO: 2662364 - RNA, 18 nt, Escherichia coli CFT073
gcuaccagaaagcgaccc

SEQ ID NO: 2662365 - RNA, 19 nt, Escherichia coli CFT073
gcuaccagaaagcgacccg

SEQ ID NO: 2662366 - RNA, 15 nt, Escherichia coli CFT073
gcuaccagcaaagag

SEQ ID NO: 2662367 - RNA, 20 nt, Escherichia coli CFT073
gcuaccaucgacaccaucgc

SEQ ID NO: 2662368 - RNA, 17 nt, Escherichia coli CFT073
gcuaccaugcuaauaau

SEQ ID NO: 2662369 - RNA, 19 nt, Escherichia coli CFT073
gcuacccgcgcagugcagg

SEQ ID NO: 2662370 - RNA, 16 nt, Escherichia coli CFT073
gcuacccggcguuuuu

SEQ ID NO: 2662371 - RNA, 15 nt, Escherichia coli CFT073
gcuacccuggcgagc

SEQ ID NO: 2662372 - RNA, 14 nt, Escherichia coli CFT073
gcuaccgaccagac

SEQ ID NO: 2662373 - RNA, 20 nt, Escherichia coli CFT073
gcuccagugccuggcauaac

SEQ ID NO: 2662374 - RNA, 19 nt, Escherichia coli CFT073
gcuccaguuaacgccgcgc

SEQ ID NO: 2662375 - RNA, 16 nt, Escherichia coli CFT073
gcuccauaauugccag

SEQ ID NO: 2662376 - RNA, 18 nt, Escherichia coli CFT073
gcuccauaauugccagcu

SEQ ID NO: 2662377 - RNA, 17 nt, Escherichia coli CFT073
gcuccaucaggucauca

SEQ ID NO: 2662378 - RNA, 19 nt, Escherichia coli CFT073
gcuccaucaggucaucaau

SEQ ID NO: 2662379 - RNA, 20 nt, Escherichia coli CFT073
gcuccaucauccgcggauaa

SEQ ID NO: 2662380 - RNA, 22 nt, Escherichia coli CFT073
gcuccaucauccgcggauaaaa

SEQ ID NO: 2662381 - RNA, 11 nt, Escherichia coli CFT073
gcuccaucaug

SEQ ID NO: 2662382 - RNA, 23 nt, Escherichia coli CFT073
gcuccaugcugcgggcgaucaua

SEQ ID NO: 2662383 - RNA, 17 nt, Escherichia coli CFT073
gcuccauuccaucgccu

SEQ ID NO: 2662384 - RNA, 14 nt, Escherichia coli CFT073
gcuccauuccgugc

SEQ ID NO: 2662385 - RNA, 13 nt, Escherichia coli CFT073
gcucccagcagug

SEQ ID NO: 2662386 - RNA, 12 nt, Escherichia coli CFT073
gcucccagcccg

SEQ ID NO: 2662387 - RNA, 13 nt, Escherichia coli CFT073
gcucccagcgcau

SEQ ID NO: 2662388 - RNA, 17 nt, Escherichia coli CFT073
gcucccauaaugcccca

SEQ ID NO: 2662389 - RNA, 22 nt, Escherichia coli CFT073
gcucccauaaugccccagcgca

SEQ ID NO: 2662390 - RNA, 15 nt, Escherichia coli CFT073
gcuccccaaaagaaa

SEQ ID NO: 2662391 - RNA, 17 nt, Escherichia coli CFT073
gcuccccagaccaauug

SEQ ID NO: 2662392 - RNA, 17 nt, Escherichia coli CFT073
gcucccgcagccacucc

SEQ ID NO: 2662393 - RNA, 18 nt, Escherichia coli CFT073
gcucccgcagccacuccu

SEQ ID NO: 2662394 - RNA, 22 nt, Escherichia coli CFT073
gcucccggauaccccagcuggc

SEQ ID NO: 2662395 - RNA, 23 nt, Escherichia coli CFT073
gcucccggauaccccagcuggcg

SEQ ID NO: 2662396 - RNA, 12 nt, Escherichia coli CFT073
gcucccucaaua

SEQ ID NO: 2662397 - RNA, 13 nt, Escherichia coli CFT073
gcuccgaagugau

SEQ ID NO: 2662398 - RNA, 14 nt, Escherichia coli CFT073
gcuccgccacuuug

SEQ ID NO: 2662399 - RNA, 19 nt, Escherichia coli CFT073
gcuccgccaucuucuugca

SEQ ID NO: 2662400 - RNA, 17 nt, Escherichia coli CFT073
gcuccgccgcagccgca

SEQ ID NO: 2662401 - RNA, 12 nt, Escherichia coli CFT073
gcuccgcgaccc

SEQ ID NO: 2662402 - RNA, 18 nt, Escherichia coli CFT073
gcuccggaagaugaaaaa

SEQ ID NO: 2662403 - RNA, 22 nt, Escherichia coli CFT073
gcuccggcacgaauugcuucca

SEQ ID NO: 2662404 - RNA, 15 nt, Escherichia coli CFT073
gcuccggcagcagca

SEQ ID NO: 2662405 - RNA, 21 nt, Escherichia coli CFT073
gcuccgggugugacaacaaca

SEQ ID NO: 2662406 - RNA, 22 nt, Escherichia coli CFT073
gcuccgggugugacaacaacau

SEQ ID NO: 2662407 - RNA, 15 nt, Escherichia coli CFT073
gcuccguccagccac

SEQ ID NO: 2662408 - RNA, 20 nt, Escherichia coli CFT073
gcuccguccagccaccgcgu

SEQ ID NO: 2662409 - RNA, 12 nt, Escherichia coli CFT073
gcuccucaucaa

SEQ ID NO: 2662410 - RNA, 18 nt, Escherichia coli CFT073
gcuccugaucaagcuggc

SEQ ID NO: 2662411 - RNA, 24 nt, Escherichia coli CFT073
gcuccugaucaagcuggcgcuggc

SEQ ID NO: 2662412 - RNA, 23 nt, Escherichia coli CFT073
gcuccugcagaaaauccagcguc

SEQ ID NO: 2662413 - RNA, 13 nt, Escherichia coli CFT073
gcuccuguugaug

SEQ ID NO: 2662414 - RNA, 18 nt, Escherichia coli CFT073
gcuccuguuugcauuucu

SEQ ID NO: 2662415 - RNA, 17 nt, Escherichia coli CFT073
gcuccuucucugagcug

SEQ ID NO: 2662416 - RNA, 18 nt, Escherichia coli CFT073
gcucgaagaguuccagcg

SEQ ID NO: 2662417 - RNA, 20 nt, Escherichia coli CFT073
gcucgaagaguuccagcgcc

SEQ ID NO: 2662418 - RNA, 16 nt, Escherichia coli CFT073
gcucgaauauaacuaa

SEQ ID NO: 2662419 - RNA, 21 nt, Escherichia coli CFT073
gcucgaauuaaaggauauucg

SEQ ID NO: 2662420 - RNA, 18 nt, Escherichia coli CFT073
gcucgacagcgcuaauac

SEQ ID NO: 2662421 - RNA, 18 nt, Escherichia coli CFT073
gcucgacgagaauuuccu

SEQ ID NO: 2662422 - RNA, 21 nt, Escherichia coli CFT073
gcucgacuagauacugacgau

SEQ ID NO: 2662423 - RNA, 16 nt, Escherichia coli CFT073
gcucgagagagaaaau

SEQ ID NO: 2662424 - RNA, 12 nt, Escherichia coli CFT073
gcucgagccgca

SEQ ID NO: 2662425 - RNA, 18 nt, Escherichia coli CFT073
gcucgaggaaaugcaauu

SEQ ID NO: 2662426 - RNA, 19 nt, Escherichia coli CFT073
gcucgaucagacgaucgcg

SEQ ID NO: 2662427 - RNA, 20 nt, Escherichia coli CFT073
gcucgaucagacgaucgcgc

SEQ ID NO: 2662428 - RNA, 16 nt, Escherichia coli CFT073
gcucgaucaguucagc

SEQ ID NO: 2662429 - RNA, 17 nt, Escherichia coli CFT073
gcucgcaggcggcaucg

SEQ ID NO: 2662430 - RNA, 20 nt, Escherichia coli CFT073
gcucgcagguuauaccuuua

SEQ ID NO: 2662431 - RNA, 15 nt, Escherichia coli CFT073
gcucgccgcagagau

SEQ ID NO: 2662432 - RNA, 17 nt, Escherichia coli CFT073
gcucgccgcagagauca

SEQ ID NO: 2662433 - RNA, 12 nt, Escherichia coli CFT073
gcucgccuacau

SEQ ID NO: 2662434 - RNA, 15 nt, Escherichia coli CFT073
gcucgcgauggcgau

SEQ ID NO: 2662435 - RNA, 16 nt, Escherichia coli CFT073
gcucgcugcaaaacag

SEQ ID NO: 2662436 - RNA, 19 nt, Escherichia coli CFT073
gcucgcugcaaaacagguc

SEQ ID NO: 2662437 - RNA, 15 nt, Escherichia coli CFT073
gcucgcuggcaggcc

SEQ ID NO: 2662438 - RNA, 19 nt, Escherichia coli CFT073
gcucggaaauauucaacac

SEQ ID NO: 2662439 - RNA, 15 nt, Escherichia coli CFT073
gcucggucacugaca

SEQ ID NO: 2662440 - RNA, 16 nt, Escherichia coli CFT073
gcucggucacugacac

SEQ ID NO: 2662441 - RNA, 20 nt, Escherichia coli CFT073
gcucguaaagcaucagacug

SEQ ID NO: 2662442 - RNA, 21 nt, Escherichia coli CFT073
gcucguagaagccagagaaca

SEQ ID NO: 2662443 - RNA, 16 nt, Escherichia coli CFT073
gcucgucaaaaacaaa

SEQ ID NO: 2662444 - RNA, 12 nt, Escherichia coli CFT073
gcucgucauccg

SEQ ID NO: 2662445 - RNA, 15 nt, Escherichia coli CFT073
gcucgucgcgacgac

SEQ ID NO: 2662446 - RNA, 21 nt, Escherichia coli CFT073
gcucgugcagaacauccagcu

SEQ ID NO: 2662447 - RNA, 15 nt, Escherichia coli CFT073
gcucguucagcacuu

SEQ ID NO: 2662448 - RNA, 15 nt, Escherichia coli CFT073
gcucguucagcgguc

SEQ ID NO: 2662449 - RNA, 16 nt, Escherichia coli CFT073
gcucuaaaucuucuuc

SEQ ID NO: 2662450 - RNA, 22 nt, Escherichia coli CFT073
gcucuaacccuuccagauucag

SEQ ID NO: 2662451 - RNA, 22 nt, Escherichia coli CFT073
gcucuacaauugguaaauaagc

SEQ ID NO: 2662452 - RNA, 16 nt, Escherichia coli CFT073
gcucuacgcuucucuc

SEQ ID NO: 2662453 - RNA, 18 nt, Escherichia coli CFT073
gcucuacgcuucucucug

SEQ ID NO: 2662454 - RNA, 17 nt, Escherichia coli CFT073
gcucuaucugcacugcu

SEQ ID NO: 2662455 - RNA, 21 nt, Escherichia coli CFT073
gcucuaucuuauuuuccuggg

SEQ ID NO: 2662456 - RNA, 22 nt, Escherichia coli CFT073
gcucuauugccguaaucgccuc

SEQ ID NO: 2662457 - RNA, 16 nt, Escherichia coli CFT073
gcucucaaauaucugc

SEQ ID NO: 2662458 - RNA, 22 nt, Escherichia coli CFT073
gcucucacuuauuuguuauuac

SEQ ID NO: 2662459 - RNA, 19 nt, Escherichia coli CFT073
gcucucccaaauaugaaau

SEQ ID NO: 2662460 - RNA, 22 nt, Escherichia coli CFT073
gcucucccauuuuauccucuuc

SEQ ID NO: 2662461 - RNA, 12 nt, Escherichia coli CFT073
gcucucgccagc

SEQ ID NO: 2662462 - RNA, 17 nt, Escherichia coli CFT073
gcucucgcuucugguga

SEQ ID NO: 2662463 - RNA, 14 nt, Escherichia coli CFT073
gcucucuucaucgu

SEQ ID NO: 2662464 - RNA, 21 nt, Escherichia coli CFT073
gcucucuucguggcccgccag

SEQ ID NO: 2662465 - RNA, 23 nt, Escherichia coli CFT073
gcucucuucguggcccgccagca

SEQ ID NO: 2662466 - RNA, 19 nt, Escherichia coli CFT073
gcucucuuucaccagcgcg

SEQ ID NO: 2662467 - RNA, 22 nt, Escherichia coli CFT073
gcucugacugaaccuucacgcu

SEQ ID NO: 2662468 - RNA, 15 nt, Escherichia coli CFT073
gcucugcgcccugca

SEQ ID NO: 2662469 - RNA, 14 nt, Escherichia coli CFT073
gcucuggaugaaau

SEQ ID NO: 2662470 - RNA, 13 nt, Escherichia coli CFT073
gcucuggcagcac

SEQ ID NO: 2662471 - RNA, 14 nt, Escherichia coli CFT073
gcucuggcagcacc

SEQ ID NO: 2662472 - RNA, 12 nt, Escherichia coli CFT073
gcucuggcaggc

SEQ ID NO: 2662473 - RNA, 23 nt, Escherichia coli CFT073
gcucuggcaggcuucaauuuuuu

SEQ ID NO: 2662474 - RNA, 23 nt, Escherichia coli CFT073
gcucuggcggcgcgauauccagu

SEQ ID NO: 2662475 - RNA, 19 nt, Escherichia coli CFT073
gcucugggaucgccggggc

SEQ ID NO: 2662476 - RNA, 23 nt, Escherichia coli CFT073
gcucugguguggagugcagcacu

SEQ ID NO: 2662477 - RNA, 20 nt, Escherichia coli CFT073
gcucugguuccccauucugc

SEQ ID NO: 2662478 - RNA, 18 nt, Escherichia coli CFT073
gcucuguaacccugugga

SEQ ID NO: 2662479 - RNA, 17 nt, Escherichia coli CFT073
gcucuguucugcgccug

SEQ ID NO: 2662480 - RNA, 23 nt, Escherichia coli CFT073
gcucuuauacgugaaauccccug

SEQ ID NO: 2662481 - RNA, 15 nt, Escherichia coli CFT073
gcugccagccaggau

SEQ ID NO: 2662482 - RNA, 20 nt, Escherichia coli CFT073
gcugccagccaggauaugcg

SEQ ID NO: 2662483 - RNA, 12 nt, Escherichia coli CFT073
gcugccagcccc

SEQ ID NO: 2662484 - RNA, 12 nt, Escherichia coli CFT073
gcugccagcggu

SEQ ID NO: 2662485 - RNA, 11 nt, Escherichia coli CFT073
gcugccaggca

SEQ ID NO: 2662486 - RNA, 17 nt, Escherichia coli CFT073
gcugccaggcaccgcgu

SEQ ID NO: 2662487 - RNA, 13 nt, Escherichia coli CFT073
gcugccaguaauu

SEQ ID NO: 2662488 - RNA, 13 nt, Escherichia coli CFT073
gcugccaguuucg

SEQ ID NO: 2662489 - RNA, 14 nt, Escherichia coli CFT073
gcugccaucaucuu

SEQ ID NO: 2662490 - RNA, 14 nt, Escherichia coli CFT073
gcugccaucgacuu

SEQ ID NO: 2662491 - RNA, 23 nt, Escherichia coli CFT073
gcugccaucuuuuggcugauaau

SEQ ID NO: 2662492 - RNA, 22 nt, Escherichia coli CFT073
gcugcccacgcgguauggucac

SEQ ID NO: 2662493 - RNA, 22 nt, Escherichia coli CFT073
gcugccccucaacuugcucaag

SEQ ID NO: 2662494 - RNA, 21 nt, Escherichia coli CFT073
gcugccgccagguuauccaga

SEQ ID NO: 2662495 - RNA, 14 nt, Escherichia coli CFT073
gcugccgcgccaga

SEQ ID NO: 2662496 - RNA, 14 nt, Escherichia coli CFT073
gcugccuacacaau

SEQ ID NO: 2662497 - RNA, 20 nt, Escherichia coli CFT073
gcugccuacacaaugccuga

SEQ ID NO: 2662498 - RNA, 22 nt, Escherichia coli CFT073
gcugccugccaguaaauggcgc

SEQ ID NO: 2662499 - RNA, 15 nt, Escherichia coli CFT073
gcugccuuucgcucc

SEQ ID NO: 2662500 - RNA, 19 nt, Escherichia coli CFT073
gcugccuuuggcgucucca

SEQ ID NO: 2662501 - RNA, 16 nt, Escherichia coli CFT073
gcugcgaaguuuuucc

SEQ ID NO: 2662502 - RNA, 19 nt, Escherichia coli CFT073
gcugcgaaguuuuuccgcc

SEQ ID NO: 2662503 - RNA, 21 nt, Escherichia coli CFT073
gcugcgauaguggaacaaaga

SEQ ID NO: 2662504 - RNA, 19 nt, Escherichia coli CFT073
gcugcgaucgcaaauccac

SEQ ID NO: 2662505 - RNA, 14 nt, Escherichia coli CFT073
gcugcgauucaggg

SEQ ID NO: 2662506 - RNA, 13 nt, Escherichia coli CFT073
gcugcgcagcggu

SEQ ID NO: 2662507 - RNA, 23 nt, Escherichia coli CFT073
gcugcgccaguugcuuauccagc

SEQ ID NO: 2662508 - RNA, 22 nt, Escherichia coli CFT073
gcugcgccauaaccgccagcac

SEQ ID NO: 2662509 - RNA, 17 nt, Escherichia coli CFT073
gcugcgccauauaccgc

SEQ ID NO: 2662510 - RNA, 19 nt, Escherichia coli CFT073
gcugcgcgcuuucuccagc

SEQ ID NO: 2662511 - RNA, 19 nt, Escherichia coli CFT073
gcugcgcuucuuccagcau

SEQ ID NO: 2662512 - RNA, 22 nt, Escherichia coli CFT073
gcugcgcuugaggauguugauc

SEQ ID NO: 2662513 - RNA, 17 nt, Escherichia coli CFT073
gcugcgcuugcggccag

SEQ ID NO: 2662514 - RNA, 15 nt, Escherichia coli CFT073
gcugcgcuugcugcc

SEQ ID NO: 2662515 - RNA, 16 nt, Escherichia coli CFT073
gcugcggauccugagc

SEQ ID NO: 2662516 - RNA, 14 nt, Escherichia coli CFT073
gcugcggccugcug

SEQ ID NO: 2662517 - RNA, 16 nt, Escherichia coli CFT073
gcugcggccugcugca

SEQ ID NO: 2662518 - RNA, 19 nt, Escherichia coli CFT073
gcugcggcguuccccaguu

SEQ ID NO: 2662519 - RNA, 22 nt, Escherichia coli CFT073
gcugcgggcgaucauauccagc

SEQ ID NO: 2662520 - RNA, 14 nt, Escherichia coli CFT073
gcugcgggcggcuc

SEQ ID NO: 2662521 - RNA, 20 nt, Escherichia coli CFT073
gcugcgucgcggccuguucc

SEQ ID NO: 2662522 - RNA, 18 nt, Escherichia coli CFT073
gcugcgucuuccacuuca

SEQ ID NO: 2662523 - RNA, 20 nt, Escherichia coli CFT073
gcugcgucuuccacuucauc

SEQ ID NO: 2662524 - RNA, 13 nt, Escherichia coli CFT073
gcugcgucuuccg

SEQ ID NO: 2662525 - RNA, 17 nt, Escherichia coli CFT073
gcugcgucuuccgcaau

SEQ ID NO: 2662526 - RNA, 15 nt, Escherichia coli CFT073
gcugcguuuuuucac

SEQ ID NO: 2662527 - RNA, 15 nt, Escherichia coli CFT073
gcugcuauggcgcgu

SEQ ID NO: 2662528 - RNA, 15 nt, Escherichia coli CFT073
gcugcucacaccaug

SEQ ID NO: 2662529 - RNA, 19 nt, Escherichia coli CFT073
gcugcucacaccaugccag

SEQ ID NO: 2662530 - RNA, 19 nt, Escherichia coli CFT073
gcugcucaggcgacgcgga

SEQ ID NO: 2662531 - RNA, 22 nt, Escherichia coli CFT073
gcugcuccugcgacugcauuug

SEQ ID NO: 2662532 - RNA, 18 nt, Escherichia coli CFT073
gcugcucggcaauuugug

SEQ ID NO: 2662533 - RNA, 21 nt, Escherichia coli CFT073
gcugcucuucacgcccgcccc

SEQ ID NO: 2662534 - RNA, 13 nt, Escherichia coli CFT073
gcugcugaagcaa

SEQ ID NO: 2662535 - RNA, 22 nt, Escherichia coli CFT073
gcugcugcacauacugcaucag

SEQ ID NO: 2662536 - RNA, 18 nt, Escherichia coli CFT073
gcugcugcguuccggcau

SEQ ID NO: 2662537 - RNA, 24 nt, Escherichia coli CFT073
gcugcugcguuccggcaugauuca

SEQ ID NO: 2662538 - RNA, 11 nt, Escherichia coli CFT073
gcugcuggagc

SEQ ID NO: 2662539 - RNA, 17 nt, Escherichia coli CFT073
gcugcuggagcagguga

SEQ ID NO: 2662540 - RNA, 22 nt, Escherichia coli CFT073
gcugcuguggcgucucgacaaa

SEQ ID NO: 2662541 - RNA, 17 nt, Escherichia coli CFT073
gcugcuguuaccagaca

SEQ ID NO: 2662542 - RNA, 14 nt, Escherichia coli CFT073
gcugcuguuuuuga

SEQ ID NO: 2662543 - RNA, 15 nt, Escherichia coli CFT073
gcugcuucaguaaua

SEQ ID NO: 2662544 - RNA, 17 nt, Escherichia coli CFT073
gcugcuucggucagcac

SEQ ID NO: 2662545 - RNA, 18 nt, Escherichia coli CFT073
gcugcuucggucagcacg

SEQ ID NO: 2662546 - RNA, 19 nt, Escherichia coli CFT073
gcugcuuuaucagaucacg

SEQ ID NO: 2662547 - RNA, 12 nt, Escherichia coli CFT073
gcugcuuucgcc

SEQ ID NO: 2662548 - RNA, 23 nt, Escherichia coli CFT073
gcuggaaaagguaaggauaaaaa

SEQ ID NO: 2662549 - RNA, 20 nt, Escherichia coli CFT073
gcuggaaaggccgcgaacca

SEQ ID NO: 2662550 - RNA, 23 nt, Escherichia coli CFT073
gcuggaaaugaccauaaaaggca

SEQ ID NO: 2662551 - RNA, 14 nt, Escherichia coli CFT073
gcuggaaccacagc

SEQ ID NO: 2662552 - RNA, 18 nt, Escherichia coli CFT073
gcuggaggaacgcgccuc

SEQ ID NO: 2662553 - RNA, 16 nt, Escherichia coli CFT073
gcuggaucccagaaga

SEQ ID NO: 2662554 - RNA, 12 nt, Escherichia coli CFT073
gcuggauggcgc

SEQ ID NO: 2662555 - RNA, 21 nt, Escherichia coli CFT073
gcuggcaaaaaugauagccag

SEQ ID NO: 2662556 - RNA, 19 nt, Escherichia coli CFT073
gcuggcaaaguagagcgaa

SEQ ID NO: 2662557 - RNA, 17 nt, Escherichia coli CFT073
gcuggcaacccagcguu

SEQ ID NO: 2662558 - RNA, 20 nt, Escherichia coli CFT073
gcuggcaagaagaucagcaa

SEQ ID NO: 2662559 - RNA, 14 nt, Escherichia coli CFT073
gcuggcaagauggc

SEQ ID NO: 2662560 - RNA, 20 nt, Escherichia coli CFT073
gcuggcaaguucgucuuccg

SEQ ID NO: 2662561 - RNA, 18 nt, Escherichia coli CFT073
gcuggcaccgugaaagag

SEQ ID NO: 2662562 - RNA, 12 nt, Escherichia coli CFT073
gcuggcagcaga

SEQ ID NO: 2662563 - RNA, 20 nt, Escherichia coli CFT073
gcuggcagcagaaccaggga

SEQ ID NO: 2662564 - RNA, 17 nt, Escherichia coli CFT073
gcuggcagccccguucg

SEQ ID NO: 2662565 - RNA, 19 nt, Escherichia coli CFT073
gcuggcagccccguucgcg

SEQ ID NO: 2662566 - RNA, 13 nt, Escherichia coli CFT073
gcuggcagcugcu

SEQ ID NO: 2662567 - RNA, 22 nt, Escherichia coli CFT073
gcuggcaggccgcguguuuccg

SEQ ID NO: 2662568 - RNA, 13 nt, Escherichia coli CFT073
gcuggcaucgagc

SEQ ID NO: 2662569 - RNA, 20 nt, Escherichia coli CFT073
gcuggcauuacaagaaucau

SEQ ID NO: 2662570 - RNA, 16 nt, Escherichia coli CFT073
gcuggcauugccagaa

SEQ ID NO: 2662571 - RNA, 21 nt, Escherichia coli CFT073
gcuggcauuuuuuauggcuga

SEQ ID NO: 2662572 - RNA, 18 nt, Escherichia coli CFT073
gcuggccgcgucuuaucc

SEQ ID NO: 2662573 - RNA, 13 nt, Escherichia coli CFT073
gcuggccgguuug

SEQ ID NO: 2662574 - RNA, 15 nt, Escherichia coli CFT073
gcuggccuacaauuc

SEQ ID NO: 2662575 - RNA, 14 nt, Escherichia coli CFT073
gcuggccuccagca

SEQ ID NO: 2662576 - RNA, 19 nt, Escherichia coli CFT073
gcuggcgagugcauccagu

SEQ ID NO: 2662577 - RNA, 18 nt, Escherichia coli CFT073
gcuggcgaucguccagcu

SEQ ID NO: 2662578 - RNA, 15 nt, Escherichia coli CFT073
gcuggcgauuccacu

SEQ ID NO: 2662579 - RNA, 17 nt, Escherichia coli CFT073
gcuggcgcgucuuaucc

SEQ ID NO: 2662580 - RNA, 14 nt, Escherichia coli CFT073
gcuggcgcuggcga

SEQ ID NO: 2662581 - RNA, 17 nt, Escherichia coli CFT073
gcuggcggaaacggguu

SEQ ID NO: 2662582 - RNA, 14 nt, Escherichia coli CFT073
gcuggcggcuggca

SEQ ID NO: 2662583 - RNA, 15 nt, Escherichia coli CFT073
gcuggcggcuggcac

SEQ ID NO: 2662584 - RNA, 13 nt, Escherichia coli CFT073
gcuggcgggcugg

SEQ ID NO: 2662585 - RNA, 14 nt, Escherichia coli CFT073
gcuggcgggcuggu

SEQ ID NO: 2662586 - RNA, 16 nt, Escherichia coli CFT073
gcuggcgggcuggugu

SEQ ID NO: 2662587 - RNA, 14 nt, Escherichia coli CFT073
gcuggcggggccgc

SEQ ID NO: 2662588 - RNA, 18 nt, Escherichia coli CFT073
gcuggcggguaauguucg

SEQ ID NO: 2662589 - RNA, 17 nt, Escherichia coli CFT073
gcuggcguaacgacagg

SEQ ID NO: 2662590 - RNA, 18 nt, Escherichia coli CFT073
gcuuacugagauagugau

SEQ ID NO: 2662591 - RNA, 16 nt, Escherichia coli CFT073
gcuuaguaagcccagg

SEQ ID NO: 2662592 - RNA, 19 nt, Escherichia coli CFT073
gcuuauauacucuaaauaa

SEQ ID NO: 2662593 - RNA, 14 nt, Escherichia coli CFT073
gcuuaucaaucucu

SEQ ID NO: 2662594 - RNA, 23 nt, Escherichia coli CFT073
gcuuaucaggccuacaauuucag

SEQ ID NO: 2662595 - RNA, 20 nt, Escherichia coli CFT073
gcuuaucaggccuacaugau

SEQ ID NO: 2662596 - RNA, 17 nt, Escherichia coli CFT073
gcuuaucaggccuacga

SEQ ID NO: 2662597 - RNA, 20 nt, Escherichia coli CFT073
gcuuaucaggccuacgugau

SEQ ID NO: 2662598 - RNA, 19 nt, Escherichia coli CFT073
gcuuaucaggccuacgugu

SEQ ID NO: 2662599 - RNA, 13 nt, Escherichia coli CFT073
gcuuaucagggcc

SEQ ID NO: 2662600 - RNA, 20 nt, Escherichia coli CFT073
gcuuaucgcaggcuuccugg

SEQ ID NO: 2662601 - RNA, 13 nt, Escherichia coli CFT073
gcuuaucgcccug

SEQ ID NO: 2662602 - RNA, 17 nt, Escherichia coli CFT073
gcuuaucgggccuacaa

SEQ ID NO: 2662603 - RNA, 22 nt, Escherichia coli CFT073
gcuuaucuuccguauuugucuc

SEQ ID NO: 2662604 - RNA, 17 nt, Escherichia coli CFT073
gcuuauugccggaugcg

SEQ ID NO: 2662605 - RNA, 22 nt, Escherichia coli CFT073
gcuuauugcuucaagaugccau

SEQ ID NO: 2662606 - RNA, 19 nt, Escherichia coli CFT073
gcuucaaaaagcggguuuu

SEQ ID NO: 2662607 - RNA, 18 nt, Escherichia coli CFT073
gcuucaaaccuucaucca

SEQ ID NO: 2662608 - RNA, 22 nt, Escherichia coli CFT073
gcuucaaacgcugacggugcca

SEQ ID NO: 2662609 - RNA, 17 nt, Escherichia coli CFT073
gcuucaaagacgcuuuc

SEQ ID NO: 2662610 - RNA, 13 nt, Escherichia coli CFT073
gcuucaaaguuug

SEQ ID NO: 2662611 - RNA, 15 nt, Escherichia coli CFT073
gcuucaacacaggcc

SEQ ID NO: 2662612 - RNA, 13 nt, Escherichia coli CFT073
gcuucaaccagug

SEQ ID NO: 2662613 - RNA, 15 nt, Escherichia coli CFT073
gcuucaaccagugca

SEQ ID NO: 2662614 - RNA, 14 nt, Escherichia coli CFT073
gcuucaaccaguuu

SEQ ID NO: 2662615 - RNA, 14 nt, Escherichia coli CFT073
gcuucaagaugcca

SEQ ID NO: 2662616 - RNA, 17 nt, Escherichia coli CFT073
gcuucaagcauugauuu

SEQ ID NO: 2662617 - RNA, 23 nt, Escherichia coli CFT073
gcuucaauacgcucgaacagcug

SEQ ID NO: 2662618 - RNA, 15 nt, Escherichia coli CFT073
gcuucaaucaacaua

SEQ ID NO: 2662619 - RNA, 13 nt, Escherichia coli CFT073
gcuucaaucugau

SEQ ID NO: 2662620 - RNA, 23 nt, Escherichia coli CFT073
gcuucaaucugauauuuagccag

SEQ ID NO: 2662621 - RNA, 20 nt, Escherichia coli CFT073
gcuucacaaaggcuugcugc

SEQ ID NO: 2662622 - RNA, 16 nt, Escherichia coli CFT073
gcuucacgcacugacu

SEQ ID NO: 2662623 - RNA, 20 nt, Escherichia coli CFT073
gcuucacugaaacagauaaa

SEQ ID NO: 2662624 - RNA, 15 nt, Escherichia coli CFT073
gcuucagauuagccg

SEQ ID NO: 2662625 - RNA, 17 nt, Escherichia coli CFT073
gcuucagauuguugaua

SEQ ID NO: 2662626 - RNA, 17 nt, Escherichia coli CFT073
gcuucagcguaucccag

SEQ ID NO: 2662627 - RNA, 18 nt, Escherichia coli CFT073
gcuucagcuaaacagccc

SEQ ID NO: 2662628 - RNA, 23 nt, Escherichia coli CFT073
gcuucaguaauaccgaacgcaga

SEQ ID NO: 2662629 - RNA, 18 nt, Escherichia coli CFT073
gcuucauaggcuuccacu

SEQ ID NO: 2662630 - RNA, 14 nt, Escherichia coli CFT073
gcuucaucuuuauu

SEQ ID NO: 2662631 - RNA, 18 nt, Escherichia coli CFT073
gcuucaugcaucgguuuu

SEQ ID NO: 2662632 - RNA, 18 nt, Escherichia coli CFT073
gcuucauuacgcgcuggg

SEQ ID NO: 2662633 - RNA, 17 nt, Escherichia coli CFT073
gcuucauucacgauuug

SEQ ID NO: 2662634 - RNA, 22 nt, Escherichia coli CFT073
gcuucauuuacaucacgcagcu

SEQ ID NO: 2662635 - RNA, 17 nt, Escherichia coli CFT073
gcuuccagccaugccac

SEQ ID NO: 2662636 - RNA, 21 nt, Escherichia coli CFT073
gcuuccagcgucgcggucaga

SEQ ID NO: 2662637 - RNA, 18 nt, Escherichia coli CFT073
gcuuccaggcaaucagua

SEQ ID NO: 2662638 - RNA, 22 nt, Escherichia coli CFT073
gcuuccaguuccauccaccagc

SEQ ID NO: 2662639 - RNA, 15 nt, Escherichia coli CFT073
gcuuccauugccugc

SEQ ID NO: 2662640 - RNA, 12 nt, Escherichia coli CFT073
gcuucccaacgc

SEQ ID NO: 2662641 - RNA, 18 nt, Escherichia coli CFT073
gcuucccgauaagggagc

SEQ ID NO: 2662642 - RNA, 19 nt, Escherichia coli CFT073
gcuucccgauaagggagca

SEQ ID NO: 2662643 - RNA, 21 nt, Escherichia coli CFT073
gcuucccgauaagggagcagg

SEQ ID NO: 2662644 - RNA, 15 nt, Escherichia coli CFT073
gcuuccggcagcuuc

SEQ ID NO: 2662645 - RNA, 13 nt, Escherichia coli CFT073
gcuuccgggcugc

SEQ ID NO: 2662646 - RNA, 14 nt, Escherichia coli CFT073
gaucggcuggcggc

SEQ ID NO: 2662647 - RNA, 14 nt, Escherichia coli CFT073
gaucggcuucaauc

SEQ ID NO: 2662648 - RNA, 22 nt, Escherichia coli CFT073
gaucggcuucaaucucgcugau

SEQ ID NO: 2662649 - RNA, 15 nt, Escherichia coli CFT073
gaucgggaacagcca

SEQ ID NO: 2662650 - RNA, 14 nt, Escherichia coli CFT073
gaucgggcagugcu

SEQ ID NO: 2662651 - RNA, 18 nt, Escherichia coli CFT073
gaucgggcuuguggcucg

SEQ ID NO: 2662652 - RNA, 20 nt, Escherichia coli CFT073
gaucgguagguccauaaacc

SEQ ID NO: 2662653 - RNA, 14 nt, Escherichia coli CFT073
gaucggucgccuga

SEQ ID NO: 2662654 - RNA, 18 nt, Escherichia coli CFT073
gaucgguuaucuugccga

SEQ ID NO: 2662655 - RNA, 14 nt, Escherichia coli CFT073
gaucgguugccaua

SEQ ID NO: 2662656 - RNA, 14 nt, Escherichia coli CFT073
gaucguacucaauc

SEQ ID NO: 2662657 - RNA, 17 nt, Escherichia coli CFT073
gaucguagccuuguaau

SEQ ID NO: 2662658 - RNA, 15 nt, Escherichia coli CFT073
gaucgucaauaauca

SEQ ID NO: 2662659 - RNA, 13 nt, Escherichia coli CFT073
gaucgucgcucac

SEQ ID NO: 2662660 - RNA, 19 nt, Escherichia coli CFT073
gaucgucuucaaccgcagu

SEQ ID NO: 2662661 - RNA, 12 nt, Escherichia coli CFT073
gaucgugauagc

SEQ ID NO: 2662662 - RNA, 14 nt, Escherichia coli CFT073
gaucgugcucgaca

SEQ ID NO: 2662663 - RNA, 23 nt, Escherichia coli CFT073
gaucguugaccuggaugccugca

SEQ ID NO: 2662664 - RNA, 16 nt, Escherichia coli CFT073
gaucguugagcagcag

SEQ ID NO: 2662665 - RNA, 21 nt, Escherichia coli CFT073
gaucguugagcagcagaugau

SEQ ID NO: 2662666 - RNA, 15 nt, Escherichia coli CFT073
gaucuacagccuuau

SEQ ID NO: 2662667 - RNA, 12 nt, Escherichia coli CFT073
gaucuaccaguu

SEQ ID NO: 2662668 - RNA, 18 nt, Escherichia coli CFT073
gaucuaccaguuccagcg

SEQ ID NO: 2662669 - RNA, 20 nt, Escherichia coli CFT073
gaucuaugucgcauccggca

SEQ ID NO: 2662670 - RNA, 16 nt, Escherichia coli CFT073
gaucucacguccacca

SEQ ID NO: 2662671 - RNA, 22 nt, Escherichia coli CFT073
gaucucacguccaccaaugcca

SEQ ID NO: 2662672 - RNA, 14 nt, Escherichia coli CFT073
gaucucaucuucca

SEQ ID NO: 2662673 - RNA, 12 nt, Escherichia coli CFT073
gaucucuuccac

SEQ ID NO: 2662674 - RNA, 19 nt, Escherichia coli CFT073
gaucugaccuauuucauuc

SEQ ID NO: 2662675 - RNA, 19 nt, Escherichia coli CFT073
gaucugaugaguacgcccu

SEQ ID NO: 2662676 - RNA, 19 nt, Escherichia coli CFT073
gaucugcaaauucaauaaa

SEQ ID NO: 2662677 - RNA, 14 nt, Escherichia coli CFT073
gaucugcacagcau

SEQ ID NO: 2662678 - RNA, 17 nt, Escherichia coli CFT073
gaucugcacagcauuca

SEQ ID NO: 2662679 - RNA, 18 nt, Escherichia coli CFT073
gaucugcacagcauucag

SEQ ID NO: 2662680 - RNA, 17 nt, Escherichia coli CFT073
gaucugccauauccagc

SEQ ID NO: 2662681 - RNA, 20 nt, Escherichia coli CFT073
gaucugcuuguacggaaccg

SEQ ID NO: 2662682 - RNA, 18 nt, Escherichia coli CFT073
gaucuggcgucagcggcu

SEQ ID NO: 2662683 - RNA, 15 nt, Escherichia coli CFT073
gaucuuccagcgcau

SEQ ID NO: 2662684 - RNA, 18 nt, Escherichia coli CFT073
gaucuuccccuuuugccu

SEQ ID NO: 2662685 - RNA, 21 nt, Escherichia coli CFT073
gaucuuccccuuuugccuucu

SEQ ID NO: 2662686 - RNA, 15 nt, Escherichia coli CFT073
gaucuuccgaccgcc

SEQ ID NO: 2662687 - RNA, 22 nt, Escherichia coli CFT073
gaucuucgccaucccggcaacc

SEQ ID NO: 2662688 - RNA, 21 nt, Escherichia coli CFT073
gaucuucgccugaaacagaag

SEQ ID NO: 2662689 - RNA, 22 nt, Escherichia coli CFT073
gaucuucugaccgggauuuuca

SEQ ID NO: 2662690 - RNA, 19 nt, Escherichia coli CFT073
gaucuuuaauguccuuuuc

SEQ ID NO: 2662691 - RNA, 15 nt, Escherichia coli CFT073
gaucuuuaucaagca

SEQ ID NO: 2662692 - RNA, 16 nt, Escherichia coli CFT073
gaucuuuaucaagcac

SEQ ID NO: 2662693 - RNA, 20 nt, Escherichia coli CFT073
gaucuuuaucaaucaccgcu

SEQ ID NO: 2662694 - RNA, 13 nt, Escherichia coli CFT073
gaucuuucacgcc

SEQ ID NO: 2662695 - RNA, 14 nt, Escherichia coli CFT073
gaucuuugcccaua

SEQ ID NO: 2662696 - RNA, 22 nt, Escherichia coli CFT073
gaugaaaaaaccagaaagggaa

SEQ ID NO: 2662697 - RNA, 18 nt, Escherichia coli CFT073
gaugaaaacgccaccaga

SEQ ID NO: 2662698 - RNA, 16 nt, Escherichia coli CFT073
gaugaaacugccggaa

SEQ ID NO: 2662699 - RNA, 19 nt, Escherichia coli CFT073
gaugaaauacuaaauauga

SEQ ID NO: 2662700 - RNA, 21 nt, Escherichia coli CFT073
gaugaaauacuaaauaugaaa

SEQ ID NO: 2662701 - RNA, 15 nt, Escherichia coli CFT073
gaugaagcaacuggu

SEQ ID NO: 2662702 - RNA, 21 nt, Escherichia coli CFT073
gaugaagcgagugcgaaacuu

SEQ ID NO: 2662703 - RNA, 12 nt, Escherichia coli CFT073
gaugaaggugcu

SEQ ID NO: 2662704 - RNA, 17 nt, Escherichia coli CFT073
gaugaagucgaucagac

SEQ ID NO: 2662705 - RNA, 15 nt, Escherichia coli CFT073
gaugaauaacccuaa

SEQ ID NO: 2662706 - RNA, 13 nt, Escherichia coli CFT073
gaugaauaacgcu

SEQ ID NO: 2662707 - RNA, 17 nt, Escherichia coli CFT073
gaugaauaacuccguca

SEQ ID NO: 2662708 - RNA, 20 nt, Escherichia coli CFT073
gaugaauagcauguuccagu

SEQ ID NO: 2662709 - RNA, 20 nt, Escherichia coli CFT073
gaugaauauucucggcugcc

SEQ ID NO: 2662710 - RNA, 13 nt, Escherichia coli CFT073
gaugaaucucaau

SEQ ID NO: 2662711 - RNA, 21 nt, Escherichia coli CFT073
gaugaaugacuguccacgaca

SEQ ID NO: 2662712 - RNA, 12 nt, Escherichia coli CFT073
gaugaaugcaac

SEQ ID NO: 2662713 - RNA, 18 nt, Escherichia coli CFT073
gaugaaugcaacugccca

SEQ ID NO: 2662714 - RNA, 14 nt, Escherichia coli CFT073
gaugacagaaucag

SEQ ID NO: 2662715 - RNA, 23 nt, Escherichia coli CFT073
gaugacauaaccuugcaggccau

SEQ ID NO: 2662716 - RNA, 23 nt, Escherichia coli CFT073
gaugacccagcgcgaucgcgcca

SEQ ID NO: 2662717 - RNA, 24 nt, Escherichia coli CFT073
gaugaccgccacgguaucaagccc

SEQ ID NO: 2662718 - RNA, 13 nt, Escherichia coli CFT073
gaugacgccagcc

SEQ ID NO: 2662719 - RNA, 14 nt, Escherichia coli CFT073
gaugacgcgcucac

SEQ ID NO: 2662720 - RNA, 20 nt, Escherichia coli CFT073
gaugacgcgcucaccgcucu

SEQ ID NO: 2662721 - RNA, 18 nt, Escherichia coli CFT073
gaugacuuucaaagagag

SEQ ID NO: 2662722 - RNA, 21 nt, Escherichia coli CFT073
gaugagaaaagagaugaauga

SEQ ID NO: 2662723 - RNA, 15 nt, Escherichia coli CFT073
gaugagauacauugg

SEQ ID NO: 2662724 - RNA, 12 nt, Escherichia coli CFT073
gaugagcaucgu

SEQ ID NO: 2662725 - RNA, 20 nt, Escherichia coli CFT073
gaugaggcguuaacagcgca

SEQ ID NO: 2662726 - RNA, 22 nt, Escherichia coli CFT073
gaugaguacgcccuguuaccgg

SEQ ID NO: 2662727 - RNA, 14 nt, Escherichia coli CFT073
gaugaguauuucau

SEQ ID NO: 2662728 - RNA, 21 nt, Escherichia coli CFT073
gaugaguauuucauccggcgu

SEQ ID NO: 2662729 - RNA, 22 nt, Escherichia coli CFT073
gaugauaaccccgcaauuucau

SEQ ID NO: 2662730 - RNA, 13 nt, Escherichia coli CFT073
gaugauacuugca

SEQ ID NO: 2662731 - RNA, 19 nt, Escherichia coli CFT073
gaugauauuuuucccugaa

SEQ ID NO: 2662732 - RNA, 14 nt, Escherichia coli CFT073
gaugaucaaaaaaa

SEQ ID NO: 2662733 - RNA, 23 nt, Escherichia coli CFT073
gaugaucaaaaaaaucuucacug

SEQ ID NO: 2662734 - RNA, 20 nt, Escherichia coli CFT073
gaugaucauccggcuuuuuu

SEQ ID NO: 2662735 - RNA, 23 nt, Escherichia coli CFT073
gaugauccacaccggcgcauacu

SEQ ID NO: 2662736 - RNA, 18 nt, Escherichia coli CFT073
gaugaucccuucgcuggc

SEQ ID NO: 2662737 - RNA, 20 nt, Escherichia coli CFT073
gaugaucccuucgcuggcaa

SEQ ID NO: 2662738 - RNA, 15 nt, Escherichia coli CFT073
gaugauccuggauuu

SEQ ID NO: 2662739 - RNA, 21 nt, Escherichia coli CFT073
gaugaucggcguacccagcgu

SEQ ID NO: 2662740 - RNA, 14 nt, Escherichia coli CFT073
gaugaucuaaaagc

SEQ ID NO: 2662741 - RNA, 22 nt, Escherichia coli CFT073
gaugaugccaaaaugcaccgga

SEQ ID NO: 2662742 - RNA, 21 nt, Escherichia coli CFT073
gaugauuaaaucgaagcguac

SEQ ID NO: 2662743 - RNA, 20 nt, Escherichia coli CFT073
gaugauucccagucaggcac

SEQ ID NO: 2662744 - RNA, 19 nt, Escherichia coli CFT073
gaugauugccacaagggca

SEQ ID NO: 2662745 - RNA, 20 nt, Escherichia coli CFT073
gaugauuuccgccagcgggg

SEQ ID NO: 2662746 - RNA, 19 nt, Escherichia coli CFT073
gaugcaaacgauuaucaac

SEQ ID NO: 2662747 - RNA, 14 nt, Escherichia coli CFT073
gaugcaacuguuuu

SEQ ID NO: 2662748 - RNA, 15 nt, Escherichia coli CFT073
gaugcaauuaucauu

SEQ ID NO: 2662749 - RNA, 13 nt, Escherichia coli CFT073
gaugcacagaacc

SEQ ID NO: 2662750 - RNA, 12 nt, Escherichia coli CFT073
gaugcaccugcg

SEQ ID NO: 2662751 - RNA, 24 nt, Escherichia coli CFT073
gaugcaccugcguugccgcaucag

SEQ ID NO: 2662752 - RNA, 16 nt, Escherichia coli CFT073
gaugcagcgcaugacc

SEQ ID NO: 2662753 - RNA, 18 nt, Escherichia coli CFT073
gaugccaccaggcagcac

SEQ ID NO: 2662754 - RNA, 23 nt, Escherichia coli CFT073
gaugccacccauuacacugaaaa

SEQ ID NO: 2662755 - RNA, 18 nt, Escherichia coli CFT073
gaugccagcacucugugc

SEQ ID NO: 2662756 - RNA, 23 nt, Escherichia coli CFT073
gaugccauuuugcaccuucagaa

SEQ ID NO: 2662757 - RNA, 22 nt, Escherichia coli CFT073
gaugccgaagugguuccacgcc

SEQ ID NO: 2662758 - RNA, 17 nt, Escherichia coli CFT073
gaugccgcuuaucccca

SEQ ID NO: 2662759 - RNA, 16 nt, Escherichia coli CFT073
gaugccguuaauaaua

SEQ ID NO: 2662760 - RNA, 18 nt, Escherichia coli CFT073
gaugccguuuacgcaggu

SEQ ID NO: 2662761 - RNA, 11 nt, Escherichia coli CFT073
gaugccugaug

SEQ ID NO: 2662762 - RNA, 22 nt, Escherichia coli CFT073
gaugccuucaguuuccagcaaa

SEQ ID NO: 2662763 - RNA, 17 nt, Escherichia coli CFT073
gaugccuugugggccug

SEQ ID NO: 2662764 - RNA, 23 nt, Escherichia coli CFT073
gaugccuugugggccugaaagcu

SEQ ID NO: 2662765 - RNA, 18 nt, Escherichia coli CFT073
gaugcgaccgccgcucuc

SEQ ID NO: 2662766 - RNA, 17 nt, Escherichia coli CFT073
gaugcgacgcaaacgcc

SEQ ID NO: 2662767 - RNA, 20 nt, Escherichia coli CFT073
gaugcgacgcaaacgccuua

SEQ ID NO: 2662768 - RNA, 19 nt, Escherichia coli CFT073
gaugcgacggcaccacauu

SEQ ID NO: 2662769 - RNA, 22 nt, Escherichia coli CFT073
gaugcgacguuacaaccacaua

SEQ ID NO: 2662770 - RNA, 18 nt, Escherichia coli CFT073
gaugcgacguuuaccgca

SEQ ID NO: 2662771 - RNA, 18 nt, Escherichia coli CFT073
gaugcgaguaaucaggcu

SEQ ID NO: 2662772 - RNA, 21 nt, Escherichia coli CFT073
gaugcgcguacuuaccgcacg

SEQ ID NO: 2662773 - RNA, 17 nt, Escherichia coli CFT073
gaugcggcagucgcgcu

SEQ ID NO: 2662774 - RNA, 20 nt, Escherichia coli CFT073
gaugcggcauaaacgccuua

SEQ ID NO: 2662775 - RNA, 19 nt, Escherichia coli CFT073
gaugcggcaugaacgccug

SEQ ID NO: 2662776 - RNA, 23 nt, Escherichia coli CFT073
gaugcggcaugugaugccgcauc

SEQ ID NO: 2662777 - RNA, 20 nt, Escherichia coli CFT073
gaugcggcgaaaacgccuca

SEQ ID NO: 2662778 - RNA, 20 nt, Escherichia coli CFT073
gaugcggcgauuaauccagu

SEQ ID NO: 2662779 - RNA, 20 nt, Escherichia coli CFT073
gaugcggcgcgagcgccuua

SEQ ID NO: 2662780 - RNA, 15 nt, Escherichia coli CFT073
gaugcggcguaaacg

SEQ ID NO: 2662781 - RNA, 20 nt, Escherichia coli CFT073
gaugcggcguaaacgccuua

SEQ ID NO: 2662782 - RNA, 20 nt, Escherichia coli CFT073
gaugcggcgugaacaccuua

SEQ ID NO: 2662783 - RNA, 20 nt, Escherichia coli CFT073
gaugcggcgugaacgccuuc

SEQ ID NO: 2662784 - RNA, 17 nt, Escherichia coli CFT073
gaugcggcgugauaaaa

SEQ ID NO: 2662785 - RNA, 16 nt, Escherichia coli CFT073
gaugcggggauuuucg

SEQ ID NO: 2662786 - RNA, 19 nt, Escherichia coli CFT073
gaugcgggugaacgcguua

SEQ ID NO: 2662787 - RNA, 18 nt, Escherichia coli CFT073
gaugcggucgcugccgcc

SEQ ID NO: 2662788 - RNA, 20 nt, Escherichia coli CFT073
gaugcggugcgagcgccuua

SEQ ID NO: 2662789 - RNA, 17 nt, Escherichia coli CFT073
gaugcggugcgccacac

SEQ ID NO: 2662790 - RNA, 22 nt, Escherichia coli CFT073
gaugcgguuaacaauacgccca

SEQ ID NO: 2662791 - RNA, 20 nt, Escherichia coli CFT073
gaugcguccgcuaguggcaa

SEQ ID NO: 2662792 - RNA, 17 nt, Escherichia coli CFT073
gaugcgucgcuggcggu

SEQ ID NO: 2662793 - RNA, 16 nt, Escherichia coli CFT073
gaugcgucuucugcag

SEQ ID NO: 2662794 - RNA, 13 nt, Escherichia coli CFT073
gaugcguucaccu

SEQ ID NO: 2662795 - RNA, 15 nt, Escherichia coli CFT073
gaugcguucuucaau

SEQ ID NO: 2662796 - RNA, 18 nt, Escherichia coli CFT073
gaugcuccgccagcgcca

SEQ ID NO: 2662797 - RNA, 19 nt, Escherichia coli CFT073
gaugcucuguguaggccgg

SEQ ID NO: 2662798 - RNA, 20 nt, Escherichia coli CFT073
gaugcucuguguaggccgga

SEQ ID NO: 2662799 - RNA, 18 nt, Escherichia coli CFT073
gaugcugggcgaucggca

SEQ ID NO: 2662800 - RNA, 12 nt, Escherichia coli CFT073
gaugcugugccu

SEQ ID NO: 2662801 - RNA, 22 nt, Escherichia coli CFT073
gaugcugugccuccugcggcuu

SEQ ID NO: 2662802 - RNA, 22 nt, Escherichia coli CFT073
gaugcugugcuccuucucugag

SEQ ID NO: 2662803 - RNA, 16 nt, Escherichia coli CFT073
gaugcuguugcugauu

SEQ ID NO: 2662804 - RNA, 17 nt, Escherichia coli CFT073
gaugcuucagauaccaa

SEQ ID NO: 2662805 - RNA, 22 nt, Escherichia coli CFT073
gauggaacaaaauuuucagcgu

SEQ ID NO: 2662806 - RNA, 15 nt, Escherichia coli CFT073
gauggagauuuuccg

SEQ ID NO: 2662807 - RNA, 17 nt, Escherichia coli CFT073
gauggauccccgcagca

SEQ ID NO: 2662808 - RNA, 22 nt, Escherichia coli CFT073
gauggauguugccaacaaucau

SEQ ID NO: 2662809 - RNA, 17 nt, Escherichia coli CFT073
gauggcaauuuucacug

SEQ ID NO: 2662810 - RNA, 18 nt, Escherichia coli CFT073
gauggcacaugacuucca

SEQ ID NO: 2662811 - RNA, 22 nt, Escherichia coli CFT073
gauggcacaugacuuccaacga

SEQ ID NO: 2662812 - RNA, 15 nt, Escherichia coli CFT073
gauggcagaaaucaa

SEQ ID NO: 2662813 - RNA, 11 nt, Escherichia coli CFT073
gauggcagagu

SEQ ID NO: 2662814 - RNA, 22 nt, Escherichia coli CFT073
gauggcagaguugccauccggc

SEQ ID NO: 2662815 - RNA, 11 nt, Escherichia coli CFT073
gauggcagggc

SEQ ID NO: 2662816 - RNA, 18 nt, Escherichia coli CFT073
gauggccgggugauuuuu

SEQ ID NO: 2662817 - RNA, 21 nt, Escherichia coli CFT073
gauggcgcaaugccauccagc

SEQ ID NO: 2662818 - RNA, 16 nt, Escherichia coli CFT073
gauggcgcgaaacguc

SEQ ID NO: 2662819 - RNA, 19 nt, Escherichia coli CFT073
gauggcggcaguauagcgg

SEQ ID NO: 2662820 - RNA, 14 nt, Escherichia coli CFT073
gauggcgggccugg

SEQ ID NO: 2662821 - RNA, 18 nt, Escherichia coli CFT073
gauggcguaaccaaugcc

SEQ ID NO: 2662822 - RNA, 21 nt, Escherichia coli CFT073
gauggcguaaccaaugccacc

SEQ ID NO: 2662823 - RNA, 23 nt, Escherichia coli CFT073
gauggcuauuacuuuaagccuuc

SEQ ID NO: 2662824 - RNA, 17 nt, Escherichia coli CFT073
gauggcuccgggcaggg

SEQ ID NO: 2662825 - RNA, 13 nt, Escherichia coli CFT073
gauggcucucauc

SEQ ID NO: 2662826 - RNA, 19 nt, Escherichia coli CFT073
gauggcugggguaccugga

SEQ ID NO: 2662827 - RNA, 22 nt, Escherichia coli CFT073
gauggcuguuuucagcaccaga

SEQ ID NO: 2662828 - RNA, 18 nt, Escherichia coli CFT073
gauggcuuuccaccauca

SEQ ID NO: 2662829 - RNA, 20 nt, Escherichia coli CFT073
gauggcuuuccaccugcaac

SEQ ID NO: 2662830 - RNA, 13 nt, Escherichia coli CFT073
gaugggccagcac

SEQ ID NO: 2662831 - RNA, 18 nt, Escherichia coli CFT073
gaugguaaaauaucacuc

SEQ ID NO: 2662832 - RNA, 18 nt, Escherichia coli CFT073
gaugguacuucaaucgcc

SEQ ID NO: 2662833 - RNA, 15 nt, Escherichia coli CFT073
gaugguaugccaucc

SEQ ID NO: 2662834 - RNA, 15 nt, Escherichia coli CFT073
gaugguauucaucgc

SEQ ID NO: 2662835 - RNA, 16 nt, Escherichia coli CFT073
gaugguauucaucgcg

SEQ ID NO: 2662836 - RNA, 19 nt, Escherichia coli CFT073
gauggucgcuugcgggcug

SEQ ID NO: 2662837 - RNA, 21 nt, Escherichia coli CFT073
gauggugaaaaauaaugccac

SEQ ID NO: 2662838 - RNA, 14 nt, Escherichia coli CFT073
gauggugaaguggc

SEQ ID NO: 2662839 - RNA, 18 nt, Escherichia coli CFT073
gauggugcuaauugcacc

SEQ ID NO: 2662840 - RNA, 15 nt, Escherichia coli CFT073
gaugguggucgcauc

SEQ ID NO: 2662841 - RNA, 19 nt, Escherichia coli CFT073
gaugguggucgcaucaucc

SEQ ID NO: 2662842 - RNA, 14 nt, Escherichia coli CFT073
gaugguuggcccga

SEQ ID NO: 2662843 - RNA, 16 nt, Escherichia coli CFT073
gaugguuuugcuuuau

SEQ ID NO: 2662844 - RNA, 19 nt, Escherichia coli CFT073
gauguaacgcagcgucagc

SEQ ID NO: 2662845 - RNA, 23 nt, Escherichia coli CFT073
gauguaaucaacuccgccagcaa

SEQ ID NO: 2662846 - RNA, 18 nt, Escherichia coli CFT073
gauguaauuaagcgcaaa

SEQ ID NO: 2662847 - RNA, 16 nt, Escherichia coli CFT073
gauguaauuaucgcag

SEQ ID NO: 2662848 - RNA, 16 nt, Escherichia coli CFT073
gauguacccgcugcaa

SEQ ID NO: 2662849 - RNA, 14 nt, Escherichia coli CFT073
gauguacuaaccau

SEQ ID NO: 2662850 - RNA, 21 nt, Escherichia coli CFT073
gauguacuucaacauaacgca

SEQ ID NO: 2662851 - RNA, 20 nt, Escherichia coli CFT073
gauguagcgugauuuuugua

SEQ ID NO: 2662852 - RNA, 14 nt, Escherichia coli CFT073
gauguauauuucug

SEQ ID NO: 2662853 - RNA, 13 nt, Escherichia coli CFT073
gauguaucgauau

SEQ ID NO: 2662854 - RNA, 15 nt, Escherichia coli CFT073
gauguaucgcccuua

SEQ ID NO: 2662855 - RNA, 21 nt, Escherichia coli CFT073
gauguauucuuugaucgccgc

SEQ ID NO: 2662856 - RNA, 16 nt, Escherichia coli CFT073
gaugucaaucagggcg

SEQ ID NO: 2662857 - RNA, 12 nt, Escherichia coli CFT073
gaugucgcugca

SEQ ID NO: 2662858 - RNA, 20 nt, Escherichia coli CFT073
gaugucugucagucugcuuu

SEQ ID NO: 2662859 - RNA, 12 nt, Escherichia coli CFT073
gaugugaugcau

SEQ ID NO: 2662860 - RNA, 21 nt, Escherichia coli CFT073
gaugugaugcccggucgcucc

SEQ ID NO: 2662861 - RNA, 11 nt, Escherichia coli CFT073
gaugugccauu

SEQ ID NO: 2662862 - RNA, 20 nt, Escherichia coli CFT073
gaugugcguuggcuucaccu

SEQ ID NO: 2662863 - RNA, 12 nt, Escherichia coli CFT073
gaugugcuccau

SEQ ID NO: 2662864 - RNA, 16 nt, Escherichia coli CFT073
gaugugcuuaucaggg

SEQ ID NO: 2662865 - RNA, 20 nt, Escherichia coli CFT073
gauguggcguaaacgccuua

SEQ ID NO: 2662866 - RNA, 15 nt, Escherichia coli CFT073
gauguuaccaacacu

SEQ ID NO: 2662867 - RNA, 14 nt, Escherichia coli CFT073
gauguucaauaaaa

SEQ ID NO: 2662868 - RNA, 13 nt, Escherichia coli CFT073
gauguuccgccau

SEQ ID NO: 2662869 - RNA, 12 nt, Escherichia coli CFT073
gauguugaagaa

SEQ ID NO: 2662870 - RNA, 20 nt, Escherichia coli CFT073
gauguuggcagcggcaagcu

SEQ ID NO: 2662871 - RNA, 18 nt, Escherichia coli CFT073
gauguuguacaugcugcu

SEQ ID NO: 2662872 - RNA, 13 nt, Escherichia coli CFT073
gauguuugcugcg

SEQ ID NO: 2662873 - RNA, 17 nt, Escherichia coli CFT073
gauguuugcugcggcgc

SEQ ID NO: 2662874 - RNA, 11 nt, Escherichia coli CFT073
gauuaaaauau

SEQ ID NO: 2662875 - RNA, 13 nt, Escherichia coli CFT073
gauuaaaauauaa

SEQ ID NO: 2662876 - RNA, 20 nt, Escherichia coli CFT073
gauuaaacgccauccggcag

SEQ ID NO: 2662877 - RNA, 18 nt, Escherichia coli CFT073
gauuaaacuucaccagca

SEQ ID NO: 2662878 - RNA, 14 nt, Escherichia coli CFT073
gauuaaagcaggua

SEQ ID NO: 2662879 - RNA, 16 nt, Escherichia coli CFT073
gauuaaaucgaagcgu

SEQ ID NO: 2662880 - RNA, 18 nt, Escherichia coli CFT073
gauuaacagcccaugaca

SEQ ID NO: 2662881 - RNA, 14 nt, Escherichia coli CFT073
gauuaacgccagau

SEQ ID NO: 2662882 - RNA, 13 nt, Escherichia coli CFT073
gauuaacuaaaug

SEQ ID NO: 2662883 - RNA, 23 nt, Escherichia coli CFT073
gauuaacucauacaucgcgcuua

SEQ ID NO: 2662884 - RNA, 23 nt, Escherichia coli CFT073
gauuaacugggcgucaaagugaa

SEQ ID NO: 2662885 - RNA, 17 nt, Escherichia coli CFT073
gauuaagauaacguuga

SEQ ID NO: 2662886 - RNA, 18 nt, Escherichia coli CFT073
gauuaauaaaauuaucca

SEQ ID NO: 2662887 - RNA, 21 nt, Escherichia coli CFT073
gauuaauaaaauuauccaacu

SEQ ID NO: 2662888 - RNA, 19 nt, Escherichia coli CFT073
gauuacacaaguccagcac

SEQ ID NO: 2662889 - RNA, 12 nt, Escherichia coli CFT073
gauuacagccag

SEQ ID NO: 2662890 - RNA, 15 nt, Escherichia coli CFT073
gauuacagccaggcg

SEQ ID NO: 2662891 - RNA, 23 nt, Escherichia coli CFT073
gauuacagccaggcgcugcugga

SEQ ID NO: 2662892 - RNA, 16 nt, Escherichia coli CFT073
gauuacaggaacugca

SEQ ID NO: 2662893 - RNA, 14 nt, Escherichia coli CFT073
gauuaccaaaacgg

SEQ ID NO: 2662894 - RNA, 18 nt, Escherichia coli CFT073
gauuaccagagaaaagau

SEQ ID NO: 2662895 - RNA, 14 nt, Escherichia coli CFT073
gauuaccagcauca

SEQ ID NO: 2662896 - RNA, 15 nt, Escherichia coli CFT073
gauuaccagcaucac

SEQ ID NO: 2662897 - RNA, 19 nt, Escherichia coli CFT073
gauuaccauuucacuguca

SEQ ID NO: 2662898 - RNA, 15 nt, Escherichia coli CFT073
gauuaccgccagcaa

SEQ ID NO: 2662899 - RNA, 12 nt, Escherichia coli CFT073
gauuaccgccuu

SEQ ID NO: 2662900 - RNA, 17 nt, Escherichia coli CFT073
gauuaccuaccaacgca

SEQ ID NO: 2662901 - RNA, 18 nt, Escherichia coli CFT073
gauuacgcucaccaaaac

SEQ ID NO: 2662902 - RNA, 11 nt, Escherichia coli CFT073
gauuauccagc

SEQ ID NO: 2662903 - RNA, 17 nt, Escherichia coli CFT073
gauuauccagccaggcg

SEQ ID NO: 2662904 - RNA, 12 nt, Escherichia coli CFT073
gauuaucuucac

SEQ ID NO: 2662905 - RNA, 18 nt, Escherichia coli CFT073
gauuaucuucaccgguag

SEQ ID NO: 2662906 - RNA, 23 nt, Escherichia coli CFT073
gauuaugaaauucagugaacugu

SEQ ID NO: 2662907 - RNA, 14 nt, Escherichia coli CFT073
gauuaugaucgcca

SEQ ID NO: 2662908 - RNA, 15 nt, Escherichia coli CFT073
gauuauucaaaaaca

SEQ ID NO: 2662909 - RNA, 13 nt, Escherichia coli CFT073
gauuauuuauuca

SEQ ID NO: 2662910 - RNA, 13 nt, Escherichia coli CFT073
gauucaaugcaau

SEQ ID NO: 2662911 - RNA, 19 nt, Escherichia coli CFT073
gauucaauuuugcagcauu

SEQ ID NO: 2662912 - RNA, 14 nt, Escherichia coli CFT073
gauucacuuucuga

SEQ ID NO: 2662913 - RNA, 17 nt, Escherichia coli CFT073
gauucagaugccauuuu

SEQ ID NO: 2662914 - RNA, 23 nt, Escherichia coli CFT073
gauucagcgucggugucaucgac

SEQ ID NO: 2662915 - RNA, 12 nt, Escherichia coli CFT073
gauucauacugu

SEQ ID NO: 2662916 - RNA, 15 nt, Escherichia coli CFT073
gauucauccaguucc

SEQ ID NO: 2662917 - RNA, 18 nt, Escherichia coli CFT073
gauucauccaguuccagu

SEQ ID NO: 2662918 - RNA, 13 nt, Escherichia coli CFT073
gauucauccggca

SEQ ID NO: 2662919 - RNA, 18 nt, Escherichia coli CFT073
gauucaucucuucuuccg

SEQ ID NO: 2662920 - RNA, 20 nt, Escherichia coli CFT073
gauucaugauacuccacauc

SEQ ID NO: 2662921 - RNA, 14 nt, Escherichia coli CFT073
gauuccaauauuaa

SEQ ID NO: 2662922 - RNA, 15 nt, Escherichia coli CFT073
gauuccacucauuaa

SEQ ID NO: 2662923 - RNA, 14 nt, Escherichia coli CFT073
gauuccagcauaau

SEQ ID NO: 2662924 - RNA, 13 nt, Escherichia coli CFT073
gauuccaggucaa

SEQ ID NO: 2662925 - RNA, 17 nt, Escherichia coli CFT073
gauuccaguaaguuaug

SEQ ID NO: 2662926 - RNA, 17 nt, Escherichia coli CFT073
gauucccagcaacagca

SEQ ID NO: 2662927 - RNA, 15 nt, Escherichia coli CFT073
gauucccccggugcc

SEQ ID NO: 2662928 - RNA, 10 nt, Escherichia coli CFT073
gauucccugc

SEQ ID NO: 2662929 - RNA, 23 nt, Escherichia coli CFT073
gauuccgccgauggugcagcaga

SEQ ID NO: 2662930 - RNA, 19 nt, Escherichia coli CFT073
gauuccggcaaauaacaga

SEQ ID NO: 2662931 - RNA, 21 nt, Escherichia coli CFT073
gauuccgggccaccaugccca

SEQ ID NO: 2662932 - RNA, 16 nt, Escherichia coli CFT073
gauuccugcgcuucca

SEQ ID NO: 2662933 - RNA, 18 nt, Escherichia coli CFT073
gauuccugcgcuuccagu

SEQ ID NO: 2662934 - RNA, 14 nt, Escherichia coli CFT073
gauuccuuccagua

SEQ ID NO: 2662935 - RNA, 17 nt, Escherichia coli CFT073
gauucgacgcaaacaac

SEQ ID NO: 2662936 - RNA, 16 nt, Escherichia coli CFT073
gauucgccgccgcaua

SEQ ID NO: 2662937 - RNA, 20 nt, Escherichia coli CFT073
gauucgcguugcauaaagcu

SEQ ID NO: 2662938 - RNA, 14 nt, Escherichia coli CFT073
gauucggauccagc

SEQ ID NO: 2662939 - RNA, 16 nt, Escherichia coli CFT073
gauucggcgcaaugau

SEQ ID NO: 2662940 - RNA, 17 nt, Escherichia coli CFT073
gauucgggcuaauuucc

SEQ ID NO: 2662941 - RNA, 12 nt, Escherichia coli CFT073
gauucuucccac

SEQ ID NO: 2662942 - RNA, 21 nt, Escherichia coli CFT073
gauugaaaaacaccucaucgc

SEQ ID NO: 2662943 - RNA, 20 nt, Escherichia coli CFT073
gauugaagcagcgcuggaga

SEQ ID NO: 2662944 - RNA, 14 nt, Escherichia coli CFT073
gauugaccgccagc

SEQ ID NO: 2662945 - RNA, 21 nt, Escherichia coli CFT073
gauugaccgccagcgccaucu

SEQ ID NO: 2662946 - RNA, 15 nt, Escherichia coli CFT073
gauugaguauuaaau

SEQ ID NO: 2662947 - RNA, 11 nt, Escherichia coli CFT073
gauugaugcga

SEQ ID NO: 2662948 - RNA, 20 nt, Escherichia coli CFT073
gauugcacaugcuaaaaauc

SEQ ID NO: 2662949 - RNA, 16 nt, Escherichia coli CFT073
gauugccgcgagaacu

SEQ ID NO: 2662950 - RNA, 11 nt, Escherichia coli CFT073
gauugcugcug

SEQ ID NO: 2662951 - RNA, 13 nt, Escherichia coli CFT073
gauuggcuucacu

SEQ ID NO: 2662952 - RNA, 15 nt, Escherichia coli CFT073
gauuggguuaagccg

SEQ ID NO: 2662953 - RNA, 18 nt, Escherichia coli CFT073
gauugguuucaaccugca

SEQ ID NO: 2662954 - RNA, 17 nt, Escherichia coli CFT073
gauuguacuuuaaaaua

SEQ ID NO: 2662955 - RNA, 14 nt, Escherichia coli CFT073
gauuguagaaaauc

SEQ ID NO: 2662956 - RNA, 15 nt, Escherichia coli CFT073
gauuguaggccggau

SEQ ID NO: 2662957 - RNA, 13 nt, Escherichia coli CFT073
gauugugacaaac

SEQ ID NO: 2662958 - RNA, 18 nt, Escherichia coli CFT073
gauugugugacacuucuu

SEQ ID NO: 2662959 - RNA, 15 nt, Escherichia coli CFT073
gauuguuaaucacau

SEQ ID NO: 2662960 - RNA, 22 nt, Escherichia coli CFT073
gauuguuucuucgauggcuggg

SEQ ID NO: 2662961 - RNA, 18 nt, Escherichia coli CFT073
gauuuaaaaaugccagcc

SEQ ID NO: 2662962 - RNA, 13 nt, Escherichia coli CFT073
gauuuaacagcaa

SEQ ID NO: 2662963 - RNA, 21 nt, Escherichia coli CFT073
gauuuauguaccgucaucgcc

SEQ ID NO: 2662964 - RNA, 17 nt, Escherichia coli CFT073
gauuuauuuuucuggcg

SEQ ID NO: 2662965 - RNA, 21 nt, Escherichia coli CFT073
gauuucaaugcgcaagcugcu

SEQ ID NO: 2662966 - RNA, 17 nt, Escherichia coli CFT073
gauuucacgcucagcaa

SEQ ID NO: 2662967 - RNA, 14 nt, Escherichia coli CFT073
gauuucauccggcu

SEQ ID NO: 2662968 - RNA, 19 nt, Escherichia coli CFT073
gauuucaucgcccaggcaa

SEQ ID NO: 2662969 - RNA, 22 nt, Escherichia coli CFT073
gauuuccggucaacccaaccug

SEQ ID NO: 2662970 - RNA, 15 nt, Escherichia coli CFT073
gauuuccuucagaaa

SEQ ID NO: 2662971 - RNA, 18 nt, Escherichia coli CFT073
gauuucgauccggcacgc

SEQ ID NO: 2662972 - RNA, 19 nt, Escherichia coli CFT073
gauuucgauccggcacgca

SEQ ID NO: 2662973 - RNA, 20 nt, Escherichia coli CFT073
gauuucguugugucgccagc

SEQ ID NO: 2662974 - RNA, 22 nt, Escherichia coli CFT073
gauuucguugugucgccagcaa

SEQ ID NO: 2662975 - RNA, 20 nt, Escherichia coli CFT073
gauuucuacuuauucaccac

SEQ ID NO: 2662976 - RNA, 14 nt, Escherichia coli CFT073
gauuucucuaaaaa

SEQ ID NO: 2662977 - RNA, 19 nt, Escherichia coli CFT073
gauuugcagaucgcggccu

SEQ ID NO: 2662978 - RNA, 15 nt, Escherichia coli CFT073
gauuugcaucaucaa

SEQ ID NO: 2662979 - RNA, 18 nt, Escherichia coli CFT073
gauuugcccaucaggcca

SEQ ID NO: 2662980 - RNA, 22 nt, Escherichia coli CFT073
gauuugcccaucaggccaggcg

SEQ ID NO: 2662981 - RNA, 18 nt, Escherichia coli CFT073
gauuugcguaaaaccugc

SEQ ID NO: 2662982 - RNA, 20 nt, Escherichia coli CFT073
gauuugcguaaaaccugcca

SEQ ID NO: 2662983 - RNA, 13 nt, Escherichia coli CFT073
gauuugcuggaag

SEQ ID NO: 2662984 - RNA, 15 nt, Escherichia coli CFT073
gauuugucugccauu

SEQ ID NO: 2662985 - RNA, 18 nt, Escherichia coli CFT073
gauuuguuucaauuaccg

SEQ ID NO: 2662986 - RNA, 20 nt, Escherichia coli CFT073
gauuuuaacuaucaggucuu

SEQ ID NO: 2662987 - RNA, 13 nt, Escherichia coli CFT073
gauuuuauuucac

SEQ ID NO: 2662988 - RNA, 11 nt, Escherichia coli CFT073
gauuuucaaca

SEQ ID NO: 2662989 - RNA, 15 nt, Escherichia coli CFT073
gauuuucaucuucuu

SEQ ID NO: 2662990 - RNA, 16 nt, Escherichia coli CFT073
gauuuucuucauugcc

SEQ ID NO: 2662991 - RNA, 14 nt, Escherichia coli CFT073
gauuuucuuccagu

SEQ ID NO: 2662992 - RNA, 15 nt, Escherichia coli CFT073
gauuuucuuccagua

SEQ ID NO: 2662993 - RNA, 16 nt, Escherichia coli CFT073
gauuuugccuucauac

SEQ ID NO: 2662994 - RNA, 13 nt, Escherichia coli CFT073
gauuuuucaucac

SEQ ID NO: 2662995 - RNA, 23 nt, Escherichia coli CFT073
gauuuuuccacuccgcuuaccau

SEQ ID NO: 2662996 - RNA, 20 nt, Escherichia coli CFT073
gauuuuuccccacuucaucc

SEQ ID NO: 2662997 - RNA, 19 nt, Escherichia coli CFT073
gauuuuuuccaacaggcga

SEQ ID NO: 2662998 - RNA, 16 nt, Escherichia coli CFT073
gauuuuuuccagcgca

SEQ ID NO: 2662999 - RNA, 16 nt, Escherichia coli CFT073
gcaaaaaaccaucccu

SEQ ID NO: 2663000 - RNA, 15 nt, Escherichia coli CFT073
gcaaaaaagaaggaa

SEQ ID NO: 2663001 - RNA, 21 nt, Escherichia coli CFT073
gcaaaaaaguagcgcagcaga

SEQ ID NO: 2663002 - RNA, 15 nt, Escherichia coli CFT073
gcaaaaaaucaacag

SEQ ID NO: 2663003 - RNA, 22 nt, Escherichia coli CFT073
gcaaaaacggcguguagguucc

SEQ ID NO: 2663004 - RNA, 14 nt, Escherichia coli CFT073
gcaaaaauaaggcg

SEQ ID NO: 2663005 - RNA, 16 nt, Escherichia coli CFT073
gcaaaaauaaggcgga

SEQ ID NO: 2663006 - RNA, 19 nt, Escherichia coli CFT073
gcaaaaaucgacagcagga

SEQ ID NO: 2663007 - RNA, 20 nt, Escherichia coli CFT073
gcaaaaaucgacagcaggau

SEQ ID NO: 2663008 - RNA, 20 nt, Escherichia coli CFT073
gcaaaaauuauucagcguuu

SEQ ID NO: 2663009 - RNA, 13 nt, Escherichia coli CFT073
gcaaaacagguca

SEQ ID NO: 2663010 - RNA, 19 nt, Escherichia coli CFT073
gcaaaaccaucaauccacu

SEQ ID NO: 2663011 - RNA, 18 nt, Escherichia coli CFT073
gcaaaacugccugaugcg

SEQ ID NO: 2663012 - RNA, 14 nt, Escherichia coli CFT073
gcaaaagcaggcac

SEQ ID NO: 2663013 - RNA, 13 nt, Escherichia coli CFT073
gcaaaauacguuu

SEQ ID NO: 2663014 - RNA, 22 nt, Escherichia coli CFT073
gcaaaauagguaucguaauuuu

SEQ ID NO: 2663015 - RNA, 13 nt, Escherichia coli CFT073
gcaaaaucaccau

SEQ ID NO: 2663016 - RNA, 13 nt, Escherichia coli CFT073
gcaaaaucaucac

SEQ ID NO: 2663017 - RNA, 12 nt, Escherichia coli CFT073
gcaaaauccaga

SEQ ID NO: 2663018 - RNA, 21 nt, Escherichia coli CFT073
gcaaaauccagaaaaaaagca

SEQ ID NO: 2663019 - RNA, 18 nt, Escherichia coli CFT073
gcaaaauccuuccagcuc

SEQ ID NO: 2663020 - RNA, 18 nt, Escherichia coli CFT073
gcaaaaucguaagcagga

SEQ ID NO: 2663021 - RNA, 14 nt, Escherichia coli CFT073
gcaaaauggcguuu

SEQ ID NO: 2663022 - RNA, 17 nt, Escherichia coli CFT073
gcaaaauuucguuccca

SEQ ID NO: 2663023 - RNA, 12 nt, Escherichia coli CFT073
gcaaacaacuug

SEQ ID NO: 2663024 - RNA, 16 nt, Escherichia coli CFT073
gcaaacaccagcugaa

SEQ ID NO: 2663025 - RNA, 21 nt, Escherichia coli CFT073
gcaaacacccgacgugcagca

SEQ ID NO: 2663026 - RNA, 12 nt, Escherichia coli CFT073
gcaaacaccgcu

SEQ ID NO: 2663027 - RNA, 16 nt, Escherichia coli CFT073
gcaaacagcacaucuc

SEQ ID NO: 2663028 - RNA, 18 nt, Escherichia coli CFT073
gcaaacaguucugcagcg

SEQ ID NO: 2663029 - RNA, 20 nt, Escherichia coli CFT073
gcaaacaucgacucaagcgu

SEQ ID NO: 2663030 - RNA, 17 nt, Escherichia coli CFT073
gcaaacaucggcuuauu

SEQ ID NO: 2663031 - RNA, 19 nt, Escherichia coli CFT073
gcaaacaucgggauaucgc

SEQ ID NO: 2663032 - RNA, 14 nt, Escherichia coli CFT073
gcaaacaugcagcc

SEQ ID NO: 2663033 - RNA, 19 nt, Escherichia coli CFT073
gcaaaccagacaacaguca

SEQ ID NO: 2663034 - RNA, 15 nt, Escherichia coli CFT073
gcaaaccaggccggu

SEQ ID NO: 2663035 - RNA, 22 nt, Escherichia coli CFT073
gcaaaccaggccgguaacgcuu

SEQ ID NO: 2663036 - RNA, 18 nt, Escherichia coli CFT073
gcaaaccauacucacauc

SEQ ID NO: 2663037 - RNA, 23 nt, Escherichia coli CFT073
gcaaaccauagaauacgccacga

SEQ ID NO: 2663038 - RNA, 15 nt, Escherichia coli CFT073
gcaaaccaugccgga

SEQ ID NO: 2663039 - RNA, 13 nt, Escherichia coli CFT073
gcaaacccacaga

SEQ ID NO: 2663040 - RNA, 14 nt, Escherichia coli CFT073
gcaaacgauaaaag

SEQ ID NO: 2663041 - RNA, 17 nt, Escherichia coli CFT073
gcaaacgauuaucaaca

SEQ ID NO: 2663042 - RNA, 19 nt, Escherichia coli CFT073
gcaaacgauuaucaacaca

SEQ ID NO: 2663043 - RNA, 16 nt, Escherichia coli CFT073
gcaaacgcaaaacugc

SEQ ID NO: 2663044 - RNA, 13 nt, Escherichia coli CFT073
gcaaacgcuggau

SEQ ID NO: 2663045 - RNA, 17 nt, Escherichia coli CFT073
gcaaacggucaaucgca

SEQ ID NO: 2663046 - RNA, 20 nt, Escherichia coli CFT073
gcaaacgguuaugaauaacu

SEQ ID NO: 2663047 - RNA, 18 nt, Escherichia coli CFT073
gcaaacucaucgccgcca

SEQ ID NO: 2663048 - RNA, 21 nt, Escherichia coli CFT073
gcaaacucaucgccgccaaac

SEQ ID NO: 2663049 - RNA, 14 nt, Escherichia coli CFT073
gcaaacugcguaga

SEQ ID NO: 2663050 - RNA, 11 nt, Escherichia coli CFT073
gcaaacugcug

SEQ ID NO: 2663051 - RNA, 23 nt, Escherichia coli CFT073
gcaaacugcugauguuguuucuc

SEQ ID NO: 2663052 - RNA, 12 nt, Escherichia coli CFT073
gcaaacugcugu

SEQ ID NO: 2663053 - RNA, 19 nt, Escherichia coli CFT073
gcaaacugcuguugcugcc

SEQ ID NO: 2663054 - RNA, 18 nt, Escherichia coli CFT073
gcaaacugguugaaauaa

SEQ ID NO: 2663055 - RNA, 20 nt, Escherichia coli CFT073
gcaaacugguugaaauaaac

SEQ ID NO: 2663056 - RNA, 14 nt, Escherichia coli CFT073
gcaaagaaacgcgc

SEQ ID NO: 2663057 - RNA, 17 nt, Escherichia coli CFT073
gcaaagaaaucaacaaa

SEQ ID NO: 2663058 - RNA, 20 nt, Escherichia coli CFT073
gcaaagagagaagccaggua

SEQ ID NO: 2663059 - RNA, 17 nt, Escherichia coli CFT073
gcaaagauuuguugauu

SEQ ID NO: 2663060 - RNA, 21 nt, Escherichia coli CFT073
gcaaagcccaucaccgccagg

SEQ ID NO: 2663061 - RNA, 17 nt, Escherichia coli CFT073
gcaaagcccgggcacau

SEQ ID NO: 2663062 - RNA, 21 nt, Escherichia coli CFT073
gcaaagcgacgugcaguagca

SEQ ID NO: 2663063 - RNA, 14 nt, Escherichia coli CFT073
gcaaagcgcaucag

SEQ ID NO: 2663064 - RNA, 18 nt, Escherichia coli CFT073
gcaaagcguacaaccgcg

SEQ ID NO: 2663065 - RNA, 19 nt, Escherichia coli CFT073
gcaaagcugucaccaauca

SEQ ID NO: 2663066 - RNA, 22 nt, Escherichia coli CFT073
gcaaagcugucaccaaucaggu

SEQ ID NO: 2663067 - RNA, 22 nt, Escherichia coli CFT073
gcaaagcuguuaucgauauaca

SEQ ID NO: 2663068 - RNA, 16 nt, Escherichia coli CFT073
gcaaaggccagcaauc

SEQ ID NO: 2663069 - RNA, 19 nt, Escherichia coli CFT073
gcaaaggccagccaggcac

SEQ ID NO: 2663070 - RNA, 17 nt, Escherichia coli CFT073
gcaaaggcgacaauaaa

SEQ ID NO: 2663071 - RNA, 22 nt, Escherichia coli CFT073
gcaaaggcguuaugcugcggca

SEQ ID NO: 2663072 - RNA, 15 nt, Escherichia coli CFT073
gcaaaguagagcgaa

SEQ ID NO: 2663073 - RNA, 16 nt, Escherichia coli CFT073
gcaaaguagagcgaaa

SEQ ID NO: 2663074 - RNA, 13 nt, Escherichia coli CFT073
gcaaaguaggccg

SEQ ID NO: 2663075 - RNA, 18 nt, Escherichia coli CFT073
gcaaaguggcgcagagcc

SEQ ID NO: 2663076 - RNA, 17 nt, Escherichia coli CFT073
gcaaaguuugugaucuu

SEQ ID NO: 2663077 - RNA, 13 nt, Escherichia coli CFT073
gcaaauaaaacau

SEQ ID NO: 2663078 - RNA, 12 nt, Escherichia coli CFT073
gcaaauaauuca

SEQ ID NO: 2663079 - RNA, 23 nt, Escherichia coli CFT073
gcaaauaauucaucuuucaucug

SEQ ID NO: 2663080 - RNA, 19 nt, Escherichia coli CFT073
gcaaauacccaaaaaauag

SEQ ID NO: 2663081 - RNA, 21 nt, Escherichia coli CFT073
gcaaauacccaaaaaauagca

SEQ ID NO: 2663082 - RNA, 15 nt, Escherichia coli CFT073
gcaaauauugcauug

SEQ ID NO: 2663083 - RNA, 13 nt, Escherichia coli CFT073
gcaaaucaaauca

SEQ ID NO: 2663084 - RNA, 15 nt, Escherichia coli CFT073
gcaaaucaacuaaaa

SEQ ID NO: 2663085 - RNA, 14 nt, Escherichia coli CFT073
gcaaaucagcggca

SEQ ID NO: 2663086 - RNA, 17 nt, Escherichia coli CFT073
gcaaauccacguuccag

SEQ ID NO: 2663087 - RNA, 22 nt, Escherichia coli CFT073
gcaaauccaucauaugcgccag

SEQ ID NO: 2663088 - RNA, 21 nt, Escherichia coli CFT073
gcaaaucgccgagaucaacag

SEQ ID NO: 2663089 - RNA, 14 nt, Escherichia coli CFT073
gcaacuucugucac

SEQ ID NO: 2663090 - RNA, 20 nt, Escherichia coli CFT073
gcaacuugugcucgcguugc

SEQ ID NO: 2663091 - RNA, 21 nt, Escherichia coli CFT073
gcaacuuuacuaaaaagugau

SEQ ID NO: 2663092 - RNA, 22 nt, Escherichia coli CFT073
gcaacuuucgccgguuuuucaa

SEQ ID NO: 2663093 - RNA, 22 nt, Escherichia coli CFT073
gcaacuuuguauucaguucauc

SEQ ID NO: 2663094 - RNA, 22 nt, Escherichia coli CFT073
gcaagaaauaccgaagaguaac

SEQ ID NO: 2663095 - RNA, 17 nt, Escherichia coli CFT073
gcaagaagaucagcaaa

SEQ ID NO: 2663096 - RNA, 21 nt, Escherichia coli CFT073
gcaagaccaacacccacagcc

SEQ ID NO: 2663097 - RNA, 15 nt, Escherichia coli CFT073
gcaagaccgcgacca

SEQ ID NO: 2663098 - RNA, 17 nt, Escherichia coli CFT073
gcaagaccugccgggcu

SEQ ID NO: 2663099 - RNA, 15 nt, Escherichia coli CFT073
gcaagacgaaaaaug

SEQ ID NO: 2663100 - RNA, 17 nt, Escherichia coli CFT073
gcaagacgaaaaaugaa

SEQ ID NO: 2663101 - RNA, 22 nt, Escherichia coli CFT073
gcaagagcaaauaaaacaucac

SEQ ID NO: 2663102 - RNA, 21 nt, Escherichia coli CFT073
gcaagaggguuauuuguucag

SEQ ID NO: 2663103 - RNA, 15 nt, Escherichia coli CFT073
gcaagaguauuacga

SEQ ID NO: 2663104 - RNA, 15 nt, Escherichia coli CFT073
gcaagaguuuuaaaa

SEQ ID NO: 2663105 - RNA, 17 nt, Escherichia coli CFT073
gcaagaucgcgcaucag

SEQ ID NO: 2663106 - RNA, 16 nt, Escherichia coli CFT073
gcaagauuugcaucac

SEQ ID NO: 2663107 - RNA, 11 nt, Escherichia coli CFT073
gcaagcaaauu

SEQ ID NO: 2663108 - RNA, 14 nt, Escherichia coli CFT073
gcaagcagccgaua

SEQ ID NO: 2663109 - RNA, 23 nt, Escherichia coli CFT073
gcaagcagccgauaauauucggc

SEQ ID NO: 2663110 - RNA, 12 nt, Escherichia coli CFT073
gcaagccaacga

SEQ ID NO: 2663111 - RNA, 14 nt, Escherichia coli CFT073
gcaagccaugacgc

SEQ ID NO: 2663112 - RNA, 16 nt, Escherichia coli CFT073
gcaagcccccaguaau

SEQ ID NO: 2663113 - RNA, 16 nt, Escherichia coli CFT073
gcaagccgacaauaaa

SEQ ID NO: 2663114 - RNA, 17 nt, Escherichia coli CFT073
gcaagccgcuaacagca

SEQ ID NO: 2663115 - RNA, 13 nt, Escherichia coli CFT073
gcaagccugaaaa

SEQ ID NO: 2663116 - RNA, 14 nt, Escherichia coli CFT073
gcaagccuugcagc

SEQ ID NO: 2663117 - RNA, 17 nt, Escherichia coli CFT073
gcaagcgucgcaucagg

SEQ ID NO: 2663118 - RNA, 21 nt, Escherichia coli CFT073
gcaagcgucgcgccauuggcc

SEQ ID NO: 2663119 - RNA, 23 nt, Escherichia coli CFT073
gcaagcgucgcgccauuggccug

SEQ ID NO: 2663120 - RNA, 14 nt, Escherichia coli CFT073
gcaagcugaacagg

SEQ ID NO: 2663121 - RNA, 22 nt, Escherichia coli CFT073
gcaagcugugcgauagcaauga

SEQ ID NO: 2663122 - RNA, 22 nt, Escherichia coli CFT073
gcaagcuuaucgggccuacaau

SEQ ID NO: 2663123 - RNA, 19 nt, Escherichia coli CFT073
gcaaggaaaaacuacccgc

SEQ ID NO: 2663124 - RNA, 15 nt, Escherichia coli CFT073
gcaaggagagccagu

SEQ ID NO: 2663125 - RNA, 17 nt, Escherichia coli CFT073
gcaaggcaaucugcucu

SEQ ID NO: 2663126 - RNA, 13 nt, Escherichia coli CFT073
gcaaggccaauac

SEQ ID NO: 2663127 - RNA, 17 nt, Escherichia coli CFT073
gcaagggguucuucggc

SEQ ID NO: 2663128 - RNA, 16 nt, Escherichia coli CFT073
gcaagguagugcuucu

SEQ ID NO: 2663129 - RNA, 20 nt, Escherichia coli CFT073
gcaagguaguuaaucaguac

SEQ ID NO: 2663130 - RNA, 23 nt, Escherichia coli CFT073
gcaaggugagcguggcuggcuga

SEQ ID NO: 2663131 - RNA, 19 nt, Escherichia coli CFT073
gcaaguaauuguuucaucg

SEQ ID NO: 2663132 - RNA, 13 nt, Escherichia coli CFT073
gcaaguacuuuug

SEQ ID NO: 2663133 - RNA, 16 nt, Escherichia coli CFT073
gcaaguaguggaugaa

SEQ ID NO: 2663134 - RNA, 15 nt, Escherichia coli CFT073
gcaagucuugcugcg

SEQ ID NO: 2663135 - RNA, 22 nt, Escherichia coli CFT073
gcaaguggaaauccccaucagg

SEQ ID NO: 2663136 - RNA, 13 nt, Escherichia coli CFT073
gcaaguucccgga

SEQ ID NO: 2663137 - RNA, 20 nt, Escherichia coli CFT073
gcaaguucggcggcgugccu

SEQ ID NO: 2663138 - RNA, 19 nt, Escherichia coli CFT073
gcaaguuucgugcuuagau

SEQ ID NO: 2663139 - RNA, 15 nt, Escherichia coli CFT073
gcaauaaaacagggc

SEQ ID NO: 2663140 - RNA, 11 nt, Escherichia coli CFT073
gcaauaaacaa

SEQ ID NO: 2663141 - RNA, 12 nt, Escherichia coli CFT073
gcaauaaacagc

SEQ ID NO: 2663142 - RNA, 14 nt, Escherichia coli CFT073
gcaauaaacauccu

SEQ ID NO: 2663143 - RNA, 17 nt, Escherichia coli CFT073
gcaauaaccaucagcuc

SEQ ID NO: 2663144 - RNA, 15 nt, Escherichia coli CFT073
gcaauaaccguaacg

SEQ ID NO: 2663145 - RNA, 21 nt, Escherichia coli CFT073
gcaauaacgaagucguuagua

SEQ ID NO: 2663146 - RNA, 12 nt, Escherichia coli CFT073
gcaauaauaaua

SEQ ID NO: 2663147 - RNA, 19 nt, Escherichia coli CFT073
gcaauaauaucccaacgca

SEQ ID NO: 2663148 - RNA, 14 nt, Escherichia coli CFT073
gcaauaaucucaau

SEQ ID NO: 2663149 - RNA, 19 nt, Escherichia coli CFT073
gcaauaaucuuuacaccaa

SEQ ID NO: 2663150 - RNA, 19 nt, Escherichia coli CFT073
gcaauacccugacccagac

SEQ ID NO: 2663151 - RNA, 23 nt, Escherichia coli CFT073
gcaauacccugacccagaccgau

SEQ ID NO: 2663152 - RNA, 14 nt, Escherichia coli CFT073
gcaauacguuucau

SEQ ID NO: 2663153 - RNA, 15 nt, Escherichia coli CFT073
gcaauagcaaagccu

SEQ ID NO: 2663154 - RNA, 13 nt, Escherichia coli CFT073
gcaauagccgcca

SEQ ID NO: 2663155 - RNA, 19 nt, Escherichia coli CFT073
gcaauagcggauacuacca

SEQ ID NO: 2663156 - RNA, 21 nt, Escherichia coli CFT073
gcaauauagcgcauggcagcc

SEQ ID NO: 2663157 - RNA, 20 nt, Escherichia coli CFT073
gcaauauauugaauuagcaa

SEQ ID NO: 2663158 - RNA, 21 nt, Escherichia coli CFT073
gcaauauauugaauuagcaag

SEQ ID NO: 2663159 - RNA, 13 nt, Escherichia coli CFT073
gcaauaucaacaa

SEQ ID NO: 2663160 - RNA, 17 nt, Escherichia coli CFT073
gcaauaugcggugccau

SEQ ID NO: 2663161 - RNA, 19 nt, Escherichia coli CFT073
gcaauaugguuauuaccaa

SEQ ID NO: 2663162 - RNA, 20 nt, Escherichia coli CFT073
gcaauaugguuauuaccaaa

SEQ ID NO: 2663163 - RNA, 22 nt, Escherichia coli CFT073
gcaauauguugauaaucaacag

SEQ ID NO: 2663164 - RNA, 21 nt, Escherichia coli CFT073
gcaauauuacuucagacgguc

SEQ ID NO: 2663165 - RNA, 16 nt, Escherichia coli CFT073
gcaauauucuuuugca

SEQ ID NO: 2663166 - RNA, 18 nt, Escherichia coli CFT073
gcaauauucuuuugcagc

SEQ ID NO: 2663167 - RNA, 17 nt, Escherichia coli CFT073
gcaaucaaauggcuggc

SEQ ID NO: 2663168 - RNA, 11 nt, Escherichia coli CFT073
gcaaucaaauu

SEQ ID NO: 2663169 - RNA, 17 nt, Escherichia coli CFT073
gcaaucaaauuugccag

SEQ ID NO: 2663170 - RNA, 20 nt, Escherichia coli CFT073
gcaaucaaauuugccagcga

SEQ ID NO: 2663171 - RNA, 11 nt, Escherichia coli CFT073
gcaaucaacag

SEQ ID NO: 2663172 - RNA, 12 nt, Escherichia coli CFT073
gcaaucaacaua

SEQ ID NO: 2663173 - RNA, 16 nt, Escherichia coli CFT073
gcaaucaacgccugau

SEQ ID NO: 2663174 - RNA, 21 nt, Escherichia coli CFT073
gcaaucacauccaccagcgcc

SEQ ID NO: 2663175 - RNA, 23 nt, Escherichia coli CFT073
gcaaucacauccaccagcgccuc

SEQ ID NO: 2663176 - RNA, 18 nt, Escherichia coli CFT073
gcaaucaccuuacaucaa

SEQ ID NO: 2663177 - RNA, 17 nt, Escherichia coli CFT073
gcaaucacgcccgccag

SEQ ID NO: 2663178 - RNA, 18 nt, Escherichia coli CFT073
gcaaucacgcccgccaga

SEQ ID NO: 2663179 - RNA, 20 nt, Escherichia coli CFT073
gcaaucacugccaccaggaa

SEQ ID NO: 2663180 - RNA, 20 nt, Escherichia coli CFT073
gcaaucacugccagaauagc

SEQ ID NO: 2663181 - RNA, 23 nt, Escherichia coli CFT073
gcaaucacugccagaauagccgc

SEQ ID NO: 2663182 - RNA, 11 nt, Escherichia coli CFT073
gcaaucagcgg

SEQ ID NO: 2663183 - RNA, 13 nt, Escherichia coli CFT073
gcaaucagcguuu

SEQ ID NO: 2663184 - RNA, 14 nt, Escherichia coli CFT073
gcaaucagcguuuc

SEQ ID NO: 2663185 - RNA, 18 nt, Escherichia coli CFT073
gcaaucaggucuuucagg

SEQ ID NO: 2663186 - RNA, 16 nt, Escherichia coli CFT073
gcaaucaguacguuau

SEQ ID NO: 2663187 - RNA, 23 nt, Escherichia coli CFT073
gcaaucaguacguuaucaccgau

SEQ ID NO: 2663188 - RNA, 16 nt, Escherichia coli CFT073
gcaaucaucguacugu

SEQ ID NO: 2663189 - RNA, 19 nt, Escherichia coli CFT073
gcaaucauuuuuuccccuu

SEQ ID NO: 2663190 - RNA, 13 nt, Escherichia coli CFT073
gcaauccacaagc

SEQ ID NO: 2663191 - RNA, 19 nt, Escherichia coli CFT073
gcaauccagcuaaccaucc

SEQ ID NO: 2663192 - RNA, 14 nt, Escherichia coli CFT073
gcaauccaguccac

SEQ ID NO: 2663193 - RNA, 15 nt, Escherichia coli CFT073
gcaauccauaccagc

SEQ ID NO: 2663194 - RNA, 20 nt, Escherichia coli CFT073
gcaauccgugcaaaugccag

SEQ ID NO: 2663195 - RNA, 23 nt, Escherichia coli CFT073
gcaauccugcuuuuuuccagcca

SEQ ID NO: 2663196 - RNA, 21 nt, Escherichia coli CFT073
gcaaucgaauccggauuguau

SEQ ID NO: 2663197 - RNA, 19 nt, Escherichia coli CFT073
gcacagacuccgguuuuug

SEQ ID NO: 2663198 - RNA, 21 nt, Escherichia coli CFT073
gcacagacuuaauauugccgu

SEQ ID NO: 2663199 - RNA, 15 nt, Escherichia coli CFT073
gcacagagauaaaag

SEQ ID NO: 2663200 - RNA, 14 nt, Escherichia coli CFT073
gcacagaucgcacu

SEQ ID NO: 2663201 - RNA, 12 nt, Escherichia coli CFT073
gcacagcauccg

SEQ ID NO: 2663202 - RNA, 15 nt, Escherichia coli CFT073
gcacagccagcgcag

SEQ ID NO: 2663203 - RNA, 19 nt, Escherichia coli CFT073
gcacagccagcgcaggcag

SEQ ID NO: 2663204 - RNA, 16 nt, Escherichia coli CFT073
gcacagcccgccgcca

SEQ ID NO: 2663205 - RNA, 23 nt, Escherichia coli CFT073
gcacagcccgccgccauccugaa

SEQ ID NO: 2663206 - RNA, 13 nt, Escherichia coli CFT073
gcacagccgcauu

SEQ ID NO: 2663207 - RNA, 16 nt, Escherichia coli CFT073
gcacagccgcauuuug

SEQ ID NO: 2663208 - RNA, 18 nt, Escherichia coli CFT073
gcacagcuacgcaucaug

SEQ ID NO: 2663209 - RNA, 19 nt, Escherichia coli CFT073
gcacagcuacgcaucaugc

SEQ ID NO: 2663210 - RNA, 16 nt, Escherichia coli CFT073
gcacaggcaauccagc

SEQ ID NO: 2663211 - RNA, 22 nt, Escherichia coli CFT073
gcacaggcaauccagcucggcg

SEQ ID NO: 2663212 - RNA, 20 nt, Escherichia coli CFT073
gcacagggggauucaccaug

SEQ ID NO: 2663213 - RNA, 21 nt, Escherichia coli CFT073
gcacagggggauucaccaugc

SEQ ID NO: 2663214 - RNA, 23 nt, Escherichia coli CFT073
gcacagggggauucaccaugcca

SEQ ID NO: 2663215 - RNA, 15 nt, Escherichia coli CFT073
gcacagguggcaaac

SEQ ID NO: 2663216 - RNA, 16 nt, Escherichia coli CFT073
gcacagguugcacgga

SEQ ID NO: 2663217 - RNA, 18 nt, Escherichia coli CFT073
gcacagucgcgacgcuga

SEQ ID NO: 2663218 - RNA, 13 nt, Escherichia coli CFT073
gcacaguggucaa

SEQ ID NO: 2663219 - RNA, 17 nt, Escherichia coli CFT073
gcacaguguuuguugaa

SEQ ID NO: 2663220 - RNA, 11 nt, Escherichia coli CFT073
gcacauaaaau

SEQ ID NO: 2663221 - RNA, 15 nt, Escherichia coli CFT073
gcacauaacucauac

SEQ ID NO: 2663222 - RNA, 20 nt, Escherichia coli CFT073
gcacauaauugagcagcaaa

SEQ ID NO: 2663223 - RNA, 19 nt, Escherichia coli CFT073
gcacauacugcaucagcgc

SEQ ID NO: 2663224 - RNA, 14 nt, Escherichia coli CFT073
gcacauacuggaca

SEQ ID NO: 2663225 - RNA, 18 nt, Escherichia coli CFT073
gcacaucgcugugcugcu

SEQ ID NO: 2663226 - RNA, 14 nt, Escherichia coli CFT073
gcacaucuagccug

SEQ ID NO: 2663227 - RNA, 20 nt, Escherichia coli CFT073
gcacaucucaaaucuucuca

SEQ ID NO: 2663228 - RNA, 13 nt, Escherichia coli CFT073
gcacaucucccac

SEQ ID NO: 2663229 - RNA, 19 nt, Escherichia coli CFT073
gcacaugacuuccaacgaa

SEQ ID NO: 2663230 - RNA, 17 nt, Escherichia coli CFT073
gcacaugaugauggcua

SEQ ID NO: 2663231 - RNA, 13 nt, Escherichia coli CFT073
gcacaugcaacuu

SEQ ID NO: 2663232 - RNA, 13 nt, Escherichia coli CFT073
gcacauuaaaaug

SEQ ID NO: 2663233 - RNA, 14 nt, Escherichia coli CFT073
gcacauuagcgacc

SEQ ID NO: 2663234 - RNA, 16 nt, Escherichia coli CFT073
gcacauuccagaugcg

SEQ ID NO: 2663235 - RNA, 21 nt, Escherichia coli CFT073
gcacauuccagaugcgccagu

SEQ ID NO: 2663236 - RNA, 12 nt, Escherichia coli CFT073
gcacauugccgu

SEQ ID NO: 2663237 - RNA, 13 nt, Escherichia coli CFT073
gcacauuguccgc

SEQ ID NO: 2663238 - RNA, 14 nt, Escherichia coli CFT073
gcacauuguccgcu

SEQ ID NO: 2663239 - RNA, 12 nt, Escherichia coli CFT073
gcaccaaacggg

SEQ ID NO: 2663240 - RNA, 17 nt, Escherichia coli CFT073
gcaccaaacgggcaagc

SEQ ID NO: 2663241 - RNA, 20 nt, Escherichia coli CFT073
gcaccaaaguuaaucagcgc

SEQ ID NO: 2663242 - RNA, 11 nt, Escherichia coli CFT073
gcaccaacaaa

SEQ ID NO: 2663243 - RNA, 16 nt, Escherichia coli CFT073
gcaccaacaucaugcc

SEQ ID NO: 2663244 - RNA, 22 nt, Escherichia coli CFT073
gcaccaacccuaacccaacauu

SEQ ID NO: 2663245 - RNA, 14 nt, Escherichia coli CFT073
gcaccaaguucuuc

SEQ ID NO: 2663246 - RNA, 17 nt, Escherichia coli CFT073
gcaccaaguucuucacu

SEQ ID NO: 2663247 - RNA, 20 nt, Escherichia coli CFT073
gcaccaaguucuucacugac

SEQ ID NO: 2663248 - RNA, 16 nt, Escherichia coli CFT073
gcaccaauauugacug

SEQ ID NO: 2663249 - RNA, 12 nt, Escherichia coli CFT073
gcaccaaucacc

SEQ ID NO: 2663250 - RNA, 23 nt, Escherichia coli CFT073
gcaccacacgacgcgccagcagc

SEQ ID NO: 2663251 - RNA, 20 nt, Escherichia coli CFT073
gcaccacauaagaucaucgg

SEQ ID NO: 2663252 - RNA, 17 nt, Escherichia coli CFT073
gcaccacauucugcauu

SEQ ID NO: 2663253 - RNA, 20 nt, Escherichia coli CFT073
gcaccacauucugcauugcg

SEQ ID NO: 2663254 - RNA, 14 nt, Escherichia coli CFT073
gcaccaccagcagc

SEQ ID NO: 2663255 - RNA, 15 nt, Escherichia coli CFT073
gcaccaccagcagcu

SEQ ID NO: 2663256 - RNA, 14 nt, Escherichia coli CFT073
gcaccaccgcccgu

SEQ ID NO: 2663257 - RNA, 19 nt, Escherichia coli CFT073
gcaccacgcagaaaaaucc

SEQ ID NO: 2663258 - RNA, 22 nt, Escherichia coli CFT073
gcaccacgcagaaaaaucccuc

SEQ ID NO: 2663259 - RNA, 18 nt, Escherichia coli CFT073
gcaccacgguuuuuugca

SEQ ID NO: 2663260 - RNA, 15 nt, Escherichia coli CFT073
gcaccacuacagcgg

SEQ ID NO: 2663261 - RNA, 15 nt, Escherichia coli CFT073
gcaccacuguuuuuc

SEQ ID NO: 2663262 - RNA, 15 nt, Escherichia coli CFT073
gcaccacuuccggca

SEQ ID NO: 2663263 - RNA, 16 nt, Escherichia coli CFT073
gcaccagaacucccug

SEQ ID NO: 2663264 - RNA, 22 nt, Escherichia coli CFT073
gcaccagaauaccuugcugcuc

SEQ ID NO: 2663265 - RNA, 12 nt, Escherichia coli CFT073
gcaccagcaccg

SEQ ID NO: 2663266 - RNA, 10 nt, Escherichia coli CFT073
gcaccagcag

SEQ ID NO: 2663267 - RNA, 19 nt, Escherichia coli CFT073
gcaccagccccuggaaaaa

SEQ ID NO: 2663268 - RNA, 16 nt, Escherichia coli CFT073
gcaccagcccgacgau

SEQ ID NO: 2663269 - RNA, 16 nt, Escherichia coli CFT073
gcaccagcggaaugca

SEQ ID NO: 2663270 - RNA, 16 nt, Escherichia coli CFT073
gcaccaggccgcgcag

SEQ ID NO: 2663271 - RNA, 21 nt, Escherichia coli CFT073
gcaccaguaaaccaauuucug

SEQ ID NO: 2663272 - RNA, 16 nt, Escherichia coli CFT073
gcaccaguaauacggc

SEQ ID NO: 2663273 - RNA, 15 nt, Escherichia coli CFT073
gcaccaguucgccgu

SEQ ID NO: 2663274 - RNA, 21 nt, Escherichia coli CFT073
gcaccaguucgccguacugac

SEQ ID NO: 2663275 - RNA, 14 nt, Escherichia coli CFT073
gcaccaguucgccu

SEQ ID NO: 2663276 - RNA, 17 nt, Escherichia coli CFT073
gcaccauccgcccacac

SEQ ID NO: 2663277 - RNA, 11 nt, Escherichia coli CFT073
gcaccauucca

SEQ ID NO: 2663278 - RNA, 12 nt, Escherichia coli CFT073
gcacccagcaau

SEQ ID NO: 2663279 - RNA, 18 nt, Escherichia coli CFT073
gcacccagcaauccugca

SEQ ID NO: 2663280 - RNA, 18 nt, Escherichia coli CFT073
gcacccaguacgggcagc

SEQ ID NO: 2663281 - RNA, 20 nt, Escherichia coli CFT073
gcacccauuuauccagcggc

SEQ ID NO: 2663282 - RNA, 15 nt, Escherichia coli CFT073
gcaccccacaaacag

SEQ ID NO: 2663283 - RNA, 18 nt, Escherichia coli CFT073
gcaccccacaaacagaau

SEQ ID NO: 2663284 - RNA, 16 nt, Escherichia coli CFT073
gcacccgaugcggcag

SEQ ID NO: 2663285 - RNA, 15 nt, Escherichia coli CFT073
gcacccgccagcgcg

SEQ ID NO: 2663286 - RNA, 14 nt, Escherichia coli CFT073
gcacccgccgcuau

SEQ ID NO: 2663287 - RNA, 13 nt, Escherichia coli CFT073
gcacccgcgccga

SEQ ID NO: 2663288 - RNA, 15 nt, Escherichia coli CFT073
gcacccgcggcugca

SEQ ID NO: 2663289 - RNA, 13 nt, Escherichia coli CFT073
gcacccggcacua

SEQ ID NO: 2663290 - RNA, 16 nt, Escherichia coli CFT073
gcaccgacaauccagu

SEQ ID NO: 2663291 - RNA, 17 nt, Escherichia coli CFT073
gcaccgaccaucggcac

SEQ ID NO: 2663292 - RNA, 18 nt, Escherichia coli CFT073
gcaccgaggaugaauaac

SEQ ID NO: 2663293 - RNA, 17 nt, Escherichia coli CFT073
gcaccgaggccaaaacc

SEQ ID NO: 2663294 - RNA, 20 nt, Escherichia coli CFT073
gcaccgaggccaaaaccaca

SEQ ID NO: 2663295 - RNA, 13 nt, Escherichia coli CFT073
gcaccgcagagau

SEQ ID NO: 2663296 - RNA, 19 nt, Escherichia coli CFT073
gcaccgcagagaucgcccc

SEQ ID NO: 2663297 - RNA, 15 nt, Escherichia coli CFT073
gcaccgcauccggca

SEQ ID NO: 2663298 - RNA, 13 nt, Escherichia coli CFT073
gcaccgcauguug

SEQ ID NO: 2663299 - RNA, 16 nt, Escherichia coli CFT073
gcaccgccaaccagcg

SEQ ID NO: 2663300 - RNA, 14 nt, Escherichia coli CFT073
gcaccgccagcagc

SEQ ID NO: 2663301 - RNA, 15 nt, Escherichia coli CFT073
gcaccgccagcagca

SEQ ID NO: 2663302 - RNA, 17 nt, Escherichia coli CFT073
gcaccgccagcaggaac

SEQ ID NO: 2663303 - RNA, 14 nt, Escherichia coli CFT073
gcaccgccgccagg

SEQ ID NO: 2663304 - RNA, 18 nt, Escherichia coli CFT073
gcaccgccuccagcgaca

SEQ ID NO: 2663305 - RNA, 18 nt, Escherichia coli CFT073
gcaccgccucgcggaucu

SEQ ID NO: 2663306 - RNA, 19 nt, Escherichia coli CFT073
gcaccgcgccacuggcgga

SEQ ID NO: 2663307 - RNA, 17 nt, Escherichia coli CFT073
gcacuucagggcgcacg

SEQ ID NO: 2663308 - RNA, 14 nt, Escherichia coli CFT073
gcacuuccagcggc

SEQ ID NO: 2663309 - RNA, 11 nt, Escherichia coli CFT073
gcacuuccuga

SEQ ID NO: 2663310 - RNA, 12 nt, Escherichia coli CFT073
gcacuucgcugg

SEQ ID NO: 2663311 - RNA, 15 nt, Escherichia coli CFT073
gcacuucgcuggugu

SEQ ID NO: 2663312 - RNA, 10 nt, Escherichia coli CFT073
gcacuucuga

SEQ ID NO: 2663313 - RNA, 17 nt, Escherichia coli CFT073
gcacuuguuuaugccag

SEQ ID NO: 2663314 - RNA, 22 nt, Escherichia coli CFT073
gcacuuuaucgaucacauccag

SEQ ID NO: 2663315 - RNA, 22 nt, Escherichia coli CFT073
gcacuuucucgacauccaugca

SEQ ID NO: 2663316 - RNA, 13 nt, Escherichia coli CFT073
gcacuuugcuggu

SEQ ID NO: 2663317 - RNA, 16 nt, Escherichia coli CFT073
gcacuuuucccacuaa

SEQ ID NO: 2663318 - RNA, 16 nt, Escherichia coli CFT073
gcacuuuucgcacugc

SEQ ID NO: 2663319 - RNA, 21 nt, Escherichia coli CFT073
gcagaaacaaccucuuuuuuc

SEQ ID NO: 2663320 - RNA, 12 nt, Escherichia coli CFT073
gcagaaaccagg

SEQ ID NO: 2663321 - RNA, 22 nt, Escherichia coli CFT073
gcagaaaccaggucaaugcaac

SEQ ID NO: 2663322 - RNA, 15 nt, Escherichia coli CFT073
gcagaaacgacacca

SEQ ID NO: 2663323 - RNA, 15 nt, Escherichia coli CFT073
gcagaaagcgacuuu

SEQ ID NO: 2663324 - RNA, 14 nt, Escherichia coli CFT073
gcagaaaggaucac

SEQ ID NO: 2663325 - RNA, 13 nt, Escherichia coli CFT073
gcagaaauacccc

SEQ ID NO: 2663326 - RNA, 22 nt, Escherichia coli CFT073
gcagaaauaccccgccagcaga

SEQ ID NO: 2663327 - RNA, 13 nt, Escherichia coli CFT073
gcagaacauccag

SEQ ID NO: 2663328 - RNA, 17 nt, Escherichia coli CFT073
gcagaacauccagcucg

SEQ ID NO: 2663329 - RNA, 21 nt, Escherichia coli CFT073
gcagaacauccagcucgcguu

SEQ ID NO: 2663330 - RNA, 17 nt, Escherichia coli CFT073
gcagaacgaccagcgcc

SEQ ID NO: 2663331 - RNA, 12 nt, Escherichia coli CFT073
gcagaacgcgug

SEQ ID NO: 2663332 - RNA, 18 nt, Escherichia coli CFT073
gcagaacguccgcaggau

SEQ ID NO: 2663333 - RNA, 13 nt, Escherichia coli CFT073
gcagaagcccagu

SEQ ID NO: 2663334 - RNA, 16 nt, Escherichia coli CFT073
gcagaauaacggcuga

SEQ ID NO: 2663335 - RNA, 20 nt, Escherichia coli CFT073
gcagaauccggcgcucauca

SEQ ID NO: 2663336 - RNA, 23 nt, Escherichia coli CFT073
gcagaauccggcgcucaucaggc

SEQ ID NO: 2663337 - RNA, 22 nt, Escherichia coli CFT073
gcagaaugaaugauacagaaag

SEQ ID NO: 2663338 - RNA, 15 nt, Escherichia coli CFT073
gcagacaaaauccug

SEQ ID NO: 2663339 - RNA, 17 nt, Escherichia coli CFT073
gcagacagccuaccaga

SEQ ID NO: 2663340 - RNA, 16 nt, Escherichia coli CFT073
gcagacagcgccaggc

SEQ ID NO: 2663341 - RNA, 13 nt, Escherichia coli CFT073
gcagaccagagcu

SEQ ID NO: 2663342 - RNA, 15 nt, Escherichia coli CFT073
gcagaccaucgucag

SEQ ID NO: 2663343 - RNA, 17 nt, Escherichia coli CFT073
gcagaccaucgucagua

SEQ ID NO: 2663344 - RNA, 20 nt, Escherichia coli CFT073
gcagacccgccaccggcuuu

SEQ ID NO: 2663345 - RNA, 22 nt, Escherichia coli CFT073
gcagaccgugaagguaccgcaa

SEQ ID NO: 2663346 - RNA, 17 nt, Escherichia coli CFT073
gcagaccuucugccaga

SEQ ID NO: 2663347 - RNA, 18 nt, Escherichia coli CFT073
gcagacgaugaugcagau

SEQ ID NO: 2663348 - RNA, 19 nt, Escherichia coli CFT073
gcagacgcauacugauuac

SEQ ID NO: 2663349 - RNA, 18 nt, Escherichia coli CFT073
gcagacguuaaugccgga

SEQ ID NO: 2663350 - RNA, 23 nt, Escherichia coli CFT073
gcagacguuuuuucugccccagu

SEQ ID NO: 2663351 - RNA, 15 nt, Escherichia coli CFT073
gcagacuguaaaucu

SEQ ID NO: 2663352 - RNA, 23 nt, Escherichia coli CFT073
gcagacuguaaaucugccgucau

SEQ ID NO: 2663353 - RNA, 21 nt, Escherichia coli CFT073
gcagacugugccguggcgcuc

SEQ ID NO: 2663354 - RNA, 21 nt, Escherichia coli CFT073
gcagacuuuuugcggcagcaa

SEQ ID NO: 2663355 - RNA, 23 nt, Escherichia coli CFT073
gcagagaaaaugccgcacaucac

SEQ ID NO: 2663356 - RNA, 19 nt, Escherichia coli CFT073
gcagagaaacgccagcagc

SEQ ID NO: 2663357 - RNA, 20 nt, Escherichia coli CFT073
gcagagaaacgccagcagca

SEQ ID NO: 2663358 - RNA, 21 nt, Escherichia coli CFT073
gcagagaaacgccagcagcag

SEQ ID NO: 2663359 - RNA, 16 nt, Escherichia coli CFT073
gcagagauacaggcca

SEQ ID NO: 2663360 - RNA, 17 nt, Escherichia coli CFT073
gcagagauacaggccac

SEQ ID NO: 2663361 - RNA, 19 nt, Escherichia coli CFT073
gcagagauagaacugcauu

SEQ ID NO: 2663362 - RNA, 22 nt, Escherichia coli CFT073
gcagagcaaaaaucgacagcag

SEQ ID NO: 2663363 - RNA, 20 nt, Escherichia coli CFT073
gcagagcaucauuuucagcu

SEQ ID NO: 2663364 - RNA, 15 nt, Escherichia coli CFT073
gcagagcauccagca

SEQ ID NO: 2663365 - RNA, 17 nt, Escherichia coli CFT073
gcagagcauccagcagc

SEQ ID NO: 2663366 - RNA, 18 nt, Escherichia coli CFT073
gcagagcauccagcagcc

SEQ ID NO: 2663367 - RNA, 20 nt, Escherichia coli CFT073
gcagagcauccuuguacucu

SEQ ID NO: 2663368 - RNA, 19 nt, Escherichia coli CFT073
gcagagcauucccgccauc

SEQ ID NO: 2663369 - RNA, 14 nt, Escherichia coli CFT073
gcagagccugaaua

SEQ ID NO: 2663370 - RNA, 18 nt, Escherichia coli CFT073
gcagagcgcgaaaccuua

SEQ ID NO: 2663371 - RNA, 17 nt, Escherichia coli CFT073
gcagaguaaaccgccug

SEQ ID NO: 2663372 - RNA, 16 nt, Escherichia coli CFT073
gcagagucuccgguuu

SEQ ID NO: 2663373 - RNA, 23 nt, Escherichia coli CFT073
gcagagucuccgguuucccggca

SEQ ID NO: 2663374 - RNA, 14 nt, Escherichia coli CFT073
gcagagugcgcagc

SEQ ID NO: 2663375 - RNA, 16 nt, Escherichia coli CFT073
gcagaguuuccaggcu

SEQ ID NO: 2663376 - RNA, 19 nt, Escherichia coli CFT073
gcagauaaacaaccccauc

SEQ ID NO: 2663377 - RNA, 14 nt, Escherichia coli CFT073
gcagauaacccagc

SEQ ID NO: 2663378 - RNA, 15 nt, Escherichia coli CFT073
gcagauaacccagca

SEQ ID NO: 2663379 - RNA, 15 nt, Escherichia coli CFT073
gcagauaacuggcca

SEQ ID NO: 2663380 - RNA, 16 nt, Escherichia coli CFT073
gcagauaacuuaguua

SEQ ID NO: 2663381 - RNA, 20 nt, Escherichia coli CFT073
gcagauaagaccaauccagc

SEQ ID NO: 2663382 - RNA, 15 nt, Escherichia coli CFT073
gcagauaauagucag

SEQ ID NO: 2663383 - RNA, 18 nt, Escherichia coli CFT073
gcagauacauugccacca

SEQ ID NO: 2663384 - RNA, 15 nt, Escherichia coli CFT073
gcagauaccacauca

SEQ ID NO: 2663385 - RNA, 21 nt, Escherichia coli CFT073
gcagauaccacaucaacccgc

SEQ ID NO: 2663386 - RNA, 23 nt, Escherichia coli CFT073
gcagauacugaugaacgcgcaga

SEQ ID NO: 2663387 - RNA, 17 nt, Escherichia coli CFT073
gcagauaucccgccagc

SEQ ID NO: 2663388 - RNA, 23 nt, Escherichia coli CFT073
gcagauaucccgccagcaccagc

SEQ ID NO: 2663389 - RNA, 14 nt, Escherichia coli CFT073
gcagauauugcacc

SEQ ID NO: 2663390 - RNA, 16 nt, Escherichia coli CFT073
gcagaucaaauucaau

SEQ ID NO: 2663391 - RNA, 12 nt, Escherichia coli CFT073
gcagaucaccaa

SEQ ID NO: 2663392 - RNA, 16 nt, Escherichia coli CFT073
gcagauccaucgccug

SEQ ID NO: 2663393 - RNA, 20 nt, Escherichia coli CFT073
gcagauccauugcgaauaag

SEQ ID NO: 2663394 - RNA, 16 nt, Escherichia coli CFT073
gcagaucccacucauc

SEQ ID NO: 2663395 - RNA, 21 nt, Escherichia coli CFT073
gcagaucccacucaucaagca

SEQ ID NO: 2663396 - RNA, 15 nt, Escherichia coli CFT073
gcagaucugcgccau

SEQ ID NO: 2663397 - RNA, 14 nt, Escherichia coli CFT073
gcagaugcucuuca

SEQ ID NO: 2663398 - RNA, 20 nt, Escherichia coli CFT073
gcagaugcucuucaaaacga

SEQ ID NO: 2663399 - RNA, 13 nt, Escherichia coli CFT073
gcagauuugccag

SEQ ID NO: 2663400 - RNA, 19 nt, Escherichia coli CFT073
gcagauuugccaguaccga

SEQ ID NO: 2663401 - RNA, 17 nt, Escherichia coli CFT073
gcagauuuuuauuaaua

SEQ ID NO: 2663402 - RNA, 15 nt, Escherichia coli CFT073
gcagcaaaagcaggc

SEQ ID NO: 2663403 - RNA, 18 nt, Escherichia coli CFT073
gcagcaaaagcaggcacc

SEQ ID NO: 2663404 - RNA, 17 nt, Escherichia coli CFT073
gcagcaaacgguuauga

SEQ ID NO: 2663405 - RNA, 22 nt, Escherichia coli CFT073
gcagcaaagcccgggcacauca

SEQ ID NO: 2663406 - RNA, 23 nt, Escherichia coli CFT073
gcagcaaaucguaggaguaauca

SEQ ID NO: 2663407 - RNA, 11 nt, Escherichia coli CFT073
gcagcaacgaa

SEQ ID NO: 2663408 - RNA, 21 nt, Escherichia coli CFT073
gcagcaaggcuauucagcagu

SEQ ID NO: 2663409 - RNA, 13 nt, Escherichia coli CFT073
gcagcaaguauuc

SEQ ID NO: 2663410 - RNA, 20 nt, Escherichia coli CFT073
gcagcaaguauucacucugc

SEQ ID NO: 2663411 - RNA, 16 nt, Escherichia coli CFT073
gcagcaagugcggcgc

SEQ ID NO: 2663412 - RNA, 22 nt, Escherichia coli CFT073
gcagcaagugcggcgcaccagc

SEQ ID NO: 2663413 - RNA, 18 nt, Escherichia coli CFT073
gcagcaauagcaaagccu

SEQ ID NO: 2663414 - RNA, 16 nt, Escherichia coli CFT073
gcagcaaucacugcca

SEQ ID NO: 2663415 - RNA, 13 nt, Escherichia coli CFT073
gcagcuucacgcc

SEQ ID NO: 2663416 - RNA, 17 nt, Escherichia coli CFT073
gcagcuuccggccagca

SEQ ID NO: 2663417 - RNA, 20 nt, Escherichia coli CFT073
gcagcuucuucuccagcugc

SEQ ID NO: 2663418 - RNA, 21 nt, Escherichia coli CFT073
gcagcuucuucuccagcugcg

SEQ ID NO: 2663419 - RNA, 16 nt, Escherichia coli CFT073
gcagcuugagaaaauc

SEQ ID NO: 2663420 - RNA, 16 nt, Escherichia coli CFT073
gcagcuugcgccgccc

SEQ ID NO: 2663421 - RNA, 14 nt, Escherichia coli CFT073
gcagcuuugugcuu

SEQ ID NO: 2663422 - RNA, 16 nt, Escherichia coli CFT073
gcagcuuugugcuuca

SEQ ID NO: 2663423 - RNA, 18 nt, Escherichia coli CFT073
gcagcuuugugcuucagu

SEQ ID NO: 2663424 - RNA, 12 nt, Escherichia coli CFT073
gcaggaaaauca

SEQ ID NO: 2663425 - RNA, 23 nt, Escherichia coli CFT073
gcaggaaaucaaugccaccagaa

SEQ ID NO: 2663426 - RNA, 22 nt, Escherichia coli CFT073
gcaggaacaaugccucgcuaau

SEQ ID NO: 2663427 - RNA, 13 nt, Escherichia coli CFT073
gcaggaacagaau

SEQ ID NO: 2663428 - RNA, 23 nt, Escherichia coli CFT073
gcaggaacgagaacucggaagca

SEQ ID NO: 2663429 - RNA, 19 nt, Escherichia coli CFT073
gcaggaagggauuaugcag

SEQ ID NO: 2663430 - RNA, 20 nt, Escherichia coli CFT073
gcaggaauagauuaugaaau

SEQ ID NO: 2663431 - RNA, 18 nt, Escherichia coli CFT073
gcaggaaucccaucagac

SEQ ID NO: 2663432 - RNA, 19 nt, Escherichia coli CFT073
gcaggacgcucccucaaua

SEQ ID NO: 2663433 - RNA, 20 nt, Escherichia coli CFT073
gcaggacguuggcgauugca

SEQ ID NO: 2663434 - RNA, 13 nt, Escherichia coli CFT073
gcaggagagaucg

SEQ ID NO: 2663435 - RNA, 21 nt, Escherichia coli CFT073
gcaggagcgauuaugaaacaa

SEQ ID NO: 2663436 - RNA, 12 nt, Escherichia coli CFT073
gcaggagcggcg

SEQ ID NO: 2663437 - RNA, 20 nt, Escherichia coli CFT073
gcaggagcgguguaggccug

SEQ ID NO: 2663438 - RNA, 21 nt, Escherichia coli CFT073
gcaggaugacauaaccuugca

SEQ ID NO: 2663439 - RNA, 14 nt, Escherichia coli CFT073
gcaggaugagcgcg

SEQ ID NO: 2663440 - RNA, 15 nt, Escherichia coli CFT073
gcaggaugagcgcga

SEQ ID NO: 2663441 - RNA, 15 nt, Escherichia coli CFT073
gcaggaugccugaug

SEQ ID NO: 2663442 - RNA, 22 nt, Escherichia coli CFT073
gcaggaugcgacauaaacguau

SEQ ID NO: 2663443 - RNA, 18 nt, Escherichia coli CFT073
gcaggauuugcgguagcg

SEQ ID NO: 2663444 - RNA, 16 nt, Escherichia coli CFT073
gcaggauuuucuuuaa

SEQ ID NO: 2663445 - RNA, 17 nt, Escherichia coli CFT073
gcaggcaaaguaggccg

SEQ ID NO: 2663446 - RNA, 20 nt, Escherichia coli CFT073
gcaggcaaaucgcucccucu

SEQ ID NO: 2663447 - RNA, 23 nt, Escherichia coli CFT073
gcaggcaaccguucgggaaaaua

SEQ ID NO: 2663448 - RNA, 23 nt, Escherichia coli CFT073
gcaggcaauagucguauuaucgc

SEQ ID NO: 2663449 - RNA, 12 nt, Escherichia coli CFT073
gcaggcaguaaa

SEQ ID NO: 2663450 - RNA, 16 nt, Escherichia coli CFT073
gcaggcaucaucagau

SEQ ID NO: 2663451 - RNA, 22 nt, Escherichia coli CFT073
gcaggcaucaucagauucugcg

SEQ ID NO: 2663452 - RNA, 18 nt, Escherichia coli CFT073
gcaggccacgaaucagca

SEQ ID NO: 2663453 - RNA, 17 nt, Escherichia coli CFT073
gcaggccaggguaaaaa

SEQ ID NO: 2663454 - RNA, 19 nt, Escherichia coli CFT073
gcaggccauaugacaccaa

SEQ ID NO: 2663455 - RNA, 16 nt, Escherichia coli CFT073
gcaggccccgucagca

SEQ ID NO: 2663456 - RNA, 17 nt, Escherichia coli CFT073
gcaggccccgucagcaa

SEQ ID NO: 2663457 - RNA, 12 nt, Escherichia coli CFT073
gcaggccugaua

SEQ ID NO: 2663458 - RNA, 21 nt, Escherichia coli CFT073
gcaggcgagcugccaguugcg

SEQ ID NO: 2663459 - RNA, 20 nt, Escherichia coli CFT073
gcaggcgcucaccauuuccg

SEQ ID NO: 2663460 - RNA, 19 nt, Escherichia coli CFT073
gcaggcgcuuaucguccca

SEQ ID NO: 2663461 - RNA, 22 nt, Escherichia coli CFT073
gcaggcggcuucgcaucccggu

SEQ ID NO: 2663462 - RNA, 16 nt, Escherichia coli CFT073
gcaggcgucgcaucag

SEQ ID NO: 2663463 - RNA, 15 nt, Escherichia coli CFT073
gcaggcuauuucugg

SEQ ID NO: 2663464 - RNA, 22 nt, Escherichia coli CFT073
gcaggcugauggagauuuuccg

SEQ ID NO: 2663465 - RNA, 15 nt, Escherichia coli CFT073
gcaggcuggugguga

SEQ ID NO: 2663466 - RNA, 22 nt, Escherichia coli CFT073
gcaggcugguggugaugguauu

SEQ ID NO: 2663467 - RNA, 19 nt, Escherichia coli CFT073
gcagggaaagaaacgccau

SEQ ID NO: 2663468 - RNA, 15 nt, Escherichia coli CFT073
gcagggcaaacagca

SEQ ID NO: 2663469 - RNA, 16 nt, Escherichia coli CFT073
gcagggcaaacagcac

SEQ ID NO: 2663470 - RNA, 13 nt, Escherichia coli CFT073
gcagggcaucaag

SEQ ID NO: 2663471 - RNA, 14 nt, Escherichia coli CFT073
gcagggcauccaga

SEQ ID NO: 2663472 - RNA, 20 nt, Escherichia coli CFT073
gcagggcgaaacgaggaaga

SEQ ID NO: 2663473 - RNA, 19 nt, Escherichia coli CFT073
gcaggguauugcgcgccgc

SEQ ID NO: 2663474 - RNA, 19 nt, Escherichia coli CFT073
gcaggguggugacaccaug

SEQ ID NO: 2663475 - RNA, 20 nt, Escherichia coli CFT073
gcaggguuugcaucgccaug

SEQ ID NO: 2663476 - RNA, 18 nt, Escherichia coli CFT073
gcagguaaaacggcagaa

SEQ ID NO: 2663477 - RNA, 20 nt, Escherichia coli CFT073
gcagguaagaguuucaacau

SEQ ID NO: 2663478 - RNA, 15 nt, Escherichia coli CFT073
gcagguacgguacug

SEQ ID NO: 2663479 - RNA, 18 nt, Escherichia coli CFT073
gcagguacgguacugaaa

SEQ ID NO: 2663480 - RNA, 16 nt, Escherichia coli CFT073
gcagguagcagcagcg

SEQ ID NO: 2663481 - RNA, 14 nt, Escherichia coli CFT073
gcagguagcgccuu

SEQ ID NO: 2663482 - RNA, 22 nt, Escherichia coli CFT073
gcagguagcgccuuuacugaca

SEQ ID NO: 2663483 - RNA, 17 nt, Escherichia coli CFT073
gcagguaguuaucugcc

SEQ ID NO: 2663484 - RNA, 19 nt, Escherichia coli CFT073
gcaggucaucgugcgucag

SEQ ID NO: 2663485 - RNA, 18 nt, Escherichia coli CFT073
gcagguccacgaccagcg

SEQ ID NO: 2663486 - RNA, 24 nt, Escherichia coli CFT073
gcaggucggauaagacgcgccagc

SEQ ID NO: 2663487 - RNA, 18 nt, Escherichia coli CFT073
gcagguggguucugcggc

SEQ ID NO: 2663488 - RNA, 20 nt, Escherichia coli CFT073
gcagguucucaauuaccguu

SEQ ID NO: 2663489 - RNA, 23 nt, Escherichia coli CFT073
gcagguugaaguugaugaagcuu

SEQ ID NO: 2663490 - RNA, 22 nt, Escherichia coli CFT073
gcagguuuuccaguuuauggaa

SEQ ID NO: 2663491 - RNA, 14 nt, Escherichia coli CFT073
gcaguaaaccaccc

SEQ ID NO: 2663492 - RNA, 16 nt, Escherichia coli CFT073
gcaguaaaccacccac

SEQ ID NO: 2663493 - RNA, 19 nt, Escherichia coli CFT073
gcaguaaaccacccaccag

SEQ ID NO: 2663494 - RNA, 21 nt, Escherichia coli CFT073
gcaguaaaccacccaccagcg

SEQ ID NO: 2663495 - RNA, 13 nt, Escherichia coli CFT073
gcaguaaacgcca

SEQ ID NO: 2663496 - RNA, 13 nt, Escherichia coli CFT073
gcaguaaagugau

SEQ ID NO: 2663497 - RNA, 12 nt, Escherichia coli CFT073
gcaguaaaucgu

SEQ ID NO: 2663498 - RNA, 23 nt, Escherichia coli CFT073
gcaguaacguuaguucgcguagc

SEQ ID NO: 2663499 - RNA, 18 nt, Escherichia coli CFT073
gcaguaaggaaauguucc

SEQ ID NO: 2663500 - RNA, 16 nt, Escherichia coli CFT073
gcaguaauauggcgac

SEQ ID NO: 2663501 - RNA, 13 nt, Escherichia coli CFT073
gcaguaauccagc

SEQ ID NO: 2663502 - RNA, 13 nt, Escherichia coli CFT073
gcaguaaugguuu

SEQ ID NO: 2663503 - RNA, 22 nt, Escherichia coli CFT073
gcaguaaugguuuuauugcccu

SEQ ID NO: 2663504 - RNA, 12 nt, Escherichia coli CFT073
gcaguaccagau

SEQ ID NO: 2663505 - RNA, 19 nt, Escherichia coli CFT073
gcaguacgucgagcaguug

SEQ ID NO: 2663506 - RNA, 20 nt, Escherichia coli CFT073
gcaguagcgucgccagcagu

SEQ ID NO: 2663507 - RNA, 22 nt, Escherichia coli CFT073
gcaguauugauagauuucucua

SEQ ID NO: 2663508 - RNA, 16 nt, Escherichia coli CFT073
gcagucaccagcauca

SEQ ID NO: 2663509 - RNA, 13 nt, Escherichia coli CFT073
gcagucagccagc

SEQ ID NO: 2663510 - RNA, 17 nt, Escherichia coli CFT073
gcagucgugcccaacug

SEQ ID NO: 2663511 - RNA, 15 nt, Escherichia coli CFT073
gcagugaaauuucug

SEQ ID NO: 2663512 - RNA, 19 nt, Escherichia coli CFT073
gcagugaaguaauaaucaa

SEQ ID NO: 2663513 - RNA, 14 nt, Escherichia coli CFT073
gcagugaauuucua

SEQ ID NO: 2663514 - RNA, 17 nt, Escherichia coli CFT073
gcagugauuuauuuuua

SEQ ID NO: 2663515 - RNA, 22 nt, Escherichia coli CFT073
gcagugauuuauuuuuacucuu

SEQ ID NO: 2663516 - RNA, 14 nt, Escherichia coli CFT073
gcagugccauccca

SEQ ID NO: 2663517 - RNA, 20 nt, Escherichia coli CFT073
gcagugccugccaugccaaa

SEQ ID NO: 2663518 - RNA, 23 nt, Escherichia coli CFT073
gcagugccugccaugccaaacag

SEQ ID NO: 2663519 - RNA, 20 nt, Escherichia coli CFT073
gcagugcgcgauaaucucau

SEQ ID NO: 2663520 - RNA, 16 nt, Escherichia coli CFT073
gcagugcugcauccug

SEQ ID NO: 2663521 - RNA, 16 nt, Escherichia coli CFT073
gcagugcuuucauuuc

SEQ ID NO: 2663522 - RNA, 17 nt, Escherichia coli CFT073
gcaguggaauauaauuu

SEQ ID NO: 2663523 - RNA, 22 nt, Escherichia coli CFT073
gcaucaggcauuauggcgcagu

SEQ ID NO: 2663524 - RNA, 20 nt, Escherichia coli CFT073
gcaucaggcauuuaucgccu

SEQ ID NO: 2663525 - RNA, 22 nt, Escherichia coli CFT073
gcaucaggcuagaugugccaau

SEQ ID NO: 2663526 - RNA, 14 nt, Escherichia coli CFT073
gcaucagucacgac

SEQ ID NO: 2663527 - RNA, 20 nt, Escherichia coli CFT073
gcaucagucucaaaccggcu

SEQ ID NO: 2663528 - RNA, 20 nt, Escherichia coli CFT073
gcaucauaaauagagacgac

SEQ ID NO: 2663529 - RNA, 15 nt, Escherichia coli CFT073
gcaucauaugcgcca

SEQ ID NO: 2663530 - RNA, 16 nt, Escherichia coli CFT073
gcaucauaugcgccag

SEQ ID NO: 2663531 - RNA, 22 nt, Escherichia coli CFT073
gcaucauccgucggcuucacgc

SEQ ID NO: 2663532 - RNA, 12 nt, Escherichia coli CFT073
gcaucaucgaca

SEQ ID NO: 2663533 - RNA, 20 nt, Escherichia coli CFT073
gcaucaucgagaucgacacc

SEQ ID NO: 2663534 - RNA, 16 nt, Escherichia coli CFT073
gcaucauguaaaucaa

SEQ ID NO: 2663535 - RNA, 15 nt, Escherichia coli CFT073
gcauccacaacccgu

SEQ ID NO: 2663536 - RNA, 13 nt, Escherichia coli CFT073
gcauccagauucu

SEQ ID NO: 2663537 - RNA, 13 nt, Escherichia coli CFT073
gcauccagcagcc

SEQ ID NO: 2663538 - RNA, 19 nt, Escherichia coli CFT073
gcauccagccaacguuucu

SEQ ID NO: 2663539 - RNA, 22 nt, Escherichia coli CFT073
gcauccagcguguucgugacga

SEQ ID NO: 2663540 - RNA, 13 nt, Escherichia coli CFT073
gcauccagcguuc

SEQ ID NO: 2663541 - RNA, 21 nt, Escherichia coli CFT073
gcauccaggccaaaagcuaac

SEQ ID NO: 2663542 - RNA, 20 nt, Escherichia coli CFT073
gcauccauaucgccauugcu

SEQ ID NO: 2663543 - RNA, 21 nt, Escherichia coli CFT073
gcauccauaucgccauugcug

SEQ ID NO: 2663544 - RNA, 13 nt, Escherichia coli CFT073
gcaucccaggcau

SEQ ID NO: 2663545 - RNA, 14 nt, Escherichia coli CFT073
gcauccccagcgca

SEQ ID NO: 2663546 - RNA, 16 nt, Escherichia coli CFT073
gcauccccugccccau

SEQ ID NO: 2663547 - RNA, 21 nt, Escherichia coli CFT073
gcaucccgguaucaaagcgcc

SEQ ID NO: 2663548 - RNA, 22 nt, Escherichia coli CFT073
gcaucccgguaucaaagcgcca

SEQ ID NO: 2663549 - RNA, 16 nt, Escherichia coli CFT073
gcauccgaaaaccgau

SEQ ID NO: 2663550 - RNA, 17 nt, Escherichia coli CFT073
gcauccgccacuuuaug

SEQ ID NO: 2663551 - RNA, 15 nt, Escherichia coli CFT073
gcauccgccagcagc

SEQ ID NO: 2663552 - RNA, 14 nt, Escherichia coli CFT073
gcauccgcugaugc

SEQ ID NO: 2663553 - RNA, 16 nt, Escherichia coli CFT073
gcauccggcaaaaaaa

SEQ ID NO: 2663554 - RNA, 22 nt, Escherichia coli CFT073
gcauccggcaagaaaaugagca

SEQ ID NO: 2663555 - RNA, 17 nt, Escherichia coli CFT073
gcauccggcaaucaacg

SEQ ID NO: 2663556 - RNA, 20 nt, Escherichia coli CFT073
gcauccggcaaucaacgccu

SEQ ID NO: 2663557 - RNA, 19 nt, Escherichia coli CFT073
gcauccggcaauccgugca

SEQ ID NO: 2663558 - RNA, 20 nt, Escherichia coli CFT073
gcauccggcaguauuaccag

SEQ ID NO: 2663559 - RNA, 15 nt, Escherichia coli CFT073
gcauccggcauaaac

SEQ ID NO: 2663560 - RNA, 17 nt, Escherichia coli CFT073
gcauccggcauaaacaa

SEQ ID NO: 2663561 - RNA, 14 nt, Escherichia coli CFT073
gcauccggcaugaa

SEQ ID NO: 2663562 - RNA, 20 nt, Escherichia coli CFT073
gcauccggcauuugagcagg

SEQ ID NO: 2663563 - RNA, 21 nt, Escherichia coli CFT073
gcauccggcauuugagcagga

SEQ ID NO: 2663564 - RNA, 14 nt, Escherichia coli CFT073
gcauccggccauca

SEQ ID NO: 2663565 - RNA, 16 nt, Escherichia coli CFT073
gcauccggccaucagu

SEQ ID NO: 2663566 - RNA, 17 nt, Escherichia coli CFT073
gcauccggccaucagua

SEQ ID NO: 2663567 - RNA, 17 nt, Escherichia coli CFT073
gcauccggcgacaggaa

SEQ ID NO: 2663568 - RNA, 17 nt, Escherichia coli CFT073
gcauccggcgauuuuca

SEQ ID NO: 2663569 - RNA, 22 nt, Escherichia coli CFT073
gcauccggcuuaaauccaaacu

SEQ ID NO: 2663570 - RNA, 18 nt, Escherichia coli CFT073
gcauccgguuaucgccug

SEQ ID NO: 2663571 - RNA, 18 nt, Escherichia coli CFT073
gcauccugaucguccugc

SEQ ID NO: 2663572 - RNA, 12 nt, Escherichia coli CFT073
gcauccugcacc

SEQ ID NO: 2663573 - RNA, 20 nt, Escherichia coli CFT073
gcauccuggggauucaucac

SEQ ID NO: 2663574 - RNA, 15 nt, Escherichia coli CFT073
gcaucgcaaaccaga

SEQ ID NO: 2663575 - RNA, 20 nt, Escherichia coli CFT073
gcaucgcaaaccagacgcgc

SEQ ID NO: 2663576 - RNA, 22 nt, Escherichia coli CFT073
gcaucgcaaaccagacgcgcgu

SEQ ID NO: 2663577 - RNA, 17 nt, Escherichia coli CFT073
gcaucgcauccggcaau

SEQ ID NO: 2663578 - RNA, 16 nt, Escherichia coli CFT073
gcaucgccaaacaggc

SEQ ID NO: 2663579 - RNA, 18 nt, Escherichia coli CFT073
gcaucgccaaacaggcga

SEQ ID NO: 2663580 - RNA, 15 nt, Escherichia coli CFT073
gcaucgccagacaau

SEQ ID NO: 2663581 - RNA, 21 nt, Escherichia coli CFT073
gcaucgccauccuuucccugg

SEQ ID NO: 2663582 - RNA, 22 nt, Escherichia coli CFT073
gcaucgcccaggcgaccaggcc

SEQ ID NO: 2663583 - RNA, 17 nt, Escherichia coli CFT073
gcaucgcccccaucgcc

SEQ ID NO: 2663584 - RNA, 20 nt, Escherichia coli CFT073
gcaucgccgggcuaaccgcu

SEQ ID NO: 2663585 - RNA, 24 nt, Escherichia coli CFT073
gcaucgccugcgcgauacuacguu

SEQ ID NO: 2663586 - RNA, 18 nt, Escherichia coli CFT073
gcaucgcgaccaaucaca

SEQ ID NO: 2663587 - RNA, 20 nt, Escherichia coli CFT073
gcaucgcuagauauauauua

SEQ ID NO: 2663588 - RNA, 21 nt, Escherichia coli CFT073
gcaucgcuuugugcucuuccu

SEQ ID NO: 2663589 - RNA, 23 nt, Escherichia coli CFT073
gcaucggcaaaacgguaguugaa

SEQ ID NO: 2663590 - RNA, 22 nt, Escherichia coli CFT073
gcaucggcaacgaaauagccag

SEQ ID NO: 2663591 - RNA, 18 nt, Escherichia coli CFT073
gcaucggcaauuuaccgc

SEQ ID NO: 2663592 - RNA, 14 nt, Escherichia coli CFT073
gcaucggcaucaaa

SEQ ID NO: 2663593 - RNA, 14 nt, Escherichia coli CFT073
gcaucggccugcaa

SEQ ID NO: 2663594 - RNA, 18 nt, Escherichia coli CFT073
gcaucgggaauggcauac

SEQ ID NO: 2663595 - RNA, 18 nt, Escherichia coli CFT073
gcaucgguaucaucccag

SEQ ID NO: 2663596 - RNA, 20 nt, Escherichia coli CFT073
gcaucgguaucgaauaaaga

SEQ ID NO: 2663597 - RNA, 22 nt, Escherichia coli CFT073
gcaucggugaggaucaccaguc

SEQ ID NO: 2663598 - RNA, 17 nt, Escherichia coli CFT073
gcaucguagauuucauc

SEQ ID NO: 2663599 - RNA, 18 nt, Escherichia coli CFT073
gcaucguaguuuuugccc

SEQ ID NO: 2663600 - RNA, 19 nt, Escherichia coli CFT073
gcaucguauuucagaccug

SEQ ID NO: 2663601 - RNA, 22 nt, Escherichia coli CFT073
gcaucgucacgcgcgccaagcc

SEQ ID NO: 2663602 - RNA, 15 nt, Escherichia coli CFT073
gcaucgucacugaua

SEQ ID NO: 2663603 - RNA, 13 nt, Escherichia coli CFT073
gcaucgucaucag

SEQ ID NO: 2663604 - RNA, 16 nt, Escherichia coli CFT073
gcaucguggaugaaac

SEQ ID NO: 2663605 - RNA, 12 nt, Escherichia coli CFT073
gcaucguggccu

SEQ ID NO: 2663606 - RNA, 13 nt, Escherichia coli CFT073
gcaucguggccug

SEQ ID NO: 2663607 - RNA, 17 nt, Escherichia coli CFT073
gcaucuacgcucucuuc

SEQ ID NO: 2663608 - RNA, 19 nt, Escherichia coli CFT073
gcaucuaucgaaucuguuc

SEQ ID NO: 2663609 - RNA, 22 nt, Escherichia coli CFT073
gcaucuaucgaaucuguucugg

SEQ ID NO: 2663610 - RNA, 15 nt, Escherichia coli CFT073
gcaucucauccauca

SEQ ID NO: 2663611 - RNA, 15 nt, Escherichia coli CFT073
gcaucuccuguuuca

SEQ ID NO: 2663612 - RNA, 18 nt, Escherichia coli CFT073
gcaucucgcgcucuucuu

SEQ ID NO: 2663613 - RNA, 17 nt, Escherichia coli CFT073
gcaucugauaagcccag

SEQ ID NO: 2663614 - RNA, 22 nt, Escherichia coli CFT073
gcaucuggcauucagaacacaa

SEQ ID NO: 2663615 - RNA, 15 nt, Escherichia coli CFT073
gcaucuggcauuuug

SEQ ID NO: 2663616 - RNA, 17 nt, Escherichia coli CFT073
gcaucuggcauuuugcu

SEQ ID NO: 2663617 - RNA, 20 nt, Escherichia coli CFT073
gcaucugguaacccauccag

SEQ ID NO: 2663618 - RNA, 22 nt, Escherichia coli CFT073
gcaucugguaacccauccagca

SEQ ID NO: 2663619 - RNA, 23 nt, Escherichia coli CFT073
gcaucuggugccagcgccagcac

SEQ ID NO: 2663620 - RNA, 17 nt, Escherichia coli CFT073
gcaucuguaugucagua

SEQ ID NO: 2663621 - RNA, 17 nt, Escherichia coli CFT073
gcaucuucgcuuucaag

SEQ ID NO: 2663622 - RNA, 20 nt, Escherichia coli CFT073
gcaucuucuucuaugccagc

SEQ ID NO: 2663623 - RNA, 15 nt, Escherichia coli CFT073
gcaucuucuucuggc

SEQ ID NO: 2663624 - RNA, 17 nt, Escherichia coli CFT073
gcaucuucuucuggcuc

SEQ ID NO: 2663625 - RNA, 22 nt, Escherichia coli CFT073
gcaucuucuucuggcucauuag

SEQ ID NO: 2663626 - RNA, 15 nt, Escherichia coli CFT073
gcaucuuuuuuuacc

SEQ ID NO: 2663627 - RNA, 19 nt, Escherichia coli CFT073
gcaucuuuuuuuaccugaa

SEQ ID NO: 2663628 - RNA, 16 nt, Escherichia coli CFT073
gcaugaaagcgaugcu

SEQ ID NO: 2663629 - RNA, 19 nt, Escherichia coli CFT073
gcaugaaauagcccacuac

SEQ ID NO: 2663630 - RNA, 15 nt, Escherichia coli CFT073
gcauuuuuucuucag

SEQ ID NO: 2663631 - RNA, 20 nt, Escherichia coli CFT073
gccaaaaaccggcacgccgu

SEQ ID NO: 2663632 - RNA, 15 nt, Escherichia coli CFT073
gccaaaaagcguccc

SEQ ID NO: 2663633 - RNA, 19 nt, Escherichia coli CFT073
gccaaaaaggggaaaaauu

SEQ ID NO: 2663634 - RNA, 14 nt, Escherichia coli CFT073
gccaaaaauggaga

SEQ ID NO: 2663635 - RNA, 22 nt, Escherichia coli CFT073
gccaaaaauggagagaaccagc

SEQ ID NO: 2663636 - RNA, 16 nt, Escherichia coli CFT073
gccaaaaccuuucacc

SEQ ID NO: 2663637 - RNA, 16 nt, Escherichia coli CFT073
gccaaacauuucacgu

SEQ ID NO: 2663638 - RNA, 12 nt, Escherichia coli CFT073
gccaaaccacgg

SEQ ID NO: 2663639 - RNA, 12 nt, Escherichia coli CFT073
gccaaacgccca

SEQ ID NO: 2663640 - RNA, 14 nt, Escherichia coli CFT073
gccaaacgcccagc

SEQ ID NO: 2663641 - RNA, 15 nt, Escherichia coli CFT073
gccaaacgcgguaag

SEQ ID NO: 2663642 - RNA, 16 nt, Escherichia coli CFT073
gccaaacgcgguaaga

SEQ ID NO: 2663643 - RNA, 15 nt, Escherichia coli CFT073
gccaaacugccguca

SEQ ID NO: 2663644 - RNA, 17 nt, Escherichia coli CFT073
gccaaacugugcaccgc

SEQ ID NO: 2663645 - RNA, 13 nt, Escherichia coli CFT073
gccaaagaccagg

SEQ ID NO: 2663646 - RNA, 15 nt, Escherichia coli CFT073
gccaaagaccaggaa

SEQ ID NO: 2663647 - RNA, 17 nt, Escherichia coli CFT073
gccaaagaccaggaaac

SEQ ID NO: 2663648 - RNA, 19 nt, Escherichia coli CFT073
gccaaagcaccacuccuca

SEQ ID NO: 2663649 - RNA, 20 nt, Escherichia coli CFT073
gccaaagcaccacuccucaa

SEQ ID NO: 2663650 - RNA, 13 nt, Escherichia coli CFT073
gccaaagccgccg

SEQ ID NO: 2663651 - RNA, 16 nt, Escherichia coli CFT073
gccaaagccgccgagc

SEQ ID NO: 2663652 - RNA, 17 nt, Escherichia coli CFT073
gccaaagccgccgagca

SEQ ID NO: 2663653 - RNA, 14 nt, Escherichia coli CFT073
gccaaagcggcagu

SEQ ID NO: 2663654 - RNA, 21 nt, Escherichia coli CFT073
gccaaaggcuuucgcgacauc

SEQ ID NO: 2663655 - RNA, 12 nt, Escherichia coli CFT073
gccaaagggagc

SEQ ID NO: 2663656 - RNA, 14 nt, Escherichia coli CFT073
gccaaauaaaaucc

SEQ ID NO: 2663657 - RNA, 21 nt, Escherichia coli CFT073
gccaaauauuucuuuaucacc

SEQ ID NO: 2663658 - RNA, 22 nt, Escherichia coli CFT073
gccaaaucaguugccgaauacc

SEQ ID NO: 2663659 - RNA, 16 nt, Escherichia coli CFT073
gccaaauccagcacca

SEQ ID NO: 2663660 - RNA, 19 nt, Escherichia coli CFT073
gccaaauccggcaaauaac

SEQ ID NO: 2663661 - RNA, 13 nt, Escherichia coli CFT073
gccaaaucguugc

SEQ ID NO: 2663662 - RNA, 18 nt, Escherichia coli CFT073
gccaaaucuaccgucaug

SEQ ID NO: 2663663 - RNA, 16 nt, Escherichia coli CFT073
gccaaauuuaaacgau

SEQ ID NO: 2663664 - RNA, 19 nt, Escherichia coli CFT073
gccaaauuuggugcucagu

SEQ ID NO: 2663665 - RNA, 15 nt, Escherichia coli CFT073
gccaacaaaaaauug

SEQ ID NO: 2663666 - RNA, 23 nt, Escherichia coli CFT073
gccaacaccacaaaucgggugaa

SEQ ID NO: 2663667 - RNA, 13 nt, Escherichia coli CFT073
gccaacagcagcc

SEQ ID NO: 2663668 - RNA, 16 nt, Escherichia coli CFT073
gccaacauccaucagc

SEQ ID NO: 2663669 - RNA, 20 nt, Escherichia coli CFT073
gccaacauccaucagcguuu

SEQ ID NO: 2663670 - RNA, 13 nt, Escherichia coli CFT073
gccaaccaucggu

SEQ ID NO: 2663671 - RNA, 18 nt, Escherichia coli CFT073
gccaaccgcgacaauauc

SEQ ID NO: 2663672 - RNA, 17 nt, Escherichia coli CFT073
gccaaccgcugauugcu

SEQ ID NO: 2663673 - RNA, 11 nt, Escherichia coli CFT073
gccaaccugca

SEQ ID NO: 2663674 - RNA, 21 nt, Escherichia coli CFT073
gccaaccuugcggaagcguca

SEQ ID NO: 2663675 - RNA, 21 nt, Escherichia coli CFT073
gccaacgaacacaugcccugc

SEQ ID NO: 2663676 - RNA, 16 nt, Escherichia coli CFT073
gccaacgcaaaugucu

SEQ ID NO: 2663677 - RNA, 17 nt, Escherichia coli CFT073
gccaacgcaacgcgcuu

SEQ ID NO: 2663678 - RNA, 15 nt, Escherichia coli CFT073
gccaacgccugcggc

SEQ ID NO: 2663679 - RNA, 18 nt, Escherichia coli CFT073
gccaacgccuuuaccacc

SEQ ID NO: 2663680 - RNA, 19 nt, Escherichia coli CFT073
gccaacggggccagcacau

SEQ ID NO: 2663681 - RNA, 21 nt, Escherichia coli CFT073
gccaacgugacguuucaucgc

SEQ ID NO: 2663682 - RNA, 22 nt, Escherichia coli CFT073
gccaacgugguuuaccaccagc

SEQ ID NO: 2663683 - RNA, 15 nt, Escherichia coli CFT073
gccaacuccaccaau

SEQ ID NO: 2663684 - RNA, 21 nt, Escherichia coli CFT073
gccaacuccaccaauaaugcc

SEQ ID NO: 2663685 - RNA, 13 nt, Escherichia coli CFT073
gccaagaaacacc

SEQ ID NO: 2663686 - RNA, 15 nt, Escherichia coli CFT073
gccaagaaacaccag

SEQ ID NO: 2663687 - RNA, 22 nt, Escherichia coli CFT073
gccaagaagaacgccgguugcg

SEQ ID NO: 2663688 - RNA, 17 nt, Escherichia coli CFT073
gccaagauagaaccacg

SEQ ID NO: 2663689 - RNA, 19 nt, Escherichia coli CFT073
gccaagauagaaccacgca

SEQ ID NO: 2663690 - RNA, 14 nt, Escherichia coli CFT073
gccaagccagagca

SEQ ID NO: 2663691 - RNA, 17 nt, Escherichia coli CFT073
gccaauaaucgauugca

SEQ ID NO: 2663692 - RNA, 15 nt, Escherichia coli CFT073
gccaauaaugcccgc

SEQ ID NO: 2663693 - RNA, 20 nt, Escherichia coli CFT073
gccaauaaugcccgcaccac

SEQ ID NO: 2663694 - RNA, 15 nt, Escherichia coli CFT073
gccaauaccgaucag

SEQ ID NO: 2663695 - RNA, 19 nt, Escherichia coli CFT073
gccaauacgugaucgcaau

SEQ ID NO: 2663696 - RNA, 15 nt, Escherichia coli CFT073
gccaaucagcgcagc

SEQ ID NO: 2663697 - RNA, 19 nt, Escherichia coli CFT073
gccaaucagcgcagcaccc

SEQ ID NO: 2663698 - RNA, 20 nt, Escherichia coli CFT073
gccaaucagcgcagcaccca

SEQ ID NO: 2663699 - RNA, 14 nt, Escherichia coli CFT073
gccaaucgacaggu

SEQ ID NO: 2663700 - RNA, 12 nt, Escherichia coli CFT073
gccaaucgccag

SEQ ID NO: 2663701 - RNA, 12 nt, Escherichia coli CFT073
gccaaucggcaa

SEQ ID NO: 2663702 - RNA, 16 nt, Escherichia coli CFT073
gccaaucggcccgccc

SEQ ID NO: 2663703 - RNA, 20 nt, Escherichia coli CFT073
gccaaucuucacaucaucau

SEQ ID NO: 2663704 - RNA, 23 nt, Escherichia coli CFT073
gccaaucuucacaucaucaucgc

SEQ ID NO: 2663705 - RNA, 19 nt, Escherichia coli CFT073
gccaaugaucccgccaucg

SEQ ID NO: 2663706 - RNA, 13 nt, Escherichia coli CFT073
gccaaugauuuug

SEQ ID NO: 2663707 - RNA, 18 nt, Escherichia coli CFT073
gccaaugcaggcaucggu

SEQ ID NO: 2663708 - RNA, 14 nt, Escherichia coli CFT073
gccaaugccugauu

SEQ ID NO: 2663709 - RNA, 22 nt, Escherichia coli CFT073
gccaauggaauagcgaagaaua

SEQ ID NO: 2663710 - RNA, 11 nt, Escherichia coli CFT073
gccaaugguua

SEQ ID NO: 2663711 - RNA, 21 nt, Escherichia coli CFT073
gccaaugguuaaguugaaaac

SEQ ID NO: 2663712 - RNA, 18 nt, Escherichia coli CFT073
gccaauguacggaauaag

SEQ ID NO: 2663713 - RNA, 16 nt, Escherichia coli CFT073
gccaauguguuuauaa

SEQ ID NO: 2663714 - RNA, 14 nt, Escherichia coli CFT073
gccaauuaagucaa

SEQ ID NO: 2663715 - RNA, 13 nt, Escherichia coli CFT073
gccaauuacaaaa

SEQ ID NO: 2663716 - RNA, 13 nt, Escherichia coli CFT073
gccaauucauucc

SEQ ID NO: 2663717 - RNA, 13 nt, Escherichia coli CFT073
gccaauuuccgcu

SEQ ID NO: 2663718 - RNA, 14 nt, Escherichia coli CFT073
gccaauuuccggaa

SEQ ID NO: 2663719 - RNA, 12 nt, Escherichia coli CFT073
gccacaaagcua

SEQ ID NO: 2663720 - RNA, 20 nt, Escherichia coli CFT073
gccacaauacugaucaucau

SEQ ID NO: 2663721 - RNA, 16 nt, Escherichia coli CFT073
gccacaauauagucgc

SEQ ID NO: 2663722 - RNA, 14 nt, Escherichia coli CFT073
gccacaaucagcgc

SEQ ID NO: 2663723 - RNA, 19 nt, Escherichia coli CFT073
gccacaaucgcuucaucgc

SEQ ID NO: 2663724 - RNA, 15 nt, Escherichia coli CFT073
gccacacgacgccag

SEQ ID NO: 2663725 - RNA, 18 nt, Escherichia coli CFT073
gccacacgacgccagcca

SEQ ID NO: 2663726 - RNA, 19 nt, Escherichia coli CFT073
gccacagaauggcauuauu

SEQ ID NO: 2663727 - RNA, 11 nt, Escherichia coli CFT073
gccacagcaag

SEQ ID NO: 2663728 - RNA, 16 nt, Escherichia coli CFT073
gccacagcaagcagcc

SEQ ID NO: 2663729 - RNA, 21 nt, Escherichia coli CFT073
gccacagcaauuuugcccagc

SEQ ID NO: 2663730 - RNA, 22 nt, Escherichia coli CFT073
gccacagcaauuuugcccagcc

SEQ ID NO: 2663731 - RNA, 22 nt, Escherichia coli CFT073
gccacagcaguuagcuuuucuc

SEQ ID NO: 2663732 - RNA, 14 nt, Escherichia coli CFT073
gccacagccuggga

SEQ ID NO: 2663733 - RNA, 20 nt, Escherichia coli CFT073
gccacagcgccagacacugg

SEQ ID NO: 2663734 - RNA, 13 nt, Escherichia coli CFT073
gccacagcguucg

SEQ ID NO: 2663735 - RNA, 19 nt, Escherichia coli CFT073
gccacaguugaucagccag

SEQ ID NO: 2663736 - RNA, 19 nt, Escherichia coli CFT073
gccacaguuuuacugcagc

SEQ ID NO: 2663737 - RNA, 24 nt, Escherichia coli CFT073
gccacaguuuuucaccguugcuca

SEQ ID NO: 2663738 - RNA, 23 nt, Escherichia coli CFT073
gccacaucagcauauuuggcgcu

SEQ ID NO: 2663739 - RNA, 19 nt, Escherichia coli CFT073
gacaaaucauacaggcgga

SEQ ID NO: 2663740 - RNA, 23 nt, Escherichia coli CFT073
gacaaaucuuucacuuuugccag

SEQ ID NO: 2663741 - RNA, 14 nt, Escherichia coli CFT073
gacaaaugcgccgc

SEQ ID NO: 2663742 - RNA, 14 nt, Escherichia coli CFT073
gacaaauguugcau

SEQ ID NO: 2663743 - RNA, 14 nt, Escherichia coli CFT073
gacaacaaacgcaa

SEQ ID NO: 2663744 - RNA, 21 nt, Escherichia coli CFT073
gacaacaccgauagaaccaaa

SEQ ID NO: 2663745 - RNA, 19 nt, Escherichia coli CFT073
gacaacagucaaccgccug

SEQ ID NO: 2663746 - RNA, 20 nt, Escherichia coli CFT073
gacaacagucaaccgccuga

SEQ ID NO: 2663747 - RNA, 22 nt, Escherichia coli CFT073
gacaacagucaaccgccugaau

SEQ ID NO: 2663748 - RNA, 18 nt, Escherichia coli CFT073
gacaacauugauuucuua

SEQ ID NO: 2663749 - RNA, 12 nt, Escherichia coli CFT073
gacaaccagcac

SEQ ID NO: 2663750 - RNA, 23 nt, Escherichia coli CFT073
gacaaccugaccuuuuuucagcg

SEQ ID NO: 2663751 - RNA, 16 nt, Escherichia coli CFT073
gacaaccugcugugua

SEQ ID NO: 2663752 - RNA, 21 nt, Escherichia coli CFT073
gacaacgccuuguucgcccug

SEQ ID NO: 2663753 - RNA, 15 nt, Escherichia coli CFT073
gacaacgugcgauuu

SEQ ID NO: 2663754 - RNA, 12 nt, Escherichia coli CFT073
gacaagcauaac

SEQ ID NO: 2663755 - RNA, 20 nt, Escherichia coli CFT073
gacaagcguaauuauucccg

SEQ ID NO: 2663756 - RNA, 17 nt, Escherichia coli CFT073
gacaagcucauuuccca

SEQ ID NO: 2663757 - RNA, 14 nt, Escherichia coli CFT073
gacaagcucucuuc

SEQ ID NO: 2663758 - RNA, 22 nt, Escherichia coli CFT073
gacaauaaaacguugcccgcug

SEQ ID NO: 2663759 - RNA, 13 nt, Escherichia coli CFT073
gacaauaaacagc

SEQ ID NO: 2663760 - RNA, 12 nt, Escherichia coli CFT073
gacaauaacgcc

SEQ ID NO: 2663761 - RNA, 12 nt, Escherichia coli CFT073
gacaauaauauc

SEQ ID NO: 2663762 - RNA, 16 nt, Escherichia coli CFT073
gacaauaauaucuuuc

SEQ ID NO: 2663763 - RNA, 20 nt, Escherichia coli CFT073
gacaauaauaucuuucuugc

SEQ ID NO: 2663764 - RNA, 21 nt, Escherichia coli CFT073
gacaauaauucccagcaccgc

SEQ ID NO: 2663765 - RNA, 23 nt, Escherichia coli CFT073
gacaauaauucccagcaccgcag

SEQ ID NO: 2663766 - RNA, 22 nt, Escherichia coli CFT073
gacaauacuugccggagauuca

SEQ ID NO: 2663767 - RNA, 14 nt, Escherichia coli CFT073
gacaauaucaucau

SEQ ID NO: 2663768 - RNA, 21 nt, Escherichia coli CFT073
gacaaucaauccggcaaucaa

SEQ ID NO: 2663769 - RNA, 17 nt, Escherichia coli CFT073
gacaaucaccaggucac

SEQ ID NO: 2663770 - RNA, 23 nt, Escherichia coli CFT073
gacaucgccacggcaugaaagcg

SEQ ID NO: 2663771 - RNA, 19 nt, Escherichia coli CFT073
gacaucgcccucuuucacc

SEQ ID NO: 2663772 - RNA, 21 nt, Escherichia coli CFT073
gacaucgggaacaguucggua

SEQ ID NO: 2663773 - RNA, 17 nt, Escherichia coli CFT073
gacaucgucaggggcau

SEQ ID NO: 2663774 - RNA, 22 nt, Escherichia coli CFT073
gacaucgucugcggugcgccaa

SEQ ID NO: 2663775 - RNA, 22 nt, Escherichia coli CFT073
gacaucuuucugcgcaucuucc

SEQ ID NO: 2663776 - RNA, 23 nt, Escherichia coli CFT073
gacaucuuucugcgcaucuuccc

SEQ ID NO: 2663777 - RNA, 15 nt, Escherichia coli CFT073
gacaugaaugucaua

SEQ ID NO: 2663778 - RNA, 18 nt, Escherichia coli CFT073
gacaugcaguugauuaca

SEQ ID NO: 2663779 - RNA, 20 nt, Escherichia coli CFT073
gacaugcgguucacgcgcca

SEQ ID NO: 2663780 - RNA, 17 nt, Escherichia coli CFT073
gacauggcuaugcguug

SEQ ID NO: 2663781 - RNA, 14 nt, Escherichia coli CFT073
gacaugugcgacag

SEQ ID NO: 2663782 - RNA, 18 nt, Escherichia coli CFT073
gacauguuuuccagcaca

SEQ ID NO: 2663783 - RNA, 22 nt, Escherichia coli CFT073
gacauuaucaccgacaaacagc

SEQ ID NO: 2663784 - RNA, 16 nt, Escherichia coli CFT073
gacauucaccucacga

SEQ ID NO: 2663785 - RNA, 16 nt, Escherichia coli CFT073
gacauugaccagugca

SEQ ID NO: 2663786 - RNA, 17 nt, Escherichia coli CFT073
gacauugaccagugcag

SEQ ID NO: 2663787 - RNA, 15 nt, Escherichia coli CFT073
gacauugaugaaaag

SEQ ID NO: 2663788 - RNA, 22 nt, Escherichia coli CFT073
gacauuuuuaugaugcacuuca

SEQ ID NO: 2663789 - RNA, 18 nt, Escherichia coli CFT073
gaccaaacuuauccgcca

SEQ ID NO: 2663790 - RNA, 16 nt, Escherichia coli CFT073
gaccaaagaaugacac

SEQ ID NO: 2663791 - RNA, 18 nt, Escherichia coli CFT073
gaccaacacccacagcca

SEQ ID NO: 2663792 - RNA, 21 nt, Escherichia coli CFT073
gaccaaccgucagauccgcca

SEQ ID NO: 2663793 - RNA, 22 nt, Escherichia coli CFT073
gaccaagaugcgcguaguacuu

SEQ ID NO: 2663794 - RNA, 15 nt, Escherichia coli CFT073
gaccaauaaacgcca

SEQ ID NO: 2663795 - RNA, 21 nt, Escherichia coli CFT073
gaccaauacgugaacgggugg

SEQ ID NO: 2663796 - RNA, 17 nt, Escherichia coli CFT073
gaccaauccagccggca

SEQ ID NO: 2663797 - RNA, 13 nt, Escherichia coli CFT073
gaccaauccgcca

SEQ ID NO: 2663798 - RNA, 14 nt, Escherichia coli CFT073
gaccaauccgccag

SEQ ID NO: 2663799 - RNA, 14 nt, Escherichia coli CFT073
gaccaaugcccaaa

SEQ ID NO: 2663800 - RNA, 19 nt, Escherichia coli CFT073
gaccaauucaaugccccac

SEQ ID NO: 2663801 - RNA, 23 nt, Escherichia coli CFT073
gaccaauugccgcaccaaccauc

SEQ ID NO: 2663802 - RNA, 21 nt, Escherichia coli CFT073
gaccacaaauaccccaccgcc

SEQ ID NO: 2663803 - RNA, 14 nt, Escherichia coli CFT073
gaccaccaaauaaa

SEQ ID NO: 2663804 - RNA, 23 nt, Escherichia coli CFT073
gaccaccaaauaaaaaaacgcca

SEQ ID NO: 2663805 - RNA, 18 nt, Escherichia coli CFT073
gaccaccagcacgcugaa

SEQ ID NO: 2663806 - RNA, 17 nt, Escherichia coli CFT073
gaccacccaccgcagcc

SEQ ID NO: 2663807 - RNA, 21 nt, Escherichia coli CFT073
gaccacccaccgcagcccaga

SEQ ID NO: 2663808 - RNA, 15 nt, Escherichia coli CFT073
gaccaccgcauucca

SEQ ID NO: 2663809 - RNA, 17 nt, Escherichia coli CFT073
gaccacgcacagcccgc

SEQ ID NO: 2663810 - RNA, 14 nt, Escherichia coli CFT073
gaccacuaacacuu

SEQ ID NO: 2663811 - RNA, 15 nt, Escherichia coli CFT073
gaccacuucaugccc

SEQ ID NO: 2663812 - RNA, 17 nt, Escherichia coli CFT073
gaccagaaacgccacca

SEQ ID NO: 2663813 - RNA, 18 nt, Escherichia coli CFT073
gaccagagccaaucggcc

SEQ ID NO: 2663814 - RNA, 16 nt, Escherichia coli CFT073
gaccagcaccgccagc

SEQ ID NO: 2663815 - RNA, 17 nt, Escherichia coli CFT073
gaccagcaccgccagca

SEQ ID NO: 2663816 - RNA, 14 nt, Escherichia coli CFT073
gaccagcacggugg

SEQ ID NO: 2663817 - RNA, 16 nt, Escherichia coli CFT073
gaccagcgaaaccuga

SEQ ID NO: 2663818 - RNA, 22 nt, Escherichia coli CFT073
gaccagcgccgcaacuaccagc

SEQ ID NO: 2663819 - RNA, 20 nt, Escherichia coli CFT073
gaccagcgccgcgagcaucg

SEQ ID NO: 2663820 - RNA, 16 nt, Escherichia coli CFT073
gaccaggaaacccaac

SEQ ID NO: 2663821 - RNA, 20 nt, Escherichia coli CFT073
gaccaggccaucagcagcgg

SEQ ID NO: 2663822 - RNA, 16 nt, Escherichia coli CFT073
gaccagggauaaagcu

SEQ ID NO: 2663823 - RNA, 17 nt, Escherichia coli CFT073
gaccaguaccaccgcga

SEQ ID NO: 2663824 - RNA, 14 nt, Escherichia coli CFT073
gaccagugaaaaug

SEQ ID NO: 2663825 - RNA, 15 nt, Escherichia coli CFT073
gaccagugcaacaga

SEQ ID NO: 2663826 - RNA, 17 nt, Escherichia coli CFT073
gaccagugcagauacca

SEQ ID NO: 2663827 - RNA, 20 nt, Escherichia coli CFT073
gaccagugcagauaccacca

SEQ ID NO: 2663828 - RNA, 23 nt, Escherichia coli CFT073
gaccaguucacaccgaccaccgc

SEQ ID NO: 2663829 - RNA, 23 nt, Escherichia coli CFT073
gaccaguuguaaucugcaccagg

SEQ ID NO: 2663830 - RNA, 14 nt, Escherichia coli CFT073
gaccaguuugccuu

SEQ ID NO: 2663831 - RNA, 22 nt, Escherichia coli CFT073
gaccauaaaugcgcucgaucag

SEQ ID NO: 2663832 - RNA, 16 nt, Escherichia coli CFT073
gaccauaacccgcuuc

SEQ ID NO: 2663833 - RNA, 19 nt, Escherichia coli CFT073
gaccauaaugauggugaaa

SEQ ID NO: 2663834 - RNA, 13 nt, Escherichia coli CFT073
gaccauacuggcg

SEQ ID NO: 2663835 - RNA, 21 nt, Escherichia coli CFT073
gaccaucagcaugacaaaaaa

SEQ ID NO: 2663836 - RNA, 22 nt, Escherichia coli CFT073
gaccaucggcacgaccaggaac

SEQ ID NO: 2663837 - RNA, 17 nt, Escherichia coli CFT073
gaccaucuuccagcauc

SEQ ID NO: 2663838 - RNA, 16 nt, Escherichia coli CFT073
gaccauuggugcuguu

SEQ ID NO: 2663839 - RNA, 21 nt, Escherichia coli CFT073
gacccacggauagauuuuuaa

SEQ ID NO: 2663840 - RNA, 20 nt, Escherichia coli CFT073
gacccagcgcgaucgcgcca

SEQ ID NO: 2663841 - RNA, 23 nt, Escherichia coli CFT073
gacccauaauguguuaauaaugc

SEQ ID NO: 2663842 - RNA, 21 nt, Escherichia coli CFT073
gaccccauauucgaacccgug

SEQ ID NO: 2663843 - RNA, 15 nt, Escherichia coli CFT073
gacccgaccgagcug

SEQ ID NO: 2663844 - RNA, 15 nt, Escherichia coli CFT073
gacccggaauaaaug

SEQ ID NO: 2663845 - RNA, 21 nt, Escherichia coli CFT073
gacccggcaagccuaccggca

SEQ ID NO: 2663846 - RNA, 19 nt, Escherichia coli CFT073
gacccguuuacggcuaaaa

SEQ ID NO: 2663847 - RNA, 13 nt, Escherichia coli CFT073
gaccgaacagcau

SEQ ID NO: 2663848 - RNA, 14 nt, Escherichia coli CFT073
gaccgacagguuaa

SEQ ID NO: 2663849 - RNA, 21 nt, Escherichia coli CFT073
gaccgacgcauuaacgcugaa

SEQ ID NO: 2663850 - RNA, 14 nt, Escherichia coli CFT073
gaccgagcugguga

SEQ ID NO: 2663851 - RNA, 15 nt, Escherichia coli CFT073
gaccgagcuggugau

SEQ ID NO: 2663852 - RNA, 14 nt, Escherichia coli CFT073
gaccgauagcagcc

SEQ ID NO: 2663853 - RNA, 23 nt, Escherichia coli CFT073
gaccgauuaauuccccugccaga

SEQ ID NO: 2663854 - RNA, 15 nt, Escherichia coli CFT073
gaccgccaaucagca

SEQ ID NO: 2663855 - RNA, 14 nt, Escherichia coli CFT073
gaccgccaauuaau

SEQ ID NO: 2663856 - RNA, 22 nt, Escherichia coli CFT073
gaccgccauuaaacgcaguaaa

SEQ ID NO: 2663857 - RNA, 18 nt, Escherichia coli CFT073
gaccgccgcucaccugac

SEQ ID NO: 2663858 - RNA, 23 nt, Escherichia coli CFT073
gaccgcuaauagcgcagcggucg

SEQ ID NO: 2663859 - RNA, 15 nt, Escherichia coli CFT073
gaccgcuucaggaac

SEQ ID NO: 2663860 - RNA, 18 nt, Escherichia coli CFT073
gaccgcuucaggaacugc

SEQ ID NO: 2663861 - RNA, 16 nt, Escherichia coli CFT073
gaccggaaguaagagg

SEQ ID NO: 2663862 - RNA, 12 nt, Escherichia coli CFT073
gaccggagaaaa

SEQ ID NO: 2663863 - RNA, 17 nt, Escherichia coli CFT073
gaccgguccacuuccug

SEQ ID NO: 2663864 - RNA, 21 nt, Escherichia coli CFT073
gaccgguccacuuccugcgcc

SEQ ID NO: 2663865 - RNA, 18 nt, Escherichia coli CFT073
gaccguacaaccaaaucu

SEQ ID NO: 2663866 - RNA, 22 nt, Escherichia coli CFT073
gaccgucaaacaugccgucaau

SEQ ID NO: 2663867 - RNA, 17 nt, Escherichia coli CFT073
gaccgucgccuucaacg

SEQ ID NO: 2663868 - RNA, 21 nt, Escherichia coli CFT073
gaccgucuuuauccagcacca

SEQ ID NO: 2663869 - RNA, 19 nt, Escherichia coli CFT073
gaccgugaagguaccgcaa

SEQ ID NO: 2663870 - RNA, 22 nt, Escherichia coli CFT073
gaccguuagcauauugcaggcu

SEQ ID NO: 2663871 - RNA, 15 nt, Escherichia coli CFT073
gaccguuuucaccag

SEQ ID NO: 2663872 - RNA, 18 nt, Escherichia coli CFT073
gaccucacgguuuugcuc

SEQ ID NO: 2663873 - RNA, 23 nt, Escherichia coli CFT073
gaccucuuaaugcaggcagcacu

SEQ ID NO: 2663874 - RNA, 18 nt, Escherichia coli CFT073
gaccugacuguuccagua

SEQ ID NO: 2663875 - RNA, 18 nt, Escherichia coli CFT073
gaccugcaacugaugacu

SEQ ID NO: 2663876 - RNA, 17 nt, Escherichia coli CFT073
gaccugcgucugaugaa

SEQ ID NO: 2663877 - RNA, 22 nt, Escherichia coli CFT073
gacgggaaacucugcuggcgga

SEQ ID NO: 2663878 - RNA, 23 nt, Escherichia coli CFT073
gacgggcauuucgucuugcagga

SEQ ID NO: 2663879 - RNA, 16 nt, Escherichia coli CFT073
gacgggccaagcaggc

SEQ ID NO: 2663880 - RNA, 22 nt, Escherichia coli CFT073
gacgggcgcugguaacaucgcc

SEQ ID NO: 2663881 - RNA, 16 nt, Escherichia coli CFT073
gacgggcgucagcgca

SEQ ID NO: 2663882 - RNA, 13 nt, Escherichia coli CFT073
gacgggucgcuuc

SEQ ID NO: 2663883 - RNA, 22 nt, Escherichia coli CFT073
gacggucgguaaacccggccug

SEQ ID NO: 2663884 - RNA, 13 nt, Escherichia coli CFT073
gacggugauaauc

SEQ ID NO: 2663885 - RNA, 20 nt, Escherichia coli CFT073
gacgguuaaaaacagccagc

SEQ ID NO: 2663886 - RNA, 22 nt, Escherichia coli CFT073
gacgguuaaaaacagccagcag

SEQ ID NO: 2663887 - RNA, 23 nt, Escherichia coli CFT073
gacgguuuccaggcagccauaac

SEQ ID NO: 2663888 - RNA, 23 nt, Escherichia coli CFT073
gacgguuucucccgccugcugcg

SEQ ID NO: 2663889 - RNA, 15 nt, Escherichia coli CFT073
gacgguuugccuucc

SEQ ID NO: 2663890 - RNA, 14 nt, Escherichia coli CFT073
gacguaccagcguc

SEQ ID NO: 2663891 - RNA, 13 nt, Escherichia coli CFT073
gacguccagaacc

SEQ ID NO: 2663892 - RNA, 23 nt, Escherichia coli CFT073
gacgucgggcggaaaacuuucuu

SEQ ID NO: 2663893 - RNA, 18 nt, Escherichia coli CFT073
gacgucucaaucaccacc

SEQ ID NO: 2663894 - RNA, 15 nt, Escherichia coli CFT073
gacgugcccuuucag

SEQ ID NO: 2663895 - RNA, 23 nt, Escherichia coli CFT073
gacgugcguaccauuaucaccaa

SEQ ID NO: 2663896 - RNA, 13 nt, Escherichia coli CFT073
gacgugcugcauc

SEQ ID NO: 2663897 - RNA, 14 nt, Escherichia coli CFT073
gacguguaugcaua

SEQ ID NO: 2663898 - RNA, 15 nt, Escherichia coli CFT073
gacguuaagaaaacg

SEQ ID NO: 2663899 - RNA, 17 nt, Escherichia coli CFT073
gacguuaagaucaaacc

SEQ ID NO: 2663900 - RNA, 20 nt, Escherichia coli CFT073
gacguuaauccgcucugccc

SEQ ID NO: 2663901 - RNA, 17 nt, Escherichia coli CFT073
gacguuauugguggugu

SEQ ID NO: 2663902 - RNA, 17 nt, Escherichia coli CFT073
gacguucaugccggucg

SEQ ID NO: 2663903 - RNA, 18 nt, Escherichia coli CFT073
gacguuccccaaccgcuu

SEQ ID NO: 2663904 - RNA, 14 nt, Escherichia coli CFT073
gacguucugccaaa

SEQ ID NO: 2663905 - RNA, 19 nt, Escherichia coli CFT073
gacguugauaaccacggcg

SEQ ID NO: 2663906 - RNA, 20 nt, Escherichia coli CFT073
gacguuuuacagcaacgggc

SEQ ID NO: 2663907 - RNA, 17 nt, Escherichia coli CFT073
gacguuuuccaucgacc

SEQ ID NO: 2663908 - RNA, 14 nt, Escherichia coli CFT073
gacuaaagccguga

SEQ ID NO: 2663909 - RNA, 14 nt, Escherichia coli CFT073
gacuaacuucugau

SEQ ID NO: 2663910 - RNA, 16 nt, Escherichia coli CFT073
gacuaacuucugaucu

SEQ ID NO: 2663911 - RNA, 17 nt, Escherichia coli CFT073
gacuacuuucaugcuca

SEQ ID NO: 2663912 - RNA, 20 nt, Escherichia coli CFT073
gacuaucuuauaaaggcgcu

SEQ ID NO: 2663913 - RNA, 14 nt, Escherichia coli CFT073
gacuauuaauauau

SEQ ID NO: 2663914 - RNA, 15 nt, Escherichia coli CFT073
gacuauuuacagauu

SEQ ID NO: 2663915 - RNA, 15 nt, Escherichia coli CFT073
gacuauuucaaacac

SEQ ID NO: 2663916 - RNA, 16 nt, Escherichia coli CFT073
gacuauuucaucagaa

SEQ ID NO: 2663917 - RNA, 13 nt, Escherichia coli CFT073
gacuauuugacac

SEQ ID NO: 2663918 - RNA, 16 nt, Escherichia coli CFT073
gacucaccaaucggca

SEQ ID NO: 2663919 - RNA, 16 nt, Escherichia coli CFT073
gacucaccugauuacc

SEQ ID NO: 2663920 - RNA, 13 nt, Escherichia coli CFT073
gacucagcaacag

SEQ ID NO: 2663921 - RNA, 14 nt, Escherichia coli CFT073
gacucagcaacagg

SEQ ID NO: 2663922 - RNA, 23 nt, Escherichia coli CFT073
gacucagcaacagguaacccagu

SEQ ID NO: 2663923 - RNA, 14 nt, Escherichia coli CFT073
gacucauuguaucu

SEQ ID NO: 2663924 - RNA, 15 nt, Escherichia coli CFT073
gacuccagcgccagc

SEQ ID NO: 2663925 - RNA, 20 nt, Escherichia coli CFT073
gacuccagcgccagcgcgcg

SEQ ID NO: 2663926 - RNA, 12 nt, Escherichia coli CFT073
gacuccagcgcu

SEQ ID NO: 2663927 - RNA, 16 nt, Escherichia coli CFT073
gacucccugaugugau

SEQ ID NO: 2663928 - RNA, 23 nt, Escherichia coli CFT073
gacucuccccugacguaaggcau

SEQ ID NO: 2663929 - RNA, 14 nt, Escherichia coli CFT073
gacucugaaacucg

SEQ ID NO: 2663930 - RNA, 20 nt, Escherichia coli CFT073
gacucugaaugccaguuuau

SEQ ID NO: 2663931 - RNA, 15 nt, Escherichia coli CFT073
gacucuguggcggga

SEQ ID NO: 2663932 - RNA, 19 nt, Escherichia coli CFT073
gacugaaaggucaucauca

SEQ ID NO: 2663933 - RNA, 14 nt, Escherichia coli CFT073
gacugaaccagcgc

SEQ ID NO: 2663934 - RNA, 16 nt, Escherichia coli CFT073
gacugaagguaagcaa

SEQ ID NO: 2663935 - RNA, 13 nt, Escherichia coli CFT073
gacugaaguucug

SEQ ID NO: 2663936 - RNA, 16 nt, Escherichia coli CFT073
gacugaauugccagca

SEQ ID NO: 2663937 - RNA, 14 nt, Escherichia coli CFT073
gacugacaaucaau

SEQ ID NO: 2663938 - RNA, 23 nt, Escherichia coli CFT073
gacugacgcagcagaccgucgga

SEQ ID NO: 2663939 - RNA, 18 nt, Escherichia coli CFT073
gacugacgucacgcacca

SEQ ID NO: 2663940 - RNA, 11 nt, Escherichia coli CFT073
gacugacuuca

SEQ ID NO: 2663941 - RNA, 13 nt, Escherichia coli CFT073
gacugacuucaac

SEQ ID NO: 2663942 - RNA, 14 nt, Escherichia coli CFT073
gacugauauccagc

SEQ ID NO: 2663943 - RNA, 23 nt, Escherichia coli CFT073
gacugauauccagccaggucgug

SEQ ID NO: 2663944 - RNA, 15 nt, Escherichia coli CFT073
gacugauaucugccc

SEQ ID NO: 2663945 - RNA, 14 nt, Escherichia coli CFT073
gacugaugcccugc

SEQ ID NO: 2663946 - RNA, 13 nt, Escherichia coli CFT073
gacugaugcuuuc

SEQ ID NO: 2663947 - RNA, 15 nt, Escherichia coli CFT073
gacugaugcuuuccg

SEQ ID NO: 2663948 - RNA, 21 nt, Escherichia coli CFT073
gacugaugugcuccaucaggu

SEQ ID NO: 2663949 - RNA, 13 nt, Escherichia coli CFT073
gacugccugcaua

SEQ ID NO: 2663950 - RNA, 19 nt, Escherichia coli CFT073
gacugcgccuuccagccag

SEQ ID NO: 2663951 - RNA, 21 nt, Escherichia coli CFT073
gacuggcauugauucgccgcc

SEQ ID NO: 2663952 - RNA, 16 nt, Escherichia coli CFT073
gacuggccauggauuc

SEQ ID NO: 2663953 - RNA, 15 nt, Escherichia coli CFT073
gacuggcgcggcagg

SEQ ID NO: 2663954 - RNA, 17 nt, Escherichia coli CFT073
gacugggccuuucgcuu

SEQ ID NO: 2663955 - RNA, 19 nt, Escherichia coli CFT073
gacugguuaguuucagcgc

SEQ ID NO: 2663956 - RNA, 23 nt, Escherichia coli CFT073
gacugguugauuggcuuuaaaag

SEQ ID NO: 2663957 - RNA, 15 nt, Escherichia coli CFT073
gacuguaagccauca

SEQ ID NO: 2663958 - RNA, 18 nt, Escherichia coli CFT073
gacuguacaauaucgaua

SEQ ID NO: 2663959 - RNA, 18 nt, Escherichia coli CFT073
gacugugauuguuuaaaa

SEQ ID NO: 2663960 - RNA, 23 nt, Escherichia coli CFT073
gacugugauuguuuaaaaauaca

SEQ ID NO: 2663961 - RNA, 22 nt, Escherichia coli CFT073
gacuguucauuuuguaggccug

SEQ ID NO: 2663962 - RNA, 15 nt, Escherichia coli CFT073
gacuguugaaauaca

SEQ ID NO: 2663963 - RNA, 17 nt, Escherichia coli CFT073
gacuguuuuuccagcuu

SEQ ID NO: 2663964 - RNA, 20 nt, Escherichia coli CFT073
gacuuaaaaggaaaaucaca

SEQ ID NO: 2663965 - RNA, 18 nt, Escherichia coli CFT073
gacuuacuuccugucuuc

SEQ ID NO: 2663966 - RNA, 21 nt, Escherichia coli CFT073
gacuuacuuccugucuucccu

SEQ ID NO: 2663967 - RNA, 19 nt, Escherichia coli CFT073
gacuuauaagucucagaaa

SEQ ID NO: 2663968 - RNA, 13 nt, Escherichia coli CFT073
gacuuauucuuca

SEQ ID NO: 2663969 - RNA, 18 nt, Escherichia coli CFT073
gacuucaguggaaucauc

SEQ ID NO: 2663970 - RNA, 20 nt, Escherichia coli CFT073
gacuucaucggugacuucca

SEQ ID NO: 2663971 - RNA, 19 nt, Escherichia coli CFT073
gacuuccaccagcggcuga

SEQ ID NO: 2663972 - RNA, 13 nt, Escherichia coli CFT073
gacuuccacuucc

SEQ ID NO: 2663973 - RNA, 20 nt, Escherichia coli CFT073
gacuuccccacaaaauaacc

SEQ ID NO: 2663974 - RNA, 12 nt, Escherichia coli CFT073
gacuucccuccc

SEQ ID NO: 2663975 - RNA, 18 nt, Escherichia coli CFT073
gacuuccugagcucgugc

SEQ ID NO: 2663976 - RNA, 21 nt, Escherichia coli CFT073
gacuuccugcaaucuuuccug

SEQ ID NO: 2663977 - RNA, 22 nt, Escherichia coli CFT073
gacuuccugcaaucuuuccugc

SEQ ID NO: 2663978 - RNA, 17 nt, Escherichia coli CFT073
gacuucuucauucaucc

SEQ ID NO: 2663979 - RNA, 21 nt, Escherichia coli CFT073
gacuucuucauucauccgccg

SEQ ID NO: 2663980 - RNA, 20 nt, Escherichia coli CFT073
gacuugccagccaugagaca

SEQ ID NO: 2663981 - RNA, 22 nt, Escherichia coli CFT073
gacuugugcgcuuguucauaau

SEQ ID NO: 2663982 - RNA, 23 nt, Escherichia coli CFT073
gacuuguggcgcaggggcagaaa

SEQ ID NO: 2663983 - RNA, 20 nt, Escherichia coli CFT073
gacuuuacccggccacagaa

SEQ ID NO: 2663984 - RNA, 19 nt, Escherichia coli CFT073
gacuuuacuaauagcaaaa

SEQ ID NO: 2663985 - RNA, 16 nt, Escherichia coli CFT073
gagauuccgcuugccu

SEQ ID NO: 2663986 - RNA, 16 nt, Escherichia coli CFT073
gagauuugcuccagcg

SEQ ID NO: 2663987 - RNA, 17 nt, Escherichia coli CFT073
gagauuuuccggguucu

SEQ ID NO: 2663988 - RNA, 15 nt, Escherichia coli CFT073
gagcaaaaaucgaca

SEQ ID NO: 2663989 - RNA, 17 nt, Escherichia coli CFT073
gagcaaaagccuuaucc

SEQ ID NO: 2663990 - RNA, 16 nt, Escherichia coli CFT073
gagcaaaucgcggcuu

SEQ ID NO: 2663991 - RNA, 17 nt, Escherichia coli CFT073
gagcaagaaccccagcc

SEQ ID NO: 2663992 - RNA, 19 nt, Escherichia coli CFT073
gagcaagaaccccagccag

SEQ ID NO: 2663993 - RNA, 15 nt, Escherichia coli CFT073
gagcaaguaguccgc

SEQ ID NO: 2663994 - RNA, 13 nt, Escherichia coli CFT073
gagcaauaaacac

SEQ ID NO: 2663995 - RNA, 21 nt, Escherichia coli CFT073
gagcaaugaucucaauaguuc

SEQ ID NO: 2663996 - RNA, 13 nt, Escherichia coli CFT073
gagcaauuuccgg

SEQ ID NO: 2663997 - RNA, 15 nt, Escherichia coli CFT073
gagcacaucagcgcc

SEQ ID NO: 2663998 - RNA, 18 nt, Escherichia coli CFT073
gagcacaucagcgcccuc

SEQ ID NO: 2663999 - RNA, 20 nt, Escherichia coli CFT073
gagcaccgccucgcggaucu

SEQ ID NO: 2664000 - RNA, 21 nt, Escherichia coli CFT073
gagcacgaccuugccaagguc

SEQ ID NO: 2664001 - RNA, 22 nt, Escherichia coli CFT073
gagcacgacuuucucuucaucu

SEQ ID NO: 2664002 - RNA, 23 nt, Escherichia coli CFT073
gagcacgguuuugucggcaugau

SEQ ID NO: 2664003 - RNA, 17 nt, Escherichia coli CFT073
gagcacuaacaugacac

SEQ ID NO: 2664004 - RNA, 20 nt, Escherichia coli CFT073
gagcacuaacaugacaccaa

SEQ ID NO: 2664005 - RNA, 19 nt, Escherichia coli CFT073
gagcacugcgcccgccagc

SEQ ID NO: 2664006 - RNA, 21 nt, Escherichia coli CFT073
gagcacugcgcccgccagcau

SEQ ID NO: 2664007 - RNA, 21 nt, Escherichia coli CFT073
gagcagagaaacgccagcagc

SEQ ID NO: 2664008 - RNA, 17 nt, Escherichia coli CFT073
gagcagauacugaugaa

SEQ ID NO: 2664009 - RNA, 18 nt, Escherichia coli CFT073
gagcagcaaccacuugca

SEQ ID NO: 2664010 - RNA, 13 nt, Escherichia coli CFT073
gagcagcacaaug

SEQ ID NO: 2664011 - RNA, 19 nt, Escherichia coli CFT073
gagcagcauuccggcauuu

SEQ ID NO: 2664012 - RNA, 11 nt, Escherichia coli CFT073
gagcagcgcgc

SEQ ID NO: 2664013 - RNA, 12 nt, Escherichia coli CFT073
gagcagcgcgcu

SEQ ID NO: 2664014 - RNA, 13 nt, Escherichia coli CFT073
gagcagcggcguu

SEQ ID NO: 2664015 - RNA, 17 nt, Escherichia coli CFT073
gagcagcuguuucaucu

SEQ ID NO: 2664016 - RNA, 18 nt, Escherichia coli CFT073
gagcaguaauccagcaaa

SEQ ID NO: 2664017 - RNA, 14 nt, Escherichia coli CFT073
gagcaguauugaua

SEQ ID NO: 2664018 - RNA, 22 nt, Escherichia coli CFT073
gagcaguccaagaacuaguagc

SEQ ID NO: 2664019 - RNA, 17 nt, Escherichia coli CFT073
gagcaucacuauacucc

SEQ ID NO: 2664020 - RNA, 14 nt, Escherichia coli CFT073
gagcaucgcgagga

SEQ ID NO: 2664021 - RNA, 17 nt, Escherichia coli CFT073
gagcaucgguaucaucc

SEQ ID NO: 2664022 - RNA, 18 nt, Escherichia coli CFT073
gagcaugguaacgcccca

SEQ ID NO: 2664023 - RNA, 19 nt, Escherichia coli CFT073
gagcauucccgccaucguu

SEQ ID NO: 2664024 - RNA, 20 nt, Escherichia coli CFT073
gagccaguacagcccgccgg

SEQ ID NO: 2664025 - RNA, 21 nt, Escherichia coli CFT073
gagccaguucguugaucagca

SEQ ID NO: 2664026 - RNA, 22 nt, Escherichia coli CFT073
gagcccacuguuugaucugcug

SEQ ID NO: 2664027 - RNA, 22 nt, Escherichia coli CFT073
gagccgauaaagcgaccaacca

SEQ ID NO: 2664028 - RNA, 15 nt, Escherichia coli CFT073
gagccgcauccgaca

SEQ ID NO: 2664029 - RNA, 17 nt, Escherichia coli CFT073
gagccggaugccucucc

SEQ ID NO: 2664030 - RNA, 18 nt, Escherichia coli CFT073
gagccggauggcauacca

SEQ ID NO: 2664031 - RNA, 17 nt, Escherichia coli CFT073
gagccugaauaaacgcc

SEQ ID NO: 2664032 - RNA, 12 nt, Escherichia coli CFT073
gagccuggcugc

SEQ ID NO: 2664033 - RNA, 14 nt, Escherichia coli CFT073
gagcgaacaauaaa

SEQ ID NO: 2664034 - RNA, 21 nt, Escherichia coli CFT073
gagcgaauaaaccacaccgcc

SEQ ID NO: 2664035 - RNA, 18 nt, Escherichia coli CFT073
gagcgaauuaagaauuuc

SEQ ID NO: 2664036 - RNA, 16 nt, Escherichia coli CFT073
gagcgauccaacuaaa

SEQ ID NO: 2664037 - RNA, 18 nt, Escherichia coli CFT073
gagcgauuuguaggccug

SEQ ID NO: 2664038 - RNA, 16 nt, Escherichia coli CFT073
gagcgccagcauggca

SEQ ID NO: 2664039 - RNA, 13 nt, Escherichia coli CFT073
gagcgccagcgaa

SEQ ID NO: 2664040 - RNA, 19 nt, Escherichia coli CFT073
gagcgccguugcgcccauc

SEQ ID NO: 2664041 - RNA, 23 nt, Escherichia coli CFT073
gagcgccguugcgcccaucauca

SEQ ID NO: 2664042 - RNA, 19 nt, Escherichia coli CFT073
gagcgccugucugcaaaaa

SEQ ID NO: 2664043 - RNA, 17 nt, Escherichia coli CFT073
gagcgccuuauccggcc

SEQ ID NO: 2664044 - RNA, 10 nt, Escherichia coli CFT073
gagcggcagu

SEQ ID NO: 2664045 - RNA, 22 nt, Escherichia coli CFT073
gagcggccuucuucuuucagag

SEQ ID NO: 2664046 - RNA, 13 nt, Escherichia coli CFT073
gagcgguaaucug

SEQ ID NO: 2664047 - RNA, 23 nt, Escherichia coli CFT073
gagcgguuccagauauucauaga

SEQ ID NO: 2664048 - RNA, 19 nt, Escherichia coli CFT073
gagcgucauauagccgccu

SEQ ID NO: 2664049 - RNA, 16 nt, Escherichia coli CFT073
gagcgugagugcgaaa

SEQ ID NO: 2664050 - RNA, 20 nt, Escherichia coli CFT073
gagcguggcgauaaucagcg

SEQ ID NO: 2664051 - RNA, 15 nt, Escherichia coli CFT073
gagcguucaaaacgg

SEQ ID NO: 2664052 - RNA, 18 nt, Escherichia coli CFT073
gagcguuuuaucaggcau

SEQ ID NO: 2664053 - RNA, 15 nt, Escherichia coli CFT073
gagcuauuuaccagc

SEQ ID NO: 2664054 - RNA, 17 nt, Escherichia coli CFT073
gagcucaauauauuaaa

SEQ ID NO: 2664055 - RNA, 14 nt, Escherichia coli CFT073
gagcugagugcgaa

SEQ ID NO: 2664056 - RNA, 21 nt, Escherichia coli CFT073
gagcugcaacuggcggcggcg

SEQ ID NO: 2664057 - RNA, 21 nt, Escherichia coli CFT073
gagcugcagccaguugcucuu

SEQ ID NO: 2664058 - RNA, 15 nt, Escherichia coli CFT073
gagcugccaguugcg

SEQ ID NO: 2664059 - RNA, 16 nt, Escherichia coli CFT073
gagcugcguagacuuc

SEQ ID NO: 2664060 - RNA, 19 nt, Escherichia coli CFT073
gagcuggaaguuacucaaa

SEQ ID NO: 2664061 - RNA, 23 nt, Escherichia coli CFT073
gagcuuauauacucuaaauaauu

SEQ ID NO: 2664062 - RNA, 24 nt, Escherichia coli CFT073
gagcuuauauacucuaaauaauuc

SEQ ID NO: 2664063 - RNA, 14 nt, Escherichia coli CFT073
gagcuuauccagca

SEQ ID NO: 2664064 - RNA, 21 nt, Escherichia coli CFT073
gagcuucaauaucaucauccg

SEQ ID NO: 2664065 - RNA, 19 nt, Escherichia coli CFT073
gagcuucuucaaaaaaguc

SEQ ID NO: 2664066 - RNA, 22 nt, Escherichia coli CFT073
gagcuuuggcggccuucuucca

SEQ ID NO: 2664067 - RNA, 22 nt, Escherichia coli CFT073
gagcuuuugccaucucacuuug

SEQ ID NO: 2664068 - RNA, 23 nt, Escherichia coli CFT073
gagcuuuuuuaauguggcugggg

SEQ ID NO: 2664069 - RNA, 19 nt, Escherichia coli CFT073
gaggaacaauccucccuua

SEQ ID NO: 2664070 - RNA, 21 nt, Escherichia coli CFT073
gaggaagcgcaacagcgcgcc

SEQ ID NO: 2664071 - RNA, 21 nt, Escherichia coli CFT073
gaggaaggcacguacaugcag

SEQ ID NO: 2664072 - RNA, 22 nt, Escherichia coli CFT073
gaggaccgaauccuuauauaaa

SEQ ID NO: 2664073 - RNA, 22 nt, Escherichia coli CFT073
gaggacuauuuacagauuuccc

SEQ ID NO: 2664074 - RNA, 23 nt, Escherichia coli CFT073
gaggagagugcaaugaaaaaccg

SEQ ID NO: 2664075 - RNA, 21 nt, Escherichia coli CFT073
gaggaggacagccaggaaucc

SEQ ID NO: 2664076 - RNA, 18 nt, Escherichia coli CFT073
gaggaggcuauagcaggu

SEQ ID NO: 2664077 - RNA, 17 nt, Escherichia coli CFT073
gaggauacagccgaagc

SEQ ID NO: 2664078 - RNA, 12 nt, Escherichia coli CFT073
gaggaucaccag

SEQ ID NO: 2664079 - RNA, 17 nt, Escherichia coli CFT073
gaggaugaucugcgccc

SEQ ID NO: 2664080 - RNA, 21 nt, Escherichia coli CFT073
gaggauguuacaaccuccucc

SEQ ID NO: 2664081 - RNA, 23 nt, Escherichia coli CFT073
gaggauuaccggugucuuuuugc

SEQ ID NO: 2664082 - RNA, 18 nt, Escherichia coli CFT073
gaggauucgaaccucgga

SEQ ID NO: 2664083 - RNA, 23 nt, Escherichia coli CFT073
gaggauucgaaccucggaaugcc

SEQ ID NO: 2664084 - RNA, 16 nt, Escherichia coli CFT073
gaggcaaccagcacgc

SEQ ID NO: 2664085 - RNA, 15 nt, Escherichia coli CFT073
gaggcauagcguucg

SEQ ID NO: 2664086 - RNA, 17 nt, Escherichia coli CFT073
gaggccaauuuggcugc

SEQ ID NO: 2664087 - RNA, 18 nt, Escherichia coli CFT073
gaggccugauaaaacgcg

SEQ ID NO: 2664088 - RNA, 21 nt, Escherichia coli CFT073
gaggcgacaaacacuugcggc

SEQ ID NO: 2664089 - RNA, 13 nt, Escherichia coli CFT073
gaggcgccagcau

SEQ ID NO: 2664090 - RNA, 15 nt, Escherichia coli CFT073
gaggcguuucaacuc

SEQ ID NO: 2664091 - RNA, 18 nt, Escherichia coli CFT073
gaggcuuugccuccgcaa

SEQ ID NO: 2664092 - RNA, 12 nt, Escherichia coli CFT073
gauaacgcuggc

SEQ ID NO: 2664093 - RNA, 21 nt, Escherichia coli CFT073
gauaacucaaaaauaaucauc

SEQ ID NO: 2664094 - RNA, 20 nt, Escherichia coli CFT073
gauaagacagcgucacauca

SEQ ID NO: 2664095 - RNA, 13 nt, Escherichia coli CFT073
gauaagacauaac

SEQ ID NO: 2664096 - RNA, 16 nt, Escherichia coli CFT073
gauaagaccaauccag

SEQ ID NO: 2664097 - RNA, 21 nt, Escherichia coli CFT073
gauaagacgcgaacagcgucg

SEQ ID NO: 2664098 - RNA, 14 nt, Escherichia coli CFT073
gauaagacgcgcca

SEQ ID NO: 2664099 - RNA, 19 nt, Escherichia coli CFT073
gauaagacgcgucaagcgu

SEQ ID NO: 2664100 - RNA, 17 nt, Escherichia coli CFT073
gauaagacgcguuaagc

SEQ ID NO: 2664101 - RNA, 18 nt, Escherichia coli CFT073
gauaagacgcguuaagcg

SEQ ID NO: 2664102 - RNA, 18 nt, Escherichia coli CFT073
gauaagaugcguuaagcg

SEQ ID NO: 2664103 - RNA, 16 nt, Escherichia coli CFT073
gauaagcaacaaacuc

SEQ ID NO: 2664104 - RNA, 21 nt, Escherichia coli CFT073
gauaagcaggagugcgaauac

SEQ ID NO: 2664105 - RNA, 22 nt, Escherichia coli CFT073
gauaagccagcaaccaacgcua

SEQ ID NO: 2664106 - RNA, 15 nt, Escherichia coli CFT073
gauaagccccaguuc

SEQ ID NO: 2664107 - RNA, 20 nt, Escherichia coli CFT073
gauaagcguagcgcagcagg

SEQ ID NO: 2664108 - RNA, 19 nt, Escherichia coli CFT073
gauaagcguagcgcaucag

SEQ ID NO: 2664109 - RNA, 19 nt, Escherichia coli CFT073
gauaagcuugcgcaucggg

SEQ ID NO: 2664110 - RNA, 18 nt, Escherichia coli CFT073
gauaaggcaacgccccuu

SEQ ID NO: 2664111 - RNA, 21 nt, Escherichia coli CFT073
gauaaggccaccagcggcacc

SEQ ID NO: 2664112 - RNA, 20 nt, Escherichia coli CFT073
gauaaggcgcucgcgccgca

SEQ ID NO: 2664113 - RNA, 20 nt, Escherichia coli CFT073
gauaaggcguuaacgccgca

SEQ ID NO: 2664114 - RNA, 20 nt, Escherichia coli CFT073
gauaaggcguucacgccgca

SEQ ID NO: 2664115 - RNA, 20 nt, Escherichia coli CFT073
gauaaggcguucgcgccgca

SEQ ID NO: 2664116 - RNA, 20 nt, Escherichia coli CFT073
gauaaggcguuuacgccgca

SEQ ID NO: 2664117 - RNA, 18 nt, Escherichia coli CFT073
gauaagguauagucacaa

SEQ ID NO: 2664118 - RNA, 16 nt, Escherichia coli CFT073
gauaaggucacgcccc

SEQ ID NO: 2664119 - RNA, 14 nt, Escherichia coli CFT073
gauaaggugucaau

SEQ ID NO: 2664120 - RNA, 19 nt, Escherichia coli CFT073
gauaaggugucaauccuuc

SEQ ID NO: 2664121 - RNA, 20 nt, Escherichia coli CFT073
gauaagguguucacgccgca

SEQ ID NO: 2664122 - RNA, 15 nt, Escherichia coli CFT073
gauaaguaaucauaa

SEQ ID NO: 2664123 - RNA, 14 nt, Escherichia coli CFT073
gauaagucacuaau

SEQ ID NO: 2664124 - RNA, 17 nt, Escherichia coli CFT073
gauaauaaaaaaggcac

SEQ ID NO: 2664125 - RNA, 17 nt, Escherichia coli CFT073
gauaauaaaaagaauga

SEQ ID NO: 2664126 - RNA, 11 nt, Escherichia coli CFT073
gauaauaacgu

SEQ ID NO: 2664127 - RNA, 14 nt, Escherichia coli CFT073
gauaauaacgucgc

SEQ ID NO: 2664128 - RNA, 15 nt, Escherichia coli CFT073
gauaauaauguguuc

SEQ ID NO: 2664129 - RNA, 15 nt, Escherichia coli CFT073
gauaauacccagcaa

SEQ ID NO: 2664130 - RNA, 18 nt, Escherichia coli CFT073
gauaauacgucggcauca

SEQ ID NO: 2664131 - RNA, 19 nt, Escherichia coli CFT073
gauaauagguaaacauccg

SEQ ID NO: 2664132 - RNA, 16 nt, Escherichia coli CFT073
gauaaucaacgcgccg

SEQ ID NO: 2664133 - RNA, 22 nt, Escherichia coli CFT073
gauaaucagaucguugaccugg

SEQ ID NO: 2664134 - RNA, 20 nt, Escherichia coli CFT073
gauaaucggugcggcaaugc

SEQ ID NO: 2664135 - RNA, 18 nt, Escherichia coli CFT073
gauaaucuucaaauaaac

SEQ ID NO: 2664136 - RNA, 13 nt, Escherichia coli CFT073
gauaaugacuucc

SEQ ID NO: 2664137 - RNA, 13 nt, Escherichia coli CFT073
gauaauggcuguu

SEQ ID NO: 2664138 - RNA, 16 nt, Escherichia coli CFT073
gauaauggcuuccagu

SEQ ID NO: 2664139 - RNA, 11 nt, Escherichia coli CFT073
gauaauguccg

SEQ ID NO: 2664140 - RNA, 20 nt, Escherichia coli CFT073
gauaaugugccgaauccaau

SEQ ID NO: 2664141 - RNA, 18 nt, Escherichia coli CFT073
gauaauuaugagcaagag

SEQ ID NO: 2664142 - RNA, 15 nt, Escherichia coli CFT073
gauaauucaacagau

SEQ ID NO: 2664143 - RNA, 16 nt, Escherichia coli CFT073
gauaauucucaucauc

SEQ ID NO: 2664144 - RNA, 15 nt, Escherichia coli CFT073
gauaauuuucagacc

SEQ ID NO: 2664145 - RNA, 13 nt, Escherichia coli CFT073
gauaauuuugaaa

SEQ ID NO: 2664146 - RNA, 15 nt, Escherichia coli CFT073
gauacaaaagcaccg

SEQ ID NO: 2664147 - RNA, 22 nt, Escherichia coli CFT073
gauacaacucgcuuaagccauc

SEQ ID NO: 2664148 - RNA, 11 nt, Escherichia coli CFT073
gauacacgaaa

SEQ ID NO: 2664149 - RNA, 18 nt, Escherichia coli CFT073
gauacacggugcuccagu

SEQ ID NO: 2664150 - RNA, 21 nt, Escherichia coli CFT073
gauacagaugccgcuauccgc

SEQ ID NO: 2664151 - RNA, 19 nt, Escherichia coli CFT073
gauacagccaaaucaucag

SEQ ID NO: 2664152 - RNA, 21 nt, Escherichia coli CFT073
gauacaggaaaccggcgaaaa

SEQ ID NO: 2664153 - RNA, 18 nt, Escherichia coli CFT073
gauacaggccaccaggcc

SEQ ID NO: 2664154 - RNA, 16 nt, Escherichia coli CFT073
gauacaugauccggca

SEQ ID NO: 2664155 - RNA, 13 nt, Escherichia coli CFT073
gauacauugccac

SEQ ID NO: 2664156 - RNA, 12 nt, Escherichia coli CFT073
gauaccaacgca

SEQ ID NO: 2664157 - RNA, 16 nt, Escherichia coli CFT073
gauaccacaucaaccc

SEQ ID NO: 2664158 - RNA, 23 nt, Escherichia coli CFT073
gauaccccagcuggcgccaggcu

SEQ ID NO: 2664159 - RNA, 19 nt, Escherichia coli CFT073
gauaccccgcaucguggcc

SEQ ID NO: 2664160 - RNA, 23 nt, Escherichia coli CFT073
gauacccuuuuugauucaccacc

SEQ ID NO: 2664161 - RNA, 18 nt, Escherichia coli CFT073
gauaccgccgcacaauac

SEQ ID NO: 2664162 - RNA, 20 nt, Escherichia coli CFT073
gauaccgcguuggcgcagca

SEQ ID NO: 2664163 - RNA, 14 nt, Escherichia coli CFT073
gauaccugauuaaa

SEQ ID NO: 2664164 - RNA, 15 nt, Escherichia coli CFT073
gauacgcauaaacau

SEQ ID NO: 2664165 - RNA, 19 nt, Escherichia coli CFT073
gauacgcauagcggcucac

SEQ ID NO: 2664166 - RNA, 15 nt, Escherichia coli CFT073
gauacgcgcaccgga

SEQ ID NO: 2664167 - RNA, 18 nt, Escherichia coli CFT073
gauacgcuggcgaucaug

SEQ ID NO: 2664168 - RNA, 15 nt, Escherichia coli CFT073
gauacgcuucaacca

SEQ ID NO: 2664169 - RNA, 17 nt, Escherichia coli CFT073
gauacgcuuuauccagc

SEQ ID NO: 2664170 - RNA, 20 nt, Escherichia coli CFT073
gauacggaauaucgcuggcc

SEQ ID NO: 2664171 - RNA, 23 nt, Escherichia coli CFT073
gauacggcgaucguucgccaucc

SEQ ID NO: 2664172 - RNA, 20 nt, Escherichia coli CFT073
gauacggcgcaaacggcgga

SEQ ID NO: 2664173 - RNA, 22 nt, Escherichia coli CFT073
gauacggcggacgugcaccguc

SEQ ID NO: 2664174 - RNA, 15 nt, Escherichia coli CFT073
gauacggucaggaua

SEQ ID NO: 2664175 - RNA, 18 nt, Escherichia coli CFT073
gauacuacguucgaucac

SEQ ID NO: 2664176 - RNA, 13 nt, Escherichia coli CFT073
gauacuauucauu

SEQ ID NO: 2664177 - RNA, 17 nt, Escherichia coli CFT073
gauacucaacucacaca

SEQ ID NO: 2664178 - RNA, 13 nt, Escherichia coli CFT073
gauacucaagcaa

SEQ ID NO: 2664179 - RNA, 21 nt, Escherichia coli CFT073
gauacucauuguuaucagcaa

SEQ ID NO: 2664180 - RNA, 21 nt, Escherichia coli CFT073
gauacuccacgcuaugugcuu

SEQ ID NO: 2664181 - RNA, 15 nt, Escherichia coli CFT073
gauacucgccgaacc

SEQ ID NO: 2664182 - RNA, 21 nt, Escherichia coli CFT073
gauacugaccuuaccaaugcu

SEQ ID NO: 2664183 - RNA, 22 nt, Escherichia coli CFT073
gauacugaccuuaccaaugcug

SEQ ID NO: 2664184 - RNA, 21 nt, Escherichia coli CFT073
gauacuggaagugaucuuuca

SEQ ID NO: 2664185 - RNA, 22 nt, Escherichia coli CFT073
gauacuggcguuacccagcgcc

SEQ ID NO: 2664186 - RNA, 16 nt, Escherichia coli CFT073
gauacuuaucaucaug

SEQ ID NO: 2664187 - RNA, 19 nt, Escherichia coli CFT073
gauagaaccacgcaaaggc

SEQ ID NO: 2664188 - RNA, 23 nt, Escherichia coli CFT073
gauagaauagccuuuagcgagcg

SEQ ID NO: 2664189 - RNA, 16 nt, Escherichia coli CFT073
gauagacacugccgcc

SEQ ID NO: 2664190 - RNA, 19 nt, Escherichia coli CFT073
gauagacuguugaaauaca

SEQ ID NO: 2664191 - RNA, 17 nt, Escherichia coli CFT073
gauagagagcagucagg

SEQ ID NO: 2664192 - RNA, 13 nt, Escherichia coli CFT073
gauagcaaugcca

SEQ ID NO: 2664193 - RNA, 21 nt, Escherichia coli CFT073
gauagccagguuuaccagcag

SEQ ID NO: 2664194 - RNA, 15 nt, Escherichia coli CFT073
gauagcccaacgauc

SEQ ID NO: 2664195 - RNA, 22 nt, Escherichia coli CFT073
gauagcccaacgaucccaacug

SEQ ID NO: 2664196 - RNA, 15 nt, Escherichia coli CFT073
gauagccgaccgcaa

SEQ ID NO: 2664197 - RNA, 15 nt, Escherichia coli CFT073
gauagcgcgccagcc

SEQ ID NO: 2664198 - RNA, 22 nt, Escherichia coli CFT073
gauagcuaacugccuccugcaa

SEQ ID NO: 2664199 - RNA, 15 nt, Escherichia coli CFT073
gauaggcaucagcaa

SEQ ID NO: 2664200 - RNA, 22 nt, Escherichia coli CFT073
gaucagcggcggcgcaaccauc

SEQ ID NO: 2664201 - RNA, 13 nt, Escherichia coli CFT073
gaucagcgguggu

SEQ ID NO: 2664202 - RNA, 15 nt, Escherichia coli CFT073
gaucagcggugguga

SEQ ID NO: 2664203 - RNA, 13 nt, Escherichia coli CFT073
gaucagcgguuuu

SEQ ID NO: 2664204 - RNA, 23 nt, Escherichia coli CFT073
gaucagcgguuuugccagcgaga

SEQ ID NO: 2664205 - RNA, 14 nt, Escherichia coli CFT073
gaucagcgucaguu

SEQ ID NO: 2664206 - RNA, 23 nt, Escherichia coli CFT073
gaucagcgucgccaauggaauag

SEQ ID NO: 2664207 - RNA, 16 nt, Escherichia coli CFT073
gaucagcguuucuucc

SEQ ID NO: 2664208 - RNA, 15 nt, Escherichia coli CFT073
gaucaggcagugaau

SEQ ID NO: 2664209 - RNA, 15 nt, Escherichia coli CFT073
gaucaggugauggca

SEQ ID NO: 2664210 - RNA, 17 nt, Escherichia coli CFT073
gaucaggugauggcagc

SEQ ID NO: 2664211 - RNA, 14 nt, Escherichia coli CFT073
gaucaguaccagcc

SEQ ID NO: 2664212 - RNA, 22 nt, Escherichia coli CFT073
gaucaguuggcagagauucuuc

SEQ ID NO: 2664213 - RNA, 16 nt, Escherichia coli CFT073
gaucaucaccaggcca

SEQ ID NO: 2664214 - RNA, 23 nt, Escherichia coli CFT073
gaucaucaccgacggauuauuca

SEQ ID NO: 2664215 - RNA, 21 nt, Escherichia coli CFT073
gaucaucaucgcgauccccca

SEQ ID NO: 2664216 - RNA, 22 nt, Escherichia coli CFT073
gaucaucaucgcgaucccccag

SEQ ID NO: 2664217 - RNA, 13 nt, Escherichia coli CFT073
gaucauccacgac

SEQ ID NO: 2664218 - RNA, 16 nt, Escherichia coli CFT073
gaucaucucaacaaac

SEQ ID NO: 2664219 - RNA, 14 nt, Escherichia coli CFT073
gaucaugauaaaua

SEQ ID NO: 2664220 - RNA, 18 nt, Escherichia coli CFT073
gaucaugaugaugccaaa

SEQ ID NO: 2664221 - RNA, 19 nt, Escherichia coli CFT073
gaucaugccgacaaacagc

SEQ ID NO: 2664222 - RNA, 20 nt, Escherichia coli CFT073
gaucaugccgacaaacagcg

SEQ ID NO: 2664223 - RNA, 14 nt, Escherichia coli CFT073
gaucauggcucaga

SEQ ID NO: 2664224 - RNA, 17 nt, Escherichia coli CFT073
gaucaugguagcgugau

SEQ ID NO: 2664225 - RNA, 21 nt, Escherichia coli CFT073
gaucaugguagcgugauggcc

SEQ ID NO: 2664226 - RNA, 18 nt, Escherichia coli CFT073
gaucauguaguaaugcuu

SEQ ID NO: 2664227 - RNA, 13 nt, Escherichia coli CFT073
gaucauuaaccag

SEQ ID NO: 2664228 - RNA, 16 nt, Escherichia coli CFT073
gaucauucaccagccc

SEQ ID NO: 2664229 - RNA, 18 nt, Escherichia coli CFT073
gaucauuccgcccagacc

SEQ ID NO: 2664230 - RNA, 13 nt, Escherichia coli CFT073
gaucauuuccggu

SEQ ID NO: 2664231 - RNA, 18 nt, Escherichia coli CFT073
gaucauuuucaugcuguu

SEQ ID NO: 2664232 - RNA, 18 nt, Escherichia coli CFT073
gauccaaaccgacugccu

SEQ ID NO: 2664233 - RNA, 19 nt, Escherichia coli CFT073
gauccacgcucgcuggcgu

SEQ ID NO: 2664234 - RNA, 20 nt, Escherichia coli CFT073
gauccagcauucccgccacc

SEQ ID NO: 2664235 - RNA, 21 nt, Escherichia coli CFT073
gauccagcauucccgccacca

SEQ ID NO: 2664236 - RNA, 15 nt, Escherichia coli CFT073
gauccagcgcaauac

SEQ ID NO: 2664237 - RNA, 15 nt, Escherichia coli CFT073
gauccagcgguugga

SEQ ID NO: 2664238 - RNA, 16 nt, Escherichia coli CFT073
gauccagcucuuccuc

SEQ ID NO: 2664239 - RNA, 16 nt, Escherichia coli CFT073
gauccauacucuuucc

SEQ ID NO: 2664240 - RNA, 23 nt, Escherichia coli CFT073
gaucccacggcggugucgccaga

SEQ ID NO: 2664241 - RNA, 12 nt, Escherichia coli CFT073
gaucccagaacc

SEQ ID NO: 2664242 - RNA, 16 nt, Escherichia coli CFT073
gaucccagaaccaguu

SEQ ID NO: 2664243 - RNA, 17 nt, Escherichia coli CFT073
gaucccagcgccugcag

SEQ ID NO: 2664244 - RNA, 16 nt, Escherichia coli CFT073
gauccccgcaagcccc

SEQ ID NO: 2664245 - RNA, 16 nt, Escherichia coli CFT073
gaucccgccaucgcgg

SEQ ID NO: 2664246 - RNA, 17 nt, Escherichia coli CFT073
gaucccggcuuccugca

SEQ ID NO: 2664247 - RNA, 19 nt, Escherichia coli CFT073
gaucccggcuuccugcagc

SEQ ID NO: 2664248 - RNA, 19 nt, Escherichia coli CFT073
gaucccuaacuggcgggcg

SEQ ID NO: 2664249 - RNA, 17 nt, Escherichia coli CFT073
gaucccuucgccgccgc

SEQ ID NO: 2664250 - RNA, 18 nt, Escherichia coli CFT073
gaucccuucgccgccgcu

SEQ ID NO: 2664251 - RNA, 22 nt, Escherichia coli CFT073
gaucccuucgcuggcaaagccg

SEQ ID NO: 2664252 - RNA, 22 nt, Escherichia coli CFT073
gauccgcgucauugacgcuggc

SEQ ID NO: 2664253 - RNA, 17 nt, Escherichia coli CFT073
gauccgcuuuacgcagu

SEQ ID NO: 2664254 - RNA, 20 nt, Escherichia coli CFT073
gauccgcuuuacgcaguugu

SEQ ID NO: 2664255 - RNA, 23 nt, Escherichia coli CFT073
gauccggauggauccccgcagca

SEQ ID NO: 2664256 - RNA, 18 nt, Escherichia coli CFT073
gauccgggcauauuuccg

SEQ ID NO: 2664257 - RNA, 17 nt, Escherichia coli CFT073
gauccgguucgccaugu

SEQ ID NO: 2664258 - RNA, 12 nt, Escherichia coli CFT073
gauccugaaauu

SEQ ID NO: 2664259 - RNA, 17 nt, Escherichia coli CFT073
gauccugaaauuccuga

SEQ ID NO: 2664260 - RNA, 24 nt, Escherichia coli CFT073
gauccugagcaaacagucgcccga

SEQ ID NO: 2664261 - RNA, 22 nt, Escherichia coli CFT073
gauccugagcuaacgcgguggu

SEQ ID NO: 2664262 - RNA, 21 nt, Escherichia coli CFT073
gauccugauacagaccgcgca

SEQ ID NO: 2664263 - RNA, 14 nt, Escherichia coli CFT073
gauccugcaacaac

SEQ ID NO: 2664264 - RNA, 15 nt, Escherichia coli CFT073
gauccugcaacaaca

SEQ ID NO: 2664265 - RNA, 22 nt, Escherichia coli CFT073
gauccuggucaaagugggcgac

SEQ ID NO: 2664266 - RNA, 12 nt, Escherichia coli CFT073
gaucgaccgguu

SEQ ID NO: 2664267 - RNA, 17 nt, Escherichia coli CFT073
gaucgaccgguucgccu

SEQ ID NO: 2664268 - RNA, 17 nt, Escherichia coli CFT073
gaucgacgugggcgugg

SEQ ID NO: 2664269 - RNA, 20 nt, Escherichia coli CFT073
gaucgagauugaucccggcu

SEQ ID NO: 2664270 - RNA, 12 nt, Escherichia coli CFT073
gaucgaggccau

SEQ ID NO: 2664271 - RNA, 13 nt, Escherichia coli CFT073
gaucgauaagcca

SEQ ID NO: 2664272 - RNA, 18 nt, Escherichia coli CFT073
gaucgauauucaccguca

SEQ ID NO: 2664273 - RNA, 13 nt, Escherichia coli CFT073
gaucgaugccaaa

SEQ ID NO: 2664274 - RNA, 14 nt, Escherichia coli CFT073
gaucgaugccaaag

SEQ ID NO: 2664275 - RNA, 20 nt, Escherichia coli CFT073
gaucgcacaugucaguugca

SEQ ID NO: 2664276 - RNA, 21 nt, Escherichia coli CFT073
gaucgccacuuucacgccgcc

SEQ ID NO: 2664277 - RNA, 20 nt, Escherichia coli CFT073
gaucgccccggaagcaucaa

SEQ ID NO: 2664278 - RNA, 17 nt, Escherichia coli CFT073
gaucgcccggcaccagc

SEQ ID NO: 2664279 - RNA, 20 nt, Escherichia coli CFT073
gaucgcccggcaccagcacc

SEQ ID NO: 2664280 - RNA, 15 nt, Escherichia coli CFT073
gaucgcccuuuuuug

SEQ ID NO: 2664281 - RNA, 12 nt, Escherichia coli CFT073
gaucgcgaaacc

SEQ ID NO: 2664282 - RNA, 15 nt, Escherichia coli CFT073
gaucgcgaccgccuu

SEQ ID NO: 2664283 - RNA, 20 nt, Escherichia coli CFT073
gaucgcgaccgccuucaguc

SEQ ID NO: 2664284 - RNA, 22 nt, Escherichia coli CFT073
gaucgcgauauuccagaccuac

SEQ ID NO: 2664285 - RNA, 18 nt, Escherichia coli CFT073
gaucgcgcaaacagugac

SEQ ID NO: 2664286 - RNA, 22 nt, Escherichia coli CFT073
gaucgcgccaaucagcgcagca

SEQ ID NO: 2664287 - RNA, 22 nt, Escherichia coli CFT073
gaucgcgcucaauguugcugcu

SEQ ID NO: 2664288 - RNA, 19 nt, Escherichia coli CFT073
gaucgcguucccgaccaau

SEQ ID NO: 2664289 - RNA, 19 nt, Escherichia coli CFT073
gaucgcucaucugcugcgu

SEQ ID NO: 2664290 - RNA, 23 nt, Escherichia coli CFT073
gaucgcuuccauugccugcaacg

SEQ ID NO: 2664291 - RNA, 13 nt, Escherichia coli CFT073
gaucgcuuucgcu

SEQ ID NO: 2664292 - RNA, 20 nt, Escherichia coli CFT073
gaucgcuuucgcuuucucuu

SEQ ID NO: 2664293 - RNA, 17 nt, Escherichia coli CFT073
gaucggagccaaaauca

SEQ ID NO: 2664294 - RNA, 18 nt, Escherichia coli CFT073
gaucggcguacuggcaau

SEQ ID NO: 2664295 - RNA, 22 nt, Escherichia coli CFT073
gaucggcguacuggcaaucgcc

SEQ ID NO: 2664296 - RNA, 15 nt, Escherichia coli CFT073
cuuccaggguaaaca

SEQ ID NO: 2664297 - RNA, 22 nt, Escherichia coli CFT073
cuuccaguaaccagccguuaug

SEQ ID NO: 2664298 - RNA, 21 nt, Escherichia coli CFT073
cuuccaguugccgacgcuccu

SEQ ID NO: 2664299 - RNA, 24 nt, Escherichia coli CFT073
cuuccaguugccgacgcuccugau

SEQ ID NO: 2664300 - RNA, 23 nt, Escherichia coli CFT073
cuuccauacggcguuaacuuguu

SEQ ID NO: 2664301 - RNA, 19 nt, Escherichia coli CFT073
cuuccaucgcaucuucgcc

SEQ ID NO: 2664302 - RNA, 20 nt, Escherichia coli CFT073
cuuccaucuuaauacgcugg

SEQ ID NO: 2664303 - RNA, 23 nt, Escherichia coli CFT073
cuuccauucuccgcucuucaucu

SEQ ID NO: 2664304 - RNA, 15 nt, Escherichia coli CFT073
cuucccagauaaauc

SEQ ID NO: 2664305 - RNA, 23 nt, Escherichia coli CFT073
cuucccauacccaccaauuaauc

SEQ ID NO: 2664306 - RNA, 15 nt, Escherichia coli CFT073
cuucccaugucagac

SEQ ID NO: 2664307 - RNA, 15 nt, Escherichia coli CFT073
cuucccccaccacca

SEQ ID NO: 2664308 - RNA, 19 nt, Escherichia coli CFT073
cuucccccugagcgguggc

SEQ ID NO: 2664309 - RNA, 22 nt, Escherichia coli CFT073
cuuccccucauuaagccacggu

SEQ ID NO: 2664310 - RNA, 17 nt, Escherichia coli CFT073
cuucccgauaagggagc

SEQ ID NO: 2664311 - RNA, 15 nt, Escherichia coli CFT073
cuucccgcagccacg

SEQ ID NO: 2664312 - RNA, 21 nt, Escherichia coli CFT073
cuucccgggucgcgacugcca

SEQ ID NO: 2664313 - RNA, 16 nt, Escherichia coli CFT073
cuucccuauccggaaa

SEQ ID NO: 2664314 - RNA, 20 nt, Escherichia coli CFT073
cuucccugcaguaaagcccg

SEQ ID NO: 2664315 - RNA, 20 nt, Escherichia coli CFT073
cuuccgaccgcccuuuuucu

SEQ ID NO: 2664316 - RNA, 17 nt, Escherichia coli CFT073
cuuccgcaauacagcca

SEQ ID NO: 2664317 - RNA, 18 nt, Escherichia coli CFT073
cuuccgcaauacagccag

SEQ ID NO: 2664318 - RNA, 21 nt, Escherichia coli CFT073
cuuccgcaauacagccagcca

SEQ ID NO: 2664319 - RNA, 21 nt, Escherichia coli CFT073
cuuccgcagaguaaugcgacg

SEQ ID NO: 2664320 - RNA, 18 nt, Escherichia coli CFT073
cuuccgccaucaaucgac

SEQ ID NO: 2664321 - RNA, 18 nt, Escherichia coli CFT073
cuuccggcaagauuugca

SEQ ID NO: 2664322 - RNA, 12 nt, Escherichia coli CFT073
cuuccggcagca

SEQ ID NO: 2664323 - RNA, 15 nt, Escherichia coli CFT073
cuuccggcagcuuca

SEQ ID NO: 2664324 - RNA, 15 nt, Escherichia coli CFT073
cuuccggcguggcgu

SEQ ID NO: 2664325 - RNA, 20 nt, Escherichia coli CFT073
cuuccggcuacgccaccagc

SEQ ID NO: 2664326 - RNA, 16 nt, Escherichia coli CFT073
cuuccggcuguagccc

SEQ ID NO: 2664327 - RNA, 21 nt, Escherichia coli CFT073
cuuccggguagcgcggcagcg

SEQ ID NO: 2664328 - RNA, 16 nt, Escherichia coli CFT073
cuuccggguuuucucc

SEQ ID NO: 2664329 - RNA, 13 nt, Escherichia coli CFT073
cuuccgguacacg

SEQ ID NO: 2664330 - RNA, 15 nt, Escherichia coli CFT073
cuuccggugcgauca

SEQ ID NO: 2664331 - RNA, 23 nt, Escherichia coli CFT073
cuuccgugguuugcgcauucaga

SEQ ID NO: 2664332 - RNA, 22 nt, Escherichia coli CFT073
cuuccucaugcggcgcgcccca

SEQ ID NO: 2664333 - RNA, 14 nt, Escherichia coli CFT073
cuuccuccaccacu

SEQ ID NO: 2664334 - RNA, 12 nt, Escherichia coli CFT073
cuuccucgccag

SEQ ID NO: 2664335 - RNA, 12 nt, Escherichia coli CFT073
cuuccucgcucu

SEQ ID NO: 2664336 - RNA, 23 nt, Escherichia coli CFT073
cuuccucguuucgcccugccuuu

SEQ ID NO: 2664337 - RNA, 16 nt, Escherichia coli CFT073
cuuccugaaucgccga

SEQ ID NO: 2664338 - RNA, 18 nt, Escherichia coli CFT073
cuuccugauaaccuucca

SEQ ID NO: 2664339 - RNA, 21 nt, Escherichia coli CFT073
cuuccugauaaccuuccagcu

SEQ ID NO: 2664340 - RNA, 22 nt, Escherichia coli CFT073
cuuccugauaaccuuccagcuu

SEQ ID NO: 2664341 - RNA, 23 nt, Escherichia coli CFT073
cuuccugccucuuugccgcuuuu

SEQ ID NO: 2664342 - RNA, 19 nt, Escherichia coli CFT073
cuuccugcggcagacgcuc

SEQ ID NO: 2664343 - RNA, 18 nt, Escherichia coli CFT073
cuuccugucuucccugcu

SEQ ID NO: 2664344 - RNA, 15 nt, Escherichia coli CFT073
cuuccuuaagcacaa

SEQ ID NO: 2664345 - RNA, 18 nt, Escherichia coli CFT073
cuuccuugcguacaccaa

SEQ ID NO: 2664346 - RNA, 15 nt, Escherichia coli CFT073
cuuccuugcugauuu

SEQ ID NO: 2664347 - RNA, 14 nt, Escherichia coli CFT073
cuucgaagaaaaac

SEQ ID NO: 2664348 - RNA, 22 nt, Escherichia coli CFT073
cuucgaauagagccuggcugcg

SEQ ID NO: 2664349 - RNA, 22 nt, Escherichia coli CFT073
cuucgacuuucaguggcuuauc

SEQ ID NO: 2664350 - RNA, 19 nt, Escherichia coli CFT073
cuucgagaauaucuucgac

SEQ ID NO: 2664351 - RNA, 13 nt, Escherichia coli CFT073
cuucgagcggggg

SEQ ID NO: 2664352 - RNA, 16 nt, Escherichia coli CFT073
cuucgaguacauccac

SEQ ID NO: 2664353 - RNA, 14 nt, Escherichia coli CFT073
cuucgauacugccu

SEQ ID NO: 2664354 - RNA, 13 nt, Escherichia coli CFT073
cuucgauccagug

SEQ ID NO: 2664355 - RNA, 18 nt, Escherichia coli CFT073
cuucgauggcugggguac

SEQ ID NO: 2664356 - RNA, 18 nt, Escherichia coli CFT073
cuucgaugguuggaauug

SEQ ID NO: 2664357 - RNA, 13 nt, Escherichia coli CFT073
cuucgauucccag

SEQ ID NO: 2664358 - RNA, 16 nt, Escherichia coli CFT073
cuucgauucccagcuu

SEQ ID NO: 2664359 - RNA, 13 nt, Escherichia coli CFT073
cuucgcaaaaaac

SEQ ID NO: 2664360 - RNA, 14 nt, Escherichia coli CFT073
cuucgcaaacaccc

SEQ ID NO: 2664361 - RNA, 17 nt, Escherichia coli CFT073
cuucgcaucccgguauc

SEQ ID NO: 2664362 - RNA, 14 nt, Escherichia coli CFT073
cuucgccaaaucgu

SEQ ID NO: 2664363 - RNA, 18 nt, Escherichia coli CFT073
cuucgccaaugaucccgc

SEQ ID NO: 2664364 - RNA, 20 nt, Escherichia coli CFT073
cuucgccaaugaucccgcca

SEQ ID NO: 2664365 - RNA, 17 nt, Escherichia coli CFT073
cuucgccacagcggcau

SEQ ID NO: 2664366 - RNA, 18 nt, Escherichia coli CFT073
cuucgccacagcggcauc

SEQ ID NO: 2664367 - RNA, 23 nt, Escherichia coli CFT073
cuucgccacuuuaugauccagcu

SEQ ID NO: 2664368 - RNA, 14 nt, Escherichia coli CFT073
cuucgccagacguu

SEQ ID NO: 2664369 - RNA, 13 nt, Escherichia coli CFT073
cuucgccagcgcg

SEQ ID NO: 2664370 - RNA, 16 nt, Escherichia coli CFT073
cuucgccagcgugacu

SEQ ID NO: 2664371 - RNA, 11 nt, Escherichia coli CFT073
cuucgccaggu

SEQ ID NO: 2664372 - RNA, 15 nt, Escherichia coli CFT073
cuucgccgcaucguc

SEQ ID NO: 2664373 - RNA, 15 nt, Escherichia coli CFT073
cuucgccugaaacag

SEQ ID NO: 2664374 - RNA, 18 nt, Escherichia coli CFT073
cuucgccugaaacagaag

SEQ ID NO: 2664375 - RNA, 14 nt, Escherichia coli CFT073
cuucgccuuucagu

SEQ ID NO: 2664376 - RNA, 17 nt, Escherichia coli CFT073
cuucgcgccauccagcu

SEQ ID NO: 2664377 - RNA, 16 nt, Escherichia coli CFT073
cuucgcggaauuucag

SEQ ID NO: 2664378 - RNA, 13 nt, Escherichia coli CFT073
cuucgcggcuguu

SEQ ID NO: 2664379 - RNA, 20 nt, Escherichia coli CFT073
cuucgcugacgccugccagc

SEQ ID NO: 2664380 - RNA, 13 nt, Escherichia coli CFT073
cuucgcugauuua

SEQ ID NO: 2664381 - RNA, 21 nt, Escherichia coli CFT073
cuucgcuucaccgacaucuuu

SEQ ID NO: 2664382 - RNA, 22 nt, Escherichia coli CFT073
cuucggaauaguucuggucugg

SEQ ID NO: 2664383 - RNA, 17 nt, Escherichia coli CFT073
cuucggcagucacuuuu

SEQ ID NO: 2664384 - RNA, 22 nt, Escherichia coli CFT073
cuucggcaucacgaauccgcac

SEQ ID NO: 2664385 - RNA, 14 nt, Escherichia coli CFT073
cuucggcaucuuuu

SEQ ID NO: 2664386 - RNA, 22 nt, Escherichia coli CFT073
cuucggcgccuuuuucgcuugu

SEQ ID NO: 2664387 - RNA, 13 nt, Escherichia coli CFT073
cuucggcgggcag

SEQ ID NO: 2664388 - RNA, 16 nt, Escherichia coli CFT073
cuucggcuuucauuuc

SEQ ID NO: 2664389 - RNA, 18 nt, Escherichia coli CFT073
cuucgggcgcuuccagcc

SEQ ID NO: 2664390 - RNA, 19 nt, Escherichia coli CFT073
cuucgggcuggcauuuuuu

SEQ ID NO: 2664391 - RNA, 14 nt, Escherichia coli CFT073
cuucggucagcacg

SEQ ID NO: 2664392 - RNA, 15 nt, Escherichia coli CFT073
cuucggucagcacgc

SEQ ID NO: 2664393 - RNA, 17 nt, Escherichia coli CFT073
cuucggugcgacaaaca

SEQ ID NO: 2664394 - RNA, 23 nt, Escherichia coli CFT073
cuucgguuuuguugccgcccguu

SEQ ID NO: 2664395 - RNA, 18 nt, Escherichia coli CFT073
cuucguaccaaaugaacc

SEQ ID NO: 2664396 - RNA, 21 nt, Escherichia coli CFT073
cuucguacuacgcgccgccag

SEQ ID NO: 2664397 - RNA, 22 nt, Escherichia coli CFT073
cuucgucaccuguucuucgcuc

SEQ ID NO: 2664398 - RNA, 19 nt, Escherichia coli CFT073
cuucguccaucccacacug

SEQ ID NO: 2664399 - RNA, 13 nt, Escherichia coli CFT073
cuucguccccagu

SEQ ID NO: 2664400 - RNA, 18 nt, Escherichia coli CFT073
cuucgucgccagcucuuc

SEQ ID NO: 2664401 - RNA, 15 nt, Escherichia coli CFT073
cuucguuaucccagg

SEQ ID NO: 2664402 - RNA, 14 nt, Escherichia coli CFT073
cuucguucagccaa

SEQ ID NO: 2664403 - RNA, 12 nt, Escherichia coli CFT073
cuucguucaucu

SEQ ID NO: 2664404 - RNA, 20 nt, Escherichia coli CFT073
cuugccaccgcuaaacguua

SEQ ID NO: 2664405 - RNA, 21 nt, Escherichia coli CFT073
cuugccagauuuucuucagcu

SEQ ID NO: 2664406 - RNA, 15 nt, Escherichia coli CFT073
cuugccagguaaaca

SEQ ID NO: 2664407 - RNA, 17 nt, Escherichia coli CFT073
cuugccauucacuucau

SEQ ID NO: 2664408 - RNA, 18 nt, Escherichia coli CFT073
cuugccauucacuucaua

SEQ ID NO: 2664409 - RNA, 15 nt, Escherichia coli CFT073
cuugccauuccacaa

SEQ ID NO: 2664410 - RNA, 19 nt, Escherichia coli CFT073
cuugccauuccacaaaaac

SEQ ID NO: 2664411 - RNA, 16 nt, Escherichia coli CFT073
cuugccgaugucuuug

SEQ ID NO: 2664412 - RNA, 23 nt, Escherichia coli CFT073
cuugccgcgucuuaucaggccua

SEQ ID NO: 2664413 - RNA, 18 nt, Escherichia coli CFT073
cuugccgucuucuuccca

SEQ ID NO: 2664414 - RNA, 17 nt, Escherichia coli CFT073
cuugcgauauggcugcg

SEQ ID NO: 2664415 - RNA, 18 nt, Escherichia coli CFT073
cuugcgauauggcugcgc

SEQ ID NO: 2664416 - RNA, 17 nt, Escherichia coli CFT073
cuugcgauccugcagau

SEQ ID NO: 2664417 - RNA, 15 nt, Escherichia coli CFT073
cuugcgcaaugaguu

SEQ ID NO: 2664418 - RNA, 15 nt, Escherichia coli CFT073
cuugcgcgcaaucag

SEQ ID NO: 2664419 - RNA, 20 nt, Escherichia coli CFT073
cuugcgcgcaaucagcaccg

SEQ ID NO: 2664420 - RNA, 22 nt, Escherichia coli CFT073
cuugcgcggauggccucugcca

SEQ ID NO: 2664421 - RNA, 14 nt, Escherichia coli CFT073
cuugcggaaacugu

SEQ ID NO: 2664422 - RNA, 19 nt, Escherichia coli CFT073
cuugcggaagcgucaaggu

SEQ ID NO: 2664423 - RNA, 16 nt, Escherichia coli CFT073
cuugcggaucggcugg

SEQ ID NO: 2664424 - RNA, 14 nt, Escherichia coli CFT073
cuugcguacaccaa

SEQ ID NO: 2664425 - RNA, 19 nt, Escherichia coli CFT073
cuugcguacaccaacauca

SEQ ID NO: 2664426 - RNA, 16 nt, Escherichia coli CFT073
cuugcgucacaaauac

SEQ ID NO: 2664427 - RNA, 11 nt, Escherichia coli CFT073
cuugcgugacg

SEQ ID NO: 2664428 - RNA, 12 nt, Escherichia coli CFT073
cuugcucauccg

SEQ ID NO: 2664429 - RNA, 14 nt, Escherichia coli CFT073
cuugcucauccgga

SEQ ID NO: 2664430 - RNA, 17 nt, Escherichia coli CFT073
cuugcuccacgcucaga

SEQ ID NO: 2664431 - RNA, 14 nt, Escherichia coli CFT073
cuugcucgaagagu

SEQ ID NO: 2664432 - RNA, 23 nt, Escherichia coli CFT073
cuugcucgaucagacgaucgcgc

SEQ ID NO: 2664433 - RNA, 22 nt, Escherichia coli CFT073
cuugcucguuuucaauggcgcu

SEQ ID NO: 2664434 - RNA, 15 nt, Escherichia coli CFT073
cuugcugcuccagcg

SEQ ID NO: 2664435 - RNA, 21 nt, Escherichia coli CFT073
cuugcugcuccagcgggcgaa

SEQ ID NO: 2664436 - RNA, 16 nt, Escherichia coli CFT073
cuugcugguacguuua

SEQ ID NO: 2664437 - RNA, 16 nt, Escherichia coli CFT073
cuugcuucgccaguuc

SEQ ID NO: 2664438 - RNA, 17 nt, Escherichia coli CFT073
cuuggcugcaaauauug

SEQ ID NO: 2664439 - RNA, 15 nt, Escherichia coli CFT073
cuuguaaaacagcca

SEQ ID NO: 2664440 - RNA, 16 nt, Escherichia coli CFT073
cuuguaaaacagccaa

SEQ ID NO: 2664441 - RNA, 20 nt, Escherichia coli CFT073
cuuguaacgaguacaaaaau

SEQ ID NO: 2664442 - RNA, 23 nt, Escherichia coli CFT073
cuuguaacgaguacaaaaauaag

SEQ ID NO: 2664443 - RNA, 15 nt, Escherichia coli CFT073
cuuguaccuucagcg

SEQ ID NO: 2664444 - RNA, 16 nt, Escherichia coli CFT073
cuuguacggcuccgcc

SEQ ID NO: 2664445 - RNA, 18 nt, Escherichia coli CFT073
cuuguacucuacaaccag

SEQ ID NO: 2664446 - RNA, 22 nt, Escherichia coli CFT073
cuuguaucacuggccucuucuc

SEQ ID NO: 2664447 - RNA, 23 nt, Escherichia coli CFT073
cuuguauuaauaccagaauaagg

SEQ ID NO: 2664448 - RNA, 23 nt, Escherichia coli CFT073
cuugucacgucucaucaggccug

SEQ ID NO: 2664449 - RNA, 20 nt, Escherichia coli CFT073
cuugucauuaccacaacaaa

SEQ ID NO: 2664450 - RNA, 16 nt, Escherichia coli CFT073
cuuguccgucaaccca

SEQ ID NO: 2664451 - RNA, 20 nt, Escherichia coli CFT073
cuugucgaguagcaaccgga

SEQ ID NO: 2664452 - RNA, 21 nt, Escherichia coli CFT073
cuugucgguaauuucacuggu

SEQ ID NO: 2664453 - RNA, 22 nt, Escherichia coli CFT073
cuuguggaaauuccagcggcag

SEQ ID NO: 2664454 - RNA, 17 nt, Escherichia coli CFT073
cuuguguaggcccgaua

SEQ ID NO: 2664455 - RNA, 13 nt, Escherichia coli CFT073
cuuguucaagagc

SEQ ID NO: 2664456 - RNA, 20 nt, Escherichia coli CFT073
cuuguucagccguuuaauug

SEQ ID NO: 2664457 - RNA, 21 nt, Escherichia coli CFT073
cuuguucauaauguuauguca

SEQ ID NO: 2664458 - RNA, 12 nt, Escherichia coli CFT073
cuuguuccugca

SEQ ID NO: 2664459 - RNA, 21 nt, Escherichia coli CFT073
cuuguucgauacaaaaacccg

SEQ ID NO: 2664460 - RNA, 20 nt, Escherichia coli CFT073
cuuguucgcccugcagugcg

SEQ ID NO: 2664461 - RNA, 17 nt, Escherichia coli CFT073
cuuguugccuguuucau

SEQ ID NO: 2664462 - RNA, 17 nt, Escherichia coli CFT073
cuuguuggaucaugcuc

SEQ ID NO: 2664463 - RNA, 15 nt, Escherichia coli CFT073
cuuguuucagcgcau

SEQ ID NO: 2664464 - RNA, 20 nt, Escherichia coli CFT073
cuuuaaaaaaauuaauuuuu

SEQ ID NO: 2664465 - RNA, 22 nt, Escherichia coli CFT073
cuuuaaaauaagcacaaagcaa

SEQ ID NO: 2664466 - RNA, 21 nt, Escherichia coli CFT073
cuuuaaaauuauccagcgccc

SEQ ID NO: 2664467 - RNA, 14 nt, Escherichia coli CFT073
cuuuaaauuauuug

SEQ ID NO: 2664468 - RNA, 19 nt, Escherichia coli CFT073
cuuuaacaucgcaaaauac

SEQ ID NO: 2664469 - RNA, 14 nt, Escherichia coli CFT073
cuuuaagauauggc

SEQ ID NO: 2664470 - RNA, 15 nt, Escherichia coli CFT073
cuuuaauaacacgaa

SEQ ID NO: 2664471 - RNA, 20 nt, Escherichia coli CFT073
cuuuaaugacugaacgugaa

SEQ ID NO: 2664472 - RNA, 18 nt, Escherichia coli CFT073
cuuuaauuuugugcagca

SEQ ID NO: 2664473 - RNA, 11 nt, Escherichia coli CFT073
cuuuacagcca

SEQ ID NO: 2664474 - RNA, 16 nt, Escherichia coli CFT073
cuuuacccgcaccgga

SEQ ID NO: 2664475 - RNA, 18 nt, Escherichia coli CFT073
cuuuacccguguuuugca

SEQ ID NO: 2664476 - RNA, 16 nt, Escherichia coli CFT073
cuuuaccgcaaucgau

SEQ ID NO: 2664477 - RNA, 22 nt, Escherichia coli CFT073
cuuuaccggaugcucacagagu

SEQ ID NO: 2664478 - RNA, 20 nt, Escherichia coli CFT073
cuuuaccgguuucaauccag

SEQ ID NO: 2664479 - RNA, 17 nt, Escherichia coli CFT073
cuuuacgaagaaaucga

SEQ ID NO: 2664480 - RNA, 17 nt, Escherichia coli CFT073
cuuuacgcaaagcagca

SEQ ID NO: 2664481 - RNA, 18 nt, Escherichia coli CFT073
cuuuacuaaaaagugaua

SEQ ID NO: 2664482 - RNA, 14 nt, Escherichia coli CFT073
cuuuacucaacucc

SEQ ID NO: 2664483 - RNA, 17 nt, Escherichia coli CFT073
cuuuacucauccccuga

SEQ ID NO: 2664484 - RNA, 11 nt, Escherichia coli CFT073
cuuuacugccu

SEQ ID NO: 2664485 - RNA, 16 nt, Escherichia coli CFT073
cuuuagacacaucagc

SEQ ID NO: 2664486 - RNA, 20 nt, Escherichia coli CFT073
cuuuagacacaucagcaacg

SEQ ID NO: 2664487 - RNA, 13 nt, Escherichia coli CFT073
cuuuaggaacgcg

SEQ ID NO: 2664488 - RNA, 23 nt, Escherichia coli CFT073
cuuuagggggggcucuuuccauc

SEQ ID NO: 2664489 - RNA, 18 nt, Escherichia coli CFT073
cuuuaguugagcuuuuuc

SEQ ID NO: 2664490 - RNA, 14 nt, Escherichia coli CFT073
cuuuauaaaguaaa

SEQ ID NO: 2664491 - RNA, 18 nt, Escherichia coli CFT073
cuuuauaaauaucaaaaa

SEQ ID NO: 2664492 - RNA, 15 nt, Escherichia coli CFT073
cuuuauagaacagag

SEQ ID NO: 2664493 - RNA, 23 nt, Escherichia coli CFT073
cuuuauagaacagagucugacca

SEQ ID NO: 2664494 - RNA, 18 nt, Escherichia coli CFT073
cuuuauagcuuuucgcgu

SEQ ID NO: 2664495 - RNA, 19 nt, Escherichia coli CFT073
cuuuauagugugcaaucac

SEQ ID NO: 2664496 - RNA, 19 nt, Escherichia coli CFT073
cuuuauaucugguuugcca

SEQ ID NO: 2664497 - RNA, 14 nt, Escherichia coli CFT073
cuuuaucaccaaug

SEQ ID NO: 2664498 - RNA, 22 nt, Escherichia coli CFT073
cuuuaucacgaccgucaagaaa

SEQ ID NO: 2664499 - RNA, 15 nt, Escherichia coli CFT073
cuuuauccagcacca

SEQ ID NO: 2664500 - RNA, 17 nt, Escherichia coli CFT073
cuuuauccagcaccacu

SEQ ID NO: 2664501 - RNA, 23 nt, Escherichia coli CFT073
cuuuauccugcccgcuccagcua

SEQ ID NO: 2664502 - RNA, 15 nt, Escherichia coli CFT073
cuuuaucgacauaaa

SEQ ID NO: 2664503 - RNA, 19 nt, Escherichia coli CFT073
cuuuaucgucgcuggaaau

SEQ ID NO: 2664504 - RNA, 21 nt, Escherichia coli CFT073
cuuuaucuuucaguauaguga

SEQ ID NO: 2664505 - RNA, 13 nt, Escherichia coli CFT073
cuuuaugcagcuc

SEQ ID NO: 2664506 - RNA, 20 nt, Escherichia coli CFT073
cuuuauucaccaguaaggca

SEQ ID NO: 2664507 - RNA, 23 nt, Escherichia coli CFT073
cuuuauuggguugcaguaacugc

SEQ ID NO: 2664508 - RNA, 13 nt, Escherichia coli CFT073
cuuuauuuccaua

SEQ ID NO: 2664509 - RNA, 14 nt, Escherichia coli CFT073
cuuuauuuccugcg

SEQ ID NO: 2664510 - RNA, 20 nt, Escherichia coli CFT073
cuuucaacgcgcuaauuuca

SEQ ID NO: 2664511 - RNA, 19 nt, Escherichia coli CFT073
cuuucaauaaccgcugcca

SEQ ID NO: 2664512 - RNA, 13 nt, Escherichia coli CFT073
cuuugaucgccgc

SEQ ID NO: 2664513 - RNA, 13 nt, Escherichia coli CFT073
cuuugaugccacc

SEQ ID NO: 2664514 - RNA, 21 nt, Escherichia coli CFT073
cuuugauggcacuauaucccu

SEQ ID NO: 2664515 - RNA, 13 nt, Escherichia coli CFT073
cuuugcaagcguu

SEQ ID NO: 2664516 - RNA, 23 nt, Escherichia coli CFT073
cuuugccaggucgcuugccgcca

SEQ ID NO: 2664517 - RNA, 21 nt, Escherichia coli CFT073
cuuugcccggcaacggauuua

SEQ ID NO: 2664518 - RNA, 22 nt, Escherichia coli CFT073
cuuugcccucugaauaacaccc

SEQ ID NO: 2664519 - RNA, 11 nt, Escherichia coli CFT073
cuuugccuggc

SEQ ID NO: 2664520 - RNA, 21 nt, Escherichia coli CFT073
cuuugcgagucugcuccagaa

SEQ ID NO: 2664521 - RNA, 14 nt, Escherichia coli CFT073
cuuugcgcaggcaa

SEQ ID NO: 2664522 - RNA, 15 nt, Escherichia coli CFT073
cuuugcgccagcggg

SEQ ID NO: 2664523 - RNA, 21 nt, Escherichia coli CFT073
cuuugcgcccccgauccagcg

SEQ ID NO: 2664524 - RNA, 17 nt, Escherichia coli CFT073
cuuugcuaaaacgugaa

SEQ ID NO: 2664525 - RNA, 23 nt, Escherichia coli CFT073
cuuugcugauacuccaugaguaa

SEQ ID NO: 2664526 - RNA, 13 nt, Escherichia coli CFT073
cuuugcuggcaug

SEQ ID NO: 2664527 - RNA, 14 nt, Escherichia coli CFT073
cuuugcuguugauu

SEQ ID NO: 2664528 - RNA, 16 nt, Escherichia coli CFT073
cuuugcuuauaaccau

SEQ ID NO: 2664529 - RNA, 20 nt, Escherichia coli CFT073
cuuuggcaccguuagugauu

SEQ ID NO: 2664530 - RNA, 17 nt, Escherichia coli CFT073
cuuuggcaccuucgcca

SEQ ID NO: 2664531 - RNA, 16 nt, Escherichia coli CFT073
cuuuggcccauugcac

SEQ ID NO: 2664532 - RNA, 20 nt, Escherichia coli CFT073
cuuuggcggcaucugccacc

SEQ ID NO: 2664533 - RNA, 16 nt, Escherichia coli CFT073
cuuuguaaagcgccaa

SEQ ID NO: 2664534 - RNA, 14 nt, Escherichia coli CFT073
cuuuguaaccugcu

SEQ ID NO: 2664535 - RNA, 16 nt, Escherichia coli CFT073
cuuuguaggccggaua

SEQ ID NO: 2664536 - RNA, 16 nt, Escherichia coli CFT073
cuuuguaggccugaua

SEQ ID NO: 2664537 - RNA, 17 nt, Escherichia coli CFT073
cuuuguaggccugauaa

SEQ ID NO: 2664538 - RNA, 18 nt, Escherichia coli CFT073
cuuuguaggccugauaag

SEQ ID NO: 2664539 - RNA, 19 nt, Escherichia coli CFT073
cuuuguaggccugauaaga

SEQ ID NO: 2664540 - RNA, 14 nt, Escherichia coli CFT073
cuuuguauccacuc

SEQ ID NO: 2664541 - RNA, 20 nt, Escherichia coli CFT073
cuuuguccagugcaacuuua

SEQ ID NO: 2664542 - RNA, 17 nt, Escherichia coli CFT073
cuuugucgaucauguag

SEQ ID NO: 2664543 - RNA, 14 nt, Escherichia coli CFT073
cuuugucugcaauc

SEQ ID NO: 2664544 - RNA, 20 nt, Escherichia coli CFT073
cuuugucugcaaucugauuc

SEQ ID NO: 2664545 - RNA, 12 nt, Escherichia coli CFT073
cuuugugccauc

SEQ ID NO: 2664546 - RNA, 22 nt, Escherichia coli CFT073
cuuugugccaucgccacaccag

SEQ ID NO: 2664547 - RNA, 17 nt, Escherichia coli CFT073
cuuugugcgaucaggca

SEQ ID NO: 2664548 - RNA, 15 nt, Escherichia coli CFT073
cuuugugcucuuccu

SEQ ID NO: 2664549 - RNA, 19 nt, Escherichia coli CFT073
cuuuguuacccccauccac

SEQ ID NO: 2664550 - RNA, 20 nt, Escherichia coli CFT073
cuuuuaaaucauccugaauc

SEQ ID NO: 2664551 - RNA, 15 nt, Escherichia coli CFT073
cuuuuaaauccugca

SEQ ID NO: 2664552 - RNA, 17 nt, Escherichia coli CFT073
cuuuuaaauccugcaca

SEQ ID NO: 2664553 - RNA, 17 nt, Escherichia coli CFT073
cuuuuaaaugcacagga

SEQ ID NO: 2664554 - RNA, 21 nt, Escherichia coli CFT073
cuuuuaaaugcccgacaaaaa

SEQ ID NO: 2664555 - RNA, 22 nt, Escherichia coli CFT073
cuuuuaaaugcccgacaaaaau

SEQ ID NO: 2664556 - RNA, 20 nt, Escherichia coli CFT073
cuuuuaaccggcgaccaaga

SEQ ID NO: 2664557 - RNA, 22 nt, Escherichia coli CFT073
cuuuuaacgccucguuugcggc

SEQ ID NO: 2664558 - RNA, 18 nt, Escherichia coli CFT073
cuuuuaaugguauccaca

SEQ ID NO: 2664559 - RNA, 14 nt, Escherichia coli CFT073
cuuuuaauuucauc

SEQ ID NO: 2664560 - RNA, 15 nt, Escherichia coli CFT073
cuuuuaccaucgcga

SEQ ID NO: 2664561 - RNA, 18 nt, Escherichia coli CFT073
cuuuuaccgacaggucaa

SEQ ID NO: 2664562 - RNA, 19 nt, Escherichia coli CFT073
cuuuuaccugcuuaaucau

SEQ ID NO: 2664563 - RNA, 21 nt, Escherichia coli CFT073
cuuuuagcgacaaaucuuuca

SEQ ID NO: 2664564 - RNA, 19 nt, Escherichia coli CFT073
cuuuucaccuucaaaauuu

SEQ ID NO: 2664565 - RNA, 21 nt, Escherichia coli CFT073
cuuuucagauugucguacaua

SEQ ID NO: 2664566 - RNA, 12 nt, Escherichia coli CFT073
cuuuucaggccu

SEQ ID NO: 2664567 - RNA, 20 nt, Escherichia coli CFT073
cuuuucaggcuagccgccag

SEQ ID NO: 2664568 - RNA, 16 nt, Escherichia coli CFT073
cuuuucauauuauuug

SEQ ID NO: 2664569 - RNA, 18 nt, Escherichia coli CFT073
cuuuucaucagaucgcga

SEQ ID NO: 2664570 - RNA, 21 nt, Escherichia coli CFT073
cuuuucaucagaucgcgaccg

SEQ ID NO: 2664571 - RNA, 11 nt, Escherichia coli CFT073
cuuuuccagcg

SEQ ID NO: 2664572 - RNA, 14 nt, Escherichia coli CFT073
cuuuucccacuaac

SEQ ID NO: 2664573 - RNA, 15 nt, Escherichia coli CFT073
cuuuucccacuaacu

SEQ ID NO: 2664574 - RNA, 13 nt, Escherichia coli CFT073
cuuuucccuuuca

SEQ ID NO: 2664575 - RNA, 23 nt, Escherichia coli CFT073
cuuuucgccaccggcaaucugcu

SEQ ID NO: 2664576 - RNA, 22 nt, Escherichia coli CFT073
cuuuucgcccaggucucccagu

SEQ ID NO: 2664577 - RNA, 20 nt, Escherichia coli CFT073
cuuuucgcccuggacaacau

SEQ ID NO: 2664578 - RNA, 16 nt, Escherichia coli CFT073
cuuuucgucaggauua

SEQ ID NO: 2664579 - RNA, 14 nt, Escherichia coli CFT073
cuuuucuccugcuu

SEQ ID NO: 2664580 - RNA, 13 nt, Escherichia coli CFT073
cuuuugaaacugu

SEQ ID NO: 2664581 - RNA, 18 nt, Escherichia coli CFT073
cuuuugauugucgauucu

SEQ ID NO: 2664582 - RNA, 19 nt, Escherichia coli CFT073
cuuuugcaaacaacgcuuc

SEQ ID NO: 2664583 - RNA, 18 nt, Escherichia coli CFT073
cuuuugcaucuucagucg

SEQ ID NO: 2664584 - RNA, 11 nt, Escherichia coli CFT073
cuuuugccaga

SEQ ID NO: 2664585 - RNA, 20 nt, Escherichia coli CFT073
cuuuugcccauaugcagcca

SEQ ID NO: 2664586 - RNA, 17 nt, Escherichia coli CFT073
cuuuugccgcauccuca

SEQ ID NO: 2664587 - RNA, 16 nt, Escherichia coli CFT073
cuuuugccuguugcac

SEQ ID NO: 2664588 - RNA, 15 nt, Escherichia coli CFT073
cuuuugccuucugag

SEQ ID NO: 2664589 - RNA, 17 nt, Escherichia coli CFT073
cuuuugcgguuuuucuc

SEQ ID NO: 2664590 - RNA, 16 nt, Escherichia coli CFT073
cuuuugcugucucauc

SEQ ID NO: 2664591 - RNA, 14 nt, Escherichia coli CFT073
cuuuuggcucauca

SEQ ID NO: 2664592 - RNA, 16 nt, Escherichia coli CFT073
cuuuuggugccggaua

SEQ ID NO: 2664593 - RNA, 15 nt, Escherichia coli CFT073
cuuuugguuuuucaa

SEQ ID NO: 2664594 - RNA, 15 nt, Escherichia coli CFT073
cuuuugucgcuuuaa

SEQ ID NO: 2664595 - RNA, 16 nt, Escherichia coli CFT073
cuuuugucgcuuuaac

SEQ ID NO: 2664596 - RNA, 14 nt, Escherichia coli CFT073
cuuuugugacgaca

SEQ ID NO: 2664597 - RNA, 15 nt, Escherichia coli CFT073
cuuuuguuucccgau

SEQ ID NO: 2664598 - RNA, 12 nt, Escherichia coli CFT073
cuuuuuagcgcc

SEQ ID NO: 2664599 - RNA, 13 nt, Escherichia coli CFT073
cuuuuuauaccgu

SEQ ID NO: 2664600 - RNA, 18 nt, Escherichia coli CFT073
cuuuuuauguuagccgcc

SEQ ID NO: 2664601 - RNA, 16 nt, Escherichia coli CFT073
cuuuuuccaggcuggc

SEQ ID NO: 2664602 - RNA, 18 nt, Escherichia coli CFT073
cuuuuuccaucacccaac

SEQ ID NO: 2664603 - RNA, 15 nt, Escherichia coli CFT073
cuuuuuccgggccaa

SEQ ID NO: 2664604 - RNA, 20 nt, Escherichia coli CFT073
cuuuuuccugagucagcagc

SEQ ID NO: 2664605 - RNA, 15 nt, Escherichia coli CFT073
cuuuuuccugccgcu

SEQ ID NO: 2664606 - RNA, 12 nt, Escherichia coli CFT073
cuuuuucuucac

SEQ ID NO: 2664607 - RNA, 17 nt, Escherichia coli CFT073
cuuuuugcauuuccgcu

SEQ ID NO: 2664608 - RNA, 22 nt, Escherichia coli CFT073
cuuuuugugcggaagucgcugc

SEQ ID NO: 2664609 - RNA, 20 nt, Escherichia coli CFT073
cuuuuugugggccugauaag

SEQ ID NO: 2664610 - RNA, 15 nt, Escherichia coli CFT073
cuuuuuuacaucauc

SEQ ID NO: 2664611 - RNA, 16 nt, Escherichia coli CFT073
cuuuuuuacaucauca

SEQ ID NO: 2664612 - RNA, 20 nt, Escherichia coli CFT073
cuuuuuuagguacaaagcca

SEQ ID NO: 2664613 - RNA, 17 nt, Escherichia coli CFT073
cuuuuuuaugcaccuuu

SEQ ID NO: 2664614 - RNA, 14 nt, Escherichia coli CFT073
cuuuuuuauggaau

SEQ ID NO: 2664615 - RNA, 14 nt, Escherichia coli CFT073
cuuuuuucaucucu

SEQ ID NO: 2664616 - RNA, 13 nt, Escherichia coli CFT073
cuuuuuucauuuc

SEQ ID NO: 2664617 - RNA, 16 nt, Escherichia coli CFT073
cuuuuuucauuucccg

SEQ ID NO: 2664618 - RNA, 20 nt, Escherichia coli CFT073
cuuuuuuucacuuucgccag

SEQ ID NO: 2664619 - RNA, 17 nt, Escherichia coli CFT073
cuuuuuuuugccccaga

SEQ ID NO: 2664620 - RNA, 17 nt, Escherichia coli CFT073
gaaaaaccguauucauc

SEQ ID NO: 2664621 - RNA, 16 nt, Escherichia coli CFT073
gaaacccggccacagc

SEQ ID NO: 2664622 - RNA, 14 nt, Escherichia coli CFT073
gaaaccgagauaaa

SEQ ID NO: 2664623 - RNA, 19 nt, Escherichia coli CFT073
gaaaccgguuuguaggccg

SEQ ID NO: 2664624 - RNA, 20 nt, Escherichia coli CFT073
gaaaccgguuuguaggccgg

SEQ ID NO: 2664625 - RNA, 23 nt, Escherichia coli CFT073
gaaaccgguuuguaggccggaua

SEQ ID NO: 2664626 - RNA, 22 nt, Escherichia coli CFT073
gaaaccgugucgacggcgcggu

SEQ ID NO: 2664627 - RNA, 17 nt, Escherichia coli CFT073
gaaaccugaauccacug

SEQ ID NO: 2664628 - RNA, 17 nt, Escherichia coli CFT073
gaaaccuucagcaucga

SEQ ID NO: 2664629 - RNA, 17 nt, Escherichia coli CFT073
gaaacgaaacccaaauc

SEQ ID NO: 2664630 - RNA, 21 nt, Escherichia coli CFT073
gaaacgagccauaaaaucaca

SEQ ID NO: 2664631 - RNA, 24 nt, Escherichia coli CFT073
gaaacgagccauaaaaucacaggu

SEQ ID NO: 2664632 - RNA, 19 nt, Escherichia coli CFT073
gaaacgcaguuuaaucguu

SEQ ID NO: 2664633 - RNA, 21 nt, Escherichia coli CFT073
gaaacgccaucugaauaaacg

SEQ ID NO: 2664634 - RNA, 21 nt, Escherichia coli CFT073
gaaacgccccuaaauaaacac

SEQ ID NO: 2664635 - RNA, 14 nt, Escherichia coli CFT073
gaaacgccugauga

SEQ ID NO: 2664636 - RNA, 17 nt, Escherichia coli CFT073
gaaacgcggcguaacca

SEQ ID NO: 2664637 - RNA, 18 nt, Escherichia coli CFT073
gaaacgcucauaaauugc

SEQ ID NO: 2664638 - RNA, 17 nt, Escherichia coli CFT073
gaaacgcuuaaagcguu

SEQ ID NO: 2664639 - RNA, 21 nt, Escherichia coli CFT073
gaaacggguuagcguuugccc

SEQ ID NO: 2664640 - RNA, 20 nt, Escherichia coli CFT073
gaaacgguuaaucuguugaa

SEQ ID NO: 2664641 - RNA, 15 nt, Escherichia coli CFT073
gaaacucgaugacaa

SEQ ID NO: 2664642 - RNA, 16 nt, Escherichia coli CFT073
gaaacugacaggucau

SEQ ID NO: 2664643 - RNA, 21 nt, Escherichia coli CFT073
gaaacugcuggcuuaaaaaac

SEQ ID NO: 2664644 - RNA, 14 nt, Escherichia coli CFT073
gaaacuggauggcc

SEQ ID NO: 2664645 - RNA, 16 nt, Escherichia coli CFT073
gaaacuggauggccug

SEQ ID NO: 2664646 - RNA, 14 nt, Escherichia coli CFT073
gaaacuguucgcug

SEQ ID NO: 2664647 - RNA, 12 nt, Escherichia coli CFT073
gaaacuuauuca

SEQ ID NO: 2664648 - RNA, 12 nt, Escherichia coli CFT073
gaaacuuccagc

SEQ ID NO: 2664649 - RNA, 16 nt, Escherichia coli CFT073
gaaacuuccagcuuca

SEQ ID NO: 2664650 - RNA, 21 nt, Escherichia coli CFT073
gaaacuugcgugauauuacau

SEQ ID NO: 2664651 - RNA, 15 nt, Escherichia coli CFT073
gaaacuugguuacgc

SEQ ID NO: 2664652 - RNA, 11 nt, Escherichia coli CFT073
gaaacuuucca

SEQ ID NO: 2664653 - RNA, 16 nt, Escherichia coli CFT073
gaaagaacaccagcac

SEQ ID NO: 2664654 - RNA, 13 nt, Escherichia coli CFT073
gaaagaauauagg

SEQ ID NO: 2664655 - RNA, 14 nt, Escherichia coli CFT073
gaaagauacaaaac

SEQ ID NO: 2664656 - RNA, 23 nt, Escherichia coli CFT073
gaaagauggacgccguauucacu

SEQ ID NO: 2664657 - RNA, 14 nt, Escherichia coli CFT073
gaaagcaaaaaaag

SEQ ID NO: 2664658 - RNA, 16 nt, Escherichia coli CFT073
gaaagcaaaaaaagaa

SEQ ID NO: 2664659 - RNA, 16 nt, Escherichia coli CFT073
gaaagcaaaaaagaag

SEQ ID NO: 2664660 - RNA, 20 nt, Escherichia coli CFT073
gaaagcaaaaaagaaggaaa

SEQ ID NO: 2664661 - RNA, 15 nt, Escherichia coli CFT073
gaaagcaauuaacag

SEQ ID NO: 2664662 - RNA, 20 nt, Escherichia coli CFT073
gaaagcaccugcacaggcau

SEQ ID NO: 2664663 - RNA, 21 nt, Escherichia coli CFT073
gaaagcagacuuuuugcggca

SEQ ID NO: 2664664 - RNA, 22 nt, Escherichia coli CFT073
gaaagcagauaacccagcagcc

SEQ ID NO: 2664665 - RNA, 12 nt, Escherichia coli CFT073
gaaagccccagc

SEQ ID NO: 2664666 - RNA, 15 nt, Escherichia coli CFT073
gaaagccgccgacau

SEQ ID NO: 2664667 - RNA, 22 nt, Escherichia coli CFT073
gaaagccgcuggcgcagcaggc

SEQ ID NO: 2664668 - RNA, 16 nt, Escherichia coli CFT073
gaaagcgacagcgcac

SEQ ID NO: 2664669 - RNA, 23 nt, Escherichia coli CFT073
gaaagcgacuuugccuggcggca

SEQ ID NO: 2664670 - RNA, 14 nt, Escherichia coli CFT073
gaaagcgccagcaa

SEQ ID NO: 2664671 - RNA, 17 nt, Escherichia coli CFT073
gaaagcgccucaagcuc

SEQ ID NO: 2664672 - RNA, 20 nt, Escherichia coli CFT073
gaaagcgcggcgacaauaau

SEQ ID NO: 2664673 - RNA, 20 nt, Escherichia coli CFT073
gaaagcguacccgccugaua

SEQ ID NO: 2664674 - RNA, 19 nt, Escherichia coli CFT073
gaaagcguauccaucacua

SEQ ID NO: 2664675 - RNA, 15 nt, Escherichia coli CFT073
gaaagcguauuaugc

SEQ ID NO: 2664676 - RNA, 19 nt, Escherichia coli CFT073
gaaagcgucagcuuucaga

SEQ ID NO: 2664677 - RNA, 15 nt, Escherichia coli CFT073
gaaagcucuucaugc

SEQ ID NO: 2664678 - RNA, 23 nt, Escherichia coli CFT073
gaaagcuuugcguuucuuccugc

SEQ ID NO: 2664679 - RNA, 14 nt, Escherichia coli CFT073
gaaagggaagaaca

SEQ ID NO: 2664680 - RNA, 19 nt, Escherichia coli CFT073
gaaagguauuuagcgaaua

SEQ ID NO: 2664681 - RNA, 16 nt, Escherichia coli CFT073
gaaaguaaauuauucu

SEQ ID NO: 2664682 - RNA, 20 nt, Escherichia coli CFT073
gaaaguaaauuauucugaca

SEQ ID NO: 2664683 - RNA, 20 nt, Escherichia coli CFT073
gaaaguaaucuauauuucug

SEQ ID NO: 2664684 - RNA, 14 nt, Escherichia coli CFT073
gaaagucgagugaa

SEQ ID NO: 2664685 - RNA, 16 nt, Escherichia coli CFT073
gaaagucguaggccug

SEQ ID NO: 2664686 - RNA, 17 nt, Escherichia coli CFT073
gaaagucguaggccuga

SEQ ID NO: 2664687 - RNA, 16 nt, Escherichia coli CFT073
gaaagugacagcccgg

SEQ ID NO: 2664688 - RNA, 18 nt, Escherichia coli CFT073
gaaagugacagcccggca

SEQ ID NO: 2664689 - RNA, 20 nt, Escherichia coli CFT073
gaaaguuaccgcgccauguu

SEQ ID NO: 2664690 - RNA, 21 nt, Escherichia coli CFT073
gaaaguuggcguucacugccg

SEQ ID NO: 2664691 - RNA, 22 nt, Escherichia coli CFT073
gaaaguuggcguucacugccgu

SEQ ID NO: 2664692 - RNA, 15 nt, Escherichia coli CFT073
gaaaguuguuuuuug

SEQ ID NO: 2664693 - RNA, 19 nt, Escherichia coli CFT073
gaaaguuuacgucgccagu

SEQ ID NO: 2664694 - RNA, 20 nt, Escherichia coli CFT073
gaaaguuucaaaggugccaa

SEQ ID NO: 2664695 - RNA, 12 nt, Escherichia coli CFT073
gaaauaaaauca

SEQ ID NO: 2664696 - RNA, 14 nt, Escherichia coli CFT073
gaaauaaaaucagc

SEQ ID NO: 2664697 - RNA, 15 nt, Escherichia coli CFT073
gaaauaaaaucagca

SEQ ID NO: 2664698 - RNA, 14 nt, Escherichia coli CFT073
gaaauaagaagcca

SEQ ID NO: 2664699 - RNA, 21 nt, Escherichia coli CFT073
gaaauaauacguagcaccaac

SEQ ID NO: 2664700 - RNA, 18 nt, Escherichia coli CFT073
gaaauaccccgccagcag

SEQ ID NO: 2664701 - RNA, 14 nt, Escherichia coli CFT073
gaaauacgacugau

SEQ ID NO: 2664702 - RNA, 15 nt, Escherichia coli CFT073
gaaauacgacugaua

SEQ ID NO: 2664703 - RNA, 17 nt, Escherichia coli CFT073
gaaauagaccggagaaa

SEQ ID NO: 2664704 - RNA, 18 nt, Escherichia coli CFT073
gaaauagauuuucagaau

SEQ ID NO: 2664705 - RNA, 21 nt, Escherichia coli CFT073
gaaauagcgccauaaaacucg

SEQ ID NO: 2664706 - RNA, 15 nt, Escherichia coli CFT073
gaaauauacacgaaa

SEQ ID NO: 2664707 - RNA, 14 nt, Escherichia coli CFT073
gaaauauauucccc

SEQ ID NO: 2664708 - RNA, 18 nt, Escherichia coli CFT073
gaaauaucagcagcacaa

SEQ ID NO: 2664709 - RNA, 15 nt, Escherichia coli CFT073
gaaauaucauuaagc

SEQ ID NO: 2664710 - RNA, 18 nt, Escherichia coli CFT073
gaaauaugcuuuuauuca

SEQ ID NO: 2664711 - RNA, 15 nt, Escherichia coli CFT073
gaaauauucaacacc

SEQ ID NO: 2664712 - RNA, 13 nt, Escherichia coli CFT073
gaaaucaaauaca

SEQ ID NO: 2664713 - RNA, 15 nt, Escherichia coli CFT073
gaaaucaaauacauc

SEQ ID NO: 2664714 - RNA, 20 nt, Escherichia coli CFT073
gaaaucaaauacaucgcgaa

SEQ ID NO: 2664715 - RNA, 14 nt, Escherichia coli CFT073
gaaaucaacacgcc

SEQ ID NO: 2664716 - RNA, 19 nt, Escherichia coli CFT073
gaaaucaaugccaccagaa

SEQ ID NO: 2664717 - RNA, 16 nt, Escherichia coli CFT073
gaaaucacuggcguca

SEQ ID NO: 2664718 - RNA, 14 nt, Escherichia coli CFT073
gaaaucagcacaga

SEQ ID NO: 2664719 - RNA, 23 nt, Escherichia coli CFT073
gaaaucagcacagagauaaaagg

SEQ ID NO: 2664720 - RNA, 20 nt, Escherichia coli CFT073
gaaaucagcagcuuugcccg

SEQ ID NO: 2664721 - RNA, 23 nt, Escherichia coli CFT073
gaaaucagcgagauaaugcgcca

SEQ ID NO: 2664722 - RNA, 18 nt, Escherichia coli CFT073
gaaaucauucgcagcugc

SEQ ID NO: 2664723 - RNA, 18 nt, Escherichia coli CFT073
gaaaucccccagcaucac

SEQ ID NO: 2664724 - RNA, 14 nt, Escherichia coli CFT073
gaaaucgaucauca

SEQ ID NO: 2664725 - RNA, 14 nt, Escherichia coli CFT073
gaaaucucacccgg

SEQ ID NO: 2664726 - RNA, 17 nt, Escherichia coli CFT073
gaaaucugaucguguaa

SEQ ID NO: 2664727 - RNA, 17 nt, Escherichia coli CFT073
gaaaugaccauaaaagg

SEQ ID NO: 2664728 - RNA, 14 nt, Escherichia coli CFT073
gaaaugagaaaacu

SEQ ID NO: 2664729 - RNA, 19 nt, Escherichia coli CFT073
gaaccugugacagcagcgg

SEQ ID NO: 2664730 - RNA, 16 nt, Escherichia coli CFT073
gaaccuguucaacaau

SEQ ID NO: 2664731 - RNA, 19 nt, Escherichia coli CFT073
gaaccuguucaacaauucg

SEQ ID NO: 2664732 - RNA, 15 nt, Escherichia coli CFT073
gaaccuguuuucacc

SEQ ID NO: 2664733 - RNA, 19 nt, Escherichia coli CFT073
gaaccuucgggcgcuucca

SEQ ID NO: 2664734 - RNA, 17 nt, Escherichia coli CFT073
gaacgacauccgccagc

SEQ ID NO: 2664735 - RNA, 22 nt, Escherichia coli CFT073
gaacgagaaaagccaaccugca

SEQ ID NO: 2664736 - RNA, 19 nt, Escherichia coli CFT073
gaacgaguugcgguuucaa

SEQ ID NO: 2664737 - RNA, 16 nt, Escherichia coli CFT073
gaacgcaccgaccauc

SEQ ID NO: 2664738 - RNA, 20 nt, Escherichia coli CFT073
gaacgcaccgaccaucggca

SEQ ID NO: 2664739 - RNA, 18 nt, Escherichia coli CFT073
gaacgcagugauaacuca

SEQ ID NO: 2664740 - RNA, 17 nt, Escherichia coli CFT073
gaacgccaaauucuuua

SEQ ID NO: 2664741 - RNA, 12 nt, Escherichia coli CFT073
gaacgccugauu

SEQ ID NO: 2664742 - RNA, 13 nt, Escherichia coli CFT073
gaacgccugugcg

SEQ ID NO: 2664743 - RNA, 21 nt, Escherichia coli CFT073
gaacgccuuauccgaccuaca

SEQ ID NO: 2664744 - RNA, 15 nt, Escherichia coli CFT073
gaacgccuuauccgg

SEQ ID NO: 2664745 - RNA, 17 nt, Escherichia coli CFT073
gaacgccuuauccggcc

SEQ ID NO: 2664746 - RNA, 16 nt, Escherichia coli CFT073
gaacgcguuauccggc

SEQ ID NO: 2664747 - RNA, 23 nt, Escherichia coli CFT073
gaacgcugacaaacugcguguga

SEQ ID NO: 2664748 - RNA, 12 nt, Escherichia coli CFT073
gaacgcuugcgg

SEQ ID NO: 2664749 - RNA, 19 nt, Escherichia coli CFT073
gaacgcuuuugcaucggca

SEQ ID NO: 2664750 - RNA, 21 nt, Escherichia coli CFT073
gaacggauagagcgcugcgca

SEQ ID NO: 2664751 - RNA, 13 nt, Escherichia coli CFT073
gaacggcaaacgc

SEQ ID NO: 2664752 - RNA, 21 nt, Escherichia coli CFT073
gaacggcagagaaaccacauc

SEQ ID NO: 2664753 - RNA, 16 nt, Escherichia coli CFT073
gaacgggauugccagc

SEQ ID NO: 2664754 - RNA, 16 nt, Escherichia coli CFT073
gaacggggcugccagc

SEQ ID NO: 2664755 - RNA, 13 nt, Escherichia coli CFT073
gaacgggugauuu

SEQ ID NO: 2664756 - RNA, 15 nt, Escherichia coli CFT073
gaacgguaggccgga

SEQ ID NO: 2664757 - RNA, 24 nt, Escherichia coli CFT073
gaacggugcgaccaaacugcucgu

SEQ ID NO: 2664758 - RNA, 21 nt, Escherichia coli CFT073
gaacguauacucgauaccagc

SEQ ID NO: 2664759 - RNA, 15 nt, Escherichia coli CFT073
gaacgugaucgcccc

SEQ ID NO: 2664760 - RNA, 13 nt, Escherichia coli CFT073
gaacgugcauauu

SEQ ID NO: 2664761 - RNA, 15 nt, Escherichia coli CFT073
gaacgugucaacgcu

SEQ ID NO: 2664762 - RNA, 20 nt, Escherichia coli CFT073
gaacguuccccgcgauggcu

SEQ ID NO: 2664763 - RNA, 18 nt, Escherichia coli CFT073
gaacuaacagcacaucga

SEQ ID NO: 2664764 - RNA, 13 nt, Escherichia coli CFT073
gaacuacccgguu

SEQ ID NO: 2664765 - RNA, 14 nt, Escherichia coli CFT073
gaacucaaaccauu

SEQ ID NO: 2664766 - RNA, 18 nt, Escherichia coli CFT073
gaacucaacgccuucuuc

SEQ ID NO: 2664767 - RNA, 18 nt, Escherichia coli CFT073
gaacucacagggcugcug

SEQ ID NO: 2664768 - RNA, 13 nt, Escherichia coli CFT073
gaacucacgcgcc

SEQ ID NO: 2664769 - RNA, 12 nt, Escherichia coli CFT073
gaacucagcgug

SEQ ID NO: 2664770 - RNA, 15 nt, Escherichia coli CFT073
gaacucaggcugcca

SEQ ID NO: 2664771 - RNA, 17 nt, Escherichia coli CFT073
gaacucaggcugccaga

SEQ ID NO: 2664772 - RNA, 15 nt, Escherichia coli CFT073
gaacuccugaaagcg

SEQ ID NO: 2664773 - RNA, 20 nt, Escherichia coli CFT073
gaacucgcugcgcggcagcu

SEQ ID NO: 2664774 - RNA, 14 nt, Escherichia coli CFT073
gaacucuuccggca

SEQ ID NO: 2664775 - RNA, 20 nt, Escherichia coli CFT073
gaacucuuccgggaaaacau

SEQ ID NO: 2664776 - RNA, 19 nt, Escherichia coli CFT073
gaacugacuuccacuuccu

SEQ ID NO: 2664777 - RNA, 15 nt, Escherichia coli CFT073
gaacugcaacucacc

SEQ ID NO: 2664778 - RNA, 18 nt, Escherichia coli CFT073
gaacuuaagcgccugaua

SEQ ID NO: 2664779 - RNA, 23 nt, Escherichia coli CFT073
gaacuucaggugacauuaaagcu

SEQ ID NO: 2664780 - RNA, 15 nt, Escherichia coli CFT073
gaacuucggcagaga

SEQ ID NO: 2664781 - RNA, 16 nt, Escherichia coli CFT073
gaacuucggcagagaa

SEQ ID NO: 2664782 - RNA, 18 nt, Escherichia coli CFT073
gaacuucggcagagaaag

SEQ ID NO: 2664783 - RNA, 14 nt, Escherichia coli CFT073
gaacuuuacugccu

SEQ ID NO: 2664784 - RNA, 12 nt, Escherichia coli CFT073
gaacuuucucug

SEQ ID NO: 2664785 - RNA, 14 nt, Escherichia coli CFT073
gaacuuuuucuuca

SEQ ID NO: 2664786 - RNA, 16 nt, Escherichia coli CFT073
gaacuuuuucuucacc

SEQ ID NO: 2664787 - RNA, 19 nt, Escherichia coli CFT073
gaacuuuuuucauccagcu

SEQ ID NO: 2664788 - RNA, 12 nt, Escherichia coli CFT073
gaagaaaaaaug

SEQ ID NO: 2664789 - RNA, 15 nt, Escherichia coli CFT073
gaagaaaaaccguau

SEQ ID NO: 2664790 - RNA, 12 nt, Escherichia coli CFT073
gaagaaaaacug

SEQ ID NO: 2664791 - RNA, 23 nt, Escherichia coli CFT073
gaagaaaaugguuugccagcaga

SEQ ID NO: 2664792 - RNA, 20 nt, Escherichia coli CFT073
gaagaaaucccccagcauca

SEQ ID NO: 2664793 - RNA, 15 nt, Escherichia coli CFT073
gaagaaaucgacauu

SEQ ID NO: 2664794 - RNA, 14 nt, Escherichia coli CFT073
gaagaagcuugcuu

SEQ ID NO: 2664795 - RNA, 13 nt, Escherichia coli CFT073
gaagaaguaaaac

SEQ ID NO: 2664796 - RNA, 14 nt, Escherichia coli CFT073
gaagacaauccccg

SEQ ID NO: 2664797 - RNA, 20 nt, Escherichia coli CFT073
gaagaccguacagaguauua

SEQ ID NO: 2664798 - RNA, 16 nt, Escherichia coli CFT073
gaagaccucacgguuu

SEQ ID NO: 2664799 - RNA, 23 nt, Escherichia coli CFT073
gaagacgaagauuuuaccgucac

SEQ ID NO: 2664800 - RNA, 12 nt, Escherichia coli CFT073
gaagacgccucg

SEQ ID NO: 2664801 - RNA, 16 nt, Escherichia coli CFT073
gaagacugugauuguu

SEQ ID NO: 2664802 - RNA, 14 nt, Escherichia coli CFT073
gaagacuuugcccu

SEQ ID NO: 2664803 - RNA, 13 nt, Escherichia coli CFT073
gaagagauaaacu

SEQ ID NO: 2664804 - RNA, 16 nt, Escherichia coli CFT073
gaagagcgacaauccc

SEQ ID NO: 2664805 - RNA, 15 nt, Escherichia coli CFT073
gaagagguguaauac

SEQ ID NO: 2664806 - RNA, 19 nt, Escherichia coli CFT073
gaagaguuccagcgccgcg

SEQ ID NO: 2664807 - RNA, 21 nt, Escherichia coli CFT073
gaagauagaggcccuuggcgu

SEQ ID NO: 2664808 - RNA, 18 nt, Escherichia coli CFT073
gaagaucaccacauucag

SEQ ID NO: 2664809 - RNA, 15 nt, Escherichia coli CFT073
gaagaucaccaccga

SEQ ID NO: 2664810 - RNA, 15 nt, Escherichia coli CFT073
gaagaucaucaccag

SEQ ID NO: 2664811 - RNA, 14 nt, Escherichia coli CFT073
gaagaucaugauga

SEQ ID NO: 2664812 - RNA, 23 nt, Escherichia coli CFT073
gaagaucaugaugaugccaaaau

SEQ ID NO: 2664813 - RNA, 15 nt, Escherichia coli CFT073
gaagaugcguucacc

SEQ ID NO: 2664814 - RNA, 17 nt, Escherichia coli CFT073
gaagaugcguucaccua

SEQ ID NO: 2664815 - RNA, 16 nt, Escherichia coli CFT073
gaagauuaagagaacc

SEQ ID NO: 2664816 - RNA, 18 nt, Escherichia coli CFT073
gaagauuuuuugccagca

SEQ ID NO: 2664817 - RNA, 16 nt, Escherichia coli CFT073
gaagcaaaauaaccgg

SEQ ID NO: 2664818 - RNA, 19 nt, Escherichia coli CFT073
gaagcaacaguaauaaugc

SEQ ID NO: 2664819 - RNA, 13 nt, Escherichia coli CFT073
gaagcaaccggug

SEQ ID NO: 2664820 - RNA, 21 nt, Escherichia coli CFT073
gaagcaacugguuaucacgaa

SEQ ID NO: 2664821 - RNA, 18 nt, Escherichia coli CFT073
gaagcaagguagugcuuc

SEQ ID NO: 2664822 - RNA, 20 nt, Escherichia coli CFT073
gaagcaauccauaccagcac

SEQ ID NO: 2664823 - RNA, 16 nt, Escherichia coli CFT073
gaagcagcaucagcaa

SEQ ID NO: 2664824 - RNA, 14 nt, Escherichia coli CFT073
gaagcagcgcugga

SEQ ID NO: 2664825 - RNA, 16 nt, Escherichia coli CFT073
gaagcagcgcuggaga

SEQ ID NO: 2664826 - RNA, 15 nt, Escherichia coli CFT073
gaagcagcuccagaa

SEQ ID NO: 2664827 - RNA, 17 nt, Escherichia coli CFT073
gaagcagcuccagaauu

SEQ ID NO: 2664828 - RNA, 18 nt, Escherichia coli CFT073
gaagcaguuucaccagca

SEQ ID NO: 2664829 - RNA, 20 nt, Escherichia coli CFT073
gaagcaguuucaccagcagu

SEQ ID NO: 2664830 - RNA, 20 nt, Escherichia coli CFT073
gaagcauaaccgagcagaua

SEQ ID NO: 2664831 - RNA, 13 nt, Escherichia coli CFT073
gaagcaugaguaa

SEQ ID NO: 2664832 - RNA, 23 nt, Escherichia coli CFT073
gaagcauucagacacgccgccag

SEQ ID NO: 2664833 - RNA, 15 nt, Escherichia coli CFT073
gaagccaccacgcca

SEQ ID NO: 2664834 - RNA, 14 nt, Escherichia coli CFT073
gaagccagacaaau

SEQ ID NO: 2664835 - RNA, 13 nt, Escherichia coli CFT073
gaagccagacgug

SEQ ID NO: 2664836 - RNA, 18 nt, Escherichia coli CFT073
gaagccaguacacgcuga

SEQ ID NO: 2664837 - RNA, 18 nt, Escherichia coli CFT073
gaagccauuaaacaccag

SEQ ID NO: 2664838 - RNA, 15 nt, Escherichia coli CFT073
gaauagcgccacgcc

SEQ ID NO: 2664839 - RNA, 16 nt, Escherichia coli CFT073
gaauagcgccacgcca

SEQ ID NO: 2664840 - RNA, 14 nt, Escherichia coli CFT073
gaauagcucaguug

SEQ ID NO: 2664841 - RNA, 17 nt, Escherichia coli CFT073
gaauagcucaguuggua

SEQ ID NO: 2664842 - RNA, 19 nt, Escherichia coli CFT073
gaauagcuuuacccagguc

SEQ ID NO: 2664843 - RNA, 14 nt, Escherichia coli CFT073
gaauauaucagccu

SEQ ID NO: 2664844 - RNA, 17 nt, Escherichia coli CFT073
gaauaucaacaaaacca

SEQ ID NO: 2664845 - RNA, 13 nt, Escherichia coli CFT073
gaauaucaccacu

SEQ ID NO: 2664846 - RNA, 23 nt, Escherichia coli CFT073
gaauaucaccacugaugccacug

SEQ ID NO: 2664847 - RNA, 12 nt, Escherichia coli CFT073
gaauaucaucac

SEQ ID NO: 2664848 - RNA, 18 nt, Escherichia coli CFT073
gaauaucaucacccugcg

SEQ ID NO: 2664849 - RNA, 13 nt, Escherichia coli CFT073
gaauauccgccgu

SEQ ID NO: 2664850 - RNA, 17 nt, Escherichia coli CFT073
gaauaucgaucgccgca

SEQ ID NO: 2664851 - RNA, 23 nt, Escherichia coli CFT073
gaauaucguauccgguuuuccag

SEQ ID NO: 2664852 - RNA, 21 nt, Escherichia coli CFT073
gaauaucuucgaccgucacca

SEQ ID NO: 2664853 - RNA, 20 nt, Escherichia coli CFT073
gaauaugaacaaagcaaaua

SEQ ID NO: 2664854 - RNA, 15 nt, Escherichia coli CFT073
gaauauggcggcggc

SEQ ID NO: 2664855 - RNA, 17 nt, Escherichia coli CFT073
gaauauggcggcggcuu

SEQ ID NO: 2664856 - RNA, 14 nt, Escherichia coli CFT073
gaauauguaggccg

SEQ ID NO: 2664857 - RNA, 20 nt, Escherichia coli CFT073
gaauauguucacgaagauau

SEQ ID NO: 2664858 - RNA, 15 nt, Escherichia coli CFT073
gaauauguuugggug

SEQ ID NO: 2664859 - RNA, 23 nt, Escherichia coli CFT073
gaauauucucggcugccuggaua

SEQ ID NO: 2664860 - RNA, 22 nt, Escherichia coli CFT073
gaauauucuuccggcuucgugu

SEQ ID NO: 2664861 - RNA, 20 nt, Escherichia coli CFT073
gaauauugccgaagaccaga

SEQ ID NO: 2664862 - RNA, 13 nt, Escherichia coli CFT073
gaauauugcugaa

SEQ ID NO: 2664863 - RNA, 23 nt, Escherichia coli CFT073
gaauauugguguugugaagugag

SEQ ID NO: 2664864 - RNA, 19 nt, Escherichia coli CFT073
gaaucaaaucaaccaggcc

SEQ ID NO: 2664865 - RNA, 15 nt, Escherichia coli CFT073
gaaucaagcgccgag

SEQ ID NO: 2664866 - RNA, 18 nt, Escherichia coli CFT073
gaaucacagcuauaccgc

SEQ ID NO: 2664867 - RNA, 19 nt, Escherichia coli CFT073
gaaucaccauguuucgccu

SEQ ID NO: 2664868 - RNA, 16 nt, Escherichia coli CFT073
gaaucaccgccacgcc

SEQ ID NO: 2664869 - RNA, 22 nt, Escherichia coli CFT073
gaaucaccugauugaccgccag

SEQ ID NO: 2664870 - RNA, 20 nt, Escherichia coli CFT073
gaaucaccuguucacgacca

SEQ ID NO: 2664871 - RNA, 14 nt, Escherichia coli CFT073
gaaucacgaggcac

SEQ ID NO: 2664872 - RNA, 16 nt, Escherichia coli CFT073
gaaucacgaggcacaa

SEQ ID NO: 2664873 - RNA, 14 nt, Escherichia coli CFT073
gaaucacucaucau

SEQ ID NO: 2664874 - RNA, 16 nt, Escherichia coli CFT073
gaaucacuucaucgcc

SEQ ID NO: 2664875 - RNA, 18 nt, Escherichia coli CFT073
gaaucacuucaucgccgc

SEQ ID NO: 2664876 - RNA, 22 nt, Escherichia coli CFT073
gaaucagaauccggugccuuac

SEQ ID NO: 2664877 - RNA, 23 nt, Escherichia coli CFT073
gaaucagcaaacugguugaaaua

SEQ ID NO: 2664878 - RNA, 12 nt, Escherichia coli CFT073
gaaucagcagcg

SEQ ID NO: 2664879 - RNA, 14 nt, Escherichia coli CFT073
gaaucagcaguuca

SEQ ID NO: 2664880 - RNA, 13 nt, Escherichia coli CFT073
gaaucagcccagc

SEQ ID NO: 2664881 - RNA, 23 nt, Escherichia coli CFT073
gaaucaggaaccacaaccacuuu

SEQ ID NO: 2664882 - RNA, 22 nt, Escherichia coli CFT073
gaaucagucccugaaucgccac

SEQ ID NO: 2664883 - RNA, 20 nt, Escherichia coli CFT073
gaaucauccaggcuuuaaac

SEQ ID NO: 2664884 - RNA, 16 nt, Escherichia coli CFT073
gaauccacuggcuguu

SEQ ID NO: 2664885 - RNA, 20 nt, Escherichia coli CFT073
gaauccacuggcuguuaucg

SEQ ID NO: 2664886 - RNA, 14 nt, Escherichia coli CFT073
gaauccagcaagcu

SEQ ID NO: 2664887 - RNA, 23 nt, Escherichia coli CFT073
gaauccagcacgaagaggccgcc

SEQ ID NO: 2664888 - RNA, 19 nt, Escherichia coli CFT073
gaauccagccccaccagca

SEQ ID NO: 2664889 - RNA, 12 nt, Escherichia coli CFT073
gaauccagcgcg

SEQ ID NO: 2664890 - RNA, 14 nt, Escherichia coli CFT073
gaauccaggccaga

SEQ ID NO: 2664891 - RNA, 19 nt, Escherichia coli CFT073
gaauccaggccagauacug

SEQ ID NO: 2664892 - RNA, 23 nt, Escherichia coli CFT073
gaaucccaguacuguacaacaca

SEQ ID NO: 2664893 - RNA, 13 nt, Escherichia coli CFT073
gaaucccaucaga

SEQ ID NO: 2664894 - RNA, 20 nt, Escherichia coli CFT073
gaauccccacaaaccaccga

SEQ ID NO: 2664895 - RNA, 17 nt, Escherichia coli CFT073
gaauccgcaccaacucc

SEQ ID NO: 2664896 - RNA, 15 nt, Escherichia coli CFT073
gaauccgccccgcgu

SEQ ID NO: 2664897 - RNA, 13 nt, Escherichia coli CFT073
gaauccggcagcg

SEQ ID NO: 2664898 - RNA, 16 nt, Escherichia coli CFT073
gaauccggucccuucu

SEQ ID NO: 2664899 - RNA, 15 nt, Escherichia coli CFT073
gaauccuucccccac

SEQ ID NO: 2664900 - RNA, 16 nt, Escherichia coli CFT073
gaauccuucccccacc

SEQ ID NO: 2664901 - RNA, 18 nt, Escherichia coli CFT073
gaaucgagcaauaaacac

SEQ ID NO: 2664902 - RNA, 13 nt, Escherichia coli CFT073
gaaucgauaaccc

SEQ ID NO: 2664903 - RNA, 18 nt, Escherichia coli CFT073
gaaucgauaacugcucuc

SEQ ID NO: 2664904 - RNA, 17 nt, Escherichia coli CFT073
gaaucgccacaacuuca

SEQ ID NO: 2664905 - RNA, 13 nt, Escherichia coli CFT073
gaaucgccagcau

SEQ ID NO: 2664906 - RNA, 14 nt, Escherichia coli CFT073
gaaucgccagcauc

SEQ ID NO: 2664907 - RNA, 18 nt, Escherichia coli CFT073
gaaucgccagcaucggca

SEQ ID NO: 2664908 - RNA, 20 nt, Escherichia coli CFT073
gaaucgccgaaauuucgccg

SEQ ID NO: 2664909 - RNA, 14 nt, Escherichia coli CFT073
gaaucggcgcagca

SEQ ID NO: 2664910 - RNA, 15 nt, Escherichia coli CFT073
gaaucgguccgccac

SEQ ID NO: 2664911 - RNA, 22 nt, Escherichia coli CFT073
gaaucggugcgcgauggucagu

SEQ ID NO: 2664912 - RNA, 15 nt, Escherichia coli CFT073
gaaucguaggccgga

SEQ ID NO: 2664913 - RNA, 13 nt, Escherichia coli CFT073
gaaucucaggcaa

SEQ ID NO: 2664914 - RNA, 14 nt, Escherichia coli CFT073
gaaucucuuuuguu

SEQ ID NO: 2664915 - RNA, 15 nt, Escherichia coli CFT073
gaaucugccgcagua

SEQ ID NO: 2664916 - RNA, 19 nt, Escherichia coli CFT073
gaaucuguucuggaaaaaa

SEQ ID NO: 2664917 - RNA, 22 nt, Escherichia coli CFT073
gaaucuguucuggaaaaaauuc

SEQ ID NO: 2664918 - RNA, 18 nt, Escherichia coli CFT073
gaaucuucuucucagcca

SEQ ID NO: 2664919 - RNA, 17 nt, Escherichia coli CFT073
gaaucuuuagcggcgga

SEQ ID NO: 2664920 - RNA, 13 nt, Escherichia coli CFT073
gaaugaaaacgaa

SEQ ID NO: 2664921 - RNA, 22 nt, Escherichia coli CFT073
gaaugaaauagacauuacgcau

SEQ ID NO: 2664922 - RNA, 13 nt, Escherichia coli CFT073
gaaugaaguaaac

SEQ ID NO: 2664923 - RNA, 12 nt, Escherichia coli CFT073
gaaugaauuucc

SEQ ID NO: 2664924 - RNA, 22 nt, Escherichia coli CFT073
gaaugacaucaucgccccgcuc

SEQ ID NO: 2664925 - RNA, 22 nt, Escherichia coli CFT073
gaaugaccgcuaauagcgcagc

SEQ ID NO: 2664926 - RNA, 19 nt, Escherichia coli CFT073
gaaugacggaucuuccagc

SEQ ID NO: 2664927 - RNA, 12 nt, Escherichia coli CFT073
gaaugacuaagc

SEQ ID NO: 2664928 - RNA, 15 nt, Escherichia coli CFT073
gaaugacuaagcgau

SEQ ID NO: 2664929 - RNA, 15 nt, Escherichia coli CFT073
gaaugagcgauggcg

SEQ ID NO: 2664930 - RNA, 15 nt, Escherichia coli CFT073
gaaugauaugcccag

SEQ ID NO: 2664931 - RNA, 22 nt, Escherichia coli CFT073
gaaugaucagcgguuuugccag

SEQ ID NO: 2664932 - RNA, 17 nt, Escherichia coli CFT073
gaaugccaaauccggca

SEQ ID NO: 2664933 - RNA, 14 nt, Escherichia coli CFT073
gaaugccagcagca

SEQ ID NO: 2664934 - RNA, 16 nt, Escherichia coli CFT073
gaaugccauaaaaguc

SEQ ID NO: 2664935 - RNA, 21 nt, Escherichia coli CFT073
gaaugccccauugcaacgugg

SEQ ID NO: 2664936 - RNA, 21 nt, Escherichia coli CFT073
gaaugccgcagcacccugagu

SEQ ID NO: 2664937 - RNA, 18 nt, Escherichia coli CFT073
gaaugccgcgccccaucu

SEQ ID NO: 2664938 - RNA, 18 nt, Escherichia coli CFT073
gaaugccggaaucagaau

SEQ ID NO: 2664939 - RNA, 21 nt, Escherichia coli CFT073
gaaugccggaaucagaauccg

SEQ ID NO: 2664940 - RNA, 16 nt, Escherichia coli CFT073
gaaugccggauuucau

SEQ ID NO: 2664941 - RNA, 12 nt, Escherichia coli CFT073
gaaugccugauc

SEQ ID NO: 2664942 - RNA, 14 nt, Escherichia coli CFT073
gaaugccugccagc

SEQ ID NO: 2664943 - RNA, 17 nt, Escherichia coli CFT073
gaaugcgcuugcagacg

SEQ ID NO: 2664944 - RNA, 13 nt, Escherichia coli CFT073
gaaugcuccccag

SEQ ID NO: 2664945 - RNA, 19 nt, Escherichia coli CFT073
gaaugcucgcuggcaggcc

SEQ ID NO: 2664946 - RNA, 15 nt, Escherichia coli CFT073
gaauggaaacagcac

SEQ ID NO: 2664947 - RNA, 16 nt, Escherichia coli CFT073
cacaccugacgaugcg

SEQ ID NO: 2664948 - RNA, 13 nt, Escherichia coli CFT073
cacaccugcucag

SEQ ID NO: 2664949 - RNA, 14 nt, Escherichia coli CFT073
cacaccuucaagaa

SEQ ID NO: 2664950 - RNA, 23 nt, Escherichia coli CFT073
cacaccuucuugcgucacaaaua

SEQ ID NO: 2664951 - RNA, 23 nt, Escherichia coli CFT073
cacaccuuguggaaauuccagcg

SEQ ID NO: 2664952 - RNA, 13 nt, Escherichia coli CFT073
cacacgacgccag

SEQ ID NO: 2664953 - RNA, 14 nt, Escherichia coli CFT073
cacacgacgcgcca

SEQ ID NO: 2664954 - RNA, 20 nt, Escherichia coli CFT073
cacacgacgcgccagcagcg

SEQ ID NO: 2664955 - RNA, 21 nt, Escherichia coli CFT073
cacacgcccaguucaaacggc

SEQ ID NO: 2664956 - RNA, 13 nt, Escherichia coli CFT073
cacacgcgcugag

SEQ ID NO: 2664957 - RNA, 15 nt, Escherichia coli CFT073
cacacggauauugcu

SEQ ID NO: 2664958 - RNA, 18 nt, Escherichia coli CFT073
cacacggauauugcuaug

SEQ ID NO: 2664959 - RNA, 14 nt, Escherichia coli CFT073
cacacggccaucac

SEQ ID NO: 2664960 - RNA, 13 nt, Escherichia coli CFT073
cacacuaccgccg

SEQ ID NO: 2664961 - RNA, 12 nt, Escherichia coli CFT073
cacacucaauga

SEQ ID NO: 2664962 - RNA, 14 nt, Escherichia coli CFT073
cacacucugccagc

SEQ ID NO: 2664963 - RNA, 13 nt, Escherichia coli CFT073
cacacugaauaaa

SEQ ID NO: 2664964 - RNA, 18 nt, Escherichia coli CFT073
cacacugacuuuaccugc

SEQ ID NO: 2664965 - RNA, 21 nt, Escherichia coli CFT073
cacacugacuuuaccugccug

SEQ ID NO: 2664966 - RNA, 23 nt, Escherichia coli CFT073
cacacugacuuuaccugccugac

SEQ ID NO: 2664967 - RNA, 23 nt, Escherichia coli CFT073
cacacugaugacaggcuacugcc

SEQ ID NO: 2664968 - RNA, 19 nt, Escherichia coli CFT073
cacacugccagugucggau

SEQ ID NO: 2664969 - RNA, 15 nt, Escherichia coli CFT073
cacacugcggccagc

SEQ ID NO: 2664970 - RNA, 22 nt, Escherichia coli CFT073
cacacugguucccagagcuuuu

SEQ ID NO: 2664971 - RNA, 20 nt, Escherichia coli CFT073
cacacuucaauauuaaugcu

SEQ ID NO: 2664972 - RNA, 16 nt, Escherichia coli CFT073
cacacuucuucagcca

SEQ ID NO: 2664973 - RNA, 14 nt, Escherichia coli CFT073
cacacuugguuugu

SEQ ID NO: 2664974 - RNA, 14 nt, Escherichia coli CFT073
cacacuuucaucaa

SEQ ID NO: 2664975 - RNA, 16 nt, Escherichia coli CFT073
cacacuuuccaguucc

SEQ ID NO: 2664976 - RNA, 18 nt, Escherichia coli CFT073
cacagaaaagcagagugu

SEQ ID NO: 2664977 - RNA, 14 nt, Escherichia coli CFT073
cacagaaacgccau

SEQ ID NO: 2664978 - RNA, 13 nt, Escherichia coli CFT073
cacagaacaaaau

SEQ ID NO: 2664979 - RNA, 11 nt, Escherichia coli CFT073
cacagaaguga

SEQ ID NO: 2664980 - RNA, 22 nt, Escherichia coli CFT073
cacagaauggcauuauuuacgc

SEQ ID NO: 2664981 - RNA, 13 nt, Escherichia coli CFT073
cacagacaaacag

SEQ ID NO: 2664982 - RNA, 13 nt, Escherichia coli CFT073
cacagacgaaggu

SEQ ID NO: 2664983 - RNA, 19 nt, Escherichia coli CFT073
cacagagcgcuuauacacc

SEQ ID NO: 2664984 - RNA, 16 nt, Escherichia coli CFT073
cacagaggucuuuucu

SEQ ID NO: 2664985 - RNA, 18 nt, Escherichia coli CFT073
cacagaggucuuuucucg

SEQ ID NO: 2664986 - RNA, 14 nt, Escherichia coli CFT073
cacagaguauuucc

SEQ ID NO: 2664987 - RNA, 17 nt, Escherichia coli CFT073
cacagaguguauucaug

SEQ ID NO: 2664988 - RNA, 19 nt, Escherichia coli CFT073
cacagaguguauucaugcc

SEQ ID NO: 2664989 - RNA, 14 nt, Escherichia coli CFT073
cacagauaaaucaa

SEQ ID NO: 2664990 - RNA, 13 nt, Escherichia coli CFT073
cacagcaaaacgc

SEQ ID NO: 2664991 - RNA, 21 nt, Escherichia coli CFT073
cacagcaaaacgcccgcaacu

SEQ ID NO: 2664992 - RNA, 20 nt, Escherichia coli CFT073
cacagcaauuuugcccagcc

SEQ ID NO: 2664993 - RNA, 12 nt, Escherichia coli CFT073
cacagcacccca

SEQ ID NO: 2664994 - RNA, 18 nt, Escherichia coli CFT073
cacagcaccccauagcca

SEQ ID NO: 2664995 - RNA, 15 nt, Escherichia coli CFT073
cacagcagccuucgc

SEQ ID NO: 2664996 - RNA, 13 nt, Escherichia coli CFT073
cacagcauccgaa

SEQ ID NO: 2664997 - RNA, 18 nt, Escherichia coli CFT073
cacagcauccgaacgcug

SEQ ID NO: 2664998 - RNA, 23 nt, Escherichia coli CFT073
cacagccagccuccaacccacaa

SEQ ID NO: 2664999 - RNA, 18 nt, Escherichia coli CFT073
cacagccauggcauccaa

SEQ ID NO: 2665000 - RNA, 23 nt, Escherichia coli CFT073
cacagccauggcauccaagcugg

SEQ ID NO: 2665001 - RNA, 14 nt, Escherichia coli CFT073
cacagcccgccaca

SEQ ID NO: 2665002 - RNA, 13 nt, Escherichia coli CFT073
cacagcgcaccaa

SEQ ID NO: 2665003 - RNA, 13 nt, Escherichia coli CFT073
cacagcgccagac

SEQ ID NO: 2665004 - RNA, 21 nt, Escherichia coli CFT073
cacagcggacaucuggucgag

SEQ ID NO: 2665005 - RNA, 13 nt, Escherichia coli CFT073
cacagcggcagca

SEQ ID NO: 2665006 - RNA, 22 nt, Escherichia coli CFT073
cacagcgggguaaucgccagca

SEQ ID NO: 2665007 - RNA, 16 nt, Escherichia coli CFT073
cacagcgugcauagca

SEQ ID NO: 2665008 - RNA, 23 nt, Escherichia coli CFT073
cacagcuacgcaucaugccgccc

SEQ ID NO: 2665009 - RNA, 17 nt, Escherichia coli CFT073
cacagcuauaccgccag

SEQ ID NO: 2665010 - RNA, 12 nt, Escherichia coli CFT073
cacagcucugcu

SEQ ID NO: 2665011 - RNA, 13 nt, Escherichia coli CFT073
cacagcucugcug

SEQ ID NO: 2665012 - RNA, 17 nt, Escherichia coli CFT073
cacaggagacaccagcg

SEQ ID NO: 2665013 - RNA, 20 nt, Escherichia coli CFT073
cacaggauggcccaaauggc

SEQ ID NO: 2665014 - RNA, 14 nt, Escherichia coli CFT073
cacaggccaucaca

SEQ ID NO: 2665015 - RNA, 23 nt, Escherichia coli CFT073
cacaggcuggcgucacgccgacc

SEQ ID NO: 2665016 - RNA, 18 nt, Escherichia coli CFT073
cacaggucgcaaacggcg

SEQ ID NO: 2665017 - RNA, 21 nt, Escherichia coli CFT073
cacaguaagccgguaaucacc

SEQ ID NO: 2665018 - RNA, 13 nt, Escherichia coli CFT073
cacagucgaugca

SEQ ID NO: 2665019 - RNA, 12 nt, Escherichia coli CFT073
cacagugacccg

SEQ ID NO: 2665020 - RNA, 14 nt, Escherichia coli CFT073
cacaguuaaccagu

SEQ ID NO: 2665021 - RNA, 18 nt, Escherichia coli CFT073
cacaguuucagccccauc

SEQ ID NO: 2665022 - RNA, 21 nt, Escherichia coli CFT073
cacaguuucauaucugccaga

SEQ ID NO: 2665023 - RNA, 17 nt, Escherichia coli CFT073
cacaguuuuacugcagc

SEQ ID NO: 2665024 - RNA, 18 nt, Escherichia coli CFT073
cacaguuuuacugcagcc

SEQ ID NO: 2665025 - RNA, 22 nt, Escherichia coli CFT073
cacaguuuuacugcagccagcg

SEQ ID NO: 2665026 - RNA, 21 nt, Escherichia coli CFT073
cacauaaaguagccaaucccg

SEQ ID NO: 2665027 - RNA, 21 nt, Escherichia coli CFT073
cacauaaccagguaaagacca

SEQ ID NO: 2665028 - RNA, 15 nt, Escherichia coli CFT073
cacauaaccagugac

SEQ ID NO: 2665029 - RNA, 14 nt, Escherichia coli CFT073
cacauaagcugaau

SEQ ID NO: 2665030 - RNA, 23 nt, Escherichia coli CFT073
cacauaaugaugccgucuuuauc

SEQ ID NO: 2665031 - RNA, 17 nt, Escherichia coli CFT073
cacauaauugagcagca

SEQ ID NO: 2665032 - RNA, 21 nt, Escherichia coli CFT073
cacauaauugagcagcaaaau

SEQ ID NO: 2665033 - RNA, 18 nt, Escherichia coli CFT073
cacauacauaauaaucua

SEQ ID NO: 2665034 - RNA, 15 nt, Escherichia coli CFT073
cacauacauguauaa

SEQ ID NO: 2665035 - RNA, 22 nt, Escherichia coli CFT073
cacauacgcgguauuaaauccg

SEQ ID NO: 2665036 - RNA, 18 nt, Escherichia coli CFT073
cacauacugcaucagcgc

SEQ ID NO: 2665037 - RNA, 21 nt, Escherichia coli CFT073
cacauacugcuugccauucac

SEQ ID NO: 2665038 - RNA, 16 nt, Escherichia coli CFT073
cacauagauaaagccg

SEQ ID NO: 2665039 - RNA, 21 nt, Escherichia coli CFT073
cacauauugcaccagaucuuc

SEQ ID NO: 2665040 - RNA, 22 nt, Escherichia coli CFT073
cacaucaacaccgacuucaaua

SEQ ID NO: 2665041 - RNA, 14 nt, Escherichia coli CFT073
cacaucaauauucc

SEQ ID NO: 2665042 - RNA, 14 nt, Escherichia coli CFT073
cacaucacauccag

SEQ ID NO: 2665043 - RNA, 13 nt, Escherichia coli CFT073
cacaucaccauaa

SEQ ID NO: 2665044 - RNA, 17 nt, Escherichia coli CFT073
cacaucagaacagcccc

SEQ ID NO: 2665045 - RNA, 12 nt, Escherichia coli CFT073
cacaucagcgcc

SEQ ID NO: 2665046 - RNA, 15 nt, Escherichia coli CFT073
cacaucagcgcccuc

SEQ ID NO: 2665047 - RNA, 19 nt, Escherichia coli CFT073
cacaucaggcccacuacac

SEQ ID NO: 2665048 - RNA, 15 nt, Escherichia coli CFT073
cacaucaggcugaga

SEQ ID NO: 2665049 - RNA, 22 nt, Escherichia coli CFT073
cacaucaggcugagaagggauu

SEQ ID NO: 2665050 - RNA, 15 nt, Escherichia coli CFT073
cacaucagugauaca

SEQ ID NO: 2665051 - RNA, 15 nt, Escherichia coli CFT073
cacaucaucaaagcc

SEQ ID NO: 2665052 - RNA, 16 nt, Escherichia coli CFT073
cacauccaccagcgcc

SEQ ID NO: 2665053 - RNA, 14 nt, Escherichia coli CFT073
cacauccaguacgc

SEQ ID NO: 2665054 - RNA, 14 nt, Escherichia coli CFT073
cacaucccagcaga

SEQ ID NO: 2665055 - RNA, 13 nt, Escherichia coli CFT073
cacauccugccag

SEQ ID NO: 2665056 - RNA, 21 nt, Escherichia coli CFT073
caccacguagcaucugguaac

SEQ ID NO: 2665057 - RNA, 12 nt, Escherichia coli CFT073
caccacuccuca

SEQ ID NO: 2665058 - RNA, 19 nt, Escherichia coli CFT073
caccacugaauaacauuau

SEQ ID NO: 2665059 - RNA, 13 nt, Escherichia coli CFT073
caccacugacaau

SEQ ID NO: 2665060 - RNA, 19 nt, Escherichia coli CFT073
caccacugacaaucgccag

SEQ ID NO: 2665061 - RNA, 22 nt, Escherichia coli CFT073
caccacugacaaucgccaguga

SEQ ID NO: 2665062 - RNA, 20 nt, Escherichia coli CFT073
caccacuggcgauauugccg

SEQ ID NO: 2665063 - RNA, 14 nt, Escherichia coli CFT073
caccacuuccugcu

SEQ ID NO: 2665064 - RNA, 20 nt, Escherichia coli CFT073
caccacuucuuucacgcccg

SEQ ID NO: 2665065 - RNA, 21 nt, Escherichia coli CFT073
caccacuucuuucacgcccgc

SEQ ID NO: 2665066 - RNA, 14 nt, Escherichia coli CFT073
caccacuugcuggu

SEQ ID NO: 2665067 - RNA, 19 nt, Escherichia coli CFT073
caccacuuguagaccagga

SEQ ID NO: 2665068 - RNA, 14 nt, Escherichia coli CFT073
caccacuuuauagc

SEQ ID NO: 2665069 - RNA, 13 nt, Escherichia coli CFT073
caccagaaacaau

SEQ ID NO: 2665070 - RNA, 17 nt, Escherichia coli CFT073
caccagaaccagcaacc

SEQ ID NO: 2665071 - RNA, 17 nt, Escherichia coli CFT073
caccagaaccgccgcug

SEQ ID NO: 2665072 - RNA, 12 nt, Escherichia coli CFT073
caccagaauacc

SEQ ID NO: 2665073 - RNA, 14 nt, Escherichia coli CFT073
caccagaaucgcca

SEQ ID NO: 2665074 - RNA, 17 nt, Escherichia coli CFT073
caccagaaucgccagca

SEQ ID NO: 2665075 - RNA, 19 nt, Escherichia coli CFT073
caccagaaucgccagcauc

SEQ ID NO: 2665076 - RNA, 13 nt, Escherichia coli CFT073
caccagaccagac

SEQ ID NO: 2665077 - RNA, 17 nt, Escherichia coli CFT073
caccagacgcaacagaa

SEQ ID NO: 2665078 - RNA, 14 nt, Escherichia coli CFT073
caccagagaacuga

SEQ ID NO: 2665079 - RNA, 17 nt, Escherichia coli CFT073
caccagauccugccauu

SEQ ID NO: 2665080 - RNA, 21 nt, Escherichia coli CFT073
caccagauccugccauuggca

SEQ ID NO: 2665081 - RNA, 17 nt, Escherichia coli CFT073
caccagaugguuaguau

SEQ ID NO: 2665082 - RNA, 20 nt, Escherichia coli CFT073
caccagaugguuaguauugc

SEQ ID NO: 2665083 - RNA, 12 nt, Escherichia coli CFT073
caccagcaacac

SEQ ID NO: 2665084 - RNA, 13 nt, Escherichia coli CFT073
caccagcaacacg

SEQ ID NO: 2665085 - RNA, 13 nt, Escherichia coli CFT073
caccagcaauaag

SEQ ID NO: 2665086 - RNA, 16 nt, Escherichia coli CFT073
caccagcaauaagcca

SEQ ID NO: 2665087 - RNA, 20 nt, Escherichia coli CFT073
caccagcaauaagccagucc

SEQ ID NO: 2665088 - RNA, 18 nt, Escherichia coli CFT073
caccagcaauaaugccag

SEQ ID NO: 2665089 - RNA, 22 nt, Escherichia coli CFT073
caccagcaauaaugccaguccc

SEQ ID NO: 2665090 - RNA, 22 nt, Escherichia coli CFT073
caccagcacaucaucaaagcca

SEQ ID NO: 2665091 - RNA, 14 nt, Escherichia coli CFT073
caccagcaccagca

SEQ ID NO: 2665092 - RNA, 17 nt, Escherichia coli CFT073
caccagcaccagcaaca

SEQ ID NO: 2665093 - RNA, 18 nt, Escherichia coli CFT073
caccagcaccgcgacaau

SEQ ID NO: 2665094 - RNA, 14 nt, Escherichia coli CFT073
caccagcagcagcg

SEQ ID NO: 2665095 - RNA, 19 nt, Escherichia coli CFT073
caccagcagcggaaacaau

SEQ ID NO: 2665096 - RNA, 22 nt, Escherichia coli CFT073
caccagcaguaaaccacccacc

SEQ ID NO: 2665097 - RNA, 15 nt, Escherichia coli CFT073
caccagcaucaacaa

SEQ ID NO: 2665098 - RNA, 19 nt, Escherichia coli CFT073
caccagcaucaacaacaau

SEQ ID NO: 2665099 - RNA, 20 nt, Escherichia coli CFT073
caccagcauuccuaaaccau

SEQ ID NO: 2665100 - RNA, 20 nt, Escherichia coli CFT073
caccagccaacaaucgcugc

SEQ ID NO: 2665101 - RNA, 22 nt, Escherichia coli CFT073
caccagccagacucagcaacag

SEQ ID NO: 2665102 - RNA, 23 nt, Escherichia coli CFT073
caccagccauuaaccagccacug

SEQ ID NO: 2665103 - RNA, 23 nt, Escherichia coli CFT073
caccagcccgacgauaccgccgc

SEQ ID NO: 2665104 - RNA, 16 nt, Escherichia coli CFT073
caccagcgacagccag

SEQ ID NO: 2665105 - RNA, 12 nt, Escherichia coli CFT073
caccagcgccac

SEQ ID NO: 2665106 - RNA, 13 nt, Escherichia coli CFT073
caccagcgccacc

SEQ ID NO: 2665107 - RNA, 14 nt, Escherichia coli CFT073
caccagcgccacca

SEQ ID NO: 2665108 - RNA, 15 nt, Escherichia coli CFT073
caccagcgccgccca

SEQ ID NO: 2665109 - RNA, 17 nt, Escherichia coli CFT073
caccagcgccgcccaca

SEQ ID NO: 2665110 - RNA, 20 nt, Escherichia coli CFT073
caccagcgccgcccacaaca

SEQ ID NO: 2665111 - RNA, 14 nt, Escherichia coli CFT073
caccagcgcgagga

SEQ ID NO: 2665112 - RNA, 21 nt, Escherichia coli CFT073
caccagcggaauuccggcuuc

SEQ ID NO: 2665113 - RNA, 14 nt, Escherichia coli CFT073
caccagcggcaccu

SEQ ID NO: 2665114 - RNA, 17 nt, Escherichia coli CFT073
caccagcgucagaaaca

SEQ ID NO: 2665115 - RNA, 14 nt, Escherichia coli CFT073
caccagcgucaguu

SEQ ID NO: 2665116 - RNA, 22 nt, Escherichia coli CFT073
caccagcgucaucaauccugca

SEQ ID NO: 2665117 - RNA, 19 nt, Escherichia coli CFT073
caccaggaacgcgccaaga

SEQ ID NO: 2665118 - RNA, 20 nt, Escherichia coli CFT073
caccaggaacgcgccaagau

SEQ ID NO: 2665119 - RNA, 21 nt, Escherichia coli CFT073
caccaggaacucagcgugcca

SEQ ID NO: 2665120 - RNA, 13 nt, Escherichia coli CFT073
caccaggaagccu

SEQ ID NO: 2665121 - RNA, 17 nt, Escherichia coli CFT073
caccaggaagccuuccg

SEQ ID NO: 2665122 - RNA, 20 nt, Escherichia coli CFT073
caccaggcaguuuauccagc

SEQ ID NO: 2665123 - RNA, 23 nt, Escherichia coli CFT073
caccaggccgcgcaggugguuau

SEQ ID NO: 2665124 - RNA, 20 nt, Escherichia coli CFT073
caccaggcucuuugaacagu

SEQ ID NO: 2665125 - RNA, 16 nt, Escherichia coli CFT073
caccagggaaauaauc

SEQ ID NO: 2665126 - RNA, 18 nt, Escherichia coli CFT073
caccagguucaacagcgu

SEQ ID NO: 2665127 - RNA, 18 nt, Escherichia coli CFT073
caccagguucgccaacaa

SEQ ID NO: 2665128 - RNA, 16 nt, Escherichia coli CFT073
caccaguaaaacgggc

SEQ ID NO: 2665129 - RNA, 15 nt, Escherichia coli CFT073
caccaguaacuuccc

SEQ ID NO: 2665130 - RNA, 17 nt, Escherichia coli CFT073
caccaguaacuuccccu

SEQ ID NO: 2665131 - RNA, 22 nt, Escherichia coli CFT073
caccaguaaggcaucuucuuca

SEQ ID NO: 2665132 - RNA, 16 nt, Escherichia coli CFT073
caccaguacacugguu

SEQ ID NO: 2665133 - RNA, 15 nt, Escherichia coli CFT073
caccaguaccgccac

SEQ ID NO: 2665134 - RNA, 23 nt, Escherichia coli CFT073
caccagucagaauguguuagcgc

SEQ ID NO: 2665135 - RNA, 14 nt, Escherichia coli CFT073
caccaguccaucgg

SEQ ID NO: 2665136 - RNA, 14 nt, Escherichia coli CFT073
caccagugccggaa

SEQ ID NO: 2665137 - RNA, 16 nt, Escherichia coli CFT073
caccaguucagugacc

SEQ ID NO: 2665138 - RNA, 18 nt, Escherichia coli CFT073
caccaguucagugaccga

SEQ ID NO: 2665139 - RNA, 16 nt, Escherichia coli CFT073
caccaguucgccuuca

SEQ ID NO: 2665140 - RNA, 18 nt, Escherichia coli CFT073
caccaguucgccuucauu

SEQ ID NO: 2665141 - RNA, 19 nt, Escherichia coli CFT073
caccaguucgccuucauuc

SEQ ID NO: 2665142 - RNA, 15 nt, Escherichia coli CFT073
caccaguucgcgcag

SEQ ID NO: 2665143 - RNA, 22 nt, Escherichia coli CFT073
caccaguugugaugccacuuca

SEQ ID NO: 2665144 - RNA, 18 nt, Escherichia coli CFT073
caccaguuguugcgugaa

SEQ ID NO: 2665145 - RNA, 21 nt, Escherichia coli CFT073
caccauaaaucagaucgacgc

SEQ ID NO: 2665146 - RNA, 12 nt, Escherichia coli CFT073
caccauaacuag

SEQ ID NO: 2665147 - RNA, 15 nt, Escherichia coli CFT073
caccauaaucagcgu

SEQ ID NO: 2665148 - RNA, 21 nt, Escherichia coli CFT073
caccauacgccuguuuuugcg

SEQ ID NO: 2665149 - RNA, 23 nt, Escherichia coli CFT073
caccauauacuccgcaccgcggu

SEQ ID NO: 2665150 - RNA, 14 nt, Escherichia coli CFT073
caccauauccagcg

SEQ ID NO: 2665151 - RNA, 16 nt, Escherichia coli CFT073
caccauauucagcagc

SEQ ID NO: 2665152 - RNA, 16 nt, Escherichia coli CFT073
caccaucaaacagccc

SEQ ID NO: 2665153 - RNA, 17 nt, Escherichia coli CFT073
caccaucaaacagcccc

SEQ ID NO: 2665154 - RNA, 13 nt, Escherichia coli CFT073
caccaucaacaaa

SEQ ID NO: 2665155 - RNA, 19 nt, Escherichia coli CFT073
caccaucaacaaacgccag

SEQ ID NO: 2665156 - RNA, 14 nt, Escherichia coli CFT073
caccaucaccucuc

SEQ ID NO: 2665157 - RNA, 20 nt, Escherichia coli CFT073
caccaucaccucucacgacg

SEQ ID NO: 2665158 - RNA, 15 nt, Escherichia coli CFT073
caccaucagcagcaa

SEQ ID NO: 2665159 - RNA, 13 nt, Escherichia coli CFT073
caccaucaguggc

SEQ ID NO: 2665160 - RNA, 13 nt, Escherichia coli CFT073
caccaucaucggc

SEQ ID NO: 2665161 - RNA, 14 nt, Escherichia coli CFT073
caccaucaucggca

SEQ ID NO: 2665162 - RNA, 14 nt, Escherichia coli CFT073
caccauccagcaac

SEQ ID NO: 2665163 - RNA, 15 nt, Escherichia coli CFT073
caccauccagcaaca

SEQ ID NO: 2665164 - RNA, 14 nt, Escherichia coli CFT073
caccauccccacca

SEQ ID NO: 2665165 - RNA, 16 nt, Escherichia coli CFT073
caccgccgccgggcuu

SEQ ID NO: 2665166 - RNA, 22 nt, Escherichia coli CFT073
caccgccguuaccuucggcccc

SEQ ID NO: 2665167 - RNA, 16 nt, Escherichia coli CFT073
caccgccuaccgccag

SEQ ID NO: 2665168 - RNA, 20 nt, Escherichia coli CFT073
caccgccuccaccugagggg

SEQ ID NO: 2665169 - RNA, 14 nt, Escherichia coli CFT073
caccgccuucguaa

SEQ ID NO: 2665170 - RNA, 13 nt, Escherichia coli CFT073
caccgcgaaaaca

SEQ ID NO: 2665171 - RNA, 18 nt, Escherichia coli CFT073
caccgcgaagcagcucca

SEQ ID NO: 2665172 - RNA, 20 nt, Escherichia coli CFT073
caccgcgaagcagcuccaga

SEQ ID NO: 2665173 - RNA, 14 nt, Escherichia coli CFT073
caccgcgacaauca

SEQ ID NO: 2665174 - RNA, 21 nt, Escherichia coli CFT073
caccgcgacaaucagguaagc

SEQ ID NO: 2665175 - RNA, 16 nt, Escherichia coli CFT073
caccgcgcccacauaa

SEQ ID NO: 2665176 - RNA, 15 nt, Escherichia coli CFT073
caccgcgcuggcuga

SEQ ID NO: 2665177 - RNA, 23 nt, Escherichia coli CFT073
caccgcguaugcccagcgcagaa

SEQ ID NO: 2665178 - RNA, 19 nt, Escherichia coli CFT073
caccgcgugaaucaacacc

SEQ ID NO: 2665179 - RNA, 12 nt, Escherichia coli CFT073
caccgcgugcga

SEQ ID NO: 2665180 - RNA, 14 nt, Escherichia coli CFT073
caccgcgugcgacg

SEQ ID NO: 2665181 - RNA, 18 nt, Escherichia coli CFT073
caccgcuacguucgcgag

SEQ ID NO: 2665182 - RNA, 23 nt, Escherichia coli CFT073
caccgcuacguucgcgaggagcg

SEQ ID NO: 2665183 - RNA, 17 nt, Escherichia coli CFT073
caccgcucugcaucccg

SEQ ID NO: 2665184 - RNA, 13 nt, Escherichia coli CFT073
caccgcugcuucu

SEQ ID NO: 2665185 - RNA, 16 nt, Escherichia coli CFT073
caccgcuucaacagcg

SEQ ID NO: 2665186 - RNA, 19 nt, Escherichia coli CFT073
caccgcuucgcucacauca

SEQ ID NO: 2665187 - RNA, 22 nt, Escherichia coli CFT073
caccgcuuuaaaauuauccagc

SEQ ID NO: 2665188 - RNA, 23 nt, Escherichia coli CFT073
caccgcuuuaaaauuauccagcg

SEQ ID NO: 2665189 - RNA, 19 nt, Escherichia coli CFT073
caccgcuuuuuucaucucu

SEQ ID NO: 2665190 - RNA, 20 nt, Escherichia coli CFT073
caccgcuuuuuucaucucuu

SEQ ID NO: 2665191 - RNA, 14 nt, Escherichia coli CFT073
caccggaaauugcu

SEQ ID NO: 2665192 - RNA, 23 nt, Escherichia coli CFT073
caccggaacaacccagcggauga

SEQ ID NO: 2665193 - RNA, 18 nt, Escherichia coli CFT073
caccggaauggucaccac

SEQ ID NO: 2665194 - RNA, 22 nt, Escherichia coli CFT073
caccggaauggucaccacaaau

SEQ ID NO: 2665195 - RNA, 21 nt, Escherichia coli CFT073
caccggaauggucaguuucgc

SEQ ID NO: 2665196 - RNA, 16 nt, Escherichia coli CFT073
caccggcaaucugcug

SEQ ID NO: 2665197 - RNA, 19 nt, Escherichia coli CFT073
caccggcaaucugcuggca

SEQ ID NO: 2665198 - RNA, 11 nt, Escherichia coli CFT073
caccggcaccg

SEQ ID NO: 2665199 - RNA, 17 nt, Escherichia coli CFT073
caccggcguaacgccgc

SEQ ID NO: 2665200 - RNA, 21 nt, Escherichia coli CFT073
caccgggagauccagcauucc

SEQ ID NO: 2665201 - RNA, 15 nt, Escherichia coli CFT073
caccgggccgaugcg

SEQ ID NO: 2665202 - RNA, 18 nt, Escherichia coli CFT073
caccgggggguugccgcc

SEQ ID NO: 2665203 - RNA, 20 nt, Escherichia coli CFT073
caccgggggguugccgccac

SEQ ID NO: 2665204 - RNA, 21 nt, Escherichia coli CFT073
caccgggggguugccgccacu

SEQ ID NO: 2665205 - RNA, 14 nt, Escherichia coli CFT073
caccgguacaaaca

SEQ ID NO: 2665206 - RNA, 15 nt, Escherichia coli CFT073
caccgguacaaacau

SEQ ID NO: 2665207 - RNA, 16 nt, Escherichia coli CFT073
caccgguacacaaccg

SEQ ID NO: 2665208 - RNA, 16 nt, Escherichia coli CFT073
caccgguacaggcauc

SEQ ID NO: 2665209 - RNA, 13 nt, Escherichia coli CFT073
caccggucagaca

SEQ ID NO: 2665210 - RNA, 18 nt, Escherichia coli CFT073
caccggugaccaucagca

SEQ ID NO: 2665211 - RNA, 16 nt, Escherichia coli CFT073
caccggugauuauugu

SEQ ID NO: 2665212 - RNA, 21 nt, Escherichia coli CFT073
caccgguguaggcauacacau

SEQ ID NO: 2665213 - RNA, 22 nt, Escherichia coli CFT073
caccgguucaucacgaaaauca

SEQ ID NO: 2665214 - RNA, 12 nt, Escherichia coli CFT073
caccguaaccac

SEQ ID NO: 2665215 - RNA, 15 nt, Escherichia coli CFT073
caccguaagaucgcg

SEQ ID NO: 2665216 - RNA, 17 nt, Escherichia coli CFT073
caccguaauugccagac

SEQ ID NO: 2665217 - RNA, 18 nt, Escherichia coli CFT073
caccguaccaucauaagc

SEQ ID NO: 2665218 - RNA, 15 nt, Escherichia coli CFT073
caccguacuccugug

SEQ ID NO: 2665219 - RNA, 14 nt, Escherichia coli CFT073
caccguauccagug

SEQ ID NO: 2665220 - RNA, 14 nt, Escherichia coli CFT073
caccgucacuucuu

SEQ ID NO: 2665221 - RNA, 16 nt, Escherichia coli CFT073
caccgucacuucuucg

SEQ ID NO: 2665222 - RNA, 20 nt, Escherichia coli CFT073
caccgucaggcguaacgaca

SEQ ID NO: 2665223 - RNA, 15 nt, Escherichia coli CFT073
caccguccagaucau

SEQ ID NO: 2665224 - RNA, 13 nt, Escherichia coli CFT073
caccguccagcgg

SEQ ID NO: 2665225 - RNA, 18 nt, Escherichia coli CFT073
caccgucgcaccgguauc

SEQ ID NO: 2665226 - RNA, 16 nt, Escherichia coli CFT073
caccgugaaagagauc

SEQ ID NO: 2665227 - RNA, 23 nt, Escherichia coli CFT073
caccgugaaagagaucaaaguga

SEQ ID NO: 2665228 - RNA, 21 nt, Escherichia coli CFT073
caccgugcacuucugcgguga

SEQ ID NO: 2665229 - RNA, 19 nt, Escherichia coli CFT073
caccgugccgcuguucuga

SEQ ID NO: 2665230 - RNA, 15 nt, Escherichia coli CFT073
caccguguucaugac

SEQ ID NO: 2665231 - RNA, 21 nt, Escherichia coli CFT073
caccguguucaugaccgugau

SEQ ID NO: 2665232 - RNA, 17 nt, Escherichia coli CFT073
caccguuaccggacggc

SEQ ID NO: 2665233 - RNA, 15 nt, Escherichia coli CFT073
caccguugagguuga

SEQ ID NO: 2665234 - RNA, 23 nt, Escherichia coli CFT073
caccguuuaccucgucaccaccu

SEQ ID NO: 2665235 - RNA, 12 nt, Escherichia coli CFT073
caccuacagcca

SEQ ID NO: 2665236 - RNA, 13 nt, Escherichia coli CFT073
caccuacaugacc

SEQ ID NO: 2665237 - RNA, 15 nt, Escherichia coli CFT073
caccuacgcccgcca

SEQ ID NO: 2665238 - RNA, 18 nt, Escherichia coli CFT073
caccucacaccccggauu

SEQ ID NO: 2665239 - RNA, 15 nt, Escherichia coli CFT073
caccucaccgguccc

SEQ ID NO: 2665240 - RNA, 19 nt, Escherichia coli CFT073
caccucaggaaaagcaaaa

SEQ ID NO: 2665241 - RNA, 20 nt, Escherichia coli CFT073
caccucaucaccacagacaa

SEQ ID NO: 2665242 - RNA, 21 nt, Escherichia coli CFT073
caccucaucaccacagacaaa

SEQ ID NO: 2665243 - RNA, 14 nt, Escherichia coli CFT073
caccuccacgccca

SEQ ID NO: 2665244 - RNA, 18 nt, Escherichia coli CFT073
caccuccacgcccagcgc

SEQ ID NO: 2665245 - RNA, 14 nt, Escherichia coli CFT073
caccucggcacuga

SEQ ID NO: 2665246 - RNA, 21 nt, Escherichia coli CFT073
caccucggcacugacgcgcuu

SEQ ID NO: 2665247 - RNA, 12 nt, Escherichia coli CFT073
caccucgugcgc

SEQ ID NO: 2665248 - RNA, 19 nt, Escherichia coli CFT073
caccucucacgacgcuggu

SEQ ID NO: 2665249 - RNA, 20 nt, Escherichia coli CFT073
caccucuccacgcaucugca

SEQ ID NO: 2665250 - RNA, 18 nt, Escherichia coli CFT073
caccucuccgggcggcgu

SEQ ID NO: 2665251 - RNA, 12 nt, Escherichia coli CFT073
caccucugcaac

SEQ ID NO: 2665252 - RNA, 19 nt, Escherichia coli CFT073
caccucugucgaugcgcuc

SEQ ID NO: 2665253 - RNA, 13 nt, Escherichia coli CFT073
caccucuucaccg

SEQ ID NO: 2665254 - RNA, 19 nt, Escherichia coli CFT073
caccugaaauggucgcccc

SEQ ID NO: 2665255 - RNA, 22 nt, Escherichia coli CFT073
caccugaacuucuucgccaggu

SEQ ID NO: 2665256 - RNA, 19 nt, Escherichia coli CFT073
caccugaguaccuugcuga

SEQ ID NO: 2665257 - RNA, 24 nt, Escherichia coli CFT073
caccugauacgcgccaaucggcaa

SEQ ID NO: 2665258 - RNA, 18 nt, Escherichia coli CFT073
caccugauagucacgcag

SEQ ID NO: 2665259 - RNA, 20 nt, Escherichia coli CFT073
caccugauccagcucuuccu

SEQ ID NO: 2665260 - RNA, 21 nt, Escherichia coli CFT073
caccugauccagcucuuccuc

SEQ ID NO: 2665261 - RNA, 13 nt, Escherichia coli CFT073
caccugauuaccu

SEQ ID NO: 2665262 - RNA, 18 nt, Escherichia coli CFT073
caccugauuaguggcaca

SEQ ID NO: 2665263 - RNA, 23 nt, Escherichia coli CFT073
caccugauugaccgccagcgcca

SEQ ID NO: 2665264 - RNA, 20 nt, Escherichia coli CFT073
caccugcaacggcaucgcca

SEQ ID NO: 2665265 - RNA, 20 nt, Escherichia coli CFT073
caccugcacaccaaccgcuu

SEQ ID NO: 2665266 - RNA, 15 nt, Escherichia coli CFT073
caccugccagcaucu

SEQ ID NO: 2665267 - RNA, 15 nt, Escherichia coli CFT073
caccugccaguuuac

SEQ ID NO: 2665268 - RNA, 23 nt, Escherichia coli CFT073
caccugccaguuuacccagugaa

SEQ ID NO: 2665269 - RNA, 22 nt, Escherichia coli CFT073
caccugcgcggccagugccagu

SEQ ID NO: 2665270 - RNA, 16 nt, Escherichia coli CFT073
caccugcguugccgca

SEQ ID NO: 2665271 - RNA, 21 nt, Escherichia coli CFT073
caccuggcgcauuaacggcaa

SEQ ID NO: 2665272 - RNA, 19 nt, Escherichia coli CFT073
caccuguaaaaaaggcagc

SEQ ID NO: 2665273 - RNA, 12 nt, Escherichia coli CFT073
cacgcucagcaa

SEQ ID NO: 2665274 - RNA, 16 nt, Escherichia coli CFT073
cacgcucagcaacaug

SEQ ID NO: 2665275 - RNA, 13 nt, Escherichia coli CFT073
cacgcucagcaau

SEQ ID NO: 2665276 - RNA, 14 nt, Escherichia coli CFT073
cacgcucccagcag

SEQ ID NO: 2665277 - RNA, 16 nt, Escherichia coli CFT073
cacgcucgcaggcggc

SEQ ID NO: 2665278 - RNA, 17 nt, Escherichia coli CFT073
cacgcucuguucugcgc

SEQ ID NO: 2665279 - RNA, 14 nt, Escherichia coli CFT073
cacgcugccgcgca

SEQ ID NO: 2665280 - RNA, 17 nt, Escherichia coli CFT073
cacgcugcgcugcacca

SEQ ID NO: 2665281 - RNA, 15 nt, Escherichia coli CFT073
cacgcuguaaugcua

SEQ ID NO: 2665282 - RNA, 13 nt, Escherichia coli CFT073
cacgcugucggca

SEQ ID NO: 2665283 - RNA, 17 nt, Escherichia coli CFT073
cacgcugucggcacuga

SEQ ID NO: 2665284 - RNA, 14 nt, Escherichia coli CFT073
cacgcuuaaucgaa

SEQ ID NO: 2665285 - RNA, 19 nt, Escherichia coli CFT073
cacgcuuacucuucguucu

SEQ ID NO: 2665286 - RNA, 15 nt, Escherichia coli CFT073
cacgcuucacugccg

SEQ ID NO: 2665287 - RNA, 17 nt, Escherichia coli CFT073
cacgcuuugauccgcca

SEQ ID NO: 2665288 - RNA, 23 nt, Escherichia coli CFT073
cacggaauaaucgggaacgcuuu

SEQ ID NO: 2665289 - RNA, 19 nt, Escherichia coli CFT073
cacggaauauuucaccggu

SEQ ID NO: 2665290 - RNA, 17 nt, Escherichia coli CFT073
cacggacgcuuguuauc

SEQ ID NO: 2665291 - RNA, 22 nt, Escherichia coli CFT073
cacggacuuaugaguucgcggc

SEQ ID NO: 2665292 - RNA, 22 nt, Escherichia coli CFT073
cacggaucguuuugauauugcg

SEQ ID NO: 2665293 - RNA, 22 nt, Escherichia coli CFT073
cacggaugaauuugugaacagc

SEQ ID NO: 2665294 - RNA, 14 nt, Escherichia coli CFT073
cacggcaaacugcg

SEQ ID NO: 2665295 - RNA, 21 nt, Escherichia coli CFT073
cacggcaggaucugcgcggca

SEQ ID NO: 2665296 - RNA, 18 nt, Escherichia coli CFT073
cacggcauaagccguccc

SEQ ID NO: 2665297 - RNA, 16 nt, Escherichia coli CFT073
cacggcauuuccgcca

SEQ ID NO: 2665298 - RNA, 16 nt, Escherichia coli CFT073
cacggcuccagcaaug

SEQ ID NO: 2665299 - RNA, 23 nt, Escherichia coli CFT073
cacggcuucugacauagccacuc

SEQ ID NO: 2665300 - RNA, 17 nt, Escherichia coli CFT073
cacggcuuugaucagcg

SEQ ID NO: 2665301 - RNA, 20 nt, Escherichia coli CFT073
cacgggcgcggaaagcaccu

SEQ ID NO: 2665302 - RNA, 18 nt, Escherichia coli CFT073
cacggguggucuucauag

SEQ ID NO: 2665303 - RNA, 14 nt, Escherichia coli CFT073
cacggguugcgccu

SEQ ID NO: 2665304 - RNA, 20 nt, Escherichia coli CFT073
cacggucacuacacgaccau

SEQ ID NO: 2665305 - RNA, 15 nt, Escherichia coli CFT073
cacggugcuccagug

SEQ ID NO: 2665306 - RNA, 19 nt, Escherichia coli CFT073
cacggugcuccagugcgcu

SEQ ID NO: 2665307 - RNA, 19 nt, Escherichia coli CFT073
cacgguggcuggcgcggcg

SEQ ID NO: 2665308 - RNA, 21 nt, Escherichia coli CFT073
cacgguggcuggcgcggcgca

SEQ ID NO: 2665309 - RNA, 22 nt, Escherichia coli CFT073
cacggugguuccacucugcccu

SEQ ID NO: 2665310 - RNA, 15 nt, Escherichia coli CFT073
cacgguuacgcuacc

SEQ ID NO: 2665311 - RNA, 18 nt, Escherichia coli CFT073
cacgguuucaaagaaacg

SEQ ID NO: 2665312 - RNA, 22 nt, Escherichia coli CFT073
cacgguuugagagucauccaug

SEQ ID NO: 2665313 - RNA, 18 nt, Escherichia coli CFT073
cacguaacgaguuaccgu

SEQ ID NO: 2665314 - RNA, 19 nt, Escherichia coli CFT073
cacguaaguacugauugac

SEQ ID NO: 2665315 - RNA, 19 nt, Escherichia coli CFT073
cacguaauaaaaucuauua

SEQ ID NO: 2665316 - RNA, 15 nt, Escherichia coli CFT073
cacguaccagaugca

SEQ ID NO: 2665317 - RNA, 19 nt, Escherichia coli CFT073
cacguaggcgaucccagcg

SEQ ID NO: 2665318 - RNA, 20 nt, Escherichia coli CFT073
cacguaucaacaucacacca

SEQ ID NO: 2665319 - RNA, 21 nt, Escherichia coli CFT073
cacguaucaacaucacaccau

SEQ ID NO: 2665320 - RNA, 21 nt, Escherichia coli CFT073
cacgucauauucgccaucagc

SEQ ID NO: 2665321 - RNA, 23 nt, Escherichia coli CFT073
cacgucauauucgccaucagcca

SEQ ID NO: 2665322 - RNA, 20 nt, Escherichia coli CFT073
cacguccaccaaugccaaug

SEQ ID NO: 2665323 - RNA, 20 nt, Escherichia coli CFT073
cacguccaguggcauccgcu

SEQ ID NO: 2665324 - RNA, 21 nt, Escherichia coli CFT073
cacgucgaagacgaagauuuu

SEQ ID NO: 2665325 - RNA, 20 nt, Escherichia coli CFT073
cacgucgagauugugcucaa

SEQ ID NO: 2665326 - RNA, 14 nt, Escherichia coli CFT073
cacgucguucgggc

SEQ ID NO: 2665327 - RNA, 12 nt, Escherichia coli CFT073
cacgucugccac

SEQ ID NO: 2665328 - RNA, 15 nt, Escherichia coli CFT073
cacgugccagauguu

SEQ ID NO: 2665329 - RNA, 12 nt, Escherichia coli CFT073
cacguuacccaa

SEQ ID NO: 2665330 - RNA, 18 nt, Escherichia coli CFT073
cacguugcaucacccgcu

SEQ ID NO: 2665331 - RNA, 13 nt, Escherichia coli CFT073
cacguugccagca

SEQ ID NO: 2665332 - RNA, 15 nt, Escherichia coli CFT073
cacguuugauggugg

SEQ ID NO: 2665333 - RNA, 14 nt, Escherichia coli CFT073
cacguuuuccuuca

SEQ ID NO: 2665334 - RNA, 15 nt, Escherichia coli CFT073
cacguuuugcggaug

SEQ ID NO: 2665335 - RNA, 19 nt, Escherichia coli CFT073
cacguuuuucauccagcgg

SEQ ID NO: 2665336 - RNA, 16 nt, Escherichia coli CFT073
cacuaacacuucugcc

SEQ ID NO: 2665337 - RNA, 20 nt, Escherichia coli CFT073
cacuaacaugacaccaagca

SEQ ID NO: 2665338 - RNA, 15 nt, Escherichia coli CFT073
cacuaacugcgcgcu

SEQ ID NO: 2665339 - RNA, 21 nt, Escherichia coli CFT073
cacuaacugcgcgcuguucca

SEQ ID NO: 2665340 - RNA, 22 nt, Escherichia coli CFT073
cacuaacuguuucgcggcaaac

SEQ ID NO: 2665341 - RNA, 16 nt, Escherichia coli CFT073
cacuaauuaagacuga

SEQ ID NO: 2665342 - RNA, 18 nt, Escherichia coli CFT073
cacuaauuaagacugaug

SEQ ID NO: 2665343 - RNA, 15 nt, Escherichia coli CFT073
cacuaauugcagcga

SEQ ID NO: 2665344 - RNA, 22 nt, Escherichia coli CFT073
cacuacaacaaccuuuguauuu

SEQ ID NO: 2665345 - RNA, 23 nt, Escherichia coli CFT073
cacuacagcgaaauacaaguccc

SEQ ID NO: 2665346 - RNA, 20 nt, Escherichia coli CFT073
cacuaccagugccagaacag

SEQ ID NO: 2665347 - RNA, 22 nt, Escherichia coli CFT073
cacuaccaucggcgcuacggcg

SEQ ID NO: 2665348 - RNA, 21 nt, Escherichia coli CFT073
cacuaccggaaccaaccgcaa

SEQ ID NO: 2665349 - RNA, 19 nt, Escherichia coli CFT073
cacuaccgugucugccaua

SEQ ID NO: 2665350 - RNA, 21 nt, Escherichia coli CFT073
cacuaccugauucgcaccacg

SEQ ID NO: 2665351 - RNA, 20 nt, Escherichia coli CFT073
cacuacgcagggauauuuca

SEQ ID NO: 2665352 - RNA, 17 nt, Escherichia coli CFT073
cacuacgcccgcugcgc

SEQ ID NO: 2665353 - RNA, 19 nt, Escherichia coli CFT073
cacuacgcuguagccgcca

SEQ ID NO: 2665354 - RNA, 23 nt, Escherichia coli CFT073
cacuacgguguaacccgccugac

SEQ ID NO: 2665355 - RNA, 16 nt, Escherichia coli CFT073
cacuagucccuccgca

SEQ ID NO: 2665356 - RNA, 15 nt, Escherichia coli CFT073
cacuauaucucaauc

SEQ ID NO: 2665357 - RNA, 23 nt, Escherichia coli CFT073
cacuauaucucaaucaaaagaac

SEQ ID NO: 2665358 - RNA, 14 nt, Escherichia coli CFT073
cacuaucaaccacg

SEQ ID NO: 2665359 - RNA, 16 nt, Escherichia coli CFT073
cacuaucgccgagaua

SEQ ID NO: 2665360 - RNA, 14 nt, Escherichia coli CFT073
cacuaucgguucug

SEQ ID NO: 2665361 - RNA, 12 nt, Escherichia coli CFT073
cacuauucagau

SEQ ID NO: 2665362 - RNA, 14 nt, Escherichia coli CFT073
cacuauuuaccgcc

SEQ ID NO: 2665363 - RNA, 20 nt, Escherichia coli CFT073
cacucaaaagcguaccgcca

SEQ ID NO: 2665364 - RNA, 21 nt, Escherichia coli CFT073
cacucaaaagcguaccgccaa

SEQ ID NO: 2665365 - RNA, 21 nt, Escherichia coli CFT073
cacucaacuuauugaucaucc

SEQ ID NO: 2665366 - RNA, 11 nt, Escherichia coli CFT073
cacucacgaca

SEQ ID NO: 2665367 - RNA, 18 nt, Escherichia coli CFT073
cacucacgacacauaaau

SEQ ID NO: 2665368 - RNA, 19 nt, Escherichia coli CFT073
cacucacgacacauaaaua

SEQ ID NO: 2665369 - RNA, 15 nt, Escherichia coli CFT073
cacucagcccauacc

SEQ ID NO: 2665370 - RNA, 23 nt, Escherichia coli CFT073
cacucagguaacagggaacuuau

SEQ ID NO: 2665371 - RNA, 19 nt, Escherichia coli CFT073
cacucaguguuggauggcg

SEQ ID NO: 2665372 - RNA, 14 nt, Escherichia coli CFT073
cacucaucaagcau

SEQ ID NO: 2665373 - RNA, 16 nt, Escherichia coli CFT073
cacucaucacuccccg

SEQ ID NO: 2665374 - RNA, 14 nt, Escherichia coli CFT073
cacucaugccuuuc

SEQ ID NO: 2665375 - RNA, 18 nt, Escherichia coli CFT073
cacuccacugcgcauaau

SEQ ID NO: 2665376 - RNA, 19 nt, Escherichia coli CFT073
cacuccaguccacccccau

SEQ ID NO: 2665377 - RNA, 17 nt, Escherichia coli CFT073
cacuccccgcaacagug

SEQ ID NO: 2665378 - RNA, 16 nt, Escherichia coli CFT073
cacucccugccccguc

SEQ ID NO: 2665379 - RNA, 15 nt, Escherichia coli CFT073
cacuccgccgcacaa

SEQ ID NO: 2665380 - RNA, 22 nt, Escherichia coli CFT073
cacuccgcuuaccauccacacc

SEQ ID NO: 2665381 - RNA, 20 nt, Escherichia coli CFT073
cacuguuaccgcugcuggcg

SEQ ID NO: 2665382 - RNA, 17 nt, Escherichia coli CFT073
cacuguucgccgcagcc

SEQ ID NO: 2665383 - RNA, 19 nt, Escherichia coli CFT073
cacuguuucgccagguuuu

SEQ ID NO: 2665384 - RNA, 20 nt, Escherichia coli CFT073
cacuguuugaucugcugcca

SEQ ID NO: 2665385 - RNA, 18 nt, Escherichia coli CFT073
cacuuaaagcaacaccau

SEQ ID NO: 2665386 - RNA, 13 nt, Escherichia coli CFT073
cacuuaaccacaa

SEQ ID NO: 2665387 - RNA, 20 nt, Escherichia coli CFT073
cacuuaacguuaccuuuaau

SEQ ID NO: 2665388 - RNA, 14 nt, Escherichia coli CFT073
cacuuaauaccacu

SEQ ID NO: 2665389 - RNA, 12 nt, Escherichia coli CFT073
cacuuacagcaa

SEQ ID NO: 2665390 - RNA, 19 nt, Escherichia coli CFT073
cacuuacagcaacgccuaa

SEQ ID NO: 2665391 - RNA, 20 nt, Escherichia coli CFT073
cacuuauuuguuauuacugc

SEQ ID NO: 2665392 - RNA, 13 nt, Escherichia coli CFT073
cacuucaaccagc

SEQ ID NO: 2665393 - RNA, 21 nt, Escherichia coli CFT073
cacuucaccgcgaauauaagc

SEQ ID NO: 2665394 - RNA, 19 nt, Escherichia coli CFT073
cacuucagcgaaaucacgc

SEQ ID NO: 2665395 - RNA, 18 nt, Escherichia coli CFT073
cacuucauacuccgucug

SEQ ID NO: 2665396 - RNA, 20 nt, Escherichia coli CFT073
cacuucauagugcgcggugu

SEQ ID NO: 2665397 - RNA, 15 nt, Escherichia coli CFT073
cacuucaucaagcaa

SEQ ID NO: 2665398 - RNA, 19 nt, Escherichia coli CFT073
cacuucauccggauacagc

SEQ ID NO: 2665399 - RNA, 15 nt, Escherichia coli CFT073
cacuucaucgucaua

SEQ ID NO: 2665400 - RNA, 14 nt, Escherichia coli CFT073
cacuucaugcccca

SEQ ID NO: 2665401 - RNA, 18 nt, Escherichia coli CFT073
cacuucauuggcuugcac

SEQ ID NO: 2665402 - RNA, 14 nt, Escherichia coli CFT073
cacuuccaccacuu

SEQ ID NO: 2665403 - RNA, 16 nt, Escherichia coli CFT073
cacuuccaccacuucc

SEQ ID NO: 2665404 - RNA, 20 nt, Escherichia coli CFT073
cacuuccaccacuuccugcu

SEQ ID NO: 2665405 - RNA, 13 nt, Escherichia coli CFT073
cacuuccagcagu

SEQ ID NO: 2665406 - RNA, 12 nt, Escherichia coli CFT073
cacuucccagcc

SEQ ID NO: 2665407 - RNA, 21 nt, Escherichia coli CFT073
cacuuccgcguaguugcgcug

SEQ ID NO: 2665408 - RNA, 13 nt, Escherichia coli CFT073
cacuuccggcaac

SEQ ID NO: 2665409 - RNA, 15 nt, Escherichia coli CFT073
cacuuccucaagcgu

SEQ ID NO: 2665410 - RNA, 14 nt, Escherichia coli CFT073
cacuuccugcucgg

SEQ ID NO: 2665411 - RNA, 19 nt, Escherichia coli CFT073
cacuuccuuuagaagcacu

SEQ ID NO: 2665412 - RNA, 14 nt, Escherichia coli CFT073
cacuucgaccaggu

SEQ ID NO: 2665413 - RNA, 20 nt, Escherichia coli CFT073
cacuucgcugacauuaccuu

SEQ ID NO: 2665414 - RNA, 14 nt, Escherichia coli CFT073
cacuucgcuggugu

SEQ ID NO: 2665415 - RNA, 16 nt, Escherichia coli CFT073
cacuucgucagaaaug

SEQ ID NO: 2665416 - RNA, 19 nt, Escherichia coli CFT073
cacuucguuaaccacgauc

SEQ ID NO: 2665417 - RNA, 23 nt, Escherichia coli CFT073
cacuucugaguucggcauggggu

SEQ ID NO: 2665418 - RNA, 13 nt, Escherichia coli CFT073
cacuucugcggug

SEQ ID NO: 2665419 - RNA, 14 nt, Escherichia coli CFT073
cacuucuggcggcg

SEQ ID NO: 2665420 - RNA, 21 nt, Escherichia coli CFT073
cacuucuuccgggcuauacac

SEQ ID NO: 2665421 - RNA, 22 nt, Escherichia coli CFT073
cacuucuuccgggcuauacacc

SEQ ID NO: 2665422 - RNA, 13 nt, Escherichia coli CFT073
cacuucuucguag

SEQ ID NO: 2665423 - RNA, 16 nt, Escherichia coli CFT073
cacuucuucuguuucu

SEQ ID NO: 2665424 - RNA, 12 nt, Escherichia coli CFT073
cacuucuuugau

SEQ ID NO: 2665425 - RNA, 18 nt, Escherichia coli CFT073
cacuugacuaagcguuuu

SEQ ID NO: 2665426 - RNA, 13 nt, Escherichia coli CFT073
cacuugcaggaac

SEQ ID NO: 2665427 - RNA, 16 nt, Escherichia coli CFT073
cacuugcaggaacaau

SEQ ID NO: 2665428 - RNA, 21 nt, Escherichia coli CFT073
cacuugcagucggcuuucuca

SEQ ID NO: 2665429 - RNA, 22 nt, Escherichia coli CFT073
cacuugcagucggcuuucucau

SEQ ID NO: 2665430 - RNA, 13 nt, Escherichia coli CFT073
cacuugccugcug

SEQ ID NO: 2665431 - RNA, 16 nt, Escherichia coli CFT073
cacuugcgcauaauaa

SEQ ID NO: 2665432 - RNA, 22 nt, Escherichia coli CFT073
cacuugcggcacccauuuaucc

SEQ ID NO: 2665433 - RNA, 20 nt, Escherichia coli CFT073
cacuugcugcaccucuuccu

SEQ ID NO: 2665434 - RNA, 22 nt, Escherichia coli CFT073
cacuugcugcaccucuuccuga

SEQ ID NO: 2665435 - RNA, 14 nt, Escherichia coli CFT073
cacuugcugguugu

SEQ ID NO: 2665436 - RNA, 21 nt, Escherichia coli CFT073
cacuuuaucgaucacauccag

SEQ ID NO: 2665437 - RNA, 17 nt, Escherichia coli CFT073
cacuuuaugauccagcu

SEQ ID NO: 2665438 - RNA, 18 nt, Escherichia coli CFT073
cacuuuaugauccagcuu

SEQ ID NO: 2665439 - RNA, 17 nt, Escherichia coli CFT073
cacuuucaaauccagcc

SEQ ID NO: 2665440 - RNA, 13 nt, Escherichia coli CFT073
cacuuucaccggu

SEQ ID NO: 2665441 - RNA, 13 nt, Escherichia coli CFT073
cacuuuccaggcg

SEQ ID NO: 2665442 - RNA, 15 nt, Escherichia coli CFT073
cacuuuccaguuccg

SEQ ID NO: 2665443 - RNA, 13 nt, Escherichia coli CFT073
cacuuuccugcuc

SEQ ID NO: 2665444 - RNA, 19 nt, Escherichia coli CFT073
cacuuucgacuucaagcga

SEQ ID NO: 2665445 - RNA, 17 nt, Escherichia coli CFT073
cacuuucgccaguucuu

SEQ ID NO: 2665446 - RNA, 18 nt, Escherichia coli CFT073
cacuuucgccaguucuuc

SEQ ID NO: 2665447 - RNA, 16 nt, Escherichia coli CFT073
cacuuucuccggcagc

SEQ ID NO: 2665448 - RNA, 20 nt, Escherichia coli CFT073
cacuuugcgcuccuguuccc

SEQ ID NO: 2665449 - RNA, 12 nt, Escherichia coli CFT073
cacuuugcuggu

SEQ ID NO: 2665450 - RNA, 15 nt, Escherichia coli CFT073
cacuuugucagcaaa

SEQ ID NO: 2665451 - RNA, 13 nt, Escherichia coli CFT073
cacuuugugucag

SEQ ID NO: 2665452 - RNA, 23 nt, Escherichia coli CFT073
cacuuuuaaaucgccaagauuag

SEQ ID NO: 2665453 - RNA, 18 nt, Escherichia coli CFT073
cacuuuuaacgccucguu

SEQ ID NO: 2665454 - RNA, 15 nt, Escherichia coli CFT073
cacuuuuauuucacc

SEQ ID NO: 2665455 - RNA, 17 nt, Escherichia coli CFT073
cacuuuucggcaaccgc

SEQ ID NO: 2665456 - RNA, 19 nt, Escherichia coli CFT073
cagaaaaaaaacagcgccc

SEQ ID NO: 2665457 - RNA, 21 nt, Escherichia coli CFT073
cagaaaaaacaaacggcacga

SEQ ID NO: 2665458 - RNA, 15 nt, Escherichia coli CFT073
cagaaaaacgaagac

SEQ ID NO: 2665459 - RNA, 14 nt, Escherichia coli CFT073
cagaaaaacuacac

SEQ ID NO: 2665460 - RNA, 15 nt, Escherichia coli CFT073
cagaaaaaucccucu

SEQ ID NO: 2665461 - RNA, 18 nt, Escherichia coli CFT073
cagaaaacgguugauaua

SEQ ID NO: 2665462 - RNA, 13 nt, Escherichia coli CFT073
cagaaaagaacca

SEQ ID NO: 2665463 - RNA, 19 nt, Escherichia coli CFT073
cagaaaaggugccacagca

SEQ ID NO: 2665464 - RNA, 20 nt, Escherichia coli CFT073
cagaaaaggugccacagcag

SEQ ID NO: 2665465 - RNA, 19 nt, Escherichia coli CFT073
cagaaaauacucagcaccc

SEQ ID NO: 2665466 - RNA, 14 nt, Escherichia coli CFT073
cagaaaaucacggc

SEQ ID NO: 2665467 - RNA, 20 nt, Escherichia coli CFT073
cagaaaaucacggcaaacug

SEQ ID NO: 2665468 - RNA, 21 nt, Escherichia coli CFT073
cagaaaauccagcagaauaac

SEQ ID NO: 2665469 - RNA, 23 nt, Escherichia coli CFT073
cagaaacaauaaguacgauacaa

SEQ ID NO: 2665470 - RNA, 20 nt, Escherichia coli CFT073
cagaaacagaguauaaaaaa

SEQ ID NO: 2665471 - RNA, 17 nt, Escherichia coli CFT073
cagaaacaggcggcgcg

SEQ ID NO: 2665472 - RNA, 16 nt, Escherichia coli CFT073
cagaaacaguuguaaa

SEQ ID NO: 2665473 - RNA, 13 nt, Escherichia coli CFT073
cagaaacaucauc

SEQ ID NO: 2665474 - RNA, 20 nt, Escherichia coli CFT073
cagaaaccagccacggcgca

SEQ ID NO: 2665475 - RNA, 23 nt, Escherichia coli CFT073
cagaaaccaggucaaugcaaccc

SEQ ID NO: 2665476 - RNA, 12 nt, Escherichia coli CFT073
cagaaacgacac

SEQ ID NO: 2665477 - RNA, 16 nt, Escherichia coli CFT073
cagaaacgccaccauu

SEQ ID NO: 2665478 - RNA, 19 nt, Escherichia coli CFT073
cagaaacgccaucucuuua

SEQ ID NO: 2665479 - RNA, 14 nt, Escherichia coli CFT073
cagaaagaaauuuc

SEQ ID NO: 2665480 - RNA, 14 nt, Escherichia coli CFT073
cagaaagcgccagc

SEQ ID NO: 2665481 - RNA, 15 nt, Escherichia coli CFT073
cagaaagcgccagca

SEQ ID NO: 2665482 - RNA, 22 nt, Escherichia coli CFT073
cagaaaggcguuguccuugccg

SEQ ID NO: 2665483 - RNA, 23 nt, Escherichia coli CFT073
cagaaagguucggcuaaccgacu

SEQ ID NO: 2665484 - RNA, 17 nt, Escherichia coli CFT073
cagaaaguaaauuauuc

SEQ ID NO: 2665485 - RNA, 18 nt, Escherichia coli CFT073
cagaaaguaauuacgccc

SEQ ID NO: 2665486 - RNA, 22 nt, Escherichia coli CFT073
cagaaagucuucaccguuauga

SEQ ID NO: 2665487 - RNA, 19 nt, Escherichia coli CFT073
cagaaagugaguuuugcau

SEQ ID NO: 2665488 - RNA, 24 nt, Escherichia coli CFT073
cagaaagugaucccacaucacauc

SEQ ID NO: 2665489 - RNA, 20 nt, Escherichia coli CFT073
cagaaaguucgcgaaaguua

SEQ ID NO: 2665490 - RNA, 15 nt, Escherichia coli CFT073
cagaauuugaggaag

SEQ ID NO: 2665491 - RNA, 16 nt, Escherichia coli CFT073
cagaauuugaggaagc

SEQ ID NO: 2665492 - RNA, 14 nt, Escherichia coli CFT073
cagaauuugcacca

SEQ ID NO: 2665493 - RNA, 20 nt, Escherichia coli CFT073
cagacaaaaagaauacgcaa

SEQ ID NO: 2665494 - RNA, 16 nt, Escherichia coli CFT073
cagacaaaacugacgc

SEQ ID NO: 2665495 - RNA, 20 nt, Escherichia coli CFT073
cagacaaaauccugccagcg

SEQ ID NO: 2665496 - RNA, 23 nt, Escherichia coli CFT073
cagacaaaauccugccagcguga

SEQ ID NO: 2665497 - RNA, 19 nt, Escherichia coli CFT073
cagacaaaugucagaaaga

SEQ ID NO: 2665498 - RNA, 22 nt, Escherichia coli CFT073
cagacaaaugucagaaagaaau

SEQ ID NO: 2665499 - RNA, 15 nt, Escherichia coli CFT073
cagacaacaugagaa

SEQ ID NO: 2665500 - RNA, 17 nt, Escherichia coli CFT073
cagacaaucauuuccag

SEQ ID NO: 2665501 - RNA, 14 nt, Escherichia coli CFT073
cagacaauccagcg

SEQ ID NO: 2665502 - RNA, 15 nt, Escherichia coli CFT073
cagacaauccagcga

SEQ ID NO: 2665503 - RNA, 15 nt, Escherichia coli CFT073
cagacaccagaauag

SEQ ID NO: 2665504 - RNA, 19 nt, Escherichia coli CFT073
cagacaccgauugccccug

SEQ ID NO: 2665505 - RNA, 21 nt, Escherichia coli CFT073
cagacaccggcgcacaaccgc

SEQ ID NO: 2665506 - RNA, 18 nt, Escherichia coli CFT073
cagacaccguuuccauau

SEQ ID NO: 2665507 - RNA, 15 nt, Escherichia coli CFT073
cagacagaacgauga

SEQ ID NO: 2665508 - RNA, 20 nt, Escherichia coli CFT073
cagacagcguaauagccuga

SEQ ID NO: 2665509 - RNA, 12 nt, Escherichia coli CFT073
cagacagugucu

SEQ ID NO: 2665510 - RNA, 12 nt, Escherichia coli CFT073
cagacaucaagu

SEQ ID NO: 2665511 - RNA, 16 nt, Escherichia coli CFT073
cagacauuacaaaaua

SEQ ID NO: 2665512 - RNA, 13 nt, Escherichia coli CFT073
cagaccaaaacgu

SEQ ID NO: 2665513 - RNA, 15 nt, Escherichia coli CFT073
cagaccaaacgguga

SEQ ID NO: 2665514 - RNA, 17 nt, Escherichia coli CFT073
cagaccaaagucaaacu

SEQ ID NO: 2665515 - RNA, 23 nt, Escherichia coli CFT073
cagaccaaccgucagauccgcca

SEQ ID NO: 2665516 - RNA, 14 nt, Escherichia coli CFT073
cagaccaauaaucc

SEQ ID NO: 2665517 - RNA, 22 nt, Escherichia coli CFT073
cagaccaauaauccccaauacg

SEQ ID NO: 2665518 - RNA, 16 nt, Escherichia coli CFT073
cagaccaauagaaagu

SEQ ID NO: 2665519 - RNA, 13 nt, Escherichia coli CFT073
cagaccaaucccg

SEQ ID NO: 2665520 - RNA, 15 nt, Escherichia coli CFT073
cagaccaauggcgag

SEQ ID NO: 2665521 - RNA, 13 nt, Escherichia coli CFT073
cagaccaauguua

SEQ ID NO: 2665522 - RNA, 19 nt, Escherichia coli CFT073
cagaccaauguuacgaccu

SEQ ID NO: 2665523 - RNA, 15 nt, Escherichia coli CFT073
cagaccacagguaau

SEQ ID NO: 2665524 - RNA, 20 nt, Escherichia coli CFT073
cagaccacucauuuuuucgg

SEQ ID NO: 2665525 - RNA, 18 nt, Escherichia coli CFT073
cagaccacugcgccgcuc

SEQ ID NO: 2665526 - RNA, 20 nt, Escherichia coli CFT073
cagaccagcaaagugcgcuu

SEQ ID NO: 2665527 - RNA, 17 nt, Escherichia coli CFT073
cagaccagcaauaaaaa

SEQ ID NO: 2665528 - RNA, 18 nt, Escherichia coli CFT073
cagaccagcaauaaaaaa

SEQ ID NO: 2665529 - RNA, 21 nt, Escherichia coli CFT073
cagaccaucgucaguaaugau

SEQ ID NO: 2665530 - RNA, 14 nt, Escherichia coli CFT073
cagacccagaacca

SEQ ID NO: 2665531 - RNA, 18 nt, Escherichia coli CFT073
cagacccagaaccauuga

SEQ ID NO: 2665532 - RNA, 21 nt, Escherichia coli CFT073
cagacccagguagacaccaag

SEQ ID NO: 2665533 - RNA, 20 nt, Escherichia coli CFT073
cagacccaguuuugcgcguu

SEQ ID NO: 2665534 - RNA, 22 nt, Escherichia coli CFT073
cagaccccggcauugacgaugc

SEQ ID NO: 2665535 - RNA, 12 nt, Escherichia coli CFT073
cagaccgccaau

SEQ ID NO: 2665536 - RNA, 18 nt, Escherichia coli CFT073
cagaccgccaaucagcau

SEQ ID NO: 2665537 - RNA, 12 nt, Escherichia coli CFT073
cagaccgccagu

SEQ ID NO: 2665538 - RNA, 11 nt, Escherichia coli CFT073
cagaccgccga

SEQ ID NO: 2665539 - RNA, 19 nt, Escherichia coli CFT073
cagaccgcgcuugccgccg

SEQ ID NO: 2665540 - RNA, 18 nt, Escherichia coli CFT073
cagaccggcaaucgcgcc

SEQ ID NO: 2665541 - RNA, 18 nt, Escherichia coli CFT073
cagaccgucggaauccaa

SEQ ID NO: 2665542 - RNA, 15 nt, Escherichia coli CFT073
cagaccgugcgcagc

SEQ ID NO: 2665543 - RNA, 16 nt, Escherichia coli CFT073
cagaccuaaaaauucc

SEQ ID NO: 2665544 - RNA, 17 nt, Escherichia coli CFT073
cagaccugaauuugcuc

SEQ ID NO: 2665545 - RNA, 17 nt, Escherichia coli CFT073
cagaccugcguucagca

SEQ ID NO: 2665546 - RNA, 22 nt, Escherichia coli CFT073
cagaccuucgcuaucaaacuga

SEQ ID NO: 2665547 - RNA, 20 nt, Escherichia coli CFT073
cagacgaaaguuugaaagau

SEQ ID NO: 2665548 - RNA, 14 nt, Escherichia coli CFT073
cagacgaaugaagc

SEQ ID NO: 2665549 - RNA, 20 nt, Escherichia coli CFT073
cagacgacggggguaaccuc

SEQ ID NO: 2665550 - RNA, 22 nt, Escherichia coli CFT073
cagacgacugucuuccugcggu

SEQ ID NO: 2665551 - RNA, 23 nt, Escherichia coli CFT073
cagacgacugucuuccugcggug

SEQ ID NO: 2665552 - RNA, 17 nt, Escherichia coli CFT073
cagacgauccuguucga

SEQ ID NO: 2665553 - RNA, 15 nt, Escherichia coli CFT073
cagacgaucgcgcag

SEQ ID NO: 2665554 - RNA, 22 nt, Escherichia coli CFT073
cagacgaucuucggcgucagaa

SEQ ID NO: 2665555 - RNA, 21 nt, Escherichia coli CFT073
cagacgcaacagaaacgccau

SEQ ID NO: 2665556 - RNA, 16 nt, Escherichia coli CFT073
cagacgcaguacgcca

SEQ ID NO: 2665557 - RNA, 14 nt, Escherichia coli CFT073
cagacgcaucgccc

SEQ ID NO: 2665558 - RNA, 15 nt, Escherichia coli CFT073
cagacgcaucgccca

SEQ ID NO: 2665559 - RNA, 21 nt, Escherichia coli CFT073
cagacgcaucgcccagccauc

SEQ ID NO: 2665560 - RNA, 22 nt, Escherichia coli CFT073
cagacgcaucgcccagccaucg

SEQ ID NO: 2665561 - RNA, 22 nt, Escherichia coli CFT073
cagacgccacuuuuuucaccca

SEQ ID NO: 2665562 - RNA, 21 nt, Escherichia coli CFT073
cagacgcccgcgcccaggcca

SEQ ID NO: 2665563 - RNA, 16 nt, Escherichia coli CFT073
cagacgccgguuaauc

SEQ ID NO: 2665564 - RNA, 19 nt, Escherichia coli CFT073
cagacgccguuccagauuc

SEQ ID NO: 2665565 - RNA, 16 nt, Escherichia coli CFT073
cagacgcgccgccacc

SEQ ID NO: 2665566 - RNA, 17 nt, Escherichia coli CFT073
cagacgcgccgccaccg

SEQ ID NO: 2665567 - RNA, 17 nt, Escherichia coli CFT073
cagacgcgcugagucac

SEQ ID NO: 2665568 - RNA, 17 nt, Escherichia coli CFT073
cagacgcucgccauuuu

SEQ ID NO: 2665569 - RNA, 20 nt, Escherichia coli CFT073
cagacggaacaucugcccca

SEQ ID NO: 2665570 - RNA, 16 nt, Escherichia coli CFT073
cagacggcccaacuga

SEQ ID NO: 2665571 - RNA, 20 nt, Escherichia coli CFT073
cagacggccccgcgccagcg

SEQ ID NO: 2665572 - RNA, 20 nt, Escherichia coli CFT073
cagacggcugucauccagca

SEQ ID NO: 2665573 - RNA, 23 nt, Escherichia coli CFT073
cagacggcugucauccagcagug

SEQ ID NO: 2665574 - RNA, 12 nt, Escherichia coli CFT073
cagacggcuguu

SEQ ID NO: 2665575 - RNA, 17 nt, Escherichia coli CFT073
cagacggcuuucuucag

SEQ ID NO: 2665576 - RNA, 19 nt, Escherichia coli CFT073
cagacggguaaacggcagg

SEQ ID NO: 2665577 - RNA, 15 nt, Escherichia coli CFT073
cagacgguccgcgag

SEQ ID NO: 2665578 - RNA, 20 nt, Escherichia coli CFT073
cagacggugccagguaauga

SEQ ID NO: 2665579 - RNA, 15 nt, Escherichia coli CFT073
cagacguccacgaga

SEQ ID NO: 2665580 - RNA, 13 nt, Escherichia coli CFT073
cagacgugcaccg

SEQ ID NO: 2665581 - RNA, 16 nt, Escherichia coli CFT073
cagacgugcacgcagc

SEQ ID NO: 2665582 - RNA, 22 nt, Escherichia coli CFT073
cagacgugggcgacggcuugcc

SEQ ID NO: 2665583 - RNA, 14 nt, Escherichia coli CFT073
cagacguucuuccu

SEQ ID NO: 2665584 - RNA, 15 nt, Escherichia coli CFT073
cagacguucuuccug

SEQ ID NO: 2665585 - RNA, 16 nt, Escherichia coli CFT073
cagacguucuuccugu

SEQ ID NO: 2665586 - RNA, 21 nt, Escherichia coli CFT073
cagacguugauaaccacggcg

SEQ ID NO: 2665587 - RNA, 23 nt, Escherichia coli CFT073
cagacguugauaaccacggcgca

SEQ ID NO: 2665588 - RNA, 18 nt, Escherichia coli CFT073
cagacguugccguacuga

SEQ ID NO: 2665589 - RNA, 18 nt, Escherichia coli CFT073
cagacguuucgccagccu

SEQ ID NO: 2665590 - RNA, 21 nt, Escherichia coli CFT073
cagacguuuguaacccaccau

SEQ ID NO: 2665591 - RNA, 18 nt, Escherichia coli CFT073
cagacuaaaccgcacugg

SEQ ID NO: 2665592 - RNA, 20 nt, Escherichia coli CFT073
cagacuaagcugcgggaaau

SEQ ID NO: 2665593 - RNA, 23 nt, Escherichia coli CFT073
cagacucaccagcaucgcuucca

SEQ ID NO: 2665594 - RNA, 23 nt, Escherichia coli CFT073
cagacucaccugauuaccuacca

SEQ ID NO: 2665595 - RNA, 21 nt, Escherichia coli CFT073
cagacucagcaacagguaacc

SEQ ID NO: 2665596 - RNA, 21 nt, Escherichia coli CFT073
cagacucauuuuuaacagugu

SEQ ID NO: 2665597 - RNA, 14 nt, Escherichia coli CFT073
cagacuccagcagu

SEQ ID NO: 2665598 - RNA, 13 nt, Escherichia coli CFT073
cagauagccgcca

SEQ ID NO: 2665599 - RNA, 16 nt, Escherichia coli CFT073
cagauaucccgccagc

SEQ ID NO: 2665600 - RNA, 17 nt, Escherichia coli CFT073
cagauaucccgccagca

SEQ ID NO: 2665601 - RNA, 19 nt, Escherichia coli CFT073
cagauaugcgcugucauuc

SEQ ID NO: 2665602 - RNA, 16 nt, Escherichia coli CFT073
cagauauguaucuacc

SEQ ID NO: 2665603 - RNA, 19 nt, Escherichia coli CFT073
cagauauguaucuacccca

SEQ ID NO: 2665604 - RNA, 18 nt, Escherichia coli CFT073
cagauauuuaaguugauc

SEQ ID NO: 2665605 - RNA, 23 nt, Escherichia coli CFT073
cagauauuuaaguugaucgccca

SEQ ID NO: 2665606 - RNA, 17 nt, Escherichia coli CFT073
cagaucaccaauaucaa

SEQ ID NO: 2665607 - RNA, 18 nt, Escherichia coli CFT073
cagaucacgcagcaagcc

SEQ ID NO: 2665608 - RNA, 17 nt, Escherichia coli CFT073
cagaucacgcaucaccc

SEQ ID NO: 2665609 - RNA, 22 nt, Escherichia coli CFT073
cagaucagaacgcagcauuucc

SEQ ID NO: 2665610 - RNA, 16 nt, Escherichia coli CFT073
cagaucagacccagaa

SEQ ID NO: 2665611 - RNA, 13 nt, Escherichia coli CFT073
cagaucagccacu

SEQ ID NO: 2665612 - RNA, 19 nt, Escherichia coli CFT073
cagaucagccacuuccugc

SEQ ID NO: 2665613 - RNA, 13 nt, Escherichia coli CFT073
cagaucagggaag

SEQ ID NO: 2665614 - RNA, 17 nt, Escherichia coli CFT073
cagaucaucaaagaaca

SEQ ID NO: 2665615 - RNA, 17 nt, Escherichia coli CFT073
cagaucauccggcacgc

SEQ ID NO: 2665616 - RNA, 22 nt, Escherichia coli CFT073
cagauccaaaccgacugccugc

SEQ ID NO: 2665617 - RNA, 21 nt, Escherichia coli CFT073
cagauccaauaccgcacuaag

SEQ ID NO: 2665618 - RNA, 14 nt, Escherichia coli CFT073
cagauccagugcuc

SEQ ID NO: 2665619 - RNA, 16 nt, Escherichia coli CFT073
cagauccgcacccgca

SEQ ID NO: 2665620 - RNA, 13 nt, Escherichia coli CFT073
cagauccgccaug

SEQ ID NO: 2665621 - RNA, 18 nt, Escherichia coli CFT073
cagauccgcugaugaauc

SEQ ID NO: 2665622 - RNA, 20 nt, Escherichia coli CFT073
cagauccggcuuacaucuuu

SEQ ID NO: 2665623 - RNA, 15 nt, Escherichia coli CFT073
cagauccgggcuaau

SEQ ID NO: 2665624 - RNA, 15 nt, Escherichia coli CFT073
cagauccugaaauuc

SEQ ID NO: 2665625 - RNA, 24 nt, Escherichia coli CFT073
cagauccugaaauuccugagagga

SEQ ID NO: 2665626 - RNA, 13 nt, Escherichia coli CFT073
cagauccugccau

SEQ ID NO: 2665627 - RNA, 16 nt, Escherichia coli CFT073
cagaucgcucaucugc

SEQ ID NO: 2665628 - RNA, 21 nt, Escherichia coli CFT073
cagaucggacuucaugcgcag

SEQ ID NO: 2665629 - RNA, 21 nt, Escherichia coli CFT073
cagaucgguaauugaucucac

SEQ ID NO: 2665630 - RNA, 16 nt, Escherichia coli CFT073
cagaucguugaccugg

SEQ ID NO: 2665631 - RNA, 24 nt, Escherichia coli CFT073
cagaucguugaccuggaugccugc

SEQ ID NO: 2665632 - RNA, 16 nt, Escherichia coli CFT073
cagaucugacgauuau

SEQ ID NO: 2665633 - RNA, 19 nt, Escherichia coli CFT073
cagaucugacgauuauuuu

SEQ ID NO: 2665634 - RNA, 21 nt, Escherichia coli CFT073
cagaucugacgauuauuuucc

SEQ ID NO: 2665635 - RNA, 13 nt, Escherichia coli CFT073
cagaucugcgcca

SEQ ID NO: 2665636 - RNA, 14 nt, Escherichia coli CFT073
cagaucuucaggag

SEQ ID NO: 2665637 - RNA, 16 nt, Escherichia coli CFT073
cagaucuuccagcggc

SEQ ID NO: 2665638 - RNA, 15 nt, Escherichia coli CFT073
cagaucuuucugcag

SEQ ID NO: 2665639 - RNA, 18 nt, Escherichia coli CFT073
cagaugaaauaccacuca

SEQ ID NO: 2665640 - RNA, 20 nt, Escherichia coli CFT073
cagaugaacgugucaacgcu

SEQ ID NO: 2665641 - RNA, 19 nt, Escherichia coli CFT073
cagaugaaugaaaacgaau

SEQ ID NO: 2665642 - RNA, 21 nt, Escherichia coli CFT073
cagaugaucaacgaccagaaa

SEQ ID NO: 2665643 - RNA, 18 nt, Escherichia coli CFT073
cagaugaucuaccaguuc

SEQ ID NO: 2665644 - RNA, 21 nt, Escherichia coli CFT073
cagaugcaccugcguugccgc

SEQ ID NO: 2665645 - RNA, 22 nt, Escherichia coli CFT073
cagaugcaccugcguugccgca

SEQ ID NO: 2665646 - RNA, 20 nt, Escherichia coli CFT073
cagaugccacaaucucgccc

SEQ ID NO: 2665647 - RNA, 22 nt, Escherichia coli CFT073
cagaugccacaaucucgcccgc

SEQ ID NO: 2665648 - RNA, 23 nt, Escherichia coli CFT073
cagaugcgacggcaccacauucu

SEQ ID NO: 2665649 - RNA, 17 nt, Escherichia coli CFT073
cagaugcgccaguugca

SEQ ID NO: 2665650 - RNA, 22 nt, Escherichia coli CFT073
cagaugcggcaugaacgccuga

SEQ ID NO: 2665651 - RNA, 15 nt, Escherichia coli CFT073
cagaugcggcgugaa

SEQ ID NO: 2665652 - RNA, 16 nt, Escherichia coli CFT073
cagaugcggugcgcca

SEQ ID NO: 2665653 - RNA, 19 nt, Escherichia coli CFT073
cagaugcggugcgccacac

SEQ ID NO: 2665654 - RNA, 23 nt, Escherichia coli CFT073
cagaugcugcucuucacgcccgc

SEQ ID NO: 2665655 - RNA, 20 nt, Escherichia coli CFT073
cagaugcugggcgaucggca

SEQ ID NO: 2665656 - RNA, 14 nt, Escherichia coli CFT073
cagaugcugugcaa

SEQ ID NO: 2665657 - RNA, 14 nt, Escherichia coli CFT073
cagauggaucagcg

SEQ ID NO: 2665658 - RNA, 17 nt, Escherichia coli CFT073
cagauggcagugcgcca

SEQ ID NO: 2665659 - RNA, 16 nt, Escherichia coli CFT073
cagauggcauccagcg

SEQ ID NO: 2665660 - RNA, 17 nt, Escherichia coli CFT073
cagauggcauccagcgg

SEQ ID NO: 2665661 - RNA, 17 nt, Escherichia coli CFT073
cagauuaccguugcggc

SEQ ID NO: 2665662 - RNA, 14 nt, Escherichia coli CFT073
cagauuagcuggcc

SEQ ID NO: 2665663 - RNA, 19 nt, Escherichia coli CFT073
cagauuaguaucguguccg

SEQ ID NO: 2665664 - RNA, 17 nt, Escherichia coli CFT073
cagauuauucaaaaaca

SEQ ID NO: 2665665 - RNA, 19 nt, Escherichia coli CFT073
cagauucaaauccagucuu

SEQ ID NO: 2665666 - RNA, 20 nt, Escherichia coli CFT073
cagauucaaauccagucuuu

SEQ ID NO: 2665667 - RNA, 13 nt, Escherichia coli CFT073
cagauucaauacu

SEQ ID NO: 2665668 - RNA, 18 nt, Escherichia coli CFT073
cagauugaacgcuggcgg

SEQ ID NO: 2665669 - RNA, 19 nt, Escherichia coli CFT073
cagauugagaauaaugccu

SEQ ID NO: 2665670 - RNA, 13 nt, Escherichia coli CFT073
cagauugauaaag

SEQ ID NO: 2665671 - RNA, 15 nt, Escherichia coli CFT073
cagauugcugcugau

SEQ ID NO: 2665672 - RNA, 17 nt, Escherichia coli CFT073
cagauuguuauccagcu

SEQ ID NO: 2665673 - RNA, 12 nt, Escherichia coli CFT073
cagauuguugau

SEQ ID NO: 2665674 - RNA, 19 nt, Escherichia coli CFT073
cagauuuaacggcagcaag

SEQ ID NO: 2665675 - RNA, 20 nt, Escherichia coli CFT073
cagauuuaacggcagcaagg

SEQ ID NO: 2665676 - RNA, 18 nt, Escherichia coli CFT073
cagauuugauuaucaauu

SEQ ID NO: 2665677 - RNA, 14 nt, Escherichia coli CFT073
cagauuuuugcgcc

SEQ ID NO: 2665678 - RNA, 14 nt, Escherichia coli CFT073
cagcaaaacacccc

SEQ ID NO: 2665679 - RNA, 15 nt, Escherichia coli CFT073
cagcaaaacaccccg

SEQ ID NO: 2665680 - RNA, 19 nt, Escherichia coli CFT073
cagcaaaacaccccgcgac

SEQ ID NO: 2665681 - RNA, 20 nt, Escherichia coli CFT073
cagcaaaagcaggcaccgcg

SEQ ID NO: 2665682 - RNA, 15 nt, Escherichia coli CFT073
cagcaaaaucaccau

SEQ ID NO: 2665683 - RNA, 14 nt, Escherichia coli CFT073
cagcaaaccacuga

SEQ ID NO: 2665684 - RNA, 23 nt, Escherichia coli CFT073
cagcaaagagagauccagcuucg

SEQ ID NO: 2665685 - RNA, 15 nt, Escherichia coli CFT073
cagcaaagagagcag

SEQ ID NO: 2665686 - RNA, 17 nt, Escherichia coli CFT073
cagcaaagagagcagcg

SEQ ID NO: 2665687 - RNA, 18 nt, Escherichia coli CFT073
cagcaaagagagcagcgc

SEQ ID NO: 2665688 - RNA, 14 nt, Escherichia coli CFT073
cagcaaagcccggg

SEQ ID NO: 2665689 - RNA, 13 nt, Escherichia coli CFT073
cagcaaauaaaac

SEQ ID NO: 2665690 - RNA, 19 nt, Escherichia coli CFT073
cagcaaauaauucaucuuu

SEQ ID NO: 2665691 - RNA, 22 nt, Escherichia coli CFT073
cagcaaauaguaagaaccacag

SEQ ID NO: 2665692 - RNA, 13 nt, Escherichia coli CFT073
cagcaaaucagcc

SEQ ID NO: 2665693 - RNA, 16 nt, Escherichia coli CFT073
cagcaaaucagccauu

SEQ ID NO: 2665694 - RNA, 21 nt, Escherichia coli CFT073
cagcaaaugacccauuuucuc

SEQ ID NO: 2665695 - RNA, 14 nt, Escherichia coli CFT073
cagcaacagcaaag

SEQ ID NO: 2665696 - RNA, 16 nt, Escherichia coli CFT073
cagcaacagcgcguca

SEQ ID NO: 2665697 - RNA, 17 nt, Escherichia coli CFT073
cagcaacagguaaccca

SEQ ID NO: 2665698 - RNA, 14 nt, Escherichia coli CFT073
cagcaacaucacca

SEQ ID NO: 2665699 - RNA, 15 nt, Escherichia coli CFT073
cagcaacaucaccaa

SEQ ID NO: 2665700 - RNA, 14 nt, Escherichia coli CFT073
cagcaacaucacgc

SEQ ID NO: 2665701 - RNA, 18 nt, Escherichia coli CFT073
cagcaacauggcgcggca

SEQ ID NO: 2665702 - RNA, 23 nt, Escherichia coli CFT073
cagcaacauggcgcggcacacca

SEQ ID NO: 2665703 - RNA, 14 nt, Escherichia coli CFT073
cagcaaccaaugcc

SEQ ID NO: 2665704 - RNA, 10 nt, Escherichia coli CFT073
cagcaaccag

SEQ ID NO: 2665705 - RNA, 13 nt, Escherichia coli CFT073
cagcaaccagagc

SEQ ID NO: 2665706 - RNA, 15 nt, Escherichia coli CFT073
cagcaaccagagccg

SEQ ID NO: 2665707 - RNA, 22 nt, Escherichia coli CFT073
cagcaaccaguagcaaaacuca

SEQ ID NO: 2665708 - RNA, 14 nt, Escherichia coli CFT073
cagcaaccgcuucc

SEQ ID NO: 2665709 - RNA, 21 nt, Escherichia coli CFT073
cagcaaccgcuuccggucugc

SEQ ID NO: 2665710 - RNA, 21 nt, Escherichia coli CFT073
cagcaacgaacuaaccgcacu

SEQ ID NO: 2665711 - RNA, 15 nt, Escherichia coli CFT073
cagcaacgcuucaac

SEQ ID NO: 2665712 - RNA, 19 nt, Escherichia coli CFT073
cagcaacgcuucaaccagu

SEQ ID NO: 2665713 - RNA, 22 nt, Escherichia coli CFT073
cagcaacgcuucguagaagcca

SEQ ID NO: 2665714 - RNA, 19 nt, Escherichia coli CFT073
cagcaacggaaaagcaaca

SEQ ID NO: 2665715 - RNA, 22 nt, Escherichia coli CFT073
cagcaacggaaaagcaacaacc

SEQ ID NO: 2665716 - RNA, 23 nt, Escherichia coli CFT073
cagcaacggccaaauauccgcgc

SEQ ID NO: 2665717 - RNA, 15 nt, Escherichia coli CFT073
cagcaacgggcugaa

SEQ ID NO: 2665718 - RNA, 21 nt, Escherichia coli CFT073
cagcaacguuucgcuggaugu

SEQ ID NO: 2665719 - RNA, 13 nt, Escherichia coli CFT073
cagcaacuacagc

SEQ ID NO: 2665720 - RNA, 17 nt, Escherichia coli CFT073
cagcaacugauggccca

SEQ ID NO: 2665721 - RNA, 21 nt, Escherichia coli CFT073
cagcaacuggcuugccagcag

SEQ ID NO: 2665722 - RNA, 12 nt, Escherichia coli CFT073
cagcaagaacca

SEQ ID NO: 2665723 - RNA, 21 nt, Escherichia coli CFT073
cagcaagagcaaauaaaacau

SEQ ID NO: 2665724 - RNA, 17 nt, Escherichia coli CFT073
cagcaaguauucacucu

SEQ ID NO: 2665725 - RNA, 16 nt, Escherichia coli CFT073
cagcaagugcggcgca

SEQ ID NO: 2665726 - RNA, 12 nt, Escherichia coli CFT073
cagcaauaaaaa

SEQ ID NO: 2665727 - RNA, 22 nt, Escherichia coli CFT073
cagcaauaagccaguccagaaa

SEQ ID NO: 2665728 - RNA, 16 nt, Escherichia coli CFT073
cagcaauaaucagaug

SEQ ID NO: 2665729 - RNA, 18 nt, Escherichia coli CFT073
cagcaauaaucagauggc

SEQ ID NO: 2665730 - RNA, 18 nt, Escherichia coli CFT073
cagcaauagcaaagccuu

SEQ ID NO: 2665731 - RNA, 12 nt, Escherichia coli CFT073
cagcaaucacug

SEQ ID NO: 2665732 - RNA, 16 nt, Escherichia coli CFT073
cagcaaucacugccag

SEQ ID NO: 2665733 - RNA, 19 nt, Escherichia coli CFT073
cagcaauccccagacaaaa

SEQ ID NO: 2665734 - RNA, 17 nt, Escherichia coli CFT073
cagcaauccugcaugua

SEQ ID NO: 2665735 - RNA, 13 nt, Escherichia coli CFT073
cagcaaucgacca

SEQ ID NO: 2665736 - RNA, 18 nt, Escherichia coli CFT073
cagcaaucucuucaagcu

SEQ ID NO: 2665737 - RNA, 14 nt, Escherichia coli CFT073
cagcaaucugagca

SEQ ID NO: 2665738 - RNA, 21 nt, Escherichia coli CFT073
cagcaaugacauacagcaccg

SEQ ID NO: 2665739 - RNA, 12 nt, Escherichia coli CFT073
cagcaaugccag

SEQ ID NO: 2665740 - RNA, 15 nt, Escherichia coli CFT073
cagcaauggaaaaag

SEQ ID NO: 2665741 - RNA, 14 nt, Escherichia coli CFT073
cagcaauggacacc

SEQ ID NO: 2665742 - RNA, 18 nt, Escherichia coli CFT073
cagcaaugguucgugcaa

SEQ ID NO: 2665743 - RNA, 18 nt, Escherichia coli CFT073
cagcaauuucuccgccgg

SEQ ID NO: 2665744 - RNA, 12 nt, Escherichia coli CFT073
cagcaauuuuac

SEQ ID NO: 2665745 - RNA, 19 nt, Escherichia coli CFT073
cagcacaccacaucgccga

SEQ ID NO: 2665746 - RNA, 21 nt, Escherichia coli CFT073
cagcacacccagcgaaccguu

SEQ ID NO: 2665747 - RNA, 23 nt, Escherichia coli CFT073
cagcacaccgucagccagcacug

SEQ ID NO: 2665748 - RNA, 21 nt, Escherichia coli CFT073
cagcacacgauuccaacgaaa

SEQ ID NO: 2665749 - RNA, 15 nt, Escherichia coli CFT073
cagcacacuguaagc

SEQ ID NO: 2665750 - RNA, 16 nt, Escherichia coli CFT073
cagcacagagauaaaa

SEQ ID NO: 2665751 - RNA, 19 nt, Escherichia coli CFT073
cagcacagagauaaaaggc

SEQ ID NO: 2665752 - RNA, 13 nt, Escherichia coli CFT073
cagcacagccaga

SEQ ID NO: 2665753 - RNA, 23 nt, Escherichia coli CFT073
cagcacagccagaaucaagguaa

SEQ ID NO: 2665754 - RNA, 19 nt, Escherichia coli CFT073
cagcacauaacucauacug

SEQ ID NO: 2665755 - RNA, 21 nt, Escherichia coli CFT073
cagcacaucaucaaagccaau

SEQ ID NO: 2665756 - RNA, 16 nt, Escherichia coli CFT073
cagcacauccaguucc

SEQ ID NO: 2665757 - RNA, 15 nt, Escherichia coli CFT073
cagcacaucucaaau

SEQ ID NO: 2665758 - RNA, 12 nt, Escherichia coli CFT073
cagcacauuaca

SEQ ID NO: 2665759 - RNA, 21 nt, Escherichia coli CFT073
cagcaccaaacuggaauagcg

SEQ ID NO: 2665760 - RNA, 18 nt, Escherichia coli CFT073
cagcaccacgcagaaaaa

SEQ ID NO: 2665761 - RNA, 16 nt, Escherichia coli CFT073
cagcaccacuggcgau

SEQ ID NO: 2665762 - RNA, 20 nt, Escherichia coli CFT073
cagcaccacuuuacgggcaa

SEQ ID NO: 2665763 - RNA, 18 nt, Escherichia coli CFT073
cagcaccagacgcaaccu

SEQ ID NO: 2665764 - RNA, 13 nt, Escherichia coli CFT073
cagcaccagcaac

SEQ ID NO: 2665765 - RNA, 15 nt, Escherichia coli CFT073
cagcaccagcaacaa

SEQ ID NO: 2665766 - RNA, 14 nt, Escherichia coli CFT073
cagcaccagcaacg

SEQ ID NO: 2665767 - RNA, 14 nt, Escherichia coli CFT073
cagcaccaguacca

SEQ ID NO: 2665768 - RNA, 21 nt, Escherichia coli CFT073
cagcaccaucgcgauccacgc

SEQ ID NO: 2665769 - RNA, 14 nt, Escherichia coli CFT073
cagcaccaucgcgc

SEQ ID NO: 2665770 - RNA, 17 nt, Escherichia coli CFT073
cagcaccaucgcgcuaa

SEQ ID NO: 2665771 - RNA, 17 nt, Escherichia coli CFT073
cagcaccccgacagcau

SEQ ID NO: 2665772 - RNA, 18 nt, Escherichia coli CFT073
cagcaccccgacagcaug

SEQ ID NO: 2665773 - RNA, 21 nt, Escherichia coli CFT073
cagcaccccgacagcaugcgu

SEQ ID NO: 2665774 - RNA, 19 nt, Escherichia coli CFT073
cagcacccgaugcggcagu

SEQ ID NO: 2665775 - RNA, 17 nt, Escherichia coli CFT073
cagcacccgcggcugca

SEQ ID NO: 2665776 - RNA, 13 nt, Escherichia coli CFT073
cagcacccggcgu

SEQ ID NO: 2665777 - RNA, 14 nt, Escherichia coli CFT073
cagcacccugaguu

SEQ ID NO: 2665778 - RNA, 13 nt, Escherichia coli CFT073
cagcaccgcagag

SEQ ID NO: 2665779 - RNA, 21 nt, Escherichia coli CFT073
cagcaccgcagagaucgcccc

SEQ ID NO: 2665780 - RNA, 22 nt, Escherichia coli CFT073
cagcaccgccagcagcagcgaa

SEQ ID NO: 2665781 - RNA, 13 nt, Escherichia coli CFT073
cagcaccgcccgu

SEQ ID NO: 2665782 - RNA, 17 nt, Escherichia coli CFT073
cagcaccgcgacaauca

SEQ ID NO: 2665783 - RNA, 19 nt, Escherichia coli CFT073
cagcaccgcgacaaucagg

SEQ ID NO: 2665784 - RNA, 14 nt, Escherichia coli CFT073
cagcaccgcuggcu

SEQ ID NO: 2665785 - RNA, 19 nt, Escherichia coli CFT073
cagcaccgcuuuaaaauua

SEQ ID NO: 2665786 - RNA, 17 nt, Escherichia coli CFT073
cagcaccggcaaauugg

SEQ ID NO: 2665787 - RNA, 18 nt, Escherichia coli CFT073
cagcaccgugcauuuuuc

SEQ ID NO: 2665788 - RNA, 19 nt, Escherichia coli CFT073
cagcaccugaauccgcgau

SEQ ID NO: 2665789 - RNA, 15 nt, Escherichia coli CFT073
cagcaccugcuugaa

SEQ ID NO: 2665790 - RNA, 14 nt, Escherichia coli CFT073
cagcacgaagaggc

SEQ ID NO: 2665791 - RNA, 18 nt, Escherichia coli CFT073
cagcacgagugaguuaau

SEQ ID NO: 2665792 - RNA, 14 nt, Escherichia coli CFT073
cagcacgcugaagg

SEQ ID NO: 2665793 - RNA, 13 nt, Escherichia coli CFT073
cagcacggagaga

SEQ ID NO: 2665794 - RNA, 19 nt, Escherichia coli CFT073
cagcacggauaccgcacgc

SEQ ID NO: 2665795 - RNA, 16 nt, Escherichia coli CFT073
cagcacggugcgggcu

SEQ ID NO: 2665796 - RNA, 15 nt, Escherichia coli CFT073
cagcacguugaacug

SEQ ID NO: 2665797 - RNA, 22 nt, Escherichia coli CFT073
cagcacguugugcccuuccagc

SEQ ID NO: 2665798 - RNA, 14 nt, Escherichia coli CFT073
cagcacguuuaaca

SEQ ID NO: 2665799 - RNA, 17 nt, Escherichia coli CFT073
cagcacguuuuauccgu

SEQ ID NO: 2665800 - RNA, 15 nt, Escherichia coli CFT073
cagcacuaccgcccg

SEQ ID NO: 2665801 - RNA, 17 nt, Escherichia coli CFT073
cagcacuacugccagau

SEQ ID NO: 2665802 - RNA, 21 nt, Escherichia coli CFT073
cagcacuacugccagauucuc

SEQ ID NO: 2665803 - RNA, 16 nt, Escherichia coli CFT073
cagcacucacgccagg

SEQ ID NO: 2665804 - RNA, 19 nt, Escherichia coli CFT073
cagcacugacauuauccgg

SEQ ID NO: 2665805 - RNA, 21 nt, Escherichia coli CFT073
cagcacugacauuauccggcu

SEQ ID NO: 2665806 - RNA, 20 nt, Escherichia coli CFT073
cagcacugccagccacaggc

SEQ ID NO: 2665807 - RNA, 15 nt, Escherichia coli CFT073
cagcacugcuuaaau

SEQ ID NO: 2665808 - RNA, 17 nt, Escherichia coli CFT073
cagcacuggcggcagca

SEQ ID NO: 2665809 - RNA, 19 nt, Escherichia coli CFT073
cagcacuuaaccacaaacg

SEQ ID NO: 2665810 - RNA, 22 nt, Escherichia coli CFT073
cagcacuuaucucuuccgcauu

SEQ ID NO: 2665811 - RNA, 20 nt, Escherichia coli CFT073
cagcacuucacccaucgcca

SEQ ID NO: 2665812 - RNA, 22 nt, Escherichia coli CFT073
cagcacuuccugcucuuucgcc

SEQ ID NO: 2665813 - RNA, 17 nt, Escherichia coli CFT073
cagcacuucgcugacau

SEQ ID NO: 2665814 - RNA, 24 nt, Escherichia coli CFT073
cagcauuuguugguacaccugcug

SEQ ID NO: 2665815 - RNA, 14 nt, Escherichia coli CFT073
cagccaaaaaugac

SEQ ID NO: 2665816 - RNA, 21 nt, Escherichia coli CFT073
cagccaaacaugacgcgcauc

SEQ ID NO: 2665817 - RNA, 18 nt, Escherichia coli CFT073
cagccaaauaaaaucccg

SEQ ID NO: 2665818 - RNA, 22 nt, Escherichia coli CFT073
cagccaaauaaaaucccgguga

SEQ ID NO: 2665819 - RNA, 16 nt, Escherichia coli CFT073
cagccaaauccagcgc

SEQ ID NO: 2665820 - RNA, 21 nt, Escherichia coli CFT073
cagccaaaucccgugaugcgg

SEQ ID NO: 2665821 - RNA, 17 nt, Escherichia coli CFT073
cagccaaaucgccccgc

SEQ ID NO: 2665822 - RNA, 23 nt, Escherichia coli CFT073
cagccaaaucgccccgcagccga

SEQ ID NO: 2665823 - RNA, 14 nt, Escherichia coli CFT073
cagccaaucauaaa

SEQ ID NO: 2665824 - RNA, 15 nt, Escherichia coli CFT073
cagccaaucauaaac

SEQ ID NO: 2665825 - RNA, 17 nt, Escherichia coli CFT073
cagccaaugcaggcauc

SEQ ID NO: 2665826 - RNA, 22 nt, Escherichia coli CFT073
cagccaaugcaggcaucgguga

SEQ ID NO: 2665827 - RNA, 16 nt, Escherichia coli CFT073
cagccacaccaaucaa

SEQ ID NO: 2665828 - RNA, 12 nt, Escherichia coli CFT073
cagccacaccac

SEQ ID NO: 2665829 - RNA, 15 nt, Escherichia coli CFT073
cagccacaccuucuu

SEQ ID NO: 2665830 - RNA, 23 nt, Escherichia coli CFT073
cagccacaguuuuccgccauuca

SEQ ID NO: 2665831 - RNA, 16 nt, Escherichia coli CFT073
cagccacggcgcauga

SEQ ID NO: 2665832 - RNA, 16 nt, Escherichia coli CFT073
cagccacugcgccauu

SEQ ID NO: 2665833 - RNA, 14 nt, Escherichia coli CFT073
cagccacugcugcg

SEQ ID NO: 2665834 - RNA, 23 nt, Escherichia coli CFT073
cagccacuucaaccagcggcgca

SEQ ID NO: 2665835 - RNA, 12 nt, Escherichia coli CFT073
cagccacuuccu

SEQ ID NO: 2665836 - RNA, 16 nt, Escherichia coli CFT073
cagccagaaaucacca

SEQ ID NO: 2665837 - RNA, 19 nt, Escherichia coli CFT073
cagccagaaaucaccaccg

SEQ ID NO: 2665838 - RNA, 20 nt, Escherichia coli CFT073
cagccagaacagcggagcaa

SEQ ID NO: 2665839 - RNA, 18 nt, Escherichia coli CFT073
cagccagaagcccggauc

SEQ ID NO: 2665840 - RNA, 17 nt, Escherichia coli CFT073
cagccagauaucgagaa

SEQ ID NO: 2665841 - RNA, 20 nt, Escherichia coli CFT073
cagccagauggggugaccgu

SEQ ID NO: 2665842 - RNA, 15 nt, Escherichia coli CFT073
cagccagcacugccg

SEQ ID NO: 2665843 - RNA, 15 nt, Escherichia coli CFT073
cagccagccagcacc

SEQ ID NO: 2665844 - RNA, 16 nt, Escherichia coli CFT073
cagccagccagcacca

SEQ ID NO: 2665845 - RNA, 19 nt, Escherichia coli CFT073
cagccagccgcuaacuucc

SEQ ID NO: 2665846 - RNA, 21 nt, Escherichia coli CFT073
cagccagccgcuaacuuccug

SEQ ID NO: 2665847 - RNA, 13 nt, Escherichia coli CFT073
cagccagcgcagg

SEQ ID NO: 2665848 - RNA, 14 nt, Escherichia coli CFT073
cagccagcgccgcg

SEQ ID NO: 2665849 - RNA, 15 nt, Escherichia coli CFT073
cagccagcgccgcgc

SEQ ID NO: 2665850 - RNA, 19 nt, Escherichia coli CFT073
cagccagcguuacccagac

SEQ ID NO: 2665851 - RNA, 14 nt, Escherichia coli CFT073
cagccaggccgcca

SEQ ID NO: 2665852 - RNA, 18 nt, Escherichia coli CFT073
cagccagggcaccaguaa

SEQ ID NO: 2665853 - RNA, 19 nt, Escherichia coli CFT073
cagccagggcaccaguaaa

SEQ ID NO: 2665854 - RNA, 23 nt, Escherichia coli CFT073
cagccaggguucccggccaaagc

SEQ ID NO: 2665855 - RNA, 17 nt, Escherichia coli CFT073
cagccagguggcgaucc

SEQ ID NO: 2665856 - RNA, 18 nt, Escherichia coli CFT073
cagccagguuuugcucug

SEQ ID NO: 2665857 - RNA, 14 nt, Escherichia coli CFT073
cagccaguagcacc

SEQ ID NO: 2665858 - RNA, 22 nt, Escherichia coli CFT073
cagccaguauugccaugcacgc

SEQ ID NO: 2665859 - RNA, 16 nt, Escherichia coli CFT073
cagccagucagucucu

SEQ ID NO: 2665860 - RNA, 18 nt, Escherichia coli CFT073
cagccaguccggcaaugu

SEQ ID NO: 2665861 - RNA, 15 nt, Escherichia coli CFT073
cagccaguucgagaa

SEQ ID NO: 2665862 - RNA, 12 nt, Escherichia coli CFT073
cagccaguugcu

SEQ ID NO: 2665863 - RNA, 14 nt, Escherichia coli CFT073
cagccaguugcucu

SEQ ID NO: 2665864 - RNA, 18 nt, Escherichia coli CFT073
cagccaguuuuucagcgc

SEQ ID NO: 2665865 - RNA, 20 nt, Escherichia coli CFT073
cagccauaaagaaaucaccu

SEQ ID NO: 2665866 - RNA, 21 nt, Escherichia coli CFT073
cagccauaaucacucuucccc

SEQ ID NO: 2665867 - RNA, 14 nt, Escherichia coli CFT073
cagccauaccggga

SEQ ID NO: 2665868 - RNA, 18 nt, Escherichia coli CFT073
cagccauacguugcauaa

SEQ ID NO: 2665869 - RNA, 22 nt, Escherichia coli CFT073
cagccaucaaucccaucuucga

SEQ ID NO: 2665870 - RNA, 22 nt, Escherichia coli CFT073
cagccaucaccacgccgagaga

SEQ ID NO: 2665871 - RNA, 18 nt, Escherichia coli CFT073
cagccaucauuuuuacag

SEQ ID NO: 2665872 - RNA, 14 nt, Escherichia coli CFT073
cagccaucgccacc

SEQ ID NO: 2665873 - RNA, 19 nt, Escherichia coli CFT073
cagccaucgccaccgcuuc

SEQ ID NO: 2665874 - RNA, 17 nt, Escherichia coli CFT073
cagccaucuguuccggc

SEQ ID NO: 2665875 - RNA, 13 nt, Escherichia coli CFT073
cagccaugaugaa

SEQ ID NO: 2665876 - RNA, 14 nt, Escherichia coli CFT073
cagccaugcauuuu

SEQ ID NO: 2665877 - RNA, 12 nt, Escherichia coli CFT073
cagccaugccac

SEQ ID NO: 2665878 - RNA, 16 nt, Escherichia coli CFT073
cagccaugccgccacc

SEQ ID NO: 2665879 - RNA, 22 nt, Escherichia coli CFT073
cagccaugccgccaccaccagc

SEQ ID NO: 2665880 - RNA, 23 nt, Escherichia coli CFT073
cagccaugccgccaccaccagcg

SEQ ID NO: 2665881 - RNA, 17 nt, Escherichia coli CFT073
cagccaugcggcaucuu

SEQ ID NO: 2665882 - RNA, 14 nt, Escherichia coli CFT073
cagccauucaaucu

SEQ ID NO: 2665883 - RNA, 16 nt, Escherichia coli CFT073
cagccauuccgggaaa

SEQ ID NO: 2665884 - RNA, 20 nt, Escherichia coli CFT073
cagccauuuugcacauucca

SEQ ID NO: 2665885 - RNA, 17 nt, Escherichia coli CFT073
cagcccaaagagcaaga

SEQ ID NO: 2665886 - RNA, 18 nt, Escherichia coli CFT073
cagcccaaagagcaagaa

SEQ ID NO: 2665887 - RNA, 18 nt, Escherichia coli CFT073
cagcccacaugccugcau

SEQ ID NO: 2665888 - RNA, 18 nt, Escherichia coli CFT073
cagcccagcccugaacca

SEQ ID NO: 2665889 - RNA, 14 nt, Escherichia coli CFT073
cagcccagcgcuuc

SEQ ID NO: 2665890 - RNA, 12 nt, Escherichia coli CFT073
cagcccagcgga

SEQ ID NO: 2665891 - RNA, 19 nt, Escherichia coli CFT073
cagcccaggaagcccgccc

SEQ ID NO: 2665892 - RNA, 22 nt, Escherichia coli CFT073
cagcccaggaagcccgcccagc

SEQ ID NO: 2665893 - RNA, 21 nt, Escherichia coli CFT073
cagcccauaccgugguuuugg

SEQ ID NO: 2665894 - RNA, 13 nt, Escherichia coli CFT073
cagccccacagca

SEQ ID NO: 2665895 - RNA, 13 nt, Escherichia coli CFT073
cagccccaccagc

SEQ ID NO: 2665896 - RNA, 15 nt, Escherichia coli CFT073
cagccccagaacuca

SEQ ID NO: 2665897 - RNA, 22 nt, Escherichia coli CFT073
cagccccagcacuucgcuggug

SEQ ID NO: 2665898 - RNA, 13 nt, Escherichia coli CFT073
cagccccaguucc

SEQ ID NO: 2665899 - RNA, 16 nt, Escherichia coli CFT073
cagccccaucagcgcc

SEQ ID NO: 2665900 - RNA, 21 nt, Escherichia coli CFT073
cagccccaucagcgccaucgc

SEQ ID NO: 2665901 - RNA, 15 nt, Escherichia coli CFT073
cagccccgcgcggcg

SEQ ID NO: 2665902 - RNA, 14 nt, Escherichia coli CFT073
cagccccgguuuuu

SEQ ID NO: 2665903 - RNA, 14 nt, Escherichia coli CFT073
cagccccucagcgg

SEQ ID NO: 2665904 - RNA, 13 nt, Escherichia coli CFT073
cagccccuccgga

SEQ ID NO: 2665905 - RNA, 14 nt, Escherichia coli CFT073
cagccccugugcca

SEQ ID NO: 2665906 - RNA, 15 nt, Escherichia coli CFT073
cagcccgagguuauu

SEQ ID NO: 2665907 - RNA, 16 nt, Escherichia coli CFT073
cagcccgccaaugccg

SEQ ID NO: 2665908 - RNA, 13 nt, Escherichia coli CFT073
cagcccgccacaa

SEQ ID NO: 2665909 - RNA, 13 nt, Escherichia coli CFT073
cagcccgccgaga

SEQ ID NO: 2665910 - RNA, 12 nt, Escherichia coli CFT073
cagcccgccgcc

SEQ ID NO: 2665911 - RNA, 18 nt, Escherichia coli CFT073
cagcccggcauguuucaa

SEQ ID NO: 2665912 - RNA, 21 nt, Escherichia coli CFT073
cagcccggguuugccgcuggc

SEQ ID NO: 2665913 - RNA, 15 nt, Escherichia coli CFT073
cagcccugcccagag

SEQ ID NO: 2665914 - RNA, 14 nt, Escherichia coli CFT073
cagcccuucucgcu

SEQ ID NO: 2665915 - RNA, 22 nt, Escherichia coli CFT073
cagcccuuugauuugucugcca

SEQ ID NO: 2665916 - RNA, 18 nt, Escherichia coli CFT073
cagccgauguuauugcag

SEQ ID NO: 2665917 - RNA, 21 nt, Escherichia coli CFT073
cagccgauguuauugcagaca

SEQ ID NO: 2665918 - RNA, 22 nt, Escherichia coli CFT073
cagccgcaaacuuugccacaau

SEQ ID NO: 2665919 - RNA, 15 nt, Escherichia coli CFT073
cagccgccaucgcug

SEQ ID NO: 2665920 - RNA, 13 nt, Escherichia coli CFT073
cagccgcccagcg

SEQ ID NO: 2665921 - RNA, 16 nt, Escherichia coli CFT073
cagccgcccagcgaac

SEQ ID NO: 2665922 - RNA, 23 nt, Escherichia coli CFT073
cagccgcgucugaauaucaucac

SEQ ID NO: 2665923 - RNA, 15 nt, Escherichia coli CFT073
cagcgccagcauaug

SEQ ID NO: 2665924 - RNA, 12 nt, Escherichia coli CFT073
cagcgccagcgc

SEQ ID NO: 2665925 - RNA, 14 nt, Escherichia coli CFT073
cagcgccaggcaca

SEQ ID NO: 2665926 - RNA, 18 nt, Escherichia coli CFT073
cagcgccauaaucagcgc

SEQ ID NO: 2665927 - RNA, 20 nt, Escherichia coli CFT073
cagcgccaucgccaggaaca

SEQ ID NO: 2665928 - RNA, 17 nt, Escherichia coli CFT073
cagcgcccguaaaccaa

SEQ ID NO: 2665929 - RNA, 23 nt, Escherichia coli CFT073
cagcgcccguuugcgagacggcg

SEQ ID NO: 2665930 - RNA, 15 nt, Escherichia coli CFT073
cagcgcccucuuuuu

SEQ ID NO: 2665931 - RNA, 15 nt, Escherichia coli CFT073
cagcgcccugccgau

SEQ ID NO: 2665932 - RNA, 13 nt, Escherichia coli CFT073
cagcgccgcccac

SEQ ID NO: 2665933 - RNA, 13 nt, Escherichia coli CFT073
cagcgccgcgagc

SEQ ID NO: 2665934 - RNA, 22 nt, Escherichia coli CFT073
cagcgccggauucacgccaacc

SEQ ID NO: 2665935 - RNA, 22 nt, Escherichia coli CFT073
cagcgccgggauguugcugcga

SEQ ID NO: 2665936 - RNA, 23 nt, Escherichia coli CFT073
cagcgccucuuccaguaaaccaa

SEQ ID NO: 2665937 - RNA, 22 nt, Escherichia coli CFT073
cagcgccugacggaucggcuca

SEQ ID NO: 2665938 - RNA, 13 nt, Escherichia coli CFT073
cagcgccugaugg

SEQ ID NO: 2665939 - RNA, 14 nt, Escherichia coli CFT073
cagcgccugaugga

SEQ ID NO: 2665940 - RNA, 17 nt, Escherichia coli CFT073
cagcgccugcagcugca

SEQ ID NO: 2665941 - RNA, 16 nt, Escherichia coli CFT073
cagcgccugcgcggca

SEQ ID NO: 2665942 - RNA, 14 nt, Escherichia coli CFT073
cagcgccugcugca

SEQ ID NO: 2665943 - RNA, 15 nt, Escherichia coli CFT073
cagcgccugcugcac

SEQ ID NO: 2665944 - RNA, 20 nt, Escherichia coli CFT073
cagcgccugcugcacaccau

SEQ ID NO: 2665945 - RNA, 17 nt, Escherichia coli CFT073
cagcgccuggcagcaug

SEQ ID NO: 2665946 - RNA, 22 nt, Escherichia coli CFT073
cagcgccugguccagcucgcga

SEQ ID NO: 2665947 - RNA, 18 nt, Escherichia coli CFT073
cagcgcgaccggcggcga

SEQ ID NO: 2665948 - RNA, 15 nt, Escherichia coli CFT073
cagcgcgaucgcgcc

SEQ ID NO: 2665949 - RNA, 14 nt, Escherichia coli CFT073
cagcgcgauuagcg

SEQ ID NO: 2665950 - RNA, 16 nt, Escherichia coli CFT073
cagcgcgccagcuacc

SEQ ID NO: 2665951 - RNA, 14 nt, Escherichia coli CFT073
cagcgcgcccggcg

SEQ ID NO: 2665952 - RNA, 14 nt, Escherichia coli CFT073
cagcgcgcgaauau

SEQ ID NO: 2665953 - RNA, 13 nt, Escherichia coli CFT073
cagcgcgcgcagc

SEQ ID NO: 2665954 - RNA, 16 nt, Escherichia coli CFT073
cagcgcgcgcgggaau

SEQ ID NO: 2665955 - RNA, 22 nt, Escherichia coli CFT073
cagcgcgcguauccugcaugga

SEQ ID NO: 2665956 - RNA, 14 nt, Escherichia coli CFT073
cagcgcgcucgcca

SEQ ID NO: 2665957 - RNA, 20 nt, Escherichia coli CFT073
cagcgcggaaggaaugaaau

SEQ ID NO: 2665958 - RNA, 16 nt, Escherichia coli CFT073
cagcgcggagaacuua

SEQ ID NO: 2665959 - RNA, 13 nt, Escherichia coli CFT073
cagcgcggcagcg

SEQ ID NO: 2665960 - RNA, 19 nt, Escherichia coli CFT073
cagcgcggcagcggcuuca

SEQ ID NO: 2665961 - RNA, 21 nt, Escherichia coli CFT073
cagcgcggcgauaauacccag

SEQ ID NO: 2665962 - RNA, 15 nt, Escherichia coli CFT073
cagcgcgggcuggcg

SEQ ID NO: 2665963 - RNA, 18 nt, Escherichia coli CFT073
cagcgcgguaacgcacag

SEQ ID NO: 2665964 - RNA, 18 nt, Escherichia coli CFT073
cagcgcgugcgccaccgc

SEQ ID NO: 2665965 - RNA, 17 nt, Escherichia coli CFT073
cagcgcguuugucagca

SEQ ID NO: 2665966 - RNA, 15 nt, Escherichia coli CFT073
cagcgcuaccagagc

SEQ ID NO: 2665967 - RNA, 20 nt, Escherichia coli CFT073
cagcgcuaccagagccgcgc

SEQ ID NO: 2665968 - RNA, 16 nt, Escherichia coli CFT073
cagcgcugcccaccac

SEQ ID NO: 2665969 - RNA, 19 nt, Escherichia coli CFT073
cagcgcugcggccugcugc

SEQ ID NO: 2665970 - RNA, 16 nt, Escherichia coli CFT073
cagcgcuggagagcgc

SEQ ID NO: 2665971 - RNA, 21 nt, Escherichia coli CFT073
cagcgcuggagagcgccgggc

SEQ ID NO: 2665972 - RNA, 21 nt, Escherichia coli CFT073
cagcgcuucuucuaucguuuu

SEQ ID NO: 2665973 - RNA, 12 nt, Escherichia coli CFT073
cagcgcuuuauc

SEQ ID NO: 2665974 - RNA, 16 nt, Escherichia coli CFT073
cagcgcuuuaucaucg

SEQ ID NO: 2665975 - RNA, 20 nt, Escherichia coli CFT073
cagcgcuuuaucaucgguca

SEQ ID NO: 2665976 - RNA, 23 nt, Escherichia coli CFT073
cagcgcuuuaucaucggucagcg

SEQ ID NO: 2665977 - RNA, 23 nt, Escherichia coli CFT073
cagcggaaauuaccgcaccacca

SEQ ID NO: 2665978 - RNA, 23 nt, Escherichia coli CFT073
cagcggaauaaaaagcgauaucc

SEQ ID NO: 2665979 - RNA, 15 nt, Escherichia coli CFT073
cagcggacggcugau

SEQ ID NO: 2665980 - RNA, 20 nt, Escherichia coli CFT073
cagcggauaaagcagggcag

SEQ ID NO: 2665981 - RNA, 15 nt, Escherichia coli CFT073
cagcggaugacccag

SEQ ID NO: 2665982 - RNA, 21 nt, Escherichia coli CFT073
cagcggaugacccagcgcgau

SEQ ID NO: 2665983 - RNA, 17 nt, Escherichia coli CFT073
cagcggcaaccagcagc

SEQ ID NO: 2665984 - RNA, 18 nt, Escherichia coli CFT073
cagcggcaaccagcagca

SEQ ID NO: 2665985 - RNA, 21 nt, Escherichia coli CFT073
cagcggcaaccagcagcauca

SEQ ID NO: 2665986 - RNA, 19 nt, Escherichia coli CFT073
cagcggcaacggcacauau

SEQ ID NO: 2665987 - RNA, 17 nt, Escherichia coli CFT073
cagcggcagaaugguaa

SEQ ID NO: 2665988 - RNA, 17 nt, Escherichia coli CFT073
cagcggcagaguaauug

SEQ ID NO: 2665989 - RNA, 16 nt, Escherichia coli CFT073
cagcggcaguaaauau

SEQ ID NO: 2665990 - RNA, 21 nt, Escherichia coli CFT073
cagcggccagacgcgccgcca

SEQ ID NO: 2665991 - RNA, 17 nt, Escherichia coli CFT073
cagcggcgcauccgcca

SEQ ID NO: 2665992 - RNA, 12 nt, Escherichia coli CFT073
cagcggcggauu

SEQ ID NO: 2665993 - RNA, 15 nt, Escherichia coli CFT073
cagcggcggcacagc

SEQ ID NO: 2665994 - RNA, 16 nt, Escherichia coli CFT073
cagcggcggcacagcg

SEQ ID NO: 2665995 - RNA, 17 nt, Escherichia coli CFT073
cagcggcguuuuaucac

SEQ ID NO: 2665996 - RNA, 20 nt, Escherichia coli CFT073
cagcggcugcuucgcgccca

SEQ ID NO: 2665997 - RNA, 17 nt, Escherichia coli CFT073
cagcggcuguuccggca

SEQ ID NO: 2665998 - RNA, 19 nt, Escherichia coli CFT073
cagcggcuuccccaacaca

SEQ ID NO: 2665999 - RNA, 16 nt, Escherichia coli CFT073
cagcgggacaacaaac

SEQ ID NO: 2666000 - RNA, 22 nt, Escherichia coli CFT073
cagcgggaucggcguacuggca

SEQ ID NO: 2666001 - RNA, 21 nt, Escherichia coli CFT073
cagcgggauucuccugagaau

SEQ ID NO: 2666002 - RNA, 17 nt, Escherichia coli CFT073
cagcgggauuuccggca

SEQ ID NO: 2666003 - RNA, 20 nt, Escherichia coli CFT073
cagcgggcgaaucaacucca

SEQ ID NO: 2666004 - RNA, 12 nt, Escherichia coli CFT073
cagcggggcgaa

SEQ ID NO: 2666005 - RNA, 20 nt, Escherichia coli CFT073
cagcggguuaucuuccagcg

SEQ ID NO: 2666006 - RNA, 23 nt, Escherichia coli CFT073
cagcggguuuucuacuuuuucuu

SEQ ID NO: 2666007 - RNA, 15 nt, Escherichia coli CFT073
cagcgguaaaauggu

SEQ ID NO: 2666008 - RNA, 17 nt, Escherichia coli CFT073
cagcgguaaaaugguca

SEQ ID NO: 2666009 - RNA, 12 nt, Escherichia coli CFT073
cagcgguaaauc

SEQ ID NO: 2666010 - RNA, 13 nt, Escherichia coli CFT073
cagcgguaaauca

SEQ ID NO: 2666011 - RNA, 19 nt, Escherichia coli CFT073
cagcggugcaccugccagc

SEQ ID NO: 2666012 - RNA, 18 nt, Escherichia coli CFT073
cagcggugccgcgauacc

SEQ ID NO: 2666013 - RNA, 14 nt, Escherichia coli CFT073
cagcgguuccccgc

SEQ ID NO: 2666014 - RNA, 16 nt, Escherichia coli CFT073
cagcgguuguagccac

SEQ ID NO: 2666015 - RNA, 13 nt, Escherichia coli CFT073
cagcgguuuaccg

SEQ ID NO: 2666016 - RNA, 12 nt, Escherichia coli CFT073
cagcgguuuugc

SEQ ID NO: 2666017 - RNA, 15 nt, Escherichia coli CFT073
cagcgguuuugccag

SEQ ID NO: 2666018 - RNA, 18 nt, Escherichia coli CFT073
cagcguaaaaaaacaaaa

SEQ ID NO: 2666019 - RNA, 21 nt, Escherichia coli CFT073
cagcguaaauccugacgcugg

SEQ ID NO: 2666020 - RNA, 16 nt, Escherichia coli CFT073
cagcguaacgcccacg

SEQ ID NO: 2666021 - RNA, 23 nt, Escherichia coli CFT073
cagcguaacggcucacccccauc

SEQ ID NO: 2666022 - RNA, 21 nt, Escherichia coli CFT073
cagcguaauaaccaacggcga

SEQ ID NO: 2666023 - RNA, 19 nt, Escherichia coli CFT073
cagcguaauaggcgcgaca

SEQ ID NO: 2666024 - RNA, 20 nt, Escherichia coli CFT073
cagcguagugauaccccgca

SEQ ID NO: 2666025 - RNA, 21 nt, Escherichia coli CFT073
cagcguagugauaccccgcau

SEQ ID NO: 2666026 - RNA, 17 nt, Escherichia coli CFT073
cagcguaugcagccagg

SEQ ID NO: 2666027 - RNA, 21 nt, Escherichia coli CFT073
cagcgucacuuccuucgccgc

SEQ ID NO: 2666028 - RNA, 16 nt, Escherichia coli CFT073
cagcgucagcacuuca

SEQ ID NO: 2666029 - RNA, 14 nt, Escherichia coli CFT073
cagcgucagcagca

SEQ ID NO: 2666030 - RNA, 15 nt, Escherichia coli CFT073
cagcgucagcagcaa

SEQ ID NO: 2666031 - RNA, 13 nt, Escherichia coli CFT073
cagcuucagauug

SEQ ID NO: 2666032 - RNA, 12 nt, Escherichia coli CFT073
cagcuucaucau

SEQ ID NO: 2666033 - RNA, 15 nt, Escherichia coli CFT073
cagcuucaucaucgc

SEQ ID NO: 2666034 - RNA, 21 nt, Escherichia coli CFT073
cagcuucgccagcgcgcggcu

SEQ ID NO: 2666035 - RNA, 18 nt, Escherichia coli CFT073
cagcuucggcgacuauuu

SEQ ID NO: 2666036 - RNA, 23 nt, Escherichia coli CFT073
cagcuucucgugaaauucacgca

SEQ ID NO: 2666037 - RNA, 15 nt, Escherichia coli CFT073
cagcuugaaggguuu

SEQ ID NO: 2666038 - RNA, 13 nt, Escherichia coli CFT073
cagcuugcagccg

SEQ ID NO: 2666039 - RNA, 14 nt, Escherichia coli CFT073
cagcuugcagccgu

SEQ ID NO: 2666040 - RNA, 14 nt, Escherichia coli CFT073
cagcuugcgccgcc

SEQ ID NO: 2666041 - RNA, 17 nt, Escherichia coli CFT073
cagcuugcgccgcccgc

SEQ ID NO: 2666042 - RNA, 12 nt, Escherichia coli CFT073
cagcuuucgcuu

SEQ ID NO: 2666043 - RNA, 18 nt, Escherichia coli CFT073
cagcuuucggguggccag

SEQ ID NO: 2666044 - RNA, 20 nt, Escherichia coli CFT073
cagcuuugcccgaucaucaa

SEQ ID NO: 2666045 - RNA, 22 nt, Escherichia coli CFT073
cagcuuuuacaaaaucuucguu

SEQ ID NO: 2666046 - RNA, 13 nt, Escherichia coli CFT073
cagcuuuuacagc

SEQ ID NO: 2666047 - RNA, 21 nt, Escherichia coli CFT073
cagcuuuuccauaucaagcau

SEQ ID NO: 2666048 - RNA, 19 nt, Escherichia coli CFT073
cagcuuuucgauaacccug

SEQ ID NO: 2666049 - RNA, 23 nt, Escherichia coli CFT073
cagcuuuugcaaacaacgcuuca

SEQ ID NO: 2666050 - RNA, 20 nt, Escherichia coli CFT073
cagcuuuuucagcguuuucu

SEQ ID NO: 2666051 - RNA, 13 nt, Escherichia coli CFT073
cagcuuuuuccug

SEQ ID NO: 2666052 - RNA, 15 nt, Escherichia coli CFT073
cagcuuuuuccugcg

SEQ ID NO: 2666053 - RNA, 23 nt, Escherichia coli CFT073
caggaaaaugagaugguuuugcu

SEQ ID NO: 2666054 - RNA, 15 nt, Escherichia coli CFT073
caggaaacccaacgc

SEQ ID NO: 2666055 - RNA, 21 nt, Escherichia coli CFT073
caggaaacccaacgcaaagag

SEQ ID NO: 2666056 - RNA, 23 nt, Escherichia coli CFT073
caggaaagaaccggguaaagacu

SEQ ID NO: 2666057 - RNA, 12 nt, Escherichia coli CFT073
caggaaauaaau

SEQ ID NO: 2666058 - RNA, 15 nt, Escherichia coli CFT073
caggaaaucaaugcc

SEQ ID NO: 2666059 - RNA, 17 nt, Escherichia coli CFT073
caggaaaucgucgaggg

SEQ ID NO: 2666060 - RNA, 13 nt, Escherichia coli CFT073
caggaaaugggug

SEQ ID NO: 2666061 - RNA, 14 nt, Escherichia coli CFT073
caggaacagauacu

SEQ ID NO: 2666062 - RNA, 22 nt, Escherichia coli CFT073
caggaacagauacuggaaguga

SEQ ID NO: 2666063 - RNA, 13 nt, Escherichia coli CFT073
caggaacagccac

SEQ ID NO: 2666064 - RNA, 21 nt, Escherichia coli CFT073
caggaaccacaaccacuuugu

SEQ ID NO: 2666065 - RNA, 18 nt, Escherichia coli CFT073
caggaacgcgccaagaua

SEQ ID NO: 2666066 - RNA, 17 nt, Escherichia coli CFT073
caggaacucagcgugcc

SEQ ID NO: 2666067 - RNA, 19 nt, Escherichia coli CFT073
caggaacugcaaggagagc

SEQ ID NO: 2666068 - RNA, 19 nt, Escherichia coli CFT073
caggaacuuaguaggccug

SEQ ID NO: 2666069 - RNA, 14 nt, Escherichia coli CFT073
caggaacuucguaa

SEQ ID NO: 2666070 - RNA, 17 nt, Escherichia coli CFT073
caggaagaagcccauca

SEQ ID NO: 2666071 - RNA, 18 nt, Escherichia coli CFT073
caggaagccuuccgcaaa

SEQ ID NO: 2666072 - RNA, 14 nt, Escherichia coli CFT073
caggaauaagacag

SEQ ID NO: 2666073 - RNA, 12 nt, Escherichia coli CFT073
caggaauauacc

SEQ ID NO: 2666074 - RNA, 20 nt, Escherichia coli CFT073
caggaauaucgaucgccgca

SEQ ID NO: 2666075 - RNA, 14 nt, Escherichia coli CFT073
caggaauucggcau

SEQ ID NO: 2666076 - RNA, 15 nt, Escherichia coli CFT073
caggacauaucaggc

SEQ ID NO: 2666077 - RNA, 13 nt, Escherichia coli CFT073
caggacaucagcg

SEQ ID NO: 2666078 - RNA, 14 nt, Escherichia coli CFT073
caggacaucagcgc

SEQ ID NO: 2666079 - RNA, 16 nt, Escherichia coli CFT073
caggacaucagcgcac

SEQ ID NO: 2666080 - RNA, 20 nt, Escherichia coli CFT073
caggacaucagcgcaccaua

SEQ ID NO: 2666081 - RNA, 15 nt, Escherichia coli CFT073
caggaccauucacac

SEQ ID NO: 2666082 - RNA, 15 nt, Escherichia coli CFT073
caggacccucaagga

SEQ ID NO: 2666083 - RNA, 12 nt, Escherichia coli CFT073
caggaccgcuga

SEQ ID NO: 2666084 - RNA, 18 nt, Escherichia coli CFT073
caggacgcucccucaaua

SEQ ID NO: 2666085 - RNA, 16 nt, Escherichia coli CFT073
caggagcaauuuucgg

SEQ ID NO: 2666086 - RNA, 15 nt, Escherichia coli CFT073
caggagccaguuggc

SEQ ID NO: 2666087 - RNA, 17 nt, Escherichia coli CFT073
caggagccgcaguaacc

SEQ ID NO: 2666088 - RNA, 15 nt, Escherichia coli CFT073
caggagcgauuauga

SEQ ID NO: 2666089 - RNA, 14 nt, Escherichia coli CFT073
caggagcgccgaau

SEQ ID NO: 2666090 - RNA, 22 nt, Escherichia coli CFT073
caggaguagcucuggguaacac

SEQ ID NO: 2666091 - RNA, 14 nt, Escherichia coli CFT073
caggagucacgcag

SEQ ID NO: 2666092 - RNA, 14 nt, Escherichia coli CFT073
caggaguuauagag

SEQ ID NO: 2666093 - RNA, 17 nt, Escherichia coli CFT073
caggauaaacuccugca

SEQ ID NO: 2666094 - RNA, 16 nt, Escherichia coli CFT073
caggauaaccuuccac

SEQ ID NO: 2666095 - RNA, 20 nt, Escherichia coli CFT073
caggauaaccuuccaccguu

SEQ ID NO: 2666096 - RNA, 15 nt, Escherichia coli CFT073
caggauaacggcaga

SEQ ID NO: 2666097 - RNA, 20 nt, Escherichia coli CFT073
caggauaacggcagaagcag

SEQ ID NO: 2666098 - RNA, 15 nt, Escherichia coli CFT073
caggauagaaaacga

SEQ ID NO: 2666099 - RNA, 13 nt, Escherichia coli CFT073
caggauaucugaa

SEQ ID NO: 2666100 - RNA, 16 nt, Escherichia coli CFT073
caggauauuuauauuu

SEQ ID NO: 2666101 - RNA, 23 nt, Escherichia coli CFT073
caggaucaccaauaccagcauca

SEQ ID NO: 2666102 - RNA, 14 nt, Escherichia coli CFT073
caggaucagcaaaa

SEQ ID NO: 2666103 - RNA, 17 nt, Escherichia coli CFT073
caggauccgcucugccc

SEQ ID NO: 2666104 - RNA, 19 nt, Escherichia coli CFT073
caggaucgacugcaagcca

SEQ ID NO: 2666105 - RNA, 19 nt, Escherichia coli CFT073
caggaucguugagcagcag

SEQ ID NO: 2666106 - RNA, 16 nt, Escherichia coli CFT073
caggaucugcgcggca

SEQ ID NO: 2666107 - RNA, 21 nt, Escherichia coli CFT073
caggaugccguuaauaauaaa

SEQ ID NO: 2666108 - RNA, 16 nt, Escherichia coli CFT073
caggaugcggcuaauu

SEQ ID NO: 2666109 - RNA, 23 nt, Escherichia coli CFT073
caggaugcucgcgaaaagaaacu

SEQ ID NO: 2666110 - RNA, 19 nt, Escherichia coli CFT073
caggaugcuucaacgaaag

SEQ ID NO: 2666111 - RNA, 23 nt, Escherichia coli CFT073
caggauggcauuugcaacaccgu

SEQ ID NO: 2666112 - RNA, 17 nt, Escherichia coli CFT073
caggaugggcugccagc

SEQ ID NO: 2666113 - RNA, 17 nt, Escherichia coli CFT073
caggauguaauccggca

SEQ ID NO: 2666114 - RNA, 14 nt, Escherichia coli CFT073
caggaugugagcug

SEQ ID NO: 2666115 - RNA, 17 nt, Escherichia coli CFT073
caggaugugagcuggcg

SEQ ID NO: 2666116 - RNA, 18 nt, Escherichia coli CFT073
caggauuacgcucaccaa

SEQ ID NO: 2666117 - RNA, 18 nt, Escherichia coli CFT073
caggauuacuuaacuucc

SEQ ID NO: 2666118 - RNA, 14 nt, Escherichia coli CFT073
caggauugguaaua

SEQ ID NO: 2666119 - RNA, 19 nt, Escherichia coli CFT073
caggauuuccagcucaaag

SEQ ID NO: 2666120 - RNA, 19 nt, Escherichia coli CFT073
caggcaaaaaugucacucg

SEQ ID NO: 2666121 - RNA, 14 nt, Escherichia coli CFT073
caggcaaaccagua

SEQ ID NO: 2666122 - RNA, 15 nt, Escherichia coli CFT073
caggcaaaccaguac

SEQ ID NO: 2666123 - RNA, 22 nt, Escherichia coli CFT073
caggcaaaguaggccguacagc

SEQ ID NO: 2666124 - RNA, 19 nt, Escherichia coli CFT073
caggcaaagucacccgaua

SEQ ID NO: 2666125 - RNA, 18 nt, Escherichia coli CFT073
caggcaaauucuguuuca

SEQ ID NO: 2666126 - RNA, 16 nt, Escherichia coli CFT073
caggcaacaucgccag

SEQ ID NO: 2666127 - RNA, 20 nt, Escherichia coli CFT073
caggcaagaauccgccccgc

SEQ ID NO: 2666128 - RNA, 16 nt, Escherichia coli CFT073
caggcaagcauaugac

SEQ ID NO: 2666129 - RNA, 22 nt, Escherichia coli CFT073
caggcaagccuugcagccagaa

SEQ ID NO: 2666130 - RNA, 19 nt, Escherichia coli CFT073
caggcaaguagcgccagac

SEQ ID NO: 2666131 - RNA, 22 nt, Escherichia coli CFT073
caggcaaucaguaaucgcgcca

SEQ ID NO: 2666132 - RNA, 14 nt, Escherichia coli CFT073
caggcaaucggcgc

SEQ ID NO: 2666133 - RNA, 19 nt, Escherichia coli CFT073
caggcaaugacaucgcccu

SEQ ID NO: 2666134 - RNA, 18 nt, Escherichia coli CFT073
caggcaauuucgccucgc

SEQ ID NO: 2666135 - RNA, 14 nt, Escherichia coli CFT073
caggcacaccagca

SEQ ID NO: 2666136 - RNA, 15 nt, Escherichia coli CFT073
caggcacaucggcua

SEQ ID NO: 2666137 - RNA, 20 nt, Escherichia coli CFT073
caggcaccaaaaaucaccgc

SEQ ID NO: 2666138 - RNA, 18 nt, Escherichia coli CFT073
caggcacuacguucucac

SEQ ID NO: 2666139 - RNA, 20 nt, Escherichia coli CFT073
caggcacuucuuccgccagc

SEQ ID NO: 2666140 - RNA, 22 nt, Escherichia coli CFT073
cagggauaaagcuuuuuauuac

SEQ ID NO: 2666141 - RNA, 16 nt, Escherichia coli CFT073
cagggaucaacauuca

SEQ ID NO: 2666142 - RNA, 19 nt, Escherichia coli CFT073
cagggaucaacauucagau

SEQ ID NO: 2666143 - RNA, 18 nt, Escherichia coli CFT073
cagggaucauccacccgc

SEQ ID NO: 2666144 - RNA, 17 nt, Escherichia coli CFT073
cagggauccccagccgc

SEQ ID NO: 2666145 - RNA, 13 nt, Escherichia coli CFT073
cagggcaaacagc

SEQ ID NO: 2666146 - RNA, 14 nt, Escherichia coli CFT073
cagggcaacggcca

SEQ ID NO: 2666147 - RNA, 21 nt, Escherichia coli CFT073
cagggcaaucgcgccaaccag

SEQ ID NO: 2666148 - RNA, 20 nt, Escherichia coli CFT073
cagggcaauguaacaccugu

SEQ ID NO: 2666149 - RNA, 16 nt, Escherichia coli CFT073
cagggcagcauggggc

SEQ ID NO: 2666150 - RNA, 19 nt, Escherichia coli CFT073
cagggcagggaagcgaguu

SEQ ID NO: 2666151 - RNA, 17 nt, Escherichia coli CFT073
cagggccucuccuuuac

SEQ ID NO: 2666152 - RNA, 18 nt, Escherichia coli CFT073
cagggcggacugauaacu

SEQ ID NO: 2666153 - RNA, 22 nt, Escherichia coli CFT073
cagggcgucaauuugcuccgcc

SEQ ID NO: 2666154 - RNA, 14 nt, Escherichia coli CFT073
cagggcgucaccgg

SEQ ID NO: 2666155 - RNA, 22 nt, Escherichia coli CFT073
cagggcuuuuuaaugcaauaaa

SEQ ID NO: 2666156 - RNA, 21 nt, Escherichia coli CFT073
cagggcuuuuuuauuucaucu

SEQ ID NO: 2666157 - RNA, 18 nt, Escherichia coli CFT073
caggggcaaucagcacua

SEQ ID NO: 2666158 - RNA, 23 nt, Escherichia coli CFT073
caggggcaaucagcacuacugcc

SEQ ID NO: 2666159 - RNA, 15 nt, Escherichia coli CFT073
caggggcagaaacaa

SEQ ID NO: 2666160 - RNA, 18 nt, Escherichia coli CFT073
cagggguuguuauuuccg

SEQ ID NO: 2666161 - RNA, 11 nt, Escherichia coli CFT073
caggguaaaaa

SEQ ID NO: 2666162 - RNA, 18 nt, Escherichia coli CFT073
caggguaucgguugcugg

SEQ ID NO: 2666163 - RNA, 19 nt, Escherichia coli CFT073
cagggucacgguauuaaua

SEQ ID NO: 2666164 - RNA, 24 nt, Escherichia coli CFT073
caggguguuaucaauaccgauggc

SEQ ID NO: 2666165 - RNA, 20 nt, Escherichia coli CFT073
caggguucccggccaaagcg

SEQ ID NO: 2666166 - RNA, 20 nt, Escherichia coli CFT073
caggguugacuuggcuuucu

SEQ ID NO: 2666167 - RNA, 14 nt, Escherichia coli CFT073
cagguaaacaccuu

SEQ ID NO: 2666168 - RNA, 13 nt, Escherichia coli CFT073
cagguaaagacca

SEQ ID NO: 2666169 - RNA, 20 nt, Escherichia coli CFT073
cagguaacugacuccgauau

SEQ ID NO: 2666170 - RNA, 21 nt, Escherichia coli CFT073
cagguaagaguuucaacauca

SEQ ID NO: 2666171 - RNA, 23 nt, Escherichia coli CFT073
cagguaagaguuucaacaucauu

SEQ ID NO: 2666172 - RNA, 19 nt, Escherichia coli CFT073
cagguaagcgaaggugccu

SEQ ID NO: 2666173 - RNA, 18 nt, Escherichia coli CFT073
cagguaagcgauaaaaau

SEQ ID NO: 2666174 - RNA, 19 nt, Escherichia coli CFT073
cagguaaucaaugcgguaa

SEQ ID NO: 2666175 - RNA, 18 nt, Escherichia coli CFT073
cagguaauuugaucaaau

SEQ ID NO: 2666176 - RNA, 13 nt, Escherichia coli CFT073
cagguagcaaaca

SEQ ID NO: 2666177 - RNA, 14 nt, Escherichia coli CFT073
cagguagcagcagc

SEQ ID NO: 2666178 - RNA, 19 nt, Escherichia coli CFT073
cagguagcagcagcgccag

SEQ ID NO: 2666179 - RNA, 18 nt, Escherichia coli CFT073
cagguagcguuucaccuc

SEQ ID NO: 2666180 - RNA, 21 nt, Escherichia coli CFT073
cagguagcguuucaccucuuu

SEQ ID NO: 2666181 - RNA, 20 nt, Escherichia coli CFT073
cagguauaccgaaaucgcca

SEQ ID NO: 2666182 - RNA, 21 nt, Escherichia coli CFT073
cagguauuguguugccgggcg

SEQ ID NO: 2666183 - RNA, 12 nt, Escherichia coli CFT073
caggucaccaga

SEQ ID NO: 2666184 - RNA, 14 nt, Escherichia coli CFT073
caggucaucgugcg

SEQ ID NO: 2666185 - RNA, 22 nt, Escherichia coli CFT073
caggucauuauucauuuuucgc

SEQ ID NO: 2666186 - RNA, 17 nt, Escherichia coli CFT073
cagguccaucacuugcu

SEQ ID NO: 2666187 - RNA, 23 nt, Escherichia coli CFT073
cagguccaucacuugcugcaccu

SEQ ID NO: 2666188 - RNA, 20 nt, Escherichia coli CFT073
cagguccguauagaucagcg

SEQ ID NO: 2666189 - RNA, 15 nt, Escherichia coli CFT073
caggucgaaaauaau

SEQ ID NO: 2666190 - RNA, 21 nt, Escherichia coli CFT073
caggucgacaauccagucagc

SEQ ID NO: 2666191 - RNA, 17 nt, Escherichia coli CFT073
caggucgccagaaacca

SEQ ID NO: 2666192 - RNA, 23 nt, Escherichia coli CFT073
caggucgcgcauuaccucaauaa

SEQ ID NO: 2666193 - RNA, 16 nt, Escherichia coli CFT073
caggucggauaagacg

SEQ ID NO: 2666194 - RNA, 23 nt, Escherichia coli CFT073
caggucggugugaaugaccaggu

SEQ ID NO: 2666195 - RNA, 18 nt, Escherichia coli CFT073
caggucuuucugaaaugg

SEQ ID NO: 2666196 - RNA, 16 nt, Escherichia coli CFT073
caggugaaaaauaaaa

SEQ ID NO: 2666197 - RNA, 17 nt, Escherichia coli CFT073
caggugaaaaauaaaag

SEQ ID NO: 2666198 - RNA, 14 nt, Escherichia coli CFT073
caggugaaauccgg

SEQ ID NO: 2666199 - RNA, 17 nt, Escherichia coli CFT073
caggugaaucaggcgau

SEQ ID NO: 2666200 - RNA, 16 nt, Escherichia coli CFT073
caggugacaccaccgc

SEQ ID NO: 2666201 - RNA, 23 nt, Escherichia coli CFT073
caggugaucccccugggccaccu

SEQ ID NO: 2666202 - RNA, 20 nt, Escherichia coli CFT073
caggugauuagucuuuaucu

SEQ ID NO: 2666203 - RNA, 22 nt, Escherichia coli CFT073
caggugauuagucuuuaucugc

SEQ ID NO: 2666204 - RNA, 11 nt, Escherichia coli CFT073
caggugcagcc

SEQ ID NO: 2666205 - RNA, 14 nt, Escherichia coli CFT073
caggugcagcccau

SEQ ID NO: 2666206 - RNA, 21 nt, Escherichia coli CFT073
caggugcccgcguuucgcugc

SEQ ID NO: 2666207 - RNA, 22 nt, Escherichia coli CFT073
caggugcgugcgcccaucauug

SEQ ID NO: 2666208 - RNA, 12 nt, Escherichia coli CFT073
caggugcuuuug

SEQ ID NO: 2666209 - RNA, 19 nt, Escherichia coli CFT073
cagguggcguuugccaccu

SEQ ID NO: 2666210 - RNA, 18 nt, Escherichia coli CFT073
caggugguugugcugagu

SEQ ID NO: 2666211 - RNA, 15 nt, Escherichia coli CFT073
cagguguaauaaagu

SEQ ID NO: 2666212 - RNA, 15 nt, Escherichia coli CFT073
cagguguaguucacc

SEQ ID NO: 2666213 - RNA, 18 nt, Escherichia coli CFT073
cagguguuacgccgcacc

SEQ ID NO: 2666214 - RNA, 17 nt, Escherichia coli CFT073
cagguguuuaaccaaca

SEQ ID NO: 2666215 - RNA, 22 nt, Escherichia coli CFT073
cagguuacgcauggucaguuga

SEQ ID NO: 2666216 - RNA, 13 nt, Escherichia coli CFT073
cagguuacggucg

SEQ ID NO: 2666217 - RNA, 15 nt, Escherichia coli CFT073
cagguuaggcugaga

SEQ ID NO: 2666218 - RNA, 14 nt, Escherichia coli CFT073
cagguuauaccuuu

SEQ ID NO: 2666219 - RNA, 23 nt, Escherichia coli CFT073
cagguuauugaccgacgcauuaa

SEQ ID NO: 2666220 - RNA, 21 nt, Escherichia coli CFT073
cagguuauugacguuccccug

SEQ ID NO: 2666221 - RNA, 14 nt, Escherichia coli CFT073
cagguucgccaaca

SEQ ID NO: 2666222 - RNA, 14 nt, Escherichia coli CFT073
cagguucguaagcg

SEQ ID NO: 2666223 - RNA, 19 nt, Escherichia coli CFT073
cagguucugaccagccagc

SEQ ID NO: 2666224 - RNA, 19 nt, Escherichia coli CFT073
cagguugaggugcugaagg

SEQ ID NO: 2666225 - RNA, 21 nt, Escherichia coli CFT073
cagguugaugaguuggcuacu

SEQ ID NO: 2666226 - RNA, 20 nt, Escherichia coli CFT073
cagguugccguccagcgccu

SEQ ID NO: 2666227 - RNA, 12 nt, Escherichia coli CFT073
cagguuggaaag

SEQ ID NO: 2666228 - RNA, 15 nt, Escherichia coli CFT073
cagguuggcaucacc

SEQ ID NO: 2666229 - RNA, 12 nt, Escherichia coli CFT073
cagguuggcgcu

SEQ ID NO: 2666230 - RNA, 16 nt, Escherichia coli CFT073
cagguuguuuucuggc

SEQ ID NO: 2666231 - RNA, 14 nt, Escherichia coli CFT073
cagguuuaccagca

SEQ ID NO: 2666232 - RNA, 15 nt, Escherichia coli CFT073
cagguuuaucaugcu

SEQ ID NO: 2666233 - RNA, 18 nt, Escherichia coli CFT073
cagguuuguacaacguaa

SEQ ID NO: 2666234 - RNA, 22 nt, Escherichia coli CFT073
cagguuuuuacccaacucuuua

SEQ ID NO: 2666235 - RNA, 20 nt, Escherichia coli CFT073
cagguuuuucagcugcccac

SEQ ID NO: 2666236 - RNA, 13 nt, Escherichia coli CFT073
caguaaaaccggu

SEQ ID NO: 2666237 - RNA, 14 nt, Escherichia coli CFT073
caguaaaccaauca

SEQ ID NO: 2666238 - RNA, 16 nt, Escherichia coli CFT073
caguaaaccaauuucu

SEQ ID NO: 2666239 - RNA, 15 nt, Escherichia coli CFT073
caguaaaccacauca

SEQ ID NO: 2666240 - RNA, 19 nt, Escherichia coli CFT073
caguaaaccacaucagcga

SEQ ID NO: 2666241 - RNA, 21 nt, Escherichia coli CFT073
caguaaaccacccaccagcgc

SEQ ID NO: 2666242 - RNA, 20 nt, Escherichia coli CFT073
caguaaacugacccgcucgu

SEQ ID NO: 2666243 - RNA, 16 nt, Escherichia coli CFT073
caguaaacugucaaca

SEQ ID NO: 2666244 - RNA, 20 nt, Escherichia coli CFT073
caguaaacugucaacaccag

SEQ ID NO: 2666245 - RNA, 22 nt, Escherichia coli CFT073
caguaaagauaaccucauuaau

SEQ ID NO: 2666246 - RNA, 23 nt, Escherichia coli CFT073
caguaaagcgcaaaauaccagca

SEQ ID NO: 2666247 - RNA, 13 nt, Escherichia coli CFT073
caguaaauaaaaa

SEQ ID NO: 2666248 - RNA, 22 nt, Escherichia coli CFT073
cagucgauauggccuucuucau

SEQ ID NO: 2666249 - RNA, 21 nt, Escherichia coli CFT073
cagucgcccgaccaucgccag

SEQ ID NO: 2666250 - RNA, 15 nt, Escherichia coli CFT073
cagucgccgcuucgu

SEQ ID NO: 2666251 - RNA, 16 nt, Escherichia coli CFT073
cagucgcgacgcugac

SEQ ID NO: 2666252 - RNA, 16 nt, Escherichia coli CFT073
cagucgcgcaauugcc

SEQ ID NO: 2666253 - RNA, 17 nt, Escherichia coli CFT073
cagucgcgcaauugcca

SEQ ID NO: 2666254 - RNA, 20 nt, Escherichia coli CFT073
cagucgcgcaauugccagac

SEQ ID NO: 2666255 - RNA, 16 nt, Escherichia coli CFT073
cagucgcugaucaccg

SEQ ID NO: 2666256 - RNA, 21 nt, Escherichia coli CFT073
cagucgcugaucaccguagaa

SEQ ID NO: 2666257 - RNA, 22 nt, Escherichia coli CFT073
cagucgcugaucaccguagaag

SEQ ID NO: 2666258 - RNA, 17 nt, Escherichia coli CFT073
cagucgcuuuaccgcug

SEQ ID NO: 2666259 - RNA, 13 nt, Escherichia coli CFT073
cagucggccaugu

SEQ ID NO: 2666260 - RNA, 21 nt, Escherichia coli CFT073
cagucggccaugugcuuuucc

SEQ ID NO: 2666261 - RNA, 13 nt, Escherichia coli CFT073
cagucggcuuucu

SEQ ID NO: 2666262 - RNA, 23 nt, Escherichia coli CFT073
cagucggggggaggcugcauuau

SEQ ID NO: 2666263 - RNA, 23 nt, Escherichia coli CFT073
cagucgggugcgacaggagccgc

SEQ ID NO: 2666264 - RNA, 15 nt, Escherichia coli CFT073
cagucgggugcugcc

SEQ ID NO: 2666265 - RNA, 21 nt, Escherichia coli CFT073
cagucgggugcugccgguggg

SEQ ID NO: 2666266 - RNA, 13 nt, Escherichia coli CFT073
cagucggucgauu

SEQ ID NO: 2666267 - RNA, 20 nt, Escherichia coli CFT073
cagucgguucaaccaucagc

SEQ ID NO: 2666268 - RNA, 21 nt, Escherichia coli CFT073
cagucgguucaaccaucagcg

SEQ ID NO: 2666269 - RNA, 22 nt, Escherichia coli CFT073
cagucguaaugaaucagcagau

SEQ ID NO: 2666270 - RNA, 17 nt, Escherichia coli CFT073
cagucguauccucagaa

SEQ ID NO: 2666271 - RNA, 15 nt, Escherichia coli CFT073
cagucgucaucccag

SEQ ID NO: 2666272 - RNA, 16 nt, Escherichia coli CFT073
cagucgucaucccagu

SEQ ID NO: 2666273 - RNA, 13 nt, Escherichia coli CFT073
cagucgugcccaa

SEQ ID NO: 2666274 - RNA, 19 nt, Escherichia coli CFT073
cagucguuaugcacgcucu

SEQ ID NO: 2666275 - RNA, 14 nt, Escherichia coli CFT073
cagucucaaaccgg

SEQ ID NO: 2666276 - RNA, 22 nt, Escherichia coli CFT073
cagucuccuugcuccacgcuca

SEQ ID NO: 2666277 - RNA, 14 nt, Escherichia coli CFT073
cagucugcgcccug

SEQ ID NO: 2666278 - RNA, 21 nt, Escherichia coli CFT073
cagucuggagaugggugugcu

SEQ ID NO: 2666279 - RNA, 15 nt, Escherichia coli CFT073
cagucuuaagcggcu

SEQ ID NO: 2666280 - RNA, 16 nt, Escherichia coli CFT073
cagucuuuuaaccggc

SEQ ID NO: 2666281 - RNA, 20 nt, Escherichia coli CFT073
cagugaaaacgcauaccagu

SEQ ID NO: 2666282 - RNA, 21 nt, Escherichia coli CFT073
cagugaaaacgcauaccaguc

SEQ ID NO: 2666283 - RNA, 12 nt, Escherichia coli CFT073
cagugaaaaugg

SEQ ID NO: 2666284 - RNA, 13 nt, Escherichia coli CFT073
cagugaacugugg

SEQ ID NO: 2666285 - RNA, 16 nt, Escherichia coli CFT073
cagugaaucucaggca

SEQ ID NO: 2666286 - RNA, 17 nt, Escherichia coli CFT073
cagugaaucucaggcaa

SEQ ID NO: 2666287 - RNA, 18 nt, Escherichia coli CFT073
cagugaaucucaggcaaa

SEQ ID NO: 2666288 - RNA, 14 nt, Escherichia coli CFT073
cagugacagcccca

SEQ ID NO: 2666289 - RNA, 21 nt, Escherichia coli CFT073
cagugacaguguuauucccaa

SEQ ID NO: 2666290 - RNA, 12 nt, Escherichia coli CFT073
cagugaccagcg

SEQ ID NO: 2666291 - RNA, 18 nt, Escherichia coli CFT073
cagugaccaucuuccagc

SEQ ID NO: 2666292 - RNA, 21 nt, Escherichia coli CFT073
cagugaccaucuuccagcauc

SEQ ID NO: 2666293 - RNA, 14 nt, Escherichia coli CFT073
cagugacccgcagc

SEQ ID NO: 2666294 - RNA, 17 nt, Escherichia coli CFT073
cagugacgaccuuuucc

SEQ ID NO: 2666295 - RNA, 17 nt, Escherichia coli CFT073
cagugacgccgccagau

SEQ ID NO: 2666296 - RNA, 23 nt, Escherichia coli CFT073
cagugacgucacuuaaugucaca

SEQ ID NO: 2666297 - RNA, 17 nt, Escherichia coli CFT073
cagugacugcuuuuuca

SEQ ID NO: 2666298 - RNA, 18 nt, Escherichia coli CFT073
cagugacugcuuuuucaa

SEQ ID NO: 2666299 - RNA, 18 nt, Escherichia coli CFT073
cagugaggguuucuucaa

SEQ ID NO: 2666300 - RNA, 14 nt, Escherichia coli CFT073
cagugauaacucaa

SEQ ID NO: 2666301 - RNA, 20 nt, Escherichia coli CFT073
cagugaucgugugccaccag

SEQ ID NO: 2666302 - RNA, 23 nt, Escherichia coli CFT073
cagugaucuacguaggccggaua

SEQ ID NO: 2666303 - RNA, 14 nt, Escherichia coli CFT073
cagugauucauagu

SEQ ID NO: 2666304 - RNA, 23 nt, Escherichia coli CFT073
cagugauuguccuauuggagaau

SEQ ID NO: 2666305 - RNA, 14 nt, Escherichia coli CFT073
cagugauuuauuuu

SEQ ID NO: 2666306 - RNA, 21 nt, Escherichia coli CFT073
cagugauuuucccuuccgcca

SEQ ID NO: 2666307 - RNA, 23 nt, Escherichia coli CFT073
cagugauuuuugcugaacgccac

SEQ ID NO: 2666308 - RNA, 23 nt, Escherichia coli CFT073
cagugcaaaaaaucaacagccac

SEQ ID NO: 2666309 - RNA, 19 nt, Escherichia coli CFT073
cagugcaaagacaucgcug

SEQ ID NO: 2666310 - RNA, 16 nt, Escherichia coli CFT073
cagugcaacagagagc

SEQ ID NO: 2666311 - RNA, 15 nt, Escherichia coli CFT073
cagugcaacuuuacu

SEQ ID NO: 2666312 - RNA, 14 nt, Escherichia coli CFT073
cagugcaaucagcg

SEQ ID NO: 2666313 - RNA, 18 nt, Escherichia coli CFT073
cagugcagauaccaccag

SEQ ID NO: 2666314 - RNA, 20 nt, Escherichia coli CFT073
cagugcagauaccaccagcg

SEQ ID NO: 2666315 - RNA, 23 nt, Escherichia coli CFT073
cagugcagcaucgcuguuuuucg

SEQ ID NO: 2666316 - RNA, 21 nt, Escherichia coli CFT073
cagugcagcgcaugauuuuca

SEQ ID NO: 2666317 - RNA, 15 nt, Escherichia coli CFT073
cagugcaggaugcga

SEQ ID NO: 2666318 - RNA, 17 nt, Escherichia coli CFT073
cagugcaggcaccagcc

SEQ ID NO: 2666319 - RNA, 22 nt, Escherichia coli CFT073
cagugcaggccggaguuaaucu

SEQ ID NO: 2666320 - RNA, 12 nt, Escherichia coli CFT073
cagugcauaagu

SEQ ID NO: 2666321 - RNA, 13 nt, Escherichia coli CFT073
cagugcauaaguc

SEQ ID NO: 2666322 - RNA, 17 nt, Escherichia coli CFT073
cagugcaugggcaaauu

SEQ ID NO: 2666323 - RNA, 22 nt, Escherichia coli CFT073
cagugccagacaaaccacgccu

SEQ ID NO: 2666324 - RNA, 13 nt, Escherichia coli CFT073
cagugccgaugcc

SEQ ID NO: 2666325 - RNA, 18 nt, Escherichia coli CFT073
cagugccgccguuaaaug

SEQ ID NO: 2666326 - RNA, 19 nt, Escherichia coli CFT073
cagugccgccguuaaaugg

SEQ ID NO: 2666327 - RNA, 22 nt, Escherichia coli CFT073
cagugccgcgcauagcaccacc

SEQ ID NO: 2666328 - RNA, 15 nt, Escherichia coli CFT073
cagugccgcgccgcg

SEQ ID NO: 2666329 - RNA, 16 nt, Escherichia coli CFT073
cagugccgcgccgcgc

SEQ ID NO: 2666330 - RNA, 18 nt, Escherichia coli CFT073
cagugccggaaugggcaa

SEQ ID NO: 2666331 - RNA, 19 nt, Escherichia coli CFT073
cagugccggaaugucuucc

SEQ ID NO: 2666332 - RNA, 21 nt, Escherichia coli CFT073
cagugccggaaugucuuccuu

SEQ ID NO: 2666333 - RNA, 20 nt, Escherichia coli CFT073
cagugccugcgccaccguuu

SEQ ID NO: 2666334 - RNA, 19 nt, Escherichia coli CFT073
cagugccuggcauaacgca

SEQ ID NO: 2666335 - RNA, 12 nt, Escherichia coli CFT073
cagugccuggcg

SEQ ID NO: 2666336 - RNA, 22 nt, Escherichia coli CFT073
cagugcgcgaaccagagacaga

SEQ ID NO: 2666337 - RNA, 21 nt, Escherichia coli CFT073
cagugcgcgguaguuuuucga

SEQ ID NO: 2666338 - RNA, 23 nt, Escherichia coli CFT073
cagugcucuuuguaggccugaua

SEQ ID NO: 2666339 - RNA, 14 nt, Escherichia coli CFT073
cagugcugacugau

SEQ ID NO: 2666340 - RNA, 19 nt, Escherichia coli CFT073
cagugcugacugaugagaa

SEQ ID NO: 2666341 - RNA, 17 nt, Escherichia coli CFT073
cagugcugcauccugca

SEQ ID NO: 2666342 - RNA, 19 nt, Escherichia coli CFT073
cagugcuucuaacaucaug

SEQ ID NO: 2666343 - RNA, 23 nt, Escherichia coli CFT073
cagugcuuuuugugggccugaua

SEQ ID NO: 2666344 - RNA, 23 nt, Escherichia coli CFT073
caguggaggaacuuaaccugcga

SEQ ID NO: 2666345 - RNA, 15 nt, Escherichia coli CFT073
caguggcaaccagcg

SEQ ID NO: 2666346 - RNA, 16 nt, Escherichia coli CFT073
caguggcggcauugac

SEQ ID NO: 2666347 - RNA, 13 nt, Escherichia coli CFT073
caguggcgggaca

SEQ ID NO: 2666348 - RNA, 19 nt, Escherichia coli CFT073
caguggcgugguaucacgu

SEQ ID NO: 2666349 - RNA, 20 nt, Escherichia coli CFT073
caguggcuuaucuuccuguu

SEQ ID NO: 2666350 - RNA, 17 nt, Escherichia coli CFT073
cagugguaaacaccacg

SEQ ID NO: 2666351 - RNA, 23 nt, Escherichia coli CFT073
caguggucaaauuucuucagcca

SEQ ID NO: 2666352 - RNA, 13 nt, Escherichia coli CFT073
cagugguuaccga

SEQ ID NO: 2666353 - RNA, 19 nt, Escherichia coli CFT073
caguguaaaccaaagccac

SEQ ID NO: 2666354 - RNA, 17 nt, Escherichia coli CFT073
cagugucacguuaaaua

SEQ ID NO: 2666355 - RNA, 17 nt, Escherichia coli CFT073
caguuugcgggacaacu

SEQ ID NO: 2666356 - RNA, 17 nt, Escherichia coli CFT073
caguuugcucaaaucca

SEQ ID NO: 2666357 - RNA, 14 nt, Escherichia coli CFT073
caguuugcugacaa

SEQ ID NO: 2666358 - RNA, 22 nt, Escherichia coli CFT073
caguuuggucuggcaaaaauaa

SEQ ID NO: 2666359 - RNA, 21 nt, Escherichia coli CFT073
caguuuguuaugcgaaauagc

SEQ ID NO: 2666360 - RNA, 22 nt, Escherichia coli CFT073
caguuuuaccgccggaacaucc

SEQ ID NO: 2666361 - RNA, 21 nt, Escherichia coli CFT073
caguuuuacugcagccagcgu

SEQ ID NO: 2666362 - RNA, 11 nt, Escherichia coli CFT073
caguuuuccau

SEQ ID NO: 2666363 - RNA, 24 nt, Escherichia coli CFT073
caguuuucgcaccgcguuuagcgu

SEQ ID NO: 2666364 - RNA, 12 nt, Escherichia coli CFT073
caguuuuuccag

SEQ ID NO: 2666365 - RNA, 18 nt, Escherichia coli CFT073
caguuuuuccccugccag

SEQ ID NO: 2666366 - RNA, 18 nt, Escherichia coli CFT073
caguuuuuccuuuuggug

SEQ ID NO: 2666367 - RNA, 17 nt, Escherichia coli CFT073
caguuuuugcuucugaa

SEQ ID NO: 2666368 - RNA, 15 nt, Escherichia coli CFT073
caguuuuuucugugc

SEQ ID NO: 2666369 - RNA, 18 nt, Escherichia coli CFT073
cauaaaagggcagcagga

SEQ ID NO: 2666370 - RNA, 19 nt, Escherichia coli CFT073
cauaaaagggcagcaggau

SEQ ID NO: 2666371 - RNA, 17 nt, Escherichia coli CFT073
cauaaacaauacagcga

SEQ ID NO: 2666372 - RNA, 14 nt, Escherichia coli CFT073
cauaaacaccagca

SEQ ID NO: 2666373 - RNA, 17 nt, Escherichia coli CFT073
cauaaacaccagcagca

SEQ ID NO: 2666374 - RNA, 20 nt, Escherichia coli CFT073
cauaaacacgguuuuucauu

SEQ ID NO: 2666375 - RNA, 16 nt, Escherichia coli CFT073
cauaaacacucacauc

SEQ ID NO: 2666376 - RNA, 19 nt, Escherichia coli CFT073
cauaaacacucacauccag

SEQ ID NO: 2666377 - RNA, 13 nt, Escherichia coli CFT073
cauaaaccagcgg

SEQ ID NO: 2666378 - RNA, 18 nt, Escherichia coli CFT073
cauaaacgccuuauccgg

SEQ ID NO: 2666379 - RNA, 21 nt, Escherichia coli CFT073
cauaaacgccuuauccggccu

SEQ ID NO: 2666380 - RNA, 15 nt, Escherichia coli CFT073
cauaaagcccgcuuc

SEQ ID NO: 2666381 - RNA, 21 nt, Escherichia coli CFT073
cauaaagcccgcuucaaacgc

SEQ ID NO: 2666382 - RNA, 14 nt, Escherichia coli CFT073
cauaaagccugaua

SEQ ID NO: 2666383 - RNA, 18 nt, Escherichia coli CFT073
cauaaagcgguuuucaaa

SEQ ID NO: 2666384 - RNA, 21 nt, Escherichia coli CFT073
cauaaagucaaaagccuccga

SEQ ID NO: 2666385 - RNA, 14 nt, Escherichia coli CFT073
cauaaauaacaucu

SEQ ID NO: 2666386 - RNA, 15 nt, Escherichia coli CFT073
cauaaauacagagca

SEQ ID NO: 2666387 - RNA, 15 nt, Escherichia coli CFT073
cauaaauggguuuuu

SEQ ID NO: 2666388 - RNA, 18 nt, Escherichia coli CFT073
cauaaauuaccaccagcg

SEQ ID NO: 2666389 - RNA, 21 nt, Escherichia coli CFT073
cauaaauuauagaugcagcau

SEQ ID NO: 2666390 - RNA, 13 nt, Escherichia coli CFT073
cauaaauuucagg

SEQ ID NO: 2666391 - RNA, 15 nt, Escherichia coli CFT073
cauaacaaaaugccg

SEQ ID NO: 2666392 - RNA, 11 nt, Escherichia coli CFT073
cauaacagaau

SEQ ID NO: 2666393 - RNA, 20 nt, Escherichia coli CFT073
cauaacagaaugcgcgcgaa

SEQ ID NO: 2666394 - RNA, 12 nt, Escherichia coli CFT073
cauaacagccau

SEQ ID NO: 2666395 - RNA, 20 nt, Escherichia coli CFT073
cauaacauucagcaauaacu

SEQ ID NO: 2666396 - RNA, 14 nt, Escherichia coli CFT073
cauaacccgcuucc

SEQ ID NO: 2666397 - RNA, 21 nt, Escherichia coli CFT073
cauaaccgaaaaguuucucgc

SEQ ID NO: 2666398 - RNA, 21 nt, Escherichia coli CFT073
cauaaccgccagcacagccag

SEQ ID NO: 2666399 - RNA, 21 nt, Escherichia coli CFT073
cauaacggcauuaucgagcug

SEQ ID NO: 2666400 - RNA, 15 nt, Escherichia coli CFT073
cauaacguaaaccaa

SEQ ID NO: 2666401 - RNA, 18 nt, Escherichia coli CFT073
cauaacucuccuguuuaa

SEQ ID NO: 2666402 - RNA, 15 nt, Escherichia coli CFT073
cauaagcgccaggaa

SEQ ID NO: 2666403 - RNA, 20 nt, Escherichia coli CFT073
cauaagguguaccgguagca

SEQ ID NO: 2666404 - RNA, 13 nt, Escherichia coli CFT073
cauaaguaaguga

SEQ ID NO: 2666405 - RNA, 19 nt, Escherichia coli CFT073
cauaauaagcuuuuucugc

SEQ ID NO: 2666406 - RNA, 16 nt, Escherichia coli CFT073
cauaauaaucuacuaa

SEQ ID NO: 2666407 - RNA, 14 nt, Escherichia coli CFT073
cauaauauaaggag

SEQ ID NO: 2666408 - RNA, 18 nt, Escherichia coli CFT073
cauaauauagcagcgccg

SEQ ID NO: 2666409 - RNA, 21 nt, Escherichia coli CFT073
cauaauaugaccugacauuaa

SEQ ID NO: 2666410 - RNA, 23 nt, Escherichia coli CFT073
cauaaucaagguugcacaaccaa

SEQ ID NO: 2666411 - RNA, 14 nt, Escherichia coli CFT073
cauaaucaaucgca

SEQ ID NO: 2666412 - RNA, 15 nt, Escherichia coli CFT073
cauaaucaaugccag

SEQ ID NO: 2666413 - RNA, 20 nt, Escherichia coli CFT073
cauaaucaccaucagcagca

SEQ ID NO: 2666414 - RNA, 18 nt, Escherichia coli CFT073
cauaaucacucuuccccg

SEQ ID NO: 2666415 - RNA, 13 nt, Escherichia coli CFT073
cauaaucauuaac

SEQ ID NO: 2666416 - RNA, 18 nt, Escherichia coli CFT073
cauaaucauuaacggcca

SEQ ID NO: 2666417 - RNA, 14 nt, Escherichia coli CFT073
cauaauccaggcau

SEQ ID NO: 2666418 - RNA, 18 nt, Escherichia coli CFT073
cauaauccugccgagaua

SEQ ID NO: 2666419 - RNA, 16 nt, Escherichia coli CFT073
cauaaucggcgcggcg

SEQ ID NO: 2666420 - RNA, 21 nt, Escherichia coli CFT073
cauaaucgggaugcguaacag

SEQ ID NO: 2666421 - RNA, 15 nt, Escherichia coli CFT073
cauaaugaugccgaa

SEQ ID NO: 2666422 - RNA, 19 nt, Escherichia coli CFT073
cauaaugaugccgaaguga

SEQ ID NO: 2666423 - RNA, 21 nt, Escherichia coli CFT073
cauaaugauggugaaagcaaa

SEQ ID NO: 2666424 - RNA, 14 nt, Escherichia coli CFT073
cauaaugcaaaaug

SEQ ID NO: 2666425 - RNA, 16 nt, Escherichia coli CFT073
cauaaugcccagcguu

SEQ ID NO: 2666426 - RNA, 16 nt, Escherichia coli CFT073
cauaaugccccagcgc

SEQ ID NO: 2666427 - RNA, 23 nt, Escherichia coli CFT073
cauaaugccccagcgcacuacgc

SEQ ID NO: 2666428 - RNA, 13 nt, Escherichia coli CFT073
cauaaugccgaca

SEQ ID NO: 2666429 - RNA, 18 nt, Escherichia coli CFT073
cauaaugggcgcgggcaa

SEQ ID NO: 2666430 - RNA, 22 nt, Escherichia coli CFT073
cauaaugguggaguggcccagg

SEQ ID NO: 2666431 - RNA, 20 nt, Escherichia coli CFT073
cauaaugucgcuggccggac

SEQ ID NO: 2666432 - RNA, 17 nt, Escherichia coli CFT073
cauaauguguuaauaau

SEQ ID NO: 2666433 - RNA, 13 nt, Escherichia coli CFT073
cauaauguuaugu

SEQ ID NO: 2666434 - RNA, 15 nt, Escherichia coli CFT073
cauaauugaccagau

SEQ ID NO: 2666435 - RNA, 21 nt, Escherichia coli CFT073
cauaauugagcagcaaaaugg

SEQ ID NO: 2666436 - RNA, 16 nt, Escherichia coli CFT073
cauaauuucagcaucg

SEQ ID NO: 2666437 - RNA, 17 nt, Escherichia coli CFT073
cauaauuuccagcagug

SEQ ID NO: 2666438 - RNA, 23 nt, Escherichia coli CFT073
cauaauuuuggucgcuaacugga

SEQ ID NO: 2666439 - RNA, 21 nt, Escherichia coli CFT073
cauaauuuuucuuuaacaucg

SEQ ID NO: 2666440 - RNA, 22 nt, Escherichia coli CFT073
cauacaaaucgugcaucuccug

SEQ ID NO: 2666441 - RNA, 13 nt, Escherichia coli CFT073
cauacaacgccau

SEQ ID NO: 2666442 - RNA, 16 nt, Escherichia coli CFT073
cauacaaucgguaacg

SEQ ID NO: 2666443 - RNA, 12 nt, Escherichia coli CFT073
cauacacagaua

SEQ ID NO: 2666444 - RNA, 18 nt, Escherichia coli CFT073
cauacacagauaaacuac

SEQ ID NO: 2666445 - RNA, 15 nt, Escherichia coli CFT073
cauacaccaccacau

SEQ ID NO: 2666446 - RNA, 17 nt, Escherichia coli CFT073
cauacaccaccacauug

SEQ ID NO: 2666447 - RNA, 22 nt, Escherichia coli CFT073
cauacaccaccacauugccgaa

SEQ ID NO: 2666448 - RNA, 15 nt, Escherichia coli CFT073
cauacagaugcugcu

SEQ ID NO: 2666449 - RNA, 14 nt, Escherichia coli CFT073
cauacagcaccgcc

SEQ ID NO: 2666450 - RNA, 16 nt, Escherichia coli CFT073
cauacagcaccgcccg

SEQ ID NO: 2666451 - RNA, 16 nt, Escherichia coli CFT073
cauacagccagcaaua

SEQ ID NO: 2666452 - RNA, 15 nt, Escherichia coli CFT073
cauacagcgacagac

SEQ ID NO: 2666453 - RNA, 19 nt, Escherichia coli CFT073
cauacagcguuuugccauc

SEQ ID NO: 2666454 - RNA, 19 nt, Escherichia coli CFT073
cauacagcuuuuacagcca

SEQ ID NO: 2666455 - RNA, 20 nt, Escherichia coli CFT073
cauacagcuuuuacagccaa

SEQ ID NO: 2666456 - RNA, 22 nt, Escherichia coli CFT073
cauacauaacagaauaucugcg

SEQ ID NO: 2666457 - RNA, 14 nt, Escherichia coli CFT073
cauacauaccagca

SEQ ID NO: 2666458 - RNA, 17 nt, Escherichia coli CFT073
cauacauggcauccccu

SEQ ID NO: 2666459 - RNA, 22 nt, Escherichia coli CFT073
cauacaugguuugaucgcuaag

SEQ ID NO: 2666460 - RNA, 15 nt, Escherichia coli CFT073
cauacauguauaaaa

SEQ ID NO: 2666461 - RNA, 19 nt, Escherichia coli CFT073
cauacauguauaaaaagaa

SEQ ID NO: 2666462 - RNA, 22 nt, Escherichia coli CFT073
cauaccaaaaucuaccagcgga

SEQ ID NO: 2666463 - RNA, 14 nt, Escherichia coli CFT073
cauaugcgccagac

SEQ ID NO: 2666464 - RNA, 13 nt, Escherichia coli CFT073
cauaugcgccagc

SEQ ID NO: 2666465 - RNA, 18 nt, Escherichia coli CFT073
cauaugcgccagcugcau

SEQ ID NO: 2666466 - RNA, 18 nt, Escherichia coli CFT073
cauaugcgccgcgauuaa

SEQ ID NO: 2666467 - RNA, 17 nt, Escherichia coli CFT073
cauaugcuuuuuuaaaa

SEQ ID NO: 2666468 - RNA, 19 nt, Escherichia coli CFT073
cauauggaagaaacgcuua

SEQ ID NO: 2666469 - RNA, 23 nt, Escherichia coli CFT073
cauauguucccuuaauuaucugg

SEQ ID NO: 2666470 - RNA, 16 nt, Escherichia coli CFT073
cauauguuuaaccggc

SEQ ID NO: 2666471 - RNA, 13 nt, Escherichia coli CFT073
cauauguuuacgc

SEQ ID NO: 2666472 - RNA, 18 nt, Escherichia coli CFT073
cauauuaaccucucagaa

SEQ ID NO: 2666473 - RNA, 15 nt, Escherichia coli CFT073
cauauuaacgcagca

SEQ ID NO: 2666474 - RNA, 14 nt, Escherichia coli CFT073
cauauuacgaauga

SEQ ID NO: 2666475 - RNA, 20 nt, Escherichia coli CFT073
cauauuauucauaaugccca

SEQ ID NO: 2666476 - RNA, 13 nt, Escherichia coli CFT073
cauauucagcagc

SEQ ID NO: 2666477 - RNA, 13 nt, Escherichia coli CFT073
cauauucagcgcc

SEQ ID NO: 2666478 - RNA, 16 nt, Escherichia coli CFT073
cauauucauuacuuau

SEQ ID NO: 2666479 - RNA, 15 nt, Escherichia coli CFT073
cauauuccaccacuu

SEQ ID NO: 2666480 - RNA, 19 nt, Escherichia coli CFT073
cauauuccgcaccugccag

SEQ ID NO: 2666481 - RNA, 14 nt, Escherichia coli CFT073
cauauuccggugcc

SEQ ID NO: 2666482 - RNA, 15 nt, Escherichia coli CFT073
cauauuccugaccca

SEQ ID NO: 2666483 - RNA, 23 nt, Escherichia coli CFT073
cauauuccugacccagcaccagu

SEQ ID NO: 2666484 - RNA, 17 nt, Escherichia coli CFT073
cauauucgccaucagcc

SEQ ID NO: 2666485 - RNA, 19 nt, Escherichia coli CFT073
cauauugaacggcaccggu

SEQ ID NO: 2666486 - RNA, 19 nt, Escherichia coli CFT073
cauauugccaucacggcag

SEQ ID NO: 2666487 - RNA, 16 nt, Escherichia coli CFT073
cauauugccgugcccc

SEQ ID NO: 2666488 - RNA, 18 nt, Escherichia coli CFT073
cauauuggcaacagccau

SEQ ID NO: 2666489 - RNA, 13 nt, Escherichia coli CFT073
cauauuggcgcgg

SEQ ID NO: 2666490 - RNA, 15 nt, Escherichia coli CFT073
cauauuuaaaaacga

SEQ ID NO: 2666491 - RNA, 13 nt, Escherichia coli CFT073
cauauuuaagccu

SEQ ID NO: 2666492 - RNA, 15 nt, Escherichia coli CFT073
cauauuucgucgcau

SEQ ID NO: 2666493 - RNA, 22 nt, Escherichia coli CFT073
cauauuucuguuugcgucagcu

SEQ ID NO: 2666494 - RNA, 18 nt, Escherichia coli CFT073
cauauuuuuugaaaaaug

SEQ ID NO: 2666495 - RNA, 15 nt, Escherichia coli CFT073
caucaaaaaucaaug

SEQ ID NO: 2666496 - RNA, 14 nt, Escherichia coli CFT073
caucaaaauuaccu

SEQ ID NO: 2666497 - RNA, 15 nt, Escherichia coli CFT073
caucaaacagccccu

SEQ ID NO: 2666498 - RNA, 14 nt, Escherichia coli CFT073
caucaaagaacagc

SEQ ID NO: 2666499 - RNA, 15 nt, Escherichia coli CFT073
caucaaagaacagcc

SEQ ID NO: 2666500 - RNA, 19 nt, Escherichia coli CFT073
caucaaaggcuucaacgac

SEQ ID NO: 2666501 - RNA, 14 nt, Escherichia coli CFT073
caucaaaucacuaa

SEQ ID NO: 2666502 - RNA, 23 nt, Escherichia coli CFT073
caucaaaucugccguaacugcgc

SEQ ID NO: 2666503 - RNA, 20 nt, Escherichia coli CFT073
caucaaaugcgccugcauaa

SEQ ID NO: 2666504 - RNA, 19 nt, Escherichia coli CFT073
caucaaauuugucgccaac

SEQ ID NO: 2666505 - RNA, 15 nt, Escherichia coli CFT073
caucaacaauuccca

SEQ ID NO: 2666506 - RNA, 14 nt, Escherichia coli CFT073
caucaacacuuugg

SEQ ID NO: 2666507 - RNA, 12 nt, Escherichia coli CFT073
caucaaccagca

SEQ ID NO: 2666508 - RNA, 16 nt, Escherichia coli CFT073
caucaaccagcacaaa

SEQ ID NO: 2666509 - RNA, 16 nt, Escherichia coli CFT073
caucaaccgccggaua

SEQ ID NO: 2666510 - RNA, 21 nt, Escherichia coli CFT073
caucaacgcagacgccguucc

SEQ ID NO: 2666511 - RNA, 16 nt, Escherichia coli CFT073
caucaacgcgcaacug

SEQ ID NO: 2666512 - RNA, 23 nt, Escherichia coli CFT073
caucaacgcggcaaaacccugcg

SEQ ID NO: 2666513 - RNA, 19 nt, Escherichia coli CFT073
caucaacguaguaucguaa

SEQ ID NO: 2666514 - RNA, 21 nt, Escherichia coli CFT073
caucaacgugaaucccaguac

SEQ ID NO: 2666515 - RNA, 23 nt, Escherichia coli CFT073
caucaacgugaaucccaguacug

SEQ ID NO: 2666516 - RNA, 23 nt, Escherichia coli CFT073
caucaacguuaauacuacgcaga

SEQ ID NO: 2666517 - RNA, 13 nt, Escherichia coli CFT073
caucaacugacua

SEQ ID NO: 2666518 - RNA, 21 nt, Escherichia coli CFT073
caucaacuuaauacgcugcgu

SEQ ID NO: 2666519 - RNA, 12 nt, Escherichia coli CFT073
caucaagaaaaa

SEQ ID NO: 2666520 - RNA, 12 nt, Escherichia coli CFT073
caucaagaaacu

SEQ ID NO: 2666521 - RNA, 15 nt, Escherichia coli CFT073
caucaagacccggcg

SEQ ID NO: 2666522 - RNA, 23 nt, Escherichia coli CFT073
caucaagacccggcgcacgcggc

SEQ ID NO: 2666523 - RNA, 16 nt, Escherichia coli CFT073
caucaagcgaaaaugc

SEQ ID NO: 2666524 - RNA, 23 nt, Escherichia coli CFT073
caucaagcggcgcaugcaggcau

SEQ ID NO: 2666525 - RNA, 22 nt, Escherichia coli CFT073
caucaagcugugccugaauaua

SEQ ID NO: 2666526 - RNA, 15 nt, Escherichia coli CFT073
caucaagcuguuccu

SEQ ID NO: 2666527 - RNA, 15 nt, Escherichia coli CFT073
caucaagucagaugc

SEQ ID NO: 2666528 - RNA, 21 nt, Escherichia coli CFT073
caucaaguugauuuuucguuu

SEQ ID NO: 2666529 - RNA, 17 nt, Escherichia coli CFT073
caucaauaacaaaggga

SEQ ID NO: 2666530 - RNA, 12 nt, Escherichia coli CFT073
caucaauaccau

SEQ ID NO: 2666531 - RNA, 19 nt, Escherichia coli CFT073
caucaauaugaauccaggc

SEQ ID NO: 2666532 - RNA, 19 nt, Escherichia coli CFT073
caucaauaugaauuaacgu

SEQ ID NO: 2666533 - RNA, 23 nt, Escherichia coli CFT073
caucaauaugaauuaacgucagg

SEQ ID NO: 2666534 - RNA, 19 nt, Escherichia coli CFT073
caucaauauuccagucagc

SEQ ID NO: 2666535 - RNA, 13 nt, Escherichia coli CFT073
caucaaucacuuu

SEQ ID NO: 2666536 - RNA, 13 nt, Escherichia coli CFT073
caucaaucagcgg

SEQ ID NO: 2666537 - RNA, 15 nt, Escherichia coli CFT073
caucaauccaaacau

SEQ ID NO: 2666538 - RNA, 15 nt, Escherichia coli CFT073
caucaauccacuucg

SEQ ID NO: 2666539 - RNA, 18 nt, Escherichia coli CFT073
caucaauccacuucgcca

SEQ ID NO: 2666540 - RNA, 16 nt, Escherichia coli CFT073
caucaauccugcagca

SEQ ID NO: 2666541 - RNA, 14 nt, Escherichia coli CFT073
caucaaugaccuga

SEQ ID NO: 2666542 - RNA, 16 nt, Escherichia coli CFT073
caucaaugauaaucuc

SEQ ID NO: 2666543 - RNA, 13 nt, Escherichia coli CFT073
caucaauuaacug

SEQ ID NO: 2666544 - RNA, 19 nt, Escherichia coli CFT073
caucaauuaaugccuucaa

SEQ ID NO: 2666545 - RNA, 20 nt, Escherichia coli CFT073
caucaauugcucacucccgg

SEQ ID NO: 2666546 - RNA, 21 nt, Escherichia coli CFT073
caucacaaaauuuauccagcg

SEQ ID NO: 2666547 - RNA, 20 nt, Escherichia coli CFT073
caucacaacuucgcaaacac

SEQ ID NO: 2666548 - RNA, 16 nt, Escherichia coli CFT073
caucacaauucaguac

SEQ ID NO: 2666549 - RNA, 13 nt, Escherichia coli CFT073
caucacagaccaa

SEQ ID NO: 2666550 - RNA, 13 nt, Escherichia coli CFT073
caucacauccagc

SEQ ID NO: 2666551 - RNA, 15 nt, Escherichia coli CFT073
caucacaucccagca

SEQ ID NO: 2666552 - RNA, 13 nt, Escherichia coli CFT073
caucaccaacacc

SEQ ID NO: 2666553 - RNA, 15 nt, Escherichia coli CFT073
caucaccaacugccc

SEQ ID NO: 2666554 - RNA, 23 nt, Escherichia coli CFT073
caucaccaaugacagccccacca

SEQ ID NO: 2666555 - RNA, 17 nt, Escherichia coli CFT073
caucaccaguaccgcca

SEQ ID NO: 2666556 - RNA, 21 nt, Escherichia coli CFT073
caucacccaacgccuuucgcu

SEQ ID NO: 2666557 - RNA, 14 nt, Escherichia coli CFT073
caucaccccgcgcu

SEQ ID NO: 2666558 - RNA, 16 nt, Escherichia coli CFT073
caucaccccuuccuga

SEQ ID NO: 2666559 - RNA, 13 nt, Escherichia coli CFT073
caucacccgcugc

SEQ ID NO: 2666560 - RNA, 14 nt, Escherichia coli CFT073
caucacccucccau

SEQ ID NO: 2666561 - RNA, 12 nt, Escherichia coli CFT073
caucacccugcg

SEQ ID NO: 2666562 - RNA, 21 nt, Escherichia coli CFT073
caucacccugcgauugugaca

SEQ ID NO: 2666563 - RNA, 17 nt, Escherichia coli CFT073
caucaccgccaggccua

SEQ ID NO: 2666564 - RNA, 19 nt, Escherichia coli CFT073
caucaccggcaucugcugu

SEQ ID NO: 2666565 - RNA, 13 nt, Escherichia coli CFT073
caucaccucuuca

SEQ ID NO: 2666566 - RNA, 14 nt, Escherichia coli CFT073
caucaccugacagc

SEQ ID NO: 2666567 - RNA, 21 nt, Escherichia coli CFT073
caucacgaaaaucaucugccg

SEQ ID NO: 2666568 - RNA, 13 nt, Escherichia coli CFT073
caucacgaaaucc

SEQ ID NO: 2666569 - RNA, 22 nt, Escherichia coli CFT073
caucacgacaaaugcgccgcca

SEQ ID NO: 2666570 - RNA, 14 nt, Escherichia coli CFT073
caucacgacagcac

SEQ ID NO: 2666571 - RNA, 17 nt, Escherichia coli CFT073
caucacgacagcaccac

SEQ ID NO: 2666572 - RNA, 18 nt, Escherichia coli CFT073
cauccacaccaaaauaac

SEQ ID NO: 2666573 - RNA, 12 nt, Escherichia coli CFT073
cauccacauucg

SEQ ID NO: 2666574 - RNA, 21 nt, Escherichia coli CFT073
cauccaccacaaaagcaaagu

SEQ ID NO: 2666575 - RNA, 15 nt, Escherichia coli CFT073
cauccaccagcgccu

SEQ ID NO: 2666576 - RNA, 10 nt, Escherichia coli CFT073
cauccaccug

SEQ ID NO: 2666577 - RNA, 17 nt, Escherichia coli CFT073
cauccacugcauacuga

SEQ ID NO: 2666578 - RNA, 23 nt, Escherichia coli CFT073
cauccagagaucgcguagcggcg

SEQ ID NO: 2666579 - RNA, 18 nt, Escherichia coli CFT073
cauccagauucucauaua

SEQ ID NO: 2666580 - RNA, 16 nt, Escherichia coli CFT073
cauccagcaacaacag

SEQ ID NO: 2666581 - RNA, 20 nt, Escherichia coli CFT073
cauccagcagacgcuccauu

SEQ ID NO: 2666582 - RNA, 12 nt, Escherichia coli CFT073
cauccagcagag

SEQ ID NO: 2666583 - RNA, 13 nt, Escherichia coli CFT073
cauccagcagccc

SEQ ID NO: 2666584 - RNA, 20 nt, Escherichia coli CFT073
cauccagcagcccuugcuuc

SEQ ID NO: 2666585 - RNA, 15 nt, Escherichia coli CFT073
cauccagcagcgacu

SEQ ID NO: 2666586 - RNA, 22 nt, Escherichia coli CFT073
cauccagcaguggaucgaacuc

SEQ ID NO: 2666587 - RNA, 18 nt, Escherichia coli CFT073
cauccagcgcacgggcag

SEQ ID NO: 2666588 - RNA, 22 nt, Escherichia coli CFT073
cauccagcggcgagcuuuucug

SEQ ID NO: 2666589 - RNA, 20 nt, Escherichia coli CFT073
cauccagcguuaccggcuuc

SEQ ID NO: 2666590 - RNA, 16 nt, Escherichia coli CFT073
cauccagcguucuauc

SEQ ID NO: 2666591 - RNA, 20 nt, Escherichia coli CFT073
cauccagcuuuuagaucacu

SEQ ID NO: 2666592 - RNA, 18 nt, Escherichia coli CFT073
cauccaggccaaaagcua

SEQ ID NO: 2666593 - RNA, 14 nt, Escherichia coli CFT073
cauccaggguuuua

SEQ ID NO: 2666594 - RNA, 15 nt, Escherichia coli CFT073
cauccaggguuuuau

SEQ ID NO: 2666595 - RNA, 17 nt, Escherichia coli CFT073
cauccaggugaaaaaua

SEQ ID NO: 2666596 - RNA, 20 nt, Escherichia coli CFT073
cauccaggugaaaaauaaaa

SEQ ID NO: 2666597 - RNA, 17 nt, Escherichia coli CFT073
cauccaguaccugaucc

SEQ ID NO: 2666598 - RNA, 19 nt, Escherichia coli CFT073
cauccaguacgccuucacg

SEQ ID NO: 2666599 - RNA, 18 nt, Escherichia coli CFT073
cauccaguauauugcuga

SEQ ID NO: 2666600 - RNA, 16 nt, Escherichia coli CFT073
cauccaguuccacacc

SEQ ID NO: 2666601 - RNA, 17 nt, Escherichia coli CFT073
cauccaguuccacaccu

SEQ ID NO: 2666602 - RNA, 15 nt, Escherichia coli CFT073
cauccaguuccaguu

SEQ ID NO: 2666603 - RNA, 14 nt, Escherichia coli CFT073
cauccaucaacgcc

SEQ ID NO: 2666604 - RNA, 12 nt, Escherichia coli CFT073
cauccaucagcg

SEQ ID NO: 2666605 - RNA, 14 nt, Escherichia coli CFT073
cauccaucugcuuu

SEQ ID NO: 2666606 - RNA, 16 nt, Escherichia coli CFT073
cauccaugcaaguagu

SEQ ID NO: 2666607 - RNA, 16 nt, Escherichia coli CFT073
cauccaugcuuguuua

SEQ ID NO: 2666608 - RNA, 20 nt, Escherichia coli CFT073
cauccauguggcauugguau

SEQ ID NO: 2666609 - RNA, 19 nt, Escherichia coli CFT073
cauccauuacaucacgacg

SEQ ID NO: 2666610 - RNA, 22 nt, Escherichia coli CFT073
cauccauucuugcgcggauggc

SEQ ID NO: 2666611 - RNA, 13 nt, Escherichia coli CFT073
caucccagcagag

SEQ ID NO: 2666612 - RNA, 15 nt, Escherichia coli CFT073
caucccagcagagau

SEQ ID NO: 2666613 - RNA, 15 nt, Escherichia coli CFT073
caucccaggcaucca

SEQ ID NO: 2666614 - RNA, 13 nt, Escherichia coli CFT073
caucccaguccuc

SEQ ID NO: 2666615 - RNA, 19 nt, Escherichia coli CFT073
caucccauugcgugcagaa

SEQ ID NO: 2666616 - RNA, 12 nt, Escherichia coli CFT073
cauccccacacc

SEQ ID NO: 2666617 - RNA, 15 nt, Escherichia coli CFT073
cauccccacaccuga

SEQ ID NO: 2666618 - RNA, 17 nt, Escherichia coli CFT073
cauccccaucaacgcag

SEQ ID NO: 2666619 - RNA, 14 nt, Escherichia coli CFT073
cauccccaucgccg

SEQ ID NO: 2666620 - RNA, 19 nt, Escherichia coli CFT073
caucccccaguggcagcaa

SEQ ID NO: 2666621 - RNA, 20 nt, Escherichia coli CFT073
caucccccaguggcagcaau

SEQ ID NO: 2666622 - RNA, 14 nt, Escherichia coli CFT073
cauccccggcaacc

SEQ ID NO: 2666623 - RNA, 21 nt, Escherichia coli CFT073
cauccccggcaaccacaccca

SEQ ID NO: 2666624 - RNA, 13 nt, Escherichia coli CFT073
cauccccuccccg

SEQ ID NO: 2666625 - RNA, 13 nt, Escherichia coli CFT073
cauccccucuucc

SEQ ID NO: 2666626 - RNA, 14 nt, Escherichia coli CFT073
cauccccucuucca

SEQ ID NO: 2666627 - RNA, 21 nt, Escherichia coli CFT073
cauccccugccccaucugccc

SEQ ID NO: 2666628 - RNA, 16 nt, Escherichia coli CFT073
caucccgaccagugca

SEQ ID NO: 2666629 - RNA, 16 nt, Escherichia coli CFT073
caucccggcaaacucu

SEQ ID NO: 2666630 - RNA, 15 nt, Escherichia coli CFT073
caucccggcaaccgc

SEQ ID NO: 2666631 - RNA, 16 nt, Escherichia coli CFT073
caucccggcagagaaa

SEQ ID NO: 2666632 - RNA, 21 nt, Escherichia coli CFT073
caucccggcaggaauaucgau

SEQ ID NO: 2666633 - RNA, 23 nt, Escherichia coli CFT073
caucccgguaucaaagcgccaga

SEQ ID NO: 2666634 - RNA, 13 nt, Escherichia coli CFT073
caucccuaacagc

SEQ ID NO: 2666635 - RNA, 15 nt, Escherichia coli CFT073
caucccuucaauuau

SEQ ID NO: 2666636 - RNA, 18 nt, Escherichia coli CFT073
caucccuuucgccugcaa

SEQ ID NO: 2666637 - RNA, 23 nt, Escherichia coli CFT073
cauccgaacgcugacaaacugcg

SEQ ID NO: 2666638 - RNA, 15 nt, Escherichia coli CFT073
cauccgacaaaauga

SEQ ID NO: 2666639 - RNA, 19 nt, Escherichia coli CFT073
cauccgacaaaaugauguc

SEQ ID NO: 2666640 - RNA, 13 nt, Escherichia coli CFT073
cauccgacaaaug

SEQ ID NO: 2666641 - RNA, 15 nt, Escherichia coli CFT073
cauccgacacuggca

SEQ ID NO: 2666642 - RNA, 15 nt, Escherichia coli CFT073
cauccgacaucaacg

SEQ ID NO: 2666643 - RNA, 19 nt, Escherichia coli CFT073
cauccgacaucaacgccug

SEQ ID NO: 2666644 - RNA, 14 nt, Escherichia coli CFT073
cauccgacauuuug

SEQ ID NO: 2666645 - RNA, 15 nt, Escherichia coli CFT073
cauccgccagcagcu

SEQ ID NO: 2666646 - RNA, 15 nt, Escherichia coli CFT073
cauccgccagcgccu

SEQ ID NO: 2666647 - RNA, 18 nt, Escherichia coli CFT073
cauccgcgcacaggcggc

SEQ ID NO: 2666648 - RNA, 18 nt, Escherichia coli CFT073
cauccgcugaaaaacgaa

SEQ ID NO: 2666649 - RNA, 21 nt, Escherichia coli CFT073
cauccgcuucaggaauaagac

SEQ ID NO: 2666650 - RNA, 18 nt, Escherichia coli CFT073
cauccggauacagcccca

SEQ ID NO: 2666651 - RNA, 12 nt, Escherichia coli CFT073
cauccggcaaca

SEQ ID NO: 2666652 - RNA, 19 nt, Escherichia coli CFT073
cauccggcaacaucaaauc

SEQ ID NO: 2666653 - RNA, 22 nt, Escherichia coli CFT073
cauccggcaaccgcgccaagcc

SEQ ID NO: 2666654 - RNA, 21 nt, Escherichia coli CFT073
cauccggcaaucggugcuggc

SEQ ID NO: 2666655 - RNA, 20 nt, Escherichia coli CFT073
cauccggcaauugcaccgcg

SEQ ID NO: 2666656 - RNA, 23 nt, Escherichia coli CFT073
cauccggcaauugcaccgcgcca

SEQ ID NO: 2666657 - RNA, 13 nt, Escherichia coli CFT073
cauccggcacgcu

SEQ ID NO: 2666658 - RNA, 20 nt, Escherichia coli CFT073
cauccggcacuuucggauua

SEQ ID NO: 2666659 - RNA, 21 nt, Escherichia coli CFT073
cauccggcacuuucggauuac

SEQ ID NO: 2666660 - RNA, 15 nt, Escherichia coli CFT073
cauccggcagcgcau

SEQ ID NO: 2666661 - RNA, 21 nt, Escherichia coli CFT073
cauccggcagcgcauaagcca

SEQ ID NO: 2666662 - RNA, 21 nt, Escherichia coli CFT073
cauccggcauaaacacaggca

SEQ ID NO: 2666663 - RNA, 16 nt, Escherichia coli CFT073
cauccggcauaaacgc

SEQ ID NO: 2666664 - RNA, 16 nt, Escherichia coli CFT073
cauccggcauauuaac

SEQ ID NO: 2666665 - RNA, 14 nt, Escherichia coli CFT073
cauccggcaugaac

SEQ ID NO: 2666666 - RNA, 13 nt, Escherichia coli CFT073
cauccggcauuau

SEQ ID NO: 2666667 - RNA, 16 nt, Escherichia coli CFT073
cauccggcgacaggaa

SEQ ID NO: 2666668 - RNA, 21 nt, Escherichia coli CFT073
cauccggcgauuuucaucgcu

SEQ ID NO: 2666669 - RNA, 17 nt, Escherichia coli CFT073
cauccggcgucaucuua

SEQ ID NO: 2666670 - RNA, 15 nt, Escherichia coli CFT073
cauccggcuuaaauc

SEQ ID NO: 2666671 - RNA, 22 nt, Escherichia coli CFT073
cauccggcuuuuuuacaucauc

SEQ ID NO: 2666672 - RNA, 23 nt, Escherichia coli CFT073
cauccggcuuuuuuacaucauca

SEQ ID NO: 2666673 - RNA, 17 nt, Escherichia coli CFT073
cauccgggcaugaagaa

SEQ ID NO: 2666674 - RNA, 15 nt, Escherichia coli CFT073
cauccgguaagcgau

SEQ ID NO: 2666675 - RNA, 16 nt, Escherichia coli CFT073
cauccgguuucaucag

SEQ ID NO: 2666676 - RNA, 19 nt, Escherichia coli CFT073
cauccgguuucaucagcca

SEQ ID NO: 2666677 - RNA, 21 nt, Escherichia coli CFT073
cauccgguuucaucagccaau

SEQ ID NO: 2666678 - RNA, 14 nt, Escherichia coli CFT073
cauccguaacgcaa

SEQ ID NO: 2666679 - RNA, 23 nt, Escherichia coli CFT073
cauccgugaauaaugcaaaaagg

SEQ ID NO: 2666680 - RNA, 16 nt, Escherichia coli CFT073
cauccuaaaggcaaaa

SEQ ID NO: 2666681 - RNA, 16 nt, Escherichia coli CFT073
caucguauuucagacc

SEQ ID NO: 2666682 - RNA, 14 nt, Escherichia coli CFT073
caucgucacaccau

SEQ ID NO: 2666683 - RNA, 13 nt, Escherichia coli CFT073
caucgucagacgc

SEQ ID NO: 2666684 - RNA, 21 nt, Escherichia coli CFT073
caucgucagccaaaucgcccc

SEQ ID NO: 2666685 - RNA, 17 nt, Escherichia coli CFT073
caucgucaggaagaagc

SEQ ID NO: 2666686 - RNA, 18 nt, Escherichia coli CFT073
caucgucaggggcauuuu

SEQ ID NO: 2666687 - RNA, 14 nt, Escherichia coli CFT073
caucguccagcagc

SEQ ID NO: 2666688 - RNA, 15 nt, Escherichia coli CFT073
caucguccggcuggg

SEQ ID NO: 2666689 - RNA, 14 nt, Escherichia coli CFT073
caucgucuccagcg

SEQ ID NO: 2666690 - RNA, 13 nt, Escherichia coli CFT073
caucgugauaaac

SEQ ID NO: 2666691 - RNA, 15 nt, Escherichia coli CFT073
caucgugauuaaacu

SEQ ID NO: 2666692 - RNA, 14 nt, Escherichia coli CFT073
caucgugcaccaau

SEQ ID NO: 2666693 - RNA, 14 nt, Escherichia coli CFT073
caucguggaugaaa

SEQ ID NO: 2666694 - RNA, 17 nt, Escherichia coli CFT073
caucguggaugaaacag

SEQ ID NO: 2666695 - RNA, 19 nt, Escherichia coli CFT073
caucguuaaaaaacagugc

SEQ ID NO: 2666696 - RNA, 14 nt, Escherichia coli CFT073
caucguuacgccca

SEQ ID NO: 2666697 - RNA, 20 nt, Escherichia coli CFT073
caucguuacucuuaucaaac

SEQ ID NO: 2666698 - RNA, 16 nt, Escherichia coli CFT073
caucguuagauagcgg

SEQ ID NO: 2666699 - RNA, 17 nt, Escherichia coli CFT073
caucguucaucuguaac

SEQ ID NO: 2666700 - RNA, 12 nt, Escherichia coli CFT073
caucguuugggc

SEQ ID NO: 2666701 - RNA, 17 nt, Escherichia coli CFT073
caucuacgcucucuuca

SEQ ID NO: 2666702 - RNA, 18 nt, Escherichia coli CFT073
caucuacgcucucuucaa

SEQ ID NO: 2666703 - RNA, 20 nt, Escherichia coli CFT073
caucuacuacuggagacaga

SEQ ID NO: 2666704 - RNA, 14 nt, Escherichia coli CFT073
caucuauaaaaucc

SEQ ID NO: 2666705 - RNA, 20 nt, Escherichia coli CFT073
caucuaucgaaucuguucug

SEQ ID NO: 2666706 - RNA, 15 nt, Escherichia coli CFT073
caucucaacaaacgc

SEQ ID NO: 2666707 - RNA, 20 nt, Escherichia coli CFT073
caucucaacuuucuuggcac

SEQ ID NO: 2666708 - RNA, 12 nt, Escherichia coli CFT073
caucucaauccg

SEQ ID NO: 2666709 - RNA, 13 nt, Escherichia coli CFT073
caucuccagugcg

SEQ ID NO: 2666710 - RNA, 14 nt, Escherichia coli CFT073
caucuccaucaucu

SEQ ID NO: 2666711 - RNA, 16 nt, Escherichia coli CFT073
caucuccugacacaac

SEQ ID NO: 2666712 - RNA, 16 nt, Escherichia coli CFT073
caucuccuuacugccc

SEQ ID NO: 2666713 - RNA, 15 nt, Escherichia coli CFT073
caucucgccauccuu

SEQ ID NO: 2666714 - RNA, 23 nt, Escherichia coli CFT073
caucucgccauccuuaugcagcg

SEQ ID NO: 2666715 - RNA, 17 nt, Escherichia coli CFT073
caucucgcgcucuucuu

SEQ ID NO: 2666716 - RNA, 21 nt, Escherichia coli CFT073
caucucgcgcucuucuucacg

SEQ ID NO: 2666717 - RNA, 20 nt, Escherichia coli CFT073
caucucggauaaggcuuccu

SEQ ID NO: 2666718 - RNA, 15 nt, Escherichia coli CFT073
caucucuaccuguuc

SEQ ID NO: 2666719 - RNA, 12 nt, Escherichia coli CFT073
caucucugcaac

SEQ ID NO: 2666720 - RNA, 13 nt, Escherichia coli CFT073
caucucugcaacg

SEQ ID NO: 2666721 - RNA, 20 nt, Escherichia coli CFT073
caucucugcaacgucuuccc

SEQ ID NO: 2666722 - RNA, 20 nt, Escherichia coli CFT073
caucucuggcggcaaaccuu

SEQ ID NO: 2666723 - RNA, 18 nt, Escherichia coli CFT073
caucucuucccacggauu

SEQ ID NO: 2666724 - RNA, 14 nt, Escherichia coli CFT073
caucucuucuucaa

SEQ ID NO: 2666725 - RNA, 14 nt, Escherichia coli CFT073
caucucuucuuccg

SEQ ID NO: 2666726 - RNA, 22 nt, Escherichia coli CFT073
caucucuucuuccggcaccauu

SEQ ID NO: 2666727 - RNA, 14 nt, Escherichia coli CFT073
caucucuuugcugu

SEQ ID NO: 2666728 - RNA, 15 nt, Escherichia coli CFT073
caucugacaaaauca

SEQ ID NO: 2666729 - RNA, 15 nt, Escherichia coli CFT073
caucugauucuuccc

SEQ ID NO: 2666730 - RNA, 19 nt, Escherichia coli CFT073
caucugcacgcggagggcg

SEQ ID NO: 2666731 - RNA, 22 nt, Escherichia coli CFT073
caucugccaccguguauuucug

SEQ ID NO: 2666732 - RNA, 20 nt, Escherichia coli CFT073
caucugccgguuccagcuuc

SEQ ID NO: 2666733 - RNA, 21 nt, Escherichia coli CFT073
caucugcgccacgaaaacccu

SEQ ID NO: 2666734 - RNA, 14 nt, Escherichia coli CFT073
caucugcgcccugg

SEQ ID NO: 2666735 - RNA, 20 nt, Escherichia coli CFT073
caucugcguuuugguggcga

SEQ ID NO: 2666736 - RNA, 21 nt, Escherichia coli CFT073
caucugcuguuucuggcacca

SEQ ID NO: 2666737 - RNA, 13 nt, Escherichia coli CFT073
caucugcuuuuug

SEQ ID NO: 2666738 - RNA, 23 nt, Escherichia coli CFT073
caucuggcaccgguacacaaccg

SEQ ID NO: 2666739 - RNA, 16 nt, Escherichia coli CFT073
caucuggcgagaacac

SEQ ID NO: 2666740 - RNA, 12 nt, Escherichia coli CFT073
caucuggucaga

SEQ ID NO: 2666741 - RNA, 19 nt, Escherichia coli CFT073
caucuggugccagcgccag

SEQ ID NO: 2666742 - RNA, 21 nt, Escherichia coli CFT073
caucuggugccagcgccagca

SEQ ID NO: 2666743 - RNA, 19 nt, Escherichia coli CFT073
caucugguuuuuuauauuc

SEQ ID NO: 2666744 - RNA, 15 nt, Escherichia coli CFT073
caucuuaauagcugc

SEQ ID NO: 2666745 - RNA, 17 nt, Escherichia coli CFT073
caucuuaauagcugcca

SEQ ID NO: 2666746 - RNA, 14 nt, Escherichia coli CFT073
caucuuauccagcc

SEQ ID NO: 2666747 - RNA, 12 nt, Escherichia coli CFT073
caucuuauccgg

SEQ ID NO: 2666748 - RNA, 17 nt, Escherichia coli CFT073
caucuucaccaauguuc

SEQ ID NO: 2666749 - RNA, 22 nt, Escherichia coli CFT073
caucuucagucgcaucuucacg

SEQ ID NO: 2666750 - RNA, 14 nt, Escherichia coli CFT073
caucuucaucaucu

SEQ ID NO: 2666751 - RNA, 18 nt, Escherichia coli CFT073
caucuucaucaucugcgc

SEQ ID NO: 2666752 - RNA, 16 nt, Escherichia coli CFT073
caucuucauuaaaugc

SEQ ID NO: 2666753 - RNA, 18 nt, Escherichia coli CFT073
caucuuccagcaucagca

SEQ ID NO: 2666754 - RNA, 21 nt, Escherichia coli CFT073
caucuuccagcugcacgccac

SEQ ID NO: 2666755 - RNA, 13 nt, Escherichia coli CFT073
caucuuccgggca

SEQ ID NO: 2666756 - RNA, 20 nt, Escherichia coli CFT073
caucuucggcaauacuucaa

SEQ ID NO: 2666757 - RNA, 14 nt, Escherichia coli CFT073
caucuucguaccaa

SEQ ID NO: 2666758 - RNA, 18 nt, Escherichia coli CFT073
caucuucguaccaaauga

SEQ ID NO: 2666759 - RNA, 13 nt, Escherichia coli CFT073
caucuucgucaaa

SEQ ID NO: 2666760 - RNA, 18 nt, Escherichia coli CFT073
caucuucgucaaagauau

SEQ ID NO: 2666761 - RNA, 12 nt, Escherichia coli CFT073
caucuucuccac

SEQ ID NO: 2666762 - RNA, 22 nt, Escherichia coli CFT073
caucuucugaaucagaucaagu

SEQ ID NO: 2666763 - RNA, 16 nt, Escherichia coli CFT073
caucuucuucuggcug

SEQ ID NO: 2666764 - RNA, 23 nt, Escherichia coli CFT073
caucuucuugcagcuuaaucaua

SEQ ID NO: 2666765 - RNA, 19 nt, Escherichia coli CFT073
caucuuguucauagugccu

SEQ ID NO: 2666766 - RNA, 14 nt, Escherichia coli CFT073
caucuuuaacugcu

SEQ ID NO: 2666767 - RNA, 20 nt, Escherichia coli CFT073
caucuuucaucuguuuucaa

SEQ ID NO: 2666768 - RNA, 21 nt, Escherichia coli CFT073
caucuuucugcgcaucuuccc

SEQ ID NO: 2666769 - RNA, 17 nt, Escherichia coli CFT073
caucuuugagucaacau

SEQ ID NO: 2666770 - RNA, 19 nt, Escherichia coli CFT073
caucuuuugcgauauauuu

SEQ ID NO: 2666771 - RNA, 23 nt, Escherichia coli CFT073
caucuuuuucaaugcauaucauu

SEQ ID NO: 2666772 - RNA, 16 nt, Escherichia coli CFT073
caucuuuuuuuaccug

SEQ ID NO: 2666773 - RNA, 17 nt, Escherichia coli CFT073
caugaaagcgaugcuga

SEQ ID NO: 2666774 - RNA, 21 nt, Escherichia coli CFT073
caugaacaaaucgcacguugu

SEQ ID NO: 2666775 - RNA, 17 nt, Escherichia coli CFT073
caugaacgcuaucggca

SEQ ID NO: 2666776 - RNA, 24 nt, Escherichia coli CFT073
caugaagauggucuguaccaccag

SEQ ID NO: 2666777 - RNA, 13 nt, Escherichia coli CFT073
caugaagcaauga

SEQ ID NO: 2666778 - RNA, 19 nt, Escherichia coli CFT073
caugaagcaaugauaaguc

SEQ ID NO: 2666779 - RNA, 22 nt, Escherichia coli CFT073
caugaagcugacaggcgcugau

SEQ ID NO: 2666780 - RNA, 14 nt, Escherichia coli CFT073
caugaauaaaaaaa

SEQ ID NO: 2666781 - RNA, 13 nt, Escherichia coli CFT073
caugaauaucaag

SEQ ID NO: 2666782 - RNA, 18 nt, Escherichia coli CFT073
caugaauggucauaaagu

SEQ ID NO: 2666783 - RNA, 13 nt, Escherichia coli CFT073
caugaaugucaua

SEQ ID NO: 2666784 - RNA, 14 nt, Escherichia coli CFT073
caugaauucgacuu

SEQ ID NO: 2666785 - RNA, 15 nt, Escherichia coli CFT073
caugaauucgacuuu

SEQ ID NO: 2666786 - RNA, 13 nt, Escherichia coli CFT073
caugaauuucacg

SEQ ID NO: 2666787 - RNA, 21 nt, Escherichia coli CFT073
caugaauuuugaaggaaaaau

SEQ ID NO: 2666788 - RNA, 20 nt, Escherichia coli CFT073
caugacaaacucaccuggcu

SEQ ID NO: 2666789 - RNA, 22 nt, Escherichia coli CFT073
caugacaaacucaccuggcuga

SEQ ID NO: 2666790 - RNA, 17 nt, Escherichia coli CFT073
cauggggagaccccaca

SEQ ID NO: 2666791 - RNA, 15 nt, Escherichia coli CFT073
caugggugccggaua

SEQ ID NO: 2666792 - RNA, 15 nt, Escherichia coli CFT073
caugguaaaaccgac

SEQ ID NO: 2666793 - RNA, 20 nt, Escherichia coli CFT073
caugguaaaaccgacuuaaa

SEQ ID NO: 2666794 - RNA, 22 nt, Escherichia coli CFT073
caugguacuggcgacugccagc

SEQ ID NO: 2666795 - RNA, 16 nt, Escherichia coli CFT073
caugguaggccgaaua

SEQ ID NO: 2666796 - RNA, 21 nt, Escherichia coli CFT073
cauggucgcagcggcuucccc

SEQ ID NO: 2666797 - RNA, 22 nt, Escherichia coli CFT073
cauggucugcgccgcauucagg

SEQ ID NO: 2666798 - RNA, 17 nt, Escherichia coli CFT073
cauggugaaaccgcagc

SEQ ID NO: 2666799 - RNA, 18 nt, Escherichia coli CFT073
cauggugaugaucgccgu

SEQ ID NO: 2666800 - RNA, 23 nt, Escherichia coli CFT073
caugguggaaaucgaacuucccg

SEQ ID NO: 2666801 - RNA, 19 nt, Escherichia coli CFT073
caugguggaacucuucaca

SEQ ID NO: 2666802 - RNA, 14 nt, Escherichia coli CFT073
caugguuaaaaucu

SEQ ID NO: 2666803 - RNA, 19 nt, Escherichia coli CFT073
caugguuaaaaucucccgc

SEQ ID NO: 2666804 - RNA, 20 nt, Escherichia coli CFT073
caugguuaaugcuucgcacu

SEQ ID NO: 2666805 - RNA, 16 nt, Escherichia coli CFT073
caugguuuacggcggu

SEQ ID NO: 2666806 - RNA, 14 nt, Escherichia coli CFT073
cauguaacgcugca

SEQ ID NO: 2666807 - RNA, 16 nt, Escherichia coli CFT073
cauguaacugccuuuc

SEQ ID NO: 2666808 - RNA, 23 nt, Escherichia coli CFT073
cauguaaugcagguccacgacca

SEQ ID NO: 2666809 - RNA, 20 nt, Escherichia coli CFT073
cauguacgcguucaaucaaa

SEQ ID NO: 2666810 - RNA, 14 nt, Escherichia coli CFT073
cauguauauuaucc

SEQ ID NO: 2666811 - RNA, 21 nt, Escherichia coli CFT073
caugucagacaacaugccgaa

SEQ ID NO: 2666812 - RNA, 12 nt, Escherichia coli CFT073
caugucaggcgu

SEQ ID NO: 2666813 - RNA, 17 nt, Escherichia coli CFT073
caugucaggcgucgcgc

SEQ ID NO: 2666814 - RNA, 15 nt, Escherichia coli CFT073
caugucaguugcaua

SEQ ID NO: 2666815 - RNA, 17 nt, Escherichia coli CFT073
caugucaucaauugcgc

SEQ ID NO: 2666816 - RNA, 18 nt, Escherichia coli CFT073
cauguccauuuccggaua

SEQ ID NO: 2666817 - RNA, 15 nt, Escherichia coli CFT073
caugucggacuucag

SEQ ID NO: 2666818 - RNA, 16 nt, Escherichia coli CFT073
caugugcaaucuacaa

SEQ ID NO: 2666819 - RNA, 15 nt, Escherichia coli CFT073
caugugccgacaucg

SEQ ID NO: 2666820 - RNA, 17 nt, Escherichia coli CFT073
caugugcgacgggccaa

SEQ ID NO: 2666821 - RNA, 15 nt, Escherichia coli CFT073
cauguuaaccaacca

SEQ ID NO: 2666822 - RNA, 18 nt, Escherichia coli CFT073
cauguuaaccaaccaguc

SEQ ID NO: 2666823 - RNA, 15 nt, Escherichia coli CFT073
cauguuaugaauauc

SEQ ID NO: 2666824 - RNA, 14 nt, Escherichia coli CFT073
cauguuauucaugc

SEQ ID NO: 2666825 - RNA, 16 nt, Escherichia coli CFT073
cauguucagucacuuc

SEQ ID NO: 2666826 - RNA, 17 nt, Escherichia coli CFT073
cauguucagucacuuca

SEQ ID NO: 2666827 - RNA, 17 nt, Escherichia coli CFT073
cauguucauaucaaaac

SEQ ID NO: 2666828 - RNA, 18 nt, Escherichia coli CFT073
cauguuccugccagucuu

SEQ ID NO: 2666829 - RNA, 20 nt, Escherichia coli CFT073
cauguugacaaaaauaccau

SEQ ID NO: 2666830 - RNA, 13 nt, Escherichia coli CFT073
cauguugacuuca

SEQ ID NO: 2666831 - RNA, 17 nt, Escherichia coli CFT073
cauguugacuucaaucu

SEQ ID NO: 2666832 - RNA, 15 nt, Escherichia coli CFT073
cauguugaucccugc

SEQ ID NO: 2666833 - RNA, 16 nt, Escherichia coli CFT073
cauguugcgcagaguu

SEQ ID NO: 2666834 - RNA, 15 nt, Escherichia coli CFT073
cauguuggagauaac

SEQ ID NO: 2666835 - RNA, 12 nt, Escherichia coli CFT073
cauguuuuccuu

SEQ ID NO: 2666836 - RNA, 21 nt, Escherichia coli CFT073
cauguuuuuuaaguucagcau

SEQ ID NO: 2666837 - RNA, 14 nt, Escherichia coli CFT073
cauuaaaacggaua

SEQ ID NO: 2666838 - RNA, 12 nt, Escherichia coli CFT073
cauuaaaaucgg

SEQ ID NO: 2666839 - RNA, 22 nt, Escherichia coli CFT073
cauuaaaaugaauaacuuccug

SEQ ID NO: 2666840 - RNA, 23 nt, Escherichia coli CFT073
cauuaaaaugaauaacuuccugu

SEQ ID NO: 2666841 - RNA, 14 nt, Escherichia coli CFT073
cauuaaaccagugc

SEQ ID NO: 2666842 - RNA, 19 nt, Escherichia coli CFT073
cauuaaacucaccuugugu

SEQ ID NO: 2666843 - RNA, 15 nt, Escherichia coli CFT073
cauuaaagcuuuacu

SEQ ID NO: 2666844 - RNA, 20 nt, Escherichia coli CFT073
cauuaaauccgccaaaugga

SEQ ID NO: 2666845 - RNA, 16 nt, Escherichia coli CFT073
cauuaaauuuaugugc

SEQ ID NO: 2666846 - RNA, 13 nt, Escherichia coli CFT073
cauuaacaaccga

SEQ ID NO: 2666847 - RNA, 15 nt, Escherichia coli CFT073
cauuaacaaccgaau

SEQ ID NO: 2666848 - RNA, 17 nt, Escherichia coli CFT073
cauuaacaccacgccag

SEQ ID NO: 2666849 - RNA, 12 nt, Escherichia coli CFT073
cauuaacaguag

SEQ ID NO: 2666850 - RNA, 15 nt, Escherichia coli CFT073
cauuaaccaaccacc

SEQ ID NO: 2666851 - RNA, 15 nt, Escherichia coli CFT073
cauuaaccagccacu

SEQ ID NO: 2666852 - RNA, 19 nt, Escherichia coli CFT073
cauuaaccagccacugcgc

SEQ ID NO: 2666853 - RNA, 20 nt, Escherichia coli CFT073
cauuaacccgagaucuuuaa

SEQ ID NO: 2666854 - RNA, 19 nt, Escherichia coli CFT073
cauuaacccgcuugucgcc

SEQ ID NO: 2666855 - RNA, 14 nt, Escherichia coli CFT073
cauuaacgauaauu

SEQ ID NO: 2666856 - RNA, 15 nt, Escherichia coli CFT073
cauuaacgcagaauc

SEQ ID NO: 2666857 - RNA, 17 nt, Escherichia coli CFT073
cauuaacgccccaauca

SEQ ID NO: 2666858 - RNA, 20 nt, Escherichia coli CFT073
cauuaacgcgaaauaaucaa

SEQ ID NO: 2666859 - RNA, 19 nt, Escherichia coli CFT073
cauuaacucacuggcgcgc

SEQ ID NO: 2666860 - RNA, 16 nt, Escherichia coli CFT073
cauuaacuccccuuua

SEQ ID NO: 2666861 - RNA, 16 nt, Escherichia coli CFT073
cauuaauacaucaacu

SEQ ID NO: 2666862 - RNA, 17 nt, Escherichia coli CFT073
cauuaauacaucaacuu

SEQ ID NO: 2666863 - RNA, 11 nt, Escherichia coli CFT073
cauuaauaccg

SEQ ID NO: 2666864 - RNA, 15 nt, Escherichia coli CFT073
cauuaauuucaggcu

SEQ ID NO: 2666865 - RNA, 18 nt, Escherichia coli CFT073
cauuaauuuucaauugau

SEQ ID NO: 2666866 - RNA, 13 nt, Escherichia coli CFT073
cauuacaaaauac

SEQ ID NO: 2666867 - RNA, 15 nt, Escherichia coli CFT073
cauuacaaaauacaa

SEQ ID NO: 2666868 - RNA, 17 nt, Escherichia coli CFT073
cauuacaagaaucaugc

SEQ ID NO: 2666869 - RNA, 18 nt, Escherichia coli CFT073
cauuacaagaaucaugcc

SEQ ID NO: 2666870 - RNA, 19 nt, Escherichia coli CFT073
cauuacaccaauaccgccc

SEQ ID NO: 2666871 - RNA, 17 nt, Escherichia coli CFT073
cauuacacugaaaaaaa

SEQ ID NO: 2666872 - RNA, 19 nt, Escherichia coli CFT073
cauuacacugaaaaaaagu

SEQ ID NO: 2666873 - RNA, 18 nt, Escherichia coli CFT073
cauuacaggcaucuucca

SEQ ID NO: 2666874 - RNA, 23 nt, Escherichia coli CFT073
cauuacaucacgacgaccaccga

SEQ ID NO: 2666875 - RNA, 21 nt, Escherichia coli CFT073
cauuaccgccaucaauugcuc

SEQ ID NO: 2666876 - RNA, 13 nt, Escherichia coli CFT073
cauuaccucaaua

SEQ ID NO: 2666877 - RNA, 20 nt, Escherichia coli CFT073
cauuaccuucaauacuggca

SEQ ID NO: 2666878 - RNA, 14 nt, Escherichia coli CFT073
cauuacgaaaccac

SEQ ID NO: 2666879 - RNA, 16 nt, Escherichia coli CFT073
cauuacgaaaucggca

SEQ ID NO: 2666880 - RNA, 22 nt, Escherichia coli CFT073
cauuacgaaaucggcaccgccg

SEQ ID NO: 2666881 - RNA, 15 nt, Escherichia coli CFT073
cauuacgaucaagaa

SEQ ID NO: 2666882 - RNA, 18 nt, Escherichia coli CFT073
cauuacgcgccucuucca

SEQ ID NO: 2666883 - RNA, 23 nt, Escherichia coli CFT073
cauuacgcgcuggguuaaacagc

SEQ ID NO: 2666884 - RNA, 21 nt, Escherichia coli CFT073
cauuacgcucgcugcaaaaca

SEQ ID NO: 2666885 - RNA, 23 nt, Escherichia coli CFT073
cauuacgcucgcugcaaaacagg

SEQ ID NO: 2666886 - RNA, 15 nt, Escherichia coli CFT073
cauuacuaaacauuu

SEQ ID NO: 2666887 - RNA, 17 nt, Escherichia coli CFT073
cauuacuauaacccacc

SEQ ID NO: 2666888 - RNA, 15 nt, Escherichia coli CFT073
cauuacucauccaug

SEQ ID NO: 2666889 - RNA, 20 nt, Escherichia coli CFT073
cauuacugcuaucugucaga

SEQ ID NO: 2666890 - RNA, 16 nt, Escherichia coli CFT073
cauuagcauuaacagu

SEQ ID NO: 2666891 - RNA, 19 nt, Escherichia coli CFT073
cauuagcauuaacaguaga

SEQ ID NO: 2666892 - RNA, 13 nt, Escherichia coli CFT073
cauuagcccggca

SEQ ID NO: 2666893 - RNA, 18 nt, Escherichia coli CFT073
cauuagcgcuaucaaagu

SEQ ID NO: 2666894 - RNA, 23 nt, Escherichia coli CFT073
cauuagcucuuaacgaaaacuga

SEQ ID NO: 2666895 - RNA, 18 nt, Escherichia coli CFT073
cauuagugcgcaguugcc

SEQ ID NO: 2666896 - RNA, 14 nt, Escherichia coli CFT073
cauuaucacaucag

SEQ ID NO: 2666897 - RNA, 23 nt, Escherichia coli CFT073
cauuaucacaucagcgcauuuac

SEQ ID NO: 2666898 - RNA, 13 nt, Escherichia coli CFT073
cauuaucaccaaa

SEQ ID NO: 2666899 - RNA, 16 nt, Escherichia coli CFT073
cauuggcaauugccau

SEQ ID NO: 2666900 - RNA, 22 nt, Escherichia coli CFT073
cauuggccccauaaucaaugcc

SEQ ID NO: 2666901 - RNA, 13 nt, Escherichia coli CFT073
cauuggcuugcac

SEQ ID NO: 2666902 - RNA, 20 nt, Escherichia coli CFT073
cauuggguucaucugauagc

SEQ ID NO: 2666903 - RNA, 15 nt, Escherichia coli CFT073
cauugguaucggcgg

SEQ ID NO: 2666904 - RNA, 18 nt, Escherichia coli CFT073
cauugguuucacccaguc

SEQ ID NO: 2666905 - RNA, 18 nt, Escherichia coli CFT073
cauugucaggaucaccaa

SEQ ID NO: 2666906 - RNA, 19 nt, Escherichia coli CFT073
cauugucaggaucaccaau

SEQ ID NO: 2666907 - RNA, 16 nt, Escherichia coli CFT073
cauugugggauuccag

SEQ ID NO: 2666908 - RNA, 20 nt, Escherichia coli CFT073
cauugugggauuccagcgcc

SEQ ID NO: 2666909 - RNA, 18 nt, Escherichia coli CFT073
cauuguguagggcagcgu

SEQ ID NO: 2666910 - RNA, 19 nt, Escherichia coli CFT073
cauuguguuaucccgauga

SEQ ID NO: 2666911 - RNA, 15 nt, Escherichia coli CFT073
cauuguuaauuacga

SEQ ID NO: 2666912 - RNA, 13 nt, Escherichia coli CFT073
cauuguuccacuc

SEQ ID NO: 2666913 - RNA, 17 nt, Escherichia coli CFT073
cauuuaaacucaccgcu

SEQ ID NO: 2666914 - RNA, 19 nt, Escherichia coli CFT073
cauuuaacacgaacuuuau

SEQ ID NO: 2666915 - RNA, 11 nt, Escherichia coli CFT073
cauuuaagcca

SEQ ID NO: 2666916 - RNA, 15 nt, Escherichia coli CFT073
cauuuaaugacaaaa

SEQ ID NO: 2666917 - RNA, 19 nt, Escherichia coli CFT073
cauuuacccgauccacuga

SEQ ID NO: 2666918 - RNA, 18 nt, Escherichia coli CFT073
cauuuacgaacauuaaga

SEQ ID NO: 2666919 - RNA, 21 nt, Escherichia coli CFT073
cauuuagcgcagcuacccgau

SEQ ID NO: 2666920 - RNA, 23 nt, Escherichia coli CFT073
cauuuaugaugagaacuccuggc

SEQ ID NO: 2666921 - RNA, 21 nt, Escherichia coli CFT073
cauuuauuccgcaccaacgca

SEQ ID NO: 2666922 - RNA, 19 nt, Escherichia coli CFT073
cauuuauuucaacgacaua

SEQ ID NO: 2666923 - RNA, 14 nt, Escherichia coli CFT073
cauuuauuucucac

SEQ ID NO: 2666924 - RNA, 17 nt, Escherichia coli CFT073
cauuucacguucacgua

SEQ ID NO: 2666925 - RNA, 16 nt, Escherichia coli CFT073
cauuucauucacgccg

SEQ ID NO: 2666926 - RNA, 21 nt, Escherichia coli CFT073
cauuucauuuggauggaaaau

SEQ ID NO: 2666927 - RNA, 15 nt, Escherichia coli CFT073
cauuuccaagauuaa

SEQ ID NO: 2666928 - RNA, 14 nt, Escherichia coli CFT073
cauuucccaacagu

SEQ ID NO: 2666929 - RNA, 15 nt, Escherichia coli CFT073
cauuucccagcaaga

SEQ ID NO: 2666930 - RNA, 17 nt, Escherichia coli CFT073
cauuucccccuuccugc

SEQ ID NO: 2666931 - RNA, 16 nt, Escherichia coli CFT073
cauuucccggaauaau

SEQ ID NO: 2666932 - RNA, 17 nt, Escherichia coli CFT073
cauuuccgcugauucaa

SEQ ID NO: 2666933 - RNA, 21 nt, Escherichia coli CFT073
cauuuccgcugauucaagauu

SEQ ID NO: 2666934 - RNA, 14 nt, Escherichia coli CFT073
cauuuccucaacau

SEQ ID NO: 2666935 - RNA, 19 nt, Escherichia coli CFT073
cauuucgauauagccgccu

SEQ ID NO: 2666936 - RNA, 20 nt, Escherichia coli CFT073
cauuucgauauguuccggcg

SEQ ID NO: 2666937 - RNA, 23 nt, Escherichia coli CFT073
cauuucgugcggguaaccagcca

SEQ ID NO: 2666938 - RNA, 14 nt, Escherichia coli CFT073
cauuucuggaaugc

SEQ ID NO: 2666939 - RNA, 17 nt, Escherichia coli CFT073
cauuucuggaaugcgga

SEQ ID NO: 2666940 - RNA, 18 nt, Escherichia coli CFT073
cauuucuggcggcgugau

SEQ ID NO: 2666941 - RNA, 20 nt, Escherichia coli CFT073
cauuugagcaggaugccuga

SEQ ID NO: 2666942 - RNA, 21 nt, Escherichia coli CFT073
cauuugcaccaggccgcgcag

SEQ ID NO: 2666943 - RNA, 17 nt, Escherichia coli CFT073
cauuugcauccaacuuc

SEQ ID NO: 2666944 - RNA, 18 nt, Escherichia coli CFT073
cauuugccagcgucagau

SEQ ID NO: 2666945 - RNA, 17 nt, Escherichia coli CFT073
cauuugcguggcgcgcg

SEQ ID NO: 2666946 - RNA, 18 nt, Escherichia coli CFT073
cauuugcucuaccagccc

SEQ ID NO: 2666947 - RNA, 19 nt, Escherichia coli CFT073
cauuugcuguagaugacac

SEQ ID NO: 2666948 - RNA, 16 nt, Escherichia coli CFT073
cauuuggacaccauug

SEQ ID NO: 2666949 - RNA, 22 nt, Escherichia coli CFT073
cauuuggauggaaaauuuuuuc

SEQ ID NO: 2666950 - RNA, 12 nt, Escherichia coli CFT073
cauuugucucaa

SEQ ID NO: 2666951 - RNA, 22 nt, Escherichia coli CFT073
cauuugucuguuucuguugcca

SEQ ID NO: 2666952 - RNA, 16 nt, Escherichia coli CFT073
cauuugugacauuaac

SEQ ID NO: 2666953 - RNA, 20 nt, Escherichia coli CFT073
cauuuuacguguuucagaau

SEQ ID NO: 2666954 - RNA, 14 nt, Escherichia coli CFT073
cauuuucagccagg

SEQ ID NO: 2666955 - RNA, 19 nt, Escherichia coli CFT073
cauuuucagcuuucgcauc

SEQ ID NO: 2666956 - RNA, 21 nt, Escherichia coli CFT073
cauuuuccagcucuucuacau

SEQ ID NO: 2666957 - RNA, 12 nt, Escherichia coli CFT073
cauuuuccagug

SEQ ID NO: 2666958 - RNA, 16 nt, Escherichia coli CFT073
cauuuucgacaauaaa

SEQ ID NO: 2666959 - RNA, 23 nt, Escherichia coli CFT073
cauuuucuaugcugccacacugc

SEQ ID NO: 2666960 - RNA, 19 nt, Escherichia coli CFT073
cauuuucucgugccgccag

SEQ ID NO: 2666961 - RNA, 14 nt, Escherichia coli CFT073
cauuuugauuaaua

SEQ ID NO: 2666962 - RNA, 12 nt, Escherichia coli CFT073
cauuuugcuauu

SEQ ID NO: 2666963 - RNA, 18 nt, Escherichia coli CFT073
cauuuugcugcuuccauu

SEQ ID NO: 2666964 - RNA, 12 nt, Escherichia coli CFT073
cauuuugcuggc

SEQ ID NO: 2666965 - RNA, 20 nt, Escherichia coli CFT073
cauuuugggacagugcagga

SEQ ID NO: 2666966 - RNA, 23 nt, Escherichia coli CFT073
cauuuugggcgggaucuccacaa

SEQ ID NO: 2666967 - RNA, 18 nt, Escherichia coli CFT073
cauuuuguaggccugaua

SEQ ID NO: 2666968 - RNA, 19 nt, Escherichia coli CFT073
cauuuuguaggccugauaa

SEQ ID NO: 2666969 - RNA, 21 nt, Escherichia coli CFT073
cauuuuguaggccugauaaga

SEQ ID NO: 2666970 - RNA, 20 nt, Escherichia coli CFT073
cauuuuguaugcggcgaagg

SEQ ID NO: 2666971 - RNA, 15 nt, Escherichia coli CFT073
cauuuuuaguuuugu

SEQ ID NO: 2666972 - RNA, 18 nt, Escherichia coli CFT073
cauuuuuaguuuugugaa

SEQ ID NO: 2666973 - RNA, 15 nt, Escherichia coli CFT073
cauuuuuauuaaaua

SEQ ID NO: 2666974 - RNA, 16 nt, Escherichia coli CFT073
cauuuuucgcuaccag

SEQ ID NO: 2666975 - RNA, 23 nt, Escherichia coli CFT073
cauuuuugccaucaaucacuuug

SEQ ID NO: 2666976 - RNA, 22 nt, Escherichia coli CFT073
cauuuuuuugcauuacugcuau

SEQ ID NO: 2666977 - RNA, 13 nt, Escherichia coli CFT073
ccaaaaaaacggc

SEQ ID NO: 2666978 - RNA, 20 nt, Escherichia coli CFT073
ccaaaaagaaccugaacgcc

SEQ ID NO: 2666979 - RNA, 20 nt, Escherichia coli CFT073
ccaaaaagcgucccuaauac

SEQ ID NO: 2666980 - RNA, 12 nt, Escherichia coli CFT073
ccaaaaaucgac

SEQ ID NO: 2666981 - RNA, 15 nt, Escherichia coli CFT073
ccaaaacagcgacac

SEQ ID NO: 2666982 - RNA, 12 nt, Escherichia coli CFT073
ccaaaaccacag

SEQ ID NO: 2666983 - RNA, 20 nt, Escherichia coli CFT073
ccaaaaccgaggagcaacaa

SEQ ID NO: 2666984 - RNA, 12 nt, Escherichia coli CFT073
ccaaaaccgcuc

SEQ ID NO: 2666985 - RNA, 16 nt, Escherichia coli CFT073
ccaaaacgcgccaggu

SEQ ID NO: 2666986 - RNA, 16 nt, Escherichia coli CFT073
ccaaaagcgauuauuu

SEQ ID NO: 2666987 - RNA, 20 nt, Escherichia coli CFT073
ccaaaagcgauuauuuauuc

SEQ ID NO: 2666988 - RNA, 14 nt, Escherichia coli CFT073
ccaaaagcuaacag

SEQ ID NO: 2666989 - RNA, 15 nt, Escherichia coli CFT073
ccaaaaugcuugacg

SEQ ID NO: 2666990 - RNA, 20 nt, Escherichia coli CFT073
ccaaaaugucggaugcgacg

SEQ ID NO: 2666991 - RNA, 11 nt, Escherichia coli CFT073
ccaaaauuuga

SEQ ID NO: 2666992 - RNA, 20 nt, Escherichia coli CFT073
ccaaaauuugaaagugcugu

SEQ ID NO: 2666993 - RNA, 12 nt, Escherichia coli CFT073
ccaaacaccagg

SEQ ID NO: 2666994 - RNA, 14 nt, Escherichia coli CFT073
ccaaacagaccaau

SEQ ID NO: 2666995 - RNA, 14 nt, Escherichia coli CFT073
ccaaacagcagaac

SEQ ID NO: 2666996 - RNA, 16 nt, Escherichia coli CFT073
ccaaacagcgccagau

SEQ ID NO: 2666997 - RNA, 16 nt, Escherichia coli CFT073
ccaaacauacgacuuu

SEQ ID NO: 2666998 - RNA, 13 nt, Escherichia coli CFT073
ccaaaccagccgc

SEQ ID NO: 2666999 - RNA, 16 nt, Escherichia coli CFT073
ccaaaccagccgccaa

SEQ ID NO: 2667000 - RNA, 14 nt, Escherichia coli CFT073
ccaaaccaucacaa

SEQ ID NO: 2667001 - RNA, 18 nt, Escherichia coli CFT073
ccaaaccauugcuuaaag

SEQ ID NO: 2667002 - RNA, 16 nt, Escherichia coli CFT073
ccaaaccgacugccug

SEQ ID NO: 2667003 - RNA, 17 nt, Escherichia coli CFT073
ccaaaccgacugccugc

SEQ ID NO: 2667004 - RNA, 16 nt, Escherichia coli CFT073
ccaaacgcccagcuaa

SEQ ID NO: 2667005 - RNA, 21 nt, Escherichia coli CFT073
ccaaacgguaucuuuccagcc

SEQ ID NO: 2667006 - RNA, 18 nt, Escherichia coli CFT073
ccaaacucuucgacaauc

SEQ ID NO: 2667007 - RNA, 23 nt, Escherichia coli CFT073
ccaaacugauuuagcaucagcgc

SEQ ID NO: 2667008 - RNA, 15 nt, Escherichia coli CFT073
ccaauaccagcauca

SEQ ID NO: 2667009 - RNA, 13 nt, Escherichia coli CFT073
ccaauaccgcacu

SEQ ID NO: 2667010 - RNA, 21 nt, Escherichia coli CFT073
ccaauaccgcccacuaccagc

SEQ ID NO: 2667011 - RNA, 21 nt, Escherichia coli CFT073
ccaauacgauuaacgccagac

SEQ ID NO: 2667012 - RNA, 20 nt, Escherichia coli CFT073
ccaauacguuucuuccacac

SEQ ID NO: 2667013 - RNA, 22 nt, Escherichia coli CFT073
ccaauacguuucuuccacacca

SEQ ID NO: 2667014 - RNA, 18 nt, Escherichia coli CFT073
ccaauagaaagugacagc

SEQ ID NO: 2667015 - RNA, 15 nt, Escherichia coli CFT073
ccaauagugcggcgu

SEQ ID NO: 2667016 - RNA, 11 nt, Escherichia coli CFT073
ccaauauccug

SEQ ID NO: 2667017 - RNA, 13 nt, Escherichia coli CFT073
ccaauauccugag

SEQ ID NO: 2667018 - RNA, 15 nt, Escherichia coli CFT073
ccaauauuaaauauc

SEQ ID NO: 2667019 - RNA, 13 nt, Escherichia coli CFT073
ccaaucaccacuu

SEQ ID NO: 2667020 - RNA, 17 nt, Escherichia coli CFT073
ccaaucagcacacauaa

SEQ ID NO: 2667021 - RNA, 21 nt, Escherichia coli CFT073
ccaaucagcacacauaacagc

SEQ ID NO: 2667022 - RNA, 13 nt, Escherichia coli CFT073
ccaaucagcgcag

SEQ ID NO: 2667023 - RNA, 20 nt, Escherichia coli CFT073
ccaaucaucgacauugacca

SEQ ID NO: 2667024 - RNA, 18 nt, Escherichia coli CFT073
ccaauccacgcggguuua

SEQ ID NO: 2667025 - RNA, 20 nt, Escherichia coli CFT073
ccaaucccccacuuuuaaau

SEQ ID NO: 2667026 - RNA, 15 nt, Escherichia coli CFT073
ccaauccgccagcca

SEQ ID NO: 2667027 - RNA, 15 nt, Escherichia coli CFT073
ccaaucgcaggcgag

SEQ ID NO: 2667028 - RNA, 15 nt, Escherichia coli CFT073
ccaaucgccacgcca

SEQ ID NO: 2667029 - RNA, 18 nt, Escherichia coli CFT073
ccaaucgcccgggcuuua

SEQ ID NO: 2667030 - RNA, 15 nt, Escherichia coli CFT073
ccaaucucccagccg

SEQ ID NO: 2667031 - RNA, 17 nt, Escherichia coli CFT073
ccaaucugaaaccagcg

SEQ ID NO: 2667032 - RNA, 13 nt, Escherichia coli CFT073
ccaaucugcaaaa

SEQ ID NO: 2667033 - RNA, 16 nt, Escherichia coli CFT073
ccaaucugcuggaaag

SEQ ID NO: 2667034 - RNA, 16 nt, Escherichia coli CFT073
ccaaucugguugccca

SEQ ID NO: 2667035 - RNA, 18 nt, Escherichia coli CFT073
ccaaucuucacaucauca

SEQ ID NO: 2667036 - RNA, 13 nt, Escherichia coli CFT073
ccaaugauuuuga

SEQ ID NO: 2667037 - RNA, 12 nt, Escherichia coli CFT073
ccaaugccaaug

SEQ ID NO: 2667038 - RNA, 21 nt, Escherichia coli CFT073
ccaaugcgcgccccugauggc

SEQ ID NO: 2667039 - RNA, 18 nt, Escherichia coli CFT073
ccaaugcugcaccccaca

SEQ ID NO: 2667040 - RNA, 21 nt, Escherichia coli CFT073
ccaauggaauagcgaagaaua

SEQ ID NO: 2667041 - RNA, 16 nt, Escherichia coli CFT073
ccaauggcugccgcca

SEQ ID NO: 2667042 - RNA, 20 nt, Escherichia coli CFT073
ccaauguaaccacaggcugg

SEQ ID NO: 2667043 - RNA, 23 nt, Escherichia coli CFT073
ccaauguggaaagccccagccca

SEQ ID NO: 2667044 - RNA, 19 nt, Escherichia coli CFT073
ccaauguggagagcaacau

SEQ ID NO: 2667045 - RNA, 14 nt, Escherichia coli CFT073
ccaauguuuuucuc

SEQ ID NO: 2667046 - RNA, 16 nt, Escherichia coli CFT073
ccaauguuuuucuccu

SEQ ID NO: 2667047 - RNA, 13 nt, Escherichia coli CFT073
ccaauuaaauauc

SEQ ID NO: 2667048 - RNA, 19 nt, Escherichia coli CFT073
ccaauuaauugugcuccuu

SEQ ID NO: 2667049 - RNA, 20 nt, Escherichia coli CFT073
ccaauuacacacaacacauc

SEQ ID NO: 2667050 - RNA, 19 nt, Escherichia coli CFT073
ccaauucaaugccccacag

SEQ ID NO: 2667051 - RNA, 22 nt, Escherichia coli CFT073
ccaauucuccgcgagcgauuuc

SEQ ID NO: 2667052 - RNA, 18 nt, Escherichia coli CFT073
ccaauuuauuuuaucgcu

SEQ ID NO: 2667053 - RNA, 13 nt, Escherichia coli CFT073
ccaauuucugugc

SEQ ID NO: 2667054 - RNA, 13 nt, Escherichia coli CFT073
ccaauuugcgccg

SEQ ID NO: 2667055 - RNA, 13 nt, Escherichia coli CFT073
ccacaaacagaau

SEQ ID NO: 2667056 - RNA, 14 nt, Escherichia coli CFT073
ccacaaacagaaug

SEQ ID NO: 2667057 - RNA, 16 nt, Escherichia coli CFT073
ccacaaaccaccgaag

SEQ ID NO: 2667058 - RNA, 13 nt, Escherichia coli CFT073
ccacaaaccagcc

SEQ ID NO: 2667059 - RNA, 20 nt, Escherichia coli CFT073
ccacaaagcagacaacccac

SEQ ID NO: 2667060 - RNA, 23 nt, Escherichia coli CFT073
ccacaacaaaucguaaucggcuu

SEQ ID NO: 2667061 - RNA, 13 nt, Escherichia coli CFT073
ccacaacagccag

SEQ ID NO: 2667062 - RNA, 19 nt, Escherichia coli CFT073
ccacaacccagacaaauaa

SEQ ID NO: 2667063 - RNA, 14 nt, Escherichia coli CFT073
ccacaaccucagca

SEQ ID NO: 2667064 - RNA, 17 nt, Escherichia coli CFT073
ccacaaccucagcaguu

SEQ ID NO: 2667065 - RNA, 19 nt, Escherichia coli CFT073
ccacaacguacggcuucag

SEQ ID NO: 2667066 - RNA, 20 nt, Escherichia coli CFT073
ccacaacgugggccaggcgu

SEQ ID NO: 2667067 - RNA, 12 nt, Escherichia coli CFT073
ccacaagcacag

SEQ ID NO: 2667068 - RNA, 17 nt, Escherichia coli CFT073
ccacaagcccgccagac

SEQ ID NO: 2667069 - RNA, 19 nt, Escherichia coli CFT073
ccacaagcccgccagacca

SEQ ID NO: 2667070 - RNA, 16 nt, Escherichia coli CFT073
ccacaaucagccagaa

SEQ ID NO: 2667071 - RNA, 18 nt, Escherichia coli CFT073
ccacaaucgcagcgcaag

SEQ ID NO: 2667072 - RNA, 21 nt, Escherichia coli CFT073
ccacaaucgcuucaucgccca

SEQ ID NO: 2667073 - RNA, 20 nt, Escherichia coli CFT073
ccacaaucggcgggaaaaau

SEQ ID NO: 2667074 - RNA, 21 nt, Escherichia coli CFT073
ccacaaucucgcccgcuucau

SEQ ID NO: 2667075 - RNA, 24 nt, Escherichia coli CFT073
ccacaauugcaguaugaaacgccu

SEQ ID NO: 2667076 - RNA, 13 nt, Escherichia coli CFT073
ccacaccaaaaua

SEQ ID NO: 2667077 - RNA, 14 nt, Escherichia coli CFT073
ccacaccaaaauaa

SEQ ID NO: 2667078 - RNA, 16 nt, Escherichia coli CFT073
ccacaccaaaauaacg

SEQ ID NO: 2667079 - RNA, 12 nt, Escherichia coli CFT073
ccacaccaauca

SEQ ID NO: 2667080 - RNA, 13 nt, Escherichia coli CFT073
ccacaccacgcca

SEQ ID NO: 2667081 - RNA, 16 nt, Escherichia coli CFT073
ccacaccagaccagac

SEQ ID NO: 2667082 - RNA, 19 nt, Escherichia coli CFT073
ccacaccaguaaagcccau

SEQ ID NO: 2667083 - RNA, 12 nt, Escherichia coli CFT073
ccacaccaguga

SEQ ID NO: 2667084 - RNA, 14 nt, Escherichia coli CFT073
ccacaccagugacg

SEQ ID NO: 2667085 - RNA, 19 nt, Escherichia coli CFT073
ccacaccagugacgcagcg

SEQ ID NO: 2667086 - RNA, 16 nt, Escherichia coli CFT073
ccacaccauaaugacc

SEQ ID NO: 2667087 - RNA, 15 nt, Escherichia coli CFT073
ccacacccacaucaa

SEQ ID NO: 2667088 - RNA, 14 nt, Escherichia coli CFT073
ccacaccgcccagc

SEQ ID NO: 2667089 - RNA, 19 nt, Escherichia coli CFT073
ccacaccgcccagcgagcu

SEQ ID NO: 2667090 - RNA, 20 nt, Escherichia coli CFT073
ccacaccgcccagcgagcug

SEQ ID NO: 2667091 - RNA, 20 nt, Escherichia coli CFT073
ccacaccgccuaccgccagu

SEQ ID NO: 2667092 - RNA, 14 nt, Escherichia coli CFT073
ccacaccggcgcau

SEQ ID NO: 2667093 - RNA, 20 nt, Escherichia coli CFT073
ccacaccuacgcccgccagu

SEQ ID NO: 2667094 - RNA, 17 nt, Escherichia coli CFT073
ccacaccugccaccagc

SEQ ID NO: 2667095 - RNA, 16 nt, Escherichia coli CFT073
ccacaccugccgggaa

SEQ ID NO: 2667096 - RNA, 18 nt, Escherichia coli CFT073
ccacacucucgcgcagcg

SEQ ID NO: 2667097 - RNA, 18 nt, Escherichia coli CFT073
ccacacugagcaccacac

SEQ ID NO: 2667098 - RNA, 21 nt, Escherichia coli CFT073
ccacacugccuugcgauaucc

SEQ ID NO: 2667099 - RNA, 22 nt, Escherichia coli CFT073
ccacacuucuucagccaguuuu

SEQ ID NO: 2667100 - RNA, 12 nt, Escherichia coli CFT073
ccacagaaacaa

SEQ ID NO: 2667101 - RNA, 19 nt, Escherichia coli CFT073
ccacagacaaacagcucga

SEQ ID NO: 2667102 - RNA, 12 nt, Escherichia coli CFT073
ccacagcaagca

SEQ ID NO: 2667103 - RNA, 16 nt, Escherichia coli CFT073
ccacagcaagcagccg

SEQ ID NO: 2667104 - RNA, 16 nt, Escherichia coli CFT073
ccacagcccgccacaa

SEQ ID NO: 2667105 - RNA, 13 nt, Escherichia coli CFT073
ccacagcgccaga

SEQ ID NO: 2667106 - RNA, 16 nt, Escherichia coli CFT073
ccacaggccggagcca

SEQ ID NO: 2667107 - RNA, 16 nt, Escherichia coli CFT073
ccacaggcuggcguca

SEQ ID NO: 2667108 - RNA, 18 nt, Escherichia coli CFT073
ccacaguugaucagccag

SEQ ID NO: 2667109 - RNA, 22 nt, Escherichia coli CFT073
ccacaguuucagccccaucagc

SEQ ID NO: 2667110 - RNA, 21 nt, Escherichia coli CFT073
ccacaguuucauaucugccag

SEQ ID NO: 2667111 - RNA, 20 nt, Escherichia coli CFT073
ccacaguuugcugcuguuac

SEQ ID NO: 2667112 - RNA, 18 nt, Escherichia coli CFT073
ccacaguuuuacugcagc

SEQ ID NO: 2667113 - RNA, 20 nt, Escherichia coli CFT073
ccacaguuuuacugcagcca

SEQ ID NO: 2667114 - RNA, 18 nt, Escherichia coli CFT073
ccacaguuuuucaccguu

SEQ ID NO: 2667115 - RNA, 23 nt, Escherichia coli CFT073
ccacauauguuuaaccggcagcu

SEQ ID NO: 2667116 - RNA, 14 nt, Escherichia coli CFT073
ccacaucaacggca

SEQ ID NO: 2667117 - RNA, 18 nt, Escherichia coli CFT073
ccacgccuuuuucuccga

SEQ ID NO: 2667118 - RNA, 14 nt, Escherichia coli CFT073
ccacgcgcguugau

SEQ ID NO: 2667119 - RNA, 21 nt, Escherichia coli CFT073
ccacgcgguauggucacugag

SEQ ID NO: 2667120 - RNA, 20 nt, Escherichia coli CFT073
ccacgcuaccuaagcgccag

SEQ ID NO: 2667121 - RNA, 21 nt, Escherichia coli CFT073
ccacgcuauacagcagccauu

SEQ ID NO: 2667122 - RNA, 18 nt, Escherichia coli CFT073
ccacgcucagcaaucgca

SEQ ID NO: 2667123 - RNA, 18 nt, Escherichia coli CFT073
ccacgcugccgcgcagcg

SEQ ID NO: 2667124 - RNA, 21 nt, Escherichia coli CFT073
ccacgcugcgcuugcugccag

SEQ ID NO: 2667125 - RNA, 22 nt, Escherichia coli CFT073
ccacgcuggacgccgaugcgcu

SEQ ID NO: 2667126 - RNA, 19 nt, Escherichia coli CFT073
ccacgcuuugauccgccag

SEQ ID NO: 2667127 - RNA, 14 nt, Escherichia coli CFT073
ccacggaauagaac

SEQ ID NO: 2667128 - RNA, 20 nt, Escherichia coli CFT073
ccacggaauauuucaccggu

SEQ ID NO: 2667129 - RNA, 23 nt, Escherichia coli CFT073
ccacggacauaaagcccgcuuca

SEQ ID NO: 2667130 - RNA, 19 nt, Escherichia coli CFT073
ccacggaguugaccagcuc

SEQ ID NO: 2667131 - RNA, 16 nt, Escherichia coli CFT073
ccacggauuaccguga

SEQ ID NO: 2667132 - RNA, 16 nt, Escherichia coli CFT073
ccacggcaugaaagcg

SEQ ID NO: 2667133 - RNA, 16 nt, Escherichia coli CFT073
ccacggccauauccag

SEQ ID NO: 2667134 - RNA, 20 nt, Escherichia coli CFT073
ccacggcggugucgccagaa

SEQ ID NO: 2667135 - RNA, 19 nt, Escherichia coli CFT073
ccacggcuaccguugcggc

SEQ ID NO: 2667136 - RNA, 16 nt, Escherichia coli CFT073
ccacgggacgcugcac

SEQ ID NO: 2667137 - RNA, 16 nt, Escherichia coli CFT073
ccacgguacgccagag

SEQ ID NO: 2667138 - RNA, 20 nt, Escherichia coli CFT073
ccacgguccgccauuuccag

SEQ ID NO: 2667139 - RNA, 21 nt, Escherichia coli CFT073
ccacggugguuccacucugcc

SEQ ID NO: 2667140 - RNA, 21 nt, Escherichia coli CFT073
ccacgguucuccacucugcca

SEQ ID NO: 2667141 - RNA, 19 nt, Escherichia coli CFT073
ccacgucacaggccaucac

SEQ ID NO: 2667142 - RNA, 20 nt, Escherichia coli CFT073
ccacgucugccacggcagaa

SEQ ID NO: 2667143 - RNA, 14 nt, Escherichia coli CFT073
ccacgugagugugg

SEQ ID NO: 2667144 - RNA, 14 nt, Escherichia coli CFT073
ccacguuagcaaau

SEQ ID NO: 2667145 - RNA, 16 nt, Escherichia coli CFT073
ccacguucaugccgac

SEQ ID NO: 2667146 - RNA, 14 nt, Escherichia coli CFT073
ccacguuccccaga

SEQ ID NO: 2667147 - RNA, 16 nt, Escherichia coli CFT073
ccacguuccccagaug

SEQ ID NO: 2667148 - RNA, 11 nt, Escherichia coli CFT073
ccacguucucu

SEQ ID NO: 2667149 - RNA, 20 nt, Escherichia coli CFT073
ccacguugcaucacccgcug

SEQ ID NO: 2667150 - RNA, 20 nt, Escherichia coli CFT073
ccacuaacccuucgccagca

SEQ ID NO: 2667151 - RNA, 16 nt, Escherichia coli CFT073
ccacuaacugcgcgcu

SEQ ID NO: 2667152 - RNA, 23 nt, Escherichia coli CFT073
ccacuaacuguuucgcggcaaac

SEQ ID NO: 2667153 - RNA, 13 nt, Escherichia coli CFT073
ccacuaauuccug

SEQ ID NO: 2667154 - RNA, 13 nt, Escherichia coli CFT073
ccacuaccagcug

SEQ ID NO: 2667155 - RNA, 13 nt, Escherichia coli CFT073
ccacuacgcugua

SEQ ID NO: 2667156 - RNA, 23 nt, Escherichia coli CFT073
ccacuacgugaucgucuucaacc

SEQ ID NO: 2667157 - RNA, 14 nt, Escherichia coli CFT073
ccacucacacagcu

SEQ ID NO: 2667158 - RNA, 14 nt, Escherichia coli CFT073
ccacucaccgccgu

SEQ ID NO: 2667159 - RNA, 17 nt, Escherichia coli CFT073
ccacucaccgccguuac

SEQ ID NO: 2667160 - RNA, 22 nt, Escherichia coli CFT073
ccacucacuaccagugccagaa

SEQ ID NO: 2667161 - RNA, 24 nt, Escherichia coli CFT073
ccacuccgguaauaucgcgcagaa

SEQ ID NO: 2667162 - RNA, 23 nt, Escherichia coli CFT073
ccacucggcacauagacggugac

SEQ ID NO: 2667163 - RNA, 19 nt, Escherichia coli CFT073
ccacucgggagagccccag

SEQ ID NO: 2667164 - RNA, 14 nt, Escherichia coli CFT073
ccacucuuaacgcc

SEQ ID NO: 2667165 - RNA, 22 nt, Escherichia coli CFT073
ccacucuucccuauccggaaac

SEQ ID NO: 2667166 - RNA, 14 nt, Escherichia coli CFT073
ccacugaauaaagu

SEQ ID NO: 2667167 - RNA, 23 nt, Escherichia coli CFT073
ccacugaauaacauuaugucugu

SEQ ID NO: 2667168 - RNA, 23 nt, Escherichia coli CFT073
ccacugacgggaaacucugcugg

SEQ ID NO: 2667169 - RNA, 16 nt, Escherichia coli CFT073
ccacugccuuuaucaa

SEQ ID NO: 2667170 - RNA, 18 nt, Escherichia coli CFT073
ccacugcgacaccagcau

SEQ ID NO: 2667171 - RNA, 19 nt, Escherichia coli CFT073
ccacugcgacaccagcaug

SEQ ID NO: 2667172 - RNA, 22 nt, Escherichia coli CFT073
ccacugcgacaccagcauguuc

SEQ ID NO: 2667173 - RNA, 22 nt, Escherichia coli CFT073
ccacugcgccaacgucugccug

SEQ ID NO: 2667174 - RNA, 14 nt, Escherichia coli CFT073
ccacugcgccgcuc

SEQ ID NO: 2667175 - RNA, 21 nt, Escherichia coli CFT073
ccacugcgccgcucggugcgc

SEQ ID NO: 2667176 - RNA, 17 nt, Escherichia coli CFT073
ccacuggauguugcauu

SEQ ID NO: 2667177 - RNA, 16 nt, Escherichia coli CFT073
ccacuggcaauaauau

SEQ ID NO: 2667178 - RNA, 19 nt, Escherichia coli CFT073
ccacuggcuccaccgcuac

SEQ ID NO: 2667179 - RNA, 21 nt, Escherichia coli CFT073
ccacugugaguggcuccaugu

SEQ ID NO: 2667180 - RNA, 12 nt, Escherichia coli CFT073
ccacuguuucaa

SEQ ID NO: 2667181 - RNA, 20 nt, Escherichia coli CFT073
ccacuuaacguuaccuuuaa

SEQ ID NO: 2667182 - RNA, 14 nt, Escherichia coli CFT073
ccacuuacauuccg

SEQ ID NO: 2667183 - RNA, 18 nt, Escherichia coli CFT073
ccacuucacgaugcagcg

SEQ ID NO: 2667184 - RNA, 13 nt, Escherichia coli CFT073
ccacuucauacuc

SEQ ID NO: 2667185 - RNA, 13 nt, Escherichia coli CFT073
ccacuucaugccc

SEQ ID NO: 2667186 - RNA, 17 nt, Escherichia coli CFT073
ccacuuccgacuucagu

SEQ ID NO: 2667187 - RNA, 12 nt, Escherichia coli CFT073
ccacuuccgcgu

SEQ ID NO: 2667188 - RNA, 15 nt, Escherichia coli CFT073
ccacuucuggcggcg

SEQ ID NO: 2667189 - RNA, 22 nt, Escherichia coli CFT073
ccacuucuguuuguagaugccc

SEQ ID NO: 2667190 - RNA, 20 nt, Escherichia coli CFT073
ccacuucuuucgcccagcgu

SEQ ID NO: 2667191 - RNA, 13 nt, Escherichia coli CFT073
ccacuugcagcuc

SEQ ID NO: 2667192 - RNA, 14 nt, Escherichia coli CFT073
ccacuugcagcuca

SEQ ID NO: 2667193 - RNA, 15 nt, Escherichia coli CFT073
ccacuugcagcucau

SEQ ID NO: 2667194 - RNA, 18 nt, Escherichia coli CFT073
ccacuuuacgcaaaauau

SEQ ID NO: 2667195 - RNA, 22 nt, Escherichia coli CFT073
ccacuuuacgggcaaucuccug

SEQ ID NO: 2667196 - RNA, 19 nt, Escherichia coli CFT073
ccacuuucacgccgccaaa

SEQ ID NO: 2667197 - RNA, 16 nt, Escherichia coli CFT073
ccacuuugcgcuccug

SEQ ID NO: 2667198 - RNA, 22 nt, Escherichia coli CFT073
ccacuuuggugaaugccugauc

SEQ ID NO: 2667199 - RNA, 22 nt, Escherichia coli CFT073
ccacuuugucguaagcgccaaa

SEQ ID NO: 2667200 - RNA, 12 nt, Escherichia coli CFT073
ccacuuuuaaau

SEQ ID NO: 2667201 - RNA, 18 nt, Escherichia coli CFT073
ccacuuuuaaaucgccaa

SEQ ID NO: 2667202 - RNA, 22 nt, Escherichia coli CFT073
ccacuuuucaguuaccagccgg

SEQ ID NO: 2667203 - RNA, 20 nt, Escherichia coli CFT073
ccacuuuucggcaaccgcau

SEQ ID NO: 2667204 - RNA, 17 nt, Escherichia coli CFT073
ccagaaaaagaaugcgc

SEQ ID NO: 2667205 - RNA, 18 nt, Escherichia coli CFT073
ccagaaaaccuggcgcag

SEQ ID NO: 2667206 - RNA, 13 nt, Escherichia coli CFT073
ccagaaaauacuc

SEQ ID NO: 2667207 - RNA, 17 nt, Escherichia coli CFT073
ccagaaaauacucagca

SEQ ID NO: 2667208 - RNA, 15 nt, Escherichia coli CFT073
ccagaaacaauaagu

SEQ ID NO: 2667209 - RNA, 15 nt, Escherichia coli CFT073
ccagaaacaucccca

SEQ ID NO: 2667210 - RNA, 20 nt, Escherichia coli CFT073
ccagaaacauccccagcguc

SEQ ID NO: 2667211 - RNA, 22 nt, Escherichia coli CFT073
ccagaaaccaguuuuugcgccc

SEQ ID NO: 2667212 - RNA, 13 nt, Escherichia coli CFT073
ccagaaaguggca

SEQ ID NO: 2667213 - RNA, 11 nt, Escherichia coli CFT073
ccagaaaucag

SEQ ID NO: 2667214 - RNA, 16 nt, Escherichia coli CFT073
ccagaaaucagcagcu

SEQ ID NO: 2667215 - RNA, 17 nt, Escherichia coli CFT073
ccagaaaucagcagcuu

SEQ ID NO: 2667216 - RNA, 17 nt, Escherichia coli CFT073
ccagaaaucggccuucc

SEQ ID NO: 2667217 - RNA, 18 nt, Escherichia coli CFT073
ccagaaaucggccuucca

SEQ ID NO: 2667218 - RNA, 20 nt, Escherichia coli CFT073
ccagaaaucggccuuccaua

SEQ ID NO: 2667219 - RNA, 18 nt, Escherichia coli CFT073
ccagaacacgcucccagc

SEQ ID NO: 2667220 - RNA, 15 nt, Escherichia coli CFT073
ccagaaccagcaacc

SEQ ID NO: 2667221 - RNA, 16 nt, Escherichia coli CFT073
ccagaaccagcaacca

SEQ ID NO: 2667222 - RNA, 21 nt, Escherichia coli CFT073
ccagaaccugaggcaauaaau

SEQ ID NO: 2667223 - RNA, 18 nt, Escherichia coli CFT073
ccagaacgcugccuugcu

SEQ ID NO: 2667224 - RNA, 20 nt, Escherichia coli CFT073
ccagaacgcugccuugcucu

SEQ ID NO: 2667225 - RNA, 22 nt, Escherichia coli CFT073
ccagauuaaucagcagauaucc

SEQ ID NO: 2667226 - RNA, 14 nt, Escherichia coli CFT073
ccagauuaccgccu

SEQ ID NO: 2667227 - RNA, 22 nt, Escherichia coli CFT073
ccagauuaccguugcggcucca

SEQ ID NO: 2667228 - RNA, 13 nt, Escherichia coli CFT073
ccagauugaacuc

SEQ ID NO: 2667229 - RNA, 17 nt, Escherichia coli CFT073
ccagauuguacuuucca

SEQ ID NO: 2667230 - RNA, 21 nt, Escherichia coli CFT073
ccagauuguacuuuccagcca

SEQ ID NO: 2667231 - RNA, 17 nt, Escherichia coli CFT073
ccagcaaaaucaccauc

SEQ ID NO: 2667232 - RNA, 14 nt, Escherichia coli CFT073
ccagcaaacgcacu

SEQ ID NO: 2667233 - RNA, 13 nt, Escherichia coli CFT073
ccagcaaacuggc

SEQ ID NO: 2667234 - RNA, 14 nt, Escherichia coli CFT073
ccagcaaauccagc

SEQ ID NO: 2667235 - RNA, 13 nt, Escherichia coli CFT073
ccagcaacaacag

SEQ ID NO: 2667236 - RNA, 14 nt, Escherichia coli CFT073
ccagcaacaacagc

SEQ ID NO: 2667237 - RNA, 17 nt, Escherichia coli CFT073
ccagcaacaacagcgcg

SEQ ID NO: 2667238 - RNA, 17 nt, Escherichia coli CFT073
ccagcaaccaaugccgc

SEQ ID NO: 2667239 - RNA, 20 nt, Escherichia coli CFT073
ccagcaacgcugauuucucu

SEQ ID NO: 2667240 - RNA, 19 nt, Escherichia coli CFT073
ccagcaacugauacaccuu

SEQ ID NO: 2667241 - RNA, 16 nt, Escherichia coli CFT073
ccagcaagagcaaaua

SEQ ID NO: 2667242 - RNA, 23 nt, Escherichia coli CFT073
ccagcaagagcaaauaaaacauc

SEQ ID NO: 2667243 - RNA, 14 nt, Escherichia coli CFT073
ccagcaagcgcacc

SEQ ID NO: 2667244 - RNA, 18 nt, Escherichia coli CFT073
ccagcaagcgcaccgauu

SEQ ID NO: 2667245 - RNA, 14 nt, Escherichia coli CFT073
ccagcaauaacuaa

SEQ ID NO: 2667246 - RNA, 23 nt, Escherichia coli CFT073
ccagcaauaagccaguccagaaa

SEQ ID NO: 2667247 - RNA, 19 nt, Escherichia coli CFT073
ccagcaauccccagacaaa

SEQ ID NO: 2667248 - RNA, 13 nt, Escherichia coli CFT073
ccagcaaugccag

SEQ ID NO: 2667249 - RNA, 23 nt, Escherichia coli CFT073
ccagcaauuuacguuuuucuucc

SEQ ID NO: 2667250 - RNA, 16 nt, Escherichia coli CFT073
ccagcaauuugcgcuc

SEQ ID NO: 2667251 - RNA, 15 nt, Escherichia coli CFT073
ccagcacaaaguggc

SEQ ID NO: 2667252 - RNA, 21 nt, Escherichia coli CFT073
ccagcacaccgucagccagca

SEQ ID NO: 2667253 - RNA, 21 nt, Escherichia coli CFT073
ccagcacagaucgcacuuaau

SEQ ID NO: 2667254 - RNA, 20 nt, Escherichia coli CFT073
ccagcacagccagccuccaa

SEQ ID NO: 2667255 - RNA, 9 nt, Escherichia coli CFT073
ccagcacau

SEQ ID NO: 2667256 - RNA, 16 nt, Escherichia coli CFT073
ccagcacaucucaaau

SEQ ID NO: 2667257 - RNA, 15 nt, Escherichia coli CFT073
ccagcaccaacaaag

SEQ ID NO: 2667258 - RNA, 22 nt, Escherichia coli CFT073
ccagcaccacuuuacgggcaau

SEQ ID NO: 2667259 - RNA, 13 nt, Escherichia coli CFT073
ccagcaccagcaa

SEQ ID NO: 2667260 - RNA, 15 nt, Escherichia coli CFT073
ccagcaccagcaaca

SEQ ID NO: 2667261 - RNA, 12 nt, Escherichia coli CFT073
ccagcaccagcu

SEQ ID NO: 2667262 - RNA, 13 nt, Escherichia coli CFT073
ccagcaccaguac

SEQ ID NO: 2667263 - RNA, 23 nt, Escherichia coli CFT073
ccagcaccgcagagaucgccccg

SEQ ID NO: 2667264 - RNA, 23 nt, Escherichia coli CFT073
ccagcaccugaauccgcgauuau

SEQ ID NO: 2667265 - RNA, 17 nt, Escherichia coli CFT073
ccagcacgaccgccauu

SEQ ID NO: 2667266 - RNA, 18 nt, Escherichia coli CFT073
ccagcacggauaccgcac

SEQ ID NO: 2667267 - RNA, 16 nt, Escherichia coli CFT073
ccagcacguugugccc

SEQ ID NO: 2667268 - RNA, 15 nt, Escherichia coli CFT073
ccagcacuaccgccc

SEQ ID NO: 2667269 - RNA, 13 nt, Escherichia coli CFT073
ccagcacugccgc

SEQ ID NO: 2667270 - RNA, 14 nt, Escherichia coli CFT073
ccagcacugccgca

SEQ ID NO: 2667271 - RNA, 16 nt, Escherichia coli CFT073
ccagcacuuccugaau

SEQ ID NO: 2667272 - RNA, 23 nt, Escherichia coli CFT073
ccagcacuuuucgcacugcaggc

SEQ ID NO: 2667273 - RNA, 22 nt, Escherichia coli CFT073
ccagcagaaugacaucaucgcc

SEQ ID NO: 2667274 - RNA, 14 nt, Escherichia coli CFT073
ccagcagaccagca

SEQ ID NO: 2667275 - RNA, 13 nt, Escherichia coli CFT073
ccagcagagcaaa

SEQ ID NO: 2667276 - RNA, 12 nt, Escherichia coli CFT073
ccagcagcaacc

SEQ ID NO: 2667277 - RNA, 15 nt, Escherichia coli CFT073
ccagcagcacagcca

SEQ ID NO: 2667278 - RNA, 17 nt, Escherichia coli CFT073
ccagcagcagcgaauaa

SEQ ID NO: 2667279 - RNA, 19 nt, Escherichia coli CFT073
ccagcagcagcgaauaauu

SEQ ID NO: 2667280 - RNA, 22 nt, Escherichia coli CFT073
ccagcagcagcgaauaauucag

SEQ ID NO: 2667281 - RNA, 13 nt, Escherichia coli CFT073
ccagcagcagcgg

SEQ ID NO: 2667282 - RNA, 15 nt, Escherichia coli CFT073
ccagcagcaucacca

SEQ ID NO: 2667283 - RNA, 19 nt, Escherichia coli CFT073
ccagcagcccgagcaacag

SEQ ID NO: 2667284 - RNA, 17 nt, Escherichia coli CFT073
ccagcagcccuugcuuc

SEQ ID NO: 2667285 - RNA, 18 nt, Escherichia coli CFT073
ccagcagcgacucacgaa

SEQ ID NO: 2667286 - RNA, 14 nt, Escherichia coli CFT073
ccagcagcggcaga

SEQ ID NO: 2667287 - RNA, 15 nt, Escherichia coli CFT073
ccagcagcggcagau

SEQ ID NO: 2667288 - RNA, 13 nt, Escherichia coli CFT073
ccagcagcugcuc

SEQ ID NO: 2667289 - RNA, 14 nt, Escherichia coli CFT073
ccagcagcugcucc

SEQ ID NO: 2667290 - RNA, 16 nt, Escherichia coli CFT073
ccagcagcugcuccca

SEQ ID NO: 2667291 - RNA, 18 nt, Escherichia coli CFT073
ccagcaggaucaauacca

SEQ ID NO: 2667292 - RNA, 13 nt, Escherichia coli CFT073
ccagcagggcaau

SEQ ID NO: 2667293 - RNA, 20 nt, Escherichia coli CFT073
ccagcaggucgauaauuuuc

SEQ ID NO: 2667294 - RNA, 16 nt, Escherichia coli CFT073
ccagcaguaaaccacc

SEQ ID NO: 2667295 - RNA, 18 nt, Escherichia coli CFT073
ccagcaguaaaccaccca

SEQ ID NO: 2667296 - RNA, 23 nt, Escherichia coli CFT073
ccagcaguaaaccacccaccagc

SEQ ID NO: 2667297 - RNA, 20 nt, Escherichia coli CFT073
ccagcaguaauuuugcucac

SEQ ID NO: 2667298 - RNA, 14 nt, Escherichia coli CFT073
ccagcagucgacca

SEQ ID NO: 2667299 - RNA, 12 nt, Escherichia coli CFT073
ccagcaguguuu

SEQ ID NO: 2667300 - RNA, 17 nt, Escherichia coli CFT073
ccagcaguucaauccac

SEQ ID NO: 2667301 - RNA, 22 nt, Escherichia coli CFT073
ccagcaguucaauccacugcau

SEQ ID NO: 2667302 - RNA, 16 nt, Escherichia coli CFT073
ccagcaguugcugacu

SEQ ID NO: 2667303 - RNA, 17 nt, Escherichia coli CFT073
ccagcauaacguggcgc

SEQ ID NO: 2667304 - RNA, 17 nt, Escherichia coli CFT073
ccagcauaaucaccauc

SEQ ID NO: 2667305 - RNA, 23 nt, Escherichia coli CFT073
ccagcauaguacgggcaauuuca

SEQ ID NO: 2667306 - RNA, 22 nt, Escherichia coli CFT073
ccagcauauguuuacgcuggcg

SEQ ID NO: 2667307 - RNA, 17 nt, Escherichia coli CFT073
ccagcaucaacaacaau

SEQ ID NO: 2667308 - RNA, 19 nt, Escherichia coli CFT073
ccagcaucacaucaaaucc

SEQ ID NO: 2667309 - RNA, 17 nt, Escherichia coli CFT073
ccagcaucauaaauggg

SEQ ID NO: 2667310 - RNA, 22 nt, Escherichia coli CFT073
ccagcaucgaaaaugccacugc

SEQ ID NO: 2667311 - RNA, 23 nt, Escherichia coli CFT073
ccagcaucgaaaaugccacugcg

SEQ ID NO: 2667312 - RNA, 13 nt, Escherichia coli CFT073
ccagcaucgacca

SEQ ID NO: 2667313 - RNA, 14 nt, Escherichia coli CFT073
ccagcaucgcauca

SEQ ID NO: 2667314 - RNA, 16 nt, Escherichia coli CFT073
ccagcaucgcaucagg

SEQ ID NO: 2667315 - RNA, 14 nt, Escherichia coli CFT073
ccagcaucgcaucc

SEQ ID NO: 2667316 - RNA, 18 nt, Escherichia coli CFT073
ccagcaucgccacggccu

SEQ ID NO: 2667317 - RNA, 23 nt, Escherichia coli CFT073
ccagcaucucaaucgcacccgcc

SEQ ID NO: 2667318 - RNA, 12 nt, Escherichia coli CFT073
ccagcaucuccu

SEQ ID NO: 2667319 - RNA, 17 nt, Escherichia coli CFT073
ccagcaucuccugcaac

SEQ ID NO: 2667320 - RNA, 19 nt, Escherichia coli CFT073
ccagcaucuccugcaacag

SEQ ID NO: 2667321 - RNA, 15 nt, Escherichia coli CFT073
ccagcaucuguucuu

SEQ ID NO: 2667322 - RNA, 22 nt, Escherichia coli CFT073
ccagcaugaugcucucccaaau

SEQ ID NO: 2667323 - RNA, 15 nt, Escherichia coli CFT073
ccagcaugccugugg

SEQ ID NO: 2667324 - RNA, 23 nt, Escherichia coli CFT073
ccagcaugugguuaccaucaacc

SEQ ID NO: 2667325 - RNA, 18 nt, Escherichia coli CFT073
ccagcauguugucccagu

SEQ ID NO: 2667326 - RNA, 20 nt, Escherichia coli CFT073
ccagcauucccgccaccauu

SEQ ID NO: 2667327 - RNA, 21 nt, Escherichia coli CFT073
ccagcauugucaggaucacca

SEQ ID NO: 2667328 - RNA, 23 nt, Escherichia coli CFT073
ccagccaaauaaaaucccgguga

SEQ ID NO: 2667329 - RNA, 18 nt, Escherichia coli CFT073
ccagccaacaaucgcugc

SEQ ID NO: 2667330 - RNA, 14 nt, Escherichia coli CFT073
ccagccacaaacca

SEQ ID NO: 2667331 - RNA, 15 nt, Escherichia coli CFT073
ccagccacaaaccau

SEQ ID NO: 2667332 - RNA, 14 nt, Escherichia coli CFT073
ccagccacaggccg

SEQ ID NO: 2667333 - RNA, 14 nt, Escherichia coli CFT073
ccagccacugcgcc

SEQ ID NO: 2667334 - RNA, 12 nt, Escherichia coli CFT073
ccagcuaccaga

SEQ ID NO: 2667335 - RNA, 14 nt, Escherichia coli CFT073
ccagcucaaccaga

SEQ ID NO: 2667336 - RNA, 21 nt, Escherichia coli CFT073
ccagcuccgccgguugccccg

SEQ ID NO: 2667337 - RNA, 13 nt, Escherichia coli CFT073
ccagcuccgggcu

SEQ ID NO: 2667338 - RNA, 22 nt, Escherichia coli CFT073
ccagcuccgggcugguuuucag

SEQ ID NO: 2667339 - RNA, 16 nt, Escherichia coli CFT073
ccagcuccguccagcc

SEQ ID NO: 2667340 - RNA, 16 nt, Escherichia coli CFT073
ccagcucgugcagaac

SEQ ID NO: 2667341 - RNA, 18 nt, Escherichia coli CFT073
ccagcucugcgcccugca

SEQ ID NO: 2667342 - RNA, 20 nt, Escherichia coli CFT073
ccagcucugcgcccugcauc

SEQ ID NO: 2667343 - RNA, 19 nt, Escherichia coli CFT073
ccagcucuuccgacuugcu

SEQ ID NO: 2667344 - RNA, 12 nt, Escherichia coli CFT073
ccagcucuucug

SEQ ID NO: 2667345 - RNA, 11 nt, Escherichia coli CFT073
ccagcugccga

SEQ ID NO: 2667346 - RNA, 14 nt, Escherichia coli CFT073
ccagcugccugcca

SEQ ID NO: 2667347 - RNA, 19 nt, Escherichia coli CFT073
ccagcugcggugguaucga

SEQ ID NO: 2667348 - RNA, 15 nt, Escherichia coli CFT073
ccagcuguaccagca

SEQ ID NO: 2667349 - RNA, 16 nt, Escherichia coli CFT073
ccagcuguaccagcaa

SEQ ID NO: 2667350 - RNA, 22 nt, Escherichia coli CFT073
ccagcuguaccagcaacugaug

SEQ ID NO: 2667351 - RNA, 21 nt, Escherichia coli CFT073
ccagcuguccgauuuguucuc

SEQ ID NO: 2667352 - RNA, 16 nt, Escherichia coli CFT073
ccagcuguucgcgcac

SEQ ID NO: 2667353 - RNA, 22 nt, Escherichia coli CFT073
ccagcuuaauucuguccuccau

SEQ ID NO: 2667354 - RNA, 20 nt, Escherichia coli CFT073
ccagcuucaucaucgcagau

SEQ ID NO: 2667355 - RNA, 20 nt, Escherichia coli CFT073
ccagcuuucgcuuagagccc

SEQ ID NO: 2667356 - RNA, 18 nt, Escherichia coli CFT073
ccagcuuuuguugucacc

SEQ ID NO: 2667357 - RNA, 21 nt, Escherichia coli CFT073
ccaggaaaaagaucagcggcg

SEQ ID NO: 2667358 - RNA, 17 nt, Escherichia coli CFT073
ccaggaacaacgacagg

SEQ ID NO: 2667359 - RNA, 14 nt, Escherichia coli CFT073
ccaggaacagugaa

SEQ ID NO: 2667360 - RNA, 16 nt, Escherichia coli CFT073
ccaggaaccugugaca

SEQ ID NO: 2667361 - RNA, 22 nt, Escherichia coli CFT073
ccaggaaccugugacagcagcg

SEQ ID NO: 2667362 - RNA, 21 nt, Escherichia coli CFT073
ccaggaacgggauugccagca

SEQ ID NO: 2667363 - RNA, 22 nt, Escherichia coli CFT073
ccaggaacucagcgugccauca

SEQ ID NO: 2667364 - RNA, 16 nt, Escherichia coli CFT073
ccaggaagcccgccca

SEQ ID NO: 2667365 - RNA, 16 nt, Escherichia coli CFT073
ccaggaccgcugaaau

SEQ ID NO: 2667366 - RNA, 21 nt, Escherichia coli CFT073
ccaggacuucaucacgaugca

SEQ ID NO: 2667367 - RNA, 15 nt, Escherichia coli CFT073
ccaggagggguuuuu

SEQ ID NO: 2667368 - RNA, 15 nt, Escherichia coli CFT073
ccaggauagaaaacg

SEQ ID NO: 2667369 - RNA, 23 nt, Escherichia coli CFT073
ccaggaucguucgcugccuuuga

SEQ ID NO: 2667370 - RNA, 19 nt, Escherichia coli CFT073
ccaggaugauauucaucgc

SEQ ID NO: 2667371 - RNA, 13 nt, Escherichia coli CFT073
ccaggcaaaccag

SEQ ID NO: 2667372 - RNA, 15 nt, Escherichia coli CFT073
ccaggcaaauucugu

SEQ ID NO: 2667373 - RNA, 20 nt, Escherichia coli CFT073
ccaggcaaauucuguuucau

SEQ ID NO: 2667374 - RNA, 16 nt, Escherichia coli CFT073
ccaggcacaccagcaa

SEQ ID NO: 2667375 - RNA, 13 nt, Escherichia coli CFT073
ccaggcagccaua

SEQ ID NO: 2667376 - RNA, 17 nt, Escherichia coli CFT073
ccaggcagcgauuaacu

SEQ ID NO: 2667377 - RNA, 13 nt, Escherichia coli CFT073
ccaggcaguuuau

SEQ ID NO: 2667378 - RNA, 20 nt, Escherichia coli CFT073
ccaggcaguuuauccagcca

SEQ ID NO: 2667379 - RNA, 17 nt, Escherichia coli CFT073
ccaggcauagaaaaaga

SEQ ID NO: 2667380 - RNA, 17 nt, Escherichia coli CFT073
ccaggcaucagauuguu

SEQ ID NO: 2667381 - RNA, 20 nt, Escherichia coli CFT073
ccaggccacucaugccuuuc

SEQ ID NO: 2667382 - RNA, 17 nt, Escherichia coli CFT073
ccaggccaucagcagcg

SEQ ID NO: 2667383 - RNA, 14 nt, Escherichia coli CFT073
ccaggcccaauaau

SEQ ID NO: 2667384 - RNA, 18 nt, Escherichia coli CFT073
ccaggccggugaugaugc

SEQ ID NO: 2667385 - RNA, 14 nt, Escherichia coli CFT073
ccaggcgcaccagc

SEQ ID NO: 2667386 - RNA, 19 nt, Escherichia coli CFT073
ccaggcgcugcuggagcag

SEQ ID NO: 2667387 - RNA, 21 nt, Escherichia coli CFT073
ccaggcgucuggcccaugcca

SEQ ID NO: 2667388 - RNA, 16 nt, Escherichia coli CFT073
ccaggcuacgccagau

SEQ ID NO: 2667389 - RNA, 23 nt, Escherichia coli CFT073
ccaggcuacgccagauccgccau

SEQ ID NO: 2667390 - RNA, 13 nt, Escherichia coli CFT073
ccaggcuccagau

SEQ ID NO: 2667391 - RNA, 16 nt, Escherichia coli CFT073
ccaggcuggucgcgcg

SEQ ID NO: 2667392 - RNA, 14 nt, Escherichia coli CFT073
ccaggcuuacacuu

SEQ ID NO: 2667393 - RNA, 13 nt, Escherichia coli CFT073
ccaggcuucauac

SEQ ID NO: 2667394 - RNA, 20 nt, Escherichia coli CFT073
ccaggcuuuaccuucagacu

SEQ ID NO: 2667395 - RNA, 13 nt, Escherichia coli CFT073
ccaggcuuuccgu

SEQ ID NO: 2667396 - RNA, 16 nt, Escherichia coli CFT073
ccagggcuuuauucac

SEQ ID NO: 2667397 - RNA, 20 nt, Escherichia coli CFT073
ccagggcuuuuuuauuucau

SEQ ID NO: 2667398 - RNA, 18 nt, Escherichia coli CFT073
ccagggucaguuucaccu

SEQ ID NO: 2667399 - RNA, 14 nt, Escherichia coli CFT073
ccagguaaacaccu

SEQ ID NO: 2667400 - RNA, 23 nt, Escherichia coli CFT073
ccagguaaagaccauaaugaugg

SEQ ID NO: 2667401 - RNA, 15 nt, Escherichia coli CFT073
ccagguaacgaagau

SEQ ID NO: 2667402 - RNA, 18 nt, Escherichia coli CFT073
ccagguacgcaggcggcu

SEQ ID NO: 2667403 - RNA, 22 nt, Escherichia coli CFT073
ccagguagcaaacaaaaaguac

SEQ ID NO: 2667404 - RNA, 18 nt, Escherichia coli CFT073
ccagguagcguuucaccu

SEQ ID NO: 2667405 - RNA, 21 nt, Escherichia coli CFT073
ccagguauugagggaagcggg

SEQ ID NO: 2667406 - RNA, 13 nt, Escherichia coli CFT073
ccaggucaauccc

SEQ ID NO: 2667407 - RNA, 15 nt, Escherichia coli CFT073
ccaggucaaucccag

SEQ ID NO: 2667408 - RNA, 19 nt, Escherichia coli CFT073
ccaggucagagagccagcc

SEQ ID NO: 2667409 - RNA, 18 nt, Escherichia coli CFT073
ccaggucgcuugccgcca

SEQ ID NO: 2667410 - RNA, 16 nt, Escherichia coli CFT073
ccaggugaaaaauaaa

SEQ ID NO: 2667411 - RNA, 20 nt, Escherichia coli CFT073
ccaggugaaauccggcuucu

SEQ ID NO: 2667412 - RNA, 20 nt, Escherichia coli CFT073
ccaggugcagcccauaagca

SEQ ID NO: 2667413 - RNA, 14 nt, Escherichia coli CFT073
ccaggugccggucu

SEQ ID NO: 2667414 - RNA, 18 nt, Escherichia coli CFT073
ccagguggauaaggcaac

SEQ ID NO: 2667415 - RNA, 13 nt, Escherichia coli CFT073
ccagguggcagac

SEQ ID NO: 2667416 - RNA, 22 nt, Escherichia coli CFT073
ccagguguuuaaccaacacaau

SEQ ID NO: 2667417 - RNA, 21 nt, Escherichia coli CFT073
ccagguuaacccacagcgcac

SEQ ID NO: 2667418 - RNA, 17 nt, Escherichia coli CFT073
ccagguuaacgcaggcg

SEQ ID NO: 2667419 - RNA, 16 nt, Escherichia coli CFT073
ccagguuaugguugaa

SEQ ID NO: 2667420 - RNA, 17 nt, Escherichia coli CFT073
ccagguuucggaugggc

SEQ ID NO: 2667421 - RNA, 17 nt, Escherichia coli CFT073
ccagguuugaccccggc

SEQ ID NO: 2667422 - RNA, 19 nt, Escherichia coli CFT073
ccagguuuucuuucaccuc

SEQ ID NO: 2667423 - RNA, 20 nt, Escherichia coli CFT073
ccagguuuucuuucaccucu

SEQ ID NO: 2667424 - RNA, 17 nt, Escherichia coli CFT073
ccaguaaaaagcauuac

SEQ ID NO: 2667425 - RNA, 21 nt, Escherichia coli CFT073
ccaguaaaaggauuggguuaa

SEQ ID NO: 2667426 - RNA, 23 nt, Escherichia coli CFT073
ccaguaaacacaccacagcaccc

SEQ ID NO: 2667427 - RNA, 18 nt, Escherichia coli CFT073
ccaguaaaccaaucaauu

SEQ ID NO: 2667428 - RNA, 19 nt, Escherichia coli CFT073
ccaguaaaccaauuucugu

SEQ ID NO: 2667429 - RNA, 18 nt, Escherichia coli CFT073
ccaguaaacugacccgcu

SEQ ID NO: 2667430 - RNA, 23 nt, Escherichia coli CFT073
ccaguaaauuguugccggagaaa

SEQ ID NO: 2667431 - RNA, 22 nt, Escherichia coli CFT073
ccaguaacuuccccuuucacau

SEQ ID NO: 2667432 - RNA, 19 nt, Escherichia coli CFT073
ccaguaagcaguccagcgc

SEQ ID NO: 2667433 - RNA, 15 nt, Escherichia coli CFT073
ccaguaagccauuga

SEQ ID NO: 2667434 - RNA, 13 nt, Escherichia coli CFT073
ccaguaauaaaga

SEQ ID NO: 2667435 - RNA, 14 nt, Escherichia coli CFT073
ccaguaauaaagac

SEQ ID NO: 2667436 - RNA, 19 nt, Escherichia coli CFT073
ccaguaaucagcgcggaac

SEQ ID NO: 2667437 - RNA, 12 nt, Escherichia coli CFT073
ccaguaaugcgc

SEQ ID NO: 2667438 - RNA, 16 nt, Escherichia coli CFT073
ccaguacaacgccgau

SEQ ID NO: 2667439 - RNA, 12 nt, Escherichia coli CFT073
ccaguaccagca

SEQ ID NO: 2667440 - RNA, 17 nt, Escherichia coli CFT073
ccaguaccgccaccacc

SEQ ID NO: 2667441 - RNA, 19 nt, Escherichia coli CFT073
ccaguaccgccagugcagc

SEQ ID NO: 2667442 - RNA, 13 nt, Escherichia coli CFT073
ccauaaccgccag

SEQ ID NO: 2667443 - RNA, 16 nt, Escherichia coli CFT073
ccauaaccgccagcac

SEQ ID NO: 2667444 - RNA, 18 nt, Escherichia coli CFT073
ccauaaccgccagcacag

SEQ ID NO: 2667445 - RNA, 22 nt, Escherichia coli CFT073
ccauaaccgccagcacagccag

SEQ ID NO: 2667446 - RNA, 12 nt, Escherichia coli CFT073
ccauaacggcug

SEQ ID NO: 2667447 - RNA, 16 nt, Escherichia coli CFT073
ccauaauacugacaaa

SEQ ID NO: 2667448 - RNA, 12 nt, Escherichia coli CFT073
ccauaaucacgc

SEQ ID NO: 2667449 - RNA, 21 nt, Escherichia coli CFT073
ccauaaucacucuuccccgcu

SEQ ID NO: 2667450 - RNA, 13 nt, Escherichia coli CFT073
ccauaaucagcgc

SEQ ID NO: 2667451 - RNA, 18 nt, Escherichia coli CFT073
ccauaauccaugccaacg

SEQ ID NO: 2667452 - RNA, 14 nt, Escherichia coli CFT073
ccauaauccggguu

SEQ ID NO: 2667453 - RNA, 15 nt, Escherichia coli CFT073
ccauaaucgacuccc

SEQ ID NO: 2667454 - RNA, 15 nt, Escherichia coli CFT073
ccauaaugccccagc

SEQ ID NO: 2667455 - RNA, 18 nt, Escherichia coli CFT073
ccauaaugccccagcgca

SEQ ID NO: 2667456 - RNA, 19 nt, Escherichia coli CFT073
ccauaaugccccagcgcac

SEQ ID NO: 2667457 - RNA, 20 nt, Escherichia coli CFT073
ccauaaugccccagcgcacu

SEQ ID NO: 2667458 - RNA, 15 nt, Escherichia coli CFT073
ccauaauggacguuu

SEQ ID NO: 2667459 - RNA, 13 nt, Escherichia coli CFT073
ccauacagaacag

SEQ ID NO: 2667460 - RNA, 15 nt, Escherichia coli CFT073
ccauacagcgucggu

SEQ ID NO: 2667461 - RNA, 23 nt, Escherichia coli CFT073
ccauacagcgucgguuccugaug

SEQ ID NO: 2667462 - RNA, 16 nt, Escherichia coli CFT073
ccauacaguguccaac

SEQ ID NO: 2667463 - RNA, 19 nt, Escherichia coli CFT073
ccauacauugcggaccagc

SEQ ID NO: 2667464 - RNA, 19 nt, Escherichia coli CFT073
ccauaccacagcaaaacgc

SEQ ID NO: 2667465 - RNA, 15 nt, Escherichia coli CFT073
ccauacccaccaauu

SEQ ID NO: 2667466 - RNA, 18 nt, Escherichia coli CFT073
ccauaccggacuccagac

SEQ ID NO: 2667467 - RNA, 17 nt, Escherichia coli CFT073
ccauaccggcugcaaac

SEQ ID NO: 2667468 - RNA, 16 nt, Escherichia coli CFT073
ccauaccgucgccaga

SEQ ID NO: 2667469 - RNA, 16 nt, Escherichia coli CFT073
ccauacgggcaugugu

SEQ ID NO: 2667470 - RNA, 12 nt, Escherichia coli CFT073
ccauacucaucu

SEQ ID NO: 2667471 - RNA, 16 nt, Escherichia coli CFT073
ccauacucaucuucca

SEQ ID NO: 2667472 - RNA, 21 nt, Escherichia coli CFT073
ccauacucuuucccggcaauc

SEQ ID NO: 2667473 - RNA, 20 nt, Escherichia coli CFT073
ccauaggaugagguuucccg

SEQ ID NO: 2667474 - RNA, 16 nt, Escherichia coli CFT073
ccauagggcagggugc

SEQ ID NO: 2667475 - RNA, 20 nt, Escherichia coli CFT073
ccauaguguguuccucugcu

SEQ ID NO: 2667476 - RNA, 22 nt, Escherichia coli CFT073
ccauaguguguuccucugcucc

SEQ ID NO: 2667477 - RNA, 18 nt, Escherichia coli CFT073
ccauaguugucggugugu

SEQ ID NO: 2667478 - RNA, 16 nt, Escherichia coli CFT073
ccauauaacguccagu

SEQ ID NO: 2667479 - RNA, 11 nt, Escherichia coli CFT073
ccauauaccgc

SEQ ID NO: 2667480 - RNA, 21 nt, Escherichia coli CFT073
ccauauaccgcgguucccagc

SEQ ID NO: 2667481 - RNA, 13 nt, Escherichia coli CFT073
ccauauagcgcac

SEQ ID NO: 2667482 - RNA, 12 nt, Escherichia coli CFT073
ccauauauaaaa

SEQ ID NO: 2667483 - RNA, 21 nt, Escherichia coli CFT073
ccauauaugccaucgccagca

SEQ ID NO: 2667484 - RNA, 13 nt, Escherichia coli CFT073
ccauaucgcuggc

SEQ ID NO: 2667485 - RNA, 18 nt, Escherichia coli CFT073
ccauaucugguuaaaaaa

SEQ ID NO: 2667486 - RNA, 17 nt, Escherichia coli CFT073
ccauaugacaccaacgc

SEQ ID NO: 2667487 - RNA, 13 nt, Escherichia coli CFT073
ccauaugcagcca

SEQ ID NO: 2667488 - RNA, 22 nt, Escherichia coli CFT073
ccauaugcagccacugcugcgc

SEQ ID NO: 2667489 - RNA, 17 nt, Escherichia coli CFT073
ccauauggcccaucauc

SEQ ID NO: 2667490 - RNA, 18 nt, Escherichia coli CFT073
ccauauggcccaucaucu

SEQ ID NO: 2667491 - RNA, 18 nt, Escherichia coli CFT073
ccauauguugaaaagcca

SEQ ID NO: 2667492 - RNA, 19 nt, Escherichia coli CFT073
ccauauucugaucgugcuc

SEQ ID NO: 2667493 - RNA, 20 nt, Escherichia coli CFT073
ccauauuucgucgcaucaca

SEQ ID NO: 2667494 - RNA, 21 nt, Escherichia coli CFT073
ccauauuuugaaucgguggcg

SEQ ID NO: 2667495 - RNA, 16 nt, Escherichia coli CFT073
ccaucaaacagccccu

SEQ ID NO: 2667496 - RNA, 13 nt, Escherichia coli CFT073
ccaucaaaucugc

SEQ ID NO: 2667497 - RNA, 13 nt, Escherichia coli CFT073
ccaucaaaugcgc

SEQ ID NO: 2667498 - RNA, 19 nt, Escherichia coli CFT073
ccaucaaccuucacaaucu

SEQ ID NO: 2667499 - RNA, 20 nt, Escherichia coli CFT073
ccaucaaucacuuugcgcuc

SEQ ID NO: 2667500 - RNA, 22 nt, Escherichia coli CFT073
ccaucaauccacuucgccagac

SEQ ID NO: 2667501 - RNA, 21 nt, Escherichia coli CFT073
ccaucaaucuucacgcgcaga

SEQ ID NO: 2667502 - RNA, 13 nt, Escherichia coli CFT073
ccaucaauugcuc

SEQ ID NO: 2667503 - RNA, 18 nt, Escherichia coli CFT073
ccaucaauugcucacucc

SEQ ID NO: 2667504 - RNA, 22 nt, Escherichia coli CFT073
ccaucacaaucagcuuaccgcc

SEQ ID NO: 2667505 - RNA, 19 nt, Escherichia coli CFT073
ccaucacaauucaguacgc

SEQ ID NO: 2667506 - RNA, 17 nt, Escherichia coli CFT073
ccaucacaauuccggua

SEQ ID NO: 2667507 - RNA, 12 nt, Escherichia coli CFT073
ccaucacacccu

SEQ ID NO: 2667508 - RNA, 17 nt, Escherichia coli CFT073
ccaucacauccugauag

SEQ ID NO: 2667509 - RNA, 22 nt, Escherichia coli CFT073
ccaucaccaacgauuuuuuccg

SEQ ID NO: 2667510 - RNA, 14 nt, Escherichia coli CFT073
ccaucaccgccacu

SEQ ID NO: 2667511 - RNA, 14 nt, Escherichia coli CFT073
ccaucaccgccagg

SEQ ID NO: 2667512 - RNA, 15 nt, Escherichia coli CFT073
ccaucaccgccaggc

SEQ ID NO: 2667513 - RNA, 13 nt, Escherichia coli CFT073
ccaucaccggcac

SEQ ID NO: 2667514 - RNA, 13 nt, Escherichia coli CFT073
ccaucaccucuuc

SEQ ID NO: 2667515 - RNA, 14 nt, Escherichia coli CFT073
ccaucaccucuuca

SEQ ID NO: 2667516 - RNA, 18 nt, Escherichia coli CFT073
ccaucaccugacagcaga

SEQ ID NO: 2667517 - RNA, 16 nt, Escherichia coli CFT073
ccaucaccuuaccgcc

SEQ ID NO: 2667518 - RNA, 19 nt, Escherichia coli CFT073
ccaucacgccccaaugcgc

SEQ ID NO: 2667519 - RNA, 14 nt, Escherichia coli CFT073
ccaucacggcagcc

SEQ ID NO: 2667520 - RNA, 18 nt, Escherichia coli CFT073
ccaucacuaaggguaaaa

SEQ ID NO: 2667521 - RNA, 11 nt, Escherichia coli CFT073
ccaucacuccc

SEQ ID NO: 2667522 - RNA, 17 nt, Escherichia coli CFT073
ccaucacuuugcagaaa

SEQ ID NO: 2667523 - RNA, 18 nt, Escherichia coli CFT073
ccaucagacuuugcgcca

SEQ ID NO: 2667524 - RNA, 15 nt, Escherichia coli CFT073
ccaucagcagcaaca

SEQ ID NO: 2667525 - RNA, 12 nt, Escherichia coli CFT073
ccaucagcagcg

SEQ ID NO: 2667526 - RNA, 18 nt, Escherichia coli CFT073
ccaucagcgccugaugga

SEQ ID NO: 2667527 - RNA, 12 nt, Escherichia coli CFT073
ccaucagcgcua

SEQ ID NO: 2667528 - RNA, 19 nt, Escherichia coli CFT073
ccaucagcggguuuuuccc

SEQ ID NO: 2667529 - RNA, 20 nt, Escherichia coli CFT073
ccaucagcucuguagcaacg

SEQ ID NO: 2667530 - RNA, 17 nt, Escherichia coli CFT073
ccaucaggcagaacacc

SEQ ID NO: 2667531 - RNA, 23 nt, Escherichia coli CFT073
ccaucaggcagauacaaccaauc

SEQ ID NO: 2667532 - RNA, 15 nt, Escherichia coli CFT073
ccaucaggcagucug

SEQ ID NO: 2667533 - RNA, 15 nt, Escherichia coli CFT073
ccaucaggccaggcg

SEQ ID NO: 2667534 - RNA, 22 nt, Escherichia coli CFT073
ccaucaggccaggcgugaauca

SEQ ID NO: 2667535 - RNA, 21 nt, Escherichia coli CFT073
ccaucaguacccaaucagcga

SEQ ID NO: 2667536 - RNA, 22 nt, Escherichia coli CFT073
ccaucaguauuaucaaaucacc

SEQ ID NO: 2667537 - RNA, 15 nt, Escherichia coli CFT073
ccaucauacagccag

SEQ ID NO: 2667538 - RNA, 13 nt, Escherichia coli CFT073
ccaucauccgcgg

SEQ ID NO: 2667539 - RNA, 13 nt, Escherichia coli CFT073
ccaucauccugau

SEQ ID NO: 2667540 - RNA, 23 nt, Escherichia coli CFT073
ccaucaugaucagaacaucgcca

SEQ ID NO: 2667541 - RNA, 12 nt, Escherichia coli CFT073
ccaucauuuuua

SEQ ID NO: 2667542 - RNA, 14 nt, Escherichia coli CFT073
ccauccagcagacg

SEQ ID NO: 2667543 - RNA, 15 nt, Escherichia coli CFT073
ccauccagcucaagu

SEQ ID NO: 2667544 - RNA, 14 nt, Escherichia coli CFT073
ccauccaucaacgc

SEQ ID NO: 2667545 - RNA, 15 nt, Escherichia coli CFT073
ccauccaucaacgcc

SEQ ID NO: 2667546 - RNA, 18 nt, Escherichia coli CFT073
ccauccaucaacgccagc

SEQ ID NO: 2667547 - RNA, 21 nt, Escherichia coli CFT073
ccauccaucaacgccagcggg

SEQ ID NO: 2667548 - RNA, 21 nt, Escherichia coli CFT073
ccauccauucggugcgucgcu

SEQ ID NO: 2667549 - RNA, 18 nt, Escherichia coli CFT073
ccauccauugcauaaaca

SEQ ID NO: 2667550 - RNA, 19 nt, Escherichia coli CFT073
ccaucccagacaccaccca

SEQ ID NO: 2667551 - RNA, 17 nt, Escherichia coli CFT073
ccauguaccagacugac

SEQ ID NO: 2667552 - RNA, 19 nt, Escherichia coli CFT073
ccaugucagacaacaugcc

SEQ ID NO: 2667553 - RNA, 21 nt, Escherichia coli CFT073
ccaugucgccaccuguccaua

SEQ ID NO: 2667554 - RNA, 15 nt, Escherichia coli CFT073
ccaugugagucagau

SEQ ID NO: 2667555 - RNA, 21 nt, Escherichia coli CFT073
ccaugugccgacaucgccacg

SEQ ID NO: 2667556 - RNA, 16 nt, Escherichia coli CFT073
ccaugugcuuuuccuc

SEQ ID NO: 2667557 - RNA, 15 nt, Escherichia coli CFT073
ccauguugacuucaa

SEQ ID NO: 2667558 - RNA, 16 nt, Escherichia coli CFT073
ccauguugaucccugc

SEQ ID NO: 2667559 - RNA, 19 nt, Escherichia coli CFT073
ccauguugaucccugcacc

SEQ ID NO: 2667560 - RNA, 12 nt, Escherichia coli CFT073
ccauguugccug

SEQ ID NO: 2667561 - RNA, 16 nt, Escherichia coli CFT073
ccauguugcgcagagu

SEQ ID NO: 2667562 - RNA, 22 nt, Escherichia coli CFT073
ccauuaaauaguuuuuuacgau

SEQ ID NO: 2667563 - RNA, 20 nt, Escherichia coli CFT073
ccauuaaaucagccuuaauc

SEQ ID NO: 2667564 - RNA, 15 nt, Escherichia coli CFT073
ccauuaacaaccgaa

SEQ ID NO: 2667565 - RNA, 14 nt, Escherichia coli CFT073
ccauuaaccagcca

SEQ ID NO: 2667566 - RNA, 16 nt, Escherichia coli CFT073
ccauuaaccagccacu

SEQ ID NO: 2667567 - RNA, 22 nt, Escherichia coli CFT073
ccauuaacccauuuaaaaauca

SEQ ID NO: 2667568 - RNA, 13 nt, Escherichia coli CFT073
ccauuaaugccgc

SEQ ID NO: 2667569 - RNA, 19 nt, Escherichia coli CFT073
ccauuacacugaaaaaaag

SEQ ID NO: 2667570 - RNA, 21 nt, Escherichia coli CFT073
ccauuaccaccaccuuacaua

SEQ ID NO: 2667571 - RNA, 18 nt, Escherichia coli CFT073
ccauuaccccugacgcuu

SEQ ID NO: 2667572 - RNA, 14 nt, Escherichia coli CFT073
ccauuaccgccauc

SEQ ID NO: 2667573 - RNA, 20 nt, Escherichia coli CFT073
ccauuagcaaauuauccccc

SEQ ID NO: 2667574 - RNA, 21 nt, Escherichia coli CFT073
ccauuagcaaauuauccccca

SEQ ID NO: 2667575 - RNA, 22 nt, Escherichia coli CFT073
ccauucacaaaaacaguaagca

SEQ ID NO: 2667576 - RNA, 22 nt, Escherichia coli CFT073
ccauucacacuccagucccagu

SEQ ID NO: 2667577 - RNA, 24 nt, Escherichia coli CFT073
ccauucaucacgcacugcaauauu

SEQ ID NO: 2667578 - RNA, 15 nt, Escherichia coli CFT073
ccauuccaccauaca

SEQ ID NO: 2667579 - RNA, 16 nt, Escherichia coli CFT073
ccauucccaaaauggu

SEQ ID NO: 2667580 - RNA, 21 nt, Escherichia coli CFT073
ccauuccccagccgaucagcg

SEQ ID NO: 2667581 - RNA, 16 nt, Escherichia coli CFT073
ccauucccggcuuugc

SEQ ID NO: 2667582 - RNA, 21 nt, Escherichia coli CFT073
ccauucccuggcacuguucau

SEQ ID NO: 2667583 - RNA, 13 nt, Escherichia coli CFT073
ccauucuccgcuc

SEQ ID NO: 2667584 - RNA, 18 nt, Escherichia coli CFT073
ccauucuccgcucuucau

SEQ ID NO: 2667585 - RNA, 21 nt, Escherichia coli CFT073
ccauucuugucagaugcggcg

SEQ ID NO: 2667586 - RNA, 21 nt, Escherichia coli CFT073
ccauugaagcaauccauacca

SEQ ID NO: 2667587 - RNA, 23 nt, Escherichia coli CFT073
ccauugacguucccuucuugcgc

SEQ ID NO: 2667588 - RNA, 22 nt, Escherichia coli CFT073
ccauugagaaaauccaucccaa

SEQ ID NO: 2667589 - RNA, 22 nt, Escherichia coli CFT073
ccauugaguagccucugcguua

SEQ ID NO: 2667590 - RNA, 18 nt, Escherichia coli CFT073
ccauugccgccucugccg

SEQ ID NO: 2667591 - RNA, 15 nt, Escherichia coli CFT073
ccauugccugcaacg

SEQ ID NO: 2667592 - RNA, 16 nt, Escherichia coli CFT073
ccauugcgaauaagaa

SEQ ID NO: 2667593 - RNA, 15 nt, Escherichia coli CFT073
ccauugcgucauaau

SEQ ID NO: 2667594 - RNA, 17 nt, Escherichia coli CFT073
ccauugcgucgcugaac

SEQ ID NO: 2667595 - RNA, 16 nt, Escherichia coli CFT073
ccauugcuaucaacaa

SEQ ID NO: 2667596 - RNA, 14 nt, Escherichia coli CFT073
ccauugcucuuuca

SEQ ID NO: 2667597 - RNA, 17 nt, Escherichia coli CFT073
ccauugcucuuucacuu

SEQ ID NO: 2667598 - RNA, 22 nt, Escherichia coli CFT073
ccauugcucuuucacuuuaccu

SEQ ID NO: 2667599 - RNA, 15 nt, Escherichia coli CFT073
ccauugcuuuuuuga

SEQ ID NO: 2667600 - RNA, 14 nt, Escherichia coli CFT073
ccauuguuagcaac

SEQ ID NO: 2667601 - RNA, 17 nt, Escherichia coli CFT073
ccauuguucggcgggua

SEQ ID NO: 2667602 - RNA, 22 nt, Escherichia coli CFT073
ccauuuauccagcggcagccau

SEQ ID NO: 2667603 - RNA, 15 nt, Escherichia coli CFT073
ccauuucacugucau

SEQ ID NO: 2667604 - RNA, 23 nt, Escherichia coli CFT073
ccauuucauaaauuaccaccagc

SEQ ID NO: 2667605 - RNA, 19 nt, Escherichia coli CFT073
ccauuucauugagucgcuu

SEQ ID NO: 2667606 - RNA, 12 nt, Escherichia coli CFT073
ccauuucugcga

SEQ ID NO: 2667607 - RNA, 17 nt, Escherichia coli CFT073
ccauuugggcggcuuuu

SEQ ID NO: 2667608 - RNA, 13 nt, Escherichia coli CFT073
ccauuuucauuua

SEQ ID NO: 2667609 - RNA, 11 nt, Escherichia coli CFT073
ccauuuugcug

SEQ ID NO: 2667610 - RNA, 14 nt, Escherichia coli CFT073
ccauuuugcuggcc

SEQ ID NO: 2667611 - RNA, 21 nt, Escherichia coli CFT073
ccauuuuggaauaguaaaagg

SEQ ID NO: 2667612 - RNA, 21 nt, Escherichia coli CFT073
ccauuuuuugaacuuuuucuu

SEQ ID NO: 2667613 - RNA, 14 nt, Escherichia coli CFT073
ccauuuuuuugcau

SEQ ID NO: 2667614 - RNA, 13 nt, Escherichia coli CFT073
cccaaaccgccca

SEQ ID NO: 2667615 - RNA, 18 nt, Escherichia coli CFT073
cccaaaccgcccagcagc

SEQ ID NO: 2667616 - RNA, 13 nt, Escherichia coli CFT073
cccaaagacgacg

SEQ ID NO: 2667617 - RNA, 23 nt, Escherichia coli CFT073
cccaaagaucaacugccgccugg

SEQ ID NO: 2667618 - RNA, 22 nt, Escherichia coli CFT073
cccaaaguguaaaaaaucccag

SEQ ID NO: 2667619 - RNA, 11 nt, Escherichia coli CFT073
cccaaaucaua

SEQ ID NO: 2667620 - RNA, 22 nt, Escherichia coli CFT073
cccaacaaauugguuuuugaau

SEQ ID NO: 2667621 - RNA, 16 nt, Escherichia coli CFT073
cccaacaguuuguuga

SEQ ID NO: 2667622 - RNA, 22 nt, Escherichia coli CFT073
cccaacauggucaucaucauua

SEQ ID NO: 2667623 - RNA, 18 nt, Escherichia coli CFT073
cccaacgcgccaccgacc

SEQ ID NO: 2667624 - RNA, 18 nt, Escherichia coli CFT073
cccaacgugaccaguacc

SEQ ID NO: 2667625 - RNA, 14 nt, Escherichia coli CFT073
cccaacugaucugc

SEQ ID NO: 2667626 - RNA, 22 nt, Escherichia coli CFT073
cccaacugaucugccagcagac

SEQ ID NO: 2667627 - RNA, 16 nt, Escherichia coli CFT073
cccaacugccugaugc

SEQ ID NO: 2667628 - RNA, 14 nt, Escherichia coli CFT073
cccaagaucaauac

SEQ ID NO: 2667629 - RNA, 21 nt, Escherichia coli CFT073
cccaagaugccagaaucccca

SEQ ID NO: 2667630 - RNA, 13 nt, Escherichia coli CFT073
cccaagcgggggg

SEQ ID NO: 2667631 - RNA, 17 nt, Escherichia coli CFT073
cccaaguuuaugcaaua

SEQ ID NO: 2667632 - RNA, 13 nt, Escherichia coli CFT073
cccaauaccuuca

SEQ ID NO: 2667633 - RNA, 21 nt, Escherichia coli CFT073
cccaaucaaacuuccggcaag

SEQ ID NO: 2667634 - RNA, 15 nt, Escherichia coli CFT073
cccaaugacgucggu

SEQ ID NO: 2667635 - RNA, 15 nt, Escherichia coli CFT073
cccaauucauacaug

SEQ ID NO: 2667636 - RNA, 15 nt, Escherichia coli CFT073
cccaauucuuccugg

SEQ ID NO: 2667637 - RNA, 22 nt, Escherichia coli CFT073
cccacaaaauaaccgccaccag

SEQ ID NO: 2667638 - RNA, 18 nt, Escherichia coli CFT073
cccacaacauugcgccuc

SEQ ID NO: 2667639 - RNA, 14 nt, Escherichia coli CFT073
cccacaagcccgcc

SEQ ID NO: 2667640 - RNA, 14 nt, Escherichia coli CFT073
cccacaccaccaug

SEQ ID NO: 2667641 - RNA, 22 nt, Escherichia coli CFT073
cccacaccaccgcaaccgccaa

SEQ ID NO: 2667642 - RNA, 22 nt, Escherichia coli CFT073
cccacaccgcccagcgagcugg

SEQ ID NO: 2667643 - RNA, 20 nt, Escherichia coli CFT073
cccacagacccagguagaca

SEQ ID NO: 2667644 - RNA, 12 nt, Escherichia coli CFT073
cccacagagugg

SEQ ID NO: 2667645 - RNA, 14 nt, Escherichia coli CFT073
cccacagcgcacca

SEQ ID NO: 2667646 - RNA, 16 nt, Escherichia coli CFT073
cccacagcgcaccaac

SEQ ID NO: 2667647 - RNA, 19 nt, Escherichia coli CFT073
cccacagcgcgucuucauc

SEQ ID NO: 2667648 - RNA, 20 nt, Escherichia coli CFT073
cccacaguuucagccccauc

SEQ ID NO: 2667649 - RNA, 19 nt, Escherichia coli CFT073
cccacaguuucauaucugc

SEQ ID NO: 2667650 - RNA, 21 nt, Escherichia coli CFT073
cccacauauguuuaaccggca

SEQ ID NO: 2667651 - RNA, 22 nt, Escherichia coli CFT073
cccacauauguuuaaccggcag

SEQ ID NO: 2667652 - RNA, 11 nt, Escherichia coli CFT073
cccacaucaca

SEQ ID NO: 2667653 - RNA, 16 nt, Escherichia coli CFT073
cccacaucacauccag

SEQ ID NO: 2667654 - RNA, 15 nt, Escherichia coli CFT073
cccaccacaaaccag

SEQ ID NO: 2667655 - RNA, 23 nt, Escherichia coli CFT073
cccaccagcgacauacucagcgc

SEQ ID NO: 2667656 - RNA, 13 nt, Escherichia coli CFT073
cccaccagcgccg

SEQ ID NO: 2667657 - RNA, 16 nt, Escherichia coli CFT073
cccaccagcgccgccc

SEQ ID NO: 2667658 - RNA, 14 nt, Escherichia coli CFT073
cccaccauaaucag

SEQ ID NO: 2667659 - RNA, 14 nt, Escherichia coli CFT073
cccaucugccccau

SEQ ID NO: 2667660 - RNA, 15 nt, Escherichia coli CFT073
cccaugacaucccca

SEQ ID NO: 2667661 - RNA, 16 nt, Escherichia coli CFT073
cccaugacauccccau

SEQ ID NO: 2667662 - RNA, 22 nt, Escherichia coli CFT073
cccaugaugcgcggcuccagaa

SEQ ID NO: 2667663 - RNA, 22 nt, Escherichia coli CFT073
cccaugcguuaucgccauccag

SEQ ID NO: 2667664 - RNA, 22 nt, Escherichia coli CFT073
cccaugucagaccaaaacgcgc

SEQ ID NO: 2667665 - RNA, 14 nt, Escherichia coli CFT073
cccauuaauaccgc

SEQ ID NO: 2667666 - RNA, 10 nt, Escherichia coli CFT073
cccauucagc

SEQ ID NO: 2667667 - RNA, 17 nt, Escherichia coli CFT073
cccauucaucgccaccg

SEQ ID NO: 2667668 - RNA, 19 nt, Escherichia coli CFT073
cccauucucggcgggcaac

SEQ ID NO: 2667669 - RNA, 12 nt, Escherichia coli CFT073
ccccaaaugucg

SEQ ID NO: 2667670 - RNA, 15 nt, Escherichia coli CFT073
ccccaacgucuuacg

SEQ ID NO: 2667671 - RNA, 20 nt, Escherichia coli CFT073
ccccaagaaucgucgcccga

SEQ ID NO: 2667672 - RNA, 15 nt, Escherichia coli CFT073
ccccaagcgggggga

SEQ ID NO: 2667673 - RNA, 20 nt, Escherichia coli CFT073
ccccaauacgauuaacgcca

SEQ ID NO: 2667674 - RNA, 15 nt, Escherichia coli CFT073
ccccaauccacgcgg

SEQ ID NO: 2667675 - RNA, 13 nt, Escherichia coli CFT073
ccccaauguggag

SEQ ID NO: 2667676 - RNA, 21 nt, Escherichia coli CFT073
ccccacaagcccgccagacca

SEQ ID NO: 2667677 - RNA, 20 nt, Escherichia coli CFT073
ccccacaaucagccagaaca

SEQ ID NO: 2667678 - RNA, 21 nt, Escherichia coli CFT073
ccccacagcucugcugucacc

SEQ ID NO: 2667679 - RNA, 15 nt, Escherichia coli CFT073
ccccacaucacacca

SEQ ID NO: 2667680 - RNA, 13 nt, Escherichia coli CFT073
ccccaccagcaaa

SEQ ID NO: 2667681 - RNA, 12 nt, Escherichia coli CFT073
ccccaccgccga

SEQ ID NO: 2667682 - RNA, 23 nt, Escherichia coli CFT073
ccccaccugaacuucuucgccag

SEQ ID NO: 2667683 - RNA, 13 nt, Escherichia coli CFT073
ccccaccugcccg

SEQ ID NO: 2667684 - RNA, 21 nt, Escherichia coli CFT073
ccccacgcuaccuaagcgcca

SEQ ID NO: 2667685 - RNA, 14 nt, Escherichia coli CFT073
ccccacucccgcau

SEQ ID NO: 2667686 - RNA, 14 nt, Escherichia coli CFT073
ccccacugccgccu

SEQ ID NO: 2667687 - RNA, 17 nt, Escherichia coli CFT073
ccccacugugcaccgcg

SEQ ID NO: 2667688 - RNA, 14 nt, Escherichia coli CFT073
ccccacuucuuccu

SEQ ID NO: 2667689 - RNA, 18 nt, Escherichia coli CFT073
ccccagaauccccacaaa

SEQ ID NO: 2667690 - RNA, 22 nt, Escherichia coli CFT073
ccccagacgacggcugccauca

SEQ ID NO: 2667691 - RNA, 22 nt, Escherichia coli CFT073
ccccagacuccagcagugcugc

SEQ ID NO: 2667692 - RNA, 11 nt, Escherichia coli CFT073
ccccagaugga

SEQ ID NO: 2667693 - RNA, 16 nt, Escherichia coli CFT073
ccccagauugccgaua

SEQ ID NO: 2667694 - RNA, 22 nt, Escherichia coli CFT073
ccccagccagaugccuugccag

SEQ ID NO: 2667695 - RNA, 23 nt, Escherichia coli CFT073
ccccagcgcacuacgccgcaaau

SEQ ID NO: 2667696 - RNA, 15 nt, Escherichia coli CFT073
ccccaggcauagaaa

SEQ ID NO: 2667697 - RNA, 17 nt, Escherichia coli CFT073
ccccaguaaacacacca

SEQ ID NO: 2667698 - RNA, 21 nt, Escherichia coli CFT073
ccccaguaaacacaccacagc

SEQ ID NO: 2667699 - RNA, 17 nt, Escherichia coli CFT073
ccccaguugugcugcca

SEQ ID NO: 2667700 - RNA, 14 nt, Escherichia coli CFT073
ccccauaaucaaug

SEQ ID NO: 2667701 - RNA, 19 nt, Escherichia coli CFT073
ccccauaaucaaugccagg

SEQ ID NO: 2667702 - RNA, 14 nt, Escherichia coli CFT073
ccccauaucccgga

SEQ ID NO: 2667703 - RNA, 13 nt, Escherichia coli CFT073
ccccauaugcagc

SEQ ID NO: 2667704 - RNA, 14 nt, Escherichia coli CFT073
ccccaucagcaucc

SEQ ID NO: 2667705 - RNA, 14 nt, Escherichia coli CFT073
ccccaucagcgcca

SEQ ID NO: 2667706 - RNA, 21 nt, Escherichia coli CFT073
ccccaucagcgccaucgccag

SEQ ID NO: 2667707 - RNA, 13 nt, Escherichia coli CFT073
ccccaugcuggcu

SEQ ID NO: 2667708 - RNA, 13 nt, Escherichia coli CFT073
ccccauucugcgc

SEQ ID NO: 2667709 - RNA, 19 nt, Escherichia coli CFT073
cccccaauguggagagcaa

SEQ ID NO: 2667710 - RNA, 13 nt, Escherichia coli CFT073
cccccaccgccgc

SEQ ID NO: 2667711 - RNA, 14 nt, Escherichia coli CFT073
cccccacugccgcc

SEQ ID NO: 2667712 - RNA, 12 nt, Escherichia coli CFT073
cccccaguaauc

SEQ ID NO: 2667713 - RNA, 17 nt, Escherichia coli CFT073
cccccugaagcaguuuc

SEQ ID NO: 2667714 - RNA, 23 nt, Escherichia coli CFT073
ccccgacgaaacgacaguaucgu

SEQ ID NO: 2667715 - RNA, 15 nt, Escherichia coli CFT073
ccccgccaacagugc

SEQ ID NO: 2667716 - RNA, 21 nt, Escherichia coli CFT073
ccccgccagcguugccagucc

SEQ ID NO: 2667717 - RNA, 22 nt, Escherichia coli CFT073
ccccgcgacagaagaggagagu

SEQ ID NO: 2667718 - RNA, 13 nt, Escherichia coli CFT073
ccccgcgccagcg

SEQ ID NO: 2667719 - RNA, 14 nt, Escherichia coli CFT073
ccccgcgcggcgca

SEQ ID NO: 2667720 - RNA, 13 nt, Escherichia coli CFT073
ccccgcucacgca

SEQ ID NO: 2667721 - RNA, 12 nt, Escherichia coli CFT073
ccccgcuccggc

SEQ ID NO: 2667722 - RNA, 16 nt, Escherichia coli CFT073
ccccggauaacguuua

SEQ ID NO: 2667723 - RNA, 21 nt, Escherichia coli CFT073
ccccgggaagucaccuuucag

SEQ ID NO: 2667724 - RNA, 18 nt, Escherichia coli CFT073
ccccggucagcagcacca

SEQ ID NO: 2667725 - RNA, 21 nt, Escherichia coli CFT073
ccccgguucgcuuuuauuucu

SEQ ID NO: 2667726 - RNA, 14 nt, Escherichia coli CFT073
ccccgguuuuacuu

SEQ ID NO: 2667727 - RNA, 19 nt, Escherichia coli CFT073
ccccgugaugaacugcggu

SEQ ID NO: 2667728 - RNA, 20 nt, Escherichia coli CFT073
ccccuaaauaaacaccagca

SEQ ID NO: 2667729 - RNA, 20 nt, Escherichia coli CFT073
ccccuauaucaacgcccaua

SEQ ID NO: 2667730 - RNA, 19 nt, Escherichia coli CFT073
ccccucuucagccgcaaac

SEQ ID NO: 2667731 - RNA, 15 nt, Escherichia coli CFT073
ccccugccagaagca

SEQ ID NO: 2667732 - RNA, 18 nt, Escherichia coli CFT073
ccccugccagaagcagaa

SEQ ID NO: 2667733 - RNA, 11 nt, Escherichia coli CFT073
ccccugcccca

SEQ ID NO: 2667734 - RNA, 14 nt, Escherichia coli CFT073
ccccugccccagag

SEQ ID NO: 2667735 - RNA, 20 nt, Escherichia coli CFT073
ccccugccccaucugcccca

SEQ ID NO: 2667736 - RNA, 12 nt, Escherichia coli CFT073
ccccugcccgcg

SEQ ID NO: 2667737 - RNA, 21 nt, Escherichia coli CFT073
ccccuggcuaucggcaaaaau

SEQ ID NO: 2667738 - RNA, 14 nt, Escherichia coli CFT073
ccccugggccaccu

SEQ ID NO: 2667739 - RNA, 16 nt, Escherichia coli CFT073
ccccuggugcuugcca

SEQ ID NO: 2667740 - RNA, 20 nt, Escherichia coli CFT073
ccccugugccagcucgugca

SEQ ID NO: 2667741 - RNA, 16 nt, Escherichia coli CFT073
ccccuguguugauuuc

SEQ ID NO: 2667742 - RNA, 20 nt, Escherichia coli CFT073
ccccuuaauaccggcaucca

SEQ ID NO: 2667743 - RNA, 13 nt, Escherichia coli CFT073
ccccuuaccccgc

SEQ ID NO: 2667744 - RNA, 13 nt, Escherichia coli CFT073
ccccuucugccgc

SEQ ID NO: 2667745 - RNA, 17 nt, Escherichia coli CFT073
ccccuuucgaaaucauu

SEQ ID NO: 2667746 - RNA, 21 nt, Escherichia coli CFT073
ccccuuucuuauuuuucugca

SEQ ID NO: 2667747 - RNA, 19 nt, Escherichia coli CFT073
cccgaaagcguauccauca

SEQ ID NO: 2667748 - RNA, 20 nt, Escherichia coli CFT073
cccgaacucgaccugcaacu

SEQ ID NO: 2667749 - RNA, 21 nt, Escherichia coli CFT073
cccgaacucgaccugcaacug

SEQ ID NO: 2667750 - RNA, 14 nt, Escherichia coli CFT073
cccgaccacuucau

SEQ ID NO: 2667751 - RNA, 19 nt, Escherichia coli CFT073
cccgaccaucgccagcuca

SEQ ID NO: 2667752 - RNA, 19 nt, Escherichia coli CFT073
cccgacgauaccgccgcac

SEQ ID NO: 2667753 - RNA, 23 nt, Escherichia coli CFT073
cccgagcgaauaaaccacaccgc

SEQ ID NO: 2667754 - RNA, 18 nt, Escherichia coli CFT073
cccgagcggccaaaggga

SEQ ID NO: 2667755 - RNA, 21 nt, Escherichia coli CFT073
cccgagcggccaaagggagca

SEQ ID NO: 2667756 - RNA, 22 nt, Escherichia coli CFT073
cccgagcgugcgggcacaggcg

SEQ ID NO: 2667757 - RNA, 20 nt, Escherichia coli CFT073
cccgagguguauuucacugu

SEQ ID NO: 2667758 - RNA, 14 nt, Escherichia coli CFT073
cccgauaaccgcaa

SEQ ID NO: 2667759 - RNA, 15 nt, Escherichia coli CFT073
cccgauaagggagca

SEQ ID NO: 2667760 - RNA, 12 nt, Escherichia coli CFT073
cccgauccagcg

SEQ ID NO: 2667761 - RNA, 17 nt, Escherichia coli CFT073
cccgaugaugaucggcg

SEQ ID NO: 2667762 - RNA, 13 nt, Escherichia coli CFT073
cccgaugccagca

SEQ ID NO: 2667763 - RNA, 21 nt, Escherichia coli CFT073
cccgauggaacaaaauuuuca

SEQ ID NO: 2667764 - RNA, 20 nt, Escherichia coli CFT073
cccgauguuaauuucuuugc

SEQ ID NO: 2667765 - RNA, 14 nt, Escherichia coli CFT073
cccgauucacauaa

SEQ ID NO: 2667766 - RNA, 18 nt, Escherichia coli CFT073
cccgauucggucauggug

SEQ ID NO: 2667767 - RNA, 19 nt, Escherichia coli CFT073
cccgcaacgcccugcaacu

SEQ ID NO: 2667768 - RNA, 23 nt, Escherichia coli CFT073
cccguguuuuugugccagagcac

SEQ ID NO: 2667769 - RNA, 16 nt, Escherichia coli CFT073
cccguugaucuucucu

SEQ ID NO: 2667770 - RNA, 15 nt, Escherichia coli CFT073
cccguugcuucgccg

SEQ ID NO: 2667771 - RNA, 18 nt, Escherichia coli CFT073
cccguugcuucgccgcau

SEQ ID NO: 2667772 - RNA, 20 nt, Escherichia coli CFT073
cccguugcuucuagugccug

SEQ ID NO: 2667773 - RNA, 20 nt, Escherichia coli CFT073
cccguuguaaaugcugcucc

SEQ ID NO: 2667774 - RNA, 22 nt, Escherichia coli CFT073
cccguuucucuuaaaugcacaa

SEQ ID NO: 2667775 - RNA, 20 nt, Escherichia coli CFT073
cccguuuuaaaucgccgcau

SEQ ID NO: 2667776 - RNA, 14 nt, Escherichia coli CFT073
cccguuuucaccuu

SEQ ID NO: 2667777 - RNA, 20 nt, Escherichia coli CFT073
cccuaaagcacccagcaauc

SEQ ID NO: 2667778 - RNA, 18 nt, Escherichia coli CFT073
cccuaaauaaacaccagc

SEQ ID NO: 2667779 - RNA, 14 nt, Escherichia coli CFT073
cccuaacaucaucc

SEQ ID NO: 2667780 - RNA, 14 nt, Escherichia coli CFT073
cccuaacucuuuca

SEQ ID NO: 2667781 - RNA, 20 nt, Escherichia coli CFT073
cccuaacuggcgggcggcuu

SEQ ID NO: 2667782 - RNA, 21 nt, Escherichia coli CFT073
cccuacgcgauaaaaaacccc

SEQ ID NO: 2667783 - RNA, 17 nt, Escherichia coli CFT073
cccuaucaucgcggcac

SEQ ID NO: 2667784 - RNA, 15 nt, Escherichia coli CFT073
cccuauuuaaagcac

SEQ ID NO: 2667785 - RNA, 21 nt, Escherichia coli CFT073
cccuauuuaaagcacaaaaac

SEQ ID NO: 2667786 - RNA, 19 nt, Escherichia coli CFT073
cccucaaacgccagcaugu

SEQ ID NO: 2667787 - RNA, 12 nt, Escherichia coli CFT073
cccucaacggaa

SEQ ID NO: 2667788 - RNA, 22 nt, Escherichia coli CFT073
cccucaauaaucauucgcccgc

SEQ ID NO: 2667789 - RNA, 16 nt, Escherichia coli CFT073
cccuccccggcggcuu

SEQ ID NO: 2667790 - RNA, 13 nt, Escherichia coli CFT073
cccucuccacgca

SEQ ID NO: 2667791 - RNA, 22 nt, Escherichia coli CFT073
cccucuuccggaaccaccagau

SEQ ID NO: 2667792 - RNA, 21 nt, Escherichia coli CFT073
cccugaaagcgacagcgcacg

SEQ ID NO: 2667793 - RNA, 13 nt, Escherichia coli CFT073
cccugaaauauug

SEQ ID NO: 2667794 - RNA, 18 nt, Escherichia coli CFT073
cccugaaucgccacgcca

SEQ ID NO: 2667795 - RNA, 19 nt, Escherichia coli CFT073
cccugacaccaucacccaa

SEQ ID NO: 2667796 - RNA, 15 nt, Escherichia coli CFT073
cccugaccuacggaa

SEQ ID NO: 2667797 - RNA, 19 nt, Escherichia coli CFT073
cccugaguuuucaguaccg

SEQ ID NO: 2667798 - RNA, 14 nt, Escherichia coli CFT073
cccugauaaaucac

SEQ ID NO: 2667799 - RNA, 12 nt, Escherichia coli CFT073
cccugauaaugu

SEQ ID NO: 2667800 - RNA, 23 nt, Escherichia coli CFT073
cccugauacguagcgcaacaggc

SEQ ID NO: 2667801 - RNA, 16 nt, Escherichia coli CFT073
cccugaucacccacac

SEQ ID NO: 2667802 - RNA, 16 nt, Escherichia coli CFT073
cccugaucggccauga

SEQ ID NO: 2667803 - RNA, 14 nt, Escherichia coli CFT073
cccugcaaacgggg

SEQ ID NO: 2667804 - RNA, 15 nt, Escherichia coli CFT073
cccugcaacaucacc

SEQ ID NO: 2667805 - RNA, 18 nt, Escherichia coli CFT073
cccugcagucaccugccc

SEQ ID NO: 2667806 - RNA, 22 nt, Escherichia coli CFT073
cccugcagucaccugcccuccg

SEQ ID NO: 2667807 - RNA, 23 nt, Escherichia coli CFT073
cccugcagucaccugcccuccgg

SEQ ID NO: 2667808 - RNA, 18 nt, Escherichia coli CFT073
cccugccagaagcagaau

SEQ ID NO: 2667809 - RNA, 14 nt, Escherichia coli CFT073
cccugccagcguca

SEQ ID NO: 2667810 - RNA, 20 nt, Escherichia coli CFT073
cccugccaucacuauucaga

SEQ ID NO: 2667811 - RNA, 16 nt, Escherichia coli CFT073
cccugcccgcugccag

SEQ ID NO: 2667812 - RNA, 11 nt, Escherichia coli CFT073
cccugccgcca

SEQ ID NO: 2667813 - RNA, 20 nt, Escherichia coli CFT073
cccugccgucugggcaaaau

SEQ ID NO: 2667814 - RNA, 15 nt, Escherichia coli CFT073
cccugccugacagac

SEQ ID NO: 2667815 - RNA, 19 nt, Escherichia coli CFT073
cccugcgcaaggcauugag

SEQ ID NO: 2667816 - RNA, 18 nt, Escherichia coli CFT073
cccugcgcgggugaaaac

SEQ ID NO: 2667817 - RNA, 14 nt, Escherichia coli CFT073
cccugcggcggaga

SEQ ID NO: 2667818 - RNA, 18 nt, Escherichia coli CFT073
cccugcgucgcacucuca

SEQ ID NO: 2667819 - RNA, 22 nt, Escherichia coli CFT073
cccugcucgucggcaaagcggg

SEQ ID NO: 2667820 - RNA, 21 nt, Escherichia coli CFT073
cccugcucuuucagcaccgcg

SEQ ID NO: 2667821 - RNA, 19 nt, Escherichia coli CFT073
cccugcugaauccccuucu

SEQ ID NO: 2667822 - RNA, 11 nt, Escherichia coli CFT073
cccuggaucgu

SEQ ID NO: 2667823 - RNA, 21 nt, Escherichia coli CFT073
cccuggcaugauugagcugcc

SEQ ID NO: 2667824 - RNA, 16 nt, Escherichia coli CFT073
cccuggcuaucggcaa

SEQ ID NO: 2667825 - RNA, 18 nt, Escherichia coli CFT073
cccugggugacaaucacc

SEQ ID NO: 2667826 - RNA, 20 nt, Escherichia coli CFT073
cccugguaccccauaacgac

SEQ ID NO: 2667827 - RNA, 20 nt, Escherichia coli CFT073
cccuggucauaggcugccga

SEQ ID NO: 2667828 - RNA, 12 nt, Escherichia coli CFT073
cccugguggcca

SEQ ID NO: 2667829 - RNA, 23 nt, Escherichia coli CFT073
cccuguaagaccugucucuuaua

SEQ ID NO: 2667830 - RNA, 15 nt, Escherichia coli CFT073
cccuguaauugccug

SEQ ID NO: 2667831 - RNA, 16 nt, Escherichia coli CFT073
cccuguaauugccuga

SEQ ID NO: 2667832 - RNA, 18 nt, Escherichia coli CFT073
cccugugcgcccuguucu

SEQ ID NO: 2667833 - RNA, 19 nt, Escherichia coli CFT073
cccugugcgcccuguucug

SEQ ID NO: 2667834 - RNA, 16 nt, Escherichia coli CFT073
cccuguggaucuuccc

SEQ ID NO: 2667835 - RNA, 16 nt, Escherichia coli CFT073
cccuguggggauuucc

SEQ ID NO: 2667836 - RNA, 13 nt, Escherichia coli CFT073
cccuguugccugc

SEQ ID NO: 2667837 - RNA, 15 nt, Escherichia coli CFT073
cccuguugccugcac

SEQ ID NO: 2667838 - RNA, 13 nt, Escherichia coli CFT073
cccuguugcgcuc

SEQ ID NO: 2667839 - RNA, 19 nt, Escherichia coli CFT073
cccuuaccauucccagacu

SEQ ID NO: 2667840 - RNA, 16 nt, Escherichia coli CFT073
cccuuaccccgcccga

SEQ ID NO: 2667841 - RNA, 15 nt, Escherichia coli CFT073
cccuuauucacgcca

SEQ ID NO: 2667842 - RNA, 14 nt, Escherichia coli CFT073
cccuucaagcgucc

SEQ ID NO: 2667843 - RNA, 12 nt, Escherichia coli CFT073
cccuucacuuca

SEQ ID NO: 2667844 - RNA, 20 nt, Escherichia coli CFT073
cccuuccagauucaguuuca

SEQ ID NO: 2667845 - RNA, 14 nt, Escherichia coli CFT073
cccuucccgcaaug

SEQ ID NO: 2667846 - RNA, 14 nt, Escherichia coli CFT073
cccuucccggugcg

SEQ ID NO: 2667847 - RNA, 22 nt, Escherichia coli CFT073
cccuuccggugcgaucaguuca

SEQ ID NO: 2667848 - RNA, 13 nt, Escherichia coli CFT073
cccuuccugcccu

SEQ ID NO: 2667849 - RNA, 17 nt, Escherichia coli CFT073
cccuucgagcgggggga

SEQ ID NO: 2667850 - RNA, 15 nt, Escherichia coli CFT073
cccuucgauaaaggc

SEQ ID NO: 2667851 - RNA, 22 nt, Escherichia coli CFT073
cccuucucaaucccuuucucca

SEQ ID NO: 2667852 - RNA, 15 nt, Escherichia coli CFT073
cccuucucgcuccug

SEQ ID NO: 2667853 - RNA, 22 nt, Escherichia coli CFT073
cccuucugccgcaauucgcccu

SEQ ID NO: 2667854 - RNA, 23 nt, Escherichia coli CFT073
cccuucuuuaugcgcuuuuuugg

SEQ ID NO: 2667855 - RNA, 13 nt, Escherichia coli CFT073
cccuugccugcag

SEQ ID NO: 2667856 - RNA, 15 nt, Escherichia coli CFT073
cccuugucgcagcau

SEQ ID NO: 2667857 - RNA, 21 nt, Escherichia coli CFT073
cccuugugcugcgccauauac

SEQ ID NO: 2667858 - RNA, 18 nt, Escherichia coli CFT073
cccuuguugugccagacc

SEQ ID NO: 2667859 - RNA, 15 nt, Escherichia coli CFT073
cccuuuacaggcgug

SEQ ID NO: 2667860 - RNA, 13 nt, Escherichia coli CFT073
cccuuucacuuua

SEQ ID NO: 2667861 - RNA, 15 nt, Escherichia coli CFT073
cccuuucugcaugaa

SEQ ID NO: 2667862 - RNA, 11 nt, Escherichia coli CFT073
cccuuucugcu

SEQ ID NO: 2667863 - RNA, 20 nt, Escherichia coli CFT073
cccuuucuuauuuuucugca

SEQ ID NO: 2667864 - RNA, 16 nt, Escherichia coli CFT073
cccuuuuucauccccg

SEQ ID NO: 2667865 - RNA, 23 nt, Escherichia coli CFT073
ccgaaaaucgccugaacaccaga

SEQ ID NO: 2667866 - RNA, 23 nt, Escherichia coli CFT073
ccgaaaucgcauugcgccauuga

SEQ ID NO: 2667867 - RNA, 12 nt, Escherichia coli CFT073
ccgaacaagaaa

SEQ ID NO: 2667868 - RNA, 21 nt, Escherichia coli CFT073
ccgaacagccaggcuuuaccu

SEQ ID NO: 2667869 - RNA, 22 nt, Escherichia coli CFT073
ccgaacagugccagacaaacca

SEQ ID NO: 2667870 - RNA, 15 nt, Escherichia coli CFT073
ccgaacaugccgcca

SEQ ID NO: 2667871 - RNA, 14 nt, Escherichia coli CFT073
ccgaaccaaacgag

SEQ ID NO: 2667872 - RNA, 16 nt, Escherichia coli CFT073
ccgaaccaaacgaggu

SEQ ID NO: 2667873 - RNA, 16 nt, Escherichia coli CFT073
ccgaaccagugcucca

SEQ ID NO: 2667874 - RNA, 13 nt, Escherichia coli CFT073
ccgaaccauguca

SEQ ID NO: 2667875 - RNA, 22 nt, Escherichia coli CFT073
ccgaacgcagaaucucugcgcu

SEQ ID NO: 2667876 - RNA, 18 nt, Escherichia coli CFT073
ccgauuuugccuucauac

SEQ ID NO: 2667877 - RNA, 17 nt, Escherichia coli CFT073
ccgcaaaacgcggcagg

SEQ ID NO: 2667878 - RNA, 23 nt, Escherichia coli CFT073
ccgcaaaccagacaacagucaac

SEQ ID NO: 2667879 - RNA, 19 nt, Escherichia coli CFT073
ccgcaaagguugcagcucc

SEQ ID NO: 2667880 - RNA, 15 nt, Escherichia coli CFT073
ccgcaacagcaauac

SEQ ID NO: 2667881 - RNA, 19 nt, Escherichia coli CFT073
ccgcaaccgccaacagcag

SEQ ID NO: 2667882 - RNA, 20 nt, Escherichia coli CFT073
ccgcaaccgccaacagcagc

SEQ ID NO: 2667883 - RNA, 14 nt, Escherichia coli CFT073
ccgcaacgccgcca

SEQ ID NO: 2667884 - RNA, 15 nt, Escherichia coli CFT073
ccgcaacgccgccaa

SEQ ID NO: 2667885 - RNA, 20 nt, Escherichia coli CFT073
ccgcaacgccgccaacguga

SEQ ID NO: 2667886 - RNA, 16 nt, Escherichia coli CFT073
ccgcaaucgcggcagc

SEQ ID NO: 2667887 - RNA, 18 nt, Escherichia coli CFT073
ccgcaauuccgcccguca

SEQ ID NO: 2667888 - RNA, 22 nt, Escherichia coli CFT073
ccgcacaaauagccagcagagc

SEQ ID NO: 2667889 - RNA, 15 nt, Escherichia coli CFT073
ccgcacaauacauag

SEQ ID NO: 2667890 - RNA, 19 nt, Escherichia coli CFT073
ccgcacauacuggacacug

SEQ ID NO: 2667891 - RNA, 15 nt, Escherichia coli CFT073
ccgcaccaacgcaaa

SEQ ID NO: 2667892 - RNA, 18 nt, Escherichia coli CFT073
ccgcaccaacgcaaaaaa

SEQ ID NO: 2667893 - RNA, 14 nt, Escherichia coli CFT073
ccgcacccgccaga

SEQ ID NO: 2667894 - RNA, 15 nt, Escherichia coli CFT073
ccgcacccgccagaa

SEQ ID NO: 2667895 - RNA, 20 nt, Escherichia coli CFT073
ccgcaccgacgguguggaaa

SEQ ID NO: 2667896 - RNA, 23 nt, Escherichia coli CFT073
ccgcacggucacuacacgaccau

SEQ ID NO: 2667897 - RNA, 18 nt, Escherichia coli CFT073
ccgcacucugaccgggaa

SEQ ID NO: 2667898 - RNA, 17 nt, Escherichia coli CFT073
ccgcacugguggcagug

SEQ ID NO: 2667899 - RNA, 16 nt, Escherichia coli CFT073
ccgcacuuacagcaac

SEQ ID NO: 2667900 - RNA, 11 nt, Escherichia coli CFT073
ccgcacuugag

SEQ ID NO: 2667901 - RNA, 17 nt, Escherichia coli CFT073
ccgcacuugaguaauua

SEQ ID NO: 2667902 - RNA, 18 nt, Escherichia coli CFT073
ccgcacuugaguaauuaa

SEQ ID NO: 2667903 - RNA, 13 nt, Escherichia coli CFT073
ccgcagaacagau

SEQ ID NO: 2667904 - RNA, 18 nt, Escherichia coli CFT073
ccgcagacaaaauccugc

SEQ ID NO: 2667905 - RNA, 22 nt, Escherichia coli CFT073
ccgcagacaccgugcacuucug

SEQ ID NO: 2667906 - RNA, 21 nt, Escherichia coli CFT073
ccgcagacccacggauagauu

SEQ ID NO: 2667907 - RNA, 16 nt, Escherichia coli CFT073
ccgcagaccuucugcc

SEQ ID NO: 2667908 - RNA, 13 nt, Escherichia coli CFT073
ccgcagagaucgc

SEQ ID NO: 2667909 - RNA, 19 nt, Escherichia coli CFT073
ccgcagauccagugcucau

SEQ ID NO: 2667910 - RNA, 21 nt, Escherichia coli CFT073
ccgcagauccagugcucaucc

SEQ ID NO: 2667911 - RNA, 17 nt, Escherichia coli CFT073
ccgcagauguagcucaa

SEQ ID NO: 2667912 - RNA, 17 nt, Escherichia coli CFT073
ccgcagcaacuacagca

SEQ ID NO: 2667913 - RNA, 13 nt, Escherichia coli CFT073
ccgcagccaucac

SEQ ID NO: 2667914 - RNA, 17 nt, Escherichia coli CFT073
ccgcagccaucaccacg

SEQ ID NO: 2667915 - RNA, 12 nt, Escherichia coli CFT073
ccgcagccgcca

SEQ ID NO: 2667916 - RNA, 15 nt, Escherichia coli CFT073
ccgcagccgccacaa

SEQ ID NO: 2667917 - RNA, 22 nt, Escherichia coli CFT073
ccgcagcggaauaaaaagcgau

SEQ ID NO: 2667918 - RNA, 20 nt, Escherichia coli CFT073
ccgcagcguccagcgccugg

SEQ ID NO: 2667919 - RNA, 14 nt, Escherichia coli CFT073
ccgcagcuccagcc

SEQ ID NO: 2667920 - RNA, 16 nt, Escherichia coli CFT073
ccgcaggagcgccgaa

SEQ ID NO: 2667921 - RNA, 16 nt, Escherichia coli CFT073
ccgcaggaugagcgcg

SEQ ID NO: 2667922 - RNA, 13 nt, Escherichia coli CFT073
ccgcaggcggcaa

SEQ ID NO: 2667923 - RNA, 22 nt, Escherichia coli CFT073
ccgcagguaaacucaauucacg

SEQ ID NO: 2667924 - RNA, 15 nt, Escherichia coli CFT073
ccgcagguagcagca

SEQ ID NO: 2667925 - RNA, 12 nt, Escherichia coli CFT073
ccgcaggucgga

SEQ ID NO: 2667926 - RNA, 16 nt, Escherichia coli CFT073
ccgcaggugacgcugg

SEQ ID NO: 2667927 - RNA, 23 nt, Escherichia coli CFT073
ccgcagucagggucuggugcuga

SEQ ID NO: 2667928 - RNA, 19 nt, Escherichia coli CFT073
ccgcagucauggcucuucc

SEQ ID NO: 2667929 - RNA, 15 nt, Escherichia coli CFT073
ccgcauagacgguuu

SEQ ID NO: 2667930 - RNA, 15 nt, Escherichia coli CFT073
ccgcauauagccaaa

SEQ ID NO: 2667931 - RNA, 14 nt, Escherichia coli CFT073
ccgcaucaauuacc

SEQ ID NO: 2667932 - RNA, 15 nt, Escherichia coli CFT073
ccgcaucaauuaccu

SEQ ID NO: 2667933 - RNA, 17 nt, Escherichia coli CFT073
ccgcaucacgacagcac

SEQ ID NO: 2667934 - RNA, 20 nt, Escherichia coli CFT073
ccgcaucauguaaaucaauu

SEQ ID NO: 2667935 - RNA, 15 nt, Escherichia coli CFT073
ccgcauccgacaaaa

SEQ ID NO: 2667936 - RNA, 11 nt, Escherichia coli CFT073
ccgcauccggc

SEQ ID NO: 2667937 - RNA, 14 nt, Escherichia coli CFT073
ccgcauccggcaaa

SEQ ID NO: 2667938 - RNA, 17 nt, Escherichia coli CFT073
ccgcauccggcaucagu

SEQ ID NO: 2667939 - RNA, 17 nt, Escherichia coli CFT073
ccgcauccggcgacagg

SEQ ID NO: 2667940 - RNA, 23 nt, Escherichia coli CFT073
ccgcauccggcgauuuucaucgc

SEQ ID NO: 2667941 - RNA, 19 nt, Escherichia coli CFT073
ccgcauccggcgcaaaaaa

SEQ ID NO: 2667942 - RNA, 17 nt, Escherichia coli CFT073
ccgcauccggcuuaaau

SEQ ID NO: 2667943 - RNA, 12 nt, Escherichia coli CFT073
ccgcaucgcuca

SEQ ID NO: 2667944 - RNA, 14 nt, Escherichia coli CFT073
ccgcauugcccaau

SEQ ID NO: 2667945 - RNA, 11 nt, Escherichia coli CFT073
ccgcauuggac

SEQ ID NO: 2667946 - RNA, 18 nt, Escherichia coli CFT073
ccgccaaaacaucuucgg

SEQ ID NO: 2667947 - RNA, 22 nt, Escherichia coli CFT073
ccgccaaaacaucuucggcguu

SEQ ID NO: 2667948 - RNA, 15 nt, Escherichia coli CFT073
ccgccaaacgccgca

SEQ ID NO: 2667949 - RNA, 20 nt, Escherichia coli CFT073
ccgccaaacugugcaccgcc

SEQ ID NO: 2667950 - RNA, 24 nt, Escherichia coli CFT073
ccgccaaacugugcaccgcccugc

SEQ ID NO: 2667951 - RNA, 18 nt, Escherichia coli CFT073
ccgccaaaggcuuucgcg

SEQ ID NO: 2667952 - RNA, 19 nt, Escherichia coli CFT073
ccgccaaccagcgcgccgu

SEQ ID NO: 2667953 - RNA, 19 nt, Escherichia coli CFT073
ccgccaaccgcugauugcu

SEQ ID NO: 2667954 - RNA, 20 nt, Escherichia coli CFT073
ccgccaauaaugaacgccac

SEQ ID NO: 2667955 - RNA, 14 nt, Escherichia coli CFT073
ccgccaaucgcccg

SEQ ID NO: 2667956 - RNA, 16 nt, Escherichia coli CFT073
ccgccacacucucgcg

SEQ ID NO: 2667957 - RNA, 11 nt, Escherichia coli CFT073
ccgccaccacg

SEQ ID NO: 2667958 - RNA, 13 nt, Escherichia coli CFT073
ccgccaccagaac

SEQ ID NO: 2667959 - RNA, 16 nt, Escherichia coli CFT073
ccgccaccagaaccgc

SEQ ID NO: 2667960 - RNA, 14 nt, Escherichia coli CFT073
ccgccaccgccaga

SEQ ID NO: 2667961 - RNA, 13 nt, Escherichia coli CFT073
ccgccaccuccgc

SEQ ID NO: 2667962 - RNA, 14 nt, Escherichia coli CFT073
ccgccaccuccgcu

SEQ ID NO: 2667963 - RNA, 22 nt, Escherichia coli CFT073
ccgccacgguaucaagcccgcc

SEQ ID NO: 2667964 - RNA, 16 nt, Escherichia coli CFT073
ccgccacgucaucagc

SEQ ID NO: 2667965 - RNA, 16 nt, Escherichia coli CFT073
ccgccagaagaaccgc

SEQ ID NO: 2667966 - RNA, 24 nt, Escherichia coli CFT073
ccgccagaauacccgaagcgccaa

SEQ ID NO: 2667967 - RNA, 17 nt, Escherichia coli CFT073
ccgccagaaucaccgga

SEQ ID NO: 2667968 - RNA, 17 nt, Escherichia coli CFT073
ccgccagaauccccggc

SEQ ID NO: 2667969 - RNA, 22 nt, Escherichia coli CFT073
ccgccagaauccggugauugcu

SEQ ID NO: 2667970 - RNA, 15 nt, Escherichia coli CFT073
ccgccagaccacugc

SEQ ID NO: 2667971 - RNA, 15 nt, Escherichia coli CFT073
ccgccagaccagcua

SEQ ID NO: 2667972 - RNA, 21 nt, Escherichia coli CFT073
ccgccagacguccggcgcugc

SEQ ID NO: 2667973 - RNA, 15 nt, Escherichia coli CFT073
ccgccagaugcggcg

SEQ ID NO: 2667974 - RNA, 15 nt, Escherichia coli CFT073
ccgccagcacagcca

SEQ ID NO: 2667975 - RNA, 14 nt, Escherichia coli CFT073
ccgccagcagcagc

SEQ ID NO: 2667976 - RNA, 23 nt, Escherichia coli CFT073
ccgccagcagcagcgaauaauuc

SEQ ID NO: 2667977 - RNA, 13 nt, Escherichia coli CFT073
ccgccagcaggaa

SEQ ID NO: 2667978 - RNA, 19 nt, Escherichia coli CFT073
ccgccagcaugccgccaag

SEQ ID NO: 2667979 - RNA, 12 nt, Escherichia coli CFT073
ccgccagcgccu

SEQ ID NO: 2667980 - RNA, 13 nt, Escherichia coli CFT073
ccgccagcgccuc

SEQ ID NO: 2667981 - RNA, 12 nt, Escherichia coli CFT073
ccgccaggcaaa

SEQ ID NO: 2667982 - RNA, 18 nt, Escherichia coli CFT073
ccgccagucacugccacc

SEQ ID NO: 2667983 - RNA, 22 nt, Escherichia coli CFT073
ccgccaguguagcgauuucacg

SEQ ID NO: 2667984 - RNA, 19 nt, Escherichia coli CFT073
ccgccaguuugcaggccaa

SEQ ID NO: 2667985 - RNA, 19 nt, Escherichia coli CFT073
ccgcuaccugccgccacca

SEQ ID NO: 2667986 - RNA, 15 nt, Escherichia coli CFT073
ccgcuacucugaccc

SEQ ID NO: 2667987 - RNA, 13 nt, Escherichia coli CFT073
ccgcuacuggcaa

SEQ ID NO: 2667988 - RNA, 16 nt, Escherichia coli CFT073
ccgcuauccugcgguu

SEQ ID NO: 2667989 - RNA, 19 nt, Escherichia coli CFT073
ccgcuauuauacugcgcuu

SEQ ID NO: 2667990 - RNA, 19 nt, Escherichia coli CFT073
ccgcuauugaccagcgccg

SEQ ID NO: 2667991 - RNA, 17 nt, Escherichia coli CFT073
ccgcuauugagcaugau

SEQ ID NO: 2667992 - RNA, 20 nt, Escherichia coli CFT073
ccgcucacgaugccgccgag

SEQ ID NO: 2667993 - RNA, 22 nt, Escherichia coli CFT073
ccgcucacgcagcggcggcacu

SEQ ID NO: 2667994 - RNA, 18 nt, Escherichia coli CFT073
ccgcucacgguuagcaua

SEQ ID NO: 2667995 - RNA, 16 nt, Escherichia coli CFT073
ccgcucaucaggccug

SEQ ID NO: 2667996 - RNA, 21 nt, Escherichia coli CFT073
ccgcucccggauaccccagcu

SEQ ID NO: 2667997 - RNA, 13 nt, Escherichia coli CFT073
ccgcuccgccauc

SEQ ID NO: 2667998 - RNA, 23 nt, Escherichia coli CFT073
ccgcuccgccaucuucuugcagc

SEQ ID NO: 2667999 - RNA, 18 nt, Escherichia coli CFT073
ccgcuccucaucaauauu

SEQ ID NO: 2668000 - RNA, 14 nt, Escherichia coli CFT073
ccgcuccuucaccu

SEQ ID NO: 2668001 - RNA, 15 nt, Escherichia coli CFT073
ccgcucgaaguuuuc

SEQ ID NO: 2668002 - RNA, 18 nt, Escherichia coli CFT073
ccgcucgaaguuuuccuc

SEQ ID NO: 2668003 - RNA, 13 nt, Escherichia coli CFT073
ccgcucgccgcag

SEQ ID NO: 2668004 - RNA, 21 nt, Escherichia coli CFT073
ccgcucucgaggcucugauug

SEQ ID NO: 2668005 - RNA, 20 nt, Escherichia coli CFT073
ccgcucugaaagcggccuua

SEQ ID NO: 2668006 - RNA, 17 nt, Escherichia coli CFT073
ccgcucugcaucccggc

SEQ ID NO: 2668007 - RNA, 22 nt, Escherichia coli CFT073
ccgcucugcaucccggcaggaa

SEQ ID NO: 2668008 - RNA, 16 nt, Escherichia coli CFT073
ccgcucugcccugcca

SEQ ID NO: 2668009 - RNA, 22 nt, Escherichia coli CFT073
ccgcucugggaucgccggggcg

SEQ ID NO: 2668010 - RNA, 17 nt, Escherichia coli CFT073
ccgcucuucaucuucca

SEQ ID NO: 2668011 - RNA, 18 nt, Escherichia coli CFT073
ccgcucuuucaccgccga

SEQ ID NO: 2668012 - RNA, 18 nt, Escherichia coli CFT073
ccgcugaccguugcucau

SEQ ID NO: 2668013 - RNA, 17 nt, Escherichia coli CFT073
ccgcugagaaaaagcga

SEQ ID NO: 2668014 - RNA, 14 nt, Escherichia coli CFT073
ccgcugauugcugg

SEQ ID NO: 2668015 - RNA, 24 nt, Escherichia coli CFT073
ccgcugcaacacuuccgcuuccag

SEQ ID NO: 2668016 - RNA, 22 nt, Escherichia coli CFT073
ccgcugcgaacacgccuuugac

SEQ ID NO: 2668017 - RNA, 21 nt, Escherichia coli CFT073
ccgcugcuucucuucagccaa

SEQ ID NO: 2668018 - RNA, 13 nt, Escherichia coli CFT073
ccgcuggcauaca

SEQ ID NO: 2668019 - RNA, 19 nt, Escherichia coli CFT073
ccgcuggcgcagcaggcgg

SEQ ID NO: 2668020 - RNA, 21 nt, Escherichia coli CFT073
ccgcuggcgcagcgugcucuc

SEQ ID NO: 2668021 - RNA, 20 nt, Escherichia coli CFT073
ccgcuguaauaccagccuuc

SEQ ID NO: 2668022 - RNA, 19 nt, Escherichia coli CFT073
ccgcugugguucauaugau

SEQ ID NO: 2668023 - RNA, 23 nt, Escherichia coli CFT073
ccgcuguguguaggccagcgaua

SEQ ID NO: 2668024 - RNA, 17 nt, Escherichia coli CFT073
ccgcuguuaugcacacg

SEQ ID NO: 2668025 - RNA, 16 nt, Escherichia coli CFT073
ccgcuguucugauuuu

SEQ ID NO: 2668026 - RNA, 15 nt, Escherichia coli CFT073
ccgcuguugccagca

SEQ ID NO: 2668027 - RNA, 16 nt, Escherichia coli CFT073
ccgcuguugccagcag

SEQ ID NO: 2668028 - RNA, 20 nt, Escherichia coli CFT073
ccgcuguuuguucaagcgca

SEQ ID NO: 2668029 - RNA, 22 nt, Escherichia coli CFT073
ccgcuguuuguucaagcgcaau

SEQ ID NO: 2668030 - RNA, 21 nt, Escherichia coli CFT073
ccgcuuaaauuuccaccgcua

SEQ ID NO: 2668031 - RNA, 23 nt, Escherichia coli CFT073
ccgcuuaccauccacaccaaaau

SEQ ID NO: 2668032 - RNA, 16 nt, Escherichia coli CFT073
ccgcuucaaaguucug

SEQ ID NO: 2668033 - RNA, 19 nt, Escherichia coli CFT073
ccgcuucaaaguucugcgu

SEQ ID NO: 2668034 - RNA, 19 nt, Escherichia coli CFT073
ccgcuucaaucuucgauuu

SEQ ID NO: 2668035 - RNA, 18 nt, Escherichia coli CFT073
ccgcuucaggaacugcau

SEQ ID NO: 2668036 - RNA, 13 nt, Escherichia coli CFT073
ccgcuuccagaaa

SEQ ID NO: 2668037 - RNA, 13 nt, Escherichia coli CFT073
ccgcuucgcccgc

SEQ ID NO: 2668038 - RNA, 16 nt, Escherichia coli CFT073
ccgcuucgcccgccag

SEQ ID NO: 2668039 - RNA, 11 nt, Escherichia coli CFT073
ccgcuucgccu

SEQ ID NO: 2668040 - RNA, 16 nt, Escherichia coli CFT073
ccgcuucgccugcccc

SEQ ID NO: 2668041 - RNA, 21 nt, Escherichia coli CFT073
ccgcuucgcguaaaauugcag

SEQ ID NO: 2668042 - RNA, 15 nt, Escherichia coli CFT073
ccgcuucuucuucca

SEQ ID NO: 2668043 - RNA, 12 nt, Escherichia coli CFT073
ccgcuucuuucu

SEQ ID NO: 2668044 - RNA, 20 nt, Escherichia coli CFT073
ccgcuugccuagggcgcagc

SEQ ID NO: 2668045 - RNA, 23 nt, Escherichia coli CFT073
ccgcuugccuagggcgcagcugu

SEQ ID NO: 2668046 - RNA, 22 nt, Escherichia coli CFT073
ccgcuugcgauauggcugcgcu

SEQ ID NO: 2668047 - RNA, 18 nt, Escherichia coli CFT073
ccgcuuguggaacgcuga

SEQ ID NO: 2668048 - RNA, 23 nt, Escherichia coli CFT073
ccgcuuuaaaauuauccagcgcc

SEQ ID NO: 2668049 - RNA, 13 nt, Escherichia coli CFT073
ccgcuuuaucuga

SEQ ID NO: 2668050 - RNA, 21 nt, Escherichia coli CFT073
ccgcuuuaugugcuucuagca

SEQ ID NO: 2668051 - RNA, 14 nt, Escherichia coli CFT073
ccgcuuucaacgcg

SEQ ID NO: 2668052 - RNA, 13 nt, Escherichia coli CFT073
ccgcuuuccucau

SEQ ID NO: 2668053 - RNA, 14 nt, Escherichia coli CFT073
ccgcuuugcagaau

SEQ ID NO: 2668054 - RNA, 13 nt, Escherichia coli CFT073
ccgcuuuuaaccc

SEQ ID NO: 2668055 - RNA, 14 nt, Escherichia coli CFT073
ccgcuuuuacgcgg

SEQ ID NO: 2668056 - RNA, 19 nt, Escherichia coli CFT073
ccgcuuuuuuacgccugca

SEQ ID NO: 2668057 - RNA, 13 nt, Escherichia coli CFT073
ccgcuuuuuucau

SEQ ID NO: 2668058 - RNA, 21 nt, Escherichia coli CFT073
ccggaaaccaaacuuaugcag

SEQ ID NO: 2668059 - RNA, 23 nt, Escherichia coli CFT073
ccggaaccaccagauccaacauc

SEQ ID NO: 2668060 - RNA, 21 nt, Escherichia coli CFT073
ccggaaccggauuuucaccau

SEQ ID NO: 2668061 - RNA, 12 nt, Escherichia coli CFT073
ccggaacgggag

SEQ ID NO: 2668062 - RNA, 22 nt, Escherichia coli CFT073
ccggaacgggagaaacccggcc

SEQ ID NO: 2668063 - RNA, 21 nt, Escherichia coli CFT073
ccggaacugaugaacggugcg

SEQ ID NO: 2668064 - RNA, 12 nt, Escherichia coli CFT073
ccggaagacuga

SEQ ID NO: 2668065 - RNA, 18 nt, Escherichia coli CFT073
ccggaagaucggaaaggg

SEQ ID NO: 2668066 - RNA, 23 nt, Escherichia coli CFT073
ccggaagcaaaauaaccggcaag

SEQ ID NO: 2668067 - RNA, 17 nt, Escherichia coli CFT073
ccggaagccaccacgcc

SEQ ID NO: 2668068 - RNA, 19 nt, Escherichia coli CFT073
ccggaagcgccaccagcgc

SEQ ID NO: 2668069 - RNA, 17 nt, Escherichia coli CFT073
ccggaauaauaaugucu

SEQ ID NO: 2668070 - RNA, 14 nt, Escherichia coli CFT073
ccggaauaaucaga

SEQ ID NO: 2668071 - RNA, 14 nt, Escherichia coli CFT073
ccggaaucagaauc

SEQ ID NO: 2668072 - RNA, 20 nt, Escherichia coli CFT073
ccggaauggucaccacaaau

SEQ ID NO: 2668073 - RNA, 20 nt, Escherichia coli CFT073
ccggaauuuacccgccaggu

SEQ ID NO: 2668074 - RNA, 22 nt, Escherichia coli CFT073
ccggaccaucuuccagcugcac

SEQ ID NO: 2668075 - RNA, 17 nt, Escherichia coli CFT073
ccggacguucagccaua

SEQ ID NO: 2668076 - RNA, 17 nt, Escherichia coli CFT073
ccggacuggcauugauu

SEQ ID NO: 2668077 - RNA, 19 nt, Escherichia coli CFT073
ccggacuuaacgucacaga

SEQ ID NO: 2668078 - RNA, 20 nt, Escherichia coli CFT073
ccggagagcaauuuccggca

SEQ ID NO: 2668079 - RNA, 18 nt, Escherichia coli CFT073
ccggagcccuacaaacca

SEQ ID NO: 2668080 - RNA, 15 nt, Escherichia coli CFT073
ccggagguuuuucaa

SEQ ID NO: 2668081 - RNA, 14 nt, Escherichia coli CFT073
ccggagucaguccc

SEQ ID NO: 2668082 - RNA, 20 nt, Escherichia coli CFT073
ccggauaagaggcgccagca

SEQ ID NO: 2668083 - RNA, 22 nt, Escherichia coli CFT073
ccggauaagguguucacgccgc

SEQ ID NO: 2668084 - RNA, 18 nt, Escherichia coli CFT073
ccggauaaugcgccagau

SEQ ID NO: 2668085 - RNA, 18 nt, Escherichia coli CFT073
ccggauacaaaaaaggcc

SEQ ID NO: 2668086 - RNA, 14 nt, Escherichia coli CFT073
ccggauagaguguu

SEQ ID NO: 2668087 - RNA, 17 nt, Escherichia coli CFT073
ccggauauccacccgca

SEQ ID NO: 2668088 - RNA, 21 nt, Escherichia coli CFT073
ccggauauccacccgcagcca

SEQ ID NO: 2668089 - RNA, 15 nt, Escherichia coli CFT073
ccggauaucggcagc

SEQ ID NO: 2668090 - RNA, 13 nt, Escherichia coli CFT073
ccggauccagcgg

SEQ ID NO: 2668091 - RNA, 15 nt, Escherichia coli CFT073
ccggaucgaugccaa

SEQ ID NO: 2668092 - RNA, 23 nt, Escherichia coli CFT073
ccggaugacuuuucauccggcga

SEQ ID NO: 2668093 - RNA, 16 nt, Escherichia coli CFT073
ccggcugugcgacuuc

SEQ ID NO: 2668094 - RNA, 13 nt, Escherichia coli CFT073
ccggcuuaaugca

SEQ ID NO: 2668095 - RNA, 16 nt, Escherichia coli CFT073
ccggcuuccugcagcg

SEQ ID NO: 2668096 - RNA, 13 nt, Escherichia coli CFT073
ccggcuuucacuu

SEQ ID NO: 2668097 - RNA, 15 nt, Escherichia coli CFT073
ccggcuuuuuuacau

SEQ ID NO: 2668098 - RNA, 19 nt, Escherichia coli CFT073
ccggcuuuuuuacaucauc

SEQ ID NO: 2668099 - RNA, 20 nt, Escherichia coli CFT073
ccggcuuuuuuacaucauca

SEQ ID NO: 2668100 - RNA, 21 nt, Escherichia coli CFT073
ccgggaaggaaccuguucaac

SEQ ID NO: 2668101 - RNA, 23 nt, Escherichia coli CFT073
ccgggagcggcgucagccagucu

SEQ ID NO: 2668102 - RNA, 13 nt, Escherichia coli CFT073
ccgggagcuguuu

SEQ ID NO: 2668103 - RNA, 20 nt, Escherichia coli CFT073
ccgggauauaugucaccagc

SEQ ID NO: 2668104 - RNA, 21 nt, Escherichia coli CFT073
ccgggauauaugucaccagca

SEQ ID NO: 2668105 - RNA, 22 nt, Escherichia coli CFT073
ccgggaucaccgaaccagggcg

SEQ ID NO: 2668106 - RNA, 18 nt, Escherichia coli CFT073
ccgggaucaucgccugau

SEQ ID NO: 2668107 - RNA, 13 nt, Escherichia coli CFT073
ccgggauugagau

SEQ ID NO: 2668108 - RNA, 16 nt, Escherichia coli CFT073
ccgggauuucaaugcg

SEQ ID NO: 2668109 - RNA, 20 nt, Escherichia coli CFT073
ccgggcaaaugcuccccugc

SEQ ID NO: 2668110 - RNA, 20 nt, Escherichia coli CFT073
ccgggcagccuuucacauca

SEQ ID NO: 2668111 - RNA, 17 nt, Escherichia coli CFT073
ccgggccgcagagauag

SEQ ID NO: 2668112 - RNA, 18 nt, Escherichia coli CFT073
ccgggccucgcagcggca

SEQ ID NO: 2668113 - RNA, 19 nt, Escherichia coli CFT073
ccgggcgaugcagcgcaug

SEQ ID NO: 2668114 - RNA, 18 nt, Escherichia coli CFT073
ccgggcugagucccccaa

SEQ ID NO: 2668115 - RNA, 19 nt, Escherichia coli CFT073
ccgggcuguuuuccagcac

SEQ ID NO: 2668116 - RNA, 20 nt, Escherichia coli CFT073
ccgggcuuccggcaauggcu

SEQ ID NO: 2668117 - RNA, 15 nt, Escherichia coli CFT073
ccgggcuuggggugu

SEQ ID NO: 2668118 - RNA, 18 nt, Escherichia coli CFT073
ccgggggcgaccugugcc

SEQ ID NO: 2668119 - RNA, 18 nt, Escherichia coli CFT073
ccgggggguugccgccac

SEQ ID NO: 2668120 - RNA, 20 nt, Escherichia coli CFT073
ccgggguucgaauccccgcc

SEQ ID NO: 2668121 - RNA, 20 nt, Escherichia coli CFT073
ccgggucagcccccacgcca

SEQ ID NO: 2668122 - RNA, 20 nt, Escherichia coli CFT073
ccgggucgcgacugccagca

SEQ ID NO: 2668123 - RNA, 21 nt, Escherichia coli CFT073
ccgggugcgaugcauccggca

SEQ ID NO: 2668124 - RNA, 19 nt, Escherichia coli CFT073
ccgggugugacaacaacau

SEQ ID NO: 2668125 - RNA, 20 nt, Escherichia coli CFT073
ccgggugugacaacaacauc

SEQ ID NO: 2668126 - RNA, 14 nt, Escherichia coli CFT073
ccggguuacggaaa

SEQ ID NO: 2668127 - RNA, 20 nt, Escherichia coli CFT073
ccggguuauuaguauggucg

SEQ ID NO: 2668128 - RNA, 22 nt, Escherichia coli CFT073
ccggguuauugguuucgucgug

SEQ ID NO: 2668129 - RNA, 18 nt, Escherichia coli CFT073
ccggguuuaacccuguac

SEQ ID NO: 2668130 - RNA, 20 nt, Escherichia coli CFT073
ccggguuugccgcuggcauc

SEQ ID NO: 2668131 - RNA, 15 nt, Escherichia coli CFT073
ccgguaaagcaauga

SEQ ID NO: 2668132 - RNA, 14 nt, Escherichia coli CFT073
ccgguaaucaccag

SEQ ID NO: 2668133 - RNA, 16 nt, Escherichia coli CFT073
ccgguaaucaccagca

SEQ ID NO: 2668134 - RNA, 19 nt, Escherichia coli CFT073
ccgguaauugcacguccag

SEQ ID NO: 2668135 - RNA, 23 nt, Escherichia coli CFT073
ccgguaauugcacguccaguggc

SEQ ID NO: 2668136 - RNA, 17 nt, Escherichia coli CFT073
ccgguacaucaauacca

SEQ ID NO: 2668137 - RNA, 16 nt, Escherichia coli CFT073
ccgguaccuuugaacu

SEQ ID NO: 2668138 - RNA, 14 nt, Escherichia coli CFT073
ccgguacuuuccuu

SEQ ID NO: 2668139 - RNA, 16 nt, Escherichia coli CFT073
ccgguaguaagcguuu

SEQ ID NO: 2668140 - RNA, 12 nt, Escherichia coli CFT073
ccgguaucacuc

SEQ ID NO: 2668141 - RNA, 15 nt, Escherichia coli CFT073
ccgguaugacgagga

SEQ ID NO: 2668142 - RNA, 13 nt, Escherichia coli CFT073
ccggucaccggau

SEQ ID NO: 2668143 - RNA, 22 nt, Escherichia coli CFT073
ccggucagccaucgccaccgcu

SEQ ID NO: 2668144 - RNA, 13 nt, Escherichia coli CFT073
ccggucauuggcc

SEQ ID NO: 2668145 - RNA, 22 nt, Escherichia coli CFT073
ccggucauuggccggaauacca

SEQ ID NO: 2668146 - RNA, 14 nt, Escherichia coli CFT073
ccgguccuggcgau

SEQ ID NO: 2668147 - RNA, 13 nt, Escherichia coli CFT073
ccgguccuucauc

SEQ ID NO: 2668148 - RNA, 22 nt, Escherichia coli CFT073
ccggucuaccgauccggcacca

SEQ ID NO: 2668149 - RNA, 15 nt, Escherichia coli CFT073
ccggugagcacauca

SEQ ID NO: 2668150 - RNA, 19 nt, Escherichia coli CFT073
ccggugauuucgccaucaa

SEQ ID NO: 2668151 - RNA, 17 nt, Escherichia coli CFT073
ccggugccaaagucauc

SEQ ID NO: 2668152 - RNA, 22 nt, Escherichia coli CFT073
ccggugccauuucgcugguacc

SEQ ID NO: 2668153 - RNA, 17 nt, Escherichia coli CFT073
ccggugccgccgucaga

SEQ ID NO: 2668154 - RNA, 15 nt, Escherichia coli CFT073
ccggugccgguuuca

SEQ ID NO: 2668155 - RNA, 15 nt, Escherichia coli CFT073
ccgguggagagcaua

SEQ ID NO: 2668156 - RNA, 14 nt, Escherichia coli CFT073
ccgguguaggcaua

SEQ ID NO: 2668157 - RNA, 18 nt, Escherichia coli CFT073
ccgguguggcauggcgaa

SEQ ID NO: 2668158 - RNA, 17 nt, Escherichia coli CFT073
ccgguuagcucaacgca

SEQ ID NO: 2668159 - RNA, 20 nt, Escherichia coli CFT073
ccgguuaucacccugugucg

SEQ ID NO: 2668160 - RNA, 17 nt, Escherichia coli CFT073
ccgguucacuucacgca

SEQ ID NO: 2668161 - RNA, 15 nt, Escherichia coli CFT073
ccgguucccagaccu

SEQ ID NO: 2668162 - RNA, 15 nt, Escherichia coli CFT073
ccgguuccugcaucg

SEQ ID NO: 2668163 - RNA, 15 nt, Escherichia coli CFT073
ccgguugagauaacg

SEQ ID NO: 2668164 - RNA, 21 nt, Escherichia coli CFT073
ccgguuggcgacugaugaagu

SEQ ID NO: 2668165 - RNA, 23 nt, Escherichia coli CFT073
ccgguugggcgauaaaucguuuc

SEQ ID NO: 2668166 - RNA, 17 nt, Escherichia coli CFT073
ccgguugugaagugcaa

SEQ ID NO: 2668167 - RNA, 22 nt, Escherichia coli CFT073
ccgguugugugcuggccaucac

SEQ ID NO: 2668168 - RNA, 22 nt, Escherichia coli CFT073
ccgguuguucaaccaccggcac

SEQ ID NO: 2668169 - RNA, 23 nt, Escherichia coli CFT073
ccgguuguucaaccaccggcacc

SEQ ID NO: 2668170 - RNA, 23 nt, Escherichia coli CFT073
ccgguuguuuugguuauuaacug

SEQ ID NO: 2668171 - RNA, 15 nt, Escherichia coli CFT073
ccgguuuagaaaaga

SEQ ID NO: 2668172 - RNA, 15 nt, Escherichia coli CFT073
ccgguuucaauccag

SEQ ID NO: 2668173 - RNA, 17 nt, Escherichia coli CFT073
ccgguuucaauccaggu

SEQ ID NO: 2668174 - RNA, 19 nt, Escherichia coli CFT073
ccgguuucgaacugaugug

SEQ ID NO: 2668175 - RNA, 22 nt, Escherichia coli CFT073
ccgguuucgccgcggcgcagcu

SEQ ID NO: 2668176 - RNA, 13 nt, Escherichia coli CFT073
ccgguuugcgccg

SEQ ID NO: 2668177 - RNA, 14 nt, Escherichia coli CFT073
ccgguuuucugccu

SEQ ID NO: 2668178 - RNA, 19 nt, Escherichia coli CFT073
ccguaaaacucacaaccag

SEQ ID NO: 2668179 - RNA, 15 nt, Escherichia coli CFT073
ccguaaacaucaucc

SEQ ID NO: 2668180 - RNA, 20 nt, Escherichia coli CFT073
ccguaaacccuaacaucauc

SEQ ID NO: 2668181 - RNA, 22 nt, Escherichia coli CFT073
ccguaacaggugauaauccaga

SEQ ID NO: 2668182 - RNA, 17 nt, Escherichia coli CFT073
ccguaaccaccagcacu

SEQ ID NO: 2668183 - RNA, 19 nt, Escherichia coli CFT073
ccguaaccaccagcacuga

SEQ ID NO: 2668184 - RNA, 21 nt, Escherichia coli CFT073
ccguaaccaccagcacugauu

SEQ ID NO: 2668185 - RNA, 21 nt, Escherichia coli CFT073
ccguaacgcucaagaacggca

SEQ ID NO: 2668186 - RNA, 22 nt, Escherichia coli CFT073
ccguaacgcucaagaacggcaa

SEQ ID NO: 2668187 - RNA, 21 nt, Escherichia coli CFT073
ccguaaguaagauaaaagcaa

SEQ ID NO: 2668188 - RNA, 21 nt, Escherichia coli CFT073
ccguaauguugcgccaguucc

SEQ ID NO: 2668189 - RNA, 18 nt, Escherichia coli CFT073
ccguaauuaacaccuuaa

SEQ ID NO: 2668190 - RNA, 23 nt, Escherichia coli CFT073
ccguaauuauuacuccacuuccu

SEQ ID NO: 2668191 - RNA, 22 nt, Escherichia coli CFT073
ccguaccaucauaagcgccagg

SEQ ID NO: 2668192 - RNA, 14 nt, Escherichia coli CFT073
ccguaccgggcgcg

SEQ ID NO: 2668193 - RNA, 14 nt, Escherichia coli CFT073
ccguacgcuuuucc

SEQ ID NO: 2668194 - RNA, 19 nt, Escherichia coli CFT073
ccguagccauuaccagguc

SEQ ID NO: 2668195 - RNA, 13 nt, Escherichia coli CFT073
ccguagcccaauc

SEQ ID NO: 2668196 - RNA, 19 nt, Escherichia coli CFT073
ccguagcggcgauaaacag

SEQ ID NO: 2668197 - RNA, 17 nt, Escherichia coli CFT073
ccguagcguaaaucauc

SEQ ID NO: 2668198 - RNA, 18 nt, Escherichia coli CFT073
ccguagcguaaaucaucg

SEQ ID NO: 2668199 - RNA, 22 nt, Escherichia coli CFT073
ccguagcguuugcuguacugcc

SEQ ID NO: 2668200 - RNA, 22 nt, Escherichia coli CFT073
ccguuugccagaacugcugcgc

SEQ ID NO: 2668201 - RNA, 12 nt, Escherichia coli CFT073
ccguuuucucca

SEQ ID NO: 2668202 - RNA, 17 nt, Escherichia coli CFT073
ccguuuuuugaaacagg

SEQ ID NO: 2668203 - RNA, 18 nt, Escherichia coli CFT073
ccuaaaaacaguaccaga

SEQ ID NO: 2668204 - RNA, 18 nt, Escherichia coli CFT073
ccuaaaagcacgccagac

SEQ ID NO: 2668205 - RNA, 21 nt, Escherichia coli CFT073
ccuaaaagcacgccagacauc

SEQ ID NO: 2668206 - RNA, 16 nt, Escherichia coli CFT073
ccuaaagcuaucccuu

SEQ ID NO: 2668207 - RNA, 11 nt, Escherichia coli CFT073
ccuaaauaacc

SEQ ID NO: 2668208 - RNA, 18 nt, Escherichia coli CFT073
ccuaacaaccauccccaa

SEQ ID NO: 2668209 - RNA, 21 nt, Escherichia coli CFT073
ccuaacacagcaauaauaaua

SEQ ID NO: 2668210 - RNA, 19 nt, Escherichia coli CFT073
ccuaacacgaucagccaua

SEQ ID NO: 2668211 - RNA, 17 nt, Escherichia coli CFT073
ccuaaccggcgcggacg

SEQ ID NO: 2668212 - RNA, 15 nt, Escherichia coli CFT073
ccuaacucuuccugc

SEQ ID NO: 2668213 - RNA, 16 nt, Escherichia coli CFT073
ccuaacucuuccugcg

SEQ ID NO: 2668214 - RNA, 17 nt, Escherichia coli CFT073
ccuaacucuuccugcgc

SEQ ID NO: 2668215 - RNA, 14 nt, Escherichia coli CFT073
ccuaacucuuucaa

SEQ ID NO: 2668216 - RNA, 15 nt, Escherichia coli CFT073
ccuaaugaauccagc

SEQ ID NO: 2668217 - RNA, 13 nt, Escherichia coli CFT073
ccuaauuuuuuga

SEQ ID NO: 2668218 - RNA, 14 nt, Escherichia coli CFT073
ccuacaaaaucaug

SEQ ID NO: 2668219 - RNA, 17 nt, Escherichia coli CFT073
ccuacaaaggcacgcca

SEQ ID NO: 2668220 - RNA, 19 nt, Escherichia coli CFT073
ccuacaaguccguugaaau

SEQ ID NO: 2668221 - RNA, 18 nt, Escherichia coli CFT073
ccuacagaacgcugcaau

SEQ ID NO: 2668222 - RNA, 19 nt, Escherichia coli CFT073
ccuacagagcugauuuccg

SEQ ID NO: 2668223 - RNA, 18 nt, Escherichia coli CFT073
ccuacagguaagguaaug

SEQ ID NO: 2668224 - RNA, 23 nt, Escherichia coli CFT073
ccuacauccaguauauugcugau

SEQ ID NO: 2668225 - RNA, 17 nt, Escherichia coli CFT073
ccuaccugcaguucauc

SEQ ID NO: 2668226 - RNA, 23 nt, Escherichia coli CFT073
ccuacgauucggcauuaauuagu

SEQ ID NO: 2668227 - RNA, 17 nt, Escherichia coli CFT073
ccuacggauucaaugca

SEQ ID NO: 2668228 - RNA, 16 nt, Escherichia coli CFT073
ccuacgggaacagugc

SEQ ID NO: 2668229 - RNA, 18 nt, Escherichia coli CFT073
ccuacgggaacagugcuc

SEQ ID NO: 2668230 - RNA, 18 nt, Escherichia coli CFT073
ccuacucucgcaugggga

SEQ ID NO: 2668231 - RNA, 13 nt, Escherichia coli CFT073
ccuacugcuccua

SEQ ID NO: 2668232 - RNA, 16 nt, Escherichia coli CFT073
ccuagcaaacuaucug

SEQ ID NO: 2668233 - RNA, 15 nt, Escherichia coli CFT073
ccuauaaggcucucu

SEQ ID NO: 2668234 - RNA, 19 nt, Escherichia coli CFT073
ccuauaccuaacacgauca

SEQ ID NO: 2668235 - RNA, 17 nt, Escherichia coli CFT073
ccuauaucaacgcccau

SEQ ID NO: 2668236 - RNA, 13 nt, Escherichia coli CFT073
ccuaucgcgucgc

SEQ ID NO: 2668237 - RNA, 19 nt, Escherichia coli CFT073
ccuaugcagguuggcgacg

SEQ ID NO: 2668238 - RNA, 23 nt, Escherichia coli CFT073
ccuauuauccggcaaccaccguu

SEQ ID NO: 2668239 - RNA, 21 nt, Escherichia coli CFT073
ccuauugcucuacgcuucucu

SEQ ID NO: 2668240 - RNA, 16 nt, Escherichia coli CFT073
ccuauuuaaauccuac

SEQ ID NO: 2668241 - RNA, 19 nt, Escherichia coli CFT073
ccucaacgaugcgaccgcc

SEQ ID NO: 2668242 - RNA, 16 nt, Escherichia coli CFT073
ccucaacgccgcacag

SEQ ID NO: 2668243 - RNA, 23 nt, Escherichia coli CFT073
ccucaagcguuugcggcuguucc

SEQ ID NO: 2668244 - RNA, 13 nt, Escherichia coli CFT073
ccucaauaaucau

SEQ ID NO: 2668245 - RNA, 23 nt, Escherichia coli CFT073
ccucaauaaucauucgcccgccg

SEQ ID NO: 2668246 - RNA, 21 nt, Escherichia coli CFT073
ccucaauggcagcaucacgca

SEQ ID NO: 2668247 - RNA, 21 nt, Escherichia coli CFT073
ccucacagagcgcuuauacac

SEQ ID NO: 2668248 - RNA, 12 nt, Escherichia coli CFT073
ccucacagaggu

SEQ ID NO: 2668249 - RNA, 20 nt, Escherichia coli CFT073
ccucacagcuaaucaucauc

SEQ ID NO: 2668250 - RNA, 15 nt, Escherichia coli CFT073
ccucacccuaacccu

SEQ ID NO: 2668251 - RNA, 22 nt, Escherichia coli CFT073
ccucacccuaacccucuccccg

SEQ ID NO: 2668252 - RNA, 13 nt, Escherichia coli CFT073
ccucaccuaaaua

SEQ ID NO: 2668253 - RNA, 16 nt, Escherichia coli CFT073
ccucaccuaaauaagu

SEQ ID NO: 2668254 - RNA, 20 nt, Escherichia coli CFT073
ccucaccucaauggcagcau

SEQ ID NO: 2668255 - RNA, 17 nt, Escherichia coli CFT073
ccucaccuuccacgcgg

SEQ ID NO: 2668256 - RNA, 13 nt, Escherichia coli CFT073
ccucacgaagcgu

SEQ ID NO: 2668257 - RNA, 21 nt, Escherichia coli CFT073
ccucacgaagcguugucagcc

SEQ ID NO: 2668258 - RNA, 14 nt, Escherichia coli CFT073
ccucacgcaaauuc

SEQ ID NO: 2668259 - RNA, 20 nt, Escherichia coli CFT073
ccucacgcaaauucuucgcg

SEQ ID NO: 2668260 - RNA, 15 nt, Escherichia coli CFT073
ccucacuguuggcuu

SEQ ID NO: 2668261 - RNA, 17 nt, Escherichia coli CFT073
ccucacuuugauuuaua

SEQ ID NO: 2668262 - RNA, 13 nt, Escherichia coli CFT073
ccucagaaaucag

SEQ ID NO: 2668263 - RNA, 19 nt, Escherichia coli CFT073
ccucagaaaucagauaaaa

SEQ ID NO: 2668264 - RNA, 14 nt, Escherichia coli CFT073
ccucagcaguuucg

SEQ ID NO: 2668265 - RNA, 13 nt, Escherichia coli CFT073
ccucagccagcgg

SEQ ID NO: 2668266 - RNA, 14 nt, Escherichia coli CFT073
ccucagccugauag

SEQ ID NO: 2668267 - RNA, 21 nt, Escherichia coli CFT073
ccucagggcggcuaucccaaa

SEQ ID NO: 2668268 - RNA, 11 nt, Escherichia coli CFT073
ccucagguuca

SEQ ID NO: 2668269 - RNA, 18 nt, Escherichia coli CFT073
ccucagguucaaccgcag

SEQ ID NO: 2668270 - RNA, 16 nt, Escherichia coli CFT073
ccucagguugauagaa

SEQ ID NO: 2668271 - RNA, 17 nt, Escherichia coli CFT073
ccucagguugauagaaa

SEQ ID NO: 2668272 - RNA, 16 nt, Escherichia coli CFT073
ccucauaaauugcuga

SEQ ID NO: 2668273 - RNA, 19 nt, Escherichia coli CFT073
ccucaucauccucuucagc

SEQ ID NO: 2668274 - RNA, 15 nt, Escherichia coli CFT073
ccucaucgcgcaacg

SEQ ID NO: 2668275 - RNA, 23 nt, Escherichia coli CFT073
ccucaucuccaguuucgagaaau

SEQ ID NO: 2668276 - RNA, 14 nt, Escherichia coli CFT073
ccucauuaagccac

SEQ ID NO: 2668277 - RNA, 19 nt, Escherichia coli CFT073
ccucauuaaucaccaguca

SEQ ID NO: 2668278 - RNA, 12 nt, Escherichia coli CFT073
ccucauuuaaaa

SEQ ID NO: 2668279 - RNA, 19 nt, Escherichia coli CFT073
ccucauuuucaauucuaga

SEQ ID NO: 2668280 - RNA, 15 nt, Escherichia coli CFT073
ccuccaaaaaacaaa

SEQ ID NO: 2668281 - RNA, 13 nt, Escherichia coli CFT073
ccuccaacaaccc

SEQ ID NO: 2668282 - RNA, 11 nt, Escherichia coli CFT073
ccuccaccacu

SEQ ID NO: 2668283 - RNA, 22 nt, Escherichia coli CFT073
ccuccagcgagcuggcgcugau

SEQ ID NO: 2668284 - RNA, 15 nt, Escherichia coli CFT073
ccuccaugaaaauag

SEQ ID NO: 2668285 - RNA, 15 nt, Escherichia coli CFT073
ccucccguuuuuaga

SEQ ID NO: 2668286 - RNA, 16 nt, Escherichia coli CFT073
ccucccguuuuuagau

SEQ ID NO: 2668287 - RNA, 21 nt, Escherichia coli CFT073
ccuccggcgucagauucggau

SEQ ID NO: 2668288 - RNA, 22 nt, Escherichia coli CFT073
ccuccugcaaaugcugacgugu

SEQ ID NO: 2668289 - RNA, 12 nt, Escherichia coli CFT073
ccuccugcagcg

SEQ ID NO: 2668290 - RNA, 18 nt, Escherichia coli CFT073
ccuccuggaacacgcgca

SEQ ID NO: 2668291 - RNA, 19 nt, Escherichia coli CFT073
ccuccugucuaaccgccug

SEQ ID NO: 2668292 - RNA, 20 nt, Escherichia coli CFT073
ccucgauuggggagaaaaac

SEQ ID NO: 2668293 - RNA, 14 nt, Escherichia coli CFT073
ccucgccccuccgg

SEQ ID NO: 2668294 - RNA, 14 nt, Escherichia coli CFT073
ccucgcccgcagaa

SEQ ID NO: 2668295 - RNA, 17 nt, Escherichia coli CFT073
ccucgccgagcagcugu

SEQ ID NO: 2668296 - RNA, 15 nt, Escherichia coli CFT073
ccucgccguuaauga

SEQ ID NO: 2668297 - RNA, 15 nt, Escherichia coli CFT073
ccucgcuuuuaugcc

SEQ ID NO: 2668298 - RNA, 12 nt, Escherichia coli CFT073
ccucggcacgcg

SEQ ID NO: 2668299 - RNA, 17 nt, Escherichia coli CFT073
ccucgguuaacagcgca

SEQ ID NO: 2668300 - RNA, 20 nt, Escherichia coli CFT073
ccucgucaccaccucacccg

SEQ ID NO: 2668301 - RNA, 18 nt, Escherichia coli CFT073
ccucgucccaaaagcucg

SEQ ID NO: 2668302 - RNA, 20 nt, Escherichia coli CFT073
ccucgucggcgguuuucauc

SEQ ID NO: 2668303 - RNA, 18 nt, Escherichia coli CFT073
ccucguuggucagcucaa

SEQ ID NO: 2668304 - RNA, 18 nt, Escherichia coli CFT073
ccucguuucgcccugccu

SEQ ID NO: 2668305 - RNA, 15 nt, Escherichia coli CFT073
ccucguuuugccgcc

SEQ ID NO: 2668306 - RNA, 18 nt, Escherichia coli CFT073
ccucuaaaccccaaccac

SEQ ID NO: 2668307 - RNA, 18 nt, Escherichia coli CFT073
ccucuaacagaucaucca

SEQ ID NO: 2668308 - RNA, 11 nt, Escherichia coli CFT073
ccucuaacucu

SEQ ID NO: 2668309 - RNA, 17 nt, Escherichia coli CFT073
ccugcaaauaaauaccg

SEQ ID NO: 2668310 - RNA, 24 nt, Escherichia coli CFT073
ccugcaacaucaauaaagccgccc

SEQ ID NO: 2668311 - RNA, 13 nt, Escherichia coli CFT073
ccugcaacaucac

SEQ ID NO: 2668312 - RNA, 13 nt, Escherichia coli CFT073
ccugcaacugaug

SEQ ID NO: 2668313 - RNA, 15 nt, Escherichia coli CFT073
ccugcaaggugguca

SEQ ID NO: 2668314 - RNA, 17 nt, Escherichia coli CFT073
ccugcaagguggucaga

SEQ ID NO: 2668315 - RNA, 18 nt, Escherichia coli CFT073
ccugcaauaccgccguua

SEQ ID NO: 2668316 - RNA, 23 nt, Escherichia coli CFT073
ccugcaauauauugaauuagcaa

SEQ ID NO: 2668317 - RNA, 17 nt, Escherichia coli CFT073
ccugcaauguuaacugu

SEQ ID NO: 2668318 - RNA, 15 nt, Escherichia coli CFT073
ccugcacaaagcgcc

SEQ ID NO: 2668319 - RNA, 17 nt, Escherichia coli CFT073
ccugcacaaagcgccag

SEQ ID NO: 2668320 - RNA, 20 nt, Escherichia coli CFT073
ccugcacaaagcgccagaau

SEQ ID NO: 2668321 - RNA, 13 nt, Escherichia coli CFT073
ccugcacaccaac

SEQ ID NO: 2668322 - RNA, 14 nt, Escherichia coli CFT073
ccugcaccacaaca

SEQ ID NO: 2668323 - RNA, 19 nt, Escherichia coli CFT073
ccugcaccggugcauccac

SEQ ID NO: 2668324 - RNA, 18 nt, Escherichia coli CFT073
ccugcaccucaaaaccaa

SEQ ID NO: 2668325 - RNA, 18 nt, Escherichia coli CFT073
ccugcacggucacaucgc

SEQ ID NO: 2668326 - RNA, 14 nt, Escherichia coli CFT073
ccugcacugguggc

SEQ ID NO: 2668327 - RNA, 18 nt, Escherichia coli CFT073
ccugcacugguggcaccu

SEQ ID NO: 2668328 - RNA, 15 nt, Escherichia coli CFT073
ccugcacuucaaauu

SEQ ID NO: 2668329 - RNA, 22 nt, Escherichia coli CFT073
ccugcagcugcagauaacuggc

SEQ ID NO: 2668330 - RNA, 21 nt, Escherichia coli CFT073
ccugcaggaaagcaagaccaa

SEQ ID NO: 2668331 - RNA, 16 nt, Escherichia coli CFT073
ccugcaguaaagcccg

SEQ ID NO: 2668332 - RNA, 14 nt, Escherichia coli CFT073
ccugcagucaccug

SEQ ID NO: 2668333 - RNA, 18 nt, Escherichia coli CFT073
ccugcagucaccugcccu

SEQ ID NO: 2668334 - RNA, 21 nt, Escherichia coli CFT073
ccugcauaaaggcaaaacagu

SEQ ID NO: 2668335 - RNA, 17 nt, Escherichia coli CFT073
ccugcauaaugucgcug

SEQ ID NO: 2668336 - RNA, 20 nt, Escherichia coli CFT073
ccugcauaaugucgcuggcc

SEQ ID NO: 2668337 - RNA, 13 nt, Escherichia coli CFT073
ccugcauacugac

SEQ ID NO: 2668338 - RNA, 18 nt, Escherichia coli CFT073
ccugcauauaaucgaucc

SEQ ID NO: 2668339 - RNA, 11 nt, Escherichia coli CFT073
ccugcauaucg

SEQ ID NO: 2668340 - RNA, 23 nt, Escherichia coli CFT073
ccugcauaucgguaaaugcuuua

SEQ ID NO: 2668341 - RNA, 19 nt, Escherichia coli CFT073
ccugccaaccaacgcgccg

SEQ ID NO: 2668342 - RNA, 17 nt, Escherichia coli CFT073
ccugccaauggcaggau

SEQ ID NO: 2668343 - RNA, 17 nt, Escherichia coli CFT073
ccugccacaguuuuuca

SEQ ID NO: 2668344 - RNA, 18 nt, Escherichia coli CFT073
ccugccagaagcagaaug

SEQ ID NO: 2668345 - RNA, 12 nt, Escherichia coli CFT073
ccugccagcuug

SEQ ID NO: 2668346 - RNA, 18 nt, Escherichia coli CFT073
ccugccaguuauagcgca

SEQ ID NO: 2668347 - RNA, 21 nt, Escherichia coli CFT073
ccugccaguuauagcgcagac

SEQ ID NO: 2668348 - RNA, 15 nt, Escherichia coli CFT073
ccugccaguuuuucc

SEQ ID NO: 2668349 - RNA, 20 nt, Escherichia coli CFT073
ccugccaugccaaacagaau

SEQ ID NO: 2668350 - RNA, 14 nt, Escherichia coli CFT073
ccugcccaauauac

SEQ ID NO: 2668351 - RNA, 20 nt, Escherichia coli CFT073
ccugccccagagacaacccg

SEQ ID NO: 2668352 - RNA, 14 nt, Escherichia coli CFT073
ccugccccaucugc

SEQ ID NO: 2668353 - RNA, 14 nt, Escherichia coli CFT073
ccugcccgauaaaa

SEQ ID NO: 2668354 - RNA, 18 nt, Escherichia coli CFT073
ccugcccgcgauccagcg

SEQ ID NO: 2668355 - RNA, 13 nt, Escherichia coli CFT073
ccugcccgcugcc

SEQ ID NO: 2668356 - RNA, 17 nt, Escherichia coli CFT073
ccugcccgcugccagga

SEQ ID NO: 2668357 - RNA, 21 nt, Escherichia coli CFT073
ccugcccggagccaucccugc

SEQ ID NO: 2668358 - RNA, 13 nt, Escherichia coli CFT073
ccugcccuccggu

SEQ ID NO: 2668359 - RNA, 18 nt, Escherichia coli CFT073
ccugccgcgccugcgcca

SEQ ID NO: 2668360 - RNA, 18 nt, Escherichia coli CFT073
ccugccgucugggcaaaa

SEQ ID NO: 2668361 - RNA, 14 nt, Escherichia coli CFT073
ccugccugacagac

SEQ ID NO: 2668362 - RNA, 14 nt, Escherichia coli CFT073
ccugccugacgaug

SEQ ID NO: 2668363 - RNA, 13 nt, Escherichia coli CFT073
ccugcgauaaacc

SEQ ID NO: 2668364 - RNA, 14 nt, Escherichia coli CFT073
ccugcgcaaggcau

SEQ ID NO: 2668365 - RNA, 22 nt, Escherichia coli CFT073
ccugcgcaauaaccguaacgca

SEQ ID NO: 2668366 - RNA, 21 nt, Escherichia coli CFT073
ccugcgcauuucgcucuucac

SEQ ID NO: 2668367 - RNA, 23 nt, Escherichia coli CFT073
ccugcgcauuucgcucuucacau

SEQ ID NO: 2668368 - RNA, 23 nt, Escherichia coli CFT073
ccugcgccaccacaacauuccca

SEQ ID NO: 2668369 - RNA, 24 nt, Escherichia coli CFT073
ccugcgccgauacgcauaaacauc

SEQ ID NO: 2668370 - RNA, 16 nt, Escherichia coli CFT073
ccugcgcgaugcgucg

SEQ ID NO: 2668371 - RNA, 15 nt, Escherichia coli CFT073
ccugcgcguuacugg

SEQ ID NO: 2668372 - RNA, 14 nt, Escherichia coli CFT073
ccugcggaucaagu

SEQ ID NO: 2668373 - RNA, 17 nt, Escherichia coli CFT073
ccugcggcggcaucgcc

SEQ ID NO: 2668374 - RNA, 19 nt, Escherichia coli CFT073
ccugcggcguaccaauacg

SEQ ID NO: 2668375 - RNA, 23 nt, Escherichia coli CFT073
ccugcggggaugaauauguaggc

SEQ ID NO: 2668376 - RNA, 16 nt, Escherichia coli CFT073
ccugcggguucuuacc

SEQ ID NO: 2668377 - RNA, 14 nt, Escherichia coli CFT073
ccugcggugcagcc

SEQ ID NO: 2668378 - RNA, 18 nt, Escherichia coli CFT073
ccugcgguugaaacacag

SEQ ID NO: 2668379 - RNA, 18 nt, Escherichia coli CFT073
ccugcguaacuguucgag

SEQ ID NO: 2668380 - RNA, 19 nt, Escherichia coli CFT073
ccugcgucgccaucgucac

SEQ ID NO: 2668381 - RNA, 18 nt, Escherichia coli CFT073
ccugcgucuaucagugca

SEQ ID NO: 2668382 - RNA, 16 nt, Escherichia coli CFT073
ccugcgucugaugaaa

SEQ ID NO: 2668383 - RNA, 13 nt, Escherichia coli CFT073
ccugcguguggcg

SEQ ID NO: 2668384 - RNA, 22 nt, Escherichia coli CFT073
ccugcguguggcgguagcgacc

SEQ ID NO: 2668385 - RNA, 15 nt, Escherichia coli CFT073
ccugcguucagcagu

SEQ ID NO: 2668386 - RNA, 20 nt, Escherichia coli CFT073
ccugcguucagcaguucugc

SEQ ID NO: 2668387 - RNA, 18 nt, Escherichia coli CFT073
ccugcguuuguccgccag

SEQ ID NO: 2668388 - RNA, 12 nt, Escherichia coli CFT073
ccugcuaacagu

SEQ ID NO: 2668389 - RNA, 14 nt, Escherichia coli CFT073
ccugcuacaccauu

SEQ ID NO: 2668390 - RNA, 23 nt, Escherichia coli CFT073
ccugcuaccgggaucuccuccag

SEQ ID NO: 2668391 - RNA, 14 nt, Escherichia coli CFT073
ccugcucaaccgcc

SEQ ID NO: 2668392 - RNA, 18 nt, Escherichia coli CFT073
ccugcucaagcguuucau

SEQ ID NO: 2668393 - RNA, 22 nt, Escherichia coli CFT073
ccugcucaaguaauaaagcacc

SEQ ID NO: 2668394 - RNA, 14 nt, Escherichia coli CFT073
ccugcucaaucgca

SEQ ID NO: 2668395 - RNA, 15 nt, Escherichia coli CFT073
ccugcucaaucgcau

SEQ ID NO: 2668396 - RNA, 21 nt, Escherichia coli CFT073
ccugcucagcacgccacucac

SEQ ID NO: 2668397 - RNA, 23 nt, Escherichia coli CFT073
ccugcuccagcagcucaaucgcc

SEQ ID NO: 2668398 - RNA, 14 nt, Escherichia coli CFT073
ccugcuccaucauc

SEQ ID NO: 2668399 - RNA, 12 nt, Escherichia coli CFT073
ccugcuccgcca

SEQ ID NO: 2668400 - RNA, 15 nt, Escherichia coli CFT073
ccugcucgcgcagau

SEQ ID NO: 2668401 - RNA, 22 nt, Escherichia coli CFT073
ccugcucgucggcaaagcgggc

SEQ ID NO: 2668402 - RNA, 23 nt, Escherichia coli CFT073
ccugcugaauauugccaauggug

SEQ ID NO: 2668403 - RNA, 19 nt, Escherichia coli CFT073
ccugcugaauuuccugcgc

SEQ ID NO: 2668404 - RNA, 24 nt, Escherichia coli CFT073
ccugcugauaagacgcauccacca

SEQ ID NO: 2668405 - RNA, 15 nt, Escherichia coli CFT073
ccugcugcacaccau

SEQ ID NO: 2668406 - RNA, 14 nt, Escherichia coli CFT073
ccugcugcacagag

SEQ ID NO: 2668407 - RNA, 14 nt, Escherichia coli CFT073
ccugcugcgucgcg

SEQ ID NO: 2668408 - RNA, 14 nt, Escherichia coli CFT073
ccugcuggcagcgu

SEQ ID NO: 2668409 - RNA, 16 nt, Escherichia coli CFT073
ccugcuggcagcgugu

SEQ ID NO: 2668410 - RNA, 19 nt, Escherichia coli CFT073
ccugcuggcuagccucccu

SEQ ID NO: 2668411 - RNA, 13 nt, Escherichia coli CFT073
ccugcuggguaaa

SEQ ID NO: 2668412 - RNA, 12 nt, Escherichia coli CFT073
ccugcugguugc

SEQ ID NO: 2668413 - RNA, 21 nt, Escherichia coli CFT073
ccugcugugucucuucuuugc

SEQ ID NO: 2668414 - RNA, 21 nt, Escherichia coli CFT073
ccugcuuaucgcccugcucca

SEQ ID NO: 2668415 - RNA, 15 nt, Escherichia coli CFT073
ccugcuuuuaccauc

SEQ ID NO: 2668416 - RNA, 13 nt, Escherichia coli CFT073
ccuggaacgaugc

SEQ ID NO: 2668417 - RNA, 14 nt, Escherichia coli CFT073
ccuggacaguuuca

SEQ ID NO: 2668418 - RNA, 16 nt, Escherichia coli CFT073
ccuuccgccaucaauc

SEQ ID NO: 2668419 - RNA, 16 nt, Escherichia coli CFT073
ccuuccgguuucaaau

SEQ ID NO: 2668420 - RNA, 18 nt, Escherichia coli CFT073
ccuuccugauaacacagc

SEQ ID NO: 2668421 - RNA, 19 nt, Escherichia coli CFT073
ccuucgaaugccgcagcac

SEQ ID NO: 2668422 - RNA, 15 nt, Escherichia coli CFT073
ccuucgauauauuuu

SEQ ID NO: 2668423 - RNA, 23 nt, Escherichia coli CFT073
ccuucgccagaauauugccauua

SEQ ID NO: 2668424 - RNA, 22 nt, Escherichia coli CFT073
ccuucgccagugcguugugcgc

SEQ ID NO: 2668425 - RNA, 16 nt, Escherichia coli CFT073
ccuucgccgcuuuaau

SEQ ID NO: 2668426 - RNA, 22 nt, Escherichia coli CFT073
ccuucgcggaauuucagaaaac

SEQ ID NO: 2668427 - RNA, 19 nt, Escherichia coli CFT073
ccuucgcggcaaaacagcc

SEQ ID NO: 2668428 - RNA, 17 nt, Escherichia coli CFT073
ccuucgcuaucaaacug

SEQ ID NO: 2668429 - RNA, 16 nt, Escherichia coli CFT073
ccuucgcugaauaucu

SEQ ID NO: 2668430 - RNA, 13 nt, Escherichia coli CFT073
ccuucggcaaauc

SEQ ID NO: 2668431 - RNA, 14 nt, Escherichia coli CFT073
ccuucggucagagu

SEQ ID NO: 2668432 - RNA, 17 nt, Escherichia coli CFT073
ccuucguacugugcgcc

SEQ ID NO: 2668433 - RNA, 13 nt, Escherichia coli CFT073
ccuucguccagca

SEQ ID NO: 2668434 - RNA, 19 nt, Escherichia coli CFT073
ccuucguguauuuugcauc

SEQ ID NO: 2668435 - RNA, 13 nt, Escherichia coli CFT073
ccuucuaaagcaa

SEQ ID NO: 2668436 - RNA, 19 nt, Escherichia coli CFT073
ccuucugagaucaaugcgc

SEQ ID NO: 2668437 - RNA, 21 nt, Escherichia coli CFT073
ccuucugagaucaaugcgcca

SEQ ID NO: 2668438 - RNA, 14 nt, Escherichia coli CFT073
ccuucugccaccag

SEQ ID NO: 2668439 - RNA, 18 nt, Escherichia coli CFT073
ccuucugcgcccgcccgc

SEQ ID NO: 2668440 - RNA, 15 nt, Escherichia coli CFT073
ccuucuggcgacccg

SEQ ID NO: 2668441 - RNA, 17 nt, Escherichia coli CFT073
ccuucuguaaccuuuuc

SEQ ID NO: 2668442 - RNA, 18 nt, Escherichia coli CFT073
ccuucuucgaaaugcugg

SEQ ID NO: 2668443 - RNA, 12 nt, Escherichia coli CFT073
ccuucuucuuuc

SEQ ID NO: 2668444 - RNA, 13 nt, Escherichia coli CFT073
ccuucuugcuguc

SEQ ID NO: 2668445 - RNA, 17 nt, Escherichia coli CFT073
ccuugaguuuuucaucc

SEQ ID NO: 2668446 - RNA, 14 nt, Escherichia coli CFT073
ccuugaugaaaaaa

SEQ ID NO: 2668447 - RNA, 14 nt, Escherichia coli CFT073
ccuugcagacgauc

SEQ ID NO: 2668448 - RNA, 14 nt, Escherichia coli CFT073
ccuugcccaccagc

SEQ ID NO: 2668449 - RNA, 21 nt, Escherichia coli CFT073
ccuugcgauaucccauuuacu

SEQ ID NO: 2668450 - RNA, 22 nt, Escherichia coli CFT073
ccuugcgauaucccauuuacug

SEQ ID NO: 2668451 - RNA, 19 nt, Escherichia coli CFT073
ccuugcgcgacaugcucug

SEQ ID NO: 2668452 - RNA, 13 nt, Escherichia coli CFT073
ccuugcggcggug

SEQ ID NO: 2668453 - RNA, 21 nt, Escherichia coli CFT073
ccuugcguacaccaacaucac

SEQ ID NO: 2668454 - RNA, 20 nt, Escherichia coli CFT073
ccuugcgugacgccugcucc

SEQ ID NO: 2668455 - RNA, 19 nt, Escherichia coli CFT073
ccuugcucauccauugcuu

SEQ ID NO: 2668456 - RNA, 18 nt, Escherichia coli CFT073
ccuugcuccacgcucaga

SEQ ID NO: 2668457 - RNA, 15 nt, Escherichia coli CFT073
ccuugcugcuccagc

SEQ ID NO: 2668458 - RNA, 13 nt, Escherichia coli CFT073
ccuugugcugcgc

SEQ ID NO: 2668459 - RNA, 21 nt, Escherichia coli CFT073
ccuuguggaaauuccagcggc

SEQ ID NO: 2668460 - RNA, 19 nt, Escherichia coli CFT073
ccuugugggccugaaagcu

SEQ ID NO: 2668461 - RNA, 20 nt, Escherichia coli CFT073
ccuugugggccugaaagcuc

SEQ ID NO: 2668462 - RNA, 21 nt, Escherichia coli CFT073
ccuuguuggaucaugcucuua

SEQ ID NO: 2668463 - RNA, 15 nt, Escherichia coli CFT073
ccuuguuuaaggaaa

SEQ ID NO: 2668464 - RNA, 20 nt, Escherichia coli CFT073
ccuuuaaacaggccgacaaa

SEQ ID NO: 2668465 - RNA, 15 nt, Escherichia coli CFT073
ccuuuaaacuguuuc

SEQ ID NO: 2668466 - RNA, 20 nt, Escherichia coli CFT073
ccuuuaaucuuagacaucaa

SEQ ID NO: 2668467 - RNA, 18 nt, Escherichia coli CFT073
ccuuuacaugaaaaauag

SEQ ID NO: 2668468 - RNA, 21 nt, Escherichia coli CFT073
ccuuuaccagacgggcauuuc

SEQ ID NO: 2668469 - RNA, 20 nt, Escherichia coli CFT073
ccuuuaccgccacagcagcc

SEQ ID NO: 2668470 - RNA, 15 nt, Escherichia coli CFT073
ccuuuacgaagaaau

SEQ ID NO: 2668471 - RNA, 13 nt, Escherichia coli CFT073
ccuuuacgcaaag

SEQ ID NO: 2668472 - RNA, 21 nt, Escherichia coli CFT073
ccuuuacggcgcgucaaguua

SEQ ID NO: 2668473 - RNA, 18 nt, Escherichia coli CFT073
ccuuuacugacuguccca

SEQ ID NO: 2668474 - RNA, 20 nt, Escherichia coli CFT073
ccuuuacuggccuggcgaua

SEQ ID NO: 2668475 - RNA, 14 nt, Escherichia coli CFT073
ccuuuaucugcccu

SEQ ID NO: 2668476 - RNA, 17 nt, Escherichia coli CFT073
ccuuuaucugcccuuua

SEQ ID NO: 2668477 - RNA, 21 nt, Escherichia coli CFT073
ccuuuauucagaaaacguugg

SEQ ID NO: 2668478 - RNA, 17 nt, Escherichia coli CFT073
ccuuucaaucacccgau

SEQ ID NO: 2668479 - RNA, 23 nt, Escherichia coli CFT073
ccuuucacgccgggaaauuuuuc

SEQ ID NO: 2668480 - RNA, 14 nt, Escherichia coli CFT073
ccuuucagccccag

SEQ ID NO: 2668481 - RNA, 18 nt, Escherichia coli CFT073
ccuuucagccccagcgca

SEQ ID NO: 2668482 - RNA, 21 nt, Escherichia coli CFT073
ccuuuccccggcagcaucagu

SEQ ID NO: 2668483 - RNA, 23 nt, Escherichia coli CFT073
ccuuucccuuacccucuccccag

SEQ ID NO: 2668484 - RNA, 15 nt, Escherichia coli CFT073
ccuuucggugaauac

SEQ ID NO: 2668485 - RNA, 17 nt, Escherichia coli CFT073
ccuuucuccgcgaccug

SEQ ID NO: 2668486 - RNA, 19 nt, Escherichia coli CFT073
ccuuucugcagcgcggcga

SEQ ID NO: 2668487 - RNA, 13 nt, Escherichia coli CFT073
ccuuucugcaucc

SEQ ID NO: 2668488 - RNA, 21 nt, Escherichia coli CFT073
ccuuucugcauccguucuucg

SEQ ID NO: 2668489 - RNA, 18 nt, Escherichia coli CFT073
ccuuucuggacacagcgu

SEQ ID NO: 2668490 - RNA, 21 nt, Escherichia coli CFT073
ccuuucuguuccauaaucgcc

SEQ ID NO: 2668491 - RNA, 18 nt, Escherichia coli CFT073
ccuuucuuuguucuucug

SEQ ID NO: 2668492 - RNA, 16 nt, Escherichia coli CFT073
ccuuugauuuucaggu

SEQ ID NO: 2668493 - RNA, 18 nt, Escherichia coli CFT073
ccuuugcggugcagcagc

SEQ ID NO: 2668494 - RNA, 21 nt, Escherichia coli CFT073
ccuuuguacuggagcuggcga

SEQ ID NO: 2668495 - RNA, 19 nt, Escherichia coli CFT073
ccuuuguaggccagauaag

SEQ ID NO: 2668496 - RNA, 11 nt, Escherichia coli CFT073
ccuuuguauuu

SEQ ID NO: 2668497 - RNA, 18 nt, Escherichia coli CFT073
ccuuugucgggcaggcuu

SEQ ID NO: 2668498 - RNA, 18 nt, Escherichia coli CFT073
ccuuuuccauugccgcag

SEQ ID NO: 2668499 - RNA, 19 nt, Escherichia coli CFT073
ccuuuugcauaugcugcuu

SEQ ID NO: 2668500 - RNA, 15 nt, Escherichia coli CFT073
ccuuuugcccggcaa

SEQ ID NO: 2668501 - RNA, 16 nt, Escherichia coli CFT073
ccuuuugccuucugag

SEQ ID NO: 2668502 - RNA, 12 nt, Escherichia coli CFT073
ccuuuuggcagu

SEQ ID NO: 2668503 - RNA, 15 nt, Escherichia coli CFT073
ccuuuuggugccgga

SEQ ID NO: 2668504 - RNA, 19 nt, Escherichia coli CFT073
ccuuuuuaggucgcccugu

SEQ ID NO: 2668505 - RNA, 18 nt, Escherichia coli CFT073
ccuuuuuauuuagauaaa

SEQ ID NO: 2668506 - RNA, 13 nt, Escherichia coli CFT073
cgaaaaaaaagau

SEQ ID NO: 2668507 - RNA, 14 nt, Escherichia coli CFT073
cgaaaaaaauuacu

SEQ ID NO: 2668508 - RNA, 13 nt, Escherichia coli CFT073
cgaaaacaucaug

SEQ ID NO: 2668509 - RNA, 17 nt, Escherichia coli CFT073
cgaaaacgauguuugcu

SEQ ID NO: 2668510 - RNA, 20 nt, Escherichia coli CFT073
cgaaaacgauguuugcugcg

SEQ ID NO: 2668511 - RNA, 20 nt, Escherichia coli CFT073
cgaaaacgcauaucuucuga

SEQ ID NO: 2668512 - RNA, 15 nt, Escherichia coli CFT073
cgaaaacgcuccaac

SEQ ID NO: 2668513 - RNA, 16 nt, Escherichia coli CFT073
cgaaaacugacgguuu

SEQ ID NO: 2668514 - RNA, 17 nt, Escherichia coli CFT073
cgaaaaggauaaauaaa

SEQ ID NO: 2668515 - RNA, 16 nt, Escherichia coli CFT073
cgaaaaucacgcugcc

SEQ ID NO: 2668516 - RNA, 14 nt, Escherichia coli CFT073
cgaaaaucauuuau

SEQ ID NO: 2668517 - RNA, 17 nt, Escherichia coli CFT073
cgaaaauuacgaaagca

SEQ ID NO: 2668518 - RNA, 21 nt, Escherichia coli CFT073
cgaaaauuacuuuccgccauu

SEQ ID NO: 2668519 - RNA, 19 nt, Escherichia coli CFT073
cgaaaauuuggauuuuugc

SEQ ID NO: 2668520 - RNA, 22 nt, Escherichia coli CFT073
cgaaacaccggugaccaucagc

SEQ ID NO: 2668521 - RNA, 18 nt, Escherichia coli CFT073
cgaaaccaagaccaaucc

SEQ ID NO: 2668522 - RNA, 12 nt, Escherichia coli CFT073
cgaaaccacagu

SEQ ID NO: 2668523 - RNA, 22 nt, Escherichia coli CFT073
cgaaaccacaguucaaugcgcc

SEQ ID NO: 2668524 - RNA, 21 nt, Escherichia coli CFT073
cgaaaccacucccgcgcuucg

SEQ ID NO: 2668525 - RNA, 17 nt, Escherichia coli CFT073
cgaaaccagcagccauc

SEQ ID NO: 2668526 - RNA, 17 nt, Escherichia coli CFT073
cgaaucgcuucauuuac

SEQ ID NO: 2668527 - RNA, 13 nt, Escherichia coli CFT073
cgaaucggcgaac

SEQ ID NO: 2668528 - RNA, 21 nt, Escherichia coli CFT073
cgaaucguauuaucgacaaac

SEQ ID NO: 2668529 - RNA, 20 nt, Escherichia coli CFT073
cgaaucuguucuggaaaaaa

SEQ ID NO: 2668530 - RNA, 17 nt, Escherichia coli CFT073
cgaaugaagcagaagcc

SEQ ID NO: 2668531 - RNA, 18 nt, Escherichia coli CFT073
cgaaugccgcagcacccu

SEQ ID NO: 2668532 - RNA, 17 nt, Escherichia coli CFT073
cgaaugcgucgugauaa

SEQ ID NO: 2668533 - RNA, 23 nt, Escherichia coli CFT073
cgaauggcugcacuuucaguacg

SEQ ID NO: 2668534 - RNA, 17 nt, Escherichia coli CFT073
cgaauggguucgauuuc

SEQ ID NO: 2668535 - RNA, 14 nt, Escherichia coli CFT073
cgaauuaacaccac

SEQ ID NO: 2668536 - RNA, 19 nt, Escherichia coli CFT073
cgaauuaagaauuucucag

SEQ ID NO: 2668537 - RNA, 21 nt, Escherichia coli CFT073
cgaauuaagaauuucucaguu

SEQ ID NO: 2668538 - RNA, 20 nt, Escherichia coli CFT073
cgaauuauucagaguauaua

SEQ ID NO: 2668539 - RNA, 17 nt, Escherichia coli CFT073
cgaauuccgccuccgcu

SEQ ID NO: 2668540 - RNA, 13 nt, Escherichia coli CFT073
cgaauuccugacu

SEQ ID NO: 2668541 - RNA, 18 nt, Escherichia coli CFT073
cgaauugacuagcuuuuc

SEQ ID NO: 2668542 - RNA, 23 nt, Escherichia coli CFT073
cgaauugagaugacgccacuggc

SEQ ID NO: 2668543 - RNA, 17 nt, Escherichia coli CFT073
cgaauugcuuccaguaa

SEQ ID NO: 2668544 - RNA, 15 nt, Escherichia coli CFT073
cgaauuuauuuguga

SEQ ID NO: 2668545 - RNA, 18 nt, Escherichia coli CFT073
cgaauuuccgcgaccuga

SEQ ID NO: 2668546 - RNA, 22 nt, Escherichia coli CFT073
cgaauuuguuccccaugcuggu

SEQ ID NO: 2668547 - RNA, 16 nt, Escherichia coli CFT073
cgacaaaaaagcguuc

SEQ ID NO: 2668548 - RNA, 16 nt, Escherichia coli CFT073
cgacaaaaacccugcc

SEQ ID NO: 2668549 - RNA, 21 nt, Escherichia coli CFT073
cgacaaaaucagaaacaaaua

SEQ ID NO: 2668550 - RNA, 16 nt, Escherichia coli CFT073
cgacaaaaucccggcg

SEQ ID NO: 2668551 - RNA, 22 nt, Escherichia coli CFT073
cgacaaagaccugaacacgcaa

SEQ ID NO: 2668552 - RNA, 22 nt, Escherichia coli CFT073
cgacaaagcccgaugcgcgacc

SEQ ID NO: 2668553 - RNA, 20 nt, Escherichia coli CFT073
cgacaaagcucaccugagua

SEQ ID NO: 2668554 - RNA, 17 nt, Escherichia coli CFT073
cgacaaaugcgccgcca

SEQ ID NO: 2668555 - RNA, 18 nt, Escherichia coli CFT073
cgacaaaugcgccgccaa

SEQ ID NO: 2668556 - RNA, 14 nt, Escherichia coli CFT073
cgacaaauguugca

SEQ ID NO: 2668557 - RNA, 23 nt, Escherichia coli CFT073
cgacaaccugaccuuuuuucagc

SEQ ID NO: 2668558 - RNA, 20 nt, Escherichia coli CFT073
cgacaacguuuucaacaauc

SEQ ID NO: 2668559 - RNA, 18 nt, Escherichia coli CFT073
cgacaagaauauugcuau

SEQ ID NO: 2668560 - RNA, 18 nt, Escherichia coli CFT073
cgacaagcauaacaaaau

SEQ ID NO: 2668561 - RNA, 19 nt, Escherichia coli CFT073
cgacaagcucauuucccaa

SEQ ID NO: 2668562 - RNA, 20 nt, Escherichia coli CFT073
cgacaagcucucuucaucgu

SEQ ID NO: 2668563 - RNA, 14 nt, Escherichia coli CFT073
cgacaaggaacgcc

SEQ ID NO: 2668564 - RNA, 21 nt, Escherichia coli CFT073
cgacaauaaaacguugcccgc

SEQ ID NO: 2668565 - RNA, 18 nt, Escherichia coli CFT073
cgacaauaaucaccacac

SEQ ID NO: 2668566 - RNA, 14 nt, Escherichia coli CFT073
cgacaauauugaug

SEQ ID NO: 2668567 - RNA, 18 nt, Escherichia coli CFT073
cgacaauauugaugcucg

SEQ ID NO: 2668568 - RNA, 19 nt, Escherichia coli CFT073
cgacaauccagucagcggu

SEQ ID NO: 2668569 - RNA, 16 nt, Escherichia coli CFT073
cgacaaucgcaaauau

SEQ ID NO: 2668570 - RNA, 18 nt, Escherichia coli CFT073
cgacaaucgcccccauca

SEQ ID NO: 2668571 - RNA, 24 nt, Escherichia coli CFT073
cgacaaugugaaaacccugcgcau

SEQ ID NO: 2668572 - RNA, 13 nt, Escherichia coli CFT073
cgacacaacgcuu

SEQ ID NO: 2668573 - RNA, 15 nt, Escherichia coli CFT073
cgacacaaucaaauc

SEQ ID NO: 2668574 - RNA, 15 nt, Escherichia coli CFT073
cgacacaauccaugc

SEQ ID NO: 2668575 - RNA, 15 nt, Escherichia coli CFT073
cgacacaaugccaua

SEQ ID NO: 2668576 - RNA, 15 nt, Escherichia coli CFT073
cgacaccacgcgcau

SEQ ID NO: 2668577 - RNA, 11 nt, Escherichia coli CFT073
cgacaccagca

SEQ ID NO: 2668578 - RNA, 15 nt, Escherichia coli CFT073
cgacacgcaucacgc

SEQ ID NO: 2668579 - RNA, 20 nt, Escherichia coli CFT073
cgacacggcucaaccuucuu

SEQ ID NO: 2668580 - RNA, 22 nt, Escherichia coli CFT073
cgacacggcucgccuuuucgcc

SEQ ID NO: 2668581 - RNA, 23 nt, Escherichia coli CFT073
cgacacggcucgccuuuucgccc

SEQ ID NO: 2668582 - RNA, 14 nt, Escherichia coli CFT073
cgacagaagaggag

SEQ ID NO: 2668583 - RNA, 16 nt, Escherichia coli CFT073
cgacagacgccagcgc

SEQ ID NO: 2668584 - RNA, 18 nt, Escherichia coli CFT073
cgacagcaaauugcgcca

SEQ ID NO: 2668585 - RNA, 14 nt, Escherichia coli CFT073
cgacagccagccca

SEQ ID NO: 2668586 - RNA, 23 nt, Escherichia coli CFT073
cgacagccauaaagaaaucaccu

SEQ ID NO: 2668587 - RNA, 17 nt, Escherichia coli CFT073
cgacagcguuucgccgc

SEQ ID NO: 2668588 - RNA, 20 nt, Escherichia coli CFT073
cgacagcguuucgccgccca

SEQ ID NO: 2668589 - RNA, 19 nt, Escherichia coli CFT073
cgacaggaaccaaaugccg

SEQ ID NO: 2668590 - RNA, 21 nt, Escherichia coli CFT073
cgacaggcuuacguuacccag

SEQ ID NO: 2668591 - RNA, 15 nt, Escherichia coli CFT073
cgacaguaccagcag

SEQ ID NO: 2668592 - RNA, 16 nt, Escherichia coli CFT073
cgacaguaccagcagu

SEQ ID NO: 2668593 - RNA, 20 nt, Escherichia coli CFT073
cgacaguaccagcaguacag

SEQ ID NO: 2668594 - RNA, 14 nt, Escherichia coli CFT073
cgacaguaucguga

SEQ ID NO: 2668595 - RNA, 23 nt, Escherichia coli CFT073
cgacauacucagcgccugcugca

SEQ ID NO: 2668596 - RNA, 14 nt, Escherichia coli CFT073
cgacauagccaucc

SEQ ID NO: 2668597 - RNA, 18 nt, Escherichia coli CFT073
cgacauagccaucccuaa

SEQ ID NO: 2668598 - RNA, 16 nt, Escherichia coli CFT073
cgacauaucgccagua

SEQ ID NO: 2668599 - RNA, 21 nt, Escherichia coli CFT073
cgacauauguuuaauguugag

SEQ ID NO: 2668600 - RNA, 16 nt, Escherichia coli CFT073
cgacaucaacgccuga

SEQ ID NO: 2668601 - RNA, 18 nt, Escherichia coli CFT073
cgacauccaugcacugca

SEQ ID NO: 2668602 - RNA, 14 nt, Escherichia coli CFT073
cgacauccgccagc

SEQ ID NO: 2668603 - RNA, 18 nt, Escherichia coli CFT073
cgacaucgacucaccacg

SEQ ID NO: 2668604 - RNA, 12 nt, Escherichia coli CFT073
cgacaucgccac

SEQ ID NO: 2668605 - RNA, 14 nt, Escherichia coli CFT073
cgacaucgccacgg

SEQ ID NO: 2668606 - RNA, 13 nt, Escherichia coli CFT073
cgacaucgcccgg

SEQ ID NO: 2668607 - RNA, 21 nt, Escherichia coli CFT073
cgacaucgucuccagcgaauc

SEQ ID NO: 2668608 - RNA, 13 nt, Escherichia coli CFT073
cgacaucuucucu

SEQ ID NO: 2668609 - RNA, 23 nt, Escherichia coli CFT073
cgacaucuuucugcgcaucuucc

SEQ ID NO: 2668610 - RNA, 20 nt, Escherichia coli CFT073
cgacauuaagacgcagauuu

SEQ ID NO: 2668611 - RNA, 13 nt, Escherichia coli CFT073
cgacauuuccccc

SEQ ID NO: 2668612 - RNA, 24 nt, Escherichia coli CFT073
cgacauuuuuaugaugcacuucag

SEQ ID NO: 2668613 - RNA, 19 nt, Escherichia coli CFT073
cgaccaacugcaaggccau

SEQ ID NO: 2668614 - RNA, 22 nt, Escherichia coli CFT073
cgaccaaucacacaaccaugca

SEQ ID NO: 2668615 - RNA, 23 nt, Escherichia coli CFT073
cgaccaauuacacacaacacauc

SEQ ID NO: 2668616 - RNA, 23 nt, Escherichia coli CFT073
cgaccacaaauaccccaccgccg

SEQ ID NO: 2668617 - RNA, 17 nt, Escherichia coli CFT073
cgaccaccucggcacug

SEQ ID NO: 2668618 - RNA, 19 nt, Escherichia coli CFT073
cgaccaccucggcacugac

SEQ ID NO: 2668619 - RNA, 17 nt, Escherichia coli CFT073
cgaccacggccaguccg

SEQ ID NO: 2668620 - RNA, 18 nt, Escherichia coli CFT073
cgaccacugaccgcccgg

SEQ ID NO: 2668621 - RNA, 12 nt, Escherichia coli CFT073
cgaccacuucca

SEQ ID NO: 2668622 - RNA, 12 nt, Escherichia coli CFT073
cgaccagaaaug

SEQ ID NO: 2668623 - RNA, 23 nt, Escherichia coli CFT073
cgaccagaauaucguauccgguu

SEQ ID NO: 2668624 - RNA, 22 nt, Escherichia coli CFT073
cgaccagcaccgccagcagcag

SEQ ID NO: 2668625 - RNA, 12 nt, Escherichia coli CFT073
cgaccagcgcaa

SEQ ID NO: 2668626 - RNA, 14 nt, Escherichia coli CFT073
cgaccagcgccgca

SEQ ID NO: 2668627 - RNA, 15 nt, Escherichia coli CFT073
cgaccagcggcaaca

SEQ ID NO: 2668628 - RNA, 12 nt, Escherichia coli CFT073
cgaccaggcaaa

SEQ ID NO: 2668629 - RNA, 17 nt, Escherichia coli CFT073
cgaccaggcaaaccagu

SEQ ID NO: 2668630 - RNA, 16 nt, Escherichia coli CFT073
cgaccaggccaucagc

SEQ ID NO: 2668631 - RNA, 21 nt, Escherichia coli CFT073
cgaccagugcaacagagagca

SEQ ID NO: 2668632 - RNA, 17 nt, Escherichia coli CFT073
cgaccaucguuaccuuu

SEQ ID NO: 2668633 - RNA, 21 nt, Escherichia coli CFT073
cgaccaucguuaccuuugcag

SEQ ID NO: 2668634 - RNA, 14 nt, Escherichia coli CFT073
cgagcaacgcagcg

SEQ ID NO: 2668635 - RNA, 23 nt, Escherichia coli CFT073
cgagcaaguaguccgcaauaacg

SEQ ID NO: 2668636 - RNA, 21 nt, Escherichia coli CFT073
cgagcaaugagcuauguuuga

SEQ ID NO: 2668637 - RNA, 22 nt, Escherichia coli CFT073
cgagcacaaagccgugccagau

SEQ ID NO: 2668638 - RNA, 23 nt, Escherichia coli CFT073
cgagcacaaagccgugccagaug

SEQ ID NO: 2668639 - RNA, 18 nt, Escherichia coli CFT073
cgagcagauacugaugaa

SEQ ID NO: 2668640 - RNA, 16 nt, Escherichia coli CFT073
cgagcagcauaauugc

SEQ ID NO: 2668641 - RNA, 19 nt, Escherichia coli CFT073
cgagcagcauuccggcauu

SEQ ID NO: 2668642 - RNA, 12 nt, Escherichia coli CFT073
cgagcagccacu

SEQ ID NO: 2668643 - RNA, 21 nt, Escherichia coli CFT073
cgagcaggacgcucccucaau

SEQ ID NO: 2668644 - RNA, 16 nt, Escherichia coli CFT073
cgagcaguaauccagc

SEQ ID NO: 2668645 - RNA, 14 nt, Escherichia coli CFT073
cgagcaguacagcc

SEQ ID NO: 2668646 - RNA, 18 nt, Escherichia coli CFT073
cgagcaguacagccgcca

SEQ ID NO: 2668647 - RNA, 19 nt, Escherichia coli CFT073
cgagcaguuguuccaguug

SEQ ID NO: 2668648 - RNA, 21 nt, Escherichia coli CFT073
cgagcaguuguuccaguugau

SEQ ID NO: 2668649 - RNA, 20 nt, Escherichia coli CFT073
cgagcaguuuggacaugccc

SEQ ID NO: 2668650 - RNA, 12 nt, Escherichia coli CFT073
cgagcaucacua

SEQ ID NO: 2668651 - RNA, 13 nt, Escherichia coli CFT073
cgagcaucaucuu

SEQ ID NO: 2668652 - RNA, 15 nt, Escherichia coli CFT073
cgagcauccgauccu

SEQ ID NO: 2668653 - RNA, 23 nt, Escherichia coli CFT073
cgagcaucgcgaggaaugacgga

SEQ ID NO: 2668654 - RNA, 13 nt, Escherichia coli CFT073
cgagcauugccag

SEQ ID NO: 2668655 - RNA, 18 nt, Escherichia coli CFT073
cgagccaaacgcccagcu

SEQ ID NO: 2668656 - RNA, 19 nt, Escherichia coli CFT073
cgagccaaacgcccagcua

SEQ ID NO: 2668657 - RNA, 20 nt, Escherichia coli CFT073
cgagccaccaauacuugcga

SEQ ID NO: 2668658 - RNA, 16 nt, Escherichia coli CFT073
cgagccagcgcauccu

SEQ ID NO: 2668659 - RNA, 13 nt, Escherichia coli CFT073
cgagccagugccc

SEQ ID NO: 2668660 - RNA, 19 nt, Escherichia coli CFT073
cgagccagugcccgcgauu

SEQ ID NO: 2668661 - RNA, 14 nt, Escherichia coli CFT073
cgagccgccgcauu

SEQ ID NO: 2668662 - RNA, 23 nt, Escherichia coli CFT073
cgagccgucccuaacaugccacu

SEQ ID NO: 2668663 - RNA, 20 nt, Escherichia coli CFT073
cgagcgcagcaacaucacgc

SEQ ID NO: 2668664 - RNA, 13 nt, Escherichia coli CFT073
cgagcgccagcga

SEQ ID NO: 2668665 - RNA, 14 nt, Escherichia coli CFT073
cgagcgccagcgaa

SEQ ID NO: 2668666 - RNA, 18 nt, Escherichia coli CFT073
cgagcggcgggcuuuaau

SEQ ID NO: 2668667 - RNA, 19 nt, Escherichia coli CFT073
cgagcguucaaaacggcug

SEQ ID NO: 2668668 - RNA, 21 nt, Escherichia coli CFT073
cgagcguugccgcucccggca

SEQ ID NO: 2668669 - RNA, 13 nt, Escherichia coli CFT073
cgagcuaauaauc

SEQ ID NO: 2668670 - RNA, 16 nt, Escherichia coli CFT073
cgagcugccaguugcg

SEQ ID NO: 2668671 - RNA, 23 nt, Escherichia coli CFT073
cgagcuucaauaucaucauccgc

SEQ ID NO: 2668672 - RNA, 16 nt, Escherichia coli CFT073
cgagcuucgacuuccu

SEQ ID NO: 2668673 - RNA, 19 nt, Escherichia coli CFT073
cgagcuucgacuuccugca

SEQ ID NO: 2668674 - RNA, 18 nt, Escherichia coli CFT073
cgagcuuucgaccagcca

SEQ ID NO: 2668675 - RNA, 15 nt, Escherichia coli CFT073
cgagcuuucuuauuc

SEQ ID NO: 2668676 - RNA, 16 nt, Escherichia coli CFT073
cgaggaauucagcgug

SEQ ID NO: 2668677 - RNA, 18 nt, Escherichia coli CFT073
cgaggaucgauaucacca

SEQ ID NO: 2668678 - RNA, 16 nt, Escherichia coli CFT073
cgaggcaaugccccag

SEQ ID NO: 2668679 - RNA, 20 nt, Escherichia coli CFT073
cgaggccaauuuggcugcca

SEQ ID NO: 2668680 - RNA, 18 nt, Escherichia coli CFT073
cgaggccauauuucacau

SEQ ID NO: 2668681 - RNA, 21 nt, Escherichia coli CFT073
cgaggcucugauugccuucca

SEQ ID NO: 2668682 - RNA, 18 nt, Escherichia coli CFT073
cgaggcuuauccggcauu

SEQ ID NO: 2668683 - RNA, 20 nt, Escherichia coli CFT073
cgagguggaacaucaggauc

SEQ ID NO: 2668684 - RNA, 15 nt, Escherichia coli CFT073
cgagguuaauauuuu

SEQ ID NO: 2668685 - RNA, 15 nt, Escherichia coli CFT073
cgagguuauaaaccc

SEQ ID NO: 2668686 - RNA, 13 nt, Escherichia coli CFT073
cgagguuuuccuu

SEQ ID NO: 2668687 - RNA, 12 nt, Escherichia coli CFT073
cgaguaaaaaaa

SEQ ID NO: 2668688 - RNA, 15 nt, Escherichia coli CFT073
cgaguaaaaaaacau

SEQ ID NO: 2668689 - RNA, 19 nt, Escherichia coli CFT073
cgaguaaacaggggcugua

SEQ ID NO: 2668690 - RNA, 18 nt, Escherichia coli CFT073
cgaguagccagcugccug

SEQ ID NO: 2668691 - RNA, 14 nt, Escherichia coli CFT073
cgaguaucguuggc

SEQ ID NO: 2668692 - RNA, 14 nt, Escherichia coli CFT073
cgaguaucuuugcc

SEQ ID NO: 2668693 - RNA, 11 nt, Escherichia coli CFT073
cgaguccgcuu

SEQ ID NO: 2668694 - RNA, 16 nt, Escherichia coli CFT073
cgaguccuuccuggcu

SEQ ID NO: 2668695 - RNA, 21 nt, Escherichia coli CFT073
cgagucgccuguacuuccugu

SEQ ID NO: 2668696 - RNA, 17 nt, Escherichia coli CFT073
cgagucgccuuuuucca

SEQ ID NO: 2668697 - RNA, 15 nt, Escherichia coli CFT073
cgagucgcugagcgu

SEQ ID NO: 2668698 - RNA, 17 nt, Escherichia coli CFT073
cgagucgcugagcgugc

SEQ ID NO: 2668699 - RNA, 22 nt, Escherichia coli CFT073
cgagucgcugagcgugccccug

SEQ ID NO: 2668700 - RNA, 16 nt, Escherichia coli CFT073
cgagucgucaguucca

SEQ ID NO: 2668701 - RNA, 17 nt, Escherichia coli CFT073
cgagugcauccagugcc

SEQ ID NO: 2668702 - RNA, 19 nt, Escherichia coli CFT073
cgagugccagcgagagagc

SEQ ID NO: 2668703 - RNA, 13 nt, Escherichia coli CFT073
cgaguggcgcagu

SEQ ID NO: 2668704 - RNA, 14 nt, Escherichia coli CFT073
cgagugguaugacu

SEQ ID NO: 2668705 - RNA, 23 nt, Escherichia coli CFT073
cgaguugcgguuucaacugcggu

SEQ ID NO: 2668706 - RNA, 20 nt, Escherichia coli CFT073
cgaguuguugugcggcaacg

SEQ ID NO: 2668707 - RNA, 20 nt, Escherichia coli CFT073
cgaguuucguuaaacgccaa

SEQ ID NO: 2668708 - RNA, 15 nt, Escherichia coli CFT073
cgaguuuucagcaau

SEQ ID NO: 2668709 - RNA, 15 nt, Escherichia coli CFT073
cgauaaaacauuacu

SEQ ID NO: 2668710 - RNA, 18 nt, Escherichia coli CFT073
cgauaaaacgccgcuggu

SEQ ID NO: 2668711 - RNA, 15 nt, Escherichia coli CFT073
cgauaaaagugcaga

SEQ ID NO: 2668712 - RNA, 14 nt, Escherichia coli CFT073
cgauaaaaucccau

SEQ ID NO: 2668713 - RNA, 15 nt, Escherichia coli CFT073
cgauaaacagcgucg

SEQ ID NO: 2668714 - RNA, 18 nt, Escherichia coli CFT073
cgauaaacaguuccgcaa

SEQ ID NO: 2668715 - RNA, 18 nt, Escherichia coli CFT073
cgauaaacucaaucaggc

SEQ ID NO: 2668716 - RNA, 14 nt, Escherichia coli CFT073
cgauaaaguugaag

SEQ ID NO: 2668717 - RNA, 14 nt, Escherichia coli CFT073
cgauaacaaucacc

SEQ ID NO: 2668718 - RNA, 17 nt, Escherichia coli CFT073
cgauaacaaucaccaaa

SEQ ID NO: 2668719 - RNA, 21 nt, Escherichia coli CFT073
cgauaacaaucaccaaaccaa

SEQ ID NO: 2668720 - RNA, 14 nt, Escherichia coli CFT073
cgauaaccaggcag

SEQ ID NO: 2668721 - RNA, 14 nt, Escherichia coli CFT073
cgauaaccccagau

SEQ ID NO: 2668722 - RNA, 21 nt, Escherichia coli CFT073
cgauaaccugccgcgccugcg

SEQ ID NO: 2668723 - RNA, 19 nt, Escherichia coli CFT073
cgauaacgccccaauccac

SEQ ID NO: 2668724 - RNA, 21 nt, Escherichia coli CFT073
cgauaacggaucggaacgcga

SEQ ID NO: 2668725 - RNA, 14 nt, Escherichia coli CFT073
cgauaacggucgua

SEQ ID NO: 2668726 - RNA, 13 nt, Escherichia coli CFT073
cgauaacugcucu

SEQ ID NO: 2668727 - RNA, 15 nt, Escherichia coli CFT073
cgauaaggcguugau

SEQ ID NO: 2668728 - RNA, 22 nt, Escherichia coli CFT073
cgauaagguaucgcgaaaaaaa

SEQ ID NO: 2668729 - RNA, 23 nt, Escherichia coli CFT073
cgauaagguaucgcgaaaaaaaa

SEQ ID NO: 2668730 - RNA, 17 nt, Escherichia coli CFT073
cgauaauaaucgcuucg

SEQ ID NO: 2668731 - RNA, 19 nt, Escherichia coli CFT073
cgauaauacgcuaaauaaa

SEQ ID NO: 2668732 - RNA, 17 nt, Escherichia coli CFT073
cgauaauaucggccugg

SEQ ID NO: 2668733 - RNA, 23 nt, Escherichia coli CFT073
cgauaaucaacgcgccgccaacc

SEQ ID NO: 2668734 - RNA, 15 nt, Escherichia coli CFT073
cgauaaucagcgcca

SEQ ID NO: 2668735 - RNA, 19 nt, Escherichia coli CFT073
cgauaaucaguaaugucgc

SEQ ID NO: 2668736 - RNA, 14 nt, Escherichia coli CFT073
cgauaaucguuggc

SEQ ID NO: 2668737 - RNA, 12 nt, Escherichia coli CFT073
cgauaaugaugu

SEQ ID NO: 2668738 - RNA, 22 nt, Escherichia coli CFT073
cgauacaaaaacccgcuucaaa

SEQ ID NO: 2668739 - RNA, 15 nt, Escherichia coli CFT073
cgauacaaaagcacc

SEQ ID NO: 2668740 - RNA, 15 nt, Escherichia coli CFT073
cgauacaccugaugu

SEQ ID NO: 2668741 - RNA, 13 nt, Escherichia coli CFT073
cgauacaccuuca

SEQ ID NO: 2668742 - RNA, 15 nt, Escherichia coli CFT073
cgauacaccuucaca

SEQ ID NO: 2668743 - RNA, 21 nt, Escherichia coli CFT073
cgaugaaugcaacugcccagg

SEQ ID NO: 2668744 - RNA, 21 nt, Escherichia coli CFT073
cgaugacuuucaaagagagca

SEQ ID NO: 2668745 - RNA, 22 nt, Escherichia coli CFT073
cgaugagucgccgcaaucagcc

SEQ ID NO: 2668746 - RNA, 17 nt, Escherichia coli CFT073
cgaugaucaaaaaaauc

SEQ ID NO: 2668747 - RNA, 13 nt, Escherichia coli CFT073
cgaugaucgccau

SEQ ID NO: 2668748 - RNA, 20 nt, Escherichia coli CFT073
cgaugaucgccaucagcgcu

SEQ ID NO: 2668749 - RNA, 13 nt, Escherichia coli CFT073
cgaugaucgccgc

SEQ ID NO: 2668750 - RNA, 14 nt, Escherichia coli CFT073
cgaugaugaucugc

SEQ ID NO: 2668751 - RNA, 22 nt, Escherichia coli CFT073
cgaugauugucccugccagcgu

SEQ ID NO: 2668752 - RNA, 15 nt, Escherichia coli CFT073
cgaugauuuccgcca

SEQ ID NO: 2668753 - RNA, 17 nt, Escherichia coli CFT073
cgaugauuuccgccagc

SEQ ID NO: 2668754 - RNA, 18 nt, Escherichia coli CFT073
cgaugauuuccggcguau

SEQ ID NO: 2668755 - RNA, 17 nt, Escherichia coli CFT073
cgaugcaaccgagcgcc

SEQ ID NO: 2668756 - RNA, 22 nt, Escherichia coli CFT073
cgaugcagaaauaaaagccuga

SEQ ID NO: 2668757 - RNA, 15 nt, Escherichia coli CFT073
cgaugcagcgcauga

SEQ ID NO: 2668758 - RNA, 21 nt, Escherichia coli CFT073
cgaugcagcgucugcuguucc

SEQ ID NO: 2668759 - RNA, 16 nt, Escherichia coli CFT073
cgaugcauccggcacg

SEQ ID NO: 2668760 - RNA, 12 nt, Escherichia coli CFT073
cgaugccagucg

SEQ ID NO: 2668761 - RNA, 21 nt, Escherichia coli CFT073
cgaugccgccuggugcaggcg

SEQ ID NO: 2668762 - RNA, 18 nt, Escherichia coli CFT073
cgaugccgcggcgcggcg

SEQ ID NO: 2668763 - RNA, 18 nt, Escherichia coli CFT073
cgaugccguuaaggccaa

SEQ ID NO: 2668764 - RNA, 23 nt, Escherichia coli CFT073
cgaugccugaugcgacgcuggcg

SEQ ID NO: 2668765 - RNA, 17 nt, Escherichia coli CFT073
cgaugccugcuuauuaa

SEQ ID NO: 2668766 - RNA, 21 nt, Escherichia coli CFT073
cgaugcgauaaccaggcaguu

SEQ ID NO: 2668767 - RNA, 14 nt, Escherichia coli CFT073
cgaugcgcaacgca

SEQ ID NO: 2668768 - RNA, 17 nt, Escherichia coli CFT073
cgaugcgcuauugccgu

SEQ ID NO: 2668769 - RNA, 15 nt, Escherichia coli CFT073
cgaugcuggcgcauc

SEQ ID NO: 2668770 - RNA, 17 nt, Escherichia coli CFT073
cgaugcuuuccagcugu

SEQ ID NO: 2668771 - RNA, 21 nt, Escherichia coli CFT073
cgaugcuuuccagcuguacca

SEQ ID NO: 2668772 - RNA, 22 nt, Escherichia coli CFT073
cgauggcaggccccgucagcaa

SEQ ID NO: 2668773 - RNA, 14 nt, Escherichia coli CFT073
cgauggcccgcuug

SEQ ID NO: 2668774 - RNA, 13 nt, Escherichia coli CFT073
cgauggcuggggu

SEQ ID NO: 2668775 - RNA, 22 nt, Escherichia coli CFT073
cgauggcuucuggcugcuccag

SEQ ID NO: 2668776 - RNA, 16 nt, Escherichia coli CFT073
cgaugggcgucccaga

SEQ ID NO: 2668777 - RNA, 20 nt, Escherichia coli CFT073
cgaugggggcaaaaauauau

SEQ ID NO: 2668778 - RNA, 20 nt, Escherichia coli CFT073
cgaugguacuucaaucgcca

SEQ ID NO: 2668779 - RNA, 13 nt, Escherichia coli CFT073
cgauggugcacga

SEQ ID NO: 2668780 - RNA, 21 nt, Escherichia coli CFT073
cgauggugcuaagccccugag

SEQ ID NO: 2668781 - RNA, 17 nt, Escherichia coli CFT073
cgauguaauccugaugg

SEQ ID NO: 2668782 - RNA, 18 nt, Escherichia coli CFT073
cgauguacuucaacauaa

SEQ ID NO: 2668783 - RNA, 19 nt, Escherichia coli CFT073
cgauguacuucaacauaac

SEQ ID NO: 2668784 - RNA, 16 nt, Escherichia coli CFT073
cgauguagcgcuguaa

SEQ ID NO: 2668785 - RNA, 14 nt, Escherichia coli CFT073
cgauguuaccguuu

SEQ ID NO: 2668786 - RNA, 14 nt, Escherichia coli CFT073
cgauguucaauaaa

SEQ ID NO: 2668787 - RNA, 21 nt, Escherichia coli CFT073
cgauguucccccagccagaug

SEQ ID NO: 2668788 - RNA, 18 nt, Escherichia coli CFT073
cgauguuguacaugcugc

SEQ ID NO: 2668789 - RNA, 12 nt, Escherichia coli CFT073
cgauuaacugcg

SEQ ID NO: 2668790 - RNA, 22 nt, Escherichia coli CFT073
cgauuaauccaguugcguaaua

SEQ ID NO: 2668791 - RNA, 17 nt, Escherichia coli CFT073
cgauuaaucuuccagau

SEQ ID NO: 2668792 - RNA, 14 nt, Escherichia coli CFT073
cgauuacagcaucg

SEQ ID NO: 2668793 - RNA, 17 nt, Escherichia coli CFT073
cgauuacaggaacugca

SEQ ID NO: 2668794 - RNA, 16 nt, Escherichia coli CFT073
cgauuaccauuucacu

SEQ ID NO: 2668795 - RNA, 15 nt, Escherichia coli CFT073
cgauuaccgccagca

SEQ ID NO: 2668796 - RNA, 16 nt, Escherichia coli CFT073
cgauuaucaacacauu

SEQ ID NO: 2668797 - RNA, 20 nt, Escherichia coli CFT073
cgauuauccaugccacagua

SEQ ID NO: 2668798 - RNA, 21 nt, Escherichia coli CFT073
cgauuauuuauucccgccaga

SEQ ID NO: 2668799 - RNA, 13 nt, Escherichia coli CFT073
cgauucagcaaca

SEQ ID NO: 2668800 - RNA, 21 nt, Escherichia coli CFT073
cgauucagcaacaucaccaac

SEQ ID NO: 2668801 - RNA, 22 nt, Escherichia coli CFT073
cgauuccgccgauggugcagca

SEQ ID NO: 2668802 - RNA, 13 nt, Escherichia coli CFT073
cgauuccggcaaa

SEQ ID NO: 2668803 - RNA, 13 nt, Escherichia coli CFT073
cgauucgccgucu

SEQ ID NO: 2668804 - RNA, 19 nt, Escherichia coli CFT073
cgauucggcaaucacaaca

SEQ ID NO: 2668805 - RNA, 20 nt, Escherichia coli CFT073
cgauucgucacuuugcuguc

SEQ ID NO: 2668806 - RNA, 17 nt, Escherichia coli CFT073
cgauucucccacagcac

SEQ ID NO: 2668807 - RNA, 17 nt, Escherichia coli CFT073
cgauucuggugagagca

SEQ ID NO: 2668808 - RNA, 13 nt, Escherichia coli CFT073
cgauugaagcagc

SEQ ID NO: 2668809 - RNA, 14 nt, Escherichia coli CFT073
cgauugaagcagcg

SEQ ID NO: 2668810 - RNA, 18 nt, Escherichia coli CFT073
cgauugcacaaagguuuc

SEQ ID NO: 2668811 - RNA, 16 nt, Escherichia coli CFT073
cgauugccacgccgua

SEQ ID NO: 2668812 - RNA, 20 nt, Escherichia coli CFT073
cgauuggggagaaaaacgga

SEQ ID NO: 2668813 - RNA, 17 nt, Escherichia coli CFT073
cgauuguacuuuaaaau

SEQ ID NO: 2668814 - RNA, 19 nt, Escherichia coli CFT073
cgauuguacuuuaaaauaa

SEQ ID NO: 2668815 - RNA, 14 nt, Escherichia coli CFT073
cgauuguuccugcu

SEQ ID NO: 2668816 - RNA, 11 nt, Escherichia coli CFT073
cgauuuagaac

SEQ ID NO: 2668817 - RNA, 11 nt, Escherichia coli CFT073
cgauuucacaa

SEQ ID NO: 2668818 - RNA, 14 nt, Escherichia coli CFT073
cgauuucagaucag

SEQ ID NO: 2668819 - RNA, 20 nt, Escherichia coli CFT073
cgauuucagggguaggaaaa

SEQ ID NO: 2668820 - RNA, 20 nt, Escherichia coli CFT073
cgauuucucaucaauuaaug

SEQ ID NO: 2668821 - RNA, 12 nt, Escherichia coli CFT073
cgauuuguucug

SEQ ID NO: 2668822 - RNA, 12 nt, Escherichia coli CFT073
cgauuuucaaaa

SEQ ID NO: 2668823 - RNA, 14 nt, Escherichia coli CFT073
cgauuuucaaaaua

SEQ ID NO: 2668824 - RNA, 18 nt, Escherichia coli CFT073
cgauuuucguccaccagg

SEQ ID NO: 2668825 - RNA, 17 nt, Escherichia coli CFT073
cgauuuugcaauaaugg

SEQ ID NO: 2668826 - RNA, 14 nt, Escherichia coli CFT073
cgauuuugccaguu

SEQ ID NO: 2668827 - RNA, 13 nt, Escherichia coli CFT073
cgauuuuuuccag

SEQ ID NO: 2668828 - RNA, 19 nt, Escherichia coli CFT073
cgcaaaaacauugccggaa

SEQ ID NO: 2668829 - RNA, 12 nt, Escherichia coli CFT073
cgcaaaacccag

SEQ ID NO: 2668830 - RNA, 17 nt, Escherichia coli CFT073
cgcaaaacccgcuucuu

SEQ ID NO: 2668831 - RNA, 22 nt, Escherichia coli CFT073
cgcaaaacccgcuucuuccagc

SEQ ID NO: 2668832 - RNA, 13 nt, Escherichia coli CFT073
cgcaaacaccagc

SEQ ID NO: 2668833 - RNA, 21 nt, Escherichia coli CFT073
cgcaaaccagacaacagucaa

SEQ ID NO: 2668834 - RNA, 12 nt, Escherichia coli CFT073
cgcaaacugcug

SEQ ID NO: 2668835 - RNA, 22 nt, Escherichia coli CFT073
cgcaaagagagaagccagguag

SEQ ID NO: 2668836 - RNA, 23 nt, Escherichia coli CFT073
cgcaaagauaaugacuuccgcca

SEQ ID NO: 2668837 - RNA, 17 nt, Escherichia coli CFT073
cgcaaagcccgccgcca

SEQ ID NO: 2668838 - RNA, 19 nt, Escherichia coli CFT073
cgcaaagccgauaccuucc

SEQ ID NO: 2668839 - RNA, 18 nt, Escherichia coli CFT073
cgcaaagucggcaccagu

SEQ ID NO: 2668840 - RNA, 18 nt, Escherichia coli CFT073
cgcaaauacugacuggcg

SEQ ID NO: 2668841 - RNA, 20 nt, Escherichia coli CFT073
cgcaaaucaacuaaaaucaa

SEQ ID NO: 2668842 - RNA, 13 nt, Escherichia coli CFT073
cgcaaaucagcgg

SEQ ID NO: 2668843 - RNA, 22 nt, Escherichia coli CFT073
cgcaaaugucucgacgguugaa

SEQ ID NO: 2668844 - RNA, 23 nt, Escherichia coli CFT073
cgcaacaauaacccccugcccca

SEQ ID NO: 2668845 - RNA, 13 nt, Escherichia coli CFT073
cgcaacaccguaa

SEQ ID NO: 2668846 - RNA, 14 nt, Escherichia coli CFT073
cgcaacagaaacgc

SEQ ID NO: 2668847 - RNA, 19 nt, Escherichia coli CFT073
cgcaacagagccaaagaau

SEQ ID NO: 2668848 - RNA, 15 nt, Escherichia coli CFT073
cgcaacagcgcgccc

SEQ ID NO: 2668849 - RNA, 16 nt, Escherichia coli CFT073
cgcaaccgccaacagc

SEQ ID NO: 2668850 - RNA, 21 nt, Escherichia coli CFT073
cgcaaccugauguuucugcgc

SEQ ID NO: 2668851 - RNA, 14 nt, Escherichia coli CFT073
cgcaaccuugcugc

SEQ ID NO: 2668852 - RNA, 17 nt, Escherichia coli CFT073
cgcagcggaguuuucgg

SEQ ID NO: 2668853 - RNA, 13 nt, Escherichia coli CFT073
cgcagcggcggca

SEQ ID NO: 2668854 - RNA, 17 nt, Escherichia coli CFT073
cgcagcuaucagcgaga

SEQ ID NO: 2668855 - RNA, 17 nt, Escherichia coli CFT073
cgcagcuauccugccgg

SEQ ID NO: 2668856 - RNA, 24 nt, Escherichia coli CFT073
cgcagcucacuucgauccagugau

SEQ ID NO: 2668857 - RNA, 15 nt, Escherichia coli CFT073
cgcagcuccagagua

SEQ ID NO: 2668858 - RNA, 12 nt, Escherichia coli CFT073
cgcagcuccagc

SEQ ID NO: 2668859 - RNA, 13 nt, Escherichia coli CFT073
cgcagcuccagcc

SEQ ID NO: 2668860 - RNA, 17 nt, Escherichia coli CFT073
cgcagcuccagcccgcg

SEQ ID NO: 2668861 - RNA, 22 nt, Escherichia coli CFT073
cgcagcucuuuauccagcagcc

SEQ ID NO: 2668862 - RNA, 16 nt, Escherichia coli CFT073
cgcagcugcaguacca

SEQ ID NO: 2668863 - RNA, 19 nt, Escherichia coli CFT073
cgcagcugcgcguuaucua

SEQ ID NO: 2668864 - RNA, 20 nt, Escherichia coli CFT073
cgcagcuucacaaaggcuug

SEQ ID NO: 2668865 - RNA, 21 nt, Escherichia coli CFT073
cgcagcuuccggccagcaugc

SEQ ID NO: 2668866 - RNA, 12 nt, Escherichia coli CFT073
cgcagcuucucg

SEQ ID NO: 2668867 - RNA, 20 nt, Escherichia coli CFT073
cgcaggagcgccgaauggau

SEQ ID NO: 2668868 - RNA, 22 nt, Escherichia coli CFT073
cgcaggauaaccuuccaccguu

SEQ ID NO: 2668869 - RNA, 15 nt, Escherichia coli CFT073
cgcaggaugagcgcg

SEQ ID NO: 2668870 - RNA, 12 nt, Escherichia coli CFT073
cgcaggcaguaa

SEQ ID NO: 2668871 - RNA, 22 nt, Escherichia coli CFT073
cgcaggcaucuuuuucaaugca

SEQ ID NO: 2668872 - RNA, 13 nt, Escherichia coli CFT073
cgcaggccacgaa

SEQ ID NO: 2668873 - RNA, 22 nt, Escherichia coli CFT073
cgcaggccacgaaucagcaccg

SEQ ID NO: 2668874 - RNA, 13 nt, Escherichia coli CFT073
cgcaggccgccca

SEQ ID NO: 2668875 - RNA, 22 nt, Escherichia coli CFT073
cgcaggcuggagcguugcgcca

SEQ ID NO: 2668876 - RNA, 17 nt, Escherichia coli CFT073
cgcaggcuguuaccccu

SEQ ID NO: 2668877 - RNA, 14 nt, Escherichia coli CFT073
cgcaggcuuccugg

SEQ ID NO: 2668878 - RNA, 17 nt, Escherichia coli CFT073
cgcaggcuuccuggcuu

SEQ ID NO: 2668879 - RNA, 13 nt, Escherichia coli CFT073
cgcagguaagaua

SEQ ID NO: 2668880 - RNA, 22 nt, Escherichia coli CFT073
cgcagguaagauaaugugccga

SEQ ID NO: 2668881 - RNA, 14 nt, Escherichia coli CFT073
cgcaggucggauaa

SEQ ID NO: 2668882 - RNA, 20 nt, Escherichia coli CFT073
cgcaggucggauaagacgcg

SEQ ID NO: 2668883 - RNA, 19 nt, Escherichia coli CFT073
cgcaggucguuauucgcca

SEQ ID NO: 2668884 - RNA, 21 nt, Escherichia coli CFT073
cgcaggugacgcuggcagcag

SEQ ID NO: 2668885 - RNA, 15 nt, Escherichia coli CFT073
cgcaguaaacgccag

SEQ ID NO: 2668886 - RNA, 23 nt, Escherichia coli CFT073
cgcaguaagcuguacacuuccca

SEQ ID NO: 2668887 - RNA, 16 nt, Escherichia coli CFT073
cgcaguaccagcaacg

SEQ ID NO: 2668888 - RNA, 14 nt, Escherichia coli CFT073
cgcagucgggugcu

SEQ ID NO: 2668889 - RNA, 13 nt, Escherichia coli CFT073
cgcagucucuuua

SEQ ID NO: 2668890 - RNA, 15 nt, Escherichia coli CFT073
cgcagucuuugccgu

SEQ ID NO: 2668891 - RNA, 21 nt, Escherichia coli CFT073
cgcagugagaagccaccgcac

SEQ ID NO: 2668892 - RNA, 17 nt, Escherichia coli CFT073
cgcagugauugccgcga

SEQ ID NO: 2668893 - RNA, 21 nt, Escherichia coli CFT073
cgcagugccugccaugccaaa

SEQ ID NO: 2668894 - RNA, 17 nt, Escherichia coli CFT073
cgcaguggauagacgca

SEQ ID NO: 2668895 - RNA, 13 nt, Escherichia coli CFT073
cgcaguugcugac

SEQ ID NO: 2668896 - RNA, 21 nt, Escherichia coli CFT073
cgcaguuguucggcgcugaaa

SEQ ID NO: 2668897 - RNA, 21 nt, Escherichia coli CFT073
cgcaguuucgcgucgucaacc

SEQ ID NO: 2668898 - RNA, 22 nt, Escherichia coli CFT073
cgcaguuucuuaccuaccugcu

SEQ ID NO: 2668899 - RNA, 21 nt, Escherichia coli CFT073
cgcauaaaacggcgcauugcc

SEQ ID NO: 2668900 - RNA, 23 nt, Escherichia coli CFT073
cgcauaaaagauaaacggcagga

SEQ ID NO: 2668901 - RNA, 21 nt, Escherichia coli CFT073
cgcauaaccgguaccugccgg

SEQ ID NO: 2668902 - RNA, 16 nt, Escherichia coli CFT073
cgcauaagccacaaua

SEQ ID NO: 2668903 - RNA, 22 nt, Escherichia coli CFT073
cgcauaaggugcgaccuacaca

SEQ ID NO: 2668904 - RNA, 15 nt, Escherichia coli CFT073
cgcauaauaucuuuc

SEQ ID NO: 2668905 - RNA, 17 nt, Escherichia coli CFT073
cgcauacauaacagaau

SEQ ID NO: 2668906 - RNA, 22 nt, Escherichia coli CFT073
cgcauaccauccaggagauauu

SEQ ID NO: 2668907 - RNA, 17 nt, Escherichia coli CFT073
cgcauaccccaucagcg

SEQ ID NO: 2668908 - RNA, 17 nt, Escherichia coli CFT073
cgcauacugauuaccca

SEQ ID NO: 2668909 - RNA, 13 nt, Escherichia coli CFT073
cgcauagagaaag

SEQ ID NO: 2668910 - RNA, 14 nt, Escherichia coli CFT073
cgcauagccuccgg

SEQ ID NO: 2668911 - RNA, 19 nt, Escherichia coli CFT073
cgcauagccuccggccacg

SEQ ID NO: 2668912 - RNA, 23 nt, Escherichia coli CFT073
cgcauagcuaauccccuccagcg

SEQ ID NO: 2668913 - RNA, 12 nt, Escherichia coli CFT073
cgcauauuguuc

SEQ ID NO: 2668914 - RNA, 20 nt, Escherichia coli CFT073
cgcaucaauugcguucuguc

SEQ ID NO: 2668915 - RNA, 12 nt, Escherichia coli CFT073
cgcaucaccccu

SEQ ID NO: 2668916 - RNA, 22 nt, Escherichia coli CFT073
cgcaucagacaccggcgcacaa

SEQ ID NO: 2668917 - RNA, 14 nt, Escherichia coli CFT073
cgcaucagcagaua

SEQ ID NO: 2668918 - RNA, 18 nt, Escherichia coli CFT073
cgcaucagcagauaccaa

SEQ ID NO: 2668919 - RNA, 21 nt, Escherichia coli CFT073
cgcaucaggcaaugggcaaac

SEQ ID NO: 2668920 - RNA, 22 nt, Escherichia coli CFT073
cgcaucaggcaaugugcuccau

SEQ ID NO: 2668921 - RNA, 21 nt, Escherichia coli CFT073
cgcaucagguaacucagcaca

SEQ ID NO: 2668922 - RNA, 16 nt, Escherichia coli CFT073
cgcaucagucacgaca

SEQ ID NO: 2668923 - RNA, 23 nt, Escherichia coli CFT073
cgcaucaguuucauuucgcgaaa

SEQ ID NO: 2668924 - RNA, 23 nt, Escherichia coli CFT073
cgcaucauccucuucaccgguac

SEQ ID NO: 2668925 - RNA, 18 nt, Escherichia coli CFT073
cgcaucaugaaacgccca

SEQ ID NO: 2668926 - RNA, 15 nt, Escherichia coli CFT073
cgcaucaugccgccc

SEQ ID NO: 2668927 - RNA, 20 nt, Escherichia coli CFT073
cgcaucauuaccggcacugg

SEQ ID NO: 2668928 - RNA, 18 nt, Escherichia coli CFT073
cgcauccagccaacguuu

SEQ ID NO: 2668929 - RNA, 15 nt, Escherichia coli CFT073
cgcauccccagcgca

SEQ ID NO: 2668930 - RNA, 17 nt, Escherichia coli CFT073
cgcauccccagcgcaag

SEQ ID NO: 2668931 - RNA, 17 nt, Escherichia coli CFT073
cgcauccccuacucucu

SEQ ID NO: 2668932 - RNA, 13 nt, Escherichia coli CFT073
cgcaucccgguuu

SEQ ID NO: 2668933 - RNA, 18 nt, Escherichia coli CFT073
cgcauccgacaucaacgc

SEQ ID NO: 2668934 - RNA, 15 nt, Escherichia coli CFT073
cgcauccgacauuug

SEQ ID NO: 2668935 - RNA, 14 nt, Escherichia coli CFT073
cgcauccgccagca

SEQ ID NO: 2668936 - RNA, 17 nt, Escherichia coli CFT073
cgcauccgccagcagcu

SEQ ID NO: 2668937 - RNA, 13 nt, Escherichia coli CFT073
cgcauccggcaag

SEQ ID NO: 2668938 - RNA, 13 nt, Escherichia coli CFT073
cgcauccggcaau

SEQ ID NO: 2668939 - RNA, 16 nt, Escherichia coli CFT073
cgcauccggcaaucaa

SEQ ID NO: 2668940 - RNA, 23 nt, Escherichia coli CFT073
cgcauccggcaaugauauuuauu

SEQ ID NO: 2668941 - RNA, 18 nt, Escherichia coli CFT073
cgcauccggcaauucuca

SEQ ID NO: 2668942 - RNA, 22 nt, Escherichia coli CFT073
cgcauccggcacgucgcguuaa

SEQ ID NO: 2668943 - RNA, 16 nt, Escherichia coli CFT073
cgcauccggcauaaua

SEQ ID NO: 2668944 - RNA, 17 nt, Escherichia coli CFT073
cgcauccggcauaauac

SEQ ID NO: 2668945 - RNA, 17 nt, Escherichia coli CFT073
cgcauccggcaucaacc

SEQ ID NO: 2668946 - RNA, 14 nt, Escherichia coli CFT073
cgcauccggcauga

SEQ ID NO: 2668947 - RNA, 21 nt, Escherichia coli CFT073
cgcauccggcaugaacaaagc

SEQ ID NO: 2668948 - RNA, 13 nt, Escherichia coli CFT073
cgcauccggcauu

SEQ ID NO: 2668949 - RNA, 18 nt, Escherichia coli CFT073
cgcauccggcauuaucac

SEQ ID NO: 2668950 - RNA, 12 nt, Escherichia coli CFT073
cgcauccggcca

SEQ ID NO: 2668951 - RNA, 17 nt, Escherichia coli CFT073
cgcauccggccaucagu

SEQ ID NO: 2668952 - RNA, 21 nt, Escherichia coli CFT073
cgcauccggcguaaacaacga

SEQ ID NO: 2668953 - RNA, 19 nt, Escherichia coli CFT073
cgcaucgccagacaauggc

SEQ ID NO: 2668954 - RNA, 18 nt, Escherichia coli CFT073
cgcaucgcgcaccagcgg

SEQ ID NO: 2668955 - RNA, 16 nt, Escherichia coli CFT073
cgcaucgggcaauggc

SEQ ID NO: 2668956 - RNA, 17 nt, Escherichia coli CFT073
cgcaucuuauccggccu

SEQ ID NO: 2668957 - RNA, 17 nt, Escherichia coli CFT073
cgcaucuucgcccacgg

SEQ ID NO: 2668958 - RNA, 21 nt, Escherichia coli CFT073
cgcaugacaauccuucccugc

SEQ ID NO: 2668959 - RNA, 23 nt, Escherichia coli CFT073
cgcaugacacacucugaccuguc

SEQ ID NO: 2668960 - RNA, 10 nt, Escherichia coli CFT073
cgccagacuc

SEQ ID NO: 2668961 - RNA, 17 nt, Escherichia coli CFT073
cgccagacucgccaggc

SEQ ID NO: 2668962 - RNA, 20 nt, Escherichia coli CFT073
cgccagacugaucaucgccc

SEQ ID NO: 2668963 - RNA, 21 nt, Escherichia coli CFT073
cgccagacugaucaucgccca

SEQ ID NO: 2668964 - RNA, 18 nt, Escherichia coli CFT073
cgccagagagcggagcaa

SEQ ID NO: 2668965 - RNA, 19 nt, Escherichia coli CFT073
cgccagagaucgcacaugu

SEQ ID NO: 2668966 - RNA, 15 nt, Escherichia coli CFT073
cgccagaggcgacaa

SEQ ID NO: 2668967 - RNA, 20 nt, Escherichia coli CFT073
cgccagauaaauucgaccau

SEQ ID NO: 2668968 - RNA, 21 nt, Escherichia coli CFT073
cgccagauagccgccagagaa

SEQ ID NO: 2668969 - RNA, 17 nt, Escherichia coli CFT073
cgccagauaguucgcaa

SEQ ID NO: 2668970 - RNA, 14 nt, Escherichia coli CFT073
cgccagaucaggga

SEQ ID NO: 2668971 - RNA, 14 nt, Escherichia coli CFT073
cgccagauccgcuu

SEQ ID NO: 2668972 - RNA, 21 nt, Escherichia coli CFT073
cgccagauccggcuuacaucu

SEQ ID NO: 2668973 - RNA, 13 nt, Escherichia coli CFT073
cgccagaugcggc

SEQ ID NO: 2668974 - RNA, 22 nt, Escherichia coli CFT073
cgccagauggcuuugcccuuuc

SEQ ID NO: 2668975 - RNA, 17 nt, Escherichia coli CFT073
cgccagauguuccgcca

SEQ ID NO: 2668976 - RNA, 19 nt, Escherichia coli CFT073
cgccagauguuccgccauu

SEQ ID NO: 2668977 - RNA, 15 nt, Escherichia coli CFT073
cgccagauugcugcu

SEQ ID NO: 2668978 - RNA, 16 nt, Escherichia coli CFT073
cgccagcaacugauac

SEQ ID NO: 2668979 - RNA, 20 nt, Escherichia coli CFT073
cgccagcaagagcaaauaaa

SEQ ID NO: 2668980 - RNA, 11 nt, Escherichia coli CFT073
cgccagcaaua

SEQ ID NO: 2668981 - RNA, 20 nt, Escherichia coli CFT073
cgccagcaauggacaccagg

SEQ ID NO: 2668982 - RNA, 19 nt, Escherichia coli CFT073
cgccagcacgaccgccauu

SEQ ID NO: 2668983 - RNA, 19 nt, Escherichia coli CFT073
cgccagcacggcgcagacg

SEQ ID NO: 2668984 - RNA, 13 nt, Escherichia coli CFT073
cgccagcacuucc

SEQ ID NO: 2668985 - RNA, 16 nt, Escherichia coli CFT073
cgccagcacuuccugc

SEQ ID NO: 2668986 - RNA, 17 nt, Escherichia coli CFT073
cgccagcacuuccugcu

SEQ ID NO: 2668987 - RNA, 20 nt, Escherichia coli CFT073
cgccagcagcagcgaauaau

SEQ ID NO: 2668988 - RNA, 18 nt, Escherichia coli CFT073
cgccagcaggaacgagaa

SEQ ID NO: 2668989 - RNA, 19 nt, Escherichia coli CFT073
cgccagcagggcaaacagc

SEQ ID NO: 2668990 - RNA, 13 nt, Escherichia coli CFT073
cgccagcaguuuu

SEQ ID NO: 2668991 - RNA, 14 nt, Escherichia coli CFT073
cgccagcaucggca

SEQ ID NO: 2668992 - RNA, 18 nt, Escherichia coli CFT073
cgccagcauguuguccca

SEQ ID NO: 2668993 - RNA, 19 nt, Escherichia coli CFT073
cgccagcauugucaggauc

SEQ ID NO: 2668994 - RNA, 16 nt, Escherichia coli CFT073
cgccagccagccaagc

SEQ ID NO: 2668995 - RNA, 22 nt, Escherichia coli CFT073
cgccagccaugucgccaccugu

SEQ ID NO: 2668996 - RNA, 14 nt, Escherichia coli CFT073
cgccagccauucaa

SEQ ID NO: 2668997 - RNA, 20 nt, Escherichia coli CFT073
cgccagccgccagcaucuca

SEQ ID NO: 2668998 - RNA, 20 nt, Escherichia coli CFT073
cgccagcgaaccaccaaacu

SEQ ID NO: 2668999 - RNA, 15 nt, Escherichia coli CFT073
cgccagcgaagguaa

SEQ ID NO: 2669000 - RNA, 22 nt, Escherichia coli CFT073
cgccagcgaagguaacaccagu

SEQ ID NO: 2669001 - RNA, 16 nt, Escherichia coli CFT073
cgccagcgaauuccag

SEQ ID NO: 2669002 - RNA, 21 nt, Escherichia coli CFT073
cgccagcgaauuccaguugau

SEQ ID NO: 2669003 - RNA, 12 nt, Escherichia coli CFT073
cgccagcgagaa

SEQ ID NO: 2669004 - RNA, 21 nt, Escherichia coli CFT073
cgccagcgagaaauacgcccu

SEQ ID NO: 2669005 - RNA, 14 nt, Escherichia coli CFT073
cgccagcgcaucau

SEQ ID NO: 2669006 - RNA, 15 nt, Escherichia coli CFT073
cgccagcgccaaagc

SEQ ID NO: 2669007 - RNA, 19 nt, Escherichia coli CFT073
cgccagcgcgaccgccaug

SEQ ID NO: 2669008 - RNA, 22 nt, Escherichia coli CFT073
cgccagcgcggcggcaaucauc

SEQ ID NO: 2669009 - RNA, 14 nt, Escherichia coli CFT073
cgccagcggcagcu

SEQ ID NO: 2669010 - RNA, 19 nt, Escherichia coli CFT073
cgccagcggcagcucgcgu

SEQ ID NO: 2669011 - RNA, 12 nt, Escherichia coli CFT073
cgccagcggggc

SEQ ID NO: 2669012 - RNA, 20 nt, Escherichia coli CFT073
cgccagcgucucuucaaucc

SEQ ID NO: 2669013 - RNA, 13 nt, Escherichia coli CFT073
cgccagcgucuga

SEQ ID NO: 2669014 - RNA, 15 nt, Escherichia coli CFT073
cgccagcgucugagc

SEQ ID NO: 2669015 - RNA, 22 nt, Escherichia coli CFT073
cgccagcuccgggcugguuuuc

SEQ ID NO: 2669016 - RNA, 17 nt, Escherichia coli CFT073
cgccagcucugcgcccu

SEQ ID NO: 2669017 - RNA, 19 nt, Escherichia coli CFT073
cgccagcucugcgcccugc

SEQ ID NO: 2669018 - RNA, 20 nt, Escherichia coli CFT073
cgccagcucugcgcccugca

SEQ ID NO: 2669019 - RNA, 16 nt, Escherichia coli CFT073
cgccagcugcauuuca

SEQ ID NO: 2669020 - RNA, 16 nt, Escherichia coli CFT073
cgccagcuucacgcgc

SEQ ID NO: 2669021 - RNA, 17 nt, Escherichia coli CFT073
cgccagcuucacgcgcu

SEQ ID NO: 2669022 - RNA, 19 nt, Escherichia coli CFT073
cgccagcuucgcuucccaa

SEQ ID NO: 2669023 - RNA, 23 nt, Escherichia coli CFT073
cgccagcuuugacguuccccaac

SEQ ID NO: 2669024 - RNA, 23 nt, Escherichia coli CFT073
cgccaggaaccugugacagcagc

SEQ ID NO: 2669025 - RNA, 18 nt, Escherichia coli CFT073
cgccaggacaucagcgca

SEQ ID NO: 2669026 - RNA, 17 nt, Escherichia coli CFT073
cgccaggaugggcugcc

SEQ ID NO: 2669027 - RNA, 20 nt, Escherichia coli CFT073
cgccaggcacuucccagaua

SEQ ID NO: 2669028 - RNA, 15 nt, Escherichia coli CFT073
cgccaggcgcgagaa

SEQ ID NO: 2669029 - RNA, 16 nt, Escherichia coli CFT073
cgccaggcuguucgga

SEQ ID NO: 2669030 - RNA, 18 nt, Escherichia coli CFT073
cgccaggcuucauacacc

SEQ ID NO: 2669031 - RNA, 22 nt, Escherichia coli CFT073
cgccaggcuuuccgucagcggc

SEQ ID NO: 2669032 - RNA, 19 nt, Escherichia coli CFT073
cgccagguacucaugccca

SEQ ID NO: 2669033 - RNA, 22 nt, Escherichia coli CFT073
cgccagguacucaugcccacgc

SEQ ID NO: 2669034 - RNA, 18 nt, Escherichia coli CFT073
cgccaggucagagagcca

SEQ ID NO: 2669035 - RNA, 22 nt, Escherichia coli CFT073
cgccaggucagagagccagccc

SEQ ID NO: 2669036 - RNA, 14 nt, Escherichia coli CFT073
cgccaggugcuuuu

SEQ ID NO: 2669037 - RNA, 15 nt, Escherichia coli CFT073
cgccagguuuuggaa

SEQ ID NO: 2669038 - RNA, 22 nt, Escherichia coli CFT073
cgccaguaagguaacgcugccc

SEQ ID NO: 2669039 - RNA, 17 nt, Escherichia coli CFT073
cgccaguaauucuucaa

SEQ ID NO: 2669040 - RNA, 17 nt, Escherichia coli CFT073
cgccaguaccagcagcg

SEQ ID NO: 2669041 - RNA, 15 nt, Escherichia coli CFT073
cgccaguaccgccgc

SEQ ID NO: 2669042 - RNA, 14 nt, Escherichia coli CFT073
cgccaguaguugcu

SEQ ID NO: 2669043 - RNA, 14 nt, Escherichia coli CFT073
cgccagucacugcc

SEQ ID NO: 2669044 - RNA, 21 nt, Escherichia coli CFT073
cgccagucccuuucaggucag

SEQ ID NO: 2669045 - RNA, 19 nt, Escherichia coli CFT073
cgccagucuccaggcagaa

SEQ ID NO: 2669046 - RNA, 21 nt, Escherichia coli CFT073
cgccagugacgaccuuuucca

SEQ ID NO: 2669047 - RNA, 19 nt, Escherichia coli CFT073
cgccagugacgccgccaga

SEQ ID NO: 2669048 - RNA, 20 nt, Escherichia coli CFT073
cgccagugcuuucagugccu

SEQ ID NO: 2669049 - RNA, 14 nt, Escherichia coli CFT073
cgccaguucaucca

SEQ ID NO: 2669050 - RNA, 14 nt, Escherichia coli CFT073
cgccaguucccccu

SEQ ID NO: 2669051 - RNA, 18 nt, Escherichia coli CFT073
cgccaguucgcgauccug

SEQ ID NO: 2669052 - RNA, 22 nt, Escherichia coli CFT073
cgccaguuucgggaucaucuca

SEQ ID NO: 2669053 - RNA, 15 nt, Escherichia coli CFT073
cgccaguuugcaggc

SEQ ID NO: 2669054 - RNA, 18 nt, Escherichia coli CFT073
cgccaguuugcaggccaa

SEQ ID NO: 2669055 - RNA, 16 nt, Escherichia coli CFT073
cgccaguuuguagccg

SEQ ID NO: 2669056 - RNA, 20 nt, Escherichia coli CFT073
cgccaguuuguagccgauaa

SEQ ID NO: 2669057 - RNA, 14 nt, Escherichia coli CFT073
cgccauaaacacca

SEQ ID NO: 2669058 - RNA, 17 nt, Escherichia coli CFT073
cgccauaaacaccagca

SEQ ID NO: 2669059 - RNA, 23 nt, Escherichia coli CFT073
cgccauaaaccgcaucauguaaa

SEQ ID NO: 2669060 - RNA, 13 nt, Escherichia coli CFT073
cgccauaucacca

SEQ ID NO: 2669061 - RNA, 14 nt, Escherichia coli CFT073
cgccauaucaccac

SEQ ID NO: 2669062 - RNA, 14 nt, Escherichia coli CFT073
cgccaucaacgaaa

SEQ ID NO: 2669063 - RNA, 18 nt, Escherichia coli CFT073
cgccaucaauaaccagcg

SEQ ID NO: 2669064 - RNA, 19 nt, Escherichia coli CFT073
cgccaucaauaaccagcgu

SEQ ID NO: 2669065 - RNA, 21 nt, Escherichia coli CFT073
cgccaucaauaaccagcguuu

SEQ ID NO: 2669066 - RNA, 13 nt, Escherichia coli CFT073
cgccaucaccagu

SEQ ID NO: 2669067 - RNA, 22 nt, Escherichia coli CFT073
cgccaucaccaguugugaugcc

SEQ ID NO: 2669068 - RNA, 23 nt, Escherichia coli CFT073
cgcccugggcuucauccagcagc

SEQ ID NO: 2669069 - RNA, 14 nt, Escherichia coli CFT073
cgcccuuaaucaac

SEQ ID NO: 2669070 - RNA, 14 nt, Escherichia coli CFT073
cgcccuucccccau

SEQ ID NO: 2669071 - RNA, 23 nt, Escherichia coli CFT073
cgcccuucccccauugccgccuc

SEQ ID NO: 2669072 - RNA, 13 nt, Escherichia coli CFT073
cgcccuuuaugca

SEQ ID NO: 2669073 - RNA, 21 nt, Escherichia coli CFT073
cgccgaaaucgcauugcgcca

SEQ ID NO: 2669074 - RNA, 19 nt, Escherichia coli CFT073
cgccgaaauuucgccgcgc

SEQ ID NO: 2669075 - RNA, 18 nt, Escherichia coli CFT073
cgccgaagcagcugcugg

SEQ ID NO: 2669076 - RNA, 22 nt, Escherichia coli CFT073
cgccgaauuaaacaacgccagu

SEQ ID NO: 2669077 - RNA, 13 nt, Escherichia coli CFT073
cgccgacgcccug

SEQ ID NO: 2669078 - RNA, 21 nt, Escherichia coli CFT073
cgccgacggucaggcuaauac

SEQ ID NO: 2669079 - RNA, 14 nt, Escherichia coli CFT073
cgccgagagaagcg

SEQ ID NO: 2669080 - RNA, 17 nt, Escherichia coli CFT073
cgccgagaucaacagca

SEQ ID NO: 2669081 - RNA, 19 nt, Escherichia coli CFT073
cgccgagaucaacagcaua

SEQ ID NO: 2669082 - RNA, 13 nt, Escherichia coli CFT073
cgccgagcgccag

SEQ ID NO: 2669083 - RNA, 18 nt, Escherichia coli CFT073
cgccgaggugcuuuccac

SEQ ID NO: 2669084 - RNA, 20 nt, Escherichia coli CFT073
cgccgauaaaggucgacagu

SEQ ID NO: 2669085 - RNA, 17 nt, Escherichia coli CFT073
cgccgauacgcauaaac

SEQ ID NO: 2669086 - RNA, 17 nt, Escherichia coli CFT073
cgccgauaucgcuggca

SEQ ID NO: 2669087 - RNA, 19 nt, Escherichia coli CFT073
cgccgauaucgcuggcaga

SEQ ID NO: 2669088 - RNA, 15 nt, Escherichia coli CFT073
cgccgauaucguuga

SEQ ID NO: 2669089 - RNA, 19 nt, Escherichia coli CFT073
cgccgauggugcagcagac

SEQ ID NO: 2669090 - RNA, 14 nt, Escherichia coli CFT073
cgccgauuaauauu

SEQ ID NO: 2669091 - RNA, 19 nt, Escherichia coli CFT073
cgccgauuccaauauuaaa

SEQ ID NO: 2669092 - RNA, 21 nt, Escherichia coli CFT073
cgccgauuucucaucaauuaa

SEQ ID NO: 2669093 - RNA, 14 nt, Escherichia coli CFT073
cgccgcaaaaccca

SEQ ID NO: 2669094 - RNA, 16 nt, Escherichia coli CFT073
cgccgcaaaacccagg

SEQ ID NO: 2669095 - RNA, 15 nt, Escherichia coli CFT073
cgccgcaacaauaac

SEQ ID NO: 2669096 - RNA, 23 nt, Escherichia coli CFT073
cgccgcaacaauaacccccugcc

SEQ ID NO: 2669097 - RNA, 20 nt, Escherichia coli CFT073
cgccgcaaccguaguggcca

SEQ ID NO: 2669098 - RNA, 16 nt, Escherichia coli CFT073
cgccgcaaucagcguu

SEQ ID NO: 2669099 - RNA, 13 nt, Escherichia coli CFT073
cgccgcacccgcc

SEQ ID NO: 2669100 - RNA, 16 nt, Escherichia coli CFT073
cgccgcacccgccaga

SEQ ID NO: 2669101 - RNA, 14 nt, Escherichia coli CFT073
cgccgcacccggca

SEQ ID NO: 2669102 - RNA, 20 nt, Escherichia coli CFT073
cgccgcacuauuuaccgcca

SEQ ID NO: 2669103 - RNA, 21 nt, Escherichia coli CFT073
cgccgcagagaucagauaaua

SEQ ID NO: 2669104 - RNA, 21 nt, Escherichia coli CFT073
cgccgcagagcgauauccagc

SEQ ID NO: 2669105 - RNA, 14 nt, Escherichia coli CFT073
cgccgcagccagau

SEQ ID NO: 2669106 - RNA, 15 nt, Escherichia coli CFT073
cgccgcagccagaua

SEQ ID NO: 2669107 - RNA, 15 nt, Escherichia coli CFT073
cgccgcagccgcauu

SEQ ID NO: 2669108 - RNA, 19 nt, Escherichia coli CFT073
cgccgcagguagcagcagc

SEQ ID NO: 2669109 - RNA, 20 nt, Escherichia coli CFT073
cgccgcagguagcagcagcg

SEQ ID NO: 2669110 - RNA, 23 nt, Escherichia coli CFT073
cgccgcagguagcagcagcgcca

SEQ ID NO: 2669111 - RNA, 17 nt, Escherichia coli CFT073
cgccgcagucagggucu

SEQ ID NO: 2669112 - RNA, 18 nt, Escherichia coli CFT073
cgccgcauaauaucuuuc

SEQ ID NO: 2669113 - RNA, 20 nt, Escherichia coli CFT073
cgccgcauaauaucuuuccu

SEQ ID NO: 2669114 - RNA, 23 nt, Escherichia coli CFT073
cgccgcauauuccaccacuucau

SEQ ID NO: 2669115 - RNA, 20 nt, Escherichia coli CFT073
cgccgcaucaggccgccagc

SEQ ID NO: 2669116 - RNA, 21 nt, Escherichia coli CFT073
cgccgcaucaggccgccagca

SEQ ID NO: 2669117 - RNA, 16 nt, Escherichia coli CFT073
cgccgcauccgacaaa

SEQ ID NO: 2669118 - RNA, 22 nt, Escherichia coli CFT073
cgccgcauccgacaucaacgcc

SEQ ID NO: 2669119 - RNA, 19 nt, Escherichia coli CFT073
cgccgcauccggcaacagu

SEQ ID NO: 2669120 - RNA, 15 nt, Escherichia coli CFT073
cgccgcauccggcau

SEQ ID NO: 2669121 - RNA, 14 nt, Escherichia coli CFT073
cgccgcauccggcc

SEQ ID NO: 2669122 - RNA, 18 nt, Escherichia coli CFT073
cgccgcaucgucacugau

SEQ ID NO: 2669123 - RNA, 16 nt, Escherichia coli CFT073
cgccgcaugugccggg

SEQ ID NO: 2669124 - RNA, 21 nt, Escherichia coli CFT073
cgccgcauuauggugaagaag

SEQ ID NO: 2669125 - RNA, 13 nt, Escherichia coli CFT073
cgccgcauugccc

SEQ ID NO: 2669126 - RNA, 22 nt, Escherichia coli CFT073
cgccgcauugguaaaaccgguu

SEQ ID NO: 2669127 - RNA, 16 nt, Escherichia coli CFT073
cgccgccaaacgcggu

SEQ ID NO: 2669128 - RNA, 24 nt, Escherichia coli CFT073
cgccgccaaacugugcaccgcccu

SEQ ID NO: 2669129 - RNA, 13 nt, Escherichia coli CFT073
cgccgccaacgug

SEQ ID NO: 2669130 - RNA, 21 nt, Escherichia coli CFT073
cgccgccaaucgcccgggcuu

SEQ ID NO: 2669131 - RNA, 22 nt, Escherichia coli CFT073
cgccgccacuugagccgccacc

SEQ ID NO: 2669132 - RNA, 21 nt, Escherichia coli CFT073
cgccgccauaaacagcaggca

SEQ ID NO: 2669133 - RNA, 17 nt, Escherichia coli CFT073
cgccgcccacaacagca

SEQ ID NO: 2669134 - RNA, 21 nt, Escherichia coli CFT073
cgccgcccccacugccgccuu

SEQ ID NO: 2669135 - RNA, 23 nt, Escherichia coli CFT073
cgccgccgagauuugccagauua

SEQ ID NO: 2669136 - RNA, 11 nt, Escherichia coli CFT073
cgccgccgccc

SEQ ID NO: 2669137 - RNA, 19 nt, Escherichia coli CFT073
cgccgccucagccagaaua

SEQ ID NO: 2669138 - RNA, 18 nt, Escherichia coli CFT073
cgccgcgagcaucgcgag

SEQ ID NO: 2669139 - RNA, 18 nt, Escherichia coli CFT073
cgccgcgauaaaauccca

SEQ ID NO: 2669140 - RNA, 17 nt, Escherichia coli CFT073
cgccgcgauuaaccguu

SEQ ID NO: 2669141 - RNA, 17 nt, Escherichia coli CFT073
cgccgcgcaaauccacg

SEQ ID NO: 2669142 - RNA, 13 nt, Escherichia coli CFT073
cgccgcgcuccau

SEQ ID NO: 2669143 - RNA, 16 nt, Escherichia coli CFT073
cgccgcguacgccgcu

SEQ ID NO: 2669144 - RNA, 17 nt, Escherichia coli CFT073
cgccgcgugccaccauu

SEQ ID NO: 2669145 - RNA, 18 nt, Escherichia coli CFT073
cgccgcuaaauaccagcg

SEQ ID NO: 2669146 - RNA, 13 nt, Escherichia coli CFT073
cgccgcuaccggc

SEQ ID NO: 2669147 - RNA, 16 nt, Escherichia coli CFT073
cgccgcuaucgcugau

SEQ ID NO: 2669148 - RNA, 13 nt, Escherichia coli CFT073
cgccgcucaccug

SEQ ID NO: 2669149 - RNA, 15 nt, Escherichia coli CFT073
cgccgcucaccugac

SEQ ID NO: 2669150 - RNA, 14 nt, Escherichia coli CFT073
cgccgcuccucauc

SEQ ID NO: 2669151 - RNA, 12 nt, Escherichia coli CFT073
cgccgcugguga

SEQ ID NO: 2669152 - RNA, 19 nt, Escherichia coli CFT073
cgccgcugucuaccagcac

SEQ ID NO: 2669153 - RNA, 20 nt, Escherichia coli CFT073
cgccgcugucuaccagcacc

SEQ ID NO: 2669154 - RNA, 19 nt, Escherichia coli CFT073
cgccgcuucaucgguuaac

SEQ ID NO: 2669155 - RNA, 19 nt, Escherichia coli CFT073
cgccgcuucgucgucgucc

SEQ ID NO: 2669156 - RNA, 20 nt, Escherichia coli CFT073
cgccgcuuuaaucaccaucg

SEQ ID NO: 2669157 - RNA, 21 nt, Escherichia coli CFT073
cgccggaaagcagcauauaaa

SEQ ID NO: 2669158 - RNA, 20 nt, Escherichia coli CFT073
cgccggagagaaaaaucucc

SEQ ID NO: 2669159 - RNA, 23 nt, Escherichia coli CFT073
cgccggagagggaaauacccugg

SEQ ID NO: 2669160 - RNA, 16 nt, Escherichia coli CFT073
cgccggaguacgccau

SEQ ID NO: 2669161 - RNA, 19 nt, Escherichia coli CFT073
cgccggauauuccugaaug

SEQ ID NO: 2669162 - RNA, 21 nt, Escherichia coli CFT073
cgccggauggguaaucgucag

SEQ ID NO: 2669163 - RNA, 16 nt, Escherichia coli CFT073
cgccgggagaucgcgu

SEQ ID NO: 2669164 - RNA, 23 nt, Escherichia coli CFT073
cgccgggauauaugucaccagca

SEQ ID NO: 2669165 - RNA, 22 nt, Escherichia coli CFT073
cgccgggaugauggcuuuggcg

SEQ ID NO: 2669166 - RNA, 18 nt, Escherichia coli CFT073
cgccgggcuugccaggua

SEQ ID NO: 2669167 - RNA, 16 nt, Escherichia coli CFT073
cgccggguuuauguga

SEQ ID NO: 2669168 - RNA, 20 nt, Escherichia coli CFT073
cgccgguaauuccagcgguu

SEQ ID NO: 2669169 - RNA, 14 nt, Escherichia coli CFT073
cgccggucacgccg

SEQ ID NO: 2669170 - RNA, 20 nt, Escherichia coli CFT073
cgccggugagcacaucagcg

SEQ ID NO: 2669171 - RNA, 23 nt, Escherichia coli CFT073
cgccgguggcguuuccagcaguu

SEQ ID NO: 2669172 - RNA, 17 nt, Escherichia coli CFT073
cgccgguuccugcaucg

SEQ ID NO: 2669173 - RNA, 15 nt, Escherichia coli CFT073
cgccgguuggucauu

SEQ ID NO: 2669174 - RNA, 12 nt, Escherichia coli CFT073
cgccgguuuugc

SEQ ID NO: 2669175 - RNA, 22 nt, Escherichia coli CFT073
cgccguaaacaucauccagacg

SEQ ID NO: 2669176 - RNA, 20 nt, Escherichia coli CFT073
cgcgaauucauguucgguaa

SEQ ID NO: 2669177 - RNA, 15 nt, Escherichia coli CFT073
cgcgacaauaccggu

SEQ ID NO: 2669178 - RNA, 19 nt, Escherichia coli CFT073
cgcgacaaucgcccccauc

SEQ ID NO: 2669179 - RNA, 19 nt, Escherichia coli CFT073
cgcgacauaaagcgcaaua

SEQ ID NO: 2669180 - RNA, 22 nt, Escherichia coli CFT073
cgcgacaucgucuccagcgaau

SEQ ID NO: 2669181 - RNA, 12 nt, Escherichia coli CFT073
cgcgaccaccuc

SEQ ID NO: 2669182 - RNA, 17 nt, Escherichia coli CFT073
cgcgaccagaccgcuuu

SEQ ID NO: 2669183 - RNA, 13 nt, Escherichia coli CFT073
cgcgaccggcggc

SEQ ID NO: 2669184 - RNA, 12 nt, Escherichia coli CFT073
cgcgacgcgcuu

SEQ ID NO: 2669185 - RNA, 22 nt, Escherichia coli CFT073
cgcgacgguugcggaacccagc

SEQ ID NO: 2669186 - RNA, 14 nt, Escherichia coli CFT073
cgcgacucccugac

SEQ ID NO: 2669187 - RNA, 14 nt, Escherichia coli CFT073
cgcgaggccagcgg

SEQ ID NO: 2669188 - RNA, 15 nt, Escherichia coli CFT073
cgcgagguuuuccuu

SEQ ID NO: 2669189 - RNA, 18 nt, Escherichia coli CFT073
cgcgaguagguagaauau

SEQ ID NO: 2669190 - RNA, 17 nt, Escherichia coli CFT073
cgcgaguucgagucucg

SEQ ID NO: 2669191 - RNA, 20 nt, Escherichia coli CFT073
cgcgauaccacccgcaguga

SEQ ID NO: 2669192 - RNA, 19 nt, Escherichia coli CFT073
cgcgauacgcaguacggca

SEQ ID NO: 2669193 - RNA, 21 nt, Escherichia coli CFT073
cgcgauacucuuuuggcguug

SEQ ID NO: 2669194 - RNA, 15 nt, Escherichia coli CFT073
cgcgauagccgcuuu

SEQ ID NO: 2669195 - RNA, 15 nt, Escherichia coli CFT073
cgcgauagcgcacca

SEQ ID NO: 2669196 - RNA, 22 nt, Escherichia coli CFT073
cgcgauaggccuuaaccgccgc

SEQ ID NO: 2669197 - RNA, 19 nt, Escherichia coli CFT073
cgcgauauuccgcaacgcc

SEQ ID NO: 2669198 - RNA, 22 nt, Escherichia coli CFT073
cgcgauauuccgcaacgccgcc

SEQ ID NO: 2669199 - RNA, 15 nt, Escherichia coli CFT073
cgcgauauucucgcc

SEQ ID NO: 2669200 - RNA, 14 nt, Escherichia coli CFT073
cgcgauauugcugc

SEQ ID NO: 2669201 - RNA, 20 nt, Escherichia coli CFT073
cgcgaucauuaacaccacgc

SEQ ID NO: 2669202 - RNA, 14 nt, Escherichia coli CFT073
cgcgaucucgucag

SEQ ID NO: 2669203 - RNA, 21 nt, Escherichia coli CFT073
cgcgauggcuggaaucaucaa

SEQ ID NO: 2669204 - RNA, 23 nt, Escherichia coli CFT073
cgcgauggcuggaaucaucaagc

SEQ ID NO: 2669205 - RNA, 21 nt, Escherichia coli CFT073
cgcgauggcuuuccaccugca

SEQ ID NO: 2669206 - RNA, 16 nt, Escherichia coli CFT073
cgcgauguuuggcgga

SEQ ID NO: 2669207 - RNA, 16 nt, Escherichia coli CFT073
cgcgauuagcgguaaa

SEQ ID NO: 2669208 - RNA, 17 nt, Escherichia coli CFT073
cgcgauuuuucugguga

SEQ ID NO: 2669209 - RNA, 15 nt, Escherichia coli CFT073
cgcgcaaccacaacg

SEQ ID NO: 2669210 - RNA, 15 nt, Escherichia coli CFT073
cgcgcaaucagcacc

SEQ ID NO: 2669211 - RNA, 18 nt, Escherichia coli CFT073
cgcgcaaucagcaccgcg

SEQ ID NO: 2669212 - RNA, 19 nt, Escherichia coli CFT073
cgcgcaaucagcaccgcgc

SEQ ID NO: 2669213 - RNA, 21 nt, Escherichia coli CFT073
cgcgcaaucagcaccgcgcgu

SEQ ID NO: 2669214 - RNA, 21 nt, Escherichia coli CFT073
cgcgcaaucguaugaucaucc

SEQ ID NO: 2669215 - RNA, 17 nt, Escherichia coli CFT073
cgcgcaauugccagaca

SEQ ID NO: 2669216 - RNA, 21 nt, Escherichia coli CFT073
cgcgcacaugcuggauggcgu

SEQ ID NO: 2669217 - RNA, 22 nt, Escherichia coli CFT073
cgcgcaccgcgugaugcggcau

SEQ ID NO: 2669218 - RNA, 16 nt, Escherichia coli CFT073
cgcgcagaucauccgg

SEQ ID NO: 2669219 - RNA, 14 nt, Escherichia coli CFT073
cgcgcaggagcggc

SEQ ID NO: 2669220 - RNA, 15 nt, Escherichia coli CFT073
cgcgcagugccugcc

SEQ ID NO: 2669221 - RNA, 22 nt, Escherichia coli CFT073
cgcgcaguucgcacaccgcuga

SEQ ID NO: 2669222 - RNA, 16 nt, Escherichia coli CFT073
cgcgcauaucguagcc

SEQ ID NO: 2669223 - RNA, 13 nt, Escherichia coli CFT073
cgcgcaugcgccu

SEQ ID NO: 2669224 - RNA, 21 nt, Escherichia coli CFT073
cgcgccaaacucggucacgcg

SEQ ID NO: 2669225 - RNA, 18 nt, Escherichia coli CFT073
cgcgccaagauagaacca

SEQ ID NO: 2669226 - RNA, 17 nt, Escherichia coli CFT073
cgcgccaaucagcgcag

SEQ ID NO: 2669227 - RNA, 22 nt, Escherichia coli CFT073
cgcgccaaucagcgcagcaccc

SEQ ID NO: 2669228 - RNA, 21 nt, Escherichia coli CFT073
cgcgccaauccagaacaccau

SEQ ID NO: 2669229 - RNA, 14 nt, Escherichia coli CFT073
cgcgccagagcugg

SEQ ID NO: 2669230 - RNA, 13 nt, Escherichia coli CFT073
cgcgccagcagcg

SEQ ID NO: 2669231 - RNA, 12 nt, Escherichia coli CFT073
cgcgccagcgug

SEQ ID NO: 2669232 - RNA, 15 nt, Escherichia coli CFT073
cgcgccagcuaccag

SEQ ID NO: 2669233 - RNA, 19 nt, Escherichia coli CFT073
cgcgccagguauuugcgua

SEQ ID NO: 2669234 - RNA, 23 nt, Escherichia coli CFT073
cgcgccagguggcaaaucgacgc

SEQ ID NO: 2669235 - RNA, 23 nt, Escherichia coli CFT073
cgcgccaguaaucagcgcggaac

SEQ ID NO: 2669236 - RNA, 22 nt, Escherichia coli CFT073
cgcgccaguucaaucauuugca

SEQ ID NO: 2669237 - RNA, 13 nt, Escherichia coli CFT073
cgcgcccagccug

SEQ ID NO: 2669238 - RNA, 18 nt, Escherichia coli CFT073
cgcgcccauacggcucag

SEQ ID NO: 2669239 - RNA, 15 nt, Escherichia coli CFT073
cgcgcccgccgccau

SEQ ID NO: 2669240 - RNA, 16 nt, Escherichia coli CFT073
cgcgccgacugcgcca

SEQ ID NO: 2669241 - RNA, 13 nt, Escherichia coli CFT073
cgcgccgcauccg

SEQ ID NO: 2669242 - RNA, 14 nt, Escherichia coli CFT073
cgcgccgccaaccc

SEQ ID NO: 2669243 - RNA, 14 nt, Escherichia coli CFT073
cgcgccgccagcca

SEQ ID NO: 2669244 - RNA, 16 nt, Escherichia coli CFT073
cgcgccgccagccaca

SEQ ID NO: 2669245 - RNA, 21 nt, Escherichia coli CFT073
cgcgccgcgcugcuguagcag

SEQ ID NO: 2669246 - RNA, 22 nt, Escherichia coli CFT073
cgcgccggacgcaccuugccaa

SEQ ID NO: 2669247 - RNA, 15 nt, Escherichia coli CFT073
cgcgccucaggcacu

SEQ ID NO: 2669248 - RNA, 13 nt, Escherichia coli CFT073
cgcgccugccagg

SEQ ID NO: 2669249 - RNA, 14 nt, Escherichia coli CFT073
cgcgccugccaggc

SEQ ID NO: 2669250 - RNA, 14 nt, Escherichia coli CFT073
cgcgccugcggcca

SEQ ID NO: 2669251 - RNA, 19 nt, Escherichia coli CFT073
cgcgccuggcgugcccccg

SEQ ID NO: 2669252 - RNA, 22 nt, Escherichia coli CFT073
cgcgccuguuuuuuuaaugcgc

SEQ ID NO: 2669253 - RNA, 16 nt, Escherichia coli CFT073
cgcgccuuaaaaacca

SEQ ID NO: 2669254 - RNA, 16 nt, Escherichia coli CFT073
cgcgccuucgugcggc

SEQ ID NO: 2669255 - RNA, 20 nt, Escherichia coli CFT073
cgcgcgaauauggcggcggc

SEQ ID NO: 2669256 - RNA, 12 nt, Escherichia coli CFT073
cgcgcgcagcac

SEQ ID NO: 2669257 - RNA, 21 nt, Escherichia coli CFT073
cgcgcgcugccagaaccgcuu

SEQ ID NO: 2669258 - RNA, 14 nt, Escherichia coli CFT073
cgcgcggaacauga

SEQ ID NO: 2669259 - RNA, 18 nt, Escherichia coli CFT073
cgcgcggcgaaccagccg

SEQ ID NO: 2669260 - RNA, 18 nt, Escherichia coli CFT073
cgcgcgggucacugcggu

SEQ ID NO: 2669261 - RNA, 19 nt, Escherichia coli CFT073
cgcgcggugguacggcauu

SEQ ID NO: 2669262 - RNA, 19 nt, Escherichia coli CFT073
cgcgcgguguaccgcaucg

SEQ ID NO: 2669263 - RNA, 17 nt, Escherichia coli CFT073
cgcgcgugccggaacgc

SEQ ID NO: 2669264 - RNA, 18 nt, Escherichia coli CFT073
cgcgcgugccggaacgcc

SEQ ID NO: 2669265 - RNA, 16 nt, Escherichia coli CFT073
cgcgcguguugcgcca

SEQ ID NO: 2669266 - RNA, 19 nt, Escherichia coli CFT073
cgcgcguuaacucccgcgc

SEQ ID NO: 2669267 - RNA, 15 nt, Escherichia coli CFT073
cgcgcguuaauuucu

SEQ ID NO: 2669268 - RNA, 20 nt, Escherichia coli CFT073
cgcgcguuaauuucuuuuca

SEQ ID NO: 2669269 - RNA, 15 nt, Escherichia coli CFT073
cgcgcuaacggagaa

SEQ ID NO: 2669270 - RNA, 22 nt, Escherichia coli CFT073
cgcgcuaccacuucccaacgcu

SEQ ID NO: 2669271 - RNA, 16 nt, Escherichia coli CFT073
cgcgcucacaccacaa

SEQ ID NO: 2669272 - RNA, 16 nt, Escherichia coli CFT073
cgcgcucaccgcucuu

SEQ ID NO: 2669273 - RNA, 19 nt, Escherichia coli CFT073
cgcgcucaccgcucuucau

SEQ ID NO: 2669274 - RNA, 21 nt, Escherichia coli CFT073
cgcgcucauacgaucgcgaau

SEQ ID NO: 2669275 - RNA, 15 nt, Escherichia coli CFT073
cgcgcucaucagcgg

SEQ ID NO: 2669276 - RNA, 18 nt, Escherichia coli CFT073
cgcgcuccggcacuuaau

SEQ ID NO: 2669277 - RNA, 22 nt, Escherichia coli CFT073
cgcgcucgaagcgggugcgcag

SEQ ID NO: 2669278 - RNA, 23 nt, Escherichia coli CFT073
cgcgcucguagguuucugccagc

SEQ ID NO: 2669279 - RNA, 24 nt, Escherichia coli CFT073
cgcgcucguagguuucugccagcg

SEQ ID NO: 2669280 - RNA, 18 nt, Escherichia coli CFT073
cgcgcugagacccggcca

SEQ ID NO: 2669281 - RNA, 22 nt, Escherichia coli CFT073
cgcgcugccagaaccgcuucuu

SEQ ID NO: 2669282 - RNA, 13 nt, Escherichia coli CFT073
cgcgcugccagau

SEQ ID NO: 2669283 - RNA, 12 nt, Escherichia coli CFT073
cgcgcuggcauc

SEQ ID NO: 2669284 - RNA, 20 nt, Escherichia coli CFT073
cgcuaacaugguuaaaaucu

SEQ ID NO: 2669285 - RNA, 17 nt, Escherichia coli CFT073
cgcuaagauaccccagc

SEQ ID NO: 2669286 - RNA, 21 nt, Escherichia coli CFT073
cgcuaagauaccccagcgcaa

SEQ ID NO: 2669287 - RNA, 12 nt, Escherichia coli CFT073
cgcuaagcccga

SEQ ID NO: 2669288 - RNA, 17 nt, Escherichia coli CFT073
cgcuaauuucagcaucg

SEQ ID NO: 2669289 - RNA, 13 nt, Escherichia coli CFT073
cgcuacauaacgc

SEQ ID NO: 2669290 - RNA, 14 nt, Escherichia coli CFT073
cgcuaccacuuccc

SEQ ID NO: 2669291 - RNA, 19 nt, Escherichia coli CFT073
cgcuaccagaaagcgaccc

SEQ ID NO: 2669292 - RNA, 13 nt, Escherichia coli CFT073
cgcuaccagcaaa

SEQ ID NO: 2669293 - RNA, 19 nt, Escherichia coli CFT073
cgcuaccauuugcgcggau

SEQ ID NO: 2669294 - RNA, 14 nt, Escherichia coli CFT073
cgcuaccgcccuga

SEQ ID NO: 2669295 - RNA, 20 nt, Escherichia coli CFT073
cgcuaccugccgccaccaug

SEQ ID NO: 2669296 - RNA, 15 nt, Escherichia coli CFT073
cgcuacgccuuccgu

SEQ ID NO: 2669297 - RNA, 15 nt, Escherichia coli CFT073
cgcuacggcguuuca

SEQ ID NO: 2669298 - RNA, 13 nt, Escherichia coli CFT073
cgcuacuggcaau

SEQ ID NO: 2669299 - RNA, 19 nt, Escherichia coli CFT073
cgcuacuggcaauccugcu

SEQ ID NO: 2669300 - RNA, 14 nt, Escherichia coli CFT073
cgcuagauagguca

SEQ ID NO: 2669301 - RNA, 14 nt, Escherichia coli CFT073
cgcuaguacgccaa

SEQ ID NO: 2669302 - RNA, 18 nt, Escherichia coli CFT073
cgcuaguuucgugcccgc

SEQ ID NO: 2669303 - RNA, 22 nt, Escherichia coli CFT073
cgcuauaccggaaaaggccacg

SEQ ID NO: 2669304 - RNA, 22 nt, Escherichia coli CFT073
cgcuauagacaccuugcaacuc

SEQ ID NO: 2669305 - RNA, 14 nt, Escherichia coli CFT073
cgcuaucaaacuga

SEQ ID NO: 2669306 - RNA, 12 nt, Escherichia coli CFT073
cgcuaucagcgc

SEQ ID NO: 2669307 - RNA, 13 nt, Escherichia coli CFT073
cgcuaucagcgcc

SEQ ID NO: 2669308 - RNA, 15 nt, Escherichia coli CFT073
cgcuaucagcgccac

SEQ ID NO: 2669309 - RNA, 13 nt, Escherichia coli CFT073
cgcuauccagcgc

SEQ ID NO: 2669310 - RNA, 15 nt, Escherichia coli CFT073
cgcuauccagcgcau

SEQ ID NO: 2669311 - RNA, 17 nt, Escherichia coli CFT073
cgcuaucguguugcugu

SEQ ID NO: 2669312 - RNA, 19 nt, Escherichia coli CFT073
cgcuauugaccagcgccgc

SEQ ID NO: 2669313 - RNA, 22 nt, Escherichia coli CFT073
cgcucaacuuccugaaucgccg

SEQ ID NO: 2669314 - RNA, 13 nt, Escherichia coli CFT073
cgcucaauauaac

SEQ ID NO: 2669315 - RNA, 20 nt, Escherichia coli CFT073
cgcucaauauaacgaucggc

SEQ ID NO: 2669316 - RNA, 18 nt, Escherichia coli CFT073
cgcucaauauauucuuua

SEQ ID NO: 2669317 - RNA, 19 nt, Escherichia coli CFT073
cgcucaauauccugaccuu

SEQ ID NO: 2669318 - RNA, 14 nt, Escherichia coli CFT073
cgcucaauguugcu

SEQ ID NO: 2669319 - RNA, 17 nt, Escherichia coli CFT073
cgcucaauguugcugcu

SEQ ID NO: 2669320 - RNA, 19 nt, Escherichia coli CFT073
cgcucacaacaauaucaaa

SEQ ID NO: 2669321 - RNA, 14 nt, Escherichia coli CFT073
cgcucacaccacaa

SEQ ID NO: 2669322 - RNA, 15 nt, Escherichia coli CFT073
cgcucacaccacaac

SEQ ID NO: 2669323 - RNA, 20 nt, Escherichia coli CFT073
cgcucacggcggcaguauuu

SEQ ID NO: 2669324 - RNA, 14 nt, Escherichia coli CFT073
cgcucacugcacga

SEQ ID NO: 2669325 - RNA, 21 nt, Escherichia coli CFT073
cgcucagcaacauggcgcggc

SEQ ID NO: 2669326 - RNA, 12 nt, Escherichia coli CFT073
cgcucagcaauc

SEQ ID NO: 2669327 - RNA, 21 nt, Escherichia coli CFT073
cgcucauaaauugcagcgauu

SEQ ID NO: 2669328 - RNA, 18 nt, Escherichia coli CFT073
cgcucauaauacaggcua

SEQ ID NO: 2669329 - RNA, 12 nt, Escherichia coli CFT073
cgcucaucagcg

SEQ ID NO: 2669330 - RNA, 22 nt, Escherichia coli CFT073
cgcucaucggcauacagcgaca

SEQ ID NO: 2669331 - RNA, 17 nt, Escherichia coli CFT073
cgcucaucugcugcguu

SEQ ID NO: 2669332 - RNA, 12 nt, Escherichia coli CFT073
cgcuccaugcug

SEQ ID NO: 2669333 - RNA, 22 nt, Escherichia coli CFT073
cgcucccaaaccgcccagcagc

SEQ ID NO: 2669334 - RNA, 23 nt, Escherichia coli CFT073
cgcucccaaaccgcccagcagcg

SEQ ID NO: 2669335 - RNA, 13 nt, Escherichia coli CFT073
cgcucccagcagu

SEQ ID NO: 2669336 - RNA, 23 nt, Escherichia coli CFT073
cgcuccgggccguaacugugcca

SEQ ID NO: 2669337 - RNA, 14 nt, Escherichia coli CFT073
cgcuccucaucaau

SEQ ID NO: 2669338 - RNA, 17 nt, Escherichia coli CFT073
cgcucgagccgcauccg

SEQ ID NO: 2669339 - RNA, 14 nt, Escherichia coli CFT073
cgcucgcauccugc

SEQ ID NO: 2669340 - RNA, 19 nt, Escherichia coli CFT073
cgcucgccaaagcagugaa

SEQ ID NO: 2669341 - RNA, 13 nt, Escherichia coli CFT073
cgcucgcgccgca

SEQ ID NO: 2669342 - RNA, 22 nt, Escherichia coli CFT073
cgcucgcuggcguuguccgcca

SEQ ID NO: 2669343 - RNA, 21 nt, Escherichia coli CFT073
cgcucggcaacaccucagcca

SEQ ID NO: 2669344 - RNA, 21 nt, Escherichia coli CFT073
cgcucuaaaaucaucacgcgg

SEQ ID NO: 2669345 - RNA, 15 nt, Escherichia coli CFT073
cgcucuacugucuca

SEQ ID NO: 2669346 - RNA, 22 nt, Escherichia coli CFT073
cgcucucgccgcgcuccaucau

SEQ ID NO: 2669347 - RNA, 23 nt, Escherichia coli CFT073
cgcucucgccgcgcuccaucaug

SEQ ID NO: 2669348 - RNA, 16 nt, Escherichia coli CFT073
cgcucucuaucacgaa

SEQ ID NO: 2669349 - RNA, 23 nt, Escherichia coli CFT073
cgcucucuucguggcccgccagc

SEQ ID NO: 2669350 - RNA, 14 nt, Escherichia coli CFT073
cgcucugacgacau

SEQ ID NO: 2669351 - RNA, 18 nt, Escherichia coli CFT073
cgcucugcaucccggcag

SEQ ID NO: 2669352 - RNA, 21 nt, Escherichia coli CFT073
cgcucuggauaaucacaaugg

SEQ ID NO: 2669353 - RNA, 17 nt, Escherichia coli CFT073
cgcucuggaugaaaucc

SEQ ID NO: 2669354 - RNA, 13 nt, Escherichia coli CFT073
cgcucuggcaggc

SEQ ID NO: 2669355 - RNA, 13 nt, Escherichia coli CFT073
cgcucuucaaacu

SEQ ID NO: 2669356 - RNA, 14 nt, Escherichia coli CFT073
cgcucuucaucuuc

SEQ ID NO: 2669357 - RNA, 16 nt, Escherichia coli CFT073
cgcucuucaucuucca

SEQ ID NO: 2669358 - RNA, 23 nt, Escherichia coli CFT073
cgcucuuuuauuagccgcggccu

SEQ ID NO: 2669359 - RNA, 18 nt, Escherichia coli CFT073
cgcugaaacuucaccaac

SEQ ID NO: 2669360 - RNA, 23 nt, Escherichia coli CFT073
cgcugaaauguaaaaguugcagu

SEQ ID NO: 2669361 - RNA, 19 nt, Escherichia coli CFT073
cgcugaauaauccccacau

SEQ ID NO: 2669362 - RNA, 15 nt, Escherichia coli CFT073
cgcugacaaacugcg

SEQ ID NO: 2669363 - RNA, 23 nt, Escherichia coli CFT073
cgcugacauuacgcgcuucguug

SEQ ID NO: 2669364 - RNA, 18 nt, Escherichia coli CFT073
cgcugaccacuuugcgcu

SEQ ID NO: 2669365 - RNA, 19 nt, Escherichia coli CFT073
cgcugaccuucuucagcaa

SEQ ID NO: 2669366 - RNA, 22 nt, Escherichia coli CFT073
cgcugacgaucauuccgcccag

SEQ ID NO: 2669367 - RNA, 18 nt, Escherichia coli CFT073
cgcugacugaaucaggaa

SEQ ID NO: 2669368 - RNA, 16 nt, Escherichia coli CFT073
cgcugagauccgucag

SEQ ID NO: 2669369 - RNA, 21 nt, Escherichia coli CFT073
cgcugaggaucgggcagugcu

SEQ ID NO: 2669370 - RNA, 20 nt, Escherichia coli CFT073
cgcugauaaaucccgccgcu

SEQ ID NO: 2669371 - RNA, 22 nt, Escherichia coli CFT073
cgcugauacgcggaucuccggc

SEQ ID NO: 2669372 - RNA, 22 nt, Escherichia coli CFT073
cgcugauauugcuccagacguu

SEQ ID NO: 2669373 - RNA, 23 nt, Escherichia coli CFT073
cgcugauucuucccacgcgguua

SEQ ID NO: 2669374 - RNA, 18 nt, Escherichia coli CFT073
cgcugauugccccuccgc

SEQ ID NO: 2669375 - RNA, 23 nt, Escherichia coli CFT073
cgcugcaaggcaacgcagcccca

SEQ ID NO: 2669376 - RNA, 14 nt, Escherichia coli CFT073
cgcugcacuuucuc

SEQ ID NO: 2669377 - RNA, 19 nt, Escherichia coli CFT073
cgcugcauggcaacuuuaa

SEQ ID NO: 2669378 - RNA, 18 nt, Escherichia coli CFT073
cgcugccccugguuaucu

SEQ ID NO: 2669379 - RNA, 12 nt, Escherichia coli CFT073
cgcugcccgccg

SEQ ID NO: 2669380 - RNA, 22 nt, Escherichia coli CFT073
cgcugcgccauaaccgccagca

SEQ ID NO: 2669381 - RNA, 18 nt, Escherichia coli CFT073
cgcugcgcgaccaucgga

SEQ ID NO: 2669382 - RNA, 22 nt, Escherichia coli CFT073
cgcugcgcuuacacacccggcc

SEQ ID NO: 2669383 - RNA, 16 nt, Escherichia coli CFT073
cgcugcgcuucucagg

SEQ ID NO: 2669384 - RNA, 20 nt, Escherichia coli CFT073
cgcugcgucuuccacuucau

SEQ ID NO: 2669385 - RNA, 15 nt, Escherichia coli CFT073
cgcugcucacaccau

SEQ ID NO: 2669386 - RNA, 17 nt, Escherichia coli CFT073
cgcugcucacaccaugc

SEQ ID NO: 2669387 - RNA, 19 nt, Escherichia coli CFT073
cgcugcuguagcaguucca

SEQ ID NO: 2669388 - RNA, 22 nt, Escherichia coli CFT073
cgcuggagaauaaagcuuuaau

SEQ ID NO: 2669389 - RNA, 17 nt, Escherichia coli CFT073
cgcuggaggcaucugau

SEQ ID NO: 2669390 - RNA, 13 nt, Escherichia coli CFT073
cgcuggaucgaac

SEQ ID NO: 2669391 - RNA, 16 nt, Escherichia coli CFT073
cgcuggaugcgaugcu

SEQ ID NO: 2669392 - RNA, 15 nt, Escherichia coli CFT073
cgcuuuuuucaucuc

SEQ ID NO: 2669393 - RNA, 22 nt, Escherichia coli CFT073
cggaaaaacguuucaaacaggc

SEQ ID NO: 2669394 - RNA, 19 nt, Escherichia coli CFT073
cggaaaaaucaaaaacucu

SEQ ID NO: 2669395 - RNA, 13 nt, Escherichia coli CFT073
cggaaaacaacac

SEQ ID NO: 2669396 - RNA, 16 nt, Escherichia coli CFT073
cggaaaacaaccgcca

SEQ ID NO: 2669397 - RNA, 23 nt, Escherichia coli CFT073
cggaaaaguuuauuacucagcgc

SEQ ID NO: 2669398 - RNA, 14 nt, Escherichia coli CFT073
cggaaaccaaacuu

SEQ ID NO: 2669399 - RNA, 15 nt, Escherichia coli CFT073
cggaaaccagcggca

SEQ ID NO: 2669400 - RNA, 17 nt, Escherichia coli CFT073
cggaaacugucaauaaa

SEQ ID NO: 2669401 - RNA, 16 nt, Escherichia coli CFT073
cggaaagcaacaaguu

SEQ ID NO: 2669402 - RNA, 19 nt, Escherichia coli CFT073
cggaaaggguuaaaccaua

SEQ ID NO: 2669403 - RNA, 23 nt, Escherichia coli CFT073
cggaaauaucggcgucguuguac

SEQ ID NO: 2669404 - RNA, 19 nt, Escherichia coli CFT073
cggaaaucauccagcacgu

SEQ ID NO: 2669405 - RNA, 14 nt, Escherichia coli CFT073
cggaaaucaugcuc

SEQ ID NO: 2669406 - RNA, 13 nt, Escherichia coli CFT073
cggaaaucuccag

SEQ ID NO: 2669407 - RNA, 18 nt, Escherichia coli CFT073
cggaaaucuccagauaau

SEQ ID NO: 2669408 - RNA, 23 nt, Escherichia coli CFT073
cggaaauuaccgcaccaccagca

SEQ ID NO: 2669409 - RNA, 16 nt, Escherichia coli CFT073
cggaacauccggcaaa

SEQ ID NO: 2669410 - RNA, 19 nt, Escherichia coli CFT073
cggaacaucgaugccgccu

SEQ ID NO: 2669411 - RNA, 13 nt, Escherichia coli CFT073
cggaaccaaccgc

SEQ ID NO: 2669412 - RNA, 13 nt, Escherichia coli CFT073
cggaaccaccaga

SEQ ID NO: 2669413 - RNA, 16 nt, Escherichia coli CFT073
cggaaccaccagaucc

SEQ ID NO: 2669414 - RNA, 14 nt, Escherichia coli CFT073
cggaaccagcgccu

SEQ ID NO: 2669415 - RNA, 15 nt, Escherichia coli CFT073
cggaaccgcaggcug

SEQ ID NO: 2669416 - RNA, 20 nt, Escherichia coli CFT073
cggaaccggauuuucaccau

SEQ ID NO: 2669417 - RNA, 17 nt, Escherichia coli CFT073
cggaacggcguugcugc

SEQ ID NO: 2669418 - RNA, 20 nt, Escherichia coli CFT073
cggaacgguaggccggauaa

SEQ ID NO: 2669419 - RNA, 16 nt, Escherichia coli CFT073
cggaacugcuccaggg

SEQ ID NO: 2669420 - RNA, 15 nt, Escherichia coli CFT073
cggaacuuucaccac

SEQ ID NO: 2669421 - RNA, 19 nt, Escherichia coli CFT073
cggaacuuuuuucauccag

SEQ ID NO: 2669422 - RNA, 20 nt, Escherichia coli CFT073
cggaagaccugacuguucca

SEQ ID NO: 2669423 - RNA, 14 nt, Escherichia coli CFT073
cggaagagacuauu

SEQ ID NO: 2669424 - RNA, 16 nt, Escherichia coli CFT073
cggaagaguuuuucag

SEQ ID NO: 2669425 - RNA, 15 nt, Escherichia coli CFT073
cggaagaucggaaag

SEQ ID NO: 2669426 - RNA, 15 nt, Escherichia coli CFT073
cggaagaugaaaaac

SEQ ID NO: 2669427 - RNA, 23 nt, Escherichia coli CFT073
cggaagauuauuucgcugcggau

SEQ ID NO: 2669428 - RNA, 14 nt, Escherichia coli CFT073
cggaagccccaggu

SEQ ID NO: 2669429 - RNA, 17 nt, Escherichia coli CFT073
cggaagccccaggucaa

SEQ ID NO: 2669430 - RNA, 21 nt, Escherichia coli CFT073
cggaagccccaggucaauaau

SEQ ID NO: 2669431 - RNA, 14 nt, Escherichia coli CFT073
cggaagcgccacca

SEQ ID NO: 2669432 - RNA, 18 nt, Escherichia coli CFT073
cggaagcgccaccagcgc

SEQ ID NO: 2669433 - RNA, 20 nt, Escherichia coli CFT073
cggaagcgccaccagcgcca

SEQ ID NO: 2669434 - RNA, 23 nt, Escherichia coli CFT073
cggaagcuuaucacagaggaaga

SEQ ID NO: 2669435 - RNA, 20 nt, Escherichia coli CFT073
cggaaggugagggggcgaua

SEQ ID NO: 2669436 - RNA, 16 nt, Escherichia coli CFT073
cggaaguaagaggagg

SEQ ID NO: 2669437 - RNA, 13 nt, Escherichia coli CFT073
cggaauaaauguc

SEQ ID NO: 2669438 - RNA, 12 nt, Escherichia coli CFT073
cggaauaauaau

SEQ ID NO: 2669439 - RNA, 22 nt, Escherichia coli CFT073
cggaauauauucauauuuuuuc

SEQ ID NO: 2669440 - RNA, 17 nt, Escherichia coli CFT073
cggaauauucuuccggc

SEQ ID NO: 2669441 - RNA, 19 nt, Escherichia coli CFT073
cggaaugaggcacgacaca

SEQ ID NO: 2669442 - RNA, 20 nt, Escherichia coli CFT073
cggaaugauauuggucacca

SEQ ID NO: 2669443 - RNA, 17 nt, Escherichia coli CFT073
cggaaugcacagccuga

SEQ ID NO: 2669444 - RNA, 19 nt, Escherichia coli CFT073
cggaaugcacagccugaua

SEQ ID NO: 2669445 - RNA, 13 nt, Escherichia coli CFT073
cggaaugccggaa

SEQ ID NO: 2669446 - RNA, 15 nt, Escherichia coli CFT073
cggaauggcaucuuc

SEQ ID NO: 2669447 - RNA, 12 nt, Escherichia coli CFT073
cggaauggucag

SEQ ID NO: 2669448 - RNA, 17 nt, Escherichia coli CFT073
cggaauuggccgcgcaa

SEQ ID NO: 2669449 - RNA, 19 nt, Escherichia coli CFT073
cggaauuuacccgccaggu

SEQ ID NO: 2669450 - RNA, 15 nt, Escherichia coli CFT073
cggaauuugcugcug

SEQ ID NO: 2669451 - RNA, 17 nt, Escherichia coli CFT073
cggacaauaauaucuuu

SEQ ID NO: 2669452 - RNA, 20 nt, Escherichia coli CFT073
cggacaauaauaucuuucuu

SEQ ID NO: 2669453 - RNA, 20 nt, Escherichia coli CFT073
cggacaccucaccaaauugu

SEQ ID NO: 2669454 - RNA, 22 nt, Escherichia coli CFT073
cggacacgaucuugauguggac

SEQ ID NO: 2669455 - RNA, 15 nt, Escherichia coli CFT073
cggacacucggcgcg

SEQ ID NO: 2669456 - RNA, 16 nt, Escherichia coli CFT073
cggacaguacugccgg

SEQ ID NO: 2669457 - RNA, 23 nt, Escherichia coli CFT073
cggacagucacguagcggcggca

SEQ ID NO: 2669458 - RNA, 20 nt, Escherichia coli CFT073
cggacauaaagcccgcuuca

SEQ ID NO: 2669459 - RNA, 21 nt, Escherichia coli CFT073
cggacaugaaccgugucgcca

SEQ ID NO: 2669460 - RNA, 21 nt, Escherichia coli CFT073
cggacauguuuuccagcacau

SEQ ID NO: 2669461 - RNA, 15 nt, Escherichia coli CFT073
cggaccaacaaaaau

SEQ ID NO: 2669462 - RNA, 23 nt, Escherichia coli CFT073
cggaccacgcacagcccgccgcc

SEQ ID NO: 2669463 - RNA, 16 nt, Escherichia coli CFT073
cggaccagcgggcgcu

SEQ ID NO: 2669464 - RNA, 22 nt, Escherichia coli CFT073
cggacgaccgugcgccagcaaa

SEQ ID NO: 2669465 - RNA, 18 nt, Escherichia coli CFT073
cggacgaucgcugaugaa

SEQ ID NO: 2669466 - RNA, 15 nt, Escherichia coli CFT073
cggacggcguccugc

SEQ ID NO: 2669467 - RNA, 16 nt, Escherichia coli CFT073
cggacggcucacuuug

SEQ ID NO: 2669468 - RNA, 15 nt, Escherichia coli CFT073
cggacgucuguuuau

SEQ ID NO: 2669469 - RNA, 14 nt, Escherichia coli CFT073
cggacguucgccca

SEQ ID NO: 2669470 - RNA, 18 nt, Escherichia coli CFT073
cggacguuugauuuuuaa

SEQ ID NO: 2669471 - RNA, 16 nt, Escherichia coli CFT073
cggacuuaacgucaca

SEQ ID NO: 2669472 - RNA, 19 nt, Escherichia coli CFT073
cggacuucaagcggacgau

SEQ ID NO: 2669473 - RNA, 23 nt, Escherichia coli CFT073
cggacuucaguuucuucaacagg

SEQ ID NO: 2669474 - RNA, 16 nt, Escherichia coli CFT073
cggagaaaauccgcca

SEQ ID NO: 2669475 - RNA, 19 nt, Escherichia coli CFT073
cggagaacuuaaucaucgc

SEQ ID NO: 2669476 - RNA, 16 nt, Escherichia coli CFT073
cggagaagagauaaac

SEQ ID NO: 2669477 - RNA, 17 nt, Escherichia coli CFT073
cggagaaggcguucacg

SEQ ID NO: 2669478 - RNA, 22 nt, Escherichia coli CFT073
cggagaaggcguucacgccgca

SEQ ID NO: 2669479 - RNA, 13 nt, Escherichia coli CFT073
cggagaauagcgc

SEQ ID NO: 2669480 - RNA, 22 nt, Escherichia coli CFT073
cggagaauccagccccaccagc

SEQ ID NO: 2669481 - RNA, 16 nt, Escherichia coli CFT073
cggagacaaacagggu

SEQ ID NO: 2669482 - RNA, 21 nt, Escherichia coli CFT073
cggagauaaccacguucauuu

SEQ ID NO: 2669483 - RNA, 14 nt, Escherichia coli CFT073
cggagaucaccaca

SEQ ID NO: 2669484 - RNA, 16 nt, Escherichia coli CFT073
cggagaucgccagccc

SEQ ID NO: 2669485 - RNA, 12 nt, Escherichia coli CFT073
cggagcaaccug

SEQ ID NO: 2669486 - RNA, 15 nt, Escherichia coli CFT073
cggagcaaccugcac

SEQ ID NO: 2669487 - RNA, 17 nt, Escherichia coli CFT073
cggagcaaugaucucaa

SEQ ID NO: 2669488 - RNA, 16 nt, Escherichia coli CFT073
cggagcccuacaaacc

SEQ ID NO: 2669489 - RNA, 21 nt, Escherichia coli CFT073
cggagcccuacaaaccaucug

SEQ ID NO: 2669490 - RNA, 16 nt, Escherichia coli CFT073
cggagcgcaucaggua

SEQ ID NO: 2669491 - RNA, 14 nt, Escherichia coli CFT073
cggagcgcgcguca

SEQ ID NO: 2669492 - RNA, 21 nt, Escherichia coli CFT073
cggagcucccccucuuccgga

SEQ ID NO: 2669493 - RNA, 20 nt, Escherichia coli CFT073
cggagcugcagccaguugcu

SEQ ID NO: 2669494 - RNA, 13 nt, Escherichia coli CFT073
cggagcugccagc

SEQ ID NO: 2669495 - RNA, 18 nt, Escherichia coli CFT073
cggagcuucacccgcagc

SEQ ID NO: 2669496 - RNA, 19 nt, Escherichia coli CFT073
cggagcuucacccgcagca

SEQ ID NO: 2669497 - RNA, 22 nt, Escherichia coli CFT073
cggagcuucacccgcagcacgg

SEQ ID NO: 2669498 - RNA, 17 nt, Escherichia coli CFT073
cggaggagugcgccagu

SEQ ID NO: 2669499 - RNA, 23 nt, Escherichia coli CFT073
cggaggccugauaaaacgcgcag

SEQ ID NO: 2669500 - RNA, 22 nt, Escherichia coli CFT073
cggcaauauagauaucaugcuc

SEQ ID NO: 2669501 - RNA, 20 nt, Escherichia coli CFT073
cggcaaucaccgccagcggc

SEQ ID NO: 2669502 - RNA, 12 nt, Escherichia coli CFT073
cggcaaucacgc

SEQ ID NO: 2669503 - RNA, 20 nt, Escherichia coli CFT073
cggcaaucauucccagaccu

SEQ ID NO: 2669504 - RNA, 15 nt, Escherichia coli CFT073
cggcaauccgugcaa

SEQ ID NO: 2669505 - RNA, 20 nt, Escherichia coli CFT073
cggcaaucgcaaucauuuuu

SEQ ID NO: 2669506 - RNA, 12 nt, Escherichia coli CFT073
cggcaaucgcca

SEQ ID NO: 2669507 - RNA, 23 nt, Escherichia coli CFT073
cggcaaucgccagauccgcuucg

SEQ ID NO: 2669508 - RNA, 14 nt, Escherichia coli CFT073
cggcaaucgcgcca

SEQ ID NO: 2669509 - RNA, 15 nt, Escherichia coli CFT073
cggcaaucgcugcua

SEQ ID NO: 2669510 - RNA, 20 nt, Escherichia coli CFT073
cggcaaucuuuaccggucag

SEQ ID NO: 2669511 - RNA, 16 nt, Escherichia coli CFT073
cggcaaugaaacucaa

SEQ ID NO: 2669512 - RNA, 22 nt, Escherichia coli CFT073
cggcaaugcgcacggaguaaca

SEQ ID NO: 2669513 - RNA, 14 nt, Escherichia coli CFT073
cggcaaugcgcccc

SEQ ID NO: 2669514 - RNA, 16 nt, Escherichia coli CFT073
cggcaaugugaaggug

SEQ ID NO: 2669515 - RNA, 21 nt, Escherichia coli CFT073
cggcaauguuaccgaucgcca

SEQ ID NO: 2669516 - RNA, 23 nt, Escherichia coli CFT073
cggcaauuucagugcugacugau

SEQ ID NO: 2669517 - RNA, 23 nt, Escherichia coli CFT073
cggcaauuuugcgccgauugccu

SEQ ID NO: 2669518 - RNA, 14 nt, Escherichia coli CFT073
cggcacaaaucccc

SEQ ID NO: 2669519 - RNA, 22 nt, Escherichia coli CFT073
cggcacacagcacggcagcaac

SEQ ID NO: 2669520 - RNA, 13 nt, Escherichia coli CFT073
cggcacaccagcc

SEQ ID NO: 2669521 - RNA, 15 nt, Escherichia coli CFT073
cggcacaccagccag

SEQ ID NO: 2669522 - RNA, 16 nt, Escherichia coli CFT073
cggcacagaaacgcca

SEQ ID NO: 2669523 - RNA, 21 nt, Escherichia coli CFT073
cggcacagccagcgcaggcag

SEQ ID NO: 2669524 - RNA, 21 nt, Escherichia coli CFT073
cggcacagucgcgacgcugac

SEQ ID NO: 2669525 - RNA, 15 nt, Escherichia coli CFT073
cggcacauaaccagu

SEQ ID NO: 2669526 - RNA, 18 nt, Escherichia coli CFT073
cggcacauagacggugac

SEQ ID NO: 2669527 - RNA, 14 nt, Escherichia coli CFT073
cggcaccagauauu

SEQ ID NO: 2669528 - RNA, 14 nt, Escherichia coli CFT073
cggcaccagcaccg

SEQ ID NO: 2669529 - RNA, 14 nt, Escherichia coli CFT073
cggcaccagcgcug

SEQ ID NO: 2669530 - RNA, 21 nt, Escherichia coli CFT073
cggcaccauuccaccucccgu

SEQ ID NO: 2669531 - RNA, 17 nt, Escherichia coli CFT073
cggcacccaucgccagc

SEQ ID NO: 2669532 - RNA, 20 nt, Escherichia coli CFT073
cggcaccgaggaugaauaac

SEQ ID NO: 2669533 - RNA, 12 nt, Escherichia coli CFT073
cggcaccgccgc

SEQ ID NO: 2669534 - RNA, 19 nt, Escherichia coli CFT073
cggcacgaccaggaacgcc

SEQ ID NO: 2669535 - RNA, 15 nt, Escherichia coli CFT073
cggcacgccggucgg

SEQ ID NO: 2669536 - RNA, 19 nt, Escherichia coli CFT073
cggcacgcguugcgcauga

SEQ ID NO: 2669537 - RNA, 18 nt, Escherichia coli CFT073
cggcacguuacugaucac

SEQ ID NO: 2669538 - RNA, 23 nt, Escherichia coli CFT073
cggcacguucgauguggcucagc

SEQ ID NO: 2669539 - RNA, 17 nt, Escherichia coli CFT073
cggcacguuuugcggau

SEQ ID NO: 2669540 - RNA, 16 nt, Escherichia coli CFT073
cggcacuagucccucc

SEQ ID NO: 2669541 - RNA, 22 nt, Escherichia coli CFT073
cggcacuagucccuccgcacaa

SEQ ID NO: 2669542 - RNA, 12 nt, Escherichia coli CFT073
cggcacuccgcc

SEQ ID NO: 2669543 - RNA, 14 nt, Escherichia coli CFT073
cggcagaaaaucca

SEQ ID NO: 2669544 - RNA, 15 nt, Escherichia coli CFT073
cggcagaaugguaac

SEQ ID NO: 2669545 - RNA, 21 nt, Escherichia coli CFT073
cggcagaaugguaacaccaga

SEQ ID NO: 2669546 - RNA, 22 nt, Escherichia coli CFT073
cggcagacagcgccaggcuguu

SEQ ID NO: 2669547 - RNA, 21 nt, Escherichia coli CFT073
cggcagagaaaaugccgcaca

SEQ ID NO: 2669548 - RNA, 18 nt, Escherichia coli CFT073
cggcagagaaaccacauc

SEQ ID NO: 2669549 - RNA, 14 nt, Escherichia coli CFT073
cggcagauaaacaa

SEQ ID NO: 2669550 - RNA, 18 nt, Escherichia coli CFT073
cggcagauugagcgucaa

SEQ ID NO: 2669551 - RNA, 16 nt, Escherichia coli CFT073
cggcagcaaucgacca

SEQ ID NO: 2669552 - RNA, 14 nt, Escherichia coli CFT073
cggcagcagcaccc

SEQ ID NO: 2669553 - RNA, 19 nt, Escherichia coli CFT073
cggcagcaggugcgccagc

SEQ ID NO: 2669554 - RNA, 13 nt, Escherichia coli CFT073
cggcagccuccug

SEQ ID NO: 2669555 - RNA, 15 nt, Escherichia coli CFT073
cggcagccugacgcc

SEQ ID NO: 2669556 - RNA, 18 nt, Escherichia coli CFT073
cggcagccugcgucgcca

SEQ ID NO: 2669557 - RNA, 15 nt, Escherichia coli CFT073
cggcagcggcuucau

SEQ ID NO: 2669558 - RNA, 17 nt, Escherichia coli CFT073
cggcagcggcuucaugc

SEQ ID NO: 2669559 - RNA, 13 nt, Escherichia coli CFT073
cggcagcgggauu

SEQ ID NO: 2669560 - RNA, 22 nt, Escherichia coli CFT073
cggcagcgggauuuccggcauc

SEQ ID NO: 2669561 - RNA, 14 nt, Escherichia coli CFT073
cggcagcuccagca

SEQ ID NO: 2669562 - RNA, 14 nt, Escherichia coli CFT073
cggcagcucuuucu

SEQ ID NO: 2669563 - RNA, 20 nt, Escherichia coli CFT073
cggcagcuuuaccggcuucg

SEQ ID NO: 2669564 - RNA, 15 nt, Escherichia coli CFT073
cggcaggcacaaaac

SEQ ID NO: 2669565 - RNA, 19 nt, Escherichia coli CFT073
cggcaggccuaacacaugc

SEQ ID NO: 2669566 - RNA, 21 nt, Escherichia coli CFT073
cggcaggguacgacuuccugg

SEQ ID NO: 2669567 - RNA, 19 nt, Escherichia coli CFT073
cggcaggguguuaucaaua

SEQ ID NO: 2669568 - RNA, 15 nt, Escherichia coli CFT073
cggcaggucaucgug

SEQ ID NO: 2669569 - RNA, 23 nt, Escherichia coli CFT073
cggcaggugauggcggcuuggcu

SEQ ID NO: 2669570 - RNA, 21 nt, Escherichia coli CFT073
cggcagguuuaaccaucaggc

SEQ ID NO: 2669571 - RNA, 18 nt, Escherichia coli CFT073
cggcaguauagcggcaug

SEQ ID NO: 2669572 - RNA, 17 nt, Escherichia coli CFT073
cggcagucgcgcuucgu

SEQ ID NO: 2669573 - RNA, 12 nt, Escherichia coli CFT073
cggcagugaaaa

SEQ ID NO: 2669574 - RNA, 22 nt, Escherichia coli CFT073
cggcagugacagccccaguucc

SEQ ID NO: 2669575 - RNA, 22 nt, Escherichia coli CFT073
cggcagugauuuucccuuccgc

SEQ ID NO: 2669576 - RNA, 18 nt, Escherichia coli CFT073
cggcagugcuuucauuuc

SEQ ID NO: 2669577 - RNA, 19 nt, Escherichia coli CFT073
cggcagugcuuucauuuca

SEQ ID NO: 2669578 - RNA, 15 nt, Escherichia coli CFT073
cggcauaaacaaagc

SEQ ID NO: 2669579 - RNA, 18 nt, Escherichia coli CFT073
cggcauaaagcugcggau

SEQ ID NO: 2669580 - RNA, 23 nt, Escherichia coli CFT073
cggcauaagccgucccuacuggu

SEQ ID NO: 2669581 - RNA, 20 nt, Escherichia coli CFT073
cggcauaauaagcccggccu

SEQ ID NO: 2669582 - RNA, 14 nt, Escherichia coli CFT073
cggcauacccauau

SEQ ID NO: 2669583 - RNA, 16 nt, Escherichia coli CFT073
cggcauauaccgucag

SEQ ID NO: 2669584 - RNA, 22 nt, Escherichia coli CFT073
cggcaucaaaccauucccggcu

SEQ ID NO: 2669585 - RNA, 21 nt, Escherichia coli CFT073
cggcaucaggcaacaucgcca

SEQ ID NO: 2669586 - RNA, 23 nt, Escherichia coli CFT073
cggcaucccgguauaacuugcca

SEQ ID NO: 2669587 - RNA, 15 nt, Escherichia coli CFT073
cggcaucgccaacca

SEQ ID NO: 2669588 - RNA, 21 nt, Escherichia coli CFT073
cggcaucgccuucgcaaaaaa

SEQ ID NO: 2669589 - RNA, 22 nt, Escherichia coli CFT073
cggcaucuuaucuaacaaucuu

SEQ ID NO: 2669590 - RNA, 16 nt, Escherichia coli CFT073
cggcaucuucuucugg

SEQ ID NO: 2669591 - RNA, 16 nt, Escherichia coli CFT073
cggcaugaaagcgaug

SEQ ID NO: 2669592 - RNA, 15 nt, Escherichia coli CFT073
cggcaugaacaaagc

SEQ ID NO: 2669593 - RNA, 15 nt, Escherichia coli CFT073
cggcaugaacgccug

SEQ ID NO: 2669594 - RNA, 16 nt, Escherichia coli CFT073
cggcaugacgccgggc

SEQ ID NO: 2669595 - RNA, 19 nt, Escherichia coli CFT073
cggcaugauauguaacaua

SEQ ID NO: 2669596 - RNA, 13 nt, Escherichia coli CFT073
cggcaugaugucc

SEQ ID NO: 2669597 - RNA, 20 nt, Escherichia coli CFT073
cggcaugauguccugcggac

SEQ ID NO: 2669598 - RNA, 23 nt, Escherichia coli CFT073
cggcaugauguccugcggacagu

SEQ ID NO: 2669599 - RNA, 20 nt, Escherichia coli CFT073
cggcaugguauaaggagcaa

SEQ ID NO: 2669600 - RNA, 14 nt, Escherichia coli CFT073
cggcauuaacgaaa

SEQ ID NO: 2669601 - RNA, 19 nt, Escherichia coli CFT073
cggcauuguucugcaaauu

SEQ ID NO: 2669602 - RNA, 22 nt, Escherichia coli CFT073
cggcauuguuuuuaucccggca

SEQ ID NO: 2669603 - RNA, 16 nt, Escherichia coli CFT073
cggcauuuccagaccu

SEQ ID NO: 2669604 - RNA, 19 nt, Escherichia coli CFT073
cggcauuuccagaccuaaa

SEQ ID NO: 2669605 - RNA, 20 nt, Escherichia coli CFT073
cggcauuucggcccaugaca

SEQ ID NO: 2669606 - RNA, 18 nt, Escherichia coli CFT073
cggcauuucuggcggcgu

SEQ ID NO: 2669607 - RNA, 21 nt, Escherichia coli CFT073
cggcauuuuccagcucuucua

SEQ ID NO: 2669608 - RNA, 12 nt, Escherichia coli CFT073
cggcuccagauu

SEQ ID NO: 2669609 - RNA, 11 nt, Escherichia coli CFT073
cggcuccagca

SEQ ID NO: 2669610 - RNA, 14 nt, Escherichia coli CFT073
cggcuccagcaaug

SEQ ID NO: 2669611 - RNA, 15 nt, Escherichia coli CFT073
cggcuccagcaaugu

SEQ ID NO: 2669612 - RNA, 23 nt, Escherichia coli CFT073
cggcuccaguuaacgccgcgccc

SEQ ID NO: 2669613 - RNA, 24 nt, Escherichia coli CFT073
cggcuccaguuaacgccgcgcccg

SEQ ID NO: 2669614 - RNA, 13 nt, Escherichia coli CFT073
cggcuccccgccc

SEQ ID NO: 2669615 - RNA, 16 nt, Escherichia coli CFT073
cggcuccccgcccuga

SEQ ID NO: 2669616 - RNA, 13 nt, Escherichia coli CFT073
cggcucccgcagc

SEQ ID NO: 2669617 - RNA, 23 nt, Escherichia coli CFT073
cggcucccgcagccacuccuuau

SEQ ID NO: 2669618 - RNA, 18 nt, Escherichia coli CFT073
cggcuccgccccaaugcg

SEQ ID NO: 2669619 - RNA, 17 nt, Escherichia coli CFT073
cggcucggcuccgggcg

SEQ ID NO: 2669620 - RNA, 23 nt, Escherichia coli CFT073
cggcucgucgagaauauacagcg

SEQ ID NO: 2669621 - RNA, 13 nt, Escherichia coli CFT073
cggcucuuuugcu

SEQ ID NO: 2669622 - RNA, 20 nt, Escherichia coli CFT073
cggcugaauacgcagcguca

SEQ ID NO: 2669623 - RNA, 23 nt, Escherichia coli CFT073
cggcugauaacaauaucaaaugc

SEQ ID NO: 2669624 - RNA, 23 nt, Escherichia coli CFT073
cggcugauaugccaggcuucauc

SEQ ID NO: 2669625 - RNA, 14 nt, Escherichia coli CFT073
cggcugccagccag

SEQ ID NO: 2669626 - RNA, 17 nt, Escherichia coli CFT073
cggcugcgcuucuucca

SEQ ID NO: 2669627 - RNA, 18 nt, Escherichia coli CFT073
cggcugcuucggucagca

SEQ ID NO: 2669628 - RNA, 18 nt, Escherichia coli CFT073
cggcuggccuuccggcac

SEQ ID NO: 2669629 - RNA, 23 nt, Escherichia coli CFT073
cggcuggcgcaauauucaagaua

SEQ ID NO: 2669630 - RNA, 14 nt, Escherichia coli CFT073
cggcugggaaauca

SEQ ID NO: 2669631 - RNA, 21 nt, Escherichia coli CFT073
cggcugggaaaucaccaccag

SEQ ID NO: 2669632 - RNA, 22 nt, Escherichia coli CFT073
cggcugggaaaucaccaccagc

SEQ ID NO: 2669633 - RNA, 16 nt, Escherichia coli CFT073
cggcuggguagcuucc

SEQ ID NO: 2669634 - RNA, 23 nt, Escherichia coli CFT073
cggcuguagagcuaccggcagga

SEQ ID NO: 2669635 - RNA, 20 nt, Escherichia coli CFT073
cggcuguuacgcacuucuuc

SEQ ID NO: 2669636 - RNA, 19 nt, Escherichia coli CFT073
cggcuguugaccccacagc

SEQ ID NO: 2669637 - RNA, 14 nt, Escherichia coli CFT073
cggcuguugccgua

SEQ ID NO: 2669638 - RNA, 19 nt, Escherichia coli CFT073
cggcuuaaugcacggcaga

SEQ ID NO: 2669639 - RNA, 17 nt, Escherichia coli CFT073
cggcuuaauugcccaaa

SEQ ID NO: 2669640 - RNA, 15 nt, Escherichia coli CFT073
cggcuuaucggucag

SEQ ID NO: 2669641 - RNA, 13 nt, Escherichia coli CFT073
cggcuucacgccc

SEQ ID NO: 2669642 - RNA, 15 nt, Escherichia coli CFT073
cggcuucaucuuuau

SEQ ID NO: 2669643 - RNA, 17 nt, Escherichia coli CFT073
cggcuucgucgccagcu

SEQ ID NO: 2669644 - RNA, 23 nt, Escherichia coli CFT073
cggcuucuaccuuauccagcaga

SEQ ID NO: 2669645 - RNA, 19 nt, Escherichia coli CFT073
cggcuucugacauagccac

SEQ ID NO: 2669646 - RNA, 20 nt, Escherichia coli CFT073
cggcuucugccaguacugca

SEQ ID NO: 2669647 - RNA, 22 nt, Escherichia coli CFT073
cggcuucugccaguacugcagg

SEQ ID NO: 2669648 - RNA, 14 nt, Escherichia coli CFT073
cggcuucuggccuc

SEQ ID NO: 2669649 - RNA, 20 nt, Escherichia coli CFT073
cggcuugaggaagcgcgccg

SEQ ID NO: 2669650 - RNA, 17 nt, Escherichia coli CFT073
cggcuugcaccagcagc

SEQ ID NO: 2669651 - RNA, 22 nt, Escherichia coli CFT073
cggcuugcgcgcaaucagcacc

SEQ ID NO: 2669652 - RNA, 16 nt, Escherichia coli CFT073
cggcuuggacgcacau

SEQ ID NO: 2669653 - RNA, 18 nt, Escherichia coli CFT073
cggcuuguacgccgccgc

SEQ ID NO: 2669654 - RNA, 13 nt, Escherichia coli CFT073
cggcuuucaacac

SEQ ID NO: 2669655 - RNA, 17 nt, Escherichia coli CFT073
cggcuuugcagguucug

SEQ ID NO: 2669656 - RNA, 21 nt, Escherichia coli CFT073
cggcuuuugguccgcaauaca

SEQ ID NO: 2669657 - RNA, 22 nt, Escherichia coli CFT073
cggcuuuuugagauuuaccgga

SEQ ID NO: 2669658 - RNA, 22 nt, Escherichia coli CFT073
cggcuuuuuuauugcugcacca

SEQ ID NO: 2669659 - RNA, 16 nt, Escherichia coli CFT073
cggcuuuuuucauuuc

SEQ ID NO: 2669660 - RNA, 14 nt, Escherichia coli CFT073
cgggaaaccaacuc

SEQ ID NO: 2669661 - RNA, 15 nt, Escherichia coli CFT073
cgggaaaccaacucc

SEQ ID NO: 2669662 - RNA, 18 nt, Escherichia coli CFT073
cgggaaacgagccauaaa

SEQ ID NO: 2669663 - RNA, 22 nt, Escherichia coli CFT073
cgggaaacgagccauaaaauca

SEQ ID NO: 2669664 - RNA, 16 nt, Escherichia coli CFT073
cgggaaacuuccagcu

SEQ ID NO: 2669665 - RNA, 22 nt, Escherichia coli CFT073
cgggaaagcaguuuauaaaauu

SEQ ID NO: 2669666 - RNA, 19 nt, Escherichia coli CFT073
cgggaacggcaucgcacca

SEQ ID NO: 2669667 - RNA, 16 nt, Escherichia coli CFT073
cgggaagauaucgugc

SEQ ID NO: 2669668 - RNA, 16 nt, Escherichia coli CFT073
cgggaagucacugcgc

SEQ ID NO: 2669669 - RNA, 14 nt, Escherichia coli CFT073
cgggaagugcgccc

SEQ ID NO: 2669670 - RNA, 14 nt, Escherichia coli CFT073
cgggaauagcucag

SEQ ID NO: 2669671 - RNA, 19 nt, Escherichia coli CFT073
cgggaauagcucaguuggu

SEQ ID NO: 2669672 - RNA, 13 nt, Escherichia coli CFT073
cgggaccagcacg

SEQ ID NO: 2669673 - RNA, 15 nt, Escherichia coli CFT073
cgggagagccccagc

SEQ ID NO: 2669674 - RNA, 18 nt, Escherichia coli CFT073
cgggagauuuucuccugc

SEQ ID NO: 2669675 - RNA, 14 nt, Escherichia coli CFT073
cgggagcaauuugu

SEQ ID NO: 2669676 - RNA, 17 nt, Escherichia coli CFT073
cgggaguucgaugguga

SEQ ID NO: 2669677 - RNA, 18 nt, Escherichia coli CFT073
cgggaguugaucgccaga

SEQ ID NO: 2669678 - RNA, 19 nt, Escherichia coli CFT073
cgggaguugaucgccagag

SEQ ID NO: 2669679 - RNA, 14 nt, Escherichia coli CFT073
cgggauaaacgaaa

SEQ ID NO: 2669680 - RNA, 21 nt, Escherichia coli CFT073
cgggauaccccgcauccugaa

SEQ ID NO: 2669681 - RNA, 20 nt, Escherichia coli CFT073
cgggauauaugucaccagca

SEQ ID NO: 2669682 - RNA, 21 nt, Escherichia coli CFT073
cgggauauaugucaccagcau

SEQ ID NO: 2669683 - RNA, 22 nt, Escherichia coli CFT073
cgggauauaugucaccagcauu

SEQ ID NO: 2669684 - RNA, 17 nt, Escherichia coli CFT073
cgggauauucagcucaa

SEQ ID NO: 2669685 - RNA, 15 nt, Escherichia coli CFT073
cgggaucacaucaua

SEQ ID NO: 2669686 - RNA, 18 nt, Escherichia coli CFT073
cgggaucaccagaccaau

SEQ ID NO: 2669687 - RNA, 17 nt, Escherichia coli CFT073
cgggaucuccacaagca

SEQ ID NO: 2669688 - RNA, 19 nt, Escherichia coli CFT073
cgggaugaccgacagagga

SEQ ID NO: 2669689 - RNA, 16 nt, Escherichia coli CFT073
cgggaugguguucacu

SEQ ID NO: 2669690 - RNA, 18 nt, Escherichia coli CFT073
cgggauucgaaccuguga

SEQ ID NO: 2669691 - RNA, 21 nt, Escherichia coli CFT073
cgggauuucaaugcgcaagcu

SEQ ID NO: 2669692 - RNA, 14 nt, Escherichia coli CFT073
cgggauuugguucu

SEQ ID NO: 2669693 - RNA, 17 nt, Escherichia coli CFT073
cgggauuuuacuuccca

SEQ ID NO: 2669694 - RNA, 19 nt, Escherichia coli CFT073
cgggauuuuacuucccagu

SEQ ID NO: 2669695 - RNA, 14 nt, Escherichia coli CFT073
cgggcaaccacagu

SEQ ID NO: 2669696 - RNA, 17 nt, Escherichia coli CFT073
cgggcaaccucuggugu

SEQ ID NO: 2669697 - RNA, 13 nt, Escherichia coli CFT073
cgggcaacugcug

SEQ ID NO: 2669698 - RNA, 14 nt, Escherichia coli CFT073
cgggcaacugcugc

SEQ ID NO: 2669699 - RNA, 14 nt, Escherichia coli CFT073
cgggcaaucagcgu

SEQ ID NO: 2669700 - RNA, 17 nt, Escherichia coli CFT073
cgggcaaucaucaccgg

SEQ ID NO: 2669701 - RNA, 15 nt, Escherichia coli CFT073
cgggcagacaaaaca

SEQ ID NO: 2669702 - RNA, 16 nt, Escherichia coli CFT073
cgggcaggcuucaaca

SEQ ID NO: 2669703 - RNA, 20 nt, Escherichia coli CFT073
cgggcaggcuucaacacagg

SEQ ID NO: 2669704 - RNA, 15 nt, Escherichia coli CFT073
cgggcauauuuccga

SEQ ID NO: 2669705 - RNA, 17 nt, Escherichia coli CFT073
cgggcauuuccauuuuu

SEQ ID NO: 2669706 - RNA, 21 nt, Escherichia coli CFT073
cgggccaaaaaucuccuccug

SEQ ID NO: 2669707 - RNA, 17 nt, Escherichia coli CFT073
cgggccguaacugugcc

SEQ ID NO: 2669708 - RNA, 13 nt, Escherichia coli CFT073
cgggccucgcagc

SEQ ID NO: 2669709 - RNA, 16 nt, Escherichia coli CFT073
cgggccugaacaagca

SEQ ID NO: 2669710 - RNA, 21 nt, Escherichia coli CFT073
cgggcgaacucuuccggcagg

SEQ ID NO: 2669711 - RNA, 14 nt, Escherichia coli CFT073
cgggcgcaaaaaca

SEQ ID NO: 2669712 - RNA, 15 nt, Escherichia coli CFT073
cgggcgcuauccugg

SEQ ID NO: 2669713 - RNA, 18 nt, Escherichia coli CFT073
cgggcggaaaacuuucuu

SEQ ID NO: 2669714 - RNA, 22 nt, Escherichia coli CFT073
cgggcggcguauuuaaugacag

SEQ ID NO: 2669715 - RNA, 15 nt, Escherichia coli CFT073
cgggcguaacucagg

SEQ ID NO: 2669716 - RNA, 14 nt, Escherichia coli CFT073
cgguauuaucacua

SEQ ID NO: 2669717 - RNA, 13 nt, Escherichia coli CFT073
cgguauugcucca

SEQ ID NO: 2669718 - RNA, 20 nt, Escherichia coli CFT073
cggucaaguaaucaaucacc

SEQ ID NO: 2669719 - RNA, 22 nt, Escherichia coli CFT073
cggucagaaaauuauuuuaaau

SEQ ID NO: 2669720 - RNA, 15 nt, Escherichia coli CFT073
cggucagcagcacca

SEQ ID NO: 2669721 - RNA, 20 nt, Escherichia coli CFT073
cggucagccaucgccaccgc

SEQ ID NO: 2669722 - RNA, 14 nt, Escherichia coli CFT073
cggucagcgcaauc

SEQ ID NO: 2669723 - RNA, 14 nt, Escherichia coli CFT073
cggucauaaaauca

SEQ ID NO: 2669724 - RNA, 22 nt, Escherichia coli CFT073
cggucaucccuaacagcguggu

SEQ ID NO: 2669725 - RNA, 13 nt, Escherichia coli CFT073
cggucauggucac

SEQ ID NO: 2669726 - RNA, 13 nt, Escherichia coli CFT073
cgguccacuuccu

SEQ ID NO: 2669727 - RNA, 16 nt, Escherichia coli CFT073
cgguccacuuccugcg

SEQ ID NO: 2669728 - RNA, 19 nt, Escherichia coli CFT073
cgguccacuuccugcgcca

SEQ ID NO: 2669729 - RNA, 19 nt, Escherichia coli CFT073
cgguccgccauuuccagcg

SEQ ID NO: 2669730 - RNA, 18 nt, Escherichia coli CFT073
cgguccuggcgaucgggc

SEQ ID NO: 2669731 - RNA, 13 nt, Escherichia coli CFT073
cgguccuucaucu

SEQ ID NO: 2669732 - RNA, 22 nt, Escherichia coli CFT073
cggucgaggcaaccagcacgcc

SEQ ID NO: 2669733 - RNA, 13 nt, Escherichia coli CFT073
cggucgaugcgga

SEQ ID NO: 2669734 - RNA, 16 nt, Escherichia coli CFT073
cggucgcugccgccau

SEQ ID NO: 2669735 - RNA, 17 nt, Escherichia coli CFT073
cggucggggccagcgca

SEQ ID NO: 2669736 - RNA, 14 nt, Escherichia coli CFT073
cggucggugcaccu

SEQ ID NO: 2669737 - RNA, 18 nt, Escherichia coli CFT073
cggucgugacugccgcca

SEQ ID NO: 2669738 - RNA, 20 nt, Escherichia coli CFT073
cggucgugacugccgccagc

SEQ ID NO: 2669739 - RNA, 21 nt, Escherichia coli CFT073
cggucgugacugccgccagca

SEQ ID NO: 2669740 - RNA, 23 nt, Escherichia coli CFT073
cggucgugacugccgccagcauu

SEQ ID NO: 2669741 - RNA, 22 nt, Escherichia coli CFT073
cggucguugucuggcuggugga

SEQ ID NO: 2669742 - RNA, 16 nt, Escherichia coli CFT073
cggucugccaacuuug

SEQ ID NO: 2669743 - RNA, 17 nt, Escherichia coli CFT073
cggucuguauuuggcug

SEQ ID NO: 2669744 - RNA, 19 nt, Escherichia coli CFT073
cggucuguauuuggcugcc

SEQ ID NO: 2669745 - RNA, 19 nt, Escherichia coli CFT073
cggucuuguuaccggcauu

SEQ ID NO: 2669746 - RNA, 23 nt, Escherichia coli CFT073
cggugaauuucacuuucugacca

SEQ ID NO: 2669747 - RNA, 21 nt, Escherichia coli CFT073
cggugacaucaauacgguuga

SEQ ID NO: 2669748 - RNA, 14 nt, Escherichia coli CFT073
cggugaccaucagc

SEQ ID NO: 2669749 - RNA, 16 nt, Escherichia coli CFT073
cggugaccgagcgccc

SEQ ID NO: 2669750 - RNA, 14 nt, Escherichia coli CFT073
cggugacuggcuua

SEQ ID NO: 2669751 - RNA, 20 nt, Escherichia coli CFT073
cggugacuggcuuaauaauu

SEQ ID NO: 2669752 - RNA, 13 nt, Escherichia coli CFT073
cggugagacgcca

SEQ ID NO: 2669753 - RNA, 19 nt, Escherichia coli CFT073
cggugagacgccagaaccg

SEQ ID NO: 2669754 - RNA, 15 nt, Escherichia coli CFT073
cggugagccaggacg

SEQ ID NO: 2669755 - RNA, 12 nt, Escherichia coli CFT073
cggugauaaacc

SEQ ID NO: 2669756 - RNA, 18 nt, Escherichia coli CFT073
cggugauaaucaucccac

SEQ ID NO: 2669757 - RNA, 16 nt, Escherichia coli CFT073
cggugaucagcgucag

SEQ ID NO: 2669758 - RNA, 20 nt, Escherichia coli CFT073
cggugaugguuggcccgaua

SEQ ID NO: 2669759 - RNA, 18 nt, Escherichia coli CFT073
cggugauuuccgccgcca

SEQ ID NO: 2669760 - RNA, 18 nt, Escherichia coli CFT073
cggugauuuuacccggug

SEQ ID NO: 2669761 - RNA, 20 nt, Escherichia coli CFT073
cggugcaucuucacacugau

SEQ ID NO: 2669762 - RNA, 22 nt, Escherichia coli CFT073
cggugcauuuucuaugcugcca

SEQ ID NO: 2669763 - RNA, 18 nt, Escherichia coli CFT073
cggugccaaagucaucaa

SEQ ID NO: 2669764 - RNA, 13 nt, Escherichia coli CFT073
cggugccagcaac

SEQ ID NO: 2669765 - RNA, 12 nt, Escherichia coli CFT073
cggugccaucac

SEQ ID NO: 2669766 - RNA, 17 nt, Escherichia coli CFT073
cggugccaucauacagc

SEQ ID NO: 2669767 - RNA, 14 nt, Escherichia coli CFT073
cggugccaucucca

SEQ ID NO: 2669768 - RNA, 16 nt, Escherichia coli CFT073
cggugccaucuccagu

SEQ ID NO: 2669769 - RNA, 22 nt, Escherichia coli CFT073
cggugccauuaaaccaacaaaa

SEQ ID NO: 2669770 - RNA, 22 nt, Escherichia coli CFT073
cggugccgccgucagacgcgcg

SEQ ID NO: 2669771 - RNA, 13 nt, Escherichia coli CFT073
cggugcgagcgcc

SEQ ID NO: 2669772 - RNA, 16 nt, Escherichia coli CFT073
cggugcgccaaacugc

SEQ ID NO: 2669773 - RNA, 14 nt, Escherichia coli CFT073
cggugcgcccgcca

SEQ ID NO: 2669774 - RNA, 23 nt, Escherichia coli CFT073
cggugcggcucucuuucuccagc

SEQ ID NO: 2669775 - RNA, 17 nt, Escherichia coli CFT073
cggugcgguaaucgccc

SEQ ID NO: 2669776 - RNA, 20 nt, Escherichia coli CFT073
cggugcuggcggccugaugc

SEQ ID NO: 2669777 - RNA, 15 nt, Escherichia coli CFT073
cgguggauuuuucgc

SEQ ID NO: 2669778 - RNA, 18 nt, Escherichia coli CFT073
cgguggauuuuucgcgac

SEQ ID NO: 2669779 - RNA, 17 nt, Escherichia coli CFT073
cgguggcaguagcgccu

SEQ ID NO: 2669780 - RNA, 13 nt, Escherichia coli CFT073
cgguggccacagc

SEQ ID NO: 2669781 - RNA, 14 nt, Escherichia coli CFT073
cgguggccacagca

SEQ ID NO: 2669782 - RNA, 13 nt, Escherichia coli CFT073
cgguggcggcagu

SEQ ID NO: 2669783 - RNA, 18 nt, Escherichia coli CFT073
cgguggcguacagcuggc

SEQ ID NO: 2669784 - RNA, 18 nt, Escherichia coli CFT073
cgguggcguuuccagcag

SEQ ID NO: 2669785 - RNA, 23 nt, Escherichia coli CFT073
cggugguaucgaucacuuuuucu

SEQ ID NO: 2669786 - RNA, 15 nt, Escherichia coli CFT073
cgguggucauaauau

SEQ ID NO: 2669787 - RNA, 19 nt, Escherichia coli CFT073
cggugguguaaccuucacc

SEQ ID NO: 2669788 - RNA, 15 nt, Escherichia coli CFT073
cggugguguuaucac

SEQ ID NO: 2669789 - RNA, 16 nt, Escherichia coli CFT073
cggugguuaccaguaa

SEQ ID NO: 2669790 - RNA, 16 nt, Escherichia coli CFT073
cggugguuucucccca

SEQ ID NO: 2669791 - RNA, 21 nt, Escherichia coli CFT073
cgguguaaccaccgcaggcag

SEQ ID NO: 2669792 - RNA, 15 nt, Escherichia coli CFT073
cgguguaacccgccu

SEQ ID NO: 2669793 - RNA, 21 nt, Escherichia coli CFT073
cgguguaaccgcaacggcgac

SEQ ID NO: 2669794 - RNA, 14 nt, Escherichia coli CFT073
cgguguacgcugca

SEQ ID NO: 2669795 - RNA, 16 nt, Escherichia coli CFT073
cgguguaggccugaua

SEQ ID NO: 2669796 - RNA, 15 nt, Escherichia coli CFT073
cgguguccacuuccg

SEQ ID NO: 2669797 - RNA, 23 nt, Escherichia coli CFT073
cggugucgauacgacaacggcag

SEQ ID NO: 2669798 - RNA, 21 nt, Escherichia coli CFT073
cgguguucccgcgccagcgug

SEQ ID NO: 2669799 - RNA, 21 nt, Escherichia coli CFT073
cgguguuguugaguccgguag

SEQ ID NO: 2669800 - RNA, 13 nt, Escherichia coli CFT073
cgguguuuccauc

SEQ ID NO: 2669801 - RNA, 13 nt, Escherichia coli CFT073
cgguguuuuccac

SEQ ID NO: 2669802 - RNA, 23 nt, Escherichia coli CFT073
cgguuaaaacaauuaacccgcga

SEQ ID NO: 2669803 - RNA, 12 nt, Escherichia coli CFT073
cgguuaacaaua

SEQ ID NO: 2669804 - RNA, 17 nt, Escherichia coli CFT073
cgguuaacaguuuguuu

SEQ ID NO: 2669805 - RNA, 23 nt, Escherichia coli CFT073
cgguuaacgccagccacaaacca

SEQ ID NO: 2669806 - RNA, 14 nt, Escherichia coli CFT073
cgguuaauaagaga

SEQ ID NO: 2669807 - RNA, 15 nt, Escherichia coli CFT073
cgguuaaucagauaa

SEQ ID NO: 2669808 - RNA, 14 nt, Escherichia coli CFT073
cgguuaauuccagc

SEQ ID NO: 2669809 - RNA, 17 nt, Escherichia coli CFT073
cgguuacggauuucccg

SEQ ID NO: 2669810 - RNA, 22 nt, Escherichia coli CFT073
cgguuagaaaauuauuuuaaau

SEQ ID NO: 2669811 - RNA, 15 nt, Escherichia coli CFT073
cgguuagcggcuuca

SEQ ID NO: 2669812 - RNA, 18 nt, Escherichia coli CFT073
cgguuagcggcuucaaag

SEQ ID NO: 2669813 - RNA, 17 nt, Escherichia coli CFT073
cgguuagcucaacgcau

SEQ ID NO: 2669814 - RNA, 12 nt, Escherichia coli CFT073
cgguuauccugc

SEQ ID NO: 2669815 - RNA, 18 nt, Escherichia coli CFT073
cgguuauccugcaaauaa

SEQ ID NO: 2669816 - RNA, 16 nt, Escherichia coli CFT073
cgguucaauaucuucc

SEQ ID NO: 2669817 - RNA, 14 nt, Escherichia coli CFT073
cgguuccagcuuca

SEQ ID NO: 2669818 - RNA, 11 nt, Escherichia coli CFT073
cgguucccaga

SEQ ID NO: 2669819 - RNA, 21 nt, Escherichia coli CFT073
cgguucgagaaaaccgaugcc

SEQ ID NO: 2669820 - RNA, 23 nt, Escherichia coli CFT073
cgguucggacauguuuuccagca

SEQ ID NO: 2669821 - RNA, 14 nt, Escherichia coli CFT073
cgguucuccuggca

SEQ ID NO: 2669822 - RNA, 16 nt, Escherichia coli CFT073
cgguugaacgccaaau

SEQ ID NO: 2669823 - RNA, 20 nt, Escherichia coli CFT073
cgguugacgccccuggcgau

SEQ ID NO: 2669824 - RNA, 19 nt, Escherichia coli CFT073
cgguugagagaagaaacga

SEQ ID NO: 2669825 - RNA, 23 nt, Escherichia coli CFT073
cgucagaccggcaaccagcaccg

SEQ ID NO: 2669826 - RNA, 12 nt, Escherichia coli CFT073
cgucagacgcgc

SEQ ID NO: 2669827 - RNA, 16 nt, Escherichia coli CFT073
cgucagaguggcguau

SEQ ID NO: 2669828 - RNA, 14 nt, Escherichia coli CFT073
cgucagauccgcca

SEQ ID NO: 2669829 - RNA, 20 nt, Escherichia coli CFT073
cgucagauuauucaaaaaca

SEQ ID NO: 2669830 - RNA, 19 nt, Escherichia coli CFT073
cgucagauucggauccagc

SEQ ID NO: 2669831 - RNA, 17 nt, Escherichia coli CFT073
cgucagcaaaauacuga

SEQ ID NO: 2669832 - RNA, 17 nt, Escherichia coli CFT073
cgucagcacucacgcca

SEQ ID NO: 2669833 - RNA, 22 nt, Escherichia coli CFT073
cgucagcaucgcgcgggcauug

SEQ ID NO: 2669834 - RNA, 13 nt, Escherichia coli CFT073
cgucagcaucucu

SEQ ID NO: 2669835 - RNA, 20 nt, Escherichia coli CFT073
cgucagcgaacggucgccgc

SEQ ID NO: 2669836 - RNA, 21 nt, Escherichia coli CFT073
cgucagcgccaccgcgauccc

SEQ ID NO: 2669837 - RNA, 14 nt, Escherichia coli CFT073
cgucagcggcagcu

SEQ ID NO: 2669838 - RNA, 23 nt, Escherichia coli CFT073
cgucagcugccaguugucgguaa

SEQ ID NO: 2669839 - RNA, 23 nt, Escherichia coli CFT073
cgucaggauuaaacuggcacgcu

SEQ ID NO: 2669840 - RNA, 14 nt, Escherichia coli CFT073
cgucagggccugcg

SEQ ID NO: 2669841 - RNA, 21 nt, Escherichia coli CFT073
cgucaguaaugaucugaucaa

SEQ ID NO: 2669842 - RNA, 15 nt, Escherichia coli CFT073
cgucaguacaaacau

SEQ ID NO: 2669843 - RNA, 18 nt, Escherichia coli CFT073
cgucaguagcgcaauaac

SEQ ID NO: 2669844 - RNA, 18 nt, Escherichia coli CFT073
cgucagugucuuaucugg

SEQ ID NO: 2669845 - RNA, 15 nt, Escherichia coli CFT073
cgucauacuccaguc

SEQ ID NO: 2669846 - RNA, 22 nt, Escherichia coli CFT073
cgucauauagccgcgcaguuuc

SEQ ID NO: 2669847 - RNA, 20 nt, Escherichia coli CFT073
cgucaucaauccugcagcag

SEQ ID NO: 2669848 - RNA, 19 nt, Escherichia coli CFT073
cgucaucaccuugcucgau

SEQ ID NO: 2669849 - RNA, 15 nt, Escherichia coli CFT073
cgucaucagcaauuu

SEQ ID NO: 2669850 - RNA, 22 nt, Escherichia coli CFT073
cgucaucauucaucgccuucuu

SEQ ID NO: 2669851 - RNA, 19 nt, Escherichia coli CFT073
cgucaucccgguuucccgg

SEQ ID NO: 2669852 - RNA, 14 nt, Escherichia coli CFT073
cgucaucggcagca

SEQ ID NO: 2669853 - RNA, 16 nt, Escherichia coli CFT073
cgucaucuuacugcaa

SEQ ID NO: 2669854 - RNA, 21 nt, Escherichia coli CFT073
cgucaugguauagagauagca

SEQ ID NO: 2669855 - RNA, 21 nt, Escherichia coli CFT073
cgucauuaugucuggcgagcu

SEQ ID NO: 2669856 - RNA, 22 nt, Escherichia coli CFT073
cgucauuggcggcagaugacuc

SEQ ID NO: 2669857 - RNA, 17 nt, Escherichia coli CFT073
cgucauuuccagacgcc

SEQ ID NO: 2669858 - RNA, 19 nt, Escherichia coli CFT073
cguccaaucagcacacaua

SEQ ID NO: 2669859 - RNA, 15 nt, Escherichia coli CFT073
cguccacaaaccguu

SEQ ID NO: 2669860 - RNA, 15 nt, Escherichia coli CFT073
cguccaccaccgccg

SEQ ID NO: 2669861 - RNA, 12 nt, Escherichia coli CFT073
cguccaccagaa

SEQ ID NO: 2669862 - RNA, 18 nt, Escherichia coli CFT073
cguccaccagaacgacga

SEQ ID NO: 2669863 - RNA, 15 nt, Escherichia coli CFT073
cguccaccagagcuu

SEQ ID NO: 2669864 - RNA, 20 nt, Escherichia coli CFT073
cguccagcgaaccuuccauc

SEQ ID NO: 2669865 - RNA, 16 nt, Escherichia coli CFT073
cguccagcgccugaau

SEQ ID NO: 2669866 - RNA, 19 nt, Escherichia coli CFT073
cguccagcugccugcggcg

SEQ ID NO: 2669867 - RNA, 19 nt, Escherichia coli CFT073
cguccaguaaugcaacacu

SEQ ID NO: 2669868 - RNA, 15 nt, Escherichia coli CFT073
cguccaguggcaucc

SEQ ID NO: 2669869 - RNA, 20 nt, Escherichia coli CFT073
cguccaucccacacuguuga

SEQ ID NO: 2669870 - RNA, 20 nt, Escherichia coli CFT073
cgucccaucggcaaucauuc

SEQ ID NO: 2669871 - RNA, 17 nt, Escherichia coli CFT073
cgucccaugaugcgcgg

SEQ ID NO: 2669872 - RNA, 15 nt, Escherichia coli CFT073
cgucccuacugcacu

SEQ ID NO: 2669873 - RNA, 18 nt, Escherichia coli CFT073
cgucccugguacagcaga

SEQ ID NO: 2669874 - RNA, 22 nt, Escherichia coli CFT073
cgucccugguacagcagacggc

SEQ ID NO: 2669875 - RNA, 18 nt, Escherichia coli CFT073
cguccgcauucuucugaa

SEQ ID NO: 2669876 - RNA, 19 nt, Escherichia coli CFT073
cguccgcucaauauauucu

SEQ ID NO: 2669877 - RNA, 17 nt, Escherichia coli CFT073
cguccggacuggcauug

SEQ ID NO: 2669878 - RNA, 20 nt, Escherichia coli CFT073
cguccggcaucgcaaaccag

SEQ ID NO: 2669879 - RNA, 21 nt, Escherichia coli CFT073
cguccggcaucgcaaaccaga

SEQ ID NO: 2669880 - RNA, 20 nt, Escherichia coli CFT073
cguccggcgucgcuucucaa

SEQ ID NO: 2669881 - RNA, 23 nt, Escherichia coli CFT073
cguccucacuuaaagcaacacca

SEQ ID NO: 2669882 - RNA, 14 nt, Escherichia coli CFT073
cgucgagagauucc

SEQ ID NO: 2669883 - RNA, 21 nt, Escherichia coli CFT073
cgucgagcagagaaacgccag

SEQ ID NO: 2669884 - RNA, 20 nt, Escherichia coli CFT073
cgucgaguuuauagccuguc

SEQ ID NO: 2669885 - RNA, 21 nt, Escherichia coli CFT073
cgucgauaauaucggccuggg

SEQ ID NO: 2669886 - RNA, 17 nt, Escherichia coli CFT073
cgucgauaucaaccagu

SEQ ID NO: 2669887 - RNA, 16 nt, Escherichia coli CFT073
cgucgaucucuuccac

SEQ ID NO: 2669888 - RNA, 21 nt, Escherichia coli CFT073
cgucgauucgccgaugcauau

SEQ ID NO: 2669889 - RNA, 19 nt, Escherichia coli CFT073
cgucgcaacuccaccagca

SEQ ID NO: 2669890 - RNA, 21 nt, Escherichia coli CFT073
cgucgcaagacgaaaaaugaa

SEQ ID NO: 2669891 - RNA, 20 nt, Escherichia coli CFT073
cgucgcaccgguaucugcca

SEQ ID NO: 2669892 - RNA, 14 nt, Escherichia coli CFT073
cgucgcagccagcg

SEQ ID NO: 2669893 - RNA, 23 nt, Escherichia coli CFT073
cgucgcagcuauccugccgguga

SEQ ID NO: 2669894 - RNA, 16 nt, Escherichia coli CFT073
cgucgcaucacagacc

SEQ ID NO: 2669895 - RNA, 20 nt, Escherichia coli CFT073
cgucgcauccggcaauuacg

SEQ ID NO: 2669896 - RNA, 17 nt, Escherichia coli CFT073
cgucgccaauggaauag

SEQ ID NO: 2669897 - RNA, 22 nt, Escherichia coli CFT073
cgucgccaauggaauagcgaag

SEQ ID NO: 2669898 - RNA, 19 nt, Escherichia coli CFT073
cgucgccacaaucagcgcg

SEQ ID NO: 2669899 - RNA, 18 nt, Escherichia coli CFT073
cgucgccaguaccagcag

SEQ ID NO: 2669900 - RNA, 17 nt, Escherichia coli CFT073
cgucgcccugggugaca

SEQ ID NO: 2669901 - RNA, 15 nt, Escherichia coli CFT073
cgucgccgccgccag

SEQ ID NO: 2669902 - RNA, 17 nt, Escherichia coli CFT073
cgucgccgguuugcagu

SEQ ID NO: 2669903 - RNA, 19 nt, Escherichia coli CFT073
cgucgccgguuugcaguau

SEQ ID NO: 2669904 - RNA, 16 nt, Escherichia coli CFT073
cgucgccuucauacca

SEQ ID NO: 2669905 - RNA, 19 nt, Escherichia coli CFT073
cgucgcguuuuucucuuuu

SEQ ID NO: 2669906 - RNA, 14 nt, Escherichia coli CFT073
cgucgcucacuuca

SEQ ID NO: 2669907 - RNA, 19 nt, Escherichia coli CFT073
cgucgcucacuucacgcug

SEQ ID NO: 2669908 - RNA, 22 nt, Escherichia coli CFT073
cgucgcucacuucacgcugcca

SEQ ID NO: 2669909 - RNA, 23 nt, Escherichia coli CFT073
cgucgcugauauugcuccagacg

SEQ ID NO: 2669910 - RNA, 17 nt, Escherichia coli CFT073
cgucgcugcucuucugu

SEQ ID NO: 2669911 - RNA, 14 nt, Escherichia coli CFT073
cgucgcuuuccagu

SEQ ID NO: 2669912 - RNA, 17 nt, Escherichia coli CFT073
cgucggcgucagcgcca

SEQ ID NO: 2669913 - RNA, 18 nt, Escherichia coli CFT073
cgucgggaagccggucau

SEQ ID NO: 2669914 - RNA, 20 nt, Escherichia coli CFT073
cgucgggauugcauccugcg

SEQ ID NO: 2669915 - RNA, 13 nt, Escherichia coli CFT073
cgucgggcgacgu

SEQ ID NO: 2669916 - RNA, 23 nt, Escherichia coli CFT073
cgucgguaaagaaaauaccgaac

SEQ ID NO: 2669917 - RNA, 14 nt, Escherichia coli CFT073
cgucggugcagcau

SEQ ID NO: 2669918 - RNA, 19 nt, Escherichia coli CFT073
cgucgguuauacacgcccg

SEQ ID NO: 2669919 - RNA, 21 nt, Escherichia coli CFT073
cgucgguucguaggccagaua

SEQ ID NO: 2669920 - RNA, 17 nt, Escherichia coli CFT073
cgucguaaucauaaaac

SEQ ID NO: 2669921 - RNA, 15 nt, Escherichia coli CFT073
cgucgucccuuccgc

SEQ ID NO: 2669922 - RNA, 19 nt, Escherichia coli CFT073
cgucgucuucaacguuccu

SEQ ID NO: 2669923 - RNA, 19 nt, Escherichia coli CFT073
cgucgucuuuauccuggcu

SEQ ID NO: 2669924 - RNA, 13 nt, Escherichia coli CFT073
cgucgugcgguga

SEQ ID NO: 2669925 - RNA, 23 nt, Escherichia coli CFT073
cgucguuucgugcucuggcaggc

SEQ ID NO: 2669926 - RNA, 16 nt, Escherichia coli CFT073
cgucuaaaucguacca

SEQ ID NO: 2669927 - RNA, 17 nt, Escherichia coli CFT073
cgucuacaggcgcgacc

SEQ ID NO: 2669928 - RNA, 15 nt, Escherichia coli CFT073
cgucuaucagcuucu

SEQ ID NO: 2669929 - RNA, 15 nt, Escherichia coli CFT073
cgucuaucagugcaa

SEQ ID NO: 2669930 - RNA, 13 nt, Escherichia coli CFT073
cgucuaugccggu

SEQ ID NO: 2669931 - RNA, 20 nt, Escherichia coli CFT073
cgucucaacaaacgauuuau

SEQ ID NO: 2669932 - RNA, 19 nt, Escherichia coli CFT073
cgugcggugagaacuguuc

SEQ ID NO: 2669933 - RNA, 12 nt, Escherichia coli CFT073
cgugcggugggc

SEQ ID NO: 2669934 - RNA, 19 nt, Escherichia coli CFT073
cgugcggugguuucucccc

SEQ ID NO: 2669935 - RNA, 16 nt, Escherichia coli CFT073
cgugcucgcuuuccau

SEQ ID NO: 2669936 - RNA, 22 nt, Escherichia coli CFT073
cgugcucucaaauaucugccgg

SEQ ID NO: 2669937 - RNA, 15 nt, Escherichia coli CFT073
cgugcuucacuucag

SEQ ID NO: 2669938 - RNA, 19 nt, Escherichia coli CFT073
cguggagcaacacgccagc

SEQ ID NO: 2669939 - RNA, 22 nt, Escherichia coli CFT073
cguggagcaacacgccagcguu

SEQ ID NO: 2669940 - RNA, 20 nt, Escherichia coli CFT073
cguggagugguucgguccgc

SEQ ID NO: 2669941 - RNA, 13 nt, Escherichia coli CFT073
cguggaugaaaca

SEQ ID NO: 2669942 - RNA, 16 nt, Escherichia coli CFT073
cguggcaauugccgca

SEQ ID NO: 2669943 - RNA, 14 nt, Escherichia coli CFT073
cguggcacgguaaa

SEQ ID NO: 2669944 - RNA, 20 nt, Escherichia coli CFT073
cguggccaugaccaccgcag

SEQ ID NO: 2669945 - RNA, 22 nt, Escherichia coli CFT073
cguggccaugaccaccgcagca

SEQ ID NO: 2669946 - RNA, 14 nt, Escherichia coli CFT073
cguggcccgccagc

SEQ ID NO: 2669947 - RNA, 21 nt, Escherichia coli CFT073
cguggcccgccagcaugccgc

SEQ ID NO: 2669948 - RNA, 14 nt, Escherichia coli CFT073
cguggccuccaaaa

SEQ ID NO: 2669949 - RNA, 20 nt, Escherichia coli CFT073
cguggcgauaaucagcgcca

SEQ ID NO: 2669950 - RNA, 18 nt, Escherichia coli CFT073
cguggcggagugccgcgu

SEQ ID NO: 2669951 - RNA, 19 nt, Escherichia coli CFT073
cguggcgucgcaucuggca

SEQ ID NO: 2669952 - RNA, 14 nt, Escherichia coli CFT073
cgugggcaggccag

SEQ ID NO: 2669953 - RNA, 20 nt, Escherichia coli CFT073
cguggguucaucgagcagca

SEQ ID NO: 2669954 - RNA, 18 nt, Escherichia coli CFT073
cgugguaucgccacugcg

SEQ ID NO: 2669955 - RNA, 14 nt, Escherichia coli CFT073
cguggucauggcau

SEQ ID NO: 2669956 - RNA, 16 nt, Escherichia coli CFT073
cguggucgugaucgug

SEQ ID NO: 2669957 - RNA, 16 nt, Escherichia coli CFT073
cguggugaaaucgccg

SEQ ID NO: 2669958 - RNA, 18 nt, Escherichia coli CFT073
cguggugauuucaggcuu

SEQ ID NO: 2669959 - RNA, 19 nt, Escherichia coli CFT073
cguggugcugauacgcgca

SEQ ID NO: 2669960 - RNA, 19 nt, Escherichia coli CFT073
cgugguggugaucgugcgc

SEQ ID NO: 2669961 - RNA, 12 nt, Escherichia coli CFT073
cgugguuacgcc

SEQ ID NO: 2669962 - RNA, 12 nt, Escherichia coli CFT073
cgugguuccggc

SEQ ID NO: 2669963 - RNA, 14 nt, Escherichia coli CFT073
cgugguugguuuca

SEQ ID NO: 2669964 - RNA, 19 nt, Escherichia coli CFT073
cgugguuugcgcauucaga

SEQ ID NO: 2669965 - RNA, 20 nt, Escherichia coli CFT073
cgugguuugcgcauucagaa

SEQ ID NO: 2669966 - RNA, 16 nt, Escherichia coli CFT073
cgugguuugcggcauu

SEQ ID NO: 2669967 - RNA, 14 nt, Escherichia coli CFT073
cgugguuuugguaa

SEQ ID NO: 2669968 - RNA, 19 nt, Escherichia coli CFT073
cguguacccagcagcgcca

SEQ ID NO: 2669969 - RNA, 17 nt, Escherichia coli CFT073
cguguauuuugcaucga

SEQ ID NO: 2669970 - RNA, 22 nt, Escherichia coli CFT073
cgugucgagcauugccagcauu

SEQ ID NO: 2669971 - RNA, 13 nt, Escherichia coli CFT073
cgugugauaaugu

SEQ ID NO: 2669972 - RNA, 20 nt, Escherichia coli CFT073
cgugugcgagugcauccagu

SEQ ID NO: 2669973 - RNA, 22 nt, Escherichia coli CFT073
cgugugcggcgaugaugacgcg

SEQ ID NO: 2669974 - RNA, 16 nt, Escherichia coli CFT073
cgugugguaaaaccuu

SEQ ID NO: 2669975 - RNA, 13 nt, Escherichia coli CFT073
cguguuauccggc

SEQ ID NO: 2669976 - RNA, 22 nt, Escherichia coli CFT073
cguguucaugaccgugaucgug

SEQ ID NO: 2669977 - RNA, 12 nt, Escherichia coli CFT073
cguguuccagcg

SEQ ID NO: 2669978 - RNA, 15 nt, Escherichia coli CFT073
cguguuccaguugca

SEQ ID NO: 2669979 - RNA, 15 nt, Escherichia coli CFT073
cguguucugaauaaa

SEQ ID NO: 2669980 - RNA, 17 nt, Escherichia coli CFT073
cguguugaggaagcgca

SEQ ID NO: 2669981 - RNA, 22 nt, Escherichia coli CFT073
cguguugcuccacgccagcguu

SEQ ID NO: 2669982 - RNA, 13 nt, Escherichia coli CFT073
cguguugcugcau

SEQ ID NO: 2669983 - RNA, 21 nt, Escherichia coli CFT073
cguguuucaucucaucaaugg

SEQ ID NO: 2669984 - RNA, 15 nt, Escherichia coli CFT073
cguuaaagcguccag

SEQ ID NO: 2669985 - RNA, 17 nt, Escherichia coli CFT073
cguuaaauccugccaac

SEQ ID NO: 2669986 - RNA, 16 nt, Escherichia coli CFT073
cguuaacagcgcauuc

SEQ ID NO: 2669987 - RNA, 15 nt, Escherichia coli CFT073
cguuaaccacuucag

SEQ ID NO: 2669988 - RNA, 13 nt, Escherichia coli CFT073
cguuaaccaugca

SEQ ID NO: 2669989 - RNA, 14 nt, Escherichia coli CFT073
cguuaacgcguccu

SEQ ID NO: 2669990 - RNA, 18 nt, Escherichia coli CFT073
cguuaacggcauuuucca

SEQ ID NO: 2669991 - RNA, 20 nt, Escherichia coli CFT073
cguuaacggcauuuuccagc

SEQ ID NO: 2669992 - RNA, 15 nt, Escherichia coli CFT073
cguuaacuggaacag

SEQ ID NO: 2669993 - RNA, 12 nt, Escherichia coli CFT073
cguuaagcccag

SEQ ID NO: 2669994 - RNA, 19 nt, Escherichia coli CFT073
cguuaagcgucgcaucagg

SEQ ID NO: 2669995 - RNA, 14 nt, Escherichia coli CFT073
cguuaaggccaaac

SEQ ID NO: 2669996 - RNA, 21 nt, Escherichia coli CFT073
cguuaaggccgcuuucagagc

SEQ ID NO: 2669997 - RNA, 19 nt, Escherichia coli CFT073
cguuaauacuacgcagacg

SEQ ID NO: 2669998 - RNA, 22 nt, Escherichia coli CFT073
cguuaauccgcucugcccacgg

SEQ ID NO: 2669999 - RNA, 14 nt, Escherichia coli CFT073
cguuaaucgccugc

SEQ ID NO: 2670000 - RNA, 15 nt, Escherichia coli CFT073
cguuaaucgccugcu

SEQ ID NO: 2670001 - RNA, 15 nt, Escherichia coli CFT073
cguuaauggcgauaa

SEQ ID NO: 2670002 - RNA, 22 nt, Escherichia coli CFT073
cguuaauuuccucuucccgcuc

SEQ ID NO: 2670003 - RNA, 13 nt, Escherichia coli CFT073
cguuaauuucuuu

SEQ ID NO: 2670004 - RNA, 16 nt, Escherichia coli CFT073
cguuaauuucuuuuca

SEQ ID NO: 2670005 - RNA, 15 nt, Escherichia coli CFT073
cguuacacagaguuu

SEQ ID NO: 2670006 - RNA, 15 nt, Escherichia coli CFT073
cguuacccagcacgg

SEQ ID NO: 2670007 - RNA, 19 nt, Escherichia coli CFT073
cguuacccuuguggauaac

SEQ ID NO: 2670008 - RNA, 13 nt, Escherichia coli CFT073
cguuaccuuugca

SEQ ID NO: 2670009 - RNA, 21 nt, Escherichia coli CFT073
cguuacgccccgguuucucuu

SEQ ID NO: 2670010 - RNA, 19 nt, Escherichia coli CFT073
cguuacggaccacgcacag

SEQ ID NO: 2670011 - RNA, 23 nt, Escherichia coli CFT073
cguuacggaucagaguacgcagu

SEQ ID NO: 2670012 - RNA, 16 nt, Escherichia coli CFT073
cguuacuuaacacccc

SEQ ID NO: 2670013 - RNA, 21 nt, Escherichia coli CFT073
cguuagaacccaacagaugag

SEQ ID NO: 2670014 - RNA, 19 nt, Escherichia coli CFT073
cguuauacaucgcuuucca

SEQ ID NO: 2670015 - RNA, 22 nt, Escherichia coli CFT073
cguuauacaucgcuuuccaggu

SEQ ID NO: 2670016 - RNA, 17 nt, Escherichia coli CFT073
cguuauacaucgucgca

SEQ ID NO: 2670017 - RNA, 13 nt, Escherichia coli CFT073
cguuaucagaacg

SEQ ID NO: 2670018 - RNA, 21 nt, Escherichia coli CFT073
cguuauccggccaacaaaaaa

SEQ ID NO: 2670019 - RNA, 14 nt, Escherichia coli CFT073
cguuaugcaaauga

SEQ ID NO: 2670020 - RNA, 16 nt, Escherichia coli CFT073
cguuaugcuuacugag

SEQ ID NO: 2670021 - RNA, 22 nt, Escherichia coli CFT073
cguuauucaauuacgcggcuuc

SEQ ID NO: 2670022 - RNA, 20 nt, Escherichia coli CFT073
cguuauugggguuacgaccu

SEQ ID NO: 2670023 - RNA, 22 nt, Escherichia coli CFT073
cguuauuuauucucacguugca

SEQ ID NO: 2670024 - RNA, 23 nt, Escherichia coli CFT073
cguuauuugcggauuaacgauua

SEQ ID NO: 2670025 - RNA, 23 nt, Escherichia coli CFT073
cguuauuuguugccggaugcggc

SEQ ID NO: 2670026 - RNA, 15 nt, Escherichia coli CFT073
cguucaaaacggcug

SEQ ID NO: 2670027 - RNA, 17 nt, Escherichia coli CFT073
cguucaacaagccacgc

SEQ ID NO: 2670028 - RNA, 23 nt, Escherichia coli CFT073
cguucaaccacuucggcaucuuu

SEQ ID NO: 2670029 - RNA, 19 nt, Escherichia coli CFT073
cguucacaaacagcgccug

SEQ ID NO: 2670030 - RNA, 19 nt, Escherichia coli CFT073
cguucacgcagcucacgca

SEQ ID NO: 2670031 - RNA, 16 nt, Escherichia coli CFT073
cguucacgccgcaucc

SEQ ID NO: 2670032 - RNA, 23 nt, Escherichia coli CFT073
cguucacgccgcauccggcaauc

SEQ ID NO: 2670033 - RNA, 20 nt, Escherichia coli CFT073
cguucacgccgcaucuggca

SEQ ID NO: 2670034 - RNA, 12 nt, Escherichia coli CFT073
cguucacugccg

SEQ ID NO: 2670035 - RNA, 20 nt, Escherichia coli CFT073
cguucagccgcuuuaucuga

SEQ ID NO: 2670036 - RNA, 13 nt, Escherichia coli CFT073
cguucaguuuacc

SEQ ID NO: 2670037 - RNA, 22 nt, Escherichia coli CFT073
cguucauaaauacagagcacgc

SEQ ID NO: 2670038 - RNA, 24 nt, Escherichia coli CFT073
cguucaucgggcaucgcaaccaca

SEQ ID NO: 2670039 - RNA, 23 nt, Escherichia coli CFT073
cguucauuaacgccccaaucaga

SEQ ID NO: 2670040 - RNA, 13 nt, Escherichia coli CFT073
cguuucgcuggau

SEQ ID NO: 2670041 - RNA, 14 nt, Escherichia coli CFT073
cguuucuccacugg

SEQ ID NO: 2670042 - RNA, 17 nt, Escherichia coli CFT073
cguuucucgacuuuuuc

SEQ ID NO: 2670043 - RNA, 12 nt, Escherichia coli CFT073
cguuucugccgu

SEQ ID NO: 2670044 - RNA, 19 nt, Escherichia coli CFT073
cguuucugcgcuucugcca

SEQ ID NO: 2670045 - RNA, 23 nt, Escherichia coli CFT073
cguuucuggcaauucgugaugcc

SEQ ID NO: 2670046 - RNA, 21 nt, Escherichia coli CFT073
cguuucuucacccuuuucgau

SEQ ID NO: 2670047 - RNA, 22 nt, Escherichia coli CFT073
cguuucuucgacacguuccuca

SEQ ID NO: 2670048 - RNA, 15 nt, Escherichia coli CFT073
cguuucuuucaucag

SEQ ID NO: 2670049 - RNA, 13 nt, Escherichia coli CFT073
cguuugaacugaa

SEQ ID NO: 2670050 - RNA, 22 nt, Escherichia coli CFT073
cguuugauuaacgccagauuac

SEQ ID NO: 2670051 - RNA, 23 nt, Escherichia coli CFT073
cguuugcauccaguucgugucgg

SEQ ID NO: 2670052 - RNA, 16 nt, Escherichia coli CFT073
cguuugcauccggcac

SEQ ID NO: 2670053 - RNA, 16 nt, Escherichia coli CFT073
cguuugccagccacac

SEQ ID NO: 2670054 - RNA, 19 nt, Escherichia coli CFT073
cguuugcugcuuaucgcga

SEQ ID NO: 2670055 - RNA, 16 nt, Escherichia coli CFT073
cguuuggccacaccau

SEQ ID NO: 2670056 - RNA, 13 nt, Escherichia coli CFT073
cguuuguagcaga

SEQ ID NO: 2670057 - RNA, 14 nt, Escherichia coli CFT073
cguuuguuagcaug

SEQ ID NO: 2670058 - RNA, 19 nt, Escherichia coli CFT073
cguuuuaaugauuuccagg

SEQ ID NO: 2670059 - RNA, 15 nt, Escherichia coli CFT073
cguuuuacagcaacg

SEQ ID NO: 2670060 - RNA, 19 nt, Escherichia coli CFT073
cguuuuaccugcuauagcc

SEQ ID NO: 2670061 - RNA, 19 nt, Escherichia coli CFT073
cguuuuacgcgucacaccu

SEQ ID NO: 2670062 - RNA, 17 nt, Escherichia coli CFT073
cguuuuaucaaacaggu

SEQ ID NO: 2670063 - RNA, 12 nt, Escherichia coli CFT073
cguuuucaacac

SEQ ID NO: 2670064 - RNA, 12 nt, Escherichia coli CFT073
cguuuucaaccg

SEQ ID NO: 2670065 - RNA, 14 nt, Escherichia coli CFT073
cguuuucacaguaa

SEQ ID NO: 2670066 - RNA, 21 nt, Escherichia coli CFT073
cguuuuccgcuaacucacgca

SEQ ID NO: 2670067 - RNA, 17 nt, Escherichia coli CFT073
cguuuucugaccaaacu

SEQ ID NO: 2670068 - RNA, 21 nt, Escherichia coli CFT073
cguuuucuucucuacgcaaag

SEQ ID NO: 2670069 - RNA, 20 nt, Escherichia coli CFT073
cguuuugacagcucacgcgc

SEQ ID NO: 2670070 - RNA, 19 nt, Escherichia coli CFT073
cguuuugacagguugccgg

SEQ ID NO: 2670071 - RNA, 20 nt, Escherichia coli CFT073
cguuuugaucuuacguuuaa

SEQ ID NO: 2670072 - RNA, 17 nt, Escherichia coli CFT073
cguuuugcccgguguca

SEQ ID NO: 2670073 - RNA, 23 nt, Escherichia coli CFT073
cguuuugcucucacgagguugca

SEQ ID NO: 2670074 - RNA, 12 nt, Escherichia coli CFT073
cguuuugcuggu

SEQ ID NO: 2670075 - RNA, 18 nt, Escherichia coli CFT073
cguuuugcuggugcaggc

SEQ ID NO: 2670076 - RNA, 18 nt, Escherichia coli CFT073
cguuuuguagcgugcggc

SEQ ID NO: 2670077 - RNA, 15 nt, Escherichia coli CFT073
cguuuugucgccggg

SEQ ID NO: 2670078 - RNA, 11 nt, Escherichia coli CFT073
cguuuuuacag

SEQ ID NO: 2670079 - RNA, 17 nt, Escherichia coli CFT073
cguuuuuacccagcagc

SEQ ID NO: 2670080 - RNA, 18 nt, Escherichia coli CFT073
cguuuuuaucgcccacgc

SEQ ID NO: 2670081 - RNA, 17 nt, Escherichia coli CFT073
cguuuuuaucgcugcgc

SEQ ID NO: 2670082 - RNA, 23 nt, Escherichia coli CFT073
cguuuuuauuauuaaaccaggaa

SEQ ID NO: 2670083 - RNA, 18 nt, Escherichia coli CFT073
cguuuuucaucuuccgga

SEQ ID NO: 2670084 - RNA, 19 nt, Escherichia coli CFT073
cguuuuucuuccggcagca

SEQ ID NO: 2670085 - RNA, 11 nt, Escherichia coli CFT073
cguuuuuucac

SEQ ID NO: 2670086 - RNA, 11 nt, Escherichia coli CFT073
cguuuuuucgc

SEQ ID NO: 2670087 - RNA, 22 nt, Escherichia coli CFT073
cguuuuuuuaucccuucuccac

SEQ ID NO: 2670088 - RNA, 16 nt, Escherichia coli CFT073
cguuuuuuucuucucg

SEQ ID NO: 2670089 - RNA, 13 nt, Escherichia coli CFT073
cuaaaaauaguuc

SEQ ID NO: 2670090 - RNA, 20 nt, Escherichia coli CFT073
cuaaaacuucauuugucuca

SEQ ID NO: 2670091 - RNA, 13 nt, Escherichia coli CFT073
cuaaaagcacgcc

SEQ ID NO: 2670092 - RNA, 16 nt, Escherichia coli CFT073
cuaaaagcacgccaga

SEQ ID NO: 2670093 - RNA, 18 nt, Escherichia coli CFT073
cuaaaagcauagccccag

SEQ ID NO: 2670094 - RNA, 24 nt, Escherichia coli CFT073
cuaaaagcauagccccagcgcaga

SEQ ID NO: 2670095 - RNA, 16 nt, Escherichia coli CFT073
cuaaaaguuauuaaaa

SEQ ID NO: 2670096 - RNA, 20 nt, Escherichia coli CFT073
cuaaaaguuauuaaaaaugg

SEQ ID NO: 2670097 - RNA, 14 nt, Escherichia coli CFT073
cuaaaaucaucacg

SEQ ID NO: 2670098 - RNA, 15 nt, Escherichia coli CFT073
cuaaaaucaucacgc

SEQ ID NO: 2670099 - RNA, 13 nt, Escherichia coli CFT073
cuaaaauccacau

SEQ ID NO: 2670100 - RNA, 19 nt, Escherichia coli CFT073
cuaaaaugucaccuaauuu

SEQ ID NO: 2670101 - RNA, 23 nt, Escherichia coli CFT073
cuaaaauuggggucaucgcccug

SEQ ID NO: 2670102 - RNA, 13 nt, Escherichia coli CFT073
cuaaaauuucuuu

SEQ ID NO: 2670103 - RNA, 17 nt, Escherichia coli CFT073
cuaaacagagcugcaaa

SEQ ID NO: 2670104 - RNA, 15 nt, Escherichia coli CFT073
cuaaaccaucagcag

SEQ ID NO: 2670105 - RNA, 23 nt, Escherichia coli CFT073
cuaaaccaucagcaguacguuuu

SEQ ID NO: 2670106 - RNA, 14 nt, Escherichia coli CFT073
cuaaaccccaacca

SEQ ID NO: 2670107 - RNA, 17 nt, Escherichia coli CFT073
cuaaacccgaccacuuc

SEQ ID NO: 2670108 - RNA, 19 nt, Escherichia coli CFT073
cuaaaccgcugccugcgcc

SEQ ID NO: 2670109 - RNA, 19 nt, Escherichia coli CFT073
cuaaacgcgccgcuuuuuc

SEQ ID NO: 2670110 - RNA, 17 nt, Escherichia coli CFT073
cuaaacugaucuuuauc

SEQ ID NO: 2670111 - RNA, 19 nt, Escherichia coli CFT073
cuaaacugaucuuuaucaa

SEQ ID NO: 2670112 - RNA, 16 nt, Escherichia coli CFT073
cuaaaggcaaaaugcc

SEQ ID NO: 2670113 - RNA, 17 nt, Escherichia coli CFT073
cuaaaggcaaaaugcca

SEQ ID NO: 2670114 - RNA, 13 nt, Escherichia coli CFT073
cuaaaggcuguca

SEQ ID NO: 2670115 - RNA, 18 nt, Escherichia coli CFT073
cuaaaguacguaaaacaa

SEQ ID NO: 2670116 - RNA, 12 nt, Escherichia coli CFT073
cuaaauaaccuu

SEQ ID NO: 2670117 - RNA, 14 nt, Escherichia coli CFT073
cuaaauaccagcgu

SEQ ID NO: 2670118 - RNA, 12 nt, Escherichia coli CFT073
cuaaaucagguu

SEQ ID NO: 2670119 - RNA, 14 nt, Escherichia coli CFT073
cuaaaugcucgccg

SEQ ID NO: 2670120 - RNA, 14 nt, Escherichia coli CFT073
cuaaauuuuuccac

SEQ ID NO: 2670121 - RNA, 19 nt, Escherichia coli CFT073
cuaacaaucucaaccgcuu

SEQ ID NO: 2670122 - RNA, 18 nt, Escherichia coli CFT073
cuaacacagcaauaauaa

SEQ ID NO: 2670123 - RNA, 19 nt, Escherichia coli CFT073
cuaacacaugcaagucgaa

SEQ ID NO: 2670124 - RNA, 14 nt, Escherichia coli CFT073
cuaacaccacauug

SEQ ID NO: 2670125 - RNA, 14 nt, Escherichia coli CFT073
cuaacagaucaucc

SEQ ID NO: 2670126 - RNA, 12 nt, Escherichia coli CFT073
cuaacaucaucc

SEQ ID NO: 2670127 - RNA, 23 nt, Escherichia coli CFT073
cuaacaucauccccguaucuuca

SEQ ID NO: 2670128 - RNA, 17 nt, Escherichia coli CFT073
cuaacauccgaauugcu

SEQ ID NO: 2670129 - RNA, 21 nt, Escherichia coli CFT073
cuaacaugcccauuccccagc

SEQ ID NO: 2670130 - RNA, 17 nt, Escherichia coli CFT073
cuaacaugguuaaaauc

SEQ ID NO: 2670131 - RNA, 18 nt, Escherichia coli CFT073
cuaacaugguuaaaaucu

SEQ ID NO: 2670132 - RNA, 15 nt, Escherichia coli CFT073
cuaacauuuuaguuu

SEQ ID NO: 2670133 - RNA, 11 nt, Escherichia coli CFT073
cuaaccaaacu

SEQ ID NO: 2670134 - RNA, 14 nt, Escherichia coli CFT073
cuaaccauccacau

SEQ ID NO: 2670135 - RNA, 14 nt, Escherichia coli CFT073
cuaacccaacauuc

SEQ ID NO: 2670136 - RNA, 15 nt, Escherichia coli CFT073
cuaacccucucccca

SEQ ID NO: 2670137 - RNA, 13 nt, Escherichia coli CFT073
cuaacccuuccag

SEQ ID NO: 2670138 - RNA, 17 nt, Escherichia coli CFT073
cuaaccgcuuuuccggc

SEQ ID NO: 2670139 - RNA, 19 nt, Escherichia coli CFT073
cuaaccuuauggugucuau

SEQ ID NO: 2670140 - RNA, 16 nt, Escherichia coli CFT073
cuaacgagcaguuugg

SEQ ID NO: 2670141 - RNA, 22 nt, Escherichia coli CFT073
cuaacgccagcgcgaccgccau

SEQ ID NO: 2670142 - RNA, 17 nt, Escherichia coli CFT073
cuaacgcuucuggcgua

SEQ ID NO: 2670143 - RNA, 17 nt, Escherichia coli CFT073
cuaacguuggcaaauug

SEQ ID NO: 2670144 - RNA, 20 nt, Escherichia coli CFT073
cuaacguuuuacgcgucaca

SEQ ID NO: 2670145 - RNA, 18 nt, Escherichia coli CFT073
cuaacucacgcagauacu

SEQ ID NO: 2670146 - RNA, 22 nt, Escherichia coli CFT073
cuaacucauugauuuucaaauc

SEQ ID NO: 2670147 - RNA, 15 nt, Escherichia coli CFT073
cuaacuccugauucc

SEQ ID NO: 2670148 - RNA, 22 nt, Escherichia coli CFT073
cuaacuccugcgucggaacauc

SEQ ID NO: 2670149 - RNA, 16 nt, Escherichia coli CFT073
cuacggcgacagcaaa

SEQ ID NO: 2670150 - RNA, 15 nt, Escherichia coli CFT073
cuacggcucagcaau

SEQ ID NO: 2670151 - RNA, 15 nt, Escherichia coli CFT073
cuacggucacgccac

SEQ ID NO: 2670152 - RNA, 14 nt, Escherichia coli CFT073
cuacggucugccgg

SEQ ID NO: 2670153 - RNA, 15 nt, Escherichia coli CFT073
cuacggugcugacgc

SEQ ID NO: 2670154 - RNA, 13 nt, Escherichia coli CFT073
cuacgugccgggc

SEQ ID NO: 2670155 - RNA, 22 nt, Escherichia coli CFT073
cuacgugccgggcaaauucaga

SEQ ID NO: 2670156 - RNA, 14 nt, Escherichia coli CFT073
cuacguuauugucg

SEQ ID NO: 2670157 - RNA, 20 nt, Escherichia coli CFT073
cuacguucgaucaccgcacg

SEQ ID NO: 2670158 - RNA, 15 nt, Escherichia coli CFT073
cuacuaauaaaucgu

SEQ ID NO: 2670159 - RNA, 15 nt, Escherichia coli CFT073
cuacucgccugccac

SEQ ID NO: 2670160 - RNA, 13 nt, Escherichia coli CFT073
cuacucugaccca

SEQ ID NO: 2670161 - RNA, 16 nt, Escherichia coli CFT073
cuacucugacccagaa

SEQ ID NO: 2670162 - RNA, 17 nt, Escherichia coli CFT073
cuacugacuccagguga

SEQ ID NO: 2670163 - RNA, 19 nt, Escherichia coli CFT073
cuacugauguucgccagau

SEQ ID NO: 2670164 - RNA, 21 nt, Escherichia coli CFT073
cuacugccagauucuccagca

SEQ ID NO: 2670165 - RNA, 17 nt, Escherichia coli CFT073
cuacugccugcggcuug

SEQ ID NO: 2670166 - RNA, 15 nt, Escherichia coli CFT073
cuacuggcaauccug

SEQ ID NO: 2670167 - RNA, 20 nt, Escherichia coli CFT073
cuacuucuuucaccaucgca

SEQ ID NO: 2670168 - RNA, 22 nt, Escherichia coli CFT073
cuacuuugcgagucugcuccag

SEQ ID NO: 2670169 - RNA, 13 nt, Escherichia coli CFT073
cuacuuuuucuua

SEQ ID NO: 2670170 - RNA, 14 nt, Escherichia coli CFT073
cuacuuuuuuaaga

SEQ ID NO: 2670171 - RNA, 15 nt, Escherichia coli CFT073
cuagaagcuccggua

SEQ ID NO: 2670172 - RNA, 11 nt, Escherichia coli CFT073
cuagauaagca

SEQ ID NO: 2670173 - RNA, 14 nt, Escherichia coli CFT073
cuagauaagcaagg

SEQ ID NO: 2670174 - RNA, 20 nt, Escherichia coli CFT073
cuagauaagcaaggcaaucu

SEQ ID NO: 2670175 - RNA, 16 nt, Escherichia coli CFT073
cuagccucccugccuc

SEQ ID NO: 2670176 - RNA, 14 nt, Escherichia coli CFT073
cuagcgcuuuuucu

SEQ ID NO: 2670177 - RNA, 11 nt, Escherichia coli CFT073
cuagcgucgca

SEQ ID NO: 2670178 - RNA, 20 nt, Escherichia coli CFT073
cuagcgucgcauccggcauu

SEQ ID NO: 2670179 - RNA, 20 nt, Escherichia coli CFT073
cuaguacgccaaucugcaaa

SEQ ID NO: 2670180 - RNA, 14 nt, Escherichia coli CFT073
cuauaaaccugcug

SEQ ID NO: 2670181 - RNA, 12 nt, Escherichia coli CFT073
cuauaaauauac

SEQ ID NO: 2670182 - RNA, 14 nt, Escherichia coli CFT073
cuauaaauauacau

SEQ ID NO: 2670183 - RNA, 19 nt, Escherichia coli CFT073
cuauaccagauaaacaucg

SEQ ID NO: 2670184 - RNA, 21 nt, Escherichia coli CFT073
cuauaccuaacacgaucagcc

SEQ ID NO: 2670185 - RNA, 14 nt, Escherichia coli CFT073
cuauagccgcaacu

SEQ ID NO: 2670186 - RNA, 23 nt, Escherichia coli CFT073
cuauauacagcgccucuuuugac

SEQ ID NO: 2670187 - RNA, 18 nt, Escherichia coli CFT073
cuauauauuuaguucaua

SEQ ID NO: 2670188 - RNA, 22 nt, Escherichia coli CFT073
cuauauauuuaguucauauaau

SEQ ID NO: 2670189 - RNA, 14 nt, Escherichia coli CFT073
cuauaucucaauca

SEQ ID NO: 2670190 - RNA, 23 nt, Escherichia coli CFT073
cuauaugacucauaaaaauauau

SEQ ID NO: 2670191 - RNA, 20 nt, Escherichia coli CFT073
cuauauuuauucaucagcgu

SEQ ID NO: 2670192 - RNA, 17 nt, Escherichia coli CFT073
cuaucaaccugaggccu

SEQ ID NO: 2670193 - RNA, 14 nt, Escherichia coli CFT073
cuaucaauacuuuc

SEQ ID NO: 2670194 - RNA, 16 nt, Escherichia coli CFT073
cuaucacuauaaauau

SEQ ID NO: 2670195 - RNA, 12 nt, Escherichia coli CFT073
cuaucagcgcca

SEQ ID NO: 2670196 - RNA, 22 nt, Escherichia coli CFT073
cuaucagcgccaccacaaaagc

SEQ ID NO: 2670197 - RNA, 16 nt, Escherichia coli CFT073
cuaucaggucuuucug

SEQ ID NO: 2670198 - RNA, 19 nt, Escherichia coli CFT073
cuaucagugcaaagacauc

SEQ ID NO: 2670199 - RNA, 22 nt, Escherichia coli CFT073
cuaucccugcguugagaaacgc

SEQ ID NO: 2670200 - RNA, 18 nt, Escherichia coli CFT073
cuaucccuugucuuuuau

SEQ ID NO: 2670201 - RNA, 16 nt, Escherichia coli CFT073
cuauccgaugcaaaaa

SEQ ID NO: 2670202 - RNA, 15 nt, Escherichia coli CFT073
cuauccgccauauca

SEQ ID NO: 2670203 - RNA, 20 nt, Escherichia coli CFT073
cuaucgaacaugcgggucuu

SEQ ID NO: 2670204 - RNA, 23 nt, Escherichia coli CFT073
cuaucgaacaugcgggucuuacu

SEQ ID NO: 2670205 - RNA, 24 nt, Escherichia coli CFT073
cuaucgcauuauccuuuaucugcc

SEQ ID NO: 2670206 - RNA, 22 nt, Escherichia coli CFT073
cuaucgcgaaaacacucugcgc

SEQ ID NO: 2670207 - RNA, 20 nt, Escherichia coli CFT073
cuaucgcugauauacccuuc

SEQ ID NO: 2670208 - RNA, 12 nt, Escherichia coli CFT073
cuaucggcgaug

SEQ ID NO: 2670209 - RNA, 13 nt, Escherichia coli CFT073
cuaucuacugccu

SEQ ID NO: 2670210 - RNA, 15 nt, Escherichia coli CFT073
cuaucugacuuuccg

SEQ ID NO: 2670211 - RNA, 18 nt, Escherichia coli CFT073
cuaucugccguucagcca

SEQ ID NO: 2670212 - RNA, 23 nt, Escherichia coli CFT073
cuaucugccguucagccaaugcc

SEQ ID NO: 2670213 - RNA, 22 nt, Escherichia coli CFT073
cuaucuggcgcgcuauuaccag

SEQ ID NO: 2670214 - RNA, 20 nt, Escherichia coli CFT073
cuaugagagccguuaaaacg

SEQ ID NO: 2670215 - RNA, 15 nt, Escherichia coli CFT073
cuaugaugaaaaagc

SEQ ID NO: 2670216 - RNA, 14 nt, Escherichia coli CFT073
cuaugauuuuccug

SEQ ID NO: 2670217 - RNA, 17 nt, Escherichia coli CFT073
cuaugauuuuccugagg

SEQ ID NO: 2670218 - RNA, 16 nt, Escherichia coli CFT073
cuaugcauacacagau

SEQ ID NO: 2670219 - RNA, 20 nt, Escherichia coli CFT073
cuaugcgccaguuuuccacu

SEQ ID NO: 2670220 - RNA, 15 nt, Escherichia coli CFT073
cuaugcugccacacu

SEQ ID NO: 2670221 - RNA, 22 nt, Escherichia coli CFT073
cuauguuugaaccagauaucgc

SEQ ID NO: 2670222 - RNA, 12 nt, Escherichia coli CFT073
cuauuaauccau

SEQ ID NO: 2670223 - RNA, 12 nt, Escherichia coli CFT073
cuauuaccaggc

SEQ ID NO: 2670224 - RNA, 21 nt, Escherichia coli CFT073
cuauuacuuuaagccuuccgc

SEQ ID NO: 2670225 - RNA, 12 nt, Escherichia coli CFT073
cuauucagcagu

SEQ ID NO: 2670226 - RNA, 14 nt, Escherichia coli CFT073
cuauucauugcuau

SEQ ID NO: 2670227 - RNA, 18 nt, Escherichia coli CFT073
cuauucauugcuauuucc

SEQ ID NO: 2670228 - RNA, 20 nt, Escherichia coli CFT073
cuauucauugcuauuucccc

SEQ ID NO: 2670229 - RNA, 21 nt, Escherichia coli CFT073
cuauucgccagcacggcgcag

SEQ ID NO: 2670230 - RNA, 22 nt, Escherichia coli CFT073
cuauugcaggggcuuauauagg

SEQ ID NO: 2670231 - RNA, 20 nt, Escherichia coli CFT073
cuauugccauacgccggaug

SEQ ID NO: 2670232 - RNA, 20 nt, Escherichia coli CFT073
cuauugccguaaucgccucc

SEQ ID NO: 2670233 - RNA, 11 nt, Escherichia coli CFT073
cuauugcgcug

SEQ ID NO: 2670234 - RNA, 16 nt, Escherichia coli CFT073
cuauugcugccacucu

SEQ ID NO: 2670235 - RNA, 12 nt, Escherichia coli CFT073
cuauugguucac

SEQ ID NO: 2670236 - RNA, 17 nt, Escherichia coli CFT073
cuauuuacagauuuccc

SEQ ID NO: 2670237 - RNA, 18 nt, Escherichia coli CFT073
cuauuuaccgccaacgca

SEQ ID NO: 2670238 - RNA, 20 nt, Escherichia coli CFT073
cuauuuuugcuacgccacug

SEQ ID NO: 2670239 - RNA, 20 nt, Escherichia coli CFT073
cuauuuuuggaggugaaggu

SEQ ID NO: 2670240 - RNA, 13 nt, Escherichia coli CFT073
cuauuuuuucaau

SEQ ID NO: 2670241 - RNA, 21 nt, Escherichia coli CFT073
cucaaaacgcgugacaccauc

SEQ ID NO: 2670242 - RNA, 21 nt, Escherichia coli CFT073
cucaaaagcguaccgccaauu

SEQ ID NO: 2670243 - RNA, 13 nt, Escherichia coli CFT073
cucaaaagguuca

SEQ ID NO: 2670244 - RNA, 15 nt, Escherichia coli CFT073
cucaaaauuucucuu

SEQ ID NO: 2670245 - RNA, 22 nt, Escherichia coli CFT073
cucaaacaccgucgcaauaccc

SEQ ID NO: 2670246 - RNA, 19 nt, Escherichia coli CFT073
cucaaaccauuucugcgag

SEQ ID NO: 2670247 - RNA, 17 nt, Escherichia coli CFT073
cucaaaccggcuccaga

SEQ ID NO: 2670248 - RNA, 12 nt, Escherichia coli CFT073
cucaaacuggcu

SEQ ID NO: 2670249 - RNA, 18 nt, Escherichia coli CFT073
cucaaagcaguauuucuu

SEQ ID NO: 2670250 - RNA, 18 nt, Escherichia coli CFT073
cucaacaaccaggccagc

SEQ ID NO: 2670251 - RNA, 19 nt, Escherichia coli CFT073
cucaacagccagaagguga

SEQ ID NO: 2670252 - RNA, 13 nt, Escherichia coli CFT073
cucaacaguaagg

SEQ ID NO: 2670253 - RNA, 17 nt, Escherichia coli CFT073
cucaacaucuucaccaa

SEQ ID NO: 2670254 - RNA, 12 nt, Escherichia coli CFT073
cucaaccagauu

SEQ ID NO: 2670255 - RNA, 15 nt, Escherichia coli CFT073
cucaaccccagccau

SEQ ID NO: 2670256 - RNA, 16 nt, Escherichia coli CFT073
cucaaccgcuucuuuc

SEQ ID NO: 2670257 - RNA, 16 nt, Escherichia coli CFT073
cucaaccuucuucgcg

SEQ ID NO: 2670258 - RNA, 23 nt, Escherichia coli CFT073
cucaucaauacccgguccuucau

SEQ ID NO: 2670259 - RNA, 22 nt, Escherichia coli CFT073
cucaucaauuugcuucuggcug

SEQ ID NO: 2670260 - RNA, 12 nt, Escherichia coli CFT073
cucaucaccgca

SEQ ID NO: 2670261 - RNA, 22 nt, Escherichia coli CFT073
cucaucaccgcaaagucggcac

SEQ ID NO: 2670262 - RNA, 15 nt, Escherichia coli CFT073
cucaucagcuuacgg

SEQ ID NO: 2670263 - RNA, 16 nt, Escherichia coli CFT073
cucaucagguauugcu

SEQ ID NO: 2670264 - RNA, 13 nt, Escherichia coli CFT073
cucaucauccucu

SEQ ID NO: 2670265 - RNA, 14 nt, Escherichia coli CFT073
cucauccaucaaau

SEQ ID NO: 2670266 - RNA, 17 nt, Escherichia coli CFT073
cucauccuguggcuuuu

SEQ ID NO: 2670267 - RNA, 20 nt, Escherichia coli CFT073
cucauccuguggcuuuuuug

SEQ ID NO: 2670268 - RNA, 15 nt, Escherichia coli CFT073
cucauccuucagugc

SEQ ID NO: 2670269 - RNA, 12 nt, Escherichia coli CFT073
cucaucgcccgc

SEQ ID NO: 2670270 - RNA, 14 nt, Escherichia coli CFT073
cucaucgccgccaa

SEQ ID NO: 2670271 - RNA, 16 nt, Escherichia coli CFT073
cucaucgucaaaugaa

SEQ ID NO: 2670272 - RNA, 20 nt, Escherichia coli CFT073
cucaucuucauaacuuugau

SEQ ID NO: 2670273 - RNA, 13 nt, Escherichia coli CFT073
cucaucuuccauu

SEQ ID NO: 2670274 - RNA, 21 nt, Escherichia coli CFT073
cucaucuuccauucuccgcuc

SEQ ID NO: 2670275 - RNA, 14 nt, Escherichia coli CFT073
cucaucuuccgggc

SEQ ID NO: 2670276 - RNA, 20 nt, Escherichia coli CFT073
cucaucuuuaucggugagac

SEQ ID NO: 2670277 - RNA, 18 nt, Escherichia coli CFT073
cucaugcaacacaagcca

SEQ ID NO: 2670278 - RNA, 14 nt, Escherichia coli CFT073
cucaugcaacugcu

SEQ ID NO: 2670279 - RNA, 19 nt, Escherichia coli CFT073
cucaugccguagaacagca

SEQ ID NO: 2670280 - RNA, 12 nt, Escherichia coli CFT073
cucaugcuucau

SEQ ID NO: 2670281 - RNA, 14 nt, Escherichia coli CFT073
cucauggccuuugc

SEQ ID NO: 2670282 - RNA, 13 nt, Escherichia coli CFT073
cucauguuaucga

SEQ ID NO: 2670283 - RNA, 22 nt, Escherichia coli CFT073
cucauguuguaagcgcgcaggu

SEQ ID NO: 2670284 - RNA, 12 nt, Escherichia coli CFT073
cucauuaaacca

SEQ ID NO: 2670285 - RNA, 15 nt, Escherichia coli CFT073
cucauuaaucaauuu

SEQ ID NO: 2670286 - RNA, 19 nt, Escherichia coli CFT073
cucauuaauuucaggcugu

SEQ ID NO: 2670287 - RNA, 15 nt, Escherichia coli CFT073
cucauuagcccggca

SEQ ID NO: 2670288 - RNA, 15 nt, Escherichia coli CFT073
cucauuaguuaauuc

SEQ ID NO: 2670289 - RNA, 14 nt, Escherichia coli CFT073
cucauuccgccgcc

SEQ ID NO: 2670290 - RNA, 22 nt, Escherichia coli CFT073
cucauugauuuucaaaucgagc

SEQ ID NO: 2670291 - RNA, 14 nt, Escherichia coli CFT073
cucauuucccaaca

SEQ ID NO: 2670292 - RNA, 14 nt, Escherichia coli CFT073
cucauuugcagaaa

SEQ ID NO: 2670293 - RNA, 14 nt, Escherichia coli CFT073
cucauuuucaauuc

SEQ ID NO: 2670294 - RNA, 13 nt, Escherichia coli CFT073
cucauuuucucuu

SEQ ID NO: 2670295 - RNA, 22 nt, Escherichia coli CFT073
cucauuuugggcgggaucucca

SEQ ID NO: 2670296 - RNA, 17 nt, Escherichia coli CFT073
cucauuuuuaacagugu

SEQ ID NO: 2670297 - RNA, 23 nt, Escherichia coli CFT073
cucauuuuucagcguuccccaga

SEQ ID NO: 2670298 - RNA, 18 nt, Escherichia coli CFT073
cuccaaccagauaucccg

SEQ ID NO: 2670299 - RNA, 14 nt, Escherichia coli CFT073
cuccaacccacaaa

SEQ ID NO: 2670300 - RNA, 16 nt, Escherichia coli CFT073
cuccaacccacaaaaa

SEQ ID NO: 2670301 - RNA, 22 nt, Escherichia coli CFT073
cuccaaggucuccgcccagcgu

SEQ ID NO: 2670302 - RNA, 20 nt, Escherichia coli CFT073
cuccacaagaaugccugcca

SEQ ID NO: 2670303 - RNA, 20 nt, Escherichia coli CFT073
cuccaccggacggacuucaa

SEQ ID NO: 2670304 - RNA, 13 nt, Escherichia coli CFT073
cuccacugcucac

SEQ ID NO: 2670305 - RNA, 11 nt, Escherichia coli CFT073
cuccacuuccu

SEQ ID NO: 2670306 - RNA, 14 nt, Escherichia coli CFT073
cuccacuuccugcc

SEQ ID NO: 2670307 - RNA, 12 nt, Escherichia coli CFT073
cuccagaauacc

SEQ ID NO: 2670308 - RNA, 22 nt, Escherichia coli CFT073
cuccagaauuccgugccagcac

SEQ ID NO: 2670309 - RNA, 19 nt, Escherichia coli CFT073
cuccagacaccgcugcuuc

SEQ ID NO: 2670310 - RNA, 19 nt, Escherichia coli CFT073
cuccagacgcccgcgccca

SEQ ID NO: 2670311 - RNA, 16 nt, Escherichia coli CFT073
cuccagaugacuggcu

SEQ ID NO: 2670312 - RNA, 12 nt, Escherichia coli CFT073
cuccagcaaugu

SEQ ID NO: 2670313 - RNA, 13 nt, Escherichia coli CFT073
cuccagcagcuca

SEQ ID NO: 2670314 - RNA, 14 nt, Escherichia coli CFT073
cuccagcagcucaa

SEQ ID NO: 2670315 - RNA, 22 nt, Escherichia coli CFT073
cuccagcaucagauggggaugg

SEQ ID NO: 2670316 - RNA, 19 nt, Escherichia coli CFT073
cuccagcgacacaaugggc

SEQ ID NO: 2670317 - RNA, 20 nt, Escherichia coli CFT073
cuccagcgccgccagaauca

SEQ ID NO: 2670318 - RNA, 19 nt, Escherichia coli CFT073
cuccagcgggcgaaucaac

SEQ ID NO: 2670319 - RNA, 23 nt, Escherichia coli CFT073
cuccagcgggcgaaucaacucca

SEQ ID NO: 2670320 - RNA, 16 nt, Escherichia coli CFT073
cuccaggcgaagacaa

SEQ ID NO: 2670321 - RNA, 21 nt, Escherichia coli CFT073
cuccaggcgaagacaaaacca

SEQ ID NO: 2670322 - RNA, 15 nt, Escherichia coli CFT073
cuccagggcagguaa

SEQ ID NO: 2670323 - RNA, 15 nt, Escherichia coli CFT073
cuccagucgcgugug

SEQ ID NO: 2670324 - RNA, 20 nt, Escherichia coli CFT073
cuccagucuuuuaaccggcg

SEQ ID NO: 2670325 - RNA, 19 nt, Escherichia coli CFT073
cuccagugcgcuuuauuca

SEQ ID NO: 2670326 - RNA, 18 nt, Escherichia coli CFT073
cuccaguuaacgccgcgc

SEQ ID NO: 2670327 - RNA, 20 nt, Escherichia coli CFT073
cuccaguucguucaguugcg

SEQ ID NO: 2670328 - RNA, 20 nt, Escherichia coli CFT073
cuccauaauugccagcuugc

SEQ ID NO: 2670329 - RNA, 22 nt, Escherichia coli CFT073
cuccauccgggaucacaucaua

SEQ ID NO: 2670330 - RNA, 16 nt, Escherichia coli CFT073
cuccauuuuucguuuc

SEQ ID NO: 2670331 - RNA, 19 nt, Escherichia coli CFT073
cucccacggaauagaaccu

SEQ ID NO: 2670332 - RNA, 22 nt, Escherichia coli CFT073
cucccagcguaccaguggcggc

SEQ ID NO: 2670333 - RNA, 18 nt, Escherichia coli CFT073
cucccauaaugccccagc

SEQ ID NO: 2670334 - RNA, 19 nt, Escherichia coli CFT073
cucccauaaugccccagcg

SEQ ID NO: 2670335 - RNA, 19 nt, Escherichia coli CFT073
cucccauuuuauccucuuc

SEQ ID NO: 2670336 - RNA, 21 nt, Escherichia coli CFT073
cucccauuuuauccucuucaa

SEQ ID NO: 2670337 - RNA, 14 nt, Escherichia coli CFT073
cuccccaaggacgc

SEQ ID NO: 2670338 - RNA, 15 nt, Escherichia coli CFT073
cuccccacaccacca

SEQ ID NO: 2670339 - RNA, 12 nt, Escherichia coli CFT073
cucccccucuuc

SEQ ID NO: 2670340 - RNA, 14 nt, Escherichia coli CFT073
cucccccucuuccg

SEQ ID NO: 2670341 - RNA, 16 nt, Escherichia coli CFT073
cuccccgcaaaccaga

SEQ ID NO: 2670342 - RNA, 17 nt, Escherichia coli CFT073
cuccccgccguugcucu

SEQ ID NO: 2670343 - RNA, 19 nt, Escherichia coli CFT073
cuccccuuucuuauuuuuc

SEQ ID NO: 2670344 - RNA, 23 nt, Escherichia coli CFT073
cuccccuuucuuauuuuucugca

SEQ ID NO: 2670345 - RNA, 14 nt, Escherichia coli CFT073
cucccgcagccacu

SEQ ID NO: 2670346 - RNA, 14 nt, Escherichia coli CFT073
cucccgccugcugc

SEQ ID NO: 2670347 - RNA, 15 nt, Escherichia coli CFT073
cucccgccugcugcg

SEQ ID NO: 2670348 - RNA, 16 nt, Escherichia coli CFT073
cucccgcgccgcagcc

SEQ ID NO: 2670349 - RNA, 16 nt, Escherichia coli CFT073
cucccgcuuuggcauc

SEQ ID NO: 2670350 - RNA, 20 nt, Escherichia coli CFT073
cucccggauaccccagcugg

SEQ ID NO: 2670351 - RNA, 16 nt, Escherichia coli CFT073
cucccggcaaugcgcc

SEQ ID NO: 2670352 - RNA, 14 nt, Escherichia coli CFT073
cucccguugcuucu

SEQ ID NO: 2670353 - RNA, 19 nt, Escherichia coli CFT073
cucccuguuccuguauuug

SEQ ID NO: 2670354 - RNA, 19 nt, Escherichia coli CFT073
cucccuugcgggaucaggc

SEQ ID NO: 2670355 - RNA, 15 nt, Escherichia coli CFT073
cucccuuucugccac

SEQ ID NO: 2670356 - RNA, 19 nt, Escherichia coli CFT073
cucccuuucugccacgcca

SEQ ID NO: 2670357 - RNA, 19 nt, Escherichia coli CFT073
cuccgauauuugccgcgac

SEQ ID NO: 2670358 - RNA, 14 nt, Escherichia coli CFT073
cuccgaucccugcg

SEQ ID NO: 2670359 - RNA, 17 nt, Escherichia coli CFT073
cuccgcacaaacgccac

SEQ ID NO: 2670360 - RNA, 18 nt, Escherichia coli CFT073
cuccgcacaaacgccacc

SEQ ID NO: 2670361 - RNA, 18 nt, Escherichia coli CFT073
cuccgcacagcaguugca

SEQ ID NO: 2670362 - RNA, 13 nt, Escherichia coli CFT073
cuccgcagccaug

SEQ ID NO: 2670363 - RNA, 14 nt, Escherichia coli CFT073
cuccgccccggcaa

SEQ ID NO: 2670364 - RNA, 23 nt, Escherichia coli CFT073
cuccgccccggcaauaaaacagg

SEQ ID NO: 2670365 - RNA, 13 nt, Escherichia coli CFT073
cuccgcgccgccg

SEQ ID NO: 2670366 - RNA, 16 nt, Escherichia coli CFT073
cuccgcggucagcgca

SEQ ID NO: 2670367 - RNA, 13 nt, Escherichia coli CFT073
cucgugcgucgca

SEQ ID NO: 2670368 - RNA, 12 nt, Escherichia coli CFT073
cucgugguucaa

SEQ ID NO: 2670369 - RNA, 20 nt, Escherichia coli CFT073
cucgugguugaugccggaug

SEQ ID NO: 2670370 - RNA, 18 nt, Escherichia coli CFT073
cucguuaccagcgccgcc

SEQ ID NO: 2670371 - RNA, 14 nt, Escherichia coli CFT073
cucguuauagguau

SEQ ID NO: 2670372 - RNA, 22 nt, Escherichia coli CFT073
cucguuauuguuugucgccuuu

SEQ ID NO: 2670373 - RNA, 23 nt, Escherichia coli CFT073
cucguucacauauugcagcuucu

SEQ ID NO: 2670374 - RNA, 11 nt, Escherichia coli CFT073
cucguugauca

SEQ ID NO: 2670375 - RNA, 15 nt, Escherichia coli CFT073
cucguugcgccggga

SEQ ID NO: 2670376 - RNA, 15 nt, Escherichia coli CFT073
cucguuggguugcca

SEQ ID NO: 2670377 - RNA, 20 nt, Escherichia coli CFT073
cucguuggguugccagcgac

SEQ ID NO: 2670378 - RNA, 14 nt, Escherichia coli CFT073
cucuaaaaucauca

SEQ ID NO: 2670379 - RNA, 18 nt, Escherichia coli CFT073
cucuaacccuuccagauu

SEQ ID NO: 2670380 - RNA, 15 nt, Escherichia coli CFT073
cucuaagucuuucug

SEQ ID NO: 2670381 - RNA, 23 nt, Escherichia coli CFT073
cucuaagucuuucugugcaauca

SEQ ID NO: 2670382 - RNA, 22 nt, Escherichia coli CFT073
cucuacaaccaguuuaugccug

SEQ ID NO: 2670383 - RNA, 14 nt, Escherichia coli CFT073
cucuaccagcccca

SEQ ID NO: 2670384 - RNA, 21 nt, Escherichia coli CFT073
cucuaccgcuucgcguaaaau

SEQ ID NO: 2670385 - RNA, 12 nt, Escherichia coli CFT073
cucuacgcaaag

SEQ ID NO: 2670386 - RNA, 21 nt, Escherichia coli CFT073
cucuacgucgcgguugcaauc

SEQ ID NO: 2670387 - RNA, 11 nt, Escherichia coli CFT073
cucuacucgcu

SEQ ID NO: 2670388 - RNA, 19 nt, Escherichia coli CFT073
cucuauacgcucauuuucu

SEQ ID NO: 2670389 - RNA, 23 nt, Escherichia coli CFT073
cucuauucgaccacgcugcgcug

SEQ ID NO: 2670390 - RNA, 15 nt, Escherichia coli CFT073
cucucaacaccgcuc

SEQ ID NO: 2670391 - RNA, 14 nt, Escherichia coli CFT073
cucucagagaauca

SEQ ID NO: 2670392 - RNA, 19 nt, Escherichia coli CFT073
cucucauuauuugccgcca

SEQ ID NO: 2670393 - RNA, 18 nt, Escherichia coli CFT073
cucuccacacggagaggc

SEQ ID NO: 2670394 - RNA, 17 nt, Escherichia coli CFT073
cucuccggcagaccauc

SEQ ID NO: 2670395 - RNA, 14 nt, Escherichia coli CFT073
cucuccuguuuaau

SEQ ID NO: 2670396 - RNA, 22 nt, Escherichia coli CFT073
cucucgaaaaaccugacgcugc

SEQ ID NO: 2670397 - RNA, 19 nt, Escherichia coli CFT073
cucucgccgcgcuccauca

SEQ ID NO: 2670398 - RNA, 18 nt, Escherichia coli CFT073
cucucgcgucgugguauc

SEQ ID NO: 2670399 - RNA, 21 nt, Escherichia coli CFT073
cucucgggcaguaaaucaaua

SEQ ID NO: 2670400 - RNA, 12 nt, Escherichia coli CFT073
cucucuuccagu

SEQ ID NO: 2670401 - RNA, 11 nt, Escherichia coli CFT073
cucucuuucuc

SEQ ID NO: 2670402 - RNA, 14 nt, Escherichia coli CFT073
cucucuuucuccag

SEQ ID NO: 2670403 - RNA, 16 nt, Escherichia coli CFT073
cucucuuucuccagcg

SEQ ID NO: 2670404 - RNA, 18 nt, Escherichia coli CFT073
cucucuuucuccagcgua

SEQ ID NO: 2670405 - RNA, 21 nt, Escherichia coli CFT073
cucugaauaaacgguacacga

SEQ ID NO: 2670406 - RNA, 13 nt, Escherichia coli CFT073
cucugaaugccag

SEQ ID NO: 2670407 - RNA, 14 nt, Escherichia coli CFT073
cucugacauaaaaa

SEQ ID NO: 2670408 - RNA, 16 nt, Escherichia coli CFT073
cucugacccagaagac

SEQ ID NO: 2670409 - RNA, 21 nt, Escherichia coli CFT073
cucugacgauucucccacagc

SEQ ID NO: 2670410 - RNA, 21 nt, Escherichia coli CFT073
cucugacugaugacaaagucu

SEQ ID NO: 2670411 - RNA, 17 nt, Escherichia coli CFT073
cucugauacucaacuca

SEQ ID NO: 2670412 - RNA, 13 nt, Escherichia coli CFT073
cucugaucacaga

SEQ ID NO: 2670413 - RNA, 17 nt, Escherichia coli CFT073
cucugcaacgucuuccc

SEQ ID NO: 2670414 - RNA, 18 nt, Escherichia coli CFT073
cucugcaacgucuucccg

SEQ ID NO: 2670415 - RNA, 23 nt, Escherichia coli CFT073
cucugcaagagauaaagcuguca

SEQ ID NO: 2670416 - RNA, 19 nt, Escherichia coli CFT073
cucugcaagucuugcugcg

SEQ ID NO: 2670417 - RNA, 16 nt, Escherichia coli CFT073
cucugcaccagaacuc

SEQ ID NO: 2670418 - RNA, 18 nt, Escherichia coli CFT073
cucugcaccgccuccagc

SEQ ID NO: 2670419 - RNA, 19 nt, Escherichia coli CFT073
cucugcaguagccagugcu

SEQ ID NO: 2670420 - RNA, 18 nt, Escherichia coli CFT073
cucugcaucccggcagga

SEQ ID NO: 2670421 - RNA, 20 nt, Escherichia coli CFT073
cucugcauguagcaacaaac

SEQ ID NO: 2670422 - RNA, 18 nt, Escherichia coli CFT073
cucugccagcugcucaua

SEQ ID NO: 2670423 - RNA, 21 nt, Escherichia coli CFT073
cucugccgccaauuugucgcc

SEQ ID NO: 2670424 - RNA, 21 nt, Escherichia coli CFT073
cucugccguaccaucgccagc

SEQ ID NO: 2670425 - RNA, 16 nt, Escherichia coli CFT073
cucugcgcccugcauc

SEQ ID NO: 2670426 - RNA, 22 nt, Escherichia coli CFT073
cucugcgccuuugaugccacca

SEQ ID NO: 2670427 - RNA, 12 nt, Escherichia coli CFT073
cucugcggcaag

SEQ ID NO: 2670428 - RNA, 21 nt, Escherichia coli CFT073
cucugcuaaucguaccgaccc

SEQ ID NO: 2670429 - RNA, 12 nt, Escherichia coli CFT073
cucugcugccac

SEQ ID NO: 2670430 - RNA, 23 nt, Escherichia coli CFT073
cucugcuguaguuguucaacagu

SEQ ID NO: 2670431 - RNA, 19 nt, Escherichia coli CFT073
cucugcuuucucaacaaau

SEQ ID NO: 2670432 - RNA, 16 nt, Escherichia coli CFT073
cucuggagaaauauaa

SEQ ID NO: 2670433 - RNA, 14 nt, Escherichia coli CFT073
cucuggauguuuca

SEQ ID NO: 2670434 - RNA, 14 nt, Escherichia coli CFT073
cucuggcacaugca

SEQ ID NO: 2670435 - RNA, 19 nt, Escherichia coli CFT073
cucuggcagcaccacgcag

SEQ ID NO: 2670436 - RNA, 13 nt, Escherichia coli CFT073
cucuggcaggcga

SEQ ID NO: 2670437 - RNA, 18 nt, Escherichia coli CFT073
cucuggccccaccugcuc

SEQ ID NO: 2670438 - RNA, 13 nt, Escherichia coli CFT073
cucuggcugcuuc

SEQ ID NO: 2670439 - RNA, 14 nt, Escherichia coli CFT073
cucuggcugcuuca

SEQ ID NO: 2670440 - RNA, 23 nt, Escherichia coli CFT073
cucuggcugcuucaguaauaccg

SEQ ID NO: 2670441 - RNA, 20 nt, Escherichia coli CFT073
cucuggcuggucauugccgu

SEQ ID NO: 2670442 - RNA, 16 nt, Escherichia coli CFT073
cucugggaucgccggg

SEQ ID NO: 2670443 - RNA, 21 nt, Escherichia coli CFT073
cucugguguggagugcagcac

SEQ ID NO: 2670444 - RNA, 19 nt, Escherichia coli CFT073
cucuguaucgcaucaggca

SEQ ID NO: 2670445 - RNA, 13 nt, Escherichia coli CFT073
cucuguguaggcc

SEQ ID NO: 2670446 - RNA, 17 nt, Escherichia coli CFT073
cucuguguaggccggau

SEQ ID NO: 2670447 - RNA, 17 nt, Escherichia coli CFT073
cucuguuggcgacguuu

SEQ ID NO: 2670448 - RNA, 18 nt, Escherichia coli CFT073
cucuuaaugcaggcagca

SEQ ID NO: 2670449 - RNA, 20 nt, Escherichia coli CFT073
cucuuaaugcaggcagcacu

SEQ ID NO: 2670450 - RNA, 16 nt, Escherichia coli CFT073
cucuuaccguaggcca

SEQ ID NO: 2670451 - RNA, 14 nt, Escherichia coli CFT073
cucuucaaaccacu

SEQ ID NO: 2670452 - RNA, 18 nt, Escherichia coli CFT073
cucuucaaacugaagauu

SEQ ID NO: 2670453 - RNA, 21 nt, Escherichia coli CFT073
cucuucaacacacugaauaaa

SEQ ID NO: 2670454 - RNA, 22 nt, Escherichia coli CFT073
cucuucaacacacugaauaaaa

SEQ ID NO: 2670455 - RNA, 14 nt, Escherichia coli CFT073
cucuucaagauuaa

SEQ ID NO: 2670456 - RNA, 21 nt, Escherichia coli CFT073
cucuucaauggcaucacgcaa

SEQ ID NO: 2670457 - RNA, 14 nt, Escherichia coli CFT073
cucuucacauccug

SEQ ID NO: 2670458 - RNA, 18 nt, Escherichia coli CFT073
cucuucacauccugccag

SEQ ID NO: 2670459 - RNA, 18 nt, Escherichia coli CFT073
cucuucacgcccgcccca

SEQ ID NO: 2670460 - RNA, 18 nt, Escherichia coli CFT073
cucuucagcaaucucuuc

SEQ ID NO: 2670461 - RNA, 16 nt, Escherichia coli CFT073
cucuucaucuuccagu

SEQ ID NO: 2670462 - RNA, 14 nt, Escherichia coli CFT073
cucuuccagaccaa

SEQ ID NO: 2670463 - RNA, 11 nt, Escherichia coli CFT073
cucuuccagcg

SEQ ID NO: 2670464 - RNA, 15 nt, Escherichia coli CFT073
cucuucccacggauu

SEQ ID NO: 2670465 - RNA, 17 nt, Escherichia coli CFT073
cucuuccggaaccacca

SEQ ID NO: 2670466 - RNA, 17 nt, Escherichia coli CFT073
cucuuccggcucccgca

SEQ ID NO: 2670467 - RNA, 14 nt, Escherichia coli CFT073
cucuuccuuaagca

SEQ ID NO: 2670468 - RNA, 22 nt, Escherichia coli CFT073
cucuuccuuaagcacaauccgc

SEQ ID NO: 2670469 - RNA, 22 nt, Escherichia coli CFT073
cucuucgauggucauauccagc

SEQ ID NO: 2670470 - RNA, 16 nt, Escherichia coli CFT073
cucuucgcccagggcg

SEQ ID NO: 2670471 - RNA, 22 nt, Escherichia coli CFT073
cucuucgcgaaugguaaucagc

SEQ ID NO: 2670472 - RNA, 17 nt, Escherichia coli CFT073
cucuucgcgaucaaacg

SEQ ID NO: 2670473 - RNA, 23 nt, Escherichia coli CFT073
cucuucgcguaauguuuccagca

SEQ ID NO: 2670474 - RNA, 15 nt, Escherichia coli CFT073
cucuucguggcccgc

SEQ ID NO: 2670475 - RNA, 19 nt, Escherichia coli CFT073
cugaauugccagcaucaga

SEQ ID NO: 2670476 - RNA, 17 nt, Escherichia coli CFT073
cugaauuggguucuuuc

SEQ ID NO: 2670477 - RNA, 19 nt, Escherichia coli CFT073
cugaauuggguucuuuccu

SEQ ID NO: 2670478 - RNA, 21 nt, Escherichia coli CFT073
cugaauuggguucuuuccugc

SEQ ID NO: 2670479 - RNA, 17 nt, Escherichia coli CFT073
cugaauugugaugguuu

SEQ ID NO: 2670480 - RNA, 12 nt, Escherichia coli CFT073
cugaauuucaau

SEQ ID NO: 2670481 - RNA, 14 nt, Escherichia coli CFT073
cugaauuuccugcg

SEQ ID NO: 2670482 - RNA, 14 nt, Escherichia coli CFT073
cugaauuugcucca

SEQ ID NO: 2670483 - RNA, 22 nt, Escherichia coli CFT073
cugaauuugcuccagaaaccau

SEQ ID NO: 2670484 - RNA, 16 nt, Escherichia coli CFT073
cugacaaacugcgugu

SEQ ID NO: 2670485 - RNA, 21 nt, Escherichia coli CFT073
cugacaaagugcacuuguuua

SEQ ID NO: 2670486 - RNA, 16 nt, Escherichia coli CFT073
cugacacaggcagcaa

SEQ ID NO: 2670487 - RNA, 14 nt, Escherichia coli CFT073
cugacacaucuuuu

SEQ ID NO: 2670488 - RNA, 20 nt, Escherichia coli CFT073
cugacaccaucacccaacaa

SEQ ID NO: 2670489 - RNA, 18 nt, Escherichia coli CFT073
cugacacuauucgccagc

SEQ ID NO: 2670490 - RNA, 21 nt, Escherichia coli CFT073
cugacacuauucgccagcacg

SEQ ID NO: 2670491 - RNA, 18 nt, Escherichia coli CFT073
cugacagaccacucucug

SEQ ID NO: 2670492 - RNA, 21 nt, Escherichia coli CFT073
cugacagcagagcaugguuaa

SEQ ID NO: 2670493 - RNA, 21 nt, Escherichia coli CFT073
cugacagcgcgucuuguacuu

SEQ ID NO: 2670494 - RNA, 24 nt, Escherichia coli CFT073
cugacagcgcgucuuguacuuccg

SEQ ID NO: 2670495 - RNA, 18 nt, Escherichia coli CFT073
cugacagcuccuccggga

SEQ ID NO: 2670496 - RNA, 23 nt, Escherichia coli CFT073
cugacaggcgggaagaacggcaa

SEQ ID NO: 2670497 - RNA, 16 nt, Escherichia coli CFT073
cugacaggucaucgca

SEQ ID NO: 2670498 - RNA, 13 nt, Escherichia coli CFT073
cugacauaaacac

SEQ ID NO: 2670499 - RNA, 21 nt, Escherichia coli CFT073
cugacauaaacaccagcaaua

SEQ ID NO: 2670500 - RNA, 18 nt, Escherichia coli CFT073
cugacauagacgccaccc

SEQ ID NO: 2670501 - RNA, 17 nt, Escherichia coli CFT073
cugacauagccacucac

SEQ ID NO: 2670502 - RNA, 19 nt, Escherichia coli CFT073
cugacauauuuuuguugaa

SEQ ID NO: 2670503 - RNA, 14 nt, Escherichia coli CFT073
cugacaucacgcca

SEQ ID NO: 2670504 - RNA, 13 nt, Escherichia coli CFT073
cugacauccacgu

SEQ ID NO: 2670505 - RNA, 17 nt, Escherichia coli CFT073
cugacauuaucagacac

SEQ ID NO: 2670506 - RNA, 21 nt, Escherichia coli CFT073
cugacauuugcauccaacuuc

SEQ ID NO: 2670507 - RNA, 16 nt, Escherichia coli CFT073
cugaccaaauacacgc

SEQ ID NO: 2670508 - RNA, 20 nt, Escherichia coli CFT073
cugaccaaauacacgcacgg

SEQ ID NO: 2670509 - RNA, 21 nt, Escherichia coli CFT073
cugaccacaaaggcgcgaagc

SEQ ID NO: 2670510 - RNA, 13 nt, Escherichia coli CFT073
cugaccaccacca

SEQ ID NO: 2670511 - RNA, 17 nt, Escherichia coli CFT073
cugaccaccagcacgcu

SEQ ID NO: 2670512 - RNA, 13 nt, Escherichia coli CFT073
cugaccacggcca

SEQ ID NO: 2670513 - RNA, 23 nt, Escherichia coli CFT073
cugaccagacagucgccgcuucg

SEQ ID NO: 2670514 - RNA, 16 nt, Escherichia coli CFT073
cugaccagguuucgga

SEQ ID NO: 2670515 - RNA, 14 nt, Escherichia coli CFT073
cugaccauuacugu

SEQ ID NO: 2670516 - RNA, 14 nt, Escherichia coli CFT073
cugacccagcacca

SEQ ID NO: 2670517 - RNA, 15 nt, Escherichia coli CFT073
cugacccagcaccag

SEQ ID NO: 2670518 - RNA, 15 nt, Escherichia coli CFT073
cugaccgcccggccc

SEQ ID NO: 2670519 - RNA, 16 nt, Escherichia coli CFT073
cugaccgguuucgaac

SEQ ID NO: 2670520 - RNA, 21 nt, Escherichia coli CFT073
cugaccguaagcgucguucgc

SEQ ID NO: 2670521 - RNA, 18 nt, Escherichia coli CFT073
cugaccgucaaagcgcca

SEQ ID NO: 2670522 - RNA, 22 nt, Escherichia coli CFT073
cugaccgucaaagcgccagcgc

SEQ ID NO: 2670523 - RNA, 17 nt, Escherichia coli CFT073
cugaccgucgcagccag

SEQ ID NO: 2670524 - RNA, 13 nt, Escherichia coli CFT073
cugaccgucgccu

SEQ ID NO: 2670525 - RNA, 22 nt, Escherichia coli CFT073
cugaccgucuuuuuuuacgggu

SEQ ID NO: 2670526 - RNA, 23 nt, Escherichia coli CFT073
cugaccgucuuuuuuuacgggua

SEQ ID NO: 2670527 - RNA, 20 nt, Escherichia coli CFT073
cugaccguuguugaacggca

SEQ ID NO: 2670528 - RNA, 16 nt, Escherichia coli CFT073
cugaccuauuucauuc

SEQ ID NO: 2670529 - RNA, 18 nt, Escherichia coli CFT073
cugaccuauuucauucag

SEQ ID NO: 2670530 - RNA, 23 nt, Escherichia coli CFT073
cugaccucuucuacugcaugauu

SEQ ID NO: 2670531 - RNA, 20 nt, Escherichia coli CFT073
cugaccugaauuaaugccuc

SEQ ID NO: 2670532 - RNA, 12 nt, Escherichia coli CFT073
cugaccuggaag

SEQ ID NO: 2670533 - RNA, 13 nt, Escherichia coli CFT073
cugaccuggaagu

SEQ ID NO: 2670534 - RNA, 22 nt, Escherichia coli CFT073
cugaccuggaaguguccaguug

SEQ ID NO: 2670535 - RNA, 14 nt, Escherichia coli CFT073
cugaccuuaauaaa

SEQ ID NO: 2670536 - RNA, 17 nt, Escherichia coli CFT073
cugaccuuaccaaugcu

SEQ ID NO: 2670537 - RNA, 19 nt, Escherichia coli CFT073
cugaccuuaguuggucgcc

SEQ ID NO: 2670538 - RNA, 13 nt, Escherichia coli CFT073
cugaccuucuuca

SEQ ID NO: 2670539 - RNA, 15 nt, Escherichia coli CFT073
cugaccuuuuuucag

SEQ ID NO: 2670540 - RNA, 17 nt, Escherichia coli CFT073
cugacgaaggugccgga

SEQ ID NO: 2670541 - RNA, 18 nt, Escherichia coli CFT073
cugacgaaggugccggau

SEQ ID NO: 2670542 - RNA, 16 nt, Escherichia coli CFT073
cugacgaucggcaucg

SEQ ID NO: 2670543 - RNA, 16 nt, Escherichia coli CFT073
cugacgcaaaacgcgc

SEQ ID NO: 2670544 - RNA, 14 nt, Escherichia coli CFT073
cugacgcaucaguc

SEQ ID NO: 2670545 - RNA, 13 nt, Escherichia coli CFT073
cugacgcaucuua

SEQ ID NO: 2670546 - RNA, 19 nt, Escherichia coli CFT073
cugacgcccguuuucaccu

SEQ ID NO: 2670547 - RNA, 17 nt, Escherichia coli CFT073
cugacgccugccagcuc

SEQ ID NO: 2670548 - RNA, 16 nt, Escherichia coli CFT073
cugacgcgcagugccu

SEQ ID NO: 2670549 - RNA, 15 nt, Escherichia coli CFT073
cugacgcgcuuuuca

SEQ ID NO: 2670550 - RNA, 20 nt, Escherichia coli CFT073
cugacgcgcuuuucaccgac

SEQ ID NO: 2670551 - RNA, 17 nt, Escherichia coli CFT073
cugacgcgugguuacgc

SEQ ID NO: 2670552 - RNA, 14 nt, Escherichia coli CFT073
cugacgcugcucag

SEQ ID NO: 2670553 - RNA, 15 nt, Escherichia coli CFT073
cugacgcugcucagg

SEQ ID NO: 2670554 - RNA, 16 nt, Escherichia coli CFT073
cugacgcugcucaggc

SEQ ID NO: 2670555 - RNA, 22 nt, Escherichia coli CFT073
cugacggaaaucauccagcacg

SEQ ID NO: 2670556 - RNA, 13 nt, Escherichia coli CFT073
cugacggccuucg

SEQ ID NO: 2670557 - RNA, 23 nt, Escherichia coli CFT073
cugacgggaaacucugcuggcgg

SEQ ID NO: 2670558 - RNA, 19 nt, Escherichia coli CFT073
cugacggugauacagcaaa

SEQ ID NO: 2670559 - RNA, 21 nt, Escherichia coli CFT073
cugacggugauacagcaaaau

SEQ ID NO: 2670560 - RNA, 17 nt, Escherichia coli CFT073
cugacguucagccgcuu

SEQ ID NO: 2670561 - RNA, 21 nt, Escherichia coli CFT073
cugacguuggguaaauugcga

SEQ ID NO: 2670562 - RNA, 17 nt, Escherichia coli CFT073
cugacuauccacuggaa

SEQ ID NO: 2670563 - RNA, 19 nt, Escherichia coli CFT073
cugacuccgauauuugccg

SEQ ID NO: 2670564 - RNA, 17 nt, Escherichia coli CFT073
cugacugaauacgaucc

SEQ ID NO: 2670565 - RNA, 22 nt, Escherichia coli CFT073
cugacugacuucaacaggaaaa

SEQ ID NO: 2670566 - RNA, 20 nt, Escherichia coli CFT073
cugacugaguaauagccuga

SEQ ID NO: 2670567 - RNA, 23 nt, Escherichia coli CFT073
cugacugaugagaaauauuuuca

SEQ ID NO: 2670568 - RNA, 12 nt, Escherichia coli CFT073
cugacuggcgag

SEQ ID NO: 2670569 - RNA, 22 nt, Escherichia coli CFT073
cugacugguuaguuucagcgcg

SEQ ID NO: 2670570 - RNA, 21 nt, Escherichia coli CFT073
cugacuguuagaagcaucgug

SEQ ID NO: 2670571 - RNA, 17 nt, Escherichia coli CFT073
cugacuguuuagcgacg

SEQ ID NO: 2670572 - RNA, 22 nt, Escherichia coli CFT073
cugacuuacuuccugucuuccc

SEQ ID NO: 2670573 - RNA, 14 nt, Escherichia coli CFT073
cugacuuccacuuc

SEQ ID NO: 2670574 - RNA, 13 nt, Escherichia coli CFT073
cugacuugccgga

SEQ ID NO: 2670575 - RNA, 17 nt, Escherichia coli CFT073
cugacuuuaccugccug

SEQ ID NO: 2670576 - RNA, 18 nt, Escherichia coli CFT073
cugacuuuaccugccuga

SEQ ID NO: 2670577 - RNA, 21 nt, Escherichia coli CFT073
cugacuuuaccugccugacga

SEQ ID NO: 2670578 - RNA, 20 nt, Escherichia coli CFT073
cugacuuuccggggaaaugc

SEQ ID NO: 2670579 - RNA, 17 nt, Escherichia coli CFT073
cugacuuucuuuucccu

SEQ ID NO: 2670580 - RNA, 15 nt, Escherichia coli CFT073
cugagaaaaagcgaa

SEQ ID NO: 2670581 - RNA, 12 nt, Escherichia coli CFT073
cugagaaaaugu

SEQ ID NO: 2670582 - RNA, 19 nt, Escherichia coli CFT073
cugagaaaauguauuucau

SEQ ID NO: 2670583 - RNA, 18 nt, Escherichia coli CFT073
cugaugcgacgcuggcgc

SEQ ID NO: 2670584 - RNA, 22 nt, Escherichia coli CFT073
cugaugcgacgcuggcgcgucu

SEQ ID NO: 2670585 - RNA, 16 nt, Escherichia coli CFT073
cugaugcgaugcuggc

SEQ ID NO: 2670586 - RNA, 23 nt, Escherichia coli CFT073
cugaugcgcugcgcuucucaggc

SEQ ID NO: 2670587 - RNA, 12 nt, Escherichia coli CFT073
cugaugcgugcg

SEQ ID NO: 2670588 - RNA, 21 nt, Escherichia coli CFT073
cugaugcgugcgccagagccc

SEQ ID NO: 2670589 - RNA, 13 nt, Escherichia coli CFT073
cugaugcuggcac

SEQ ID NO: 2670590 - RNA, 17 nt, Escherichia coli CFT073
cugaugcugugaauauu

SEQ ID NO: 2670591 - RNA, 20 nt, Escherichia coli CFT073
cugaugcuuuccgccgucau

SEQ ID NO: 2670592 - RNA, 20 nt, Escherichia coli CFT073
cugauggacauucuccggca

SEQ ID NO: 2670593 - RNA, 22 nt, Escherichia coli CFT073
cugauggagauuaacugggcgu

SEQ ID NO: 2670594 - RNA, 14 nt, Escherichia coli CFT073
cugauggccggaug

SEQ ID NO: 2670595 - RNA, 20 nt, Escherichia coli CFT073
cugauguaaucaacuccgcc

SEQ ID NO: 2670596 - RNA, 19 nt, Escherichia coli CFT073
cugauguagcgugauuuug

SEQ ID NO: 2670597 - RNA, 16 nt, Escherichia coli CFT073
cugauguauccggcau

SEQ ID NO: 2670598 - RNA, 21 nt, Escherichia coli CFT073
cugaugugucccuuuacuggc

SEQ ID NO: 2670599 - RNA, 16 nt, Escherichia coli CFT073
cugauguucgccagau

SEQ ID NO: 2670600 - RNA, 15 nt, Escherichia coli CFT073
cugauguugauaaag

SEQ ID NO: 2670601 - RNA, 23 nt, Escherichia coli CFT073
cugauguuguuucucuuucuuca

SEQ ID NO: 2670602 - RNA, 20 nt, Escherichia coli CFT073
cugauuaagaucgugcagca

SEQ ID NO: 2670603 - RNA, 20 nt, Escherichia coli CFT073
cugauuaagcggguuuugaa

SEQ ID NO: 2670604 - RNA, 19 nt, Escherichia coli CFT073
cugauuaauuuucgcccgu

SEQ ID NO: 2670605 - RNA, 20 nt, Escherichia coli CFT073
cugauuaauuuucgcccguu

SEQ ID NO: 2670606 - RNA, 19 nt, Escherichia coli CFT073
cugauuaccuaccaacgca

SEQ ID NO: 2670607 - RNA, 20 nt, Escherichia coli CFT073
cugauuaccuuccugccaga

SEQ ID NO: 2670608 - RNA, 17 nt, Escherichia coli CFT073
cugauucacgcugacaa

SEQ ID NO: 2670609 - RNA, 22 nt, Escherichia coli CFT073
cugauuccaggucaaucccagg

SEQ ID NO: 2670610 - RNA, 16 nt, Escherichia coli CFT073
cugauucccugccuga

SEQ ID NO: 2670611 - RNA, 15 nt, Escherichia coli CFT073
cugauucgcuucaau

SEQ ID NO: 2670612 - RNA, 20 nt, Escherichia coli CFT073
cugauugaccgccagcgcca

SEQ ID NO: 2670613 - RNA, 23 nt, Escherichia coli CFT073
cugauugacgcguucgcuaaaga

SEQ ID NO: 2670614 - RNA, 14 nt, Escherichia coli CFT073
cugauugauugcga

SEQ ID NO: 2670615 - RNA, 14 nt, Escherichia coli CFT073
cugauugccggaug

SEQ ID NO: 2670616 - RNA, 14 nt, Escherichia coli CFT073
cugauuuaaaaaug

SEQ ID NO: 2670617 - RNA, 13 nt, Escherichia coli CFT073
cugauuuaaucgc

SEQ ID NO: 2670618 - RNA, 23 nt, Escherichia coli CFT073
cugauuuacuuacuucugcugca

SEQ ID NO: 2670619 - RNA, 21 nt, Escherichia coli CFT073
cugauuucucuggagaaauau

SEQ ID NO: 2670620 - RNA, 19 nt, Escherichia coli CFT073
cugauuuguaugguuuugu

SEQ ID NO: 2670621 - RNA, 18 nt, Escherichia coli CFT073
cugauuuucaucuucuuc

SEQ ID NO: 2670622 - RNA, 20 nt, Escherichia coli CFT073
cugcaaaaagccuugcugaa

SEQ ID NO: 2670623 - RNA, 17 nt, Escherichia coli CFT073
cugcaaaauaccaauaa

SEQ ID NO: 2670624 - RNA, 19 nt, Escherichia coli CFT073
cugcaaacaguaacccagc

SEQ ID NO: 2670625 - RNA, 17 nt, Escherichia coli CFT073
cugcaaagcguacaacc

SEQ ID NO: 2670626 - RNA, 18 nt, Escherichia coli CFT073
cugcaaagcguacaaccg

SEQ ID NO: 2670627 - RNA, 19 nt, Escherichia coli CFT073
cugcaaagcugauaaucau

SEQ ID NO: 2670628 - RNA, 16 nt, Escherichia coli CFT073
cugcaaagcugauggu

SEQ ID NO: 2670629 - RNA, 14 nt, Escherichia coli CFT073
cugcaaauacccaa

SEQ ID NO: 2670630 - RNA, 14 nt, Escherichia coli CFT073
cugcaaaucaccac

SEQ ID NO: 2670631 - RNA, 22 nt, Escherichia coli CFT073
cugcaaaucugcgccuacggca

SEQ ID NO: 2670632 - RNA, 18 nt, Escherichia coli CFT073
cugcaaauuaugccugau

SEQ ID NO: 2670633 - RNA, 14 nt, Escherichia coli CFT073
cugcaaauucaaua

SEQ ID NO: 2670634 - RNA, 15 nt, Escherichia coli CFT073
cugcaaauucaauaa

SEQ ID NO: 2670635 - RNA, 23 nt, Escherichia coli CFT073
cugcaaauuuuaacgcauaauaa

SEQ ID NO: 2670636 - RNA, 15 nt, Escherichia coli CFT073
cugcaacaacaccag

SEQ ID NO: 2670637 - RNA, 22 nt, Escherichia coli CFT073
cugcaacagguuacgcuggauu

SEQ ID NO: 2670638 - RNA, 22 nt, Escherichia coli CFT073
cugcaacaucaauaaagccgcc

SEQ ID NO: 2670639 - RNA, 13 nt, Escherichia coli CFT073
cugcaacaucacc

SEQ ID NO: 2670640 - RNA, 13 nt, Escherichia coli CFT073
cugcaaccagaaa

SEQ ID NO: 2670641 - RNA, 15 nt, Escherichia coli CFT073
cugcaacgucuuccc

SEQ ID NO: 2670642 - RNA, 14 nt, Escherichia coli CFT073
cugcaacguuuccg

SEQ ID NO: 2670643 - RNA, 19 nt, Escherichia coli CFT073
cugcaacguuuuaagcaaa

SEQ ID NO: 2670644 - RNA, 23 nt, Escherichia coli CFT073
cugcaacucggcuauacgagcuu

SEQ ID NO: 2670645 - RNA, 16 nt, Escherichia coli CFT073
cugcaacuucacggcu

SEQ ID NO: 2670646 - RNA, 19 nt, Escherichia coli CFT073
cugcaacuucacggcugua

SEQ ID NO: 2670647 - RNA, 16 nt, Escherichia coli CFT073
cugcaacuucgcauuu

SEQ ID NO: 2670648 - RNA, 21 nt, Escherichia coli CFT073
cugcaagacgcgucauacgau

SEQ ID NO: 2670649 - RNA, 14 nt, Escherichia coli CFT073
cugcaagcgucgcg

SEQ ID NO: 2670650 - RNA, 23 nt, Escherichia coli CFT073
cugcaaggcaacgcagccccagc

SEQ ID NO: 2670651 - RNA, 14 nt, Escherichia coli CFT073
cugcaaggcucuau

SEQ ID NO: 2670652 - RNA, 16 nt, Escherichia coli CFT073
cugcaagguggucaga

SEQ ID NO: 2670653 - RNA, 15 nt, Escherichia coli CFT073
cugcaauaccgccgu

SEQ ID NO: 2670654 - RNA, 14 nt, Escherichia coli CFT073
cugcaaucaacacu

SEQ ID NO: 2670655 - RNA, 15 nt, Escherichia coli CFT073
cugcaaucuuuccug

SEQ ID NO: 2670656 - RNA, 16 nt, Escherichia coli CFT073
cugcaaucuuuccugc

SEQ ID NO: 2670657 - RNA, 20 nt, Escherichia coli CFT073
cugcaaugccguuugcugca

SEQ ID NO: 2670658 - RNA, 22 nt, Escherichia coli CFT073
cugcaauguuaacuguuuaucg

SEQ ID NO: 2670659 - RNA, 16 nt, Escherichia coli CFT073
cugcaauugcggcagg

SEQ ID NO: 2670660 - RNA, 13 nt, Escherichia coli CFT073
cugcaauuuccgc

SEQ ID NO: 2670661 - RNA, 18 nt, Escherichia coli CFT073
cugcacaaagcgccagaa

SEQ ID NO: 2670662 - RNA, 23 nt, Escherichia coli CFT073
cugcacaaccggaaccagcgccu

SEQ ID NO: 2670663 - RNA, 14 nt, Escherichia coli CFT073
cugcacaaugccuu

SEQ ID NO: 2670664 - RNA, 15 nt, Escherichia coli CFT073
cugcacaccaaccgc

SEQ ID NO: 2670665 - RNA, 16 nt, Escherichia coli CFT073
cugcacaccaaccgcu

SEQ ID NO: 2670666 - RNA, 12 nt, Escherichia coli CFT073
cugcacagagcu

SEQ ID NO: 2670667 - RNA, 17 nt, Escherichia coli CFT073
cugcacagagcuaugaa

SEQ ID NO: 2670668 - RNA, 19 nt, Escherichia coli CFT073
cugcacagcauucagcuuc

SEQ ID NO: 2670669 - RNA, 21 nt, Escherichia coli CFT073
cugcacagcauucagcuucca

SEQ ID NO: 2670670 - RNA, 19 nt, Escherichia coli CFT073
cugcacauacugcaucagc

SEQ ID NO: 2670671 - RNA, 21 nt, Escherichia coli CFT073
cugcacauacugcaucagcgc

SEQ ID NO: 2670672 - RNA, 22 nt, Escherichia coli CFT073
cugcaccagaacucccuguucc

SEQ ID NO: 2670673 - RNA, 11 nt, Escherichia coli CFT073
cugcaccagca

SEQ ID NO: 2670674 - RNA, 12 nt, Escherichia coli CFT073
cugcaccagcag

SEQ ID NO: 2670675 - RNA, 19 nt, Escherichia coli CFT073
cugcaccagcagcgucagc

SEQ ID NO: 2670676 - RNA, 18 nt, Escherichia coli CFT073
cugcaccaggccguaccu

SEQ ID NO: 2670677 - RNA, 14 nt, Escherichia coli CFT073
cugcaccaggcggg

SEQ ID NO: 2670678 - RNA, 17 nt, Escherichia coli CFT073
cugcaccagguuuucgu

SEQ ID NO: 2670679 - RNA, 16 nt, Escherichia coli CFT073
cugcaccucaaaacca

SEQ ID NO: 2670680 - RNA, 16 nt, Escherichia coli CFT073
cugcaccucuuccuga

SEQ ID NO: 2670681 - RNA, 20 nt, Escherichia coli CFT073
cugcaccugcucaggcagaa

SEQ ID NO: 2670682 - RNA, 12 nt, Escherichia coli CFT073
cugcacgaugcc

SEQ ID NO: 2670683 - RNA, 18 nt, Escherichia coli CFT073
cugcacgccgguucccag

SEQ ID NO: 2670684 - RNA, 22 nt, Escherichia coli CFT073
cugcacgcgauggcuuuccacc

SEQ ID NO: 2670685 - RNA, 20 nt, Escherichia coli CFT073
cugcacggucacaucgcuga

SEQ ID NO: 2670686 - RNA, 18 nt, Escherichia coli CFT073
cugcacgguuuuuccagc

SEQ ID NO: 2670687 - RNA, 19 nt, Escherichia coli CFT073
cugcacgguuuuuccagcu

SEQ ID NO: 2670688 - RNA, 16 nt, Escherichia coli CFT073
cugcacguuuugcugg

SEQ ID NO: 2670689 - RNA, 20 nt, Escherichia coli CFT073
cugcacuaacccucuguccg

SEQ ID NO: 2670690 - RNA, 17 nt, Escherichia coli CFT073
cugcacugguggcaccu

SEQ ID NO: 2670691 - RNA, 19 nt, Escherichia coli CFT073
cugcccgugggcaggccag

SEQ ID NO: 2670692 - RNA, 20 nt, Escherichia coli CFT073
cugcccucuuuagcauucag

SEQ ID NO: 2670693 - RNA, 19 nt, Escherichia coli CFT073
cugccgaccagaauaucgu

SEQ ID NO: 2670694 - RNA, 15 nt, Escherichia coli CFT073
cugccgaccagagcc

SEQ ID NO: 2670695 - RNA, 17 nt, Escherichia coli CFT073
cugccgagauggugcca

SEQ ID NO: 2670696 - RNA, 14 nt, Escherichia coli CFT073
cugccgcaauggcc

SEQ ID NO: 2670697 - RNA, 15 nt, Escherichia coli CFT073
cugccgcauccggcg

SEQ ID NO: 2670698 - RNA, 19 nt, Escherichia coli CFT073
cugccgccaauuugucgcc

SEQ ID NO: 2670699 - RNA, 15 nt, Escherichia coli CFT073
cugccgcuccagaua

SEQ ID NO: 2670700 - RNA, 15 nt, Escherichia coli CFT073
cugccggaacgugca

SEQ ID NO: 2670701 - RNA, 14 nt, Escherichia coli CFT073
cugccggaauaauc

SEQ ID NO: 2670702 - RNA, 12 nt, Escherichia coli CFT073
cugccgggaaga

SEQ ID NO: 2670703 - RNA, 21 nt, Escherichia coli CFT073
cugccgggaagcucucuucca

SEQ ID NO: 2670704 - RNA, 19 nt, Escherichia coli CFT073
cugccgggaauacugcaac

SEQ ID NO: 2670705 - RNA, 22 nt, Escherichia coli CFT073
cugccgggggcgaccugugccg

SEQ ID NO: 2670706 - RNA, 15 nt, Escherichia coli CFT073
cugccgguuccagcu

SEQ ID NO: 2670707 - RNA, 19 nt, Escherichia coli CFT073
cugccgguuccagcuucag

SEQ ID NO: 2670708 - RNA, 22 nt, Escherichia coli CFT073
cugccgguucggcgucgccgcu

SEQ ID NO: 2670709 - RNA, 14 nt, Escherichia coli CFT073
cugccguaacugcg

SEQ ID NO: 2670710 - RNA, 16 nt, Escherichia coli CFT073
cugccguaacugcgcc

SEQ ID NO: 2670711 - RNA, 15 nt, Escherichia coli CFT073
cugccgucaauuuua

SEQ ID NO: 2670712 - RNA, 16 nt, Escherichia coli CFT073
cugccgucaucgacuu

SEQ ID NO: 2670713 - RNA, 15 nt, Escherichia coli CFT073
cugccguuccuggca

SEQ ID NO: 2670714 - RNA, 12 nt, Escherichia coli CFT073
cugccucaggca

SEQ ID NO: 2670715 - RNA, 14 nt, Escherichia coli CFT073
cugccuccaugaaa

SEQ ID NO: 2670716 - RNA, 22 nt, Escherichia coli CFT073
cugccucccauucaucgccacc

SEQ ID NO: 2670717 - RNA, 15 nt, Escherichia coli CFT073
cugccugaucuuucu

SEQ ID NO: 2670718 - RNA, 20 nt, Escherichia coli CFT073
cugccugaugcgacgcuuga

SEQ ID NO: 2670719 - RNA, 16 nt, Escherichia coli CFT073
cugccugcagcugcuc

SEQ ID NO: 2670720 - RNA, 23 nt, Escherichia coli CFT073
cugccugcggcgaucuucaaacu

SEQ ID NO: 2670721 - RNA, 19 nt, Escherichia coli CFT073
cugccuggauaaggccacc

SEQ ID NO: 2670722 - RNA, 22 nt, Escherichia coli CFT073
cugccuggauaaggccaccagc

SEQ ID NO: 2670723 - RNA, 15 nt, Escherichia coli CFT073
cugccuuccuccggc

SEQ ID NO: 2670724 - RNA, 13 nt, Escherichia coli CFT073
cugccuucgcagu

SEQ ID NO: 2670725 - RNA, 21 nt, Escherichia coli CFT073
cugccuugaguuuuucauccc

SEQ ID NO: 2670726 - RNA, 19 nt, Escherichia coli CFT073
cugccuugugggcuauaac

SEQ ID NO: 2670727 - RNA, 18 nt, Escherichia coli CFT073
cugccuuuuuuauugcuu

SEQ ID NO: 2670728 - RNA, 17 nt, Escherichia coli CFT073
cugcgaaucgcuucauu

SEQ ID NO: 2670729 - RNA, 18 nt, Escherichia coli CFT073
cugcgaaucgcuucauuu

SEQ ID NO: 2670730 - RNA, 20 nt, Escherichia coli CFT073
cugcgaaucuaaaucagguu

SEQ ID NO: 2670731 - RNA, 16 nt, Escherichia coli CFT073
cugcgaauugagauga

SEQ ID NO: 2670732 - RNA, 16 nt, Escherichia coli CFT073
cugcgaauuuccugcc

SEQ ID NO: 2670733 - RNA, 15 nt, Escherichia coli CFT073
cugcgacaccagcau

SEQ ID NO: 2670734 - RNA, 23 nt, Escherichia coli CFT073
cugcgacaccagcauguuccauu

SEQ ID NO: 2670735 - RNA, 18 nt, Escherichia coli CFT073
cugcgacgugcccuuuca

SEQ ID NO: 2670736 - RNA, 15 nt, Escherichia coli CFT073
cugcgauaacggucg

SEQ ID NO: 2670737 - RNA, 20 nt, Escherichia coli CFT073
cugcgauaguggaacaaaga

SEQ ID NO: 2670738 - RNA, 22 nt, Escherichia coli CFT073
cugcgaucgauauucaccguca

SEQ ID NO: 2670739 - RNA, 18 nt, Escherichia coli CFT073
cugcgaucgcaaauccac

SEQ ID NO: 2670740 - RNA, 18 nt, Escherichia coli CFT073
cugcgauuucagcgccgc

SEQ ID NO: 2670741 - RNA, 17 nt, Escherichia coli CFT073
cugcgcagauuagccgg

SEQ ID NO: 2670742 - RNA, 17 nt, Escherichia coli CFT073
cugcgcaucggucgcgu

SEQ ID NO: 2670743 - RNA, 14 nt, Escherichia coli CFT073
cugcgcaucuuccc

SEQ ID NO: 2670744 - RNA, 22 nt, Escherichia coli CFT073
cugcgcauuaaauaccaagcca

SEQ ID NO: 2670745 - RNA, 15 nt, Escherichia coli CFT073
cugcgcauuucccag

SEQ ID NO: 2670746 - RNA, 18 nt, Escherichia coli CFT073
cugcgccaacgucugccu

SEQ ID NO: 2670747 - RNA, 11 nt, Escherichia coli CFT073
cugcgccagac

SEQ ID NO: 2670748 - RNA, 12 nt, Escherichia coli CFT073
cugcgccagcca

SEQ ID NO: 2670749 - RNA, 14 nt, Escherichia coli CFT073
cugcgccagcggga

SEQ ID NO: 2670750 - RNA, 17 nt, Escherichia coli CFT073
cugcgccauauaccgcg

SEQ ID NO: 2670751 - RNA, 20 nt, Escherichia coli CFT073
cugcgccaucaguguuggcg

SEQ ID NO: 2670752 - RNA, 14 nt, Escherichia coli CFT073
cugcgcccgcagcg

SEQ ID NO: 2670753 - RNA, 14 nt, Escherichia coli CFT073
cugcgcccgccagc

SEQ ID NO: 2670754 - RNA, 20 nt, Escherichia coli CFT073
cugcgcccgcccgcuguaag

SEQ ID NO: 2670755 - RNA, 16 nt, Escherichia coli CFT073
cugcgccgaucgucgc

SEQ ID NO: 2670756 - RNA, 18 nt, Escherichia coli CFT073
cugcgccgaucgucgcuc

SEQ ID NO: 2670757 - RNA, 17 nt, Escherichia coli CFT073
cugcgccgcgagcauuu

SEQ ID NO: 2670758 - RNA, 19 nt, Escherichia coli CFT073
cugcgccgggcagagucuc

SEQ ID NO: 2670759 - RNA, 23 nt, Escherichia coli CFT073
cugcgccuaacaacugcuggacg

SEQ ID NO: 2670760 - RNA, 18 nt, Escherichia coli CFT073
cugcgccuuugaugccac

SEQ ID NO: 2670761 - RNA, 13 nt, Escherichia coli CFT073
cugcgcgaaauag

SEQ ID NO: 2670762 - RNA, 16 nt, Escherichia coli CFT073
cugcgcgacucccuga

SEQ ID NO: 2670763 - RNA, 16 nt, Escherichia coli CFT073
cugcgcggaauuuguc

SEQ ID NO: 2670764 - RNA, 23 nt, Escherichia coli CFT073
cugcgcggaccccgcgcucgcgc

SEQ ID NO: 2670765 - RNA, 20 nt, Escherichia coli CFT073
cugcgcguggucagcacaaa

SEQ ID NO: 2670766 - RNA, 21 nt, Escherichia coli CFT073
cugcgcguuuuaucaggccuc

SEQ ID NO: 2670767 - RNA, 14 nt, Escherichia coli CFT073
cugcgcuauccagc

SEQ ID NO: 2670768 - RNA, 13 nt, Escherichia coli CFT073
cugcgcucuucug

SEQ ID NO: 2670769 - RNA, 15 nt, Escherichia coli CFT073
cugcgcugcaccagu

SEQ ID NO: 2670770 - RNA, 23 nt, Escherichia coli CFT073
cugcgcuggcaagaagaucagca

SEQ ID NO: 2670771 - RNA, 12 nt, Escherichia coli CFT073
cugcgcuggcag

SEQ ID NO: 2670772 - RNA, 19 nt, Escherichia coli CFT073
cugcgcuuacacacccggc

SEQ ID NO: 2670773 - RNA, 16 nt, Escherichia coli CFT073
cugcgcuuccaguucc

SEQ ID NO: 2670774 - RNA, 17 nt, Escherichia coli CFT073
cugcgcuugcgcggcag

SEQ ID NO: 2670775 - RNA, 18 nt, Escherichia coli CFT073
cugcgcuugcgcggcagc

SEQ ID NO: 2670776 - RNA, 19 nt, Escherichia coli CFT073
cugcgcuugcgcggcagcu

SEQ ID NO: 2670777 - RNA, 13 nt, Escherichia coli CFT073
cugcgcuuucugc

SEQ ID NO: 2670778 - RNA, 14 nt, Escherichia coli CFT073
cugcgcuuucugcu

SEQ ID NO: 2670779 - RNA, 17 nt, Escherichia coli CFT073
cugcgcuuucugcuucg

SEQ ID NO: 2670780 - RNA, 18 nt, Escherichia coli CFT073
cugcgcuuuguucauguc

SEQ ID NO: 2670781 - RNA, 20 nt, Escherichia coli CFT073
cugcgcuuuuaauucacuuc

SEQ ID NO: 2670782 - RNA, 22 nt, Escherichia coli CFT073
cugcgcuuuuaauucacuucug

SEQ ID NO: 2670783 - RNA, 16 nt, Escherichia coli CFT073
cugcggaagcuaccga

SEQ ID NO: 2670784 - RNA, 12 nt, Escherichia coli CFT073
cugcggaaucac

SEQ ID NO: 2670785 - RNA, 18 nt, Escherichia coli CFT073
cugcggaaucaccggcaa

SEQ ID NO: 2670786 - RNA, 15 nt, Escherichia coli CFT073
cugcggacgucuguu

SEQ ID NO: 2670787 - RNA, 17 nt, Escherichia coli CFT073
cugcggacgucuguuua

SEQ ID NO: 2670788 - RNA, 20 nt, Escherichia coli CFT073
cugcggaugcgccauccagu

SEQ ID NO: 2670789 - RNA, 23 nt, Escherichia coli CFT073
cugcggcaagaauuacuucuuga

SEQ ID NO: 2670790 - RNA, 16 nt, Escherichia coli CFT073
cugcggcauuuccaga

SEQ ID NO: 2670791 - RNA, 14 nt, Escherichia coli CFT073
cugcggccagcagc

SEQ ID NO: 2670792 - RNA, 20 nt, Escherichia coli CFT073
cugcggcgacaaauguugca

SEQ ID NO: 2670793 - RNA, 23 nt, Escherichia coli CFT073
cugcggcugguuacucaccagcc

SEQ ID NO: 2670794 - RNA, 14 nt, Escherichia coli CFT073
cugcgggaacauau

SEQ ID NO: 2670795 - RNA, 13 nt, Escherichia coli CFT073
cugcgggagcgcu

SEQ ID NO: 2670796 - RNA, 17 nt, Escherichia coli CFT073
cugcgggaguugcucca

SEQ ID NO: 2670797 - RNA, 21 nt, Escherichia coli CFT073
cugcgggcgaucauauccagc

SEQ ID NO: 2670798 - RNA, 16 nt, Escherichia coli CFT073
cugcgggcgcaccgca

SEQ ID NO: 2670799 - RNA, 23 nt, Escherichia coli CFT073
cuggacgccaauaccgaucagua

SEQ ID NO: 2670800 - RNA, 19 nt, Escherichia coli CFT073
cuggagagcgccgggcaaa

SEQ ID NO: 2670801 - RNA, 17 nt, Escherichia coli CFT073
cuggagcaaacgcgcca

SEQ ID NO: 2670802 - RNA, 19 nt, Escherichia coli CFT073
cuggagccugauccauacu

SEQ ID NO: 2670803 - RNA, 14 nt, Escherichia coli CFT073
cuggagcuggcgaa

SEQ ID NO: 2670804 - RNA, 14 nt, Escherichia coli CFT073
cuggaggagauauu

SEQ ID NO: 2670805 - RNA, 15 nt, Escherichia coli CFT073
cuggaggagauauug

SEQ ID NO: 2670806 - RNA, 14 nt, Escherichia coli CFT073
cuggaguaaaucag

SEQ ID NO: 2670807 - RNA, 18 nt, Escherichia coli CFT073
cuggaguaaaucagagga

SEQ ID NO: 2670808 - RNA, 23 nt, Escherichia coli CFT073
cuggaguguaaaaaagcgucgcc

SEQ ID NO: 2670809 - RNA, 21 nt, Escherichia coli CFT073
cuggauaaggccaccagcggc

SEQ ID NO: 2670810 - RNA, 21 nt, Escherichia coli CFT073
cuggauaaucacaauggucaa

SEQ ID NO: 2670811 - RNA, 16 nt, Escherichia coli CFT073
cuggaucccagaagau

SEQ ID NO: 2670812 - RNA, 18 nt, Escherichia coli CFT073
cuggaucguggcugagug

SEQ ID NO: 2670813 - RNA, 16 nt, Escherichia coli CFT073
cuggaucuucuucaug

SEQ ID NO: 2670814 - RNA, 18 nt, Escherichia coli CFT073
cuggaugaaauccauauc

SEQ ID NO: 2670815 - RNA, 15 nt, Escherichia coli CFT073
cuggaugaucccuuc

SEQ ID NO: 2670816 - RNA, 13 nt, Escherichia coli CFT073
cuggaugccauuu

SEQ ID NO: 2670817 - RNA, 17 nt, Escherichia coli CFT073
cuggaugccugcauuug

SEQ ID NO: 2670818 - RNA, 19 nt, Escherichia coli CFT073
cuggauggcuugcugcgac

SEQ ID NO: 2670819 - RNA, 15 nt, Escherichia coli CFT073
cuggcaaaguagagc

SEQ ID NO: 2670820 - RNA, 21 nt, Escherichia coli CFT073
cuggcaacacuuuaucugcca

SEQ ID NO: 2670821 - RNA, 23 nt, Escherichia coli CFT073
cuggcaacacuuuaucugccauu

SEQ ID NO: 2670822 - RNA, 15 nt, Escherichia coli CFT073
cuggcaagaaacgcu

SEQ ID NO: 2670823 - RNA, 19 nt, Escherichia coli CFT073
cuggcaagaaacgcuccac

SEQ ID NO: 2670824 - RNA, 17 nt, Escherichia coli CFT073
cuggcaaguucgucuuc

SEQ ID NO: 2670825 - RNA, 21 nt, Escherichia coli CFT073
cuggcaauaauaucccaacgc

SEQ ID NO: 2670826 - RNA, 17 nt, Escherichia coli CFT073
cuggcaaucaccucuuu

SEQ ID NO: 2670827 - RNA, 23 nt, Escherichia coli CFT073
cuggcaaucaugcgcauaaccca

SEQ ID NO: 2670828 - RNA, 14 nt, Escherichia coli CFT073
cuggcaaucgacuc

SEQ ID NO: 2670829 - RNA, 13 nt, Escherichia coli CFT073
cuggcaaucgcca

SEQ ID NO: 2670830 - RNA, 15 nt, Escherichia coli CFT073
cuggcacaagacuga

SEQ ID NO: 2670831 - RNA, 13 nt, Escherichia coli CFT073
cuggcaccaucag

SEQ ID NO: 2670832 - RNA, 21 nt, Escherichia coli CFT073
cuggcaccgcagauaagacca

SEQ ID NO: 2670833 - RNA, 17 nt, Escherichia coli CFT073
cuggcaccgcaucaaag

SEQ ID NO: 2670834 - RNA, 21 nt, Escherichia coli CFT073
cuggcaccgguacacaaccgc

SEQ ID NO: 2670835 - RNA, 14 nt, Escherichia coli CFT073
cuggcacgcucgcg

SEQ ID NO: 2670836 - RNA, 13 nt, Escherichia coli CFT073
cuggcacugccga

SEQ ID NO: 2670837 - RNA, 18 nt, Escherichia coli CFT073
cuggcagaaugaaguaaa

SEQ ID NO: 2670838 - RNA, 17 nt, Escherichia coli CFT073
cuggcagauccugaaau

SEQ ID NO: 2670839 - RNA, 19 nt, Escherichia coli CFT073
cuggcagcaagugcggcgc

SEQ ID NO: 2670840 - RNA, 17 nt, Escherichia coli CFT073
cuggcagccauaaucac

SEQ ID NO: 2670841 - RNA, 17 nt, Escherichia coli CFT073
cuggcagccccguucgc

SEQ ID NO: 2670842 - RNA, 12 nt, Escherichia coli CFT073
cuggcaggcgac

SEQ ID NO: 2670843 - RNA, 21 nt, Escherichia coli CFT073
cuggcagggaaagaaacgcca

SEQ ID NO: 2670844 - RNA, 15 nt, Escherichia coli CFT073
cuggcagugugccug

SEQ ID NO: 2670845 - RNA, 23 nt, Escherichia coli CFT073
cuggcaguucccuacucucgcau

SEQ ID NO: 2670846 - RNA, 19 nt, Escherichia coli CFT073
cuggcauaaacacggcgaa

SEQ ID NO: 2670847 - RNA, 17 nt, Escherichia coli CFT073
cuggcauacaucaacgc

SEQ ID NO: 2670848 - RNA, 21 nt, Escherichia coli CFT073
cuggcauacuccggcggcagc

SEQ ID NO: 2670849 - RNA, 17 nt, Escherichia coli CFT073
cuggcaugaauggucau

SEQ ID NO: 2670850 - RNA, 15 nt, Escherichia coli CFT073
cuggcauuacaagaa

SEQ ID NO: 2670851 - RNA, 21 nt, Escherichia coli CFT073
cuggcauucagaacacaaaac

SEQ ID NO: 2670852 - RNA, 21 nt, Escherichia coli CFT073
cuggcauugccagaaaccagc

SEQ ID NO: 2670853 - RNA, 16 nt, Escherichia coli CFT073
cuggcauuguaggcca

SEQ ID NO: 2670854 - RNA, 16 nt, Escherichia coli CFT073
cuggcauuuugcugcu

SEQ ID NO: 2670855 - RNA, 18 nt, Escherichia coli CFT073
cuggcauuuuugucgcgc

SEQ ID NO: 2670856 - RNA, 16 nt, Escherichia coli CFT073
cuggccaauuggcugg

SEQ ID NO: 2670857 - RNA, 15 nt, Escherichia coli CFT073
cuggccaguccaggu

SEQ ID NO: 2670858 - RNA, 12 nt, Escherichia coli CFT073
cuggccaguucg

SEQ ID NO: 2670859 - RNA, 19 nt, Escherichia coli CFT073
cuggccaguucggauguga

SEQ ID NO: 2670860 - RNA, 15 nt, Escherichia coli CFT073
cuggcccauagacag

SEQ ID NO: 2670861 - RNA, 16 nt, Escherichia coli CFT073
cuggccccaccugcuc

SEQ ID NO: 2670862 - RNA, 14 nt, Escherichia coli CFT073
cuggccgcuucaga

SEQ ID NO: 2670863 - RNA, 19 nt, Escherichia coli CFT073
cuggccgguuugccauaac

SEQ ID NO: 2670864 - RNA, 15 nt, Escherichia coli CFT073
cuggccguacccagc

SEQ ID NO: 2670865 - RNA, 16 nt, Escherichia coli CFT073
cuggccguuugcugcu

SEQ ID NO: 2670866 - RNA, 23 nt, Escherichia coli CFT073
cuggccuagaugaaugacugucc

SEQ ID NO: 2670867 - RNA, 18 nt, Escherichia coli CFT073
cuggccuccagcacuucc

SEQ ID NO: 2670868 - RNA, 13 nt, Escherichia coli CFT073
cuggccuggcgau

SEQ ID NO: 2670869 - RNA, 14 nt, Escherichia coli CFT073
cuggcgaaaggagg

SEQ ID NO: 2670870 - RNA, 19 nt, Escherichia coli CFT073
cuggcgacugccagccaca

SEQ ID NO: 2670871 - RNA, 16 nt, Escherichia coli CFT073
cuggcgagcgccagca

SEQ ID NO: 2670872 - RNA, 22 nt, Escherichia coli CFT073
cuggcgagcgccagcauggcac

SEQ ID NO: 2670873 - RNA, 14 nt, Escherichia coli CFT073
cuggcgagugcauc

SEQ ID NO: 2670874 - RNA, 19 nt, Escherichia coli CFT073
cuggcgauauugccgcgau

SEQ ID NO: 2670875 - RNA, 23 nt, Escherichia coli CFT073
cuggcgauauugccgcgauagca

SEQ ID NO: 2670876 - RNA, 22 nt, Escherichia coli CFT073
cuggcgaugcccccaggagcgc

SEQ ID NO: 2670877 - RNA, 18 nt, Escherichia coli CFT073
cuggcgcaacacccugau

SEQ ID NO: 2670878 - RNA, 20 nt, Escherichia coli CFT073
cuggcgcaacacccugaugu

SEQ ID NO: 2670879 - RNA, 23 nt, Escherichia coli CFT073
cuggcgcaauauucaagauaacg

SEQ ID NO: 2670880 - RNA, 20 nt, Escherichia coli CFT073
cuggcgcacguucugucgcu

SEQ ID NO: 2670881 - RNA, 17 nt, Escherichia coli CFT073
cuggcgcagcaggcggu

SEQ ID NO: 2670882 - RNA, 19 nt, Escherichia coli CFT073
cuggcgcagcgcagcgcca

SEQ ID NO: 2670883 - RNA, 19 nt, Escherichia coli CFT073
cuggcgcauuaacggcaag

SEQ ID NO: 2670884 - RNA, 17 nt, Escherichia coli CFT073
cuggcgcgcuauuacca

SEQ ID NO: 2670885 - RNA, 13 nt, Escherichia coli CFT073
cuggcgcggcgca

SEQ ID NO: 2670886 - RNA, 14 nt, Escherichia coli CFT073
cuggcgcggcgcaa

SEQ ID NO: 2670887 - RNA, 18 nt, Escherichia coli CFT073
cuggcgcuaacguuaauc

SEQ ID NO: 2670888 - RNA, 15 nt, Escherichia coli CFT073
cuggcgcugcucagg

SEQ ID NO: 2670889 - RNA, 16 nt, Escherichia coli CFT073
cuggcgcugcucaggc

SEQ ID NO: 2670890 - RNA, 18 nt, Escherichia coli CFT073
cuggcgcuuugaaacgca

SEQ ID NO: 2670891 - RNA, 22 nt, Escherichia coli CFT073
cuggcggaucugaucagcacga

SEQ ID NO: 2670892 - RNA, 18 nt, Escherichia coli CFT073
cuggcggcaaucgccaga

SEQ ID NO: 2670893 - RNA, 13 nt, Escherichia coli CFT073
cuggcggcagcag

SEQ ID NO: 2670894 - RNA, 15 nt, Escherichia coli CFT073
cuggcggcgcucgau

SEQ ID NO: 2670895 - RNA, 18 nt, Escherichia coli CFT073
cuggcggcgugaugccga

SEQ ID NO: 2670896 - RNA, 19 nt, Escherichia coli CFT073
cuggcgggaauaaaagcca

SEQ ID NO: 2670897 - RNA, 20 nt, Escherichia coli CFT073
cuggcgggaauaaaagccag

SEQ ID NO: 2670898 - RNA, 20 nt, Escherichia coli CFT073
cuggcgguuacgaaagcgcg

SEQ ID NO: 2670899 - RNA, 17 nt, Escherichia coli CFT073
cuggcguacagagggca

SEQ ID NO: 2670900 - RNA, 17 nt, Escherichia coli CFT073
cuggcguaucuccagua

SEQ ID NO: 2670901 - RNA, 23 nt, Escherichia coli CFT073
cuggcgucacgccgaccagaccg

SEQ ID NO: 2670902 - RNA, 15 nt, Escherichia coli CFT073
cuggcgucuccuccc

SEQ ID NO: 2670903 - RNA, 16 nt, Escherichia coli CFT073
cuggcgugaaauucac

SEQ ID NO: 2670904 - RNA, 22 nt, Escherichia coli CFT073
cuggcguguugcuccacgccag

SEQ ID NO: 2670905 - RNA, 23 nt, Escherichia coli CFT073
cuggcguuaagcauucgcgaggu

SEQ ID NO: 2670906 - RNA, 19 nt, Escherichia coli CFT073
cuggcguuacccagcgcca

SEQ ID NO: 2670907 - RNA, 19 nt, Escherichia coli CFT073
cuggcguuguccgccagaa

SEQ ID NO: 2670908 - RNA, 18 nt, Escherichia coli CFT073
cuggcucaucgccuucca

SEQ ID NO: 2670909 - RNA, 20 nt, Escherichia coli CFT073
cuggcucauuaguuaauuca

SEQ ID NO: 2670910 - RNA, 18 nt, Escherichia coli CFT073
cuggcucgccgcagccaa

SEQ ID NO: 2670911 - RNA, 23 nt, Escherichia coli CFT073
cuggcugaacgccugcaccagcc

SEQ ID NO: 2670912 - RNA, 15 nt, Escherichia coli CFT073
cuggcugaaucccug

SEQ ID NO: 2670913 - RNA, 20 nt, Escherichia coli CFT073
cuggcugacauaaacaccag

SEQ ID NO: 2670914 - RNA, 16 nt, Escherichia coli CFT073
cuggcugaugcuggca

SEQ ID NO: 2670915 - RNA, 23 nt, Escherichia coli CFT073
cuggcugccagcccgcugguugu

SEQ ID NO: 2670916 - RNA, 15 nt, Escherichia coli CFT073
cuggcuggcaaccca

SEQ ID NO: 2670917 - RNA, 12 nt, Escherichia coli CFT073
cuggcuggcgcu

SEQ ID NO: 2670918 - RNA, 18 nt, Escherichia coli CFT073
cuggcugggcgucauccc

SEQ ID NO: 2670919 - RNA, 22 nt, Escherichia coli CFT073
cuggcuggggaaggcaaagucc

SEQ ID NO: 2670920 - RNA, 16 nt, Escherichia coli CFT073
cuggcugguggaacag

SEQ ID NO: 2670921 - RNA, 23 nt, Escherichia coli CFT073
cuggcuguaaaauuauccucuuc

SEQ ID NO: 2670922 - RNA, 16 nt, Escherichia coli CFT073
cuggcuguauuuuucc

SEQ ID NO: 2670923 - RNA, 19 nt, Escherichia coli CFT073
cuggcugucgaucuccggc

SEQ ID NO: 2670924 - RNA, 15 nt, Escherichia coli CFT073
cuggcuguuacucaa

SEQ ID NO: 2670925 - RNA, 14 nt, Escherichia coli CFT073
cuggcuguuaucgc

SEQ ID NO: 2670926 - RNA, 17 nt, Escherichia coli CFT073
cuggcuguuaucgcuga

SEQ ID NO: 2670927 - RNA, 20 nt, Escherichia coli CFT073
cuggcuguuucgcuucuuca

SEQ ID NO: 2670928 - RNA, 18 nt, Escherichia coli CFT073
cuggcuucuaucuucauc

SEQ ID NO: 2670929 - RNA, 19 nt, Escherichia coli CFT073
cuggcuucuaucuucaucu

SEQ ID NO: 2670930 - RNA, 15 nt, Escherichia coli CFT073
cuggcuugccagcca

SEQ ID NO: 2670931 - RNA, 16 nt, Escherichia coli CFT073
cuggcuugcugccccc

SEQ ID NO: 2670932 - RNA, 13 nt, Escherichia coli CFT073
cuggcuuucauuu

SEQ ID NO: 2670933 - RNA, 16 nt, Escherichia coli CFT073
cugggaaaucaccacc

SEQ ID NO: 2670934 - RNA, 22 nt, Escherichia coli CFT073
cugggaaaucaccaccagcacc

SEQ ID NO: 2670935 - RNA, 22 nt, Escherichia coli CFT073
cugggagaugauaaccccgcaa

SEQ ID NO: 2670936 - RNA, 21 nt, Escherichia coli CFT073
cugggauauaaacucgccaaa

SEQ ID NO: 2670937 - RNA, 19 nt, Escherichia coli CFT073
cugggaucguagccuugua

SEQ ID NO: 2670938 - RNA, 18 nt, Escherichia coli CFT073
cugggaucugauuuucuu

SEQ ID NO: 2670939 - RNA, 16 nt, Escherichia coli CFT073
cugggauucacguuga

SEQ ID NO: 2670940 - RNA, 18 nt, Escherichia coli CFT073
cugggauuuggcagcacc

SEQ ID NO: 2670941 - RNA, 15 nt, Escherichia coli CFT073
cugggcaauggugaa

SEQ ID NO: 2670942 - RNA, 16 nt, Escherichia coli CFT073
cugggcaauggugaac

SEQ ID NO: 2670943 - RNA, 14 nt, Escherichia coli CFT073
cugggccugcauau

SEQ ID NO: 2670944 - RNA, 14 nt, Escherichia coli CFT073
cugggcgagguggg

SEQ ID NO: 2670945 - RNA, 19 nt, Escherichia coli CFT073
cugggcgaucggcaggaaa

SEQ ID NO: 2670946 - RNA, 23 nt, Escherichia coli CFT073
cugggcgauuuucuacuucuuuc

SEQ ID NO: 2670947 - RNA, 12 nt, Escherichia coli CFT073
cugggcgcggcc

SEQ ID NO: 2670948 - RNA, 20 nt, Escherichia coli CFT073
cugggcuaccgcgagcguag

SEQ ID NO: 2670949 - RNA, 13 nt, Escherichia coli CFT073
cugggcuguuacc

SEQ ID NO: 2670950 - RNA, 14 nt, Escherichia coli CFT073
cugggcuucaccac

SEQ ID NO: 2670951 - RNA, 19 nt, Escherichia coli CFT073
cugggcuucauccagcagc

SEQ ID NO: 2670952 - RNA, 20 nt, Escherichia coli CFT073
cugggcuucauccagcagcg

SEQ ID NO: 2670953 - RNA, 15 nt, Escherichia coli CFT073
cuggggucaucagca

SEQ ID NO: 2670954 - RNA, 19 nt, Escherichia coli CFT073
cuggguagaguuugaacuc

SEQ ID NO: 2670955 - RNA, 21 nt, Escherichia coli CFT073
cuggguagaguuugaacucac

SEQ ID NO: 2670956 - RNA, 19 nt, Escherichia coli CFT073
cuggguagcuuccugcugu

SEQ ID NO: 2670957 - RNA, 14 nt, Escherichia coli CFT073
cuggguauucagcg

SEQ ID NO: 2670958 - RNA, 17 nt, Escherichia coli CFT073
cugggugaugguccagu

SEQ ID NO: 2670959 - RNA, 22 nt, Escherichia coli CFT073
cuggguguauuguuccucguuc

SEQ ID NO: 2670960 - RNA, 20 nt, Escherichia coli CFT073
cuggguuucgccugccagau

SEQ ID NO: 2670961 - RNA, 14 nt, Escherichia coli CFT073
cuggguuuucacag

SEQ ID NO: 2670962 - RNA, 22 nt, Escherichia coli CFT073
cugguaaacgacccugccacag

SEQ ID NO: 2670963 - RNA, 17 nt, Escherichia coli CFT073
cugguaacugccagggc

SEQ ID NO: 2670964 - RNA, 12 nt, Escherichia coli CFT073
cugguaacugua

SEQ ID NO: 2670965 - RNA, 14 nt, Escherichia coli CFT073
cugguaaucaccac

SEQ ID NO: 2670966 - RNA, 23 nt, Escherichia coli CFT073
cugguaaucgcggguugccauug

SEQ ID NO: 2670967 - RNA, 22 nt, Escherichia coli CFT073
cugguacgcgcaccgcgugaug

SEQ ID NO: 2670968 - RNA, 16 nt, Escherichia coli CFT073
cugguagcgcauuuca

SEQ ID NO: 2670969 - RNA, 21 nt, Escherichia coli CFT073
cugguaguuguacaacugcuu

SEQ ID NO: 2670970 - RNA, 14 nt, Escherichia coli CFT073
cugguaugccugga

SEQ ID NO: 2670971 - RNA, 16 nt, Escherichia coli CFT073
cuggucaaagacaaua

SEQ ID NO: 2670972 - RNA, 18 nt, Escherichia coli CFT073
cuggucaaccgcaccaaa

SEQ ID NO: 2670973 - RNA, 19 nt, Escherichia coli CFT073
cuggucagcaucgucaacg

SEQ ID NO: 2670974 - RNA, 22 nt, Escherichia coli CFT073
cuggucaggccaaacuacgcug

SEQ ID NO: 2670975 - RNA, 14 nt, Escherichia coli CFT073
cuggucaucaaguu

SEQ ID NO: 2670976 - RNA, 13 nt, Escherichia coli CFT073
cuggucgagaucg

SEQ ID NO: 2670977 - RNA, 20 nt, Escherichia coli CFT073
cuggucgaggaucucugcaa

SEQ ID NO: 2670978 - RNA, 14 nt, Escherichia coli CFT073
cuggucgcgcggca

SEQ ID NO: 2670979 - RNA, 20 nt, Escherichia coli CFT073
cuggugaaagagccaucauu

SEQ ID NO: 2670980 - RNA, 12 nt, Escherichia coli CFT073
cuggugaauauc

SEQ ID NO: 2670981 - RNA, 13 nt, Escherichia coli CFT073
cuggugaauaucg

SEQ ID NO: 2670982 - RNA, 19 nt, Escherichia coli CFT073
cuggugagugcgguuuugu

SEQ ID NO: 2670983 - RNA, 18 nt, Escherichia coli CFT073
cuggugauucagggcagc

SEQ ID NO: 2670984 - RNA, 15 nt, Escherichia coli CFT073
cuggugcaggcguua

SEQ ID NO: 2670985 - RNA, 15 nt, Escherichia coli CFT073
cuggugccagcgcca

SEQ ID NO: 2670986 - RNA, 14 nt, Escherichia coli CFT073
cuggugcccaucac

SEQ ID NO: 2670987 - RNA, 21 nt, Escherichia coli CFT073
cugguggccaucggcccguua

SEQ ID NO: 2670988 - RNA, 22 nt, Escherichia coli CFT073
cugguggggcaaaaacccuucu

SEQ ID NO: 2670989 - RNA, 16 nt, Escherichia coli CFT073
cugguggugaugguau

SEQ ID NO: 2670990 - RNA, 20 nt, Escherichia coli CFT073
cugguguggagugcagcacu

SEQ ID NO: 2670991 - RNA, 23 nt, Escherichia coli CFT073
cugguguucuuuuacgcuaccau

SEQ ID NO: 2670992 - RNA, 22 nt, Escherichia coli CFT073
cugguuaguuucagcgcgggga

SEQ ID NO: 2670993 - RNA, 21 nt, Escherichia coli CFT073
cugguuaucuuccaccaccac

SEQ ID NO: 2670994 - RNA, 14 nt, Escherichia coli CFT073
cugguucaggcguu

SEQ ID NO: 2670995 - RNA, 20 nt, Escherichia coli CFT073
cugguucaggcguuucuuca

SEQ ID NO: 2670996 - RNA, 13 nt, Escherichia coli CFT073
cugguucagucgu

SEQ ID NO: 2670997 - RNA, 16 nt, Escherichia coli CFT073
cugguucccaacaaca

SEQ ID NO: 2670998 - RNA, 11 nt, Escherichia coli CFT073
cugguucccag

SEQ ID NO: 2670999 - RNA, 21 nt, Escherichia coli CFT073
cugguucccagagcuuuugcc

SEQ ID NO: 2671000 - RNA, 15 nt, Escherichia coli CFT073
cugguucguuuauua

SEQ ID NO: 2671001 - RNA, 15 nt, Escherichia coli CFT073
cugguugaaauaaac

SEQ ID NO: 2671002 - RNA, 17 nt, Escherichia coli CFT073
cugguugaaauaaacca

SEQ ID NO: 2671003 - RNA, 18 nt, Escherichia coli CFT073
cugguugacgcguaaauc

SEQ ID NO: 2671004 - RNA, 19 nt, Escherichia coli CFT073
cugguugauauuuuccugc

SEQ ID NO: 2671005 - RNA, 22 nt, Escherichia coli CFT073
cugguugaucaauucgagcauc

SEQ ID NO: 2671006 - RNA, 14 nt, Escherichia coli CFT073
cugguuucucuccg

SEQ ID NO: 2671007 - RNA, 20 nt, Escherichia coli CFT073
cugguuuucagcgaaacagc

SEQ ID NO: 2671008 - RNA, 15 nt, Escherichia coli CFT073
cugguuuugaaaaga

SEQ ID NO: 2671009 - RNA, 13 nt, Escherichia coli CFT073
cugguuuugccau

SEQ ID NO: 2671010 - RNA, 16 nt, Escherichia coli CFT073
cugguuuuuuauauuc

SEQ ID NO: 2671011 - RNA, 15 nt, Escherichia coli CFT073
cuguaaacuccuuuc

SEQ ID NO: 2671012 - RNA, 14 nt, Escherichia coli CFT073
cuguaaaucugccg

SEQ ID NO: 2671013 - RNA, 15 nt, Escherichia coli CFT073
cuguaaaucugccgu

SEQ ID NO: 2671014 - RNA, 21 nt, Escherichia coli CFT073
cuguaacaaggugaaucaagc

SEQ ID NO: 2671015 - RNA, 19 nt, Escherichia coli CFT073
cugugucucuucuuugcug

SEQ ID NO: 2671016 - RNA, 21 nt, Escherichia coli CFT073
cuguguuggguucacuuuccc

SEQ ID NO: 2671017 - RNA, 12 nt, Escherichia coli CFT073
cuguguuguucu

SEQ ID NO: 2671018 - RNA, 21 nt, Escherichia coli CFT073
cuguuaagaagggcuggccaa

SEQ ID NO: 2671019 - RNA, 19 nt, Escherichia coli CFT073
cuguuaagcccauuuuuuu

SEQ ID NO: 2671020 - RNA, 17 nt, Escherichia coli CFT073
cuguuaccgcugcuggc

SEQ ID NO: 2671021 - RNA, 23 nt, Escherichia coli CFT073
cuguuacuacagaggguuuuuua

SEQ ID NO: 2671022 - RNA, 23 nt, Escherichia coli CFT073
cuguuacucauaaguuucccagc

SEQ ID NO: 2671023 - RNA, 12 nt, Escherichia coli CFT073
cuguuauauauu

SEQ ID NO: 2671024 - RNA, 21 nt, Escherichia coli CFT073
cuguucaaaugcgcucagagu

SEQ ID NO: 2671025 - RNA, 12 nt, Escherichia coli CFT073
cuguucaacaau

SEQ ID NO: 2671026 - RNA, 19 nt, Escherichia coli CFT073
cuguucacgaccaucaacc

SEQ ID NO: 2671027 - RNA, 23 nt, Escherichia coli CFT073
cuguucagacauuaagcaucgca

SEQ ID NO: 2671028 - RNA, 21 nt, Escherichia coli CFT073
cuguucaucccgaccagugca

SEQ ID NO: 2671029 - RNA, 14 nt, Escherichia coli CFT073
cuguucaucuggcg

SEQ ID NO: 2671030 - RNA, 17 nt, Escherichia coli CFT073
cuguucauuuuguaggc

SEQ ID NO: 2671031 - RNA, 20 nt, Escherichia coli CFT073
cuguucauuuuguaggccug

SEQ ID NO: 2671032 - RNA, 22 nt, Escherichia coli CFT073
cuguuccaguacggauaaugga

SEQ ID NO: 2671033 - RNA, 15 nt, Escherichia coli CFT073
cuguuccggcuuugu

SEQ ID NO: 2671034 - RNA, 13 nt, Escherichia coli CFT073
cuguuccucaacu

SEQ ID NO: 2671035 - RNA, 19 nt, Escherichia coli CFT073
cuguucgaacauuagcgca

SEQ ID NO: 2671036 - RNA, 17 nt, Escherichia coli CFT073
cuguucgagguaaucca

SEQ ID NO: 2671037 - RNA, 19 nt, Escherichia coli CFT073
cuguucgagguaauccagc

SEQ ID NO: 2671038 - RNA, 20 nt, Escherichia coli CFT073
cuguucgagguaauccagcg

SEQ ID NO: 2671039 - RNA, 20 nt, Escherichia coli CFT073
cuguucgcaaccuaaccaaa

SEQ ID NO: 2671040 - RNA, 15 nt, Escherichia coli CFT073
cuguucgccagugca

SEQ ID NO: 2671041 - RNA, 18 nt, Escherichia coli CFT073
cuguucgccgccgcuuuc

SEQ ID NO: 2671042 - RNA, 14 nt, Escherichia coli CFT073
cuguucgcgguuuu

SEQ ID NO: 2671043 - RNA, 14 nt, Escherichia coli CFT073
cuguucgcugguga

SEQ ID NO: 2671044 - RNA, 15 nt, Escherichia coli CFT073
cuguucggacggcga

SEQ ID NO: 2671045 - RNA, 20 nt, Escherichia coli CFT073
cuguucggaugagucggcgu

SEQ ID NO: 2671046 - RNA, 13 nt, Escherichia coli CFT073
cuguucugauuuu

SEQ ID NO: 2671047 - RNA, 21 nt, Escherichia coli CFT073
cuguucuggcguaucuccagu

SEQ ID NO: 2671048 - RNA, 21 nt, Escherichia coli CFT073
cuguucuuucaacacaugcac

SEQ ID NO: 2671049 - RNA, 14 nt, Escherichia coli CFT073
cuguugaaauacaa

SEQ ID NO: 2671050 - RNA, 15 nt, Escherichia coli CFT073
cuguugaccaagaac

SEQ ID NO: 2671051 - RNA, 17 nt, Escherichia coli CFT073
cuguugauaaaacacuc

SEQ ID NO: 2671052 - RNA, 21 nt, Escherichia coli CFT073
cuguugcccaugcuucugcac

SEQ ID NO: 2671053 - RNA, 18 nt, Escherichia coli CFT073
cuguugcccuuugcuggc

SEQ ID NO: 2671054 - RNA, 17 nt, Escherichia coli CFT073
cuguugccugcacucag

SEQ ID NO: 2671055 - RNA, 14 nt, Escherichia coli CFT073
cuguugcgguuucu

SEQ ID NO: 2671056 - RNA, 18 nt, Escherichia coli CFT073
cuguugguaacuuacuga

SEQ ID NO: 2671057 - RNA, 19 nt, Escherichia coli CFT073
cuguuggugccagauagcc

SEQ ID NO: 2671058 - RNA, 21 nt, Escherichia coli CFT073
cuguuguaguuggaugacauu

SEQ ID NO: 2671059 - RNA, 15 nt, Escherichia coli CFT073
cuguugugaugcaac

SEQ ID NO: 2671060 - RNA, 22 nt, Escherichia coli CFT073
cuguugugccacauccagcggc

SEQ ID NO: 2671061 - RNA, 17 nt, Escherichia coli CFT073
cuguuguggguaacguu

SEQ ID NO: 2671062 - RNA, 14 nt, Escherichia coli CFT073
cuguuguuccagcu

SEQ ID NO: 2671063 - RNA, 20 nt, Escherichia coli CFT073
cuguuguuccagcuuccagg

SEQ ID NO: 2671064 - RNA, 12 nt, Escherichia coli CFT073
cuguuuaagcga

SEQ ID NO: 2671065 - RNA, 18 nt, Escherichia coli CFT073
cuguuuaauaugcaauuc

SEQ ID NO: 2671066 - RNA, 15 nt, Escherichia coli CFT073
cuguuuaccggugcc

SEQ ID NO: 2671067 - RNA, 13 nt, Escherichia coli CFT073
cuguuuagccgcu

SEQ ID NO: 2671068 - RNA, 19 nt, Escherichia coli CFT073
cuguuuagccgcuucugca

SEQ ID NO: 2671069 - RNA, 23 nt, Escherichia coli CFT073
cuguuuagccgcuucugcagcuu

SEQ ID NO: 2671070 - RNA, 15 nt, Escherichia coli CFT073
cuguuuauuguugau

SEQ ID NO: 2671071 - RNA, 20 nt, Escherichia coli CFT073
cuguuucacgcccagaucca

SEQ ID NO: 2671072 - RNA, 15 nt, Escherichia coli CFT073
cuguuucaguaacug

SEQ ID NO: 2671073 - RNA, 14 nt, Escherichia coli CFT073
cuguuuccaguuac

SEQ ID NO: 2671074 - RNA, 19 nt, Escherichia coli CFT073
cuguuucgcggcaaacugc

SEQ ID NO: 2671075 - RNA, 12 nt, Escherichia coli CFT073
cuguuucugucg

SEQ ID NO: 2671076 - RNA, 21 nt, Escherichia coli CFT073
cuguuucugucgagcaucacu

SEQ ID NO: 2671077 - RNA, 20 nt, Escherichia coli CFT073
cuguuucuguugccagcagu

SEQ ID NO: 2671078 - RNA, 17 nt, Escherichia coli CFT073
cuguuugaucugcugcc

SEQ ID NO: 2671079 - RNA, 20 nt, Escherichia coli CFT073
cuguuugcgucagcuucaga

SEQ ID NO: 2671080 - RNA, 16 nt, Escherichia coli CFT073
cuguuugcgucauggu

SEQ ID NO: 2671081 - RNA, 16 nt, Escherichia coli CFT073
cuguuuucgauuuuuu

SEQ ID NO: 2671082 - RNA, 22 nt, Escherichia coli CFT073
cuguuuucgauuuuuuccagcg

SEQ ID NO: 2671083 - RNA, 16 nt, Escherichia coli CFT073
cuuaaaaaccagagaa

SEQ ID NO: 2671084 - RNA, 14 nt, Escherichia coli CFT073
cuuaaaagcacaga

SEQ ID NO: 2671085 - RNA, 21 nt, Escherichia coli CFT073
cuuaacaccggcgcacuggcg

SEQ ID NO: 2671086 - RNA, 18 nt, Escherichia coli CFT073
cuuaaccggcuucguuuu

SEQ ID NO: 2671087 - RNA, 18 nt, Escherichia coli CFT073
cuuaacgcgggcuucuuc

SEQ ID NO: 2671088 - RNA, 22 nt, Escherichia coli CFT073
cuuaacgcgggcuucuucuuuc

SEQ ID NO: 2671089 - RNA, 11 nt, Escherichia coli CFT073
cuuaacggcag

SEQ ID NO: 2671090 - RNA, 20 nt, Escherichia coli CFT073
cuuaacggcagcgccugcag

SEQ ID NO: 2671091 - RNA, 22 nt, Escherichia coli CFT073
cuuaacgguuuuaccuucugcu

SEQ ID NO: 2671092 - RNA, 13 nt, Escherichia coli CFT073
cuuaacuacugcu

SEQ ID NO: 2671093 - RNA, 22 nt, Escherichia coli CFT073
cuuaacugccauuucauaaauu

SEQ ID NO: 2671094 - RNA, 16 nt, Escherichia coli CFT073
cuuaagauaagaauaa

SEQ ID NO: 2671095 - RNA, 20 nt, Escherichia coli CFT073
cuuaagauaagaauaauaag

SEQ ID NO: 2671096 - RNA, 15 nt, Escherichia coli CFT073
cuuaagaucaacuuc

SEQ ID NO: 2671097 - RNA, 20 nt, Escherichia coli CFT073
cuuaagauucggcuucuucc

SEQ ID NO: 2671098 - RNA, 18 nt, Escherichia coli CFT073
cuuaagccaucaucaaua

SEQ ID NO: 2671099 - RNA, 14 nt, Escherichia coli CFT073
cuuaagcgccugau

SEQ ID NO: 2671100 - RNA, 20 nt, Escherichia coli CFT073
cuuaaggcuguucccacgca

SEQ ID NO: 2671101 - RNA, 17 nt, Escherichia coli CFT073
cuuaagguucacuuaau

SEQ ID NO: 2671102 - RNA, 13 nt, Escherichia coli CFT073
cuuaagguuuuuu

SEQ ID NO: 2671103 - RNA, 16 nt, Escherichia coli CFT073
cuuaagguuuuuuccu

SEQ ID NO: 2671104 - RNA, 16 nt, Escherichia coli CFT073
cuuaauaagaaaaaag

SEQ ID NO: 2671105 - RNA, 22 nt, Escherichia coli CFT073
cuuaauaauucccgugcugcuu

SEQ ID NO: 2671106 - RNA, 17 nt, Escherichia coli CFT073
cuuaauaccggcaucca

SEQ ID NO: 2671107 - RNA, 16 nt, Escherichia coli CFT073
cuuaauagcugccagc

SEQ ID NO: 2671108 - RNA, 11 nt, Escherichia coli CFT073
cuuaaucaacu

SEQ ID NO: 2671109 - RNA, 13 nt, Escherichia coli CFT073
cuuaaucaccagc

SEQ ID NO: 2671110 - RNA, 16 nt, Escherichia coli CFT073
cuuaaucaucaaugcc

SEQ ID NO: 2671111 - RNA, 12 nt, Escherichia coli CFT073
cuuaaugaaaag

SEQ ID NO: 2671112 - RNA, 20 nt, Escherichia coli CFT073
cuuaaugcaggcagcacugc

SEQ ID NO: 2671113 - RNA, 23 nt, Escherichia coli CFT073
cuuaaugcccaucucuucuucaa

SEQ ID NO: 2671114 - RNA, 21 nt, Escherichia coli CFT073
cuuaaugucacaaucccuucc

SEQ ID NO: 2671115 - RNA, 17 nt, Escherichia coli CFT073
cuuaauuuugguaauuc

SEQ ID NO: 2671116 - RNA, 17 nt, Escherichia coli CFT073
cuuacauauauuacuca

SEQ ID NO: 2671117 - RNA, 21 nt, Escherichia coli CFT073
cuuacauauauuacucauuaa

SEQ ID NO: 2671118 - RNA, 11 nt, Escherichia coli CFT073
cuuacauucug

SEQ ID NO: 2671119 - RNA, 16 nt, Escherichia coli CFT073
cuuacauucugucuca

SEQ ID NO: 2671120 - RNA, 14 nt, Escherichia coli CFT073
cuuaccaaccgcaa

SEQ ID NO: 2671121 - RNA, 15 nt, Escherichia coli CFT073
cuuaccaaccgcaau

SEQ ID NO: 2671122 - RNA, 16 nt, Escherichia coli CFT073
cuuaccauccacacca

SEQ ID NO: 2671123 - RNA, 18 nt, Escherichia coli CFT073
cuucaccaauguucaguu

SEQ ID NO: 2671124 - RNA, 15 nt, Escherichia coli CFT073
cuucaccaccagaaa

SEQ ID NO: 2671125 - RNA, 20 nt, Escherichia coli CFT073
cuucaccacgccccacgcca

SEQ ID NO: 2671126 - RNA, 19 nt, Escherichia coli CFT073
cuucaccagugaucuggcu

SEQ ID NO: 2671127 - RNA, 15 nt, Escherichia coli CFT073
cuucacccgcagcac

SEQ ID NO: 2671128 - RNA, 20 nt, Escherichia coli CFT073
cuucacccguugaucuucuc

SEQ ID NO: 2671129 - RNA, 21 nt, Escherichia coli CFT073
cuucacccguugaucuucucu

SEQ ID NO: 2671130 - RNA, 20 nt, Escherichia coli CFT073
cuucaccgguaguaagcguu

SEQ ID NO: 2671131 - RNA, 22 nt, Escherichia coli CFT073
cuucaccguggucuuuugccuc

SEQ ID NO: 2671132 - RNA, 17 nt, Escherichia coli CFT073
cuucaccuacgcuggca

SEQ ID NO: 2671133 - RNA, 20 nt, Escherichia coli CFT073
cuucaccugccugcagcugc

SEQ ID NO: 2671134 - RNA, 15 nt, Escherichia coli CFT073
cuucacgcaccauaa

SEQ ID NO: 2671135 - RNA, 18 nt, Escherichia coli CFT073
cuucacgcggguugccac

SEQ ID NO: 2671136 - RNA, 16 nt, Escherichia coli CFT073
cuucacgggcaaccac

SEQ ID NO: 2671137 - RNA, 22 nt, Escherichia coli CFT073
cuucacggguugcgccuguguu

SEQ ID NO: 2671138 - RNA, 13 nt, Escherichia coli CFT073
cuucacucucuuu

SEQ ID NO: 2671139 - RNA, 22 nt, Escherichia coli CFT073
cuucacuggcgacacgcaucac

SEQ ID NO: 2671140 - RNA, 22 nt, Escherichia coli CFT073
cuucacuucagcgaaaucacgc

SEQ ID NO: 2671141 - RNA, 15 nt, Escherichia coli CFT073
cuucagaagaucgga

SEQ ID NO: 2671142 - RNA, 14 nt, Escherichia coli CFT073
cuucagaauggaaa

SEQ ID NO: 2671143 - RNA, 20 nt, Escherichia coli CFT073
cuucagaucgaaaucuuuuu

SEQ ID NO: 2671144 - RNA, 19 nt, Escherichia coli CFT073
cuucagcaagaguuuuaaa

SEQ ID NO: 2671145 - RNA, 20 nt, Escherichia coli CFT073
cuucagcaagaguuuuaaaa

SEQ ID NO: 2671146 - RNA, 23 nt, Escherichia coli CFT073
cuucagcaagaguuuuaaaacca

SEQ ID NO: 2671147 - RNA, 14 nt, Escherichia coli CFT073
cuucagcaaggcuu

SEQ ID NO: 2671148 - RNA, 20 nt, Escherichia coli CFT073
cuucagcaaggcuuuccaga

SEQ ID NO: 2671149 - RNA, 21 nt, Escherichia coli CFT073
cuucagcaaggcuuuccagac

SEQ ID NO: 2671150 - RNA, 21 nt, Escherichia coli CFT073
cuucagcaauuuguucacacc

SEQ ID NO: 2671151 - RNA, 22 nt, Escherichia coli CFT073
cuucagcagcagccgcgcuuuc

SEQ ID NO: 2671152 - RNA, 24 nt, Escherichia coli CFT073
cuucagccaaagcgacacaaucaa

SEQ ID NO: 2671153 - RNA, 23 nt, Escherichia coli CFT073
cuucagccacucggacaccucac

SEQ ID NO: 2671154 - RNA, 19 nt, Escherichia coli CFT073
cuucagccagaggcggcaa

SEQ ID NO: 2671155 - RNA, 11 nt, Escherichia coli CFT073
cuucagcgaug

SEQ ID NO: 2671156 - RNA, 16 nt, Escherichia coli CFT073
cuucagcguaucccag

SEQ ID NO: 2671157 - RNA, 22 nt, Escherichia coli CFT073
cuucagcgucuucgccgucagu

SEQ ID NO: 2671158 - RNA, 18 nt, Escherichia coli CFT073
cuucagcuguuucaguaa

SEQ ID NO: 2671159 - RNA, 23 nt, Escherichia coli CFT073
cuucagcuguuucaguaacuggc

SEQ ID NO: 2671160 - RNA, 23 nt, Escherichia coli CFT073
cuucagcuucggcgacuauuuca

SEQ ID NO: 2671161 - RNA, 22 nt, Escherichia coli CFT073
cuucaggccagccugauccacu

SEQ ID NO: 2671162 - RNA, 22 nt, Escherichia coli CFT073
cuucagggcgcacgcacggcgu

SEQ ID NO: 2671163 - RNA, 19 nt, Escherichia coli CFT073
cuucaggugcgcaauauca

SEQ ID NO: 2671164 - RNA, 11 nt, Escherichia coli CFT073
cuucagguuca

SEQ ID NO: 2671165 - RNA, 14 nt, Escherichia coli CFT073
cuucagucaggcga

SEQ ID NO: 2671166 - RNA, 16 nt, Escherichia coli CFT073
cuucagucaggcgauu

SEQ ID NO: 2671167 - RNA, 23 nt, Escherichia coli CFT073
cuucagucaggcgauuguuuaga

SEQ ID NO: 2671168 - RNA, 22 nt, Escherichia coli CFT073
cuucagugagcugucugucaaa

SEQ ID NO: 2671169 - RNA, 17 nt, Escherichia coli CFT073
cuucauaccauauuguu

SEQ ID NO: 2671170 - RNA, 18 nt, Escherichia coli CFT073
cuucauaccauauuguuu

SEQ ID NO: 2671171 - RNA, 22 nt, Escherichia coli CFT073
cuucauagauagccagcaacau

SEQ ID NO: 2671172 - RNA, 21 nt, Escherichia coli CFT073
cuucauagucucgcccacggu

SEQ ID NO: 2671173 - RNA, 16 nt, Escherichia coli CFT073
cuucauagugcgcggu

SEQ ID NO: 2671174 - RNA, 19 nt, Escherichia coli CFT073
cuucaucaucgcagauuuc

SEQ ID NO: 2671175 - RNA, 13 nt, Escherichia coli CFT073
cuucaucaucugc

SEQ ID NO: 2671176 - RNA, 14 nt, Escherichia coli CFT073
cuucaucccugaaa

SEQ ID NO: 2671177 - RNA, 15 nt, Escherichia coli CFT073
uucauuccagucaau

SEQ ID NO: 2671178 - RNA, 21 nt, Escherichia coli CFT073
uucauugaacgcaaaugguga

SEQ ID NO: 2671179 - RNA, 22 nt, Escherichia coli CFT073
uucauugccacgucaucuguaa

SEQ ID NO: 2671180 - RNA, 19 nt, Escherichia coli CFT073
uucauugcguaaccaaaua

SEQ ID NO: 2671181 - RNA, 13 nt, Escherichia coli CFT073
uucauuguccguc

SEQ ID NO: 2671182 - RNA, 17 nt, Escherichia coli CFT073
uucauuguguaucaggu

SEQ ID NO: 2671183 - RNA, 15 nt, Escherichia coli CFT073
uucauuguucuccca

SEQ ID NO: 2671184 - RNA, 21 nt, Escherichia coli CFT073
uucauuguucucccauaggau

SEQ ID NO: 2671185 - RNA, 15 nt, Escherichia coli CFT073
uucauuuaagccacu

SEQ ID NO: 2671186 - RNA, 22 nt, Escherichia coli CFT073
uucauuuaagccacuuccagca

SEQ ID NO: 2671187 - RNA, 16 nt, Escherichia coli CFT073
uucauuucacgcagcg

SEQ ID NO: 2671188 - RNA, 22 nt, Escherichia coli CFT073
uucauuucgcgaaacugacagg

SEQ ID NO: 2671189 - RNA, 12 nt, Escherichia coli CFT073
uucauuuggaug

SEQ ID NO: 2671190 - RNA, 20 nt, Escherichia coli CFT073
uuccaacgaguaagaggcua

SEQ ID NO: 2671191 - RNA, 15 nt, Escherichia coli CFT073
uuccacaauaccaau

SEQ ID NO: 2671192 - RNA, 17 nt, Escherichia coli CFT073
uuccacaccacuucauu

SEQ ID NO: 2671193 - RNA, 16 nt, Escherichia coli CFT073
uuccaccaucacgcca

SEQ ID NO: 2671194 - RNA, 21 nt, Escherichia coli CFT073
uuccaccccauagcggagcaa

SEQ ID NO: 2671195 - RNA, 14 nt, Escherichia coli CFT073
uuccaccguaucca

SEQ ID NO: 2671196 - RNA, 23 nt, Escherichia coli CFT073
uuccacgaaacgguguugagcaa

SEQ ID NO: 2671197 - RNA, 23 nt, Escherichia coli CFT073
uuccacgccguuuuuacccagca

SEQ ID NO: 2671198 - RNA, 22 nt, Escherichia coli CFT073
uuccacgcggguaaguacgcca

SEQ ID NO: 2671199 - RNA, 12 nt, Escherichia coli CFT073
uuccacgcuaua

SEQ ID NO: 2671200 - RNA, 18 nt, Escherichia coli CFT073
uuccacgcuauacagcag

SEQ ID NO: 2671201 - RNA, 16 nt, Escherichia coli CFT073
uuccacucugcccuuc

SEQ ID NO: 2671202 - RNA, 12 nt, Escherichia coli CFT073
uuccacuucauc

SEQ ID NO: 2671203 - RNA, 13 nt, Escherichia coli CFT073
uuccacuucauca

SEQ ID NO: 2671204 - RNA, 14 nt, Escherichia coli CFT073
uuccacuuccacca

SEQ ID NO: 2671205 - RNA, 17 nt, Escherichia coli CFT073
uuccacuuugcuuucag

SEQ ID NO: 2671206 - RNA, 12 nt, Escherichia coli CFT073
uuccacuuuguc

SEQ ID NO: 2671207 - RNA, 15 nt, Escherichia coli CFT073
uuccagaaacuggug

SEQ ID NO: 2671208 - RNA, 21 nt, Escherichia coli CFT073
uuccagaaccugaggcaauaa

SEQ ID NO: 2671209 - RNA, 19 nt, Escherichia coli CFT073
uuccagaagcgguuugccg

SEQ ID NO: 2671210 - RNA, 20 nt, Escherichia coli CFT073
uuccagaauauguucgcuua

SEQ ID NO: 2671211 - RNA, 19 nt, Escherichia coli CFT073
uuccagaaugccucaauca

SEQ ID NO: 2671212 - RNA, 22 nt, Escherichia coli CFT073
uuccagaaugccucaaucagcg

SEQ ID NO: 2671213 - RNA, 14 nt, Escherichia coli CFT073
uuccagaccaaaca

SEQ ID NO: 2671214 - RNA, 16 nt, Escherichia coli CFT073
uuccagaccuaaaaau

SEQ ID NO: 2671215 - RNA, 18 nt, Escherichia coli CFT073
uuccagacggaugacaaa

SEQ ID NO: 2671216 - RNA, 22 nt, Escherichia coli CFT073
uuccagacugaugugcuccauc

SEQ ID NO: 2671217 - RNA, 13 nt, Escherichia coli CFT073
uuccagauggaca

SEQ ID NO: 2671218 - RNA, 12 nt, Escherichia coli CFT073
uuccagcaaauc

SEQ ID NO: 2671219 - RNA, 16 nt, Escherichia coli CFT073
uuccagcagaccagca

SEQ ID NO: 2671220 - RNA, 22 nt, Escherichia coli CFT073
uuccagcagcuuaagcgaccag

SEQ ID NO: 2671221 - RNA, 19 nt, Escherichia coli CFT073
uuccagcauaaugacucuc

SEQ ID NO: 2671222 - RNA, 15 nt, Escherichia coli CFT073
uuccagcaucagcag

SEQ ID NO: 2671223 - RNA, 13 nt, Escherichia coli CFT073
uuccagcauuugu

SEQ ID NO: 2671224 - RNA, 15 nt, Escherichia coli CFT073
uuccagcggcaggcc

SEQ ID NO: 2671225 - RNA, 16 nt, Escherichia coli CFT073
uuccagcggcaggccg

SEQ ID NO: 2671226 - RNA, 12 nt, Escherichia coli CFT073
uuccagcggcau

SEQ ID NO: 2671227 - RNA, 18 nt, Escherichia coli CFT073
uuccagcgguaacuuauc

SEQ ID NO: 2671228 - RNA, 21 nt, Escherichia coli CFT073
uuccagcguagugaaggcaaa

SEQ ID NO: 2671229 - RNA, 13 nt, Escherichia coli CFT073
uuccagcgucgcg

SEQ ID NO: 2671230 - RNA, 22 nt, Escherichia coli CFT073
uuccagcguuaauuuccucuuc

SEQ ID NO: 2671231 - RNA, 12 nt, Escherichia coli CFT073
uuccagcucuua

SEQ ID NO: 2671232 - RNA, 21 nt, Escherichia coli CFT073
uuccagcucuucuacauuucu

SEQ ID NO: 2671233 - RNA, 23 nt, Escherichia coli CFT073
uuccagcucuucuacauuucugu

SEQ ID NO: 2671234 - RNA, 21 nt, Escherichia coli CFT073
uuccagcuguaccagcaacug

SEQ ID NO: 2671235 - RNA, 14 nt, Escherichia coli CFT073
uuccagcugugcca

SEQ ID NO: 2671236 - RNA, 12 nt, Escherichia coli CFT073
uuccagcuucag

SEQ ID NO: 2671237 - RNA, 21 nt, Escherichia coli CFT073
uuccagcuuccaggcaaucag

SEQ ID NO: 2671238 - RNA, 19 nt, Escherichia coli CFT073
uuccagcuucgcuaccuga

SEQ ID NO: 2671239 - RNA, 20 nt, Escherichia coli CFT073
uuccagcuucgcuaccugag

SEQ ID NO: 2671240 - RNA, 22 nt, Escherichia coli CFT073
uuccaggcuggcaggccucaug

SEQ ID NO: 2671241 - RNA, 16 nt, Escherichia coli CFT073
uuccaggucaauccca

SEQ ID NO: 2671242 - RNA, 19 nt, Escherichia coli CFT073
uuccaguaaguuauguauu

SEQ ID NO: 2671243 - RNA, 21 nt, Escherichia coli CFT073
uuccaguagcacaaucaaauc

SEQ ID NO: 2671244 - RNA, 20 nt, Escherichia coli CFT073
uuccagucacccugcccggc

SEQ ID NO: 2671245 - RNA, 23 nt, Escherichia coli CFT073
uuccaguuaccgccggcuucauc

SEQ ID NO: 2671246 - RNA, 18 nt, Escherichia coli CFT073
uuccaguuccauccacca

SEQ ID NO: 2671247 - RNA, 22 nt, Escherichia coli CFT073
uuccaguucgcuggcauugcca

SEQ ID NO: 2671248 - RNA, 21 nt, Escherichia coli CFT073
uuccaguucuuccgccagaca

SEQ ID NO: 2671249 - RNA, 20 nt, Escherichia coli CFT073
uuccaguuugcguucaauac

SEQ ID NO: 2671250 - RNA, 23 nt, Escherichia coli CFT073
uuccauaccggcugcaaacccug

SEQ ID NO: 2671251 - RNA, 18 nt, Escherichia coli CFT073
uuccauauguucccuuaa

SEQ ID NO: 2671252 - RNA, 22 nt, Escherichia coli CFT073
uuccauccggcaacaucaaauc

SEQ ID NO: 2671253 - RNA, 23 nt, Escherichia coli CFT073
uuccauccggcaacaucaaauca

SEQ ID NO: 2671254 - RNA, 12 nt, Escherichia coli CFT073
uuccaucgacca

SEQ ID NO: 2671255 - RNA, 13 nt, Escherichia coli CFT073
uuccaucgcaucu

SEQ ID NO: 2671256 - RNA, 18 nt, Escherichia coli CFT073
uuccaucgcgcuuagcaa

SEQ ID NO: 2671257 - RNA, 19 nt, Escherichia coli CFT073
uuccaucgcgcuuagcaaa

SEQ ID NO: 2671258 - RNA, 19 nt, Escherichia coli CFT073
uuccaucucgccauccuua

SEQ ID NO: 2671259 - RNA, 17 nt, Escherichia coli CFT073
uuccaucuuuccucacu

SEQ ID NO: 2671260 - RNA, 19 nt, Escherichia coli CFT073
uuccaugcuaugcgccacg

SEQ ID NO: 2671261 - RNA, 16 nt, Escherichia coli CFT073
uuccauucaaggacaa

SEQ ID NO: 2671262 - RNA, 21 nt, Escherichia coli CFT073
uuccauucuccgcucuucauc

SEQ ID NO: 2671263 - RNA, 15 nt, Escherichia coli CFT073
uuccauugcgcccau

SEQ ID NO: 2671264 - RNA, 16 nt, Escherichia coli CFT073
uuccauuucaucgcca

SEQ ID NO: 2671265 - RNA, 15 nt, Escherichia coli CFT073
uucccaaaucaaauc

SEQ ID NO: 2671266 - RNA, 17 nt, Escherichia coli CFT073
uucccaacaacagcgcg

SEQ ID NO: 2671267 - RNA, 16 nt, Escherichia coli CFT073
uucccaacugaaagaa

SEQ ID NO: 2671268 - RNA, 19 nt, Escherichia coli CFT073
uucccagcaggaucaauac

SEQ ID NO: 2671269 - RNA, 16 nt, Escherichia coli CFT073
uucccauucucggcgg

SEQ ID NO: 2671270 - RNA, 14 nt, Escherichia coli CFT073
uuccccaacacagg

SEQ ID NO: 2671271 - RNA, 14 nt, Escherichia coli CFT073
uuccccaacgaugg

SEQ ID NO: 2671272 - RNA, 22 nt, Escherichia coli CFT073
uuccccauucugcgcugacucu

SEQ ID NO: 2671273 - RNA, 12 nt, Escherichia coli CFT073
uucccccacagc

SEQ ID NO: 2671274 - RNA, 17 nt, Escherichia coli CFT073
uuccccccacaaucagc

SEQ ID NO: 2671275 - RNA, 19 nt, Escherichia coli CFT073
uuccccggcagcaucagua

SEQ ID NO: 2671276 - RNA, 15 nt, Escherichia coli CFT073
uuccccuaacucuuu

SEQ ID NO: 2671277 - RNA, 16 nt, Escherichia coli CFT073
uuccccugccaaccaa

SEQ ID NO: 2671278 - RNA, 14 nt, Escherichia coli CFT073
uuccccugguucaa

SEQ ID NO: 2671279 - RNA, 23 nt, Escherichia coli CFT073
uuccccuguaacgagaaguuuuu

SEQ ID NO: 2671280 - RNA, 11 nt, Escherichia coli CFT073
uucccgagcgg

SEQ ID NO: 2671281 - RNA, 21 nt, Escherichia coli CFT073
uucccgaggcauuccuuuacu

SEQ ID NO: 2671282 - RNA, 17 nt, Escherichia coli CFT073
uucccgauaagggagca

SEQ ID NO: 2671283 - RNA, 21 nt, Escherichia coli CFT073
uucccgauaagggagcaggcc

SEQ ID NO: 2671284 - RNA, 15 nt, Escherichia coli CFT073
uucccgcgccagcgc

SEQ ID NO: 2671285 - RNA, 23 nt, Escherichia coli CFT073
uucccgcgcuaccacuucccaac

SEQ ID NO: 2671286 - RNA, 23 nt, Escherichia coli CFT073
uucccggaacaaaugaaagcagc

SEQ ID NO: 2671287 - RNA, 20 nt, Escherichia coli CFT073
uucccggcaaucgccagauc

SEQ ID NO: 2671288 - RNA, 14 nt, Escherichia coli CFT073
uucccggccaaagc

SEQ ID NO: 2671289 - RNA, 14 nt, Escherichia coli CFT073
uucccggcuuugca

SEQ ID NO: 2671290 - RNA, 21 nt, Escherichia coli CFT073
uucccgggucgcgacugccag

SEQ ID NO: 2671291 - RNA, 22 nt, Escherichia coli CFT073
uucccggucaguagaauaaucu

SEQ ID NO: 2671292 - RNA, 13 nt, Escherichia coli CFT073
uucccgugcugcu

SEQ ID NO: 2671293 - RNA, 18 nt, Escherichia coli CFT073
uucccuacgccuaccacc

SEQ ID NO: 2671294 - RNA, 21 nt, Escherichia coli CFT073
uucccuacgcgauaaaaaacc

SEQ ID NO: 2671295 - RNA, 17 nt, Escherichia coli CFT073
uucccuacucucgcaug

SEQ ID NO: 2671296 - RNA, 22 nt, Escherichia coli CFT073
uucccuggcguucgguauuaau

SEQ ID NO: 2671297 - RNA, 16 nt, Escherichia coli CFT073
uucccuuguugugcca

SEQ ID NO: 2671298 - RNA, 11 nt, Escherichia coli CFT073
uucccuuucag

SEQ ID NO: 2671299 - RNA, 15 nt, Escherichia coli CFT073
uucccuuucagauau

SEQ ID NO: 2671300 - RNA, 22 nt, Escherichia coli CFT073
uuccgacugggccuuucgcuua

SEQ ID NO: 2671301 - RNA, 19 nt, Escherichia coli CFT073
uuccgagaugguuguaauc

SEQ ID NO: 2671302 - RNA, 23 nt, Escherichia coli CFT073
uuccgcaaacaggcgcagaacuu

SEQ ID NO: 2671303 - RNA, 18 nt, Escherichia coli CFT073
uuccgcaacgccgccaac

SEQ ID NO: 2671304 - RNA, 14 nt, Escherichia coli CFT073
uuccgcaauacagc

SEQ ID NO: 2671305 - RNA, 19 nt, Escherichia coli CFT073
uuccgcaauagucauuaaa

SEQ ID NO: 2671306 - RNA, 15 nt, Escherichia coli CFT073
uuccgcaauuccgcc

SEQ ID NO: 2671307 - RNA, 20 nt, Escherichia coli CFT073
uuccgcaccaacgcaaaaaa

SEQ ID NO: 2671308 - RNA, 14 nt, Escherichia coli CFT073
uuccgcacguuuuu

SEQ ID NO: 2671309 - RNA, 20 nt, Escherichia coli CFT073
uuccgccagacaauccagcg

SEQ ID NO: 2671310 - RNA, 12 nt, Escherichia coli CFT073
uuccgccagcgg

SEQ ID NO: 2671311 - RNA, 16 nt, Escherichia coli CFT073
uuccgccauuucuggc

SEQ ID NO: 2671312 - RNA, 20 nt, Escherichia coli CFT073
uuccgccgauggugcagcag

SEQ ID NO: 2671313 - RNA, 13 nt, Escherichia coli CFT073
uuccgccuccgcu

SEQ ID NO: 2671314 - RNA, 20 nt, Escherichia coli CFT073
uuccgcgucaaucugcccga

SEQ ID NO: 2671315 - RNA, 14 nt, Escherichia coli CFT073
uuccgcugauucaa

SEQ ID NO: 2671316 - RNA, 12 nt, Escherichia coli CFT073
uuccgcuuucaa

SEQ ID NO: 2671317 - RNA, 22 nt, Escherichia coli CFT073
uuccgcuuuuuucccaauaauu

SEQ ID NO: 2671318 - RNA, 20 nt, Escherichia coli CFT073
uuccggaguaaugaaaccga

SEQ ID NO: 2671319 - RNA, 12 nt, Escherichia coli CFT073
uuccggagucaa

SEQ ID NO: 2671320 - RNA, 15 nt, Escherichia coli CFT073
uuccggcaagcaaau

SEQ ID NO: 2671321 - RNA, 18 nt, Escherichia coli CFT073
uuccggcaaucaacagau

SEQ ID NO: 2671322 - RNA, 15 nt, Escherichia coli CFT073
uuccggcagaagcag

SEQ ID NO: 2671323 - RNA, 20 nt, Escherichia coli CFT073
uuccggcagcaaauucaccg

SEQ ID NO: 2671324 - RNA, 16 nt, Escherichia coli CFT073
uuccggcaucgccagc

SEQ ID NO: 2671325 - RNA, 20 nt, Escherichia coli CFT073
uuccggcgcuguuuggugca

SEQ ID NO: 2671326 - RNA, 17 nt, Escherichia coli CFT073
uuccggcggcacagcca

SEQ ID NO: 2671327 - RNA, 14 nt, Escherichia coli CFT073
uuccggcguggugc

SEQ ID NO: 2671328 - RNA, 19 nt, Escherichia coli CFT073
uuccggcucccgcagccac

SEQ ID NO: 2671329 - RNA, 18 nt, Escherichia coli CFT073
uuccgggagcaauuugua

SEQ ID NO: 2671330 - RNA, 19 nt, Escherichia coli CFT073
uuccgggcugccaucuuuu

SEQ ID NO: 2671331 - RNA, 15 nt, Escherichia coli CFT073
uuccgggcuguuuuc

SEQ ID NO: 2671332 - RNA, 20 nt, Escherichia coli CFT073
uuccgggguaaauuucuucc

SEQ ID NO: 2671333 - RNA, 13 nt, Escherichia coli CFT073
uuccggugcauca

SEQ ID NO: 2671334 - RNA, 15 nt, Escherichia coli CFT073
uuccguagcguuuuu

SEQ ID NO: 2671335 - RNA, 15 nt, Escherichia coli CFT073
uuccgucagcaaagu

SEQ ID NO: 2671336 - RNA, 14 nt, Escherichia coli CFT073
uuccgugguuugcg

SEQ ID NO: 2671337 - RNA, 21 nt, Escherichia coli CFT073
uuccgugguuugcgcauucag

SEQ ID NO: 2671338 - RNA, 17 nt, Escherichia coli CFT073
uuccuacaagaggucaa

SEQ ID NO: 2671339 - RNA, 23 nt, Escherichia coli CFT073
uuccucuacgacaaaauuuucgu

SEQ ID NO: 2671340 - RNA, 12 nt, Escherichia coli CFT073
uuccucugcccu

SEQ ID NO: 2671341 - RNA, 21 nt, Escherichia coli CFT073
uuccugaaucacaauccgcuc

SEQ ID NO: 2671342 - RNA, 16 nt, Escherichia coli CFT073
uuccugaaucgccgaa

SEQ ID NO: 2671343 - RNA, 19 nt, Escherichia coli CFT073
uuccugacgaucaagcgaa

SEQ ID NO: 2671344 - RNA, 19 nt, Escherichia coli CFT073
uuccugacuugccagccau

SEQ ID NO: 2671345 - RNA, 13 nt, Escherichia coli CFT073
uuccugagaggau

SEQ ID NO: 2671346 - RNA, 20 nt, Escherichia coli CFT073
uuccugauaaccuuccagcu

SEQ ID NO: 2671347 - RNA, 23 nt, Escherichia coli CFT073
uuccugauaaggaucuggauaaa

SEQ ID NO: 2671348 - RNA, 17 nt, Escherichia coli CFT073
uuccugaucaauaaucu

SEQ ID NO: 2671349 - RNA, 14 nt, Escherichia coli CFT073
uuccugaugaaaaa

SEQ ID NO: 2671350 - RNA, 22 nt, Escherichia coli CFT073
uuccugcaaacaguaacccagc

SEQ ID NO: 2671351 - RNA, 23 nt, Escherichia coli CFT073
uuccugcaaacaguaacccagca

SEQ ID NO: 2671352 - RNA, 15 nt, Escherichia coli CFT073
uuccugcacaaugcc

SEQ ID NO: 2671353 - RNA, 17 nt, Escherichia coli CFT073
uuccugcacaaugccuu

SEQ ID NO: 2671354 - RNA, 15 nt, Escherichia coli CFT073
uuccugcacacggau

SEQ ID NO: 2671355 - RNA, 22 nt, Escherichia coli CFT073
uuccugcagcgugauccacccu

SEQ ID NO: 2671356 - RNA, 14 nt, Escherichia coli CFT073
uuccugcaucgccu

SEQ ID NO: 2671357 - RNA, 16 nt, Escherichia coli CFT073
uuccugcgcuuccagu

SEQ ID NO: 2671358 - RNA, 18 nt, Escherichia coli CFT073
uuccugcgcuuucugcuu
